United States Patent 8,877,916 (PROMOTER, PROMOTER CONTROL ELEMENTS, AND COMBINATIONS, AND USES THEREOF) - sequence listing, part 22

SEQ ID NO: 36671 - DNA, 3000 bp, Unknown
  misc_feature (1)..( 3000): 2750-1469P.txt file - cDNA_ID_3099015; gDNA_ID_2936568; Annot_ID_194688
tgaaccgacaagcgaactctaagtaccgaaccggattctaattgtaccgactttattaggtggtaaatgtttcacttttagttttattggggttgtttcgttagataagattagatttgggtccagaatgtaaataattttgattttcgttgaggttatttcttcgtagagcgggttgttcgataacaagtcagtcattaataataactgtagcgagagtgagaagtgcttcccatgttcagagatcgattccagagatattaaaccacatgctttgataatataaacaagttttgactcattagcacagtgactttagggagcgacagcttttgttcctcttttattatatagttttctacacaaataaaaatattaaggtatgattttgcatgttagagacaaatccaaaatgcaaatcctctccgtatcggcttagttcatctactgcactgtggttctttattttaatcagtgtcaacttagtgtaattatttgatgatgaagagacagctttaccatgttggcctagattaagattaactactacatgttgatctccggtgaaaagatatttatatactcgtggatatgtaacttcaagcagctttgaaactgagggacataagattaacgaaacgaaaaacaagaaactgaaaggtaaaatgggggatggtcaaagcgtgaagaaagatgtcagtcatatgagctgcaattttttcgagtaaatgaagttttggctccaataattttatcttttttcaaatatatatagtacacatcacaaataaaagttgctggtcgttctcgaacactgtattttcaatcccatccgttggatgtttccttcgtcctcacctcaatttagtgaccacaataatataagtacatacacacatcacagaaaagaacaaggctacaagttcacgattttttatttttgggttttaatgtgacgctagaagttcttgtttatcaatcgttttgaatggttgcacgtatagaaggaacggattaacttccttgtgaattagacccttttgttttgggggcggataataatttataccattttttccaacagttcgtaattagtttatagcaggaaaaaaatgatttcgatgcaaccatataaaactattgtttgaagtatcagaaggttaatataaatttatgtcaaattttgttattagtaggtgacaaactaaactagcatataaaaagtctagtagtgtgaaatactcaacatgtagaaatgtcttttgaaagattttgtttcaaagttttaaccaatattgtaaacatagaaaaataatatatagttttaatacaggttcttaggaatcgtcttggactaagagaagttttggattaatgatactcctaagaagataatatagtatattcatttcacagaaatatattcatttacacaaagtacactacggtaagataatgaacctaaagaagtattacacaaagtatattagtgtatgcatgtatttgatgtattatttactaaagtgtttggatttaatttcaatatgccatataacaaaacagagtccgaaaacaaaaatctgcaatggtctttttgaccggtcttgaatttatggggacccatcgtcctcttgccaattatttggatttggaacgtacaacactacaacatataaaaacagtacagttaaacactgattactacatttttgtttttcaaccacatattaccacaatttcaagggatgttctcacgagtctccttcaattccaatggtgtaaaataattgaattggctaattctatgaattatgtatataattaaaacatttatgtatgtaagcctcaaaattcgacagaagtatggaaatgttttttctatatgtggtgtaactaaacctaattcatattggtcattggtcaatgtagcatccagtccggtggtaaaatttcggcttactcgaataagacattctagcagtacatatcgattttaaatcagatagctagacaaacatactcgcggattcatttgaatcctaagacaaatgtggaaaacaaatgctagaaaactttttgaacaataaataatttgtttttttttttacgaaacaaaagtaataataaggacagaaaagtaagagtaaggtggggaagatgaaggagagaacgtgatacatcccagtcttgtgccctctgatagattcgcaatctcttatttgatgctttcattcatatgtctctttgctctttttattacatatttgcgcatttatatatttattgtttatatcggagtaacgagccacgacaaatggcctaagtagaaaaggccgacaagaaaggagaaattagttagaaatagatactatgcctaatagataccgagtttagtacgtcaaaatggacattaacatgttagagttaggacaaagacaaataccataatccatagataatctaattatttagaaaaactataaacctaggtaagaaacgtctttttgtttctgctagctagacttattaacatgttacatgttcaatcatgcatgaaacctaaactataggattgttgtgagattaaagtgtacaatcgaacaatatgctaatcaatattttggcacttaataaggcatatatatatgtttgttttaggattcgttctctatatatatttagactttgatgtttctcgttattggagagagcatgaaagcgagagaaaagtacgtaagaactatgatgggaagtggacatcattttcgcgttgaatatgaaacactaataataatatgtggtttcaattcttgttcttttagtcgttttatgagattgggggaaattacgttatacattaataatgctcgtgacaacaccacccactctatatgaattgaaacaatgcaggtccttatcctaattgggcaacaattgttatatacaagtgtgagagtgatgataaagatccacagctaggatgctatgtaatatctaatg

SEQ ID NO: 36672 - DNA, 428 bp, Unknown
  misc_feature (1)..( 428): 2750-1469P.txt file - cDNA_ID_3099035; gDNA_ID_2936568; Annot_ID_143730
gatcttccaagtaagtttgttttactcactcttgcttttttctgttttttgcactccaaaccatgcaaacacaaatagaaaaaaaattaggtctaacttttatgagaaaaacaaaagtaaagtcgtgtatgcatgtttgtgaagtaaaattaacacataaattattgttataaactgatgatcaaacataatttttgtttgaagggtcgaggaatacagagaaggagagctacttcttttgtaagagaggaaggaaatacagaaacagcataagaccgaaccgagtgactggttccggtttctggaaagccacagggatagacaagcctgtctattccgatggatccaacaaagccgtgatcggtctaaagaagacactcgtttattacctaggaagcgccgggaaaggaaacaagacggattggatg

SEQ ID NO: 36673 - DNA, 1975 bp, Unknown
  misc_feature (1)..( 1975): 2750-1469P.txt file - cDNA_ID_3099074; gDNA_ID_2936569; Annot_ID_194726
cttcatctcaaagacgaaacaacttaaagaacacacaccggtttgtaagaagcaataacttgtccgattgccagtcataacaagactccagagccatatcctattgccgctgctttccagttcaacaagctttctttatttgtcggttttggttgttgtgtctgtggtgttcactctttaaactttttcatgtttttcttcaaactctgaatgcacatatccatttaacaaacgacgataaatattcactcttcaaagtttttcttgttttattctcacttcaattatgagataatattgttgaccaaaagaagttgttatgatctatttttcttctttcctacagggagaccgttaaatgtattcttgaacttgggcttcgtccacaaaaacatgccaaaagagaaatgatattgttgaatagtaaaagtcatacaactttcggtttcctttttctccttccctcttatcctcttgacagtatatctacgcaaaaaattgtgtgttattatacatatagaaagaacaaaagaaagaacgaaaaggaaaatggaatgtgctcaagtcccaaaggtcaaacaaagaagtgtgaaattgaaagcgaaaggtgaggcttctttcttgatacacttgttttgtttgtttggccaatgttcatcattcgccccttatcacaatcacacctccctcttcccaaacaaagccttctttcacctacttctctctttttgtttctaacaaatattgatttttttttcttgtaacaaatacttatgaacttgaagaaaaaagatctacttattttagggttatattttcagaagcttgaccatacacatgtttgaaacttgataagtaaaagaggagaaaatcaaaaggaatttgtttggagatagtatgatttatctttcaactggaaataatcattagattccatagattttgtatggaccacaatcccatcacacattccaaatccttctttgcccacaaaaaaaaaaaaaatggctggagaacaaacgatacacataacagatcatatcaaaaataaggatcacatcaacatatagacgcattattattatgttctatcaaacaccatttcaaagaaaaaagttatttgtatggcgaaagaattacaagtactacacatcgtgtaatttgtatgatgaagaaaagtaaaataaagtgcactaggaacaaaatttcacttggtgaatcattttgctggccattagagagatcatatcactcgaatgttttttccacattattaatcccatgccttaaaatccaccccccacactactaccctaggcctagggttgctaaaatgcgcacctagccagcgcacgatagctctgataatattaccaccgttgctaaaatgagccctgaattttcttcaacgcccccctttaaaaaggagatgtctttttagcaactctgcgtttctttctctctctctagtcacttgttgttcttactcaaagtgttcatctctctttcaccggtggatttctcgacaaagattctaactttgagagagatttttcggttgtagatgcagattcagagcgtatcatctctcgagaaaggatcaatgtctcatgaaataagctagactctgtttctgttttcttcttcttcgatctcaatttcttcttcttcgagctaggggttgtttatgtttgggaaaggaatgggcactaggcagtattcactgggagaagtagggccaccaataaatccgagagctggattgcgaagggaacaagctggtagaggttcatacagaggtagttagtagattcgtagctcatctgtaggcaaaaagggtttccttttaggtggcaagactgtttattttcagacacagagactgattaagaattcaagggagagttcttgtcgggggactattttaagttttaaaaaggggtgttttttagtggtgaaggggaaggtttagatg

SEQ ID NO: 36674 - DNA, 3000 bp, Unknown
  misc_feature (1)..( 3000): 2750-1469P.txt file - cDNA_ID_3099086; gDNA_ID_2936569; Annot_ID_194722
cgtgttccagttgctgcaaaggggccaggttatagggtcaggtccgaacggttgcacaaacatcccaggaggttctggcacttgtcgcccgtgagcggtcacgtgagtctgggtttacattctttaaattttttcaagcctaatgtaataaacacaatattgttttgtgtattggttctattttgacgcagttgtagcacatgtgaaagcaaatgtatgtattcattaacttggtaaatttgccaaaactagttgatgagattagctattcttttttgttttatgaactttaaacatgtaactttttggtttatattttttattttaagaatctttctgctaatttatgaatgcaagtccagattataatgccggtcaagatggcagtattaagagtttaagactgcagtttgtgaaattgtatattggtaaacaaaactaaaatctttcttaagttataattgtctgatcttacttttcttgaagaagctttttcaaaaagaaagtattctacgatcgcagaaatatgattgtgatcgtaaattaaagaaatttaatggttgtgatctatagtgtagacacaactaactctattttgtagagaaattctcttatagttcgagttttgattgggacatgacgtcgagtatcatataattaccaaatttcatgacatactatggtaattttgtggttattactggctaagtaaacaaatttcatgacacactcttttggagagaaattttctaatagttcgagttttgattggaacatgagtcacatgacgtcgattataattcattttatatgatacactcatacaccaagctatggtaattttgtggttattaattaaacaaatttcatgacacactcgtattaacccaggttaattatgataatataatggttattaattactgacgaaaaaacatatatgtgggtacaccatctttttttaatttgtcaaatttacattgcggtgtaaagtataaaaggttaatattgttttcggctatgatttctagtagaaacaaatttacatatatcacaataataaagaatccaagaatctctggttgcgtttcaagaagaagaatcaagtgcccggtcagtactcaaccatggcacctaggtgtaccacggggaatgttggtgcaaccatttggacctgacccgctgactggacccctttgcagtgcttggaacacgaaccggatctcatcggcagctgttgggaacggcctcattgcttcaacttgcttgacgtccaagaatacaacaaaaaaggcaactaacataacaaagatcattacttgtctcttcatcttcctcgatcgtactcttgcaatatcttcctcaaagaaaaaaataatctgacttgtttttctgtgtgtattggcacgtaaaattggttgtagagtgtaggcctttttttgtttgcatggggtttcattttaagtctatatatatatatatatatatatatatgtagagttattggtcaacacctcatggcttgactttgggatcatcctcactagcttgtatatgtatgtatatatatctttgactttgactttactacaaaaacaaatggctttcaaatatttgataaaacaagcgtaggaattgatcaaacgagtcactataacacggtttccactttgcgatcgcatttagacaaaggcctcttcgtgtcccgaacaaatagcacgtgtctccatctaatatacccaaaacaaagaaattgcataacccggtctagattggtttagtgcatgttcgattttatatatggaatttactctagctagtgtgacggctacgttcatcactagctaattgggacaggagtatagttagatttaatttgtgatatgcttacataattatgactctcatcctgtcacccattacaattttgcaatggatgatgataactagtttgctacaatctttttttgaaaaagtcatttttgcatgggtttgaaaattttgtatctcctatatatataagtggctctataacttgtatatatacaaggtatgttgggggtggctaataatggtttgacaagaattgaagaaactatcgaggcttgactttacttgggactaatgatgacatttgaacaatgaaactgatcaaacaagttactacacgtacgactcggtcggttctcggccgtacaccactaaaaggcagattataaccgcaaaagaccagatcagaattccggtttaagcttggttcatcagatagtctatgttattgtttactttccaatcagatagttttcttcttttaacattaaagaaaaaaaaaaatactcttctcctgtgtatttcaacatagggttgttaattgttatataattattgagatgtaattaaaattaattatactacaatgattgagaagtaaaagtcacgtttcgggtcaaaggcacaaaatactaataaactaaatgttacgaattatgaacagactagcaaattaagataatgcgaacgcgcctgcctacaccggatgtgtacttctgcgtgccgcgtacgtatatgtattaccgaattggaaagtcctaggaaaaatacacatgcatgtgtaaaatcctaaattgtatatttaaaagtcaaaacttgttttctaatttataatttttaaaaatacgtgaatgtgtgaactcataaactatattttcttacataaatttctaagaaaagattatatataggatgaatttataaactacactattaacctatttcaaatatcggtttatgtatttatctatcatacggtttacttaataatcattagaccacgcctccctgattatttggtttggtttggtttggtttcggtttagtagtagtgtgactgacttggtcacttgggtcagtttctgttgtcagttcacagagatttgtgtagaactctctctctctctataacaaaattggacagaattgggcaatcgagagagaaagatg

SEQ ID NO: 36675 - DNA, 3003 bp, Unknown
  misc_feature (1)..( 3003): 2750-1469P.txt file - cDNA_ID_3099093; gDNA_ID_2936569; Annot_ID_194720
tttatatggacataagaaatactaatgaaatagtatattttctgctatttaaagaaaagcaaaaatatactatttaattagtttttttttttgtcaatctagttagtaattcttattgtccaaaaagaaaaagaaaagcaaaaatatacttttttagattgtccaaagaataaaataatacaataaaattaaaactatcaattagaaaacattctattattttgctaatatgataactatataaaagatttctattaaaagtagaaggtagaacgatttatgaaatgggccatttttctgctgttgctagctatgatcatgttcaaagtacggagatatgggtatctatatttgtatatagagtattgataaatgagtagtgactatattctatgtacaatggtggaaatggtccattgattgatgttttaatttccttttctttatttatttttccttcgtatacatttttagacaccgaaaggaagaaaaaatggccatacacatggtgttcgcatttaaagaggttcgaacttacccactatccatgatccatctatcagccatgctcggcagaaatattttaggcattctgcattgatcatatcaagttaataaatacatttctaactctcttatcgtataagaaatttataaaaaaaataagcttgtatgattttctccatgaacctgatatgcatttgcactttgcagtatcttttcgacagcatgcgtttttgactgttctgttattcttaatttcttattactacgggacatgcatctgttttccatttctccatatgcctagcaaaaaaaaaacgaaataataattaaatagtagtacatttgttttttggttttaagaaatagtacaagctagagtaagtgcatgtaatatatatatatatatatgtatatgtatgtatgtatacataaacatattacatgcacttattaacgaagtcaatatcgagctccgtgtcaggtttatgcgtacatgcatgatgcatctatggtttccaataataataataatattactacaacaagttaatgaagtgttatgaggccaacgtcccaactgcaacaatttacagatataatgaaaagtggccctggagaaggaatgtattagctaagcctaagtagtcgttagttcgaacaatttgttcatacgtttcttattttggtttttgaatgttaatatttctttttgacatgaacgacttctcgtcaccattattacgttttaaaaattcaaaaaaattgcttaacaaattttctctaaattattacgcatcttataagccaacactttcacaattgtatattgtttacagaaaatatttgactttacatagtgacggttttttcgtctaacttctaccattcccaacgatttatgaatatcgctacaacgtaataaaaccgcgtcatggttaatttgttcctagtgacgaaatatcgctacaacgtaataattaaaaccgcgtcatagtttgttcctagtgagtaaaaatgtttcatttcttcctttttttttttttgagtttttaatttatttttcaaatgctttcttagttttggagattagatagttgctagataaagatagtaagatggcattcattaatttttaccaaattttaagtaaaactcgttcttcttctctgggatatatgcatgtgctttgcatatctttcttagtttgaagattagatgattgctaaaaatctcattaaccgattcttccttattaattcaagaaagatatattaatcaatatacatgttcttccatctcgtccttatttttggagattagatagttgctaagtgagaatacgtgaattaatatcttctaacttcaagaaagagtggttttcttctttgggatatttgcatgtgctttccatttcttccttatctttcaggatgaggtatcgatggttgctaagcaattacactaattaatttcattcgaactcatataagtttcgttcattaatttattagagatataggagtcctgatgttgcttggtccaccacatacacaatatagtattaagaaaaaaattattattgacataaaacaacatatagaaaaattcaaactttttctaacaagaagctaacaagatacatggttgagatatcttgattaaaaagatgattttctattacttctaatctccaaaaaataaaatatttagaaagtgaatctgttttgaaatggtaaattatattcattaattactttaacatgttatatcgaagacgaaatgagtgaactcgaagatgatttcttgaatatataaaagtaaacaaacaaatcgtgagaaagagtagaaatgaagggtctaaattttgttgatatccgttgctctaaaaatatttgtagtatagtcttgtattctctagattgtcaccaataagcctaattaacggtaacaaagaaaccgtacgtgttcatataacggcatatagaaggctattcaaaaacagaaatgacaaaatcaaagctataaatatggatgtacatatacattgaattagcatccataaaataaaaaatagtacaagattgaagaattgcatgaaatacgggtatgtatatcacaatactaaatcaaaatcgaggtctgtgtcagctttatgcttacatagttacatgcatctatctatggattccaacaatagaaatattttattattttcacaccaagttaatgaagtgataacgactacgtcccaactgcaacaatttacagataggataaaaaagaggtagcatgcattagagaataaattacggcgtccgttagtaagtcaattcactctattcaattttttaccctccatgctactataaattacaacgatactcactcacaaaacctaaaccactataacactctttatacaaacttcaaatccacaaagagtctttttttttttttctcttcgacttagcttatacatagttttattacaagatg

SEQ ID NO: 36676 - DNA, 3000 bp, Unknown
  misc_feature (1)..( 3000): 2750-1469P.txt file - cDNA_ID_3099107; gDNA_ID_2936569; Annot_ID_194716
tttttttgtcataataatcataaatttttgttaaatccaaactaataatattatttttattttgaattctattaataataattactagttggacttggaccttatttccagttggaagtttaattaattagatatgaactaaagcgttacgccacggaagaatttaggatctgttcgcagcatccgtttcaacgctaaatccaaacaacaaaagaagattagcaaaatcggattatcttctttgtttcttttcccttgacaagtcttcgtttttgaattagggtttttggacaattcttctcttcttcggctgcaaaaggtttattgtttgctccttgtcctgcgattgaattagtcttttgttatttgtatctctcaactttgattttttcctttttattattgtagctgattcctcttgaacctctgaaacttgttaatcgtttctgggttttgattgctctgttgataaaaaaaaacgtttttttttccgtttcttcttatgtgttgtagatgaatgtaaaattcaattatctgggctctgtctctgtgctttgtctattgaatggtatgcatgttatttcagataatctagggcttaggtttgtagaaaatctcagaatcgtgtatgctgaattttgatgtcattactcagaatttgagtcaatttactaactttattctagtttccggtgtagctatgacttgaaccggagttaccagctcctagtttttgtttctttgagcaatttttgtttcactcttttcttttaaaaagttcttgtggcatagtatgaatcctatgggaaattagatgaggaatagatagagcctcagacatacatggttctgttttctgatcacatgttttggtcttcttgatggcatattcttgtttgctatattcactaagtagaatccatgagattgttttccacactcagttttactcaaggatttaagctctgtgttgcaggttttcgcaagatatggctggctctgttggtgaggaaactgagccagaatggattaagagagtgaaattagagggagctgttccatgtcttaagccagacgacaactgcaaaaatggttggacgacgccatctcctgacacatttatggttagaggaccaaagtatttctctgacaaagttaagatacctgctggtgatttccttctaaagcctctgggttttgattggattaaaggtcctaaaaagctttctgagatcctgagttatccaagcagccgaatcaggaaagttatcgatgaggagtttcaaaaagatggaactaagccttttgtctgggcattcaatctccagcttcctcacaaagacaattacagtgctgtggcttactttgttaccacagagcctatccttgaaggctccctgatggatcggtttttgaaaggagatgatgggttcaagaaatcgaggcttaaactgattgcaaacattgtcaaaggcccttggattgttagaaaagctgttggagagcaagcgatctgtgtgattggacgtgcactctcttgcaaatatgtttcaggggaaaactttgtggagattgatgtcgatattggttcttcaatggtcgctagtgccattgttcatctcgcatttggctacgttactacattgacagttgatcttgcgttcctcattgagagtcagaccgaagcagagcttccagaaaagctactaggagctgtgagattctctgagctgcagaccgagtcagccacatctatcgaactgtcctcaagcaccagtaatgaccagtgggatcaaactacctcagagcggtcgagctggtggaaatcgattggaaatggattctctaatctgcttaatcaagatacggccaacatgaacaatacttctcatggggacatccagaaggatgaacatgtacagaagcagtaagtgttttgggagttattaacttcacaattctttgaatttgttcgatttcattaccaaaaaacagaaacaaaaacttgtcaattctttaaaaaaaccacagatgtatagattggtttttactaatatggatggatatgtgatatccaacaacaattcttgtgaccaaccatgcctaattttgtattggtgtcttttaggatcattctttttctcgaacgggctaagcattcatttctttgttagttaacatgccagtatatttttaatgattgcattaatcgtttttatgattgagaaaacgaaaaagtgaaagaagaagaaaaatctgatcgaatggtacatattaacataacatgtcgtcattccaaggaatcaattcacatgtcattttcaagattacgtgtagtcgtgtaatattctctgatttgagtaataccattacccaactctttctttctagatgaagcccatttttgtatacaaatctttcttgaaatcgtaaaagttcacgagacttgaaattcgagcatatcatataaaaggagcgtaaaagtctagtggtggtggaattattgaagttagtttattagtcaaaattaatgtgttttgactagattagtaaacaaaacacaaatctctactacgtgagaaaataacaagaatataaaatagcaaagtgtgaatataataaaaatatctaaaggtaggagagatgacgagaggaagaaggagagccacagaaaaagagtgggacccgcaagaccttgctgtaagaagcagagtgtttccttttgatacgcagaataatgaaaacaaagcaacaagcaagattcatcaaatccttatcttctctctttcactcacaaccaattgctcatcccacctacttgttccccacaaaacactctctccctctttgttctttcatcttctctaagctctttctctgaacctacgcttctgctaagctattctaagagaagccagactagcaataaacccttcattttaagcattctgtttccttcttgagaaacctagatattttggtttcttgtatccggtgatg

SEQ ID NO: 36677 - DNA, 3000 bp, Unknown
  misc_feature (1)..( 3000): 2750-1469P.txt file - cDNA_ID_3099134; gDNA_ID_2936569; Annot_ID_194710
aactcccacttgtgaagtttctcagatctcttcaaaattttcagaccccaacttacatttttagcaacaaaaacaaaaaaggaagaaaaaatagatgtttgttcgtgtttgtggtcgtgtggaggatcaagactatgagtgcctgattctctggactaggctgcaaccgttgaactgaaactcggactgaacacttttgattcatataactcgtactttttttataaacaaatgcatacgtactacttattcatgtatgtttgacctcactatttctgaataaacgttagttgagttcacacctcttttagttacaaggaacgaaggaagactgtttgttacacatttcacattaggtaaaatcccttccactttatggataggttatggattatttttagcggtccagtaaaaacagtttacaatcagaaaattggagcaacacacaaatctcgatccaaatccatacataaaaagtgattagataaagcgaagattcctggcaatatgcgcttgacaaaattagattatggtattgtcaagcggatacaacattagatccgtggaaaaaaatacaacattagatccaatttttttcggatacaaaaatctaattttgtcaaacggatattgccaaccatctttattttgtctaattgattcagtatttataaacgagattcctcctaatagagctacatcagttacaattagctagcctagttgccaatgatctcaattattggcacaggtggattctcattacattataaatcaaacgcatttataaaacacaaactaaaatattcactaggaaaacagaacaagaatgcagtaaactaggatcatttttcttttgtgtctttcattcctaagacaatataattaattaaatcaaggatcccaaaacacaaaaatgccagaaaaaaataaaaccatattaattagctacaaagaattaaaaccaccgcctttcatcatttgtctaaactctttgtagttaaccctaccatcaccatcaacatccactttctttatcatcttcttacaatcgtccaaggtcttaccttgtttgagccccaaggaagacaaaaccgccttcaattcatccaccgttataaacccatctccattctgatcaaacacattgaaagcttctttcatgtcctcttcttcttcgtcttcctcgtccattatcgtcttgtatagctcaccaaactcgtctatgtccacgcacccatcaccattcacgtcgatcttctcgatcatttgagtcaactccttgtccgggatgtaaatccctaggcttcgtagtgtctcgctcagctctttccccgtgatcgtcccgtccccgttcttgtcgaacatttggaacacgcgttttagctctgtcggatccatctcttttaaagttgtagtgttgcgtgtggaggaagaaaagataatggtgagggctccacgaggccgagaaaatcttttaccctttcctggcttcttggataagggcaggaattcaaaaatctaggaggaagttacaagagatgcaacaaagagacattcattagccaaaaataggaaggaagaaggagataaaaagatatgcctttggttgatattgttaatcggtagagatggacatgttgagggttttaaaaggatgcaactctatgagtttatggaattaattattttcttaaaatttgttatatatatagtgggaatttaattaatactttgttttcaccaaacaaaaaagtaagaattaagaaacagtagtactagggggaaagttgagtcaacattcaaataatatataatctgatagatttgtgtatccttttgaaggtagataacaaaattcttgtaaaataattacattcttgaatctgagcgaattaatatttagtataaacaactgcgacaaataccctggaatttacattcttgaattaacattagtatacgcaaaatatatgtttcgttttaaattattgttagcgtaattaattcccagttacaattaatcaagaacagttttagtgacgtttagctccaaacatttatcccagttaaataagacatattttgctgttaaaaaactagatagtaaatggtaggcaggtactccccacctcgaggatattggttgcacgtttagctccaaacatttatcagtttaaacaattgcattagctaaataacagtttattattgatcaaatcagaatttgatttaatatttgattcttaaaagaaaaacagctaaaaactctaatgaagtggtgaaccactattatgatttatggccaatgaaagtatcctaaaaagattttgttttataaaaactacaaagagatccaaaattgatacattacaatgagtcgcatcgctttcactaaatctctttatttaatacttacaaaaaaaaaaatatcttatttaatttcaactacatgttttttataatttacagggaaaggaaaaaaataaaattgcataaggttgaaaaataaaaaagtgcccacacgcaggatcgaactacggaccttcagtttacaagactgacgctctaccactgagctatacgggccattgataatggaatccaataacaaatatataaatctataaaagtcgtcatttatcctcctaacttacttcttcttccttatttcgtctccccccatagacgacgcctttgacacgagtttaacagttacttccagagacgacgcctttaacacgaattctctccagttcaggtaattctttgatctctatccttctattcatcaatgccccatcgatttcgctactatctcttcattcccatttctctgagaaaccctagattttcgccccgatttcttttttgtttttccagaaaattcgttgcatatatttaagacggaaattgtaactctgttgaatcaatttggggtttgttctatttgaacttaaattcgtttatcgttttctcttcttaatttggttagtgatg

SEQ ID NO: 36678 - DNA, 3000 bp, Unknown
  misc_feature (1)..( 3000): 2750-1469P.txt file - cDNA_ID_3099138; gDNA_ID_2936569; Annot_ID_194709
ggaatttacattcttgaattaacattagtatacgcaaaatatatgtttcgttttaaattattgttagcgtaattaattcccagttacaattaatcaagaacagttttagtgacgtttagctccaaacatttatcccagttaaataagacatattttgctgttaaaaaactagatagtaaatggtaggcaggtactccccacctcgaggatattggttgcacgtttagctccaaacatttatcagtttaaacaattgcattagctaaataacagtttattattgatcaaatcagaatttgatttaatatttgattcttaaaagaaaaacagctaaaaactctaatgaagtggtgaaccactattatgatttatggccaatgaaagtatcctaaaaagattttgttttataaaaactacaaagagatccaaaattgatacattacaatgagtcgcatcgctttcactaaatctctttatttaatacttacaaaaaaaaaaatatcttatttaatttcaactacatgttttttataatttacagggaaaggaaaaaaataaaattgcataaggttgaaaaataaaaaagtgcccacacgcaggatcgaactacggaccttcagtttacaagactgacgctctaccactgagctatacgggccattgataatggaatccaataacaaatatataaatctataaaagtcgtcatttatcctcctaacttacttcttcttccttatttcgtctccccccatagacgacgcctttgacacgagtttaacagttacttccagagacgacgcctttaacacgaattctctccagttcaggtaattctttgatctctatccttctattcatcaatgccccatcgatttcgctactatctcttcattcccatttctctgagaaaccctagattttcgccccgatttcttttttgtttttccagaaaattcgttgcatatatttaagacggaaattgtaactctgttgaatcaatttggggtttgttctatttgaacttaaattcgtttatcgttttctcttcttaatttggttagtgatggcgactccggaagaagtagcgtatgagaagttcctagagagagttcgtcgtactgtctacgtagacgaactcacgcctcttgccacagctcctgttatttcatctgctttcaatcagtttgggactgtcaagaaagtcagcttcatacctaactacttgggtccaaaggagcttcctatgggtgttcttgttgagatggagaatgaagagatgacacaggctgttatctctactgtctcacagttacctttcatggttgctggtatgccaaggcctgtgagagcttgtgctgctgagcctaatatgtttgttgataaaccgaagaagcctggtagaacggtccgttttcgctggattaagcctaacgatcctgatttcgacaaggccaggagagtcaagcggcttgctcgtaagcatagtgctgaaaattcgttcatgctcaaggtgcttatattttttgttttttgttttcgtttgtttgttgtctcttcctgtggtattggatctgattggcggtgatagtgttaatgaagacttgtgtgctattgtgtgaatgtgttttcttgtcttctgttgtcagaaacagcttgaggaggcagagaagctgtcgaaacagcaagctgagacggcggtaacacatcacaagaagtttgagatgatggataaactcctctacgatggtgttgctcagaaactggctggccgttacgacctgaaaggttttccttatcggtagagagagactgcatatggtattttgcttagaacttccttatgtcactagtttgtgcagtgtctattttggttgagctgactttgctgtaggcgctctgactttaactcgtaatgaagaatgttccacattctcatttatgtgaaacaagtagaagcgtgtaaatgagataatcaaagtccctgctttagtttaccttgacctctcctcttaatgcctaattctcaagcaaaacaagatttaagctttagagacacatattctgctctctctgatatttcagatttttggcgtttggttttctacattcccggttcttaagtcttgtgagtagtgtatgacatttgagatgagatagcttgatttctatgttggatcagacatttgaattgtattactattaaccaaactaaaaattgtgtaaagcgaatataataattttcggtttagtcatgaaccaccaaaccaattctgaagggaattaaaaaccaagaaaaattaagaaaagatcaaaagaacaattgtcaagaatcatagaggactagtcaatggatccattcagcagaaaacaaccttcaaaaattcggaccgtatatagcccgcatcacataagcactagtggatccattacaagatatttgaagggtatattggtaatttaaagaggaattcggactgacactttccgacattaatggcggaaagaagagagagagagagcttttttaataatgaaatggagagattaaataaaataatgataaaaagacgagagaagagcaatgccacctctgagcgggcaagcgggattagatttgccttcttctccccaagctgcctctctggcttttccccatcttcctggtaaaattctctccttcttcaatctctatctctctcttttttcctggttaattccaatttggatttgtaatttctctgaatttgattcctttatttcctttccgggatcgaaaattctaaatttccctttttttgttctgggttttcagggttctccggattgcgatcttggtaactagatattgaatttagggtgccaatcaaatcgcagctgctaggttttctttgattcctctgttgttgttgtcttcaattaggaattgttgctttcaaagatttagtcttaagatatagagatatttgcagggggggatattaggcggagaagaaaatg

SEQ ID NO: 36679 - DNA, 3000 bp, Unknown
  misc_feature (1)..( 3000): 2750-1469P.txt file - cDNA_ID_3099144; gDNA_ID_2936569; Annot_ID_194708
gctggagaaggttattgtggatgcatgtagtttatccatgagcttagatgcgtcttcagatctttttatcttgaacaagtgtcccataaggagagttgcagttctgttggttgactcagagaagaagagttgctatcttcaacacagttccatcacacaaggtgtctggtctctacttgagaaacccattgaaaaggagaaagccgctagggaaaatcagaaagaagagggcgtctttcaaaaagttgcatttgctgttgttaaggaggccacaggttatcttcaaagactgatcatttggtagtagcattctttctgtaagttattactaactgttttgaatcttttgcaggtgttaatcacaaggacattgtgatcttggagaggcatttggtatgctccttgagtgaagagaagacagcagtccgcttttacataatgaagtgcacttcacaagacaaattttctggagaaaatcctgtcgaagaagtgcttagttggtaagttgactttggtatgctctagctcaaatgactcccaaattttggcaagatggttattcagctgttatccttaaactcactttactttacattagttgcatgattggatcattctttactttttgtaagtacaaggaggtattgacatgatattcctaaccatcttcttttgcttttctctatgaaaatagtatgcagggtcctttatttgagaagagcttttccgactggactatgaattctatagtggaatactttcatgttcttccatatgccactctcatagaagattggttttccaggtttaattgcatcctttttttcttcctaaattgttattccttaacattactttgagtttgtttggtatcatttctagtttaggggtagcaatataagtttattgtgctttttcaggcgaggagataccgaatttgtgatagagaaagaaccagaagctgtatgtgatgatatcgaaagcaacaaagtagatgcaaccaaggagtcggaagtttccgacatttttgaaagacgagaaaaagctgctttaaaaaggagatatgaaattaaagtatgctctcataatgatacttgtattgtatggttgtgttaaggaaaatggtattacaaattaacttaagaatttaaattgcaggccaaaaaagttgccgctctactgagccatcctggagctagaggaaaagctacgacgaggttgcaaaatcggtacttaaaaggaagtatgagtggtgcgaaggaacctaatgttcactcggagacagtagttgcgttgaaggctaagaatgtaggtaatgaaatgagcccttgtaaggataactattcgaatggagagaaaggtggtttcgaggtgaaatctgaaatctacactaacaattatatattctcaattcaatcttcaagtatcctttatcacccttttgtaaatgcaggttgcgtctgacccaaaggaacttaaagaaagaggtctccagaggaagaaagctgttcctgacagacttaatagcattcataagcttaattcaactcctgcttctgctcataactctaatccaaatcttgaggagctacagacgtctcttctttctaaagcaacatcactatccgaaactgcattgaaagttcttctttgcaaacgagataaactggtaataactgtagaatttgatcaaagatacacaacacagcaaaaaaactgattggcaatagcatatatatccttattttatgattaagagctgctctctttttctctggctgcagactcgtcaacagaggaacatagaagacgagattgctaaatgtgataaatgcatccagaacatcaaaggtatgtatatatacatatacttttcctttctgcacagctttgtttttacatgaatcttagtgatctcgtgggtgttataggtgattgggagctgcaattagaaacagtactcgagtgctgtaacgagacatacccgaggcgtaaccttcaagaatctcttgacaagtcagcatgccaaagcaacaagaggctgaagctcagtgaaactcttccttctactaaaagtctgtgtcaggttagtttatggttactttaatcatttcttgttcaaagaattaagattcattgcccctatttattgcagagactcgatgatatctgtctcatgaataactgggtactaccaaactatcgtgtggctccatcagatggtaaagttttgagatcatttgccaaactcgtagttcagctccattactcccttcagatttgcatgttgatgttgatgctttgttcaaaaaggtggatatgaagctgaagtaagaatcacggggaatcatgtcgcatgtacaatacatggagaggaaaagtctgatgctgaggaagctagggaatctgcggcagcttgcttgctaacaaagttacaacacgacacagcagccaacttatcatgattatgtgagattcaagaacaactcagaaaccaaactaacttccagcatgagtagaaaacaaccctgattttgatatgtatggccattttggacgaatagcaagatttgtacaaaactccatcctctggttgagattttgagatatattacaagaagtcaaaggtattaactgatgcagaaactaaagtagaaccagaatcatgttaaaaacctaatcctaagcctcctgcatttaaaacaatcctagaaactcaaaaacccaacaaagtgctaaagagggatgaaagaaatcctagtaaaaaaaaaccctaatattgttaactagaccaaaaacctcaacaatggcctgaaagattagaccaatatgaatctcaacagacacaagaaacttgtcaacaacgaaaataggagctatactgtctcatggcaaaacagaggactccatcgcacctaaaggcccaaagacagatgtcgtcgcgagctttcagttcattagagggttattgggtttaagtggtctctgttgggcccaatg

SEQ ID NO: 36680 - DNA, 3003 bp, Unknown
  misc_feature (1)..( 3003): 2750-1469P.txt file - cDNA_ID_3099150; gDNA_ID_2936570; Annot_ID_194747
aaaaattgcaagttagtagtataagtttggttacctcgttgttacaaattcatatgtctaataccacctataatgttgatccctatggttcgaaaaacattgggaactttcatcatttgatcatgtagtacaatctcattgcctaggattctaatttataggacagtcattccgaaataaaaaaaattcttagtgggatatatatataaattaaaattaataaatgggaagtcaaagtaaaaataacaatggctgttaaattaacaatacaaagctaggttttcatcgagcgcaacaaaaataaagaaaatttgttgagaaaagacaaaagggagattaggcaactagtttaatcattgaagatccagtcatcaaagttaggggttcattgtttcagttctgccaaaaaatattattatttgtgaaaattgtaaatacagacaattatttattatagagtccacacaaaaaaaaaatccacggtccgttaattagtattttttattttatttttaataaacgatataattaaagcgtagttgttgctaattcgtaactcgaaacccataatgaaatgtgttgaattttattaatggttgcaaatttgcaatgtttcattatatatgtcgtgtatattaaatggtcggttgataacgatgcatttgttgcatctacgagaagtcaaaacctcagttgagtcgtgacttttggactgaactaaacataccactttacatcaatacttatttagttagacaaaactgtatagtcatgactcatgaatctgggttacgtcaattagttttgcatctgattttctcgttgattgtaatatatttattgagaccgatttttgtatacaagcaaggaagatttaacaatagctatccatgattttttttttcttgggggtcagatataccatttgaatgtagttcactattgacttttgacttaaaattttgtcgattttggtcttatcaaataccaaatgacgctatatactaattaacatcaaattgcgccgctaaatcacgcggttccatgtgatcaaagtccctggagtggatttgcttgtttggtctcactctcacgccaattaaaaggtgtctgtttaaccttttctcctttagtttatagactatgatatggtcaggaattacttaactataccacggatttataagaggtatctcaataaaagatctaatgaattttgaatcagatacaaatatatgatttttataattataaaacctttaaactatctcatggagtagtttggttggaaaacgaaatggatcctatccatccgttagttgataattattactcgtgacctaaaacttagactatatagggtttgctgtcaagcaagtattcattaaaaattgcacatttatataattactttgtttaaccgcatattcacagcacttgttaaagtttcaattatgaaactcagctatagtcttatactgttattatgttcacattaatctcatgaacggcaatatagagactgttggataaggtttgaaataacttaattctcatacaacagcacaatatataattgtttacgatccaatttagtgatttgcaaaataatgaaagaaaacatgtgaaagtaatagtaactgataactttccaaaatgatctaattatttcaaatctttgtaagattttatttcagccaaatagtatttttgtggtgtcttatctttgattaagccaaatgaagcaattgccgacaaaaataaaagatgctaaagacgtaattaaatattaaaatattaccgcacgagggaccttttgaaaaatcaacattccatcacataggtaaaattatgtcaaatgaccgtctagctaatcacaccatctgattaagcggcaacattttttaagtagttctaaatctaaccagtgttttgatttcggagtgatccggccggtcggacctttaaacatgcgacttgaatacgactaaactatagttcgtttggtaagcgatttttctttcacccactagaactaaacatgcaaaaacttcggcaaaaactagtgatccggtaaaatccacacaagggcggtctttaacacgccaaatcacaattttttttttatcctggtaacctctgattctttttttttttttctttctaattttgatgacgtgattgatatatttatttgataaatttgactctctaaaataatttaatttctgctaagacatacaagaactaataaaatcacacacatatatatatatatatatatagaacgtattatatgataaattttgattttcttggagaattctcatgctgattttttttaataactttaggaataattaattagtttcaaatcactctagaagacatttacttaatcatagcctctgatgataatagttccgaaacaagaaaacaaaacatacaatatatattatttattttatttttaattttataatagatatcaaaattggtgatatttattgtgatggggattcattgaaactggaagacaactgtagagaaagtgccccatagaagaagatcttcatagtactctccatctctttactctccttctctttctctctctctatctctctatttctctctctctctctctctcacccacagagaaaaccagcagtagtagcagtaaattgcttgagttcttgatgacagatcgacaatgtcttaaatgatgaagagaaaagaaggaaagcaataaaccttggcggcgtttgcagcagtttcttaaatttcctcaccatcattactctctcatctgctcccaaatctgctccttttaaataccaaacacatctccaagcctagctagaaattaatgtgatagagagcaaaagaaaaaggtgaacacaaatccccaaaaataattcatccacaaaccccaaaaaagtctcataaatcctctttctttctttttgtttgtgttttgtgttggggaagtagaaaaaaatg

SEQ ID NO: 36681 - DNA, 3000 bp, Unknown
  misc_feature (1)..( 3000): 2750-1469P.txt file - cDNA_ID_3099158; gDNA_ID_2936570; Annot_ID_194745
acaattttttaagtgaccacaacgaaattttctttaccggcgatatatatagactctagaaattagttgtctgattcaaccaaaaaattttccgaactaaaaaaatatatatataaaaaattttgagaatgatttcagttccggtggagccatattggctcccgtatgatgttaaacgacaataattggatgtagatttgttaaaattaacataagattgacgctaaggttcctcattcctaaccatcagtttgttagcttaaagaaaagtgataattacgctctttccgcctagaatggctttttgtcttgttgaatatataaaggaatgaagtgactcaaagcttcgtggtaaagttaagatatagaaactttattcgtatacactatgtaaatacacgcaatatctcaactaccctttaatagttgtgttatcaaataataaaatatataatatgagaaaatatgttaaacaccttccttttcggtcttaattaatgatcaattttgttaaaatcgttacaaaagggataagaaacaatcaccaacagagacaaaaataacattaccaacacatataatacaactctcattagtgaacactcatgtaaccaaaactgttaaccattagcgtatgattgagaacgatcctccctcataaaatatgtgaaagttatctaagggaatgttaagatatagtttttgttttattcaaacaccgttagttaaacttgaaagcatgcatgctaatgtttgggattcgatcctatgcgagagatcaatcttaagagaggttaaacttcacattcaataatgtaccgggaatggagacttcaagaatcatcggcttgatagaccactaataaaaaaatgacaaaaactagaacatccaaatatatgtcgttcgaaaatgtaattccgtagctagcttatacaattctatacacagaagatatttcgaatatagacacatataagatgttgcggtaatgcaattttaagtgtagttggacatggattggtgagaaaagtaaagtgaaaaaaagaaataattaaggaagagggggctatagctctgaaaccctagacgaaagcaacactgcattgccaatagtagaaacagtgcgatcacgagattcaactcattcctactttcttacttcttagtatccactccacttgtagtactagctagctccctgccacgtggtcctctcctcttcttttagctttatgggccttgtaaagcccgcgggccccatctgcccatcccatgcacatgcatcacattatgctttctctctatctacgaaattacgaatataagtatacgtatagaacactttttacaataaccaagggtcaaagttttctcgagtcggaggatatgaactaaatagtacattgtctaccagcgaagcttgaacatgagatcttgagacacatttcctttggaaggtactgaattgagtgttcatagcggttcaaggaactcgattaatttaaaatacctgaattaccatttttttggggattcgttgtgcttttttaatcaatctaccggaaatgaagacaagttttgctaaaaacgtaacacttgaatattgtaaatttgtaacataaaactctaaaaccttaacaaattaatacctctaattaaaatagaatactcataaaaatataaaatgtaaaagatacaaatattgaatatcttctaatataattctaagatgcgaaagatatagtagtcgaattaaagcaaccaatttcagcgtttccttaaacttatatttccaaaatatcatctaggacagtttgttttttttaagaatcgagaccctctactaaactcttgcattcaatttggtagaatcacgttttgtgtaggagagaagtagtgcttttggtttgtagtgtagagtagggtaaacgtgagtatataaaacgtagagaggcatatattatacagagagtgtgcttttaaagaacggaccggctgaagaaaaagataacgttgttgtctccgtaaaggttaccaagtatcactgtcacgtgaccaccaccattcctcttttcacatctttctcctttcgatattggttatattatagttaagttagcatttagttaaatttactatatattagtaagcaatgaaggggatattagtacaaatctggacatgaaatgtaggcctttatttgattgattgtcttggtataaacatttcatataatagctttgtagatttatacaaccaattaaataattaacactttacatatacagaataacataaaatgtttagatcatatattttgtcattttggatcaatagagaaaaacactcattgttattttcttatttatacttttctgtatcagtctatgtgtaaagtacaagtggacctgccgtgaatggcatagagcccacgctttacttgtaaaagtatattgggctttacggcccacggaccaatttatgttttgccattggttttttttttgtttgttttgttgggagttaaacccacacatcttcttcgcaactgttagttgtgtgtgttgttgttgttggcactgtgccactttctctctcgatgaaccctctcaagcaagcttcttcgatcttccgagcttagtttcgtttctaaatgtaagttttcaagtttttgtttcagtaagaagattgatagacctaattatttgttccccttctatatagtagagatttcacctagattggtccgtacatatcttatactgggattcgaatttggctgcctcagagtcagagattgattaattgatcaggtcaccggaaactttttgtctcgatttggatctcttatgcaaaatctgttgtgtcctaattctatttgattgtaaatcaatttgattctgggtttattacagattcagctgttgaaatcgtgcttattgctacaaattgagaggcactaaatcagtgaggtcgtaaagaagaaggcaaccacaatg

SEQ ID NO: 36682 - DNA, 2939 bp, Unknown
  misc_feature (1)..( 2939): 2750-1469P.txt file - cDNA_ID_3099170; gDNA_ID_2936570; Annot_ID_194742
gaattctatcaactattgattgataatggtgaatattgaataattttacttggtgttgttacgggcgagcgaagctaagaataaatagctagcgcatcacagccgtcggattgattctgagattagctattgtacaacgcagactacagtaagaccaaactggtaaacgtgtgaaaccaagccacgtgttttccttgctgtcaagctgctgtgtttgatttcgacaatagttggatgttgactttatttttcctctctattaatattaattctaaaagctgaattatattcacaaaaatttcgagataaaacaatcaaaaactgattgaaacaatttatgttttaattataaaatatttcctgaatttaatttgggtggtgagcaccattatttcaattaaatcacaagttgtttaatctaattaaaaaagtggataaaatgtgtaggtagacagtagacatattagatgatatacctaatgcaaatatttatgattattatgtaaagtcgaagctatttgatcatattttaattaagaaaatgacctcaataatcatattcgtttagactttactcttcacgtctcgttctttaaaacgagaaataatgtctgcttttataattgaaaataagtcgctatataggaaaaacaatatctgatttttataatgaaaataagtcgttatatcagttttgggttctcaatttttttcctaaattttaattaaaattgaaaagtcatatagttttttttttctctttacttttggtccgtggaattgctatttacagactgtagtgtacaaacttttgttcgctggcttgtctctaaaactatatgaatgcaattgtaagaagttaggaccatcggctgaatgaatttaataattatgtaaacattttcatgcatttttggttgttcgtagcatatgaccaaaactcagatttgtatttattatctatttttgggaggtaacaaaaacaagaaatgatcgtcctttttaatttccgttaagtttgagataaggtttaattaaacgagtggaaaacaaacgcttcaaattaatatcgtcggttgctccgtttcccatatttagtccatttagtcacttaccataatcatttttctacatattatttcgaaatttacttactacagtattaaaacactcaggtttcatcctaatcattctcgatgtaatactaatcatcattcatcagtcaaagtaattaaaagaaaaccagtcaaatttcttgatataaacaaaaaaaaacgcgaagaattatttgttaggagaacacatttaatgaacatttaatttatgtatattatcttccagcaaaatctcagtttaatgaagtgcattatcatcaacataaaccttctgtactaaatacaatctgtcccatttattttaatttatataaaaggaagattttattaaatactattccatgcttcatatagttgtagtggagtaaacagtatgatcacgatgtaaaaacagaaaagataatcataaaacagtcaaaaacgtttttttttcttttcaaaatgatcacatatacaatgtttgtatgaggtaagctaaatttatttctcttacaattacaaaatgttcagtaacaaatacgtctaagtataatactgtttatttaagtatcgcatgcaacggtaaatacaataaacgcttttcagaaatcaaagattgaaagtctcgaaaacgtcaatggcttaggtttattttgttcaggtcttctattaatagggattgtataaaaaggaagcacatgtgatacatgtcattgtttggctatcatcgtgataagaaattttaggaaaaagcctatctattcattccctttaacaaaaatagggctactgtgtatacggatttagtatttttatttgtttccgacttaaaaccagaattattactattaatcaacaggccaaatatctaaataatactatatagaattcaactaaattgaattattaaaagattattaaggagggtaaataaatagaaggagaataaaaaaaaaaaaaaaagaagagaaagtgaaggtaacgattagtttaaaggagagcctctgctacgttttaggctttgaagtgatacagaaggcattagatagatagatagattattttcaccatcaacatcaccatcaccgccactatcacaccataacccaccactcttcttcttcttcttcttcttctctctctttctctgtatctagaaacagagagtttttgattctctctgttttcaaatctgttccactaagctctcttgctttcgggaagattctgtttcactgctgcattttggatttttccggtgagtttttttctctctccatatatactctcctcctttcgattctacatttcttcggaattatgcttcgaaatcggagaactgtatatatcatgctctgttattagttcatttacaaaaaaaaaaaaaaaagaggaatcggcgtcggtgacttttggttttgtgatttgactgttgagaaaaaagcgtcggtgatttggttttcgaggtatttttttcttcgtctgccatttgtttggctttatatcctgaagttactgattctagtaatggcttttgtctccattttacttgatttttggaggtattcctttactagtttgattcctctcttcttttcatttacaagtgttcacagttcatcgaaatcagaaattttctagtcgattgcgatcgtcggtagtcttttgcctctgcatctctgattattttttactttctggcatttgctttctgatttgacttcaccacttcgtttcggaaagttcttaattatttttccgaaatcccaaaattgtatatatttggtttaatttttatgtttttgttttctgaaaatgttgaattgtttgttgattatgaagatg

SEQ ID NO: 36683 - DNA, 3003 bp, Unknown
  misc_feature (1)..( 3003): 2750-1469P.txt file - cDNA_ID_3099227; gDNA_ID_2936570; Annot_ID_194762
atgaaatttcaaatctaatattatgagttatgaccggaatatcaaagttatgacaatttttaaaaaaactaaaatttatatattcagaaaattaagagaagaaaattctctattcttaattacttgttgtgattacacaaaagaaaaaaaaaaacagaaaaagttaatgaatatcgcaatattttttcaaaataaacgtagtaattcacgaaacagcacctaaaaatattacgcaagtgatataccttttagtgcgtgggaatctttctcatttgagaaaccaacataaaaacagaaacctagtggtccacataagcttgtcagtttatcaaaactatcacaaatagacatgctaagttgctaacaagttgaattatcatccatatatttttaaggttccatgtcgtgaggcggagaaggaagacaggacaataacagctgatttagaaaacatggggaaaatatacatatcaaagacaagtcctaagagtgcacataaagcttatgctcttcaattccaaactgatttctgggtttttttgagatcgcgatctgaggagttggtcccgggaggccgaatggttttatcgttccttggtagaagatcactggatcccacaaccgaagagagttgctatcaatgggaactcctagctcaagctcttatgtccatggccaaagaggtatagtggtgtacatatgtttacatttatttataactaacatgtaagtctctttcggttataaatggctcatattctaaaaggatctgaccatgtcacgttacttgaccaattaagtcctagctagtaatgtggcccatgtgttcttttccaaatttcttgcggtttctcaaattacttaagttagtcaacaaagattttatcatatacaaatagatttgatatataccatatagaaattatttgtagtgccaaatactagctaaattcttactatatatttacgcaatcaattaagttttggagaaaaaaacgaatacttatgaaaaaacatatttattaattagttcccggttttttctcttgataaagaagcaaggtatggcagtaaaacattttaccctcctcataattacaaaatagttaataatgttttggtaatttaaactagtttcttgatttctgaaaaaaaaaatcttgatttctctatatttcaacataactatttagaactcaatatattgtagcctagattttcctctaaaaccattcatgattatttcaaacgattttctagataatatatatgatcaaaactaatgttaaatcttaggtttgatccaacaagatcgatagattattggatcaatagattaaaaaaaaaaaaaaaaaaacctagaagaaatcctcagtaagtcataactaaaaggtgccgcgtttatttttctccatcttaagggtatcatcgaggaagagaagatcgatgctttcaacgctccttactatgctgcgagctccgaagagttgaaaatggtgatagagaaagaagggtcattttcgatcgataggcttgagataagtccgattgattgggaaggtgggagtatcagtgaggagagttatgaccttgtaataaggtccaaacccgaagccctagctagtggccgaagagtgtctaataccataagagctgtggtcgagccgatgctagaacctactttcggtgaaaatgtgatggacgagctttttgaaaggtatgcaaagatcgtgggagagtacttctatgtaagctcgccacgatacgctattgttattctttcgctcgttagagccggttgatcgtgttataacatatgccaatatacatgtctttgggcctacaatgacatgatttggtagttttctaatcaagcatatgtaatataatttgcttcgagaataaaataataaaataaagtctgatgttacggtagacccttttttttttttttttttcatttacggtagacctatagtattaaaacaaatagaatcagctggttcggaccttgaaatgagagagcttggatgcatgtagacgcattagtcgtgaattattcaaatagaactaccttttgggcaatcacaatttgttcttctttttgcttttcctttataagatgcaacattaaggcggaatgtgacgtgagaatgttaaaagtgatcatcactttaacttgccacttaggagttgtgccgcaacaagtggaaaacaagttaatcatggccactcgtgagtcgtgagaatgtagggcaataccgcaacagcttctcttcaccgttcacgtgtctcccaaattataatttttctatttttgtatttctgttgttccttttgtttcaactttcagcgcatggcgtcacctcccatgaccaagacatttcttaagaagcgagaaaattccataaccaaaacatttatttatagccgttcaaatattttccacatgctcatgatttatttttaatctgccaagaatcgtgattagttgcacaatacgtcaatactgttgcctctgtattctgtaactcactaacactagtctcgagatgatatttttgtatcactcaactaatataaatatcaagaaaataattacagtagtttgatataccgataatttttcatgtatcaagaaaatgtgtttttttttttgttaaattatatcaagaaaatgttatacaccaaagtttacatacgttaaccttgaaaaaaaaaacagaaaagtgattaaaaacaaataaaaacttagaagacgttatattagtctcttggtttaatataccttctttgtatagccagcctcgattgatttatctgtaagaaaatatatatacacacacgcatattcaacagattttagtctaaagaaacatcatgaggagcaaaaaaagatcaacggcccactcactcgttacagaaaatatctctctatatttatagattacaagctcgaacaaagattgcatactaaaatttagaactaaattaaaccaaatg

SEQ ID NO: 36684 - DNA, 3003 bp, Unknown
  misc_feature (1)..( 3003): 2750-1469P.txt file - cDNA_ID_3099233; gDNA_ID_2936570; Annot_ID_194761
tcaaacagggtagacaaacactagctggaccttgagtcttttctttctccatcatctatatttaaaggttaattttatgtcacattcaaatatttagaagtacttcaatatttttaacataaatcaatccagacatgatcatattcactaagtagtaagtgaatcatgtgactggagatgtattaggtatcatactttaataaaatttgggtatctacctttctctaaaacaacattgtgtctctagtaaagtacacataacaaaagcgtgaaattttaccaccgaaagtaaaatagatgatggagaaacattgcttgaatggattttactatgattttagataatggatattttattttaccttttagacttattaaactataatatatatgattcactgtaagtctgtaagttaaaacattgcttgaatggaatttagcagatataaggtatgaaagattttgtaagacgtgaaaacaaaaaatacataaatatatcaaaatgaagtctgtatacatatatacatagacaataatccaacatatataaggagaaacgaggctcatcgtcagaacgtgaagcagaatgttcacgtgatattactacttcatttggcaatctattcgcgtccgaaaattacttggcagcaacggccacgtggttcacgacaattccttggttatttttacatattattagtatactcctgaaaatgaaaatgcattgcctatctagagtcaaattaaggagtgcatggcttagtatcttcatttgtttgcaaaaaaaaaaaaaagttttaaaagttgatagattgaactataccaaaaccataagccgtatctattgcggaatagaaaacataaacgtgacaaaataatgtcttctcatattcttcggatatagttcgaatataatttgaaatcaaatgttccacgaaccatatgccgtggtccaaacgtgaaagttttcctttttaaaataataaacacggatctttattcggtctatattctttagattaagactttatatcatatgccttaatctcgtatatttctactattgagtcgggcctctgtcttgtgtttatcacgcggattctttcaaaagtcggtcaggaactcttatgtgttgacattattaaaccctacaattaattattataaaaaatcgattaatttataatatttaaaatttgatatacagtatagagatacatttacatacgtgaagatattcaaagtatttttttcataacatattattcatgtaatatttaaaatgataaatgtcaatggcataaaatctaactgtgtacatattaaatgatttttgttttatttatgttgggaccatattgctgctcagaaaattgaaacgtacaagagacctaatctgatattcttgcctaccttaaaaacttgagaagacaaacccaattagagagctagaacctaacatttacaatataaacgtttaaaatatcagcacgtagtcgattacgacaaatcctttgacacatcagttagattcaagtacttgtatattatggtttgtctattacgattagtcgaaaattcagaaatttgttttagatatttttttcttaattatgttactgaaaaatatgtgtttatatataagaagccttgtattaatatattacaacgatcttaaaacagaagctgaatgtcaactagtactttattagcgctgataaattgagtgttaactacctaaatagatgttgacagtcaattaaaacgaatccttcatcggttcgaatcaatcaagaagtttagttataattgtataaatgcctgcagttcgaaattccaaaattcgttttgaattttttcttaataagtttttcttactaaaaaaggccagagcttgaattatatataacaagccttttataagtgtcaaccgtcaaaaatgattctgaaatggatacattgtcgttgtaatcacaaaataatatccaagtctttaaattgtgtagacctaacgagagaaaaaaaaaagtttacatatccaagaaatgatacatagaacatttttgttaacattatgctttgttgaaagacacatatttttggtatatattcacatgaaaatatatattattaaaaaaagggctcatttaattcagtttttccttatcaacaatttccattgttttaccatcgaccgctagatgagacttaatcttcttataatatgtattttttgataatatattatcggttagtactgataagactaagaacaaattctaagtggacagatacccatttccatgagccttgccattgcttcttgttttccggactaaaatgttgtacaactattttctgctgtagaattaattttgcaacttttatgattgaaatctaggattgtatatctaaactacttcatggaatccgcggaaatcatatgaaatcagcagtggttaataagaatttatcttcgtactcgacttacatgatattaactattggacatatatataatggtacctaatttttaatttttgttttttctttttcacagaattcttgcctgataaatttcatcaaaccaaagactattcccggtttttgaaaatgagttactttatgacttttgcgcgcggattaaaactcaaagtcactagagtttactcaattttctaaaatccaggttgaactaattaactgcgtgtggataccgattaacttacttgttaatataaaaaaaaattcgtaaaagggaccatcgtatgtttatatgtgtgtgtggagagagagatgcacccaacgcacgtccataagatgcatgtagtttataccaattaaaaaccaaaaaataaaaagattcatgtggctgtcaaaactctaatcgtttacaacacctctttccttatatatatcgacccaacatcacttactatattcattaaccttctgcttcatcaaaaagaaagagacacaaagagcgagagagggagagagatg

SEQ ID NO: 36685 - DNA, 3003 bp, Unknown
  misc_feature (1)..( 3003): 2750-1469P.txt file - cDNA_ID_3099238; gDNA_ID_2936570; Annot_ID_194760
ttctatcataggtgattgtagagattcatcagattttatgtgattacgtggtcaatttagctactaggtgatataatataaactatagttttcacttgttttgatcaacatgttttgtttttttcccgacctttttagctattgtatttgtgtggtgatcagttatttctcttgcaagtaaagtagttttgtgattttgtgaaccgagttagggttaagagatggggtgatgttggatactaaaagttttaattttgacacttgaatgtttctgggttctgcatcaaaagagtgaagatgaggtcgcttcaagcaccggttgtttgccctagtgttcgtcccagacaattgggtgtctctgctttacttgtcaactgctctgtttcgaaaactaggagtctcagaaaacaattctggggtaaccagaccaaaaatgacaagtctcaggctgctacagtgaatcttcgtctgcatcttcggaggtataagagtatcaaatgtcttttcagctcgcactctgatggtaccggaagcacagcagagaatttcaacgagaacgatgaggattatgtcaagtctagtgtattggaagctggtaatcctggttaaatctgtatttataccattagttctctctattcttcttgtgttttgattctaatcatcgatgttctcttgttggttttgtatataagttgaggtaaaaagtggaccagatggtttcatggtgaagatgaaggatgggaggcaacttcgatgtgtccacaataatcctcaaggagggaatcttccaaattatgctccacattctgcaattgtgctgaaaatggaagatggaactggtcttcttctccccattatcgtctgtatgtgatatcaaaactcattcttttgtttatgtgtgttgagatttccaatttgccttgtgttttgaatctcctttctttgttttttgtttattgcagtggagatgcctagtgtgttacttatggcagcaatgacaaatgttcaaatagtagggcttctgttattctttgcgttatgcttctgtttgaatcagtcaagagttgtgaagagagggtttatggattttttttggttactgcttgtaggcaaggcccactatgtatcaagtggtgaaggacatggtagacaaaatgggttatgaggtacgcctttcggtttttctgttttctctatcctgttattttccctttagcaatacaaattcttatgtgagtaacgttaccaaacaccaactttttctgcaggttaggcttgttagagttaccacaagagttcacgaggcatatttcgcagagttatacctttcaaaggtttgtaacttctggcatagaaatgcatcttccattcattttttcaaaaagttgtcccgaaactcgttatccattactagtatctcacttccatctgttttaaacttttactaaatctgctatgaatggaattgcaggtgggggataagtcggattgtgtcagcttcgatcttcgtccttctgatgcaattaatatagctgttagatgcaaggtatagttatattaccatatgctcaattctttcttttctaggggcacagtcacacagaggcctctccatgagatcatcttaaccggatacaaactacgtgatcactatgaaaaatggttttaatcctcactctttaggtacctattcaagtcaacaagtatctagcttatagtgatggaatgagagtcatcgattccggaaagctatcaaagcaaacacctgcttctgatggtttattgtttactgaactagaccggtaacgcttgtgaatttagtcatctgaaaccctttgctggcgaatttgaaaattacaaaacttaaaaacattatgttttccttgtgtaggccaaatggtcagccttgttttgatacaaaagagttcgatctagtaaggaacatgatgcaagctgttgatgaagaacggtatgatgaagccggtaagcttagtctctctcaccctccctatttggtagtgatcttggtcctgatcaactactagaattttcttaggttcttgtgtcaagaagaaccaatgttgaatatcttgtttggttttgcttttgtagctgagtggagagacaagcttggcaagtttcaggcaaaacgcaaattaaggaaatacacatgacaggtataatttcttttaacggctcatccaatccaatggactatacacaaaaacaaaatgagtaagttttgctctgttttttcttaatgcagctcgcagacgggagtgtttttaatacataatttatgtaaataataaagaagccattgccatttgccagaagttgtgatcatgaagaaaaatatctctctcgtatgagatatacttttctctatcgacacttgtgcacgtagttgattctcaaggaacggacaaaataaaaatgttattttataattgtagcgtgatggtgatgtgatgtgtacatatacattaatcttctgtaataatatatggtaagcctacgctttctcaattacatttgtctatagttactgtcacttgtccttaccacattatataaacaaactacataattcattagaaagtcatagaagaaaataaaataaaaactcctctaattgtctctgaactagaaaaaccgaattaacgtgtgacgtaataactggaagcgagttcccgccaagagcgttcacatgataactaaccgccacgtgtcttgatggcaataataagtaaccaaaaaaaacgaagaggcagacgaaaaaaaaaaagtcgaatcttcaacatttatggctctgattttccggccgccgtgaaaattagtagccaacatttatttcacattcgcataacgaaacgaatcaataaatcgctcacagttacttcttcatatacccctttccttcaatttcagtttcagattttccaaattctaaagtttcgatttttttggagtatcaagttcgattgattcttctcaatg

SEQ ID NO: 36686 - DNA, 3003 bp, Unknown
  misc_feature (1)..( 3003): 2750-1469P.txt file - cDNA_ID_3099243; gDNA_ID_2936570; Annot_ID_194759
catcgttttcgggaaacgaattaaattgtactccgaaaatgataaatgcatggagtaattgtataccaactaacttgtaataatttgaatcaacacatgctcttttgtttacgcagcccatgcatttatcgttttcgaaagtatttaattcattttgttataactacgatgagaagccgagagaaccacagaattataatgaatcggataagaaaaatcaacattctccccctataaatacaaaacaactagctaaagttcgaaggattcatacataaatcttcaacacaactctttaattatctagtttaatacaaatggcggcgatagaggacagtccaacgttttcctctgtggtaactccggcggcttttgagataggcagcctcccgacaaccgagataccggtggatccggtggaaaatgattcaacagcaccgccaaaaccggtgagaatcacctgtccaacagtcgccggaacttatcccgtcgttttattcttccatggcttttatcttcgcaactacttctactctgacgttcttaaccacatcgcttcgcatggttacattcttgtagccccacaggtacataatttaactatacaaaaaataattatgaatcatttaaaaggataacttacggtatgtaacatgtaacatgtaaaacaaaatgtacattaattgagattgattgttacgtgaaaagatataagttaattttatattcttgaatgacagttgtgcaaattattgccgccgggagggcaagtggaagtggacgatgctggaagtgtgataaactgggcatcggaaaacctcaaagctcacctaccaacttcggtaaatgctaatggaaaatacacctcactcgtgggccacagccgcggtgggaaaacggcgtttgcggttgcgctaggccatgccgcaacattagacccatccatcacgttttcagctctaataggaattgatccagtcgcaggaactaacaaatacattagaaccgatccgcatatcttaacgtataaaccggaatctttcgagctggacataccggttgcagtggtgggaaccggactcggaccgaagtggaacaacgtgatgccaccatgcgcaccaacggacttaaaccatgaggagttttacaaagagtgtaaggcgacgaaagcccatttcgtggctgcggattacggacatatggatatgttggacgatgatttgcccggttttgttgggtttatggccggttgtatgtgtaagaatgggcaaagaaaaaagtctgagatgaggagctttgtaggtggaattgtggttgcgtttctcaagtatagtttgtggggtgaaaaagcggagattcgattgattgtgaaggatccttccgtttctccggccaagcttgatccttcacctgagttggaagaagcttctggtatcttcgtctagatttgtgttatgtactattatcagaggggtcttgaatatttgaaaaacctatcaatgttttctagctccaagctagctattgttcatgtcctaagttgcatgtgtatttttattaaactcgatcaaaacatttgttatagttttaccccaaaactttacagcttcttcttatactaaaacctaaacacatttaaatagctatataattctctatataattcttatataatgaaatgtgaccaagcttttcaacttcgttgcaatgattcatgtaatttggtttaactccgtcacaaactctatatctttgtaacatacccttattcaaactttcttgttgtattctaaagttaatggtatttgtaacatatcgcaatttcgatcttattttcgtaaggagaaaggaaaaatttgctcctgcactacaacatttaatgagagctccaaactctacaaacaagtcaacaatgacaaattaatttgggcctgcactacgacaacgatacagcaaaatggagacaaaaccacatttaaggttttattgtaggcaaatggtcctaagattgtctgtatacgaaaggtgcgtcgtgagtctcgtgactcttgtgtatgtggtggttattttactctcgagttccacgtgtgtttgttataattgttagtatatacgaaagattgttagttataaccaccagctgacctgctgaagaaaggaattgagatgagccgaaaaggatcgagtcataaagcttggaccggtagatatttaaatgggcctaggcccatattggtcatttactttcaaagtagataaaacagtttcccacacatcccactaaagtcacatccaaacattacaaaaagaaaaaaagaaaaaaaccaccttatccataaccatccctgacacaggcgccgtacacgtggcgtccattaggcttaatttaatcggtgactgttacttgatgacttgtcagttttccacgagttaacggttcacgtcatcacggctagacactgaattctcatttttatcccttcaccacgaccattaatcaaatgcaagatattggtgaaagggtatattcgtcattgaaacaaacatgagtcgataaaattgacagagtcacagattctattttttcctctctctctgctctttgttgatctgtctgtgtgggattcttcctttagttcctctgttgatctatccaatcgaatcttacgaaaattttcggtaaagtttcactctttcttgtatttctatcataggtgattgtagagattcatcagattttatgtgattacgtggtcaatttagctactaggtgatataatataaactatagttttcacttgttttgatcaacatgttttgtttttttcccgacctttttagctattgtatttgtgtggtgatcagttatttctcttgcaagtaaagtagttttgtgattttgtgaaccgagttagggttaagagatggggtgatgttggatactaaaagttttaattttgacacttgaatgtttctgggttctgcatcaaaagagtgaagatg

SEQ ID NO: 36687 - DNA, 3003 bp, Unknown
  misc_feature (1)..( 3003): 2750-1469P.txt file - cDNA_ID_3099249; gDNA_ID_2936570; Annot_ID_194758
cacaccacaggactaaattccgctgatctgaatctttcctgtggagaattagggactctttagtaaagatagatttttagtttatccttttttgtttcttctgcattctacaaaatgacaagtttgtttcattggtacacatattttccccatgtgacatttaaacatggaataaaagtaaaaagggatacaaaatgtttaagggagcttttctctaatccaaagccagtcctattttatgtcatgttgcctgattaaggccctgaaatgcggaaaaagaagtgttagcagttgagaaacttaactttgtttagatggaaagtgaacatattgagtctcgtatggatattttacctcaacgcttgaaaaagaatgacttaatcttttattactatgtctggaccaaaagctcttcttcgaggtagaatccctggctttactccacttggtgctgacggaaccgaagtgccatttcataaaagacttagacgtggagcctttggtattcgaactaggatccatcttcagaccttttccttctcgtttccctagattctggaacataagatcctcacattcactgcggacataactatctaccacacggttcttacaccttttgtaactcgttgccttcaattctgcctcggcttttagagctttcctcgataatttagtaacctgtgtctctgtgcatatgggacacgtaggatcatacttctctgtttcatttgtcattgtctctaagcatgccgcatggtaaacatggccgcacgctagaacagcaggaattggaaggtcaaacctggcaactggagacctttcagttaaaagctttgagcaacgcccacaagtctgctgatcaacagaaggggagcatgagaatctgctactactacacccacttagtcttcgtcgtccggaacctaagtgctcattatcaaaagaccatctctccctttgagactgagccacgagctcacaaaaggcgtttatggaccagccaccttcagaagaagcaaaatgggacccagtggcagtgtcattactacaggtcgaaagcacaaaggacgaccttccttcagatgttgagtaattattgggagatttcaatcccaaagtttgactatcagaaacctgcctaaacaactgctgcccaggtgaacctcgagcacgtctagacggagttgatctgggaggaagtgaatgtgtgtgagctgaaggaagatcagagaccgaggtggaacttgacggatttggtaaaactgatgaaacaatatctgatgagtcaactatattcttcacctgaagaattaaaagacgagagggttaagagactctgaagggacgaaaagagactctgattggagtaagtaatgatctcacctcaacacgaacaggacttgccaaggatacatctgcccagagaaaatagatgcatgagagacaggaaaaaaatccttcattacagtaagaaaataaagctgaaatgatctctaccaaaaaatgaaatgtctctcgatctaatcctaccaaataaatgttgttacccctttgactggattgagtagactggaaaagaacatccacgaaggaactaaaatcgactcaacagtatattcccaaacaatgaaactgaaagttctacactttccccacaaaaaaagtgtttgaacgaacatacctgaaggagatcgaatcgccaaacttgtacccgctaaaggagctgtaaccatcgaagctgtgcccatctctgagtctgcggatttctgagagccaagagtagctaaacccccagtttcagatgacggaggtcctctctctaagcctaacgacaacttatcgatgtcaatacctctactcccaacattatgattagatgaatctttaatctcatcagctacacgcctcctgttgtcccgtcgaaaactccacgatggtgaacacactgaattatcaatagctccactgggaacatttctgtcctttgcagccacacagcaaacagaccccataatccttaaaagagagctgtaatgaatatgtcttacacaatctccattggtggtgcttcctaatctaccactgaagaacttatcacagtagcaaaccacaattctgcatataaacaaacagaatgtgaacttcgaatcagagccattataatacatagaggtgaaggcagagacctcaaaatctaacgcagaaatcatcaatggaacggaattaaagtaaatacaatagatgattctaaaatccgggggttcaccagggactcaccagagcaactagggttccgcaggattgaaacgaggtatatgaagatgcggcggaattcgaatccaacggctgagagagatttcaattactcgacggagatggccgccgatctgagagagagagagacggaggttgggtgcgtcgcagggaaattgtgccacgtcacccttcctctcttctttttctgttctctgtttttcttgtgctactatttgtttttggtcaaattttacttttttggtcaatttgtttcttttttttttacataacaattttttttttttttttactgaacaaacataacaaaatgttttttttaacaaacataacaatatgtttcctaatgcaatttgattatattttttagtagtacttagtaagtcttggtatgtgtttatggacacatcgttttcgggaaacgaattaaattgtactccgaaaatgataaatgcatggagtaattgtataccaactaacttgtaataatttgaatcaacacatgctcttttgtttacgcagcccatgcatttatcgttttcgaaagtatttaattcattttgttataactacgatgagaagccgagagaaccacagaattataatgaatcggataagaaaaatcaacattctccccctataaatacaaaacaactagctaaagttcgaaggattcatacataaatcttcaacacaactctttaattatctagtttaatacaaatg

SEQ ID NO: 36688 - DNA, 3000 bp, Unknown
  misc_feature (1)..( 3000): 2750-1469P.txt file - cDNA_ID_3099251; gDNA_ID_2936570; Annot_ID_194757
tataccctttcaccaatatcttgcatttgattaatggtcgtggtgaagggataaaaatgagaattcagtgtctagccgtgatgacgtgaaccgttaactcgtggaaaactgacaagtcatcaagtaacagtcaccgattaaattaagcctaatggacgccacgtgtacggcgcctgtgtcagggatggttatggataaggtggtttttttctttttttctttttgtaatgtttggatgtgactttagtgggatgtgtgggaaactgttttatctactttgaaagtaaatgaccaatatgggcctaggcccatttaaatatctaccggtccaagctttatgactcgatccttttcggctcatctcaattcctttcttcagcaggtcagctggtggttataactaacaatctttcgtatatactaacaattataacaaacacacgtggaactcgagagtaaaataaccaccacatacacaagagtcacgagactcacgacgcacctttcgtatacagacaatcttaggaccatttgcctacaataaaaccttaaatgtggttttgtctccattttgctgtatcgttgtcgtagtgcaggcccaaattaatttgtcattgttgacttgtttgtagagtttggagctctcattaaatgttgtagtgcaggagcaaatttttcctttctccttacgaaaataagatcgaaattgcgatatgttacaaataccattaactttagaatacaacaagaaagtttgaataagggtatgttacaaagatatagagtttgtgacggagttaaaccaaattacatgaatcattgcaacgaagttgaaaagcttggtcacatttcattatataagaattatatagagaattatatagctatttaaatgtgtttaggttttagtataagaagaagctgtaaagttttggggtaaaactataacaaatgttttgatcgagtttaataaaaatacacatgcaacttaggacatgaacaatagctagcttggagctagaaaacattgataggtttttcaaatattcaagacccctctgataatagtacataacacaaatctagacgaagataccagaagcttcttccaactcaggtgaaggatcaagcttggccggagaaacggaaggatccttcacaatcaatcgaatctccgctttttcaccccacaaactatacttgagaaacgcaaccacaattccacctacaaagctcctcatctcagacttttttctttgcccattcttacacatacaaccggccataaacccaacaaaaccgggcaaatcatcgtccaacatatccatatgtccgtaatccgcagccacgaaatgggctttcgtcgccttacactctttgtaaaactcctcatggtttaagtccgttggtgcgcatggtggcatcacgttgttccacttcggtccgagtccggttcccaccactgcaaccggtatgtccagctcgaaagattccggtttatacgttaagatatgcggatcggttctaatgtatttgttagttcctgcgactggatcaattcctattagagctgaaaacgtgatggatgggtctaatgttgcggcatggcctagcgcaaccgcaaacgccgttttcccaccgcggctgtggcccacgagtgaggtgtattttccattagcatttaccgaagttggtaggtgagctttgaggttttccgatgcccagtttatcacacttccagcatcgtccacttccacttgccctcccggcggcaataatttgcacaactgtcattcaagaatataaaattaacttatatcttttcacgtaacaatcaatctcaattaatgtacattttgttttacatgttacatgttacataccgtaagttatccttttaaatgattcataattattttttgtatagttaaattatgtacctgtggggctacaagaatgtaaccatgcgaagcgatgtggttaagaacgtcagagtagaagtagttgcgaagataaaagccatggaagaataaaacgacgggataagttccggcgactgttggacaggtgattctcaccggttttggcggtgctgttgaatcattttccaccggatccaccggtatctcggttgtcgggaggctgcctatctcaaaagccgccggagttaccacagaggaaaacgttggactgtcctctatcgccgccatttgtattaaactagataattaaagagttgtgttgaagatttatgtatgaatccttcgaactttagctagttgttttgtatttatagggggagaatgttgatttttcttatccgattcattataattctgtggttctctcggcttctcatcgtagttataacaaaatgaattaaatactttcgaaaacgataaatgcatgggctgcgtaaacaaaagagcatgtgttgattcaaattattacaagttagttggtatacaattactccatgcatttatcattttcggagtacaatttaattcgtttcccgaaaacgatgtgtccataaacacataccaagacttactaagtactactaaaaaatataatcaaattgcattaggaaacatattgttatgtttgttaaaaaaaacattttgttatgtttgttcagtaaaaaaaaaaaaaaaattgttatgtaaaaaaaaaagaaacaaattgaccaaaaaagtaaaatttgaccaaaaacaaatagtagcacaagaaaaacagagaacagaaaaagaagagaggaagggtgacgtggcacaatttccctgcgacgcacccaacctccgtctctctctctctcagatcggcggccatctccgtcgagtaattgaaatctctctcagccgttggattcgaattccgccgcatcttcatatacctcgtttcaatcctgcggaaccctagttgctctggtgagtccctggtgaacccccggattttagaatcatctattgtatttactttaattccgttccattgatg

SEQ ID NO: 36689 - DNA, 3000 bp, Unknown
  misc_feature (1)..( 3000): 2750-1469P.txt file - cDNA_ID_3099266; gDNA_ID_2936570; Annot_ID_194754
agatcctgcaaaaaaataagaggaagaagagtcgtgtaaggtgtggaattttaaaaatttctgatggaatctaagagaggttaaaacatcgtaatcatttcacaccaaaccattttttttatatatcatacataaacagtttcgaaagcaacaaacagaatcggaccaaattattcggaggattaaagtcaaattcttgataaaaagcaaatgtttttcgtgaagaactgaagaaacccagaaaaacccaatacaggaattgtgtaatcgtagaggaatacccgatctatggaggtgaaattgagaggagaaaaaaaccctaatttgaggttggaaaaaaaaatgcagagtaaaaagaaattgtgtagctcaacgtagtgagtcaaaagcagagaagattcaattattacataaagaagtaaagtgtcttgatgatttcatctcttgtaggagaatttccaaaaagcaagggagaaaaaaaacacagaaagtatacaaaaaataataatcaagaaacacagtacaagattaatcatatcaagaatcaagaatcaagaacttgaatttttaaaaactacctgagggagagaatcaaagttaaaaggaagaaaaaaaacctagagattgtgtttgtgagtgtggatgtggctgaatcaggaaacacaaaagcagaagagtttcgaacagttgaagacaaaaaaagatttgagacccaatcccgagagagatagagaaagaggcgattaataattgcaaaattcttaaataaacaaatttttttcagtccacaagaacaataaaaccaacccaacttatcattgggacattagacaccaacccaatttttaaaaatattattatgcaatatcaacaataaaataaaataatgatcactaccggaaaaatttgacaaccgctacctgtaatttttaattttttgcggcagaagcttctgtttctgatgcttagagtaaagataaattaatatgattttttttgtgtgccaaccattcatagagaaacacgtgagagcttacaaatcaccaattttcttttcttgattacgtgataatatttcttatgacgactttaacatacaaaacttaacaattccacacacacaaataaatggatttttatagatgattgtattatactttaatgatgttgtgttgtcattgacttgagactcatactacttttccgtataagttaactaaatacaaccaaaagaaaaaagttgaaggaatgagtgtttatatatgaaaagtttagtatttgtatattaaaaaaaaaaaccaaatctaactatttaaacgaaataatctataatgcgtacattaccatggtatcgtgggaaacttttaacgacttcctgatttgtgtacgtgaggctccaaaatagtgaaattattacctgccacaaattatagagtctagatttggatttcaaactaaaatgtttttttaaactatttgttcttatcaccttgctttcatcataaagttaaagttcgatacatttttaatagaacttcttgagcactttgtagttcaatatctttgaggttttctttaaatgtttgatataacggatatacttttagttatgcatggtagcggaaattaaactccatcaaataaaacatagaaacgtcattataggtaggaatatgagattacaaaactgaccctgataagctggtttaaggaagaagataaaacaaaggtgggtgtgtgtctgctcaattgcttaattgatggattaaatgacttaacaaccagttggtgagtccctccttactcttctgttatacccaatttttattctaagttctcttgtctttttatttcttttgttataaaccttttagttatacacttacatgtttgtatttgcatattccacaatgaagaatacgtaaaagattatctttatagctacactaataatataatccatttcctctgatttttaaaataacaagtagtttcgttttggtttgttggagattggatttagagcagccgacacaaaatcatttggcaagtaccattgtgttggaaaattattattcatgtgttttgagtctttgagagatgatgatattgacttttgtttccacgtggatcttgatttataatgatgattaaaaataaattaattaggcagttagctggtgagagattgattaaatctactaaaaatttagattattaatgatgtaattatttttaaaaccgtatggttctgtaaatcatattttaaagttgaggatgaatcgatgatgctaaacgaggaaaatgtgtgtgagtaagaaatgaacaacctttggtttggaggaaaatgttgaagtataataattcttgccaattgtcaaatatattaattacatggatatatccgaaaaaaaactttataataaatagccacaagttatggccgtgtaacaaaaagtaaaagaatttattgccacatacattgttggaccatatatgaagacggatcatcaccactaaaattcatgtttgtaacatttatattctatggatcgaaatcattatgctctccattattagaaccaaacaaaaccaaaccaaaattgtatcagcaaaactaatctgaagcctagcttagcttaagaaaaaaaaagaattaaaaccatatagtatgcattaactatcatcataactagtttagttttaggcttttagcaaataggccttttaaagcccattataaatatgaagagaggattccatcgggggcctgctgagaaacggcaatcaacttccttctaaataacaaaaacggcgtgaattgcaaacttctgcaaagagtcaacactgattagcggcttttccccattaaatctctcctctaaacttcttcgttccaagctttctccatcactgacgacagatccttagaaagttctgagatcgattgttactgtgtaaaccctaggatgtgattctaagctgtagagagaaacaatg

SEQ ID NO: 36690 - DNA, 3003 bp, Unknown
  misc_feature (1)..( 3003): 2750-1469P.txt file - cDNA_ID_3099271; gDNA_ID_2936570; Annot_ID_194753
tactagtgcaatcaagtaaaacccttttcttgatcaatcctactactgtatataatcctatgaacatagaggcaatccagagtctggcattgatccgaataagcaaaagagagcatcttgagaggctttcaatgtaaatgccaactcgagccgcttcgtattaagaacaacacttgaatcactagagtaatcttttatcatagaggcaatcaagtaaaaacccatttcttgatcaatccaaacgatcctatgaaacacatctccactatctattacctaagtttctgaaactttacacattgatcaaatataatgtatccaataataactgaaaacaccgaaacggagaccagaagaaatatctaaataccgattaaactatggctgcgatgggaacacatctttcacagcagaagctgccgtcaaataattgagtgtattcctcagcgtctccctctctctctttaacctagccgccgtatcttcaagctccagtaacgcttgctgctccatcggagctccttcaaacgtgcttccgacgaagaacgagaacggagtcggaaactgattcttcctcagatcctgagattccttatctggtttcccattcaatctattcgacaatcgaatcacttctttcatcagaacctcaacttcattcgccaattcgtccagattctcttcaccggacggtcgatcttcaagccacgtcactttcgcgacgaggtaaggtttcgtacggacgagatcggtgactcggaatcgttcctgacctttacagattaagaagaatcgatcgtcgactagacgctcgtgtttcacgatttctccgacgcatccgattccagctgcggagcctgaaacagcgtcggagtagacaacgccgaatctgagatcggattggagaagcgtttgcatcatgactcggtaacgaaactcgaagatctgaagcgggattgttgcgcctgggaagagaacgagaggtagtggaaatagaggaagctcgactaagtcatctgatttgggtggattcgcgttgttgtggtgtttctcggagaaggaagaggatgagcaacggaaggagaggagtttacagcttcgacggttgatgctccggtaagtagctggaagatgtagaggtttagggttgaaggcggagagataaggtggagttgatttgaaggaaggagatgagacagtgcttggaagcgccattagagagagtgaaggaggagaggtttcacaagtgaacggcgaaattgatttaagattttaattgtttcgtctttaaaattaaaccttatctgtttgagaaaatatatttcatcagatatttttatttcataattcctgtggctagaaatttgtttagaatagaaataaaaatatatacgagccatttggttcgtgtgtaagtgtgtagtacatgcatttgagacaccggtccacttggatatcatttcgtagtaaccatgaatttgcaggggtaattgtgtcaatatctcttggtcatatataggttacaaagatgaacggaagaaagaaaaaaaggtgatcggagattttggcttattctcagatttgggagaaatggcggcagaagagggtcaagtgattggttgtcacacgaacgatgtatggactgtgcaacttgataaagccaaagaatccaacaagctggtctcgattctcacccctttgttatgcaattctctttggttgtattggatttgggaattaggtttttgtttgattagggttactgtttctagtgtcaaagaaagcattatggtttcacatgttatggtataggttttgattccggctaacgtagagttggaataaacggattgttaaggagatcacaacattagatgtgagggcaagtgaatcatcagtgaaacttacgttttgatgtgtaaacttttagagtattttctttaattgattcatctttgtgacttttgttgtgttcctcttttccttattgtagctcagagtcacccctctggtaaaaaaaatcattttggattgggttatttaggattctgatggtgtgataatttcattgttttcagattgtgattgatttcactgcttcatggtgtccaccatgccgcatgattgctccaattttcaacgatttggccaagaagttcatgtcaagtgccatcttcttcaaggtggatgttgatgaacttcaggtgaacaaatacactttctttacaaacaaattaatctcctcactcttagactttagaattacactgatatattctatatacttgtgatgatgtttaacagagtgttgctaaagagtttggtgtggaggcaatgccaacctttgtgttcattaaagccggcgaagttgtggataagctcgttggtgcgaataaagaagatcttcaggcgaaaatagtgaagcatactggtgttacaactgcgtaaatcagtttgaggcataaataataaggtctaatttgtttatcttaaactagctagacataacgggaatagtgcagattggagatgaagtagaagttattgatctctgactgtcataaaaccatgctttttttatatggtctttggcttttgcctaattcatatgtttaggtgttctttctatacctccatagaccaccactcagtcgaattttcagatcagtgaaatagactcttgtgaatgaattgttccatgcatatcataatttgaatatctgaaatctgaggccttgcaaaggtgtaaaataattttgtgcgagcagctgtttccacgtgttataatttgattggaagttgaaattcttatccaccaaacgtttcatattttgttgccaacgaacccattaccgaggttcttcgtgctttcttatcttctttcttcttcgctgagcttactctgtaatcttgtgaactctcgttgataattcaaagaggaaacggagataaaggagaaaactttagagcgtgttcaagttaataacagttctgtcgataatg

SEQ ID NO: 36691 - DNA, 3000 bp, Unknown
  misc_feature (1)..( 3000): 2750-1469P.txt file - cDNA_ID_3099298; gDNA_ID_2936572; Annot_ID_194790
tttgtttaatataggacaaaattataaaactaaagaatagttttgaggctaatttgaatatttcctaaagatatgaactatttttggcaattttggaaatcacgagatttttatgaccgacgaacccataaaagaccaccagttcgacaacggcggcgacgaggctgagataacagacgcggcgaagaggtcccttccgattaaaagtcgcaagcattcaacgatggcttccatcacgaattatgtccgatacatggctcacaagctcgagtactctctcactctcagccttaaggttcttataatgctctctctctctctctctttcactctgtgacgcacagcttgtgttaagctttcagttccttaccttttgcttatctggttgtatggaaatttaactttctgatttctctctttgtaatttatgaaattggctttaggaatggttaaattggctagggtttctgatatgttcccctcatccaattatgattttgcttgaatacgtagctttagaaaattgcctccataaaacgccatttatcaagaaaatttgcttctttcgagctatgcatttggataaactaaatctttatgcttttagttagggaatgattgtaagtaccacttataataaaagggcatactttgaaattaaaaacaagaaaaaggaacaaactttatgctaagggatcagtagtttggttgacatgatcttcaatagcttgtgattcttgaatttattttaaaacaagttatacggtcaaatcattgctattgaatttgtgatagtacttctatcatattagtttcacttgtgactatgatctcaagatctttctttcagatgatctgattaaatctaatgactcaaaaaaagcgactatgatctcaagatctttctttcagatgatctgattaaatccaatgactcaaaaaaagccgtcatgattgttctggtccttgttgtttcttctgctgcagatacttttttttttctttctgaatccatttttttcagctcacttagttgtttaaaactgtcatgtagaatctgtcttttttttaaaaaaaaaaaaatttaaacacgttgtaaaatctgtttttagttaccatgcttgagttactctatttgcagaaacatactagagagaagctcagtgaccgggaactctttggtgtagtcatgaagaatctattctatggaagaataagctacttacactcggacaaaggaaaagagatggccccaaccatgggaacaaatgaaagcacgctacttgtccgtaagctaccagttgttgatacaaggtatgtttcttggcattaagggttagtccttttagttccacttacataaacaagttaccacttggtgttctatgaaatgttgctccgtatgctagttatctagtggggatatgggatcatgtttatctttctgaagtcataaacgttggattatttgtgtttcctttcttgtgtaggagctgtacttaatttccattagctaaagtcatgggcttttacattattttttatttcttatcttgcatttggaagttgtaacttgtatgtagtgtaggagaaagaggaaatcgaggattaaaatgtttgcaaaaagttataacaatgcttgttgttttgcttatgataaaatgtgtagtgggtgtatatgtatatgtcttcttactttgacagaatgaattggacagaattgagttggttggaacagacaagtatatttaactccgatgagctcattgaaaatgtaaattcttggtttcagctttttaatgtatccaataatcagtctaaaccctagctcgcagccttttctaggttcagtgtgtatatcattagtgatgctcatcaggatttcttgctttgttatctaggtacattttcgtaggggatgctgttgtcttgaaggacccgaatgaaacaaataagtatatagtcagaagactagcagctttagagggatctgaaatggtatcaagtgatgagaaagatgagccttttgttctcgaaaaggatcagtgctgggtcgttgctgagaatcaagagatgaaatctaaagtacaccacttactttctcccttacataattacttatccatgtagcgcttacataagagaaactaaatctatgtatactttggtatgtattaataaggaagcatatgatagtcgaacatttggtccaatttcaatggcggacatagtgggaagagctatatattgtctgaggacagcagtggatcatggtccagtaagcaacaggtaagagaagatttctattgtcccctatcagctttatctttctgtcattcttttattactgaggaaaaacaaatcctggaaaatgttgcttttatcagtgaatttgccatggacgaggattccccaatcctggcggtagaacttgacgtggatgaattggctaaaggccacaaggcgtcataatgaagaacctttcttgtaccacattttcattcactgtgtcgatgtttcacttataaactccaatttagttgtcattggaggtgtttgtggcaaatgttggcccgttggtacttaagcttaatacgtcggatgctgttgagtgttgacttgaggaaaaggttcttcatgagcttcatcctctctataataaacaaccatttctatagagaatccaccccatggttttaaaccgaaccggggaagactgtaccgttaatattaatatgaaattgatttctgaattcggtttggaagagttgtaaccgagattagaccgaatatagattattggtttgcgttagggcaatcgcttctgaaatgtcacggtttattttatgttttgtcggcaatttcacaaagcccataaagcccaatatcaacatttttgtgttaccaagataagccagagaaaacgcgagagtcgacaaggaaaaggcaatgcaagaagaagcttaaatctctcttctctgctcctgaagtctgttcatg

SEQ ID NO: 36692 - DNA, 3003 bp, Unknown
  misc_feature (1)..( 3003): 2750-1469P.txt file - cDNA_ID_3099307; gDNA_ID_2936572; Annot_ID_194803
taaccccttaaaaggttcttattttagtggcaaaaatatattttctgcaaaccgggagtttggggaaatcatataaagtcatacctgaatgcgtttaagacaggttcaagctaatcccaggaggaataatccggtaatgggagagtgagctgggaagaacgagattttgcttcacagaggaatatcatcgaacgactggacggcaagatgtgaagaactcaaatgaatagacgatgacttgaggtttagtaaatcggatcaaagtgagtaatacgaaacacccatgagctttgatcgaatacgtttgttcacagatttgatatgtagcagaatggtgtgattaggaaagaaggaatcttgcgttttgattctatcagcctctgttgggctttgaggttttaaaacctaaccggatatattcaaagggtttacgtttaaccggaatttggtcggttcagccacaaaaatttcagatttggacctaggaatagttaacaaattttaatcctataaaattcaggagacgtgtgaaaaaaatgtcaaatgtaaatatgtaacatgcaccaattagtaattacagaactctgtttttggtctaacaccattgatttgtccattacattatgcatacaaaaagaaaaacctaggtctacatagttcagagtgaaaaaaaaactttgatctaatcttcaaatttcatagccaattccaaattatagcgtatacttaattatgtgattttactttcgcaagatggccgtaaaatatgactgaattaccgcacaaggttttactcccgaagatacaccacgaattgcaagaaacaattaaaaattatagttacttagatataaacattataattactttttttttttttttttccgtcaaacattatagttacttagagtgggagatagtgttgtttgaaaccattattaatcactgcataacattgttgcctttgatcgtgctttagattttcccaaccaccttgcacattccttgatgcatatccaccgttgacaatctcccgattcacaccaacaccattgttgttaacactaaaccctcctgatccactcgaattcgtcatcgctaatccgttcttgttgttactattattgttaaatacgcgttgattattatcccaaccaatgagaggctggttatgaaccaagcttttgtataacttgagctcttcacaaatcctcctatactctccataggagccaaggaccggatctttctgtctccatagagcttcccatgttaaagaatcagagagcttggtacggtcctcttcacgtaccgtccgtaccattttttgtacgttactgacaccgaagaccttgtgcacggcctgaaactctttagtcttgcgggctgggaaatacggcgataagatacattcgttgttgcatttcttcctttgatgtttgcatgaagcacaagcttgatgcgacgatgagttattggagatgttactggtgatgctggtgttgttagagttcctttgcatcatgtcatgtccctagtaacggaaacttgaaattttaatacaaatataaatgttagggatcgataaggtttgaagcatcgatatatataaaatttccacacaccgtatgtatattcacaattgacaaggaaataagaaggaaacagatatataactcagagaagaacaaagttttgaacataatgtcaagaagggtcatatacaaacctcttgcctcttttattttccttcatttgtgggttaatagcaattggagatatggatttatattaataataagggatattggtagatgattattatttattatatgttatttttggaaaaaaataaagaagaatattaatggtgcacaaagagtttgtctaatgaacatgaaaagattgtttggtttgatgaaagaaaaaggtgtttggatgaagggtcgataatgatttatgagttttaggttgcccatgaaaaaggacaataacaactaggaaatcaataaacaaaacgaaattttgctttacatatttgatttttgttttttataattataatgggaaaatatgattccaagcattttggatgaaaatgtgtggaatgtaaagaataatactagtagtatgttagatattaatataatttgttggtggcttccatatttaagagtttttatgtaggcataacatggaaagaatgattacaattgcctcttcttcttcttatttttcctcttcttgcatcttagttatgtattacagtgagtaaccgagtataaaaggggaacgaagtatataatgtgtaggaagatgttttgtggagagatcttgttcatagaatttggcatatacaactagattctcgtgatatctttctattattatgtaatgcatttcccgtgttcaatacgtgatagtgatatgcaagatccatgcatggtaatatttacgtaatttttttatatataaaaagtatgacgacatataccgatgaatataaaaaatcttaaaattttaacatgtaccaacttaattaagcaatcgatgtctcggaaacttataagaaaatattgtgtggacactaggtttacaacagttgatacaatagtgcaccggtctgagagatgatcaaaaatcaaaatcacttttaatttcttggttcttttgtagttgaccggtcggttagaaattttttaaaccaaaagaaggttgacggatagatgaataataaacggctgagattgaacggcgataaggataacgaccttatcccaactaaaatcccttcgtacttccctaggagaggagtttcatggtctcgttaccaaattggttttaattagttttctcaaagggtatttatgtaatctcaccaccgttactaattttataaaattaaggaaactatcgttgaaacttcttcatcttccttaaaacaaccacaacgtcactttcttcccggataattgaaatcggtgatcggaatccctagaaatg

SEQ ID NO: 36693 - DNA, 3003 bp, Unknown
  misc_feature (1)..( 3003): 2750-1469P.txt file - cDNA_ID_3099316; gDNA_ID_2936572; Annot_ID_194800
catcatccatttgaagcatccctttgtttgccagacacctccaggtacttggcactaagtactcgtcctttagagcatccaatcctttattgaccaacgaaatatcccggccaatctccagcttgaataccccgtctgtatcttgcatccctgccatgccgtgcaggtatatctccaggttatggtagttcctgaagttcagagaccgtttcaggtatgttgagttcaaagtattgatctctaacacctcgccaatttctgagtacagtaagagtggataatgtggtgcgacatctggaacatttactattcttagaatgtttagtggttggagtgagtcgactacgtttttgaagttatggtctccaatccgaggactcccgaaagcaaaaactgtgataggaacttgctttttttgaagatttatattgatattattctttttgccatagacaagatctgcagctgatagaactgacataactgcgcccaagctatggcctgtgaaggtgatgcttatttcttcatccttgtaaagttctagcaacctcttgagctctccttgtacctaaaaccaaaaccaagacacgatgccattaggagaaagaaggagaaatggaagtagtgttgttgacgttgtaatgggtcgccccgccacgttttgagctcaacccatttcggccttgataacttgaacctgtcactgaagtgaatgcgatgataaaagagaaaggtgaggacctgttcttgtgcactagtcgtgtcataaggtgagcgagaatcagaagcggtatagatgtcgagccagccacttccaatacgagggttatctttggggtcagttactgggaaaaccgagatagctggctcaagcggaaaatcgaaatcattagcccattcatatggctgtagagttcctctccatgcaacaacaatgtctctcctccctaacatcgcttttccctggtctgtagcaaccgcaatgtaacccatccagttagtctgcacgcgagatgcatcctttgacaaagactttacgatgaaagagattggtaactttatggaagctgttgcgtagatgtacttagtcactttgtacctgaaaatctatcatgggtaagcttacatcgtcgaatcaaagatgaaacattgtgggagtatggtacctgaaagggttggctttaaggaagccggttcgagctaacagtcggttcttggagtaataacaatcaccggcgtatctggacttacggtcccagttaaaggcatcgtaaccaacctgagacatctcgccgtagtgaatgatgtagcggcgaagatccgggtcaagtggatcaagcaggcctttccatttgttttggccacttagcaccttccatctctttggtatgccctccaccatgtttgcctttgtttttttttcacaaacctttttcttcttgttcttgatgtttggagagtaacattgctccttgtgtgaaagaattggataatgcgtgaaggaaatggtccttaatgtatggcccttcacataaatagtgccggtttaagtttattttaagtgtacgtttattacaaatttgtaggattcacatcactttttttaacggttaatcaacgcttaaaacatgtactattgttagttacatcgaaattaaattaattaaagactatttcctctatagcctgtctaattttattcggctaaaccaaaccggaaacatctatccagaaccgaagcaggggcttatacttagcgaccagcgttgttaaggtgcaattgagtacttgaccggtgagtttcaatgtattcatgttctctgctctgcctcattcttgaagattccattatctttcatcaatggtttggaacctgaaactaaatttctcaaaaagagttgtcaccatcaagtaagactggttcgctcgccagagcatgttgtctaatatctggatctttcctgcaaacagaatcagccaccccttatgaccattgtcttcattttccgacattcctctctgtagataaacctttctggcactgcttcagaatcatctgaacattcttttgcaaaatcagacagtcatgattcaggagtttttgaacatggggacttgtgacctcggaaagctcttcttctcatctgtaatggactgattagaccgcctcagagaagttaacaggttataaagatccgcatgacaaagcaagcatcatccttggttcagttttctagctgaacaatacccatggcttctttccatattcatgatttcttttcaaagcatattcatgtaataattagaaggggaggcaatggttttccataaacgaaagaggcttcagcaagcaagtcttgaaccacatctgaacaaagtttctcaacagggtttctgactgtaatgaacttgatcctaaacaaattttgcagtatcagaaaccaagagttaacaaactagaaacatcatagtacgaattacatgtgctactataaagtatgaagtacctggaagcctcaaatttctccagcacatgtttttccatagctcaagaaactgaatcttcttgggtcaaaaatttgtatttatttagaaatgacaaagaaagaaggactcaagaattgtcaacaccaaagtttacaatggaaggatcaacaatcttcagagaaagccaatcagcaccagttttacaacgagtacctttacctgcaaaatgtcaaaagaagagaaaatttcagttttcaagaccaaaaaaaaaatgacttctggagaaacaggcataacataaacacatatgtcagttgactaaaacaaactaaattatacgactctcttaaacttacgtttctgcatattgttaaggatgggacaggaggaaacttgtcccactggaactgcaacaaaacacaaaacctgtgaccaagaaagcagtacaggactgaagcttatataccagaaaccaaactcatttcccaaactccaacttttaaacaaacaaaaatg

SEQ ID NO: 36694 - DNA, 3000 bp, Unknown
  misc_feature (1)..( 3000): 2750-1469P.txt file - cDNA_ID_3099323; gDNA_ID_2936572; Annot_ID_194798
tatcaaacaggatgcttctaggagaaagtaccaatcgttcaagcgagcctcatgtgcttaggcaggtattatagaaaacacatgtttctcttataatcgcatcttgactttagaatcctgttaacgataacctgcctctcaattatctctagtactttattttacaatcgtaattattttagctgcgctattgcagatagtcatacagagagcattgttatccaaaaggaaaaggttctaacgcttatggagattcatggactcactgcaagggatagcttgccatcatagcaataccacatttacccgtgtcttcacttacaccacgctccatccgtatgtagccttcttcaccccagccagttccccatgaattctttacgatccagtacttttgatcgccttctactccatatccaacaacagtcactccatggttgagatttgttccacagtaatttgtgaaaacaccggaggagtagagctgaaagataaacccaccagcatcgattccaactgatactggctgttgagctgcagcgatttgtaggctcgcctcgttttgggctaccttttggtatccttgtatcgtaactaccttatttttggatttttcttggtcgcaggtaccctctatgcctgtgtatgggtagtcggtctccgtggcgagtccaccattggttttgatgaattcaaatgctgtttccattaatccgccactacagcctttgttgtaagtgccgacatcacaatctatgagttgttgttctgagagagacactaaattccctgttttaatcttgttgatgccttcaatagctgctactgcagagaatgcccagcaacctcctgcaacaagaaaaacaaaacgcaatcagaatgtcatcagttgaataatgaatgtttgcaaggttttatgtttagaatgaattatgtaaaaacataatttcataccgcattttccttgatttctgataggagtcacagcaccttgagtcctccagtccacagcgtccgggacattgcctgctgggtcacaaactggtctctgcttcttgtgtaacctcaaggaagacgtgttcaacccgagaaaatgggccttaaactcagaattggtcatatctgcaaatctattatccgttagcttaaagggcaagtggagggagttgatgtagtcaatcaactggacgttagactgatatatcccaaaccgtagcatccactcatcccttcctccatataatttgctgtgggttttaagccacttctcgaaccgctgcttcagggttttgtgtgggtcatacacagaggaatcgacggaacatagctttgaagctatcaagacaaagcaaatcaaaacggcaagggtcaggttagaatttcgaagtacattcagcatttttgtttgtttaaaagttggagtttgggaaatgagtttggtttctggtatataagcttcagtcctgtactgctttcttggtcacaggttttgtgttttgttgcagttccagtgggacaagtttcctcctgtcccatccttaacaatatgcagaaacgtaagtttaagagagtcgtataatttagtttgttttagtcaactgacatatgtgtttatgttatgcctgtttctccagaagtcattttttttttggtcttgaaaactgaaattttctcttcttttgacattttgcaggtaaaggtactcgttgtaaaactggtgctgattggctttctctgaagattgttgatccttccattgtaaactttggtgttgacaattcttgagtccttctttctttgtcatttctaaataaatacaaatttttgacccaagaagattcagtttcttgagctatggaaaaacatgtgctggagaaatttgaggcttccaggtacttcatactttatagtagcacatgtaattcgtactatgatgtttctagtttgttaactcttggtttctgatactgcaaaatttgtttaggatcaagttcattacagtcagaaaccctgttgagaaactttgttcagatgtggttcaagacttgcttgctgaagcctctttcgtttatggaaaaccattgcctccccttctaattattacatgaatatgctttgaaaagaaatcatgaatatggaaagaagccatgggtattgttcagctagaaaactgaaccaaggatgatgcttgctttgtcatgcggatctttataacctgttaacttctctgaggcggtctaatcagtccattacagatgagaagaagagctttccgaggtcacaagtccccatgttcaaaaactcctgaatcatgactgtctgattttgcaaaagaatgttcagatgattctgaagcagtgccagaaaggtttatctacagagaggaatgtcggaaaatgaagacaatggtcataaggggtggctgattctgtttgcaggaaagatccagatattagacaacatgctctggcgagcgaaccagtcttacttgatggtgacaactctttttgagaaatttagtttcaggttccaaaccattgatgaaagataatggaatcttcaagaatgaggcagagcagagaacatgaatacattgaaactcaccggtcaagtactcaattgcaccttaacaacgctggtcgctaagtataagcccctgcttcggttctggatagatgtttccggtttggtttagccgaataaaattagacaggctatagaggaaatagtctttaattaatttaatttcgatgtaactaacaatagtacatgttttaagcgttgattaaccgttaaaaaaagtgatgtgaatcctacaaatttgtaataaacgtacacttaaaataaacttaaaccggcactatttatgtgaagggccatacattaaggaccatttccttcacgcattatccaattctttcacacaaggagcaatgttactctccaaacatcaagaacaagaagaaaaaggtttgtgaaaaaaaaacaaaggcaaacatg

SEQ ID NO: 36695 - DNA, 3003 bp, Unknown
  misc_feature (1)..( 3003): 2750-1469P.txt file - cDNA_ID_3099342; gDNA_ID_2936572; Annot_ID_194793
cttcgttaaattaagcaaagtctgggaaaattgtgcagagaatatggacaaattgaagatagcagaatggggagagaagctgaagactggtggagctcagatgagcagaatggtgagtgagaaagtgaaagatatgcttcaagctccaaccttggaatccaaaatggtggatgaagctactttagagactttagaggagcctaattggggaatgaacatgaggatttgtgctcagattaacaacgatgagtttaacggcactgagattgttagagctatcaagaggaagatctcaggtaagagccctgtgagccaaaggctgagccttgagcttttagaggcttgtgctatgaattgcgagaaggttttctctgaagttgcttctgagaaagttcttgatgagatggtttggttaatcaagaacggagaagctgattccgagaacagaaagcgagcttttcagcttattagagcttggggacaatcccaagatcttacttatcttcctgttttccaccagacttatatggtaaatctctctgaatcttatttgcttattatgcaaagatggaattgttcatatgcctataatctccggcttgtcttttgtttcatagagcttggaaggcgaaaatggattacacgctcgaggtgaagagaattcaatgccgggacaaagttctctggagtctcttatgcaacggcctgttccagtgcctccacctggtagctatccggttcctaatcaagaacaggctcttggggacgatgatggtcttgactataactttgggaacttatcgataaaggataagaaagaacagattgagattacacggaacagcctcgaattgctctctagcatgttgaatactgaaggaaagccaaatcacacagaggtagttgctacgttgtctgctcatctaacttttgtcattttccttaacaaatgtctatggaatatggattgagttatgagtatctcctggtttacattattgtttccttggatatatgtgcttaaagtgaaattgacaggacagtgataagtaataggtttatatatattatggttacaggacgatctaacggttagcctgatggagaaatgcaagcaatcgcagccattgattcaaatgatcatagagagtacaacagacgacgagggagtcctgttcgaggctctgcatctgaatgatgagctccaacaagttttatctagttacaagaagcctgatgaaaccgaaaagaaagcctccattgtggaacaagaatcatcaggaagcaaagatactggtccgaaaccaacagaacaagaagaacaagagcctgtaaagaaaacgggtgctgatgatgacaaaaaacattcagaagcatcaggatcctccaacaaaaccgtcaaagaagagaagcaggccgtgaaaatagaactggggctttcgagtgatgaagatgaaaaataagcagtctgtgtttgttgtcttcttccgacatggatatcagaatgttgcgaagagttgttcttgatggtttacttttaaattataacaatgtacttccattataagtgtggaacctttttagcttcgtttctcactttctgttttaaagtggtttcttagacattgttaaaccgtaggtgaatcttcacccgaaacatttatacgaggtgttttggtttgcacttagcctattgcttatgtgttgagaggtgagtatctacatctcctctggattatataaatggcttgataaaattcacctcactctccgataaactcgctcgaaatgataaaacgaagtctaacctttaatgtgtttaatgtgtttagtcttctcaagtcaaataataatcggagtcttggtctcttggacgatgctacacagggatatttcaaaagtttacccttatcaccaactagagaacccaaattaggtcttgtaccgattgtagagtatatgtctatacgatacttctcactgtctcttggacgatgcttcacagtgatattccaaaagtttacccctgtcaccaacaaagccaaataagggcttgtaccgattgaagagtatatgatacttcccactacacttgagtaaagaactgtcttcatgtaatcattataaccatcttgttatgcttactatcttcttcaaatcgcagctttcaatctaaaatgaactcctaagtgacatacgactaattttgcttcatccatcgcaaaacgcaaacatcttttaaaacttttactgaattttttctgcagtaaacatagtgaacccggtttacgttctggtttagacgtttcaattttttctaaattgggccgattgacatataattggacccgacccatcaacatatcccacatcgttacaaatagatttcaattactataatttaatcaatatataccgactaaaactctctgtccgacgtagagtcttccaatcaaaacctaaatctaaatttttcattcccttgttccggcgataacagtctcagtggcgacaaaccctattgccgagccaactcgcattttcctctagctatcgcaacgcctctcgctctctctccccaccggttcgtcttctcactccttaactttgttcagcttgttgattctaccctaggttattgctctactccaacgcttctgctcgactctcgccttgttgtttttctttagtccaacttagcataagcttctgctcgattctctcctagggttttgctctagtctaattaccttaagtttctggttgattctagctttttcatggtgttctcttggacttggtgttgagcattagaggagattactcgccaatgggttaaataaaatatgttgcagaattgctatagtaaataacccagatagatctatcaaaagcttgattttgtggtaatgcactcatttgacttttttgccgttattgtttatctgctacaaaatcctgattgctcatgggattcttttttgacaggtttacataaagatg

SEQ ID NO: 36696 - DNA, 3003 bp, Unknown
  misc_feature (1)..( 3003): 2750-1469P.txt file - cDNA_ID_3099347; gDNA_ID_2936572; Annot_ID_194792
acagtgaatgaaaatgtggtacaagaaaggttcttcattatgacgccttgtggcctttagccaattcatccacgtcaagttctaccgccaggattggggaatcctcgtccatggcaaattcactgataaaagcaacattttccaggatttgtttttcctcagtaataaaagaatgacagaaagataaagctgataggggacaatagaaatcttctcttacctgttgcttactggaccatgatccactgctgtcctcagacaatatatagctcttcccactatgtccgccattgaaattggaccaaatgttcgactatcatatgcttccttattaatacataccaaagtatacatagatttagtttctcttatgtaagcgctacatggataagtaattatgtaagggagaaagtaagtggtgtactttagatttcatctcttgattctcagcaacgacccagcactgatccttttcgagaacaaaaggctcatctttctcatcacttgataccatttcagatccctctaaagctgctagtcttctgactatatacttatttgtttcattcgggtccttcaagacaacagcatcccctacgaaaatgtacctagataacaaagcaagaaatcctgatgagcatcactaatgatatacacactgaacctagaaaaggctgcgagctagggtttagactgattattggatacattaaaaagctgaaaccaagaatttacattttcaatgagctcatcggagttaaatatacttgtctgttccaaccaactcaattctgtccaattcattctgtcaaagtaagaagacatatacatatacacccactacacattttatcataagcaaaacaacaagcattgttataactttttgcaaacattttaatcctcgatttcctctttctcctacactacatacaagttacaacttccaaatgcaagataagaaataaaaaataatgtaaaagcccatgactttagctaatggaaattaagtacagctcctacacaagaaaggaaacacaaataatccaacgtttatgacttcagaaagataaacatgatcccatatccccactagataactagcatacggagcaacatttcatagaacaccaagtggtaacttgtttatgtaagtggaactaaaaggactaacccttaatgccaagaaacataccttgtatcaacaactggtagcttacggacaagtagcgtgctttcatttgttcccatggttggggccatctcttttcctttgtccgagtgtaagtagcttattcttccatagaatagattcttcatgactacaccaaagagttcccggtcactgagcttctctctagtatgtttctgcaaatagagtaactcaagcatggtaactaaaaacagattttacaacgtgtttaaatttttttttttttaaaaaaaagacagattctacatgacagttttaaacaactaagtgagctgaaaaaaatggattcagaaagaaaaaaaaaagtatctgcagcagaagaaacaacaaggaccagaacaatcatgacggctttttttgagtcattggatttaatcagatcatctgaaagaaagatcttgagatcatagtcgctttttttgagtcattagatttaatcagatcatctgaaagaaagatcttgagatcatagtcacaagtgaaactaatatgatagaagtactatcacaaattcaatagcaatgatttgaccgtataacttgttttaaaataaattcaagaatcacaagctattgaagatcatgtcaaccaaactactgatcccttagcataaagtttgttcctttttcttgtttttaatttcaaagtatgcccttttattataagtggtacttacaatcattccctaactaaaagcataaagatttagtttatccaaatgcatagctcgaaagaagcaaattttcttgataaatggcgttttatggaggcaattttctaaagctacgtattcaagcaaaatcataattggatgaggggaacatatcagaaaccctagccaatttaaccattcctaaagccaatttcataaattacaaagagagaaatcagaaagttaaatttccatacaaccagataagcaaaaggtaaggaactgaaagcttaacacaagctgtgcgtcacagagtgaaagagagagagagagagagcattataagaaccttaaggctgagagtgagagagtactcgagcttgtgagccatgtatcggacataattcgtgatggaagccatcgttgaatgcttgcgacttttaatcggaagggacctcttcgccgcgtctgttatctcagcctcgtcgccgccgttgtcgaactggtggtcttttatgggttcgtcggtcataaaaatctcgtgatttccaaaattgccaaaaatagttcatatctttaggaaatattcaaattagcctcaaaactattctttagttttataattttgtcctatattaaacaaaattatcactttaacccccaccaggaagcttctgaccaaactttcgagttaggctttgtcaacatggcacgtgttcaacagtccttctcttttttttaactctcttaacatttccttccgacagatttgcttgcagattgaagctaaaataatcaaagacaaataccaaacacaacaacaaattttccagacgatttgaatttgatcatctctaataaacttcgtcgcaggtttgttcgctcctctcttctttttctagtgtactcaaggatcagcacatttgaatttatagatccaatttattgtaattgttttcttccctgatctctattcgtttagattttggttgattgatctcgattcggagtttacggttgtactgtttagtattatatagaacgatggtgactcgaaactgattcggaaatcaaattagggtttttttagggcttcgttaaattaagcaaagtctgggaaaattgtgcagagaatatg

SEQ ID NO: 36697 - DNA, 3000 bp, Unknown
  misc_feature (1)..( 3000): 2750-1469P.txt file - cDNA_ID_3099352; gDNA_ID_2936572; Annot_ID_194791
tcggacagagagttttagtcggtatatattgattaaattatagtaattgaaatctatttgtaacgatgtgggatatgttgatgggtcgggtccaattatatgtcaatcggcccaatttagaaaaaattgaaacgtctaaaccagaacgtaaaccgggttcactatgtttactgcagaaaaaattcagtaaaagttttaaaagatgtttgcgttttgcgatggatgaagcaaaattagtcgtatgtcacttaggagttcattttagattgaaagctgcgatttgaagaagatagtaagcataacaagatggttataatgattacatgaagacagttctttactcaagtgtagtgggaagtatcatatactcttcaatcggtacaagcccttatttggctttgttggtgacaggggtaaacttttggaatatcactgtgaagcatcgtccaagagacagtgagaagtatcgtatagacatatactctacaatcggtacaagacctaatttgggttctctagttggtgataagggtaaacttttgaaatatccctgtgtagcatcgtccaagagaccaagactccgattattatttgacttgagaagactaaacacattaaacacattaaaggttagacttcgttttatcatttcgagcgagtttatcggagagtgaggtgaattttatcaagccatttatataatccagaggagatgtagatactcacctctcaacacataagcaataggctaagtgcaaaccaaaacacctcgtataaatgtttcgggtgaagattcacctacggtttaacaatgtctaagaaaccactttaaaacagaaagtgagaaacgaagctaaaaaggttccacacttataatggaagtacattgttataatttaaaagtaaaccatcaagaacaactcttcgcaacattctgatatccatgtcggaagaagacaacaaacacagactgcttatttttcatcttcatcactcgaaagccccagttctattttcacggcctgcttctcttctttgacggttttgttggaggatcctgatgcttctgaatgttttttgtcatcatcagcacccgttttctttacaggctcttgttcttcttgttctgttggtttcggaccagtatctttgcttcctgatgattcttgttccacaatggaggctttcttttcggtttcatcaggcttcttgtaactagataaaacttgttggagctcatcattcagatgcagagcctcgaacaggactccctcgtcgtctgttgtactctctatgatcatttgaatcaatggctgcgattgcttgcatttctccatcaggctaaccgttagatcgtcctgtaaccataatatatataaacctattacttatcactgtcctgtcaatttcactttaagcacatatatccaaggaaacaataatgtaaaccaggagatactcataactcaatccatattccatagacatttgttaaggaaaatgacaaaagttagatgagcagacaacgtagcaactacctctgtgtgatttggctttccttcagtattcaacatgctagagagcaattcgaggctgttccgtgtaatctcaatctgttctttcttatcctttatcgataagttcccaaagttatagtcaagaccatcatcgtccccaagagcctgttcttgattaggaaccggatagctaccaggtggaggcactggaacaggccgttgcataagagactccagagaactttgtcccggcattgaattctcttcacctcgagcgtgtaatccattttcgccttccaagctctatgaaacaaaagacaagccggagattataggcatatgaacaattccatctttgcataataagcaaataagattcagagagatttaccatataagtctggtggaaaacaggaagataagtaagatcttgggattgtccccaagctctaataagctgaaaagctcgctttctgttctcggaatcagcttctccgttcttgattaaccaaaccatctcatcaagaactttctcagaagcaacttcagagaaaaccttctcgcaattcatagcacaagcctctaaaagctcaaggctcagcctttggctcacagggctcttacctgagatcttcctcttgatagctctaacaatctcagtgccgttaaactcatcgttgttaatctgagcacaaatcctcatgttcattccccaattaggctcctctaaagtctctaaagtagcttcatccaccattttggattccaaggttggagcttgaagcatatctttcactttctcactcaccattctgctcatctgagctccaccagtcttcagcttctctccccattctgctatcttcaatttgtccatattctctgcacaattttcccagactttgcttaatttaacgaagccctaaaaaaaccctaatttgatttccgaatcagtttcgagtcaccatcgttctatataatactaaacagtacaaccgtaaactccgaatcgagatcaatcaaccaaaatctaaacgaatagagatcagggaagaaaacaattacaataaattggatctataaattcaaatgtgctgatccttgagtacactagaaaaagaagagaggagcgaacaaacctgcgacgaagtttattagagatgatcaaattcaaatcgtctggaaaatttgttgttgtgtttggtatttgtctttgattattttagcttcaatctgcaagcaaatctgtcggaaggaaatgttaagagagttaaaaaaaagagaaggactgttgaacacgtgccatgttgacaaagcctaactcgaaagtttggtcagaagcttcctggtgggggttaaagtgataattttgtttaatataggacaaaattataaaactaaagaatagttttgaggctaatttgaatatttcctaaagatatgaactatttttggcaattttggaaatcacgagatttttatg

SEQ ID NO: 36698 - DNA, 3003 bp, Unknown
  misc_feature (1)..( 3003): 2750-1469P.txt file - cDNA_ID_3099394; gDNA_ID_2936573; Annot_ID_194817
tattgatccgccttgggaaaatgcaagtgctcatcagaaatcaaagttcgttatctacttaatgtatgcatgtggataagtattttttgtatctgaaagttcatgaccaatgtttcttggttctttgttttaggtatcctactttaccgaaccaatacttcttatctcttccgatcaagcagcttgctcatgctgaaggagctctcgtggctttgtgggtgacaaatagagagaaattactaagttttgttgagaaagagctattccctgcgtggggaattaagtatgtagctacaatgtattggttaaaggtgagctcatcttgcagctctcagtccccatcttggtttctgagttgcacatatgacttgacattttacatacttgctatgtaaatgtttcaggtgaaaccggatggtacactgatttgcgacctggacctggtccatcataaaccttatgagtaccttctactaggctaccattttaccgaagtaagtcaattcatttttttgtcacttgaataatctgagaaaggaacttctgtttgaacagccatgttgtgtatacatgtcatagcttgcaggatcagaaaagaggtcagattttaaactcttggacaagaaccagataatcatgagcatccctggtgatttttcgaggaaacccccaattggaggtattcttatgtttatattttcaacagctttgttctgcgattggcttcatcaaattcaagagtagataatgcaattttttcaaattcttggtctaaagctcccctgattcttgtttgtttccacttggactttgtgtagatatactactgaaacacactcccgggtctcaacctgctcggtgccttgagctatttgcgagggaaatggctgccggatggacctcttggggaaacgaaccgcttcactttcaggactcgagatactttttgaaagtttagtgggcgcattccctagggtgtaaccaagaaaaaggctggcttgggccctcatgatcgtttttctctatgactcattctcaagctggggacagttaggagagaacccttggaaagaagtggaaggttcggttcatcgcaaacgacatcgtttgaagaagacaacactagagtaagcctgaaaaaagtatagtgttactaaagattattttgtctcagaactgtaccatcaatttagtaagctttttccttttcctttcataaacagatgatgtttcagataaaatttaaatatattatcagtacagtaagattacatactatattagtatcactattctgctattcactagatttctttttctttttcaacaaaatatgaataaaataaaggcaaaagcgtgttaaatataaattcaataagtgactactcgttggaagatcatatctgctttgatgggtctatttgtggggcaaatccactatccagttttccttttgtgttcaatgaactatacaattgtcaaaaaaaaaaaaacatgagaattaaagaaaatcatcatgaccaatgaagagcaggtcccaacaataattccgaattataggctctgattgttatagcaatcaaacaatatgcttacaaatcacaaaacaaaattaacgatatttccaaatatagagctttccagtttgacttaataatgttgtgtgaatatcctcacatttccattttcgactctctttagtaaattttgaagtagtagaatgatgtagaatgttttgttttatcaatcacacagttttgtgaaatcacgatttccatccactattcaagaaaaacatcaagtggaagaaataataaaccaaaaccatcgcaacaaaatgcatatcacgagtatagaatgaacaaactacactgtcaaatacttaatttaggacttaaacttcgctttcagacaacttggttcggaaacttgaccatccgtcatgttgatatacacaatccatctcaaatgtagtagtgaatcactatatcagcatgtgttatcaaacgcaagttgtcactaagatcggagcttctagttcaaaatgttgataagtattacgaaagtacaattgaatataccaattatacatccaaacacgtccatgcttctccactcgagttctctttggaaatctatataatccgtcggtttggtattttactagttgtacgtagtgtctcccctcatatgtattgagtctttatagtttgttgcctcgtatacgatagaaagtaaaggctaaaaaaccatactatttcataaagggtttatttagttaacttttaatctaaaccatgtatcactccattttacgtatattcgttttcacaaataatctactaaataattttgtaatgtgataaaattaaagaataaacacatgatacataaacagtcaggacaaaagtaagcactcattttcttctattcatactatagtgaaacactattttatttttatccatatactatagtgacaaattaatctaatcattaaatgttatgaggctcaaaacaatttgttttcttatttaacatggccgatcccctcataaaccaatcagatggtgtgttttccggtcatactcgtgtaggacccacttcattacaatggccccacatgtctctctatctttttctcctctttataaaatcagctccttttcttacacagatttagagaaacacaacataaaacgtacttcttcttcaaaacgcgaaaccacactgtaagttacgtacaccaccacctatcctcaccattcatcatcgacacgtggctggtttaactcaaatcaacggtgaattctttttgcttttttattttaaataatgaatgaaaagattcttctataattccagcgaagaagaaagaaaaaaaaaagcgtattcctcgtgagcactaacttctcactcattcttcttcttcagctgaatccaaatacccatttccatttttaaccgtggttggattgttttgagagttgaaggaagaagatg

SEQ ID NO: 36699 - DNA, 3000 bp, Unknown
  misc_feature (1)..( 3000): 2750-1469P.txt file - cDNA_ID_3099410; gDNA_ID_2936573; Annot_ID_194818
cataagtgcctaagtggtctgcggaaaaaaaacttatgtattcaccaaaaaggtatttctttgatccagctgatttatgcgtttttttttttccgtctggatatcaaatatcaactatgctagtcttgagtcatgacatccattagcaattgtttaatagaaagaaaaatatttcaaaacaagttaaaattattaatgttaaaagatattccttaaaatatcttaagacaactcttcaccgtggcccgaagacgactggagcaaattccggacacaaagatctcaaattttgacgctttatcaaatttcttacttcacccataaaaatctgagtttttagacttcaacaggacagatctttcttctctttccagatcctaaaatcttcatctcctacagatctgcagaaatggcggttacgtactgattcagatacgggagaagaaaaagaagaaagctttctgctttaacttttcccattactgtaatggcggatcctctaaacggcaagtccttctttatctgtttctcccttttattctccttcactctgcttttcatttcgccgttgtatgccaccgagtctccggttatcgaagatgtttctaccgatgttgctgtgtctgttagcgaaaccaatcgagaagctgttctattgcataatttagaggaactcgttaagaatctgacggaattagtcgctaatctagatgctaagttatctgcaactccattaaaggagaagaacgagatctcagttgatgatgacatcggagaagagaaagagagaggaagggctaaggcgttttcagtgactaaatacagtccgttttggtcggagaggtttcagtttacatcagctgtgaaactcaattccgatgcgacttgtatcaatgtgttgccgtttagagatttcgaaggttcaagcaagtactttgcaattggtgattctaaaggtagagtttatgtgttcttgagaaatggtgatgttttgattgagtttttcaccactgttgattctccggttactgctatggtttcgtattcatctgtgtttaagaactcgagtttcgtggttacgggtcatcagaacggtgcggtgttgttgcatcggattcacgagggatcgaatggcgaagattggaactcgaattcggtttctatggaacatgttgggaagtttgatgtggatgattcagctgatcctgtgactttgttggaagtgcatcatgtgggtcgtgttaggtatatattggcgactgatttaagcgggaagctcacggttttaactgagaacaggacggtttatgggtcggttattccatcgagtagaccgctcgtgttcttgaagcagagattgttgtttcttactgagtctggtgctggttccttggacttaagaagcatgaagataagagaaactgagtgtgaaggactgaaccattcgcttgcgagaacttatgtttttgatgctgcggaacggtctaaagcttatggattcacatccgagggcgagatcattcacgtattgcttcatggagatataatgaacttcaaatgtagggttagatccaagaagaagtttcaaatggaggagccagtagctttacaatcaatcaaaggctatcttctagttatcaacgaagaaaaggttttcgctttcaatgtatcgactcagcattatgttcgtactgcgggtcctcggcttttgttctcagcgggattagaagagatcagatccgcgttcttgagccatcgcgaatcatcttcacgaaccaccacagtagtaaagactaggccgttaatagctagcgacagggaaaaccttcttgtgatcggtttagaaaacggatatttcgctgtttacaaatcgaagctgccaactctcaaaggagacttcaacacaatgctttggagcagtcctgtgttcttcttcatactatttctattcggggcttggcatttctttgccaagaagaaagaatcgctcactgcatggggaccagatgatccttttaccccgaccggcgcacaaaatagttcggcgaaagagccaacatttactgaaccttcaagaagaaacgatgacctcatggatctacggagaaggtacgctggtggctcataccggtcagttggagctaacgacccgagttcaagagctccggttgatggaaactatagaacaaccgcacaggatcataacaattatcgcggtggtggctcgggtcttgattcaaacgggtttggtaatagaagagatcatttgtttggtaacaacaaagttttggataacgaaagttagaatctttggattacttgcaaattctggcacgttaatcaccacttacttcaaaaattgtaatctttgtaactttatataaacgctaaagggttttattattcctcgttcggtttttaactttatataaacgcaagtctcttgaaattttcgaatacaaaaactctggtcaaagaataattgtttgacagctaaaacaacttaatctcaatcatagtcaagatgtgttttggtctatcatgtctcatgtgatcgtgctagcaagtgggtaaataattgagtttaatttttctccttaatctcgatttataatgtgttatgttgaccgtcagatgagtcagcgaaatagtcatgtcatctaacggttaagacttcatcttcaactaaagaatttcagaaaggaatctacatcgtgtgaagtagaggaacattactttcgagctttgattcatcgtcgtcgtcttcggagacgaagccaaacacacaagctctctctttctctcaacaacttcaaaagccggcaggtatgaccgagacctccgaagaaaaacagaacatttctagggtttaactctgatccaccacattaccaaaactttcttcaactaggtgatcaaaaaggagtcctttttcattttgagcttctgggtctttggcttctgatttcgctataaggaagagaaaagtcaacggccatg

SEQ ID NO: 36700 - DNA, 2828 bp, Unknown
  misc_feature (1)..( 2828): 2750-1469P.txt file - cDNA_ID_3099420; gDNA_ID_2936570; Annot_ID_194766
tcaagcgacatctggtttggtattctagtcgttgttctccttatgacagcatggtagggaaaaccgtgacggtttgaaaaggtaacgtagaagtttgcattcgctgccttggccttcatcgtcagcttcggctcccaggtttgcacaattacatatattagctccaatggctttgcccactccactagcttaatagatgcccagtgggagaacaatgtgatttccgcgtacagaagaaacaattcctggtgtcttccatctctgattttctcaacaagtagaatttcggcttattaagcataaacaagagtaagaacgtagtagtaaattaccaaaggtggagccgcccagtctaccgtctggggatcagaacataaatctttgtagatttcacattccggcctttctcccggagccggttgttgatattttggtgaatcgggtgattcatggtcagcatgacagctgtcagttggtgattctgaagagggcaaggatggttcatattcctcctccggtgtaacaaagttgtcatctggatagccttcagattagaaacctcttacacgtccccgctcatatgggtacggtggatcaggaaaaacgacgtatccctcagaagaagagaaaaaacaatttgatgcaaatcatgaaaatcgctggtcatccacaataaaatccgattaccttacgactgctgacggtgcgactataactgccttctcccaggaacattcttggaaaatctcacccaaccctacattcacccgcccaagaacattgtatcgcagaacgatatggttgatttgtgggatgtaaagatcggtaagactctcgagtctcgacaagacttatgtttctgaggaagaactcctcaaaaccatcaaaggtgatcagttaaaccataaaaacagtttctgatatccaatattcatcagtccaaactccaaagtattaaacgagtcacttgcatttgcagagacccagcctccaatggatttttttgtgggtttgatccatacggtccttgcgaagagcgactttacctccttgactatagatccttcttttggagttaagacttctgagctttatcctgaggtcaagtacacaagtactgtcgatgagtttcttaaataatttgtctgaaaaaacccttgtcccttatgttacgtgtagccagtgtttatccgagtttcgatatggaggcaaatcttatttcaaaataggcttcttatttgattgatacagtacattacataaaaaggtccaagtacattatttgactgatataagagagagaccttgaacaacattaccacaccaacgatctcataacggtgcatagtttcaagggttaaccttgggagcccatccagagatcacatacttttcctcggtcttagttttctcaaaagagtcgagcgagaacagagtcttcatgtagttatggacatggggaaagctctcagggacagaccagcttttgaaatggccaagagcaacttgaaggtggtaaagctttggtgctaagcttagatccactgcggaaactctttctccggcgataaaagggccatcgtgactcttaagatggttttccaaagcttctagctcaacaagcaaggcatgttcagatccgtcattggagtctttgctcttcaagaatgtcccaaaagtaccaaaaatgttggatccaacagaggcaaattcagcaggagtcttgagtggtggatcaggatacttctcctcgagtataccaacgatgacgtcggaatcagtcacccacttgtcgtcgatcttaagcactggtactttcccttgaggactaatgtccaagaacctgcatcatatataaaaccaaagccaccaatttcaagttccggttaacacaatgctcgcacatgaagccaatccaatttccggttaacacaaagctcgtaccagttacaagtaaaatttcagagattatggctaaacaagttcaaactagaccgatcttaagggtttaggcgtgagagaaactgaccactggggtttgtcagagaggttaatcagatggattttgtaggtaagactcttctcctcgagtgtgagaagagcccgttggctgaacggacctaaaacgacaaacaaacacttaaattagtaaatttaccaacgatcaaagctcagaaattaagaattgcaaaatcaaaagcttaatgcaaaacaaaaacagagagagaaagagaagatggttacagtcgccgagatgatcaggagcaccaacagcagctttcacacagatttccagagccatcttgattcttcttcctttgtttgcagagacggatgaatgattgagttaatcagtgagaaggcttagcttttaaactgaattattaccattctccacccaccagtgggccatttttacccgatgtttatcttttctcacgtgttatgcgttgcaagtgacgacgatacgaaacgacattgttactgatagggccatttgatttttggtcggcaggttttggaccgttcaatttagtgaaaatatagtaataaattcgtaccgaataatataatcggtttaatgaaactactacctgaaatatcgaattagatttggttcatatttcgtattgttttggttcgattaaaccatattaaaccactgtaactgtaatttattgtttcgccgtcccggaatgttcctgttgaaatccattttcgctgattttttttcttccgtctcttcttcagcttcgaccattttcgtcttcttcattcagtgttgagtcctcgtttacctgtgagctcgaagaaagtgacgatcaatg

SEQ ID NO: 36701 - DNA, 3003 bp, Unknown
  misc_feature (1)..( 3003): 2750-1469P.txt file - cDNA_ID_3099420; gDNA_ID_2936573; Annot_ID_194843
gtacgagagaagtcattaactcataaacttgagtaacacacaacaagcgaaacattgagaaaataaaaatgtagccacaccaccatctggagaaacaactctcaaatcgataaaatgataatacataatgggacgataggatacttgttatttggaacgcatcaacatcttgaattcaagcgacatctggtttggtattctagtcgttgttctccttatgacagcatggtagggaaaaccgtgacggtttgaaaaggtaacgtagaagtttgcattcgctgccttggccttcatcgtcagcttcggctcccaggtttgcacaattacatatattagctccaatggctttgcccactccactagcttaatagatgcccagtgggagaacaatgtgatttccgcgtacagaagaaacaattcctggtgtcttccatctctgattttctcaacaagtagaatttcggcttattaagcataaacaagagtaagaacgtagtagtaaattaccaaaggtggagccgcccagtctaccgtctggggatcagaacataaatctttgtagatttcacattccggcctttctcccggagccggttgttgatattttggtgaatcgggtgattcatggtcagcatgacagctgtcagttggtgattctgaagagggcaaggatggttcatattcctcctccggtgtaacaaagttgtcatctggatagccttcagattagaaacctcttacacgtccccgctcatatgggtacggtggatcaggaaaaacgacgtatccctcagaagaagagaaaaaacaatttgatgcaaatcatgaaaatcgctggtcatccacaataaaatccgattaccttacgactgctgacggtgcgactataactgccttctcccaggaacattcttggaaaatctcacccaaccctacattcacccgcccaagaacattgtatcgcagaacgatatggttgatttgtgggatgtaaagatcggtaagactctcgagtctcgacaagacttatgtttctgaggaagaactcctcaaaaccatcaaaggtgatcagttaaaccataaaaacagtttctgatatccaatattcatcagtccaaactccaaagtattaaacgagtcacttgcatttgcagagacccagcctccaatggatttttttgtgggtttgatccatacggtccttgcgaagagcgactttacctccttgactatagatccttcttttggagttaagacttctgagctttatcctgaggtcaagtacacaagtactgtcgatgagtttcttaaataatttgtctgaaaaaacccttgtcccttatgttacgtgtagccagtgtttatccgagtttcgatatggaggcaaatcttatttcaaaataggcttcttatttgattgatacagtacattacataaaaaggtccaagtacattatttgactgatataagagagagaccttgaacaacattaccacaccaacgatctcataacggtgcatagtttcaagggttaaccttgggagcccatccagagatcacatacttttcctcggtcttagttttctcaaaagagtcgagcgagaacagagtcttcatgtagttatggacatggggaaagctctcagggacagaccagcttttgaaatggccaagagcaacttgaaggtggtaaagctttggtgctaagcttagatccactgcggaaactctttctccggcgataaaagggccatcgtgactcttaagatggttttccaaagcttctagctcaacaagcaaggcatgttcagatccgtcattggagtctttgctcttcaagaatgtcccaaaagtaccaaaaatgttggatccaacagaggcaaattcagcaggagtcttgagtggtggatcaggatacttctcctcgagtataccaacgatgacgtcggaatcagtcacccacttgtcgtcgatcttaagcactggtactttcccttgaggactaatgtccaagaacctgcatcatatataaaaccaaagccaccaatttcaagttccggttaacacaatgctcgcacatgaagccaatccaatttccggttaacacaaagctcgtaccagttacaagtaaaatttcagagattatggctaaacaagttcaaactagaccgatcttaagggtttaggcgtgagagaaactgaccactggggtttgtcagagaggttaatcagatggattttgtaggtaagactcttctcctcgagtgtgagaagagcccgttggctgaacggacctaaaacgacaaacaaacacttaaattagtaaatttaccaacgatcaaagctcagaaattaagaattgcaaaatcaaaagcttaatgcaaaacaaaaacagagagagaaagagaagatggttacagtcgccgagatgatcaggagcaccaacagcagctttcacacagatttccagagccatcttgattcttcttcctttgtttgcagagacggatgaatgattgagttaatcagtgagaaggcttagcttttaaactgaattattaccattctccacccaccagtgggccatttttacccgatgtttatcttttctcacgtgttatgcgttgcaagtgacgacgatacgaaacgacattgttactgatagggccatttgatttttggtcggcaggttttggaccgttcaatttagtgaaaatatagtaataaattcgtaccgaataatataatcggtttaatgaaactactacctgaaatatcgaattagatttggttcatatttcgtattgttttggttcgattaaaccatattaaaccactgtaactgtaatttattgtttcgccgtcccggaatgttcctgttgaaatccattttcgctgattttttttcttccgtctcttcttcagcttcgaccattttcgtcttcttcattcagtgttgagtcctcgtttacctgtgagctcgaagaaagtgacgatcaatg

SEQ ID NO: 36702 - DNA, 3003 bp, Unknown
  misc_feature (1)..( 3003): 2750-1469P.txt file - cDNA_ID_3099425; gDNA_ID_2936570; Annot_ID_194767
atctttattcttcatgcttgcctagcaacataggcgcacatggatttttgcatacgcacatgcatcagactaatattcactcatgtttcatgaacttgattcttacgttcaaaagaccgaagtgataacatacaaagtttgattagacaataatactccctaagaaaccatgaaaaaatgttgaacatagcttcttcaaaagctgtaaatccgtctaccctaatgtactctacctgccatattcaaaccagagaccgaaacataatccccttgagtatctcaccctgtagggcttcggccagaaaacatacccctgaaaaatcagttcacattagaaggacgcttggtttctttatcaggcagtatgttgttagggaggttaagctctggtggagtttctctcactattccgagcattgagtcatactcctcgtcctttagagcatgcttcttgcgtagaaccttctcgaactcaatcacatttaatggctttgcattctctgcagcgtgagcctgtgcgaggtttgagtagtttgttgctgactgagagataaaagcaatttcctcatcagtgagcttcctgaggaaccttgctgggtttcctccccatacctgagtcattatagaccaatgcgaacattttaactctgtcagtcaatatggcggatgaagtaaattttaaggccatgatgagagactaacaccctttggcattcatatgcagataaaccatagctagaagaacatttccactttcatctaactaacatttataatctgttagggcatctgaaaagtggataagatacgttctatccagatagaggagaagaattctcaagactagaaactgtatttcaatttcacaccaacctccaatactttcagccaatgaaagaaagacactaataatgtcaataatatagcctatgctgtctaagtagcaatagaagtatacccgcaccaatggttacttgtgggttttcaggtaatcagaaatgttaaacccaaaatcatacctctccagaaggaattctggtgttttgtcgtacaagtgcaccagcagcaaccatcccatgcttttcaacaacgaccccatcaagaagtgtcgcacccatcccaataaaggtctcatcctcaacagtacatccatgtaaaacagcactatgacctgttacacatttaatttaagactatatcccaaatgcttcttggagatgtatgcatattaaacattttcaaaataaacagtgagtaagagattcccactaaccaatggttacattgtctccaattatggttgggtgcaccttcccgcttaagtttgattttgccacatgcacaagtgagttgtcctgaatattagttcctgacccaacacttacggtgttcacatcgcctgcgcagaaaaaaagagagaaagcaagtttagattgtatgttatcccagtttcctggtaaagtactaacaggcttagccatacagtaccaatgtgttatgacatgaaagcattctgtaaaaaggacaaccctatttcatcaccattaaataaaaatccagactagccaactcatactcgcaataaggattcaactcaaactcaataatctgtatatgatatcgttcaactaattctggtgttatgacatgaaagcattctgtatatgattggggatatcatatacccaatcacccattagagcaactgccagtatcatcaagatacgatatgtagtaatgatctgtttaagatccttcaataaagctagaaagctccattttgagtagtagtcttgttcatcgcttaaccagaagagtaaaaaacagatattcgttcactattttctatcgtaagagttgacacagctaaggatacagaagtagatactatttcaaacaaaacttcagtcactaaaatagtcaaccaccaaacaccaaacattgaggcttagtagctagctcacctcgtaatacgcatccataccaaatggacgatcctcttccaatgtgaacgtccccaataactgaggcgcttggtgccacaaaagcttccttgtccacaatcggagccttatcaaatacattcatcagtgtccgatgccttgacactacacagagaaaaccacaattacatataagcaaatttcgtgaccaggaaacaaaaaaaaaactaagcagcaaaacacattccacatcaattaatcccttgtgccattcgaatccagaatcgctatacctacaaagacatcaattccagatctctaacctaaccagaataggtgagctgaattacccaatcgaaactcctcactctttacgaattcgaaatcggagtgaaaaatagagttacgcagaatcttacgttgttctcggaagtaatttttgccttgaaggcgacaaccgaggcgatcaagagcttgaccagtctcacggatccaaaaaccgaccgagtaaaatgctctgcctagggttcccattgatcgtcactttcttcgagctcacaggtaaacgaggactcaacactgaatgaagaagacgaaaatggtcgaagctgaagaagagacggaagaaaaaaaatcagcgaaaatggatttcaacaggaacattccgggacggcgaaacaataaattacagttacagtggtttaatatggtttaatcgaaccaaaacaatacgaaatatgaaccaaatctaattcgatatttcaggtagtagtttcattaaaccgattatattattcggtacgaatttattactatattttcactaaattgaacggtccaaaacctgccgaccaaaaatcaaatggccctatcagtaacaatgtcgtttcgtatcgtcgtcacttgcaacgcataacacgtgagaaaagataaacatcgggtaaaaatggcccactggtgggtggagaatggtaataattcagtttaaaagctaagccttctcactgattaactcaatcattcatccgtctctgcaaacaaaggaagaagaatcaagatg

SEQ ID NO: 36703 - DNA, 3000 bp, Unknown
  misc_feature (1)..( 3000): 2750-1469P.txt file - cDNA_ID_3099425; gDNA_ID_2936573; Annot_ID_194842
tttattcttcatgcttgcctagcaacataggcgcacatggatttttgcatacgcacatgcatcagactaatattcactcatgtttcatgaacttgattcttacgttcaaaagaccgaagtgataacatacaaagtttgattagacaataatactccctaagaaaccatgaaaaaatgttgaacatagcttcttcaaaagctgtaaatccgtctaccctaatgtactctacctgccatattcaaaccagagaccgaaacataatccccttgagtatctcaccctgtagggcttcggccagaaaacatacccctgaaaaatcagttcacattagaaggacgcttggtttctttatcaggcagtatgttgttagggaggttaagctctggtggagtttctctcactattccgagcattgagtcatactcctcgtcctttagagcatgcttcttgcgtagaaccttctcgaactcaatcacatttaatggctttgcattctctgcagcgtgagcctgtgcgaggtttgagtagtttgttgctgactgagagataaaagcaatttcctcatcagtgagcttcctgaggaaccttgctgggtttcctccccatacctgagtcattatagaccaatgcgaacattttaactctgtcagtcaatatggcggatgaagtaaattttaaggccatgatgagagactaacaccctttggcattcatatgcagataaaccatagctagaagaacatttccactttcatctaactaacatttataatctgttagggcatctgaaaagtggataagatacgttctatccagatagaggagaagaattctcaagactagaaactgtatttcaatttcacaccaacctccaatactttcagccaatgaaagaaagacactaataatgtcaataatatagcctatgctgtctaagtagcaatagaagtatacccgcaccaatggttacttgtgggttttcaggtaatcagaaatgttaaacccaaaatcatacctctccagaaggaattctggtgttttgtcgtacaagtgcaccagcagcaaccatcccatgcttttcaacaacgaccccatcaagaagtgtcgcacccatcccaataaaggtctcatcctcaacagtacatccatgtaaaacagcactatgacctgttacacatttaatttaagactatatcccaaatgcttcttggagatgtatgcatattaaacattttcaaaataaacagtgagtaagagattcccactaaccaatggttacattgtctccaattatggttgggtgcaccttcccgcttaagtttgattttgccacatgcacaagtgagttgtcctgaatattagttcctgacccaacacttacggtgttcacatcgcctgcgcagaaaaaaagagagaaagcaagtttagattgtatgttatcccagtttcctggtaaagtactaacaggcttagccatacagtaccaatgtgttatgacatgaaagcattctgtaaaaaggacaaccctatttcatcaccattaaataaaaatccagactagccaactcatactcgcaataaggattcaactcaaactcaataatctgtatatgatatcgttcaactaattctggtgttatgacatgaaagcattctgtatatgattggggatatcatatacccaatcacccattagagcaactgccagtatcatcaagatacgatatgtagtaatgatctgtttaagatccttcaataaagctagaaagctccattttgagtagtagtcttgttcatcgcttaaccagaagagtaaaaaacagatattcgttcactattttctatcgtaagagttgacacagctaaggatacagaagtagatactatttcaaacaaaacttcagtcactaaaatagtcaaccaccaaacaccaaacattgaggcttagtagctagctcacctcgtaatacgcatccataccaaatggacgatcctcttccaatgtgaacgtccccaataactgaggcgcttggtgccacaaaagcttccttgtccacaatcggagccttatcaaatacattcatcagtgtccgatgccttgacactacacagagaaaaccacaattacatataagcaaatttcgtgaccaggaaacaaaaaaaaaactaagcagcaaaacacattccacatcaattaatcccttgtgccattcgaatccagaatcgctatacctacaaagacatcaattccagatctctaacctaaccagaataggtgagctgaattacccaatcgaaactcctcactctttacgaattcgaaatcggagtgaaaaatagagttacgcagaatcttacgttgttctcggaagtaatttttgccttgaaggcgacaaccgaggcgatcaagagcttgaccagtctcacggatccaaaaaccgaccgagtaaaatgctctgcctagggttcccattgatcgtcactttcttcgagctcacaggtaaacgaggactcaacactgaatgaagaagacgaaaatggtcgaagctgaagaagagacggaagaaaaaaaatcagcgaaaatggatttcaacaggaacattccgggacggcgaaacaataaattacagttacagtggtttaatatggtttaatcgaaccaaaacaatacgaaatatgaaccaaatctaattcgatatttcaggtagtagtttcattaaaccgattatattattcggtacgaatttattactatattttcactaaattgaacggtccaaaacctgccgaccaaaaatcaaatggccctatcagtaacaatgtcgtttcgtatcgtcgtcacttgcaacgcataacacgtgagaaaagataaacatcgggtaaaaatggcccactggtgggtggagaatggtaataattcagtttaaaagctaagccttctcactgattaactcaatcattcatccgtctctgcaaacaaaggaagaagaatcaagatg

SEQ ID NO: 36704 - DNA, 3000 bp, Unknown
  misc_feature (1)..( 3000): 2750-1469P.txt file - cDNA_ID_3099430; gDNA_ID_2936573; Annot_ID_194840
cagaatcaccaactgacagctgtcatgctgaccatgaatcacccgattcaccaaaatatcaacaaccggctccgggagaaaggccggaatgtgaaatctacaaagatttatgttctgatccccagacggtagactgggcggctccacctttggtaatttactactacgttcttactcttgtttatgcttaataagccgaaattctacttgttgagaaaatcagagatggaagacaccaggaattgtttcttctgtacgcggaaatcacattgttctcccactgggcatctattaagctagtggagtgggcaaagccattggagctaatatatgtaattgtgcaaacctgggagccgaagctgacgatgaaggccaaggcagcgaatgcaaacttctacgttaccttttcaaaccgtcacggttttccctaccatgctgtcataaggagaacaacgactagaataccaaaccagatgtcgcttgaattcaagatgttgatgcgttccaaataacaagtatcctatcgtcccattatgtattatcattttatcgatttgagagttgtttctccagatggtggtgtggctacatttttattttctcaatgtttcgcttgttgtgtgttactcaagtttatgagttaatgacttctctcgtacatccccgtctttcgactacttgttgctgtaactttgatttgaatgtcaagagtgttcgtcctttaatttgtcctagttgcaagtttttcagagatggaagaaaagccatacgaggaacaaccatgagaattgcattacagaatgtgagggtctcgagcgatttgcaggtgtacaagcaaattggcaatgtagcagatttgttatgatgagaagaatattcaacgcatagtttgatatcttctggttgaaatggtaaagtacaaaacttgagacgcaagctttctaaaaccggaactctatgtagtggcaatgtccttttaattaaacgtcgtaacctccggagattggacggtttagtgtcacgatcatcatgctcgagcttctttcacagcagagtgaacagttacgtacagagaaaaacggtgcaaaagaaattgatattgtggaaggttgggggtgagactttactactgactaggttatttccatatctcgaacgtcgttttatttttttgaatatactttctggtcaaagtttgtattcgatgtctttctgggaactaaaatgtgttttgggaattaaaatgtgttttgggaactacaaagagaacttaaacacactaagttcattcaattgtaataaacacgaaaccttaatcgcaatttggctgtgtagaaacataattaatggcggctacattttgttaatcgtcaggagaacaccatgccgttttcgttttggctagctagtctaagaaaatttaggttgaagtttgttttttcttcttcttatttcatggttgatcctacactctctttttttgtcatttggagttatttttgcactttttatttttatttattttgaatttaatatactttttaaagatctttaaattttttttaacgtatctgaaccaaagaataaaatttttaatggggcagggggcttccacttcctcttagttaaacaaagaataaataagatgtattcgtttaagtctatattatcctcaatattaagacaagcataattctatggaggtcttttttcatctaaacaaagtataactcaatatagatattttttgtcgaaaggggaaactcaatatagtcactctatatatataaactgaaagctatcatcgttacataaaccaaaacataagaaaattatatacaaaactagaagtaaaagcatagatttatttcatctatggaaatactaaaaggaaatttactcactagtaaaaacgcgtgggctaaaatgtgacggctgcaatctaggtaaagactattatagcgatgggtatcgttgctttcgttctggattcttctttcatagccaatgcgcccactccaatatagagattcataacctctatcatccacaacattctttgtttatcaaagtagttgcagaaaatgaaaatgttgatgaagaatgcaagctttgtagaggtaacttgccaaaaatatattattattgttctacatgtgattttgctatcgatttgatatgtgcaaaaaaagaagttaaaataataattcaaagtccagaaacccacgagcattgtttatcccttattccgaagatggttatgtttaattgttatctatgtggacggcttgatgatcggttcccttatgtatgtaccttatgtgatttgagttttcacaaagattgcgccgaatccacaccagagatcaactactcttgtcatcctagtcacattctcaagcgtttcacgcgtgttccaaattactcagatggaaaaatgtttatgtggaaacaaacttcataacgtgttctatagctgttctatttgtaattttagtgtggatgtggattgtgcaaagaatccaccccctttcactcttgttcaacctaaggctcataaacattcactcactcttatgccgcaaagaacttttttttgtaatgtttgtggactggatgacgatccaaatccttatatatgtattccatgcaatttcatgatccatcggaagtgtgttgacataccacgcgtcataaagatcagtcgtcatgatcatcgtattcattataatcattgtcttgaagtcggaaattggaactgtggagtgtgtcataaagagataaaatggacacatggggcttattcttgtttgaaatgtcctaattttgcttatcatgtaagatgtgccacaaggtccgggatttgggataggattgaactcgaaggcataccagaaaaaattgtagaggttagatcatatgaagtgatcaaagaaggagtgataaaacatttcagtcacaagggtcatactttaaagctcaaagaagaaagtgataatg

SEQ ID NO: 36705 - DNA, 3003 bp, Unknown
  misc_feature (1)..( 3003): 2750-1469P.txt file - cDNA_ID_3099434; gDNA_ID_2936573; Annot_ID_194839
atttactgcttctttttagctatgagatttttcttataatccatttccaagaagaactcttttctgaaatcaactttctatttggtttctcaacattttccttcgtttcttccatctgaatgtatttttcatggaaacgatcagtttcatttcgtgtccgaaaagttattatgtttcctctttcatagagaaacatataaataccataggttctctcttttgaacattctcctctcggatcattacaattttgccaattattgacaaaatcgcctaaaccgatcacagtgtaggccgggacaagattgatttttattaggaaaattaaacggatacttgaatttaatttcttttgttaactaactttgtttctttgtgatctcaatttccttttgacgtatacctcaactttgtaaaaagcgaacatacaatttcttttatcaagtagatataacttcaagaaattcgaagagataatgtacatgtgtgaattgtgatgtgtctgccacgcatcgtacacgtgtcgctgtcagcaatgaaaaagtcagaacaatccattaacgagctaagacaaaaacaaaaagtgttgaatccagttgtttatgcaagttaagccgactaatttagtattgttatgcagctaaatctgttttggatcgaagtgtccatcttaaacaattttccaaggttatctcctcgttacgtttgatatcgatcgttccacctcaaagacgaaacttcggcatcatcttttgtcatgttttagtttgtatccttgtataactgtattgctttcaagaaatttcatatttcgttgtctatctaaaactttggaatcaggaccaaacgaaataaaatgggatccaaaactacagatgaatttactgtactaaaaataataatcgtagtcgtcgtaggagacaagataaggttggaaagttaatatcttctctgtctatagattttaataatttaatcaattccactacttaaatcagtgggctattaccggagttttccaaagccaaatcatgggatttagttttctcaagttatacgaacttggaccgaatagccaagtaaatatataatattaataaactaaacacaaatttaatatctttgggggataagaattatctagatgacttgcatactttgcatggagcactatatatagaagaatgttaacacatgatcctaccgacattaatgtttactaatcagaaaatcaaaaggacaattggaaaagattaatagcaaatgggttctttaatgtcaggatgggactctcgagtaagggatcccaaatcaggtaactaatatcatcatgtatattatattttggattaatattcatgcatgtatgagattatattgtatgtttgattatacaatagaaactaaaagatgatttttaacataaattcagtgagaaggtgcaagtcgctcacaagagaagaaatcgacactttttggaaaacgaagaagaagaatgaagaagaagaacatgttcaagccttttccaagttggtaactcaggttaaaaccaaactttaaatttatttatttcttatttcccaaggaaagagacaatatttctactatcagtgatcttagtgaaaatcagagttcgactttaaaatttaccaaaaattattaaaatgatctaaaaaaggctttgaaattgtttgcaggaaggtgcacaaagccaagcgaaagagaagaagagtgtagatgatctttttgagaaccaaagcaagagtagtggatggtaattttttttttgtgcaaaaaccaatctcgtaactaagttctttaagagatatttgaaatgataaactgatgtggttggtcaggtggagaaaaacctactgggcgttcttgaatgagccgagggaggaagagggtcgaccgaacaactacgtgtcgcaattcaaagttgctcacatcgccaaaattgcgggctcgtaatgacgctataatcaccggctaatcacatatatatctcgtgtgaaatgcgattagtcgtctgccgttgtggtttaatcaccggctaatcacatatatagtatgttggccgtgttagtatgtgaatgtgtgagtagagcatgtaacaaagggtgtacgattttaatgtaagaatgtgttttactttatatgtgtcatgtatgtatttttttggttgtgtgagggtgtaatttacttttcaatggatcttcttaagtcttttccttgatgaaatagcgtgtgcttatgaattacgggagtcttgtgcatgataaaaaaacaaagatcaataataggtgatcatgaagacttttctgtttgttgtttccaaataacatttttacgccattcataacatttgtctaatctttatttatttttcattttaggaaagattgtctaaaattttgttcatatgtaatcttacgtatacattgataatacatttcatccaatttttacaatatatgtactcacttacaaatttcatatagtttacaaatttttataagacacgaagaacaaatatatgtaaactaaatcacaatagtagtggagcatatatagtagagcaaatttgttggatatgttaaaaggctattatatgtatttaggtagattgttagtaacttattttgaattcttttttagaaattgtggtagttttcttaattttccctactaattatgtgatttttaatatataaaaataaaaaagttttgttttgcagtttctggatttatttgtgatatcctataatgatataattatgcaatgtcaccaaaaccaaaaccaaactctaaaagtgaatcatcaatgtgaatgcaatagctgtcacactctgtgtctgtgggtcacaaaagggtactttggtaattatataactcggggccgttcggttcccaccgaacgaaaatataaaaccgatcaatctgagacggttgattactctcacttcagacttctcttcaacgaaactagccagagagatg

SEQ ID NO: 36706 - DNA, 3000 bp, Unknown
  misc_feature (1)..( 3000): 2750-1469P.txt file - cDNA_ID_3099465; gDNA_ID_2936573; Annot_ID_194829
cgtatcatatttaaaaaattacttaaatgtttcccaattcattcatctgtaaataacactctgtttttctttttttttaaaaatatatcttcaatgaattttagaaaaaagagagaatgacttttgtggagatttttttttttttttccaatacatatattttattcaccaatacaacatcaaatgtcatctaaatttatgttttaaaacataatgttattggtaaacattgaaaatgtcatctaaacttatgttttaaaacataactagatcataactcgtgctatacagcacgaacattaatattttgtataaattaaattgtatactttattatgtttgctatgtttgtcaaaattatttgttatatttgtcaaactttagtaaaatatatttaaatataattaaatttattaaaatttaataaatttaaaagtttttgttgtttggagacgcattatctacatacaaaatacctgtttctattttttgagtatttttagggcctgaaactttttatccaaactgacctaaacccaaatggacgcgatccgaaccgaatatttagaattattctattaggtagtaaatcatatacccattaatcccaaatccgaacgggttatacccgaactcgaatgggttactcatatgcctagccctattctctgatttaattatctaaaaaatcccaataaaacatatgttttggtgactactttttattcaaaaaaatttacatcttcttctgccaaaatcatttcataagacatcccaaaacccttggaataatgattccatgaatgaagaatcctaatttgaatataccaagaggttttgaaaggttttaagtttttgataggtgtgtatgtgagatggtacatccatcgtgatggtaatcggcttatttataattttaacttgcattatacagcaggtagtcttatattttagttaaactaaaaacttttattgtaaagttgattataaatatatgatattattttatttgattttaaatgtatagtaaactgcgagttgtatatgttttgttgatattatttatattgtttagtgtttaaaattatatacttgtattttgattgttaattttaaagtttcacatatagtatatcatcttgtattaatattgatttaaacccgtcaattgtaggatttttcagcttgtattaaaaattgaatcacatcatacacattaaaaaatctaatatgttattaattattgtagtatataagattataaattttaaaataatatgtatgaaattgaatataaatattcaaactatgacacagtactcagtaaaaaaatttcttaaatctacttttgacccgttatagtattttttcatgtattgaacagtttatattcgtttttaaaaattcaaattgtggcatatgcgaaaaaattctaattatttttttataacgatgatattatttttttgcaaaaatagaatcatataaagatgagaggtgaactataataattaataaaaaattaatatgataatttagatatcaaatctaatttgttgattttaattggttacttttttggaaattaataatgtatttcgtttttgagttaaatttaattaattaaattagtatttgacttttaatttttaaagaaataaattaatttactctttaaaatcttatttctaatgacatacctatgtaattacttacaaaaaaataaagttatatttaaaatgtatttcctaaataatatagtaggatgttattggtaaacattgaaataacatgtcgtattctcaaagattttaaatattgaaaataaataaataatgttgtatctgaataaatatttatatttattgaagtattcgaaattaatgacatccatatatttttcatatactagaaaacaaaaactataattattcgagtttatctaataaaataatgtcacttgcatatttgtgacctatcgacatcaatatcaacgaggtagcgaaaatgctaaaaagtagaggaggattcgagcattatattcatatttaagtgttactttaataatcttattatttgtcctaaattgaagttttagctaaattttctcccacaatattgttattctgattttgttaagagttaggacaacatctaaatatgaattctataatgcatgctaactattattataagtgctaaaatataaaatgacattgtcactttttgttgtcaaaaggaatgtctagtggcctcgtattctaatatgggaagttttaattattattcctaccaaaaaatatctttgaagtagacagtttacctaaacaaaaagaaaaacattttcttaaaaatacaatatagtttagtctcagcctgtaccacaattttatagtattgttgcgtaattagttacattgtaaaagctcattataatactaatgagtatgtagaagtatgtagaagaaaataaatgattcaaagcgactacaaatgcttgtatatgtgagcgaacatgggacaatgattcaaaaaattatctttgcgcaaaaaataactcgaaaacgacaatcagacaaaaaaaaacaatagttaaatttgatataaaagaatttaaaatgaacgatatcttatttaattacaaattaaaatgtttttaaattaagtttttttttgtcgacagagaagaaaaaaaacaggtccctttacgaattctataaatcgatgttaggcgacgcgttctgaggtggaaaactatgaaacagtctgcgtctctccacgcaaaggctcaatttttacaaaccatgaagaattcttaagcaaaacaagtctaacatctttttgaattcacccaaaactcaaatcctacctcaaatttcgtatttttcttcttctgcattttctagtttaggatcgacatttttatcctccgaaagattcgtgcttttttctctctgtagattacgattgttttgtagatttaagaaaaacaaaaagatg

SEQ ID NO: 36707 - DNA, 3003 bp, Unknown
  misc_feature (1)..( 3003): 2750-1469P.txt file - cDNA_ID_3099470; gDNA_ID_2936573; Annot_ID_194828
gcaagcagcacaatgaatggtatcgaagactccactaggaaaaggaagtcttctacttgctaaagagctgacaaaagtaggaaacccgcgctcaagagcgacctgtgctaagtcgactagatcgtcctttaaacctagagacaccgtcaaaacatccttatccagcaatgcagctacaaaacttgaatctgagcatccaatgtccaacactatacgaacattcttcccccattcaatatctggtaccatctatcaaacaccaatcatgtttttatctctaacacagaacttgtctccaatgaaaagccaacttcagagagtaacaaatgatactcacctcttgaatgaattcaaggtactgtagaacatttccgttgaacgtagtctggttctgtggaaaagataggtattcaccggtttcattcacccaattatgcttcttaatatacgcagccaacttcggatgtgccacgttcttatacaatatctgatgttaataaataaaaaagacattagatcaaaagaacttgaaccaaatatctcaaagaagctccaaaaatttaaaccttagatttgctttcaggccaggaaacaggaggatcatagccatcatgtggaagaggaacaagacacataactggtttcttaggacaactcctctctctatgtctataactctgaagcctccctattaacccatcattatcaatacatggcatgtaattgtgcttgctcctagtgttacacaatctccagctatactcagctttaggatcaaacaccggacctttcctcttcctctttttacttatctcgtttacagttacttcctcattcttttcttccacttcttcatcaactgatgcacttgaatcatccacacttccatctccatttccatcagattctccttcattgccatctgactcagttccttcttctccatcttccttattagactgatcagaatcgtcagattccgcctcttcatgttcttgatcctccttaaccacaacttcttcaaccacaggctttggcacatccttcttcttatgtggatgagacacagcatgctctttctttttcttggtttcatgtttatgaacagacgaacctccaacttttttcccctctttagatttcgaaccagattcaactttacctctctcatgtaatttgctagattcagacacctcatgagctgacttagtgcgagatgacactggctcagctatgtcgtcgaagctttctctctggacattaaaggtagaagcagaggaagataagaaggaccagaagaagacgaagcagagacccaaaacaactatgaacgtcatcttcacccaaatccctcgtggctgtttaatcctacgcgcgaaataagcaatccccatttctcgttttctctccatcatttttaaaatcttaaagaaaccacttttaacgcaactgaacaacagagatctgcaaagaagtactttaaccaaacttgagataagctcggaggccaagaatttgatcaaaactaagcaaactctgggagctaaatcaggatctccgcaagtaaggttcttgagcacgatttagtaggaatttgcagtacccagattggaaaagctgctaaaagaagaaaatttacaaatctcagatttctatcacgggagaaaagaacgaaacacagtagaaatttgcagtaccccaaatcgaatcgtaaaaatttaagcttgataatcaatcacataactgaaaattacgactcttttttaagctaacactaataatattatcctcaatgcttttttctcacttttttccttgtatagttgaaagttgaaaaagaaaagagaagaagaaatgggaaattctggcttttcacttttggtaataaataataactgagaagtggtcagaactcagaagttggtcgggtttcggaaaagtgccaacaagagagtcgaaacagccggaggtgacggagaattttaatttttggtctctctttaacagatcaggcattaagcccaaatggatttgaagtaaatcagcccaatgggctcattacggttgtacaatatacatgaatgttgattactgtataggtaataaatacacagtaatgcatcatttcatcactgttgttacttgttaaaattcgaaagagcataatagaaatctcaacttccaatgagatttggattccataaattttgccacaatttatttagaactcacaacaaagtcaacattgctgttaactctagatatcttgcttcaattacaatagtctttacatcctttaaaatctttcaatttttttctttattcatacattacttgttctgattttcccattatactactcctttctatttcaaactcttgctttctgtcattagcaaatagagaaagtgatttcttaaccaaacttacaaaattggaacttaacaagaaagaagaaagttcgttttgttcacgtataaaaggaacatgctgccattttaggacaagtttgtacatttttaaaattttaaaaacttttacaattacagaatttagctaataattccgacatgctaaaaaaactctttttactattttttttttaagaaaaggaaataataaaaacagctcgtcatgatgcataattatgtcaagattcgtttcaaaaaaacgtggacccctaccgcctcctcctccactactactaccaccaccacctttggtttccgtttctctgtatattcattcctcgaaaccctccaaaaacccatttcaatcaatttctcgcttttgccctctacgtttctcgtcctgggtttctcaaatccagctcagtttattccccaattcaataatcaaaactctgtcttttggtgggtcttcgtcaaagctctctcctttacggtccttttctccagcgcatgaaataataaaggacacctgtatttattaaaatcactacattttccgtaacaaaaaaaatcaaactttgttttctcaatg

SEQ ID NO: 36708 - DNA, 3000 bp, Unknown
  misc_feature (1)..( 3000): 2750-1469P.txt file - cDNA_ID_3099474; gDNA_ID_2936573; Annot_ID_194827
cctcttcgcatccttcccttcgcttcaatgtaagccaattcataccaaatggagctcgaagatgtgttaccaaatcgatgaagagtcatcctcgaagcctcgacatgaactggtgaaagctgcagattcttctctaactcatcgatcacagctcttccaccagcatggatacagaaatgctcgaaagcaagtttgaaatccgggatatacggtttcactttaccgttaaagagcttcttcacaactagagtcataaagaagagaatctgctcacttatcggtagaacaagaggacccaatgtagtgatattggttttgagagtttcccctgcaatcgccattagatctttcgacaacgaaaccccggttctccctgtatcatcctgctcttgataaacacaacggaaagctttatcatctgctccacggtgagtcctgactacatgtacaagcctgtacttagaccgtctcttgtccctcgacttgttcgatagcaaaaccgcagagccaccaactcgaaacaagcagttcggtatcaacatcgatttcttgttaccaaaataccaattctgagtaatgttctcagtagaaacaacaaccgcataagtgttcctatgtaccaacaacatgtctttagcaagatccacagcgataactcccgcgctgcaacccataccgcctagattgtagcttctaatgttacctctaagcttatacttgttcacaatcattgcagataacgaaggagttggattaaagagactacaattcacaacaaggattccaatatcctttggtttcacattagtgttagcgaaaaggttatctaaagcaccaaacatgacttgttcagcttcttctctagcagcagccattgaaattctcggtggaacataatgcatagcttcagggacataagtgtcttcccctaaaccagaacgctcaaggatcttgcgttgaaactcgagagcagagtcatcgaaatctccggtgagtctagaatgttccatgaaccgagcgtaaggagctttgagatgatcaggtgggagataacaagagaaatcaaccaagtaaacgggtctaggtcgggtcataacataaaccgttaacccgaagactagaatcgctgaacagatgatgatactaaccagattgtattgtagatggatccagagctgtttgagatcatctgggttcatctgagaggcttcgacggagataacaacggcgagagggaataaacagagagtcaagagatttgagattaagtaatggtaacctaatttcacatacttgagattcacgctctggagaaaatccggtagcatccgtgtttgtcggatctgaactccaacagaaccatcaccaccaccatcaccaccgagtcgtgattctccggcaccgtccattgagaaaacaaagtttgattttttttgttacggaaaatgtagtgattttaataaatacaggtgtcctttattatttcatgcgctggagaaaaggaccgtaaaggagagagctttgacgaagacccaccaaaagacagagttttgattattgaattggggaataaactgagctggatttgagaaacccaggacgagaaacgtagagggcaaaagcgagaaattgattgaaatgggtttttggagggtttcgaggaatgaatatacagagaaacggaaaccaaaggtggtggtggtagtagtagtggaggaggaggcggtaggggtccacgtttttttgaaacgaatcttgacataattatgcatcatgacgagctgtttttattatttccttttcttaaaaaaaaaatagtaaaaagagtttttttagcatgtcggaattattagctaaattctgtaattgtaaaagtttttaaaattttaaaaatgtacaaacttgtcctaaaatggcagcatgttccttttatacgtgaacaaaacgaactttcttctttcttgttaagttccaattttgtaagtttggttaagaaatcactttctctatttgctaatgacagaaagcaagagtttgaaatagaaaggagtagtataatgggaaaatcagaacaagtaatgtatgaataaagaaaaaaattgaaagattttaaaggatgtaaagactattgtaattgaagcaagatatctagagttaacagcaatgttgactttgttgtgagttctaaataaattgtggcaaaatttatggaatccaaatctcattggaagttgagatttctattatgctctttcgaattttaacaagtaacaacagtgatgaaatgatgcattactgtgtatttattacctatacagtaatcaacattcatgtatattgtacaaccgtaatgagcccattgggctgatttacttcaaatccatttgggcttaatgcctgatctgttaaagagagaccaaaaattaaaattctccgtcacctccggctgtttcgactctcttgttggcacttttccgaaacccgaccaacttctgagttctgaccacttctcagttattatttattaccaaaagtgaaaagccagaatttcccatttcttcttctcttttctttttcaactttcaactatacaaggaaaaaagtgagaaaaaagcattgaggataatattattagtgttagcttaaaaaagagtcgtaattttcagttatgtgattgattatcaagcttaaatttttacgattcgatttggggtactgcaaatttctactgtgtttcgttcttttctcccgtgatagaaatctgagatttgtaaattttcttcttttagcagcttttccaatctgggtactgcaaattcctactaaatcgtgctcaagaaccttacttgcggagatcctgatttagctcccagagtttgcttagttttgatcaaattcttggcctccgagcttatctcaagtttggttaaagtacttctttgcagatctctgttgttcagttgcgttaaaagtggtttctttaagattttaaaaatgatg

SEQ ID NO: 36709 - DNA, 3003 bp, Unknown
  misc_feature (1)..( 3003): 2750-1469P.txt file - cDNA_ID_3099479; gDNA_ID_2936573; Annot_ID_194826
tatccttaatattaagacaagaataattctttgagtgtccttttcaagtaaacaaagaatataacttgatatagattatttgatggagtataaaagaatatctatcatcgttacctgaaaccaaaacataagaaaaccatacacaaaactaaaagtaaaagcatagatttatttcatctatggaaatactaatgaaaatttactcactatcactaatgtgacggctgcaatcaaggcgaagattcttatagcgatgggtatcgttgtttccgttctggactcttctttcataagcaatgctccaactccgatatagagatccataatctctatcatccacaacattctttgcatatcaaagtagttgctgaaaatgaagatgtacatgaaaaatgcaagctttgtagaggtaacttgccaaagatgtattactattgttctacatgtgactttgctatcgatttggtatgcgcaagaaaagaagtcattcttacaattgaaagtctagagacccacgggcatcgtttatcacttattccaaagatggttatgtttacttgttctctatgtggactgcttgatgatcggtttccttatgcatgtattaaatgtattaaatgtttggtttcataatatttaacttataaatttgtatacctgctatctcctctttcgtttaaatttaaactttcttcgttattaaatattttatttttatagtatattttagaatgttgagtaccccatttctcaaaatatattatgggtatttctactgcaatgtatagaaattttcatcatttaaatttattgaaaaggtttctttgaaaggaaggaaaatcgaatttataatttttaaaaaccttgtgctggccgtaactcaaacactgtctctgcgggtccatcatcaagcaagggatctaattcggttcaggcaaatcacatgttcacaccaaacagcgttacatctcccggtttttgttttcaacatgacaactcaagctcccctcgcacctgcagatctcgttgggattagtggtctaaacgatgatgattggaaattgttacaacacatgcttgcagagcgcaagaacaagtcaacagaacgtctctccggtaagtttttctttgaatcatggatcattgatacaagcgcgtcgaatcatatgacgggtacacttgagtttttgcttgatatacatggcatggcacctgttttgataaaacttccggatggacggttcacaacctccacaaaacatggtcgtgttttgatgggttcttcattaagtctccaagatgtgttctttgttgatgggcttcattgtcatctcatttcagtatcacaattgactagagacagtggatatatgtttcagataactgacaaggtttgtgttattcaagaccgcatcacgaagacgctgattggcgcaggtgaacagcttaatggtctttatttctttagaggattgggagttgcagcgcctgttcaacacaaagattctacacccatcgatgtgtggcatagacgtctcgggcatccatcttctaaagctatggagatgttgaaattctcagattttagtagtagtggttttgattcaaaagattgtgagatttgtattagtgccaagcagacaagagattcgtttcctttgagttcaaataaaacaagttttgcttttgaattgattcattgcgatctatggggtccttatcgatcattctgcttgtgaattctcgcgacgatctctcacgggctggtttatacaactaggtggttctcctatttcgtggaagacaaataaacatgatgtggtctcacgttcttccgctgaggctgaatacagggccatggctgacaccttcagtgagttattatggatccgtcagttactaaatgttttaggaattgattgttcacagcctatcacactacactacgatagcttgtctgcaatttaattggctgccaatccggtttatcatgcaaggacaaaacacgttggccgtgatgttcatttcgtccgtgacgagataattcgtggagtagtaaagacaacgcatgtcaatacaaagtctcagctcgccgatatcatgactaaagctcttggtcgaaaggagtttgaagagttcctttgcaagctaggtattgggctatatgggcctcgtttaacttagtccatatcttgtaattaggttaagtcataagactaatgtcttctcttgtatataaggcaacgatcatgtatcgtagcaaaataaaaaaatcttttacatcttctgggtttcttgacagtttttaaatttgaaagagctaaatttatacttataaaatggaaaaaactcatgggcttgtaaccattggaaatacttttagaactttttttcaaaaataaaataagaaaattggctttgtagaagacaaggcactcaattaatggcggcccatattttttaaatagcccaagagcacactatgccattttcgttttaggttccgtccaaaaactaacaatatttttgtcgaagtttttcattttgatcttatactctttttttgtcatttggagtttttgttacatttctttttcttatatctgttgttttttaacgcaatttattttgattctagtagttaaatcttgtattcattttttaataatccttttggtaactcaaaaataaaaattaaattgaaaaaaaaaaaaaattaacctaatttaacatgtttatcgtgtatgccaaacttattttgaaattgggatgtcatcctcttagttacacaaagattaacctacttcgttaagtcttatattatccttaatattaagacaagaataattctttgagtgtccttttcaagtaaacaaagaatataacttgatatagattatttgatggagtataaaagaatatctatcatcgttacctgaaaccaaaacataagaaaaccatatacaaaactaaaagtaaaagcatagatttatttcatctatg

SEQ ID NO: 36710 - DNA, 3003 bp, Unknown
  misc_feature (1)..( 3003): 2750-1469P.txt file - cDNA_ID_3099497; gDNA_ID_2936573; Annot_ID_194822
tgaatctcacatggataataagtgacatatccagaagattatgttcaatctttgactactaaagatctaaaagttgtataaagcaattcttatacgaatgtgttattagataaaataagttataattaattatttctgaaacttcaagacttgaagtctctttgtgaatataactcacattgttaagagaatatctatgatgcagagatggtaaaacagacgcttaaacttttacgcaagtattgttgtcctgtagacacaatattttgaaagaaattttgagaactaatataaacttaaatcgagtgtttttcaaaggctaagaaaacatatgagttatcgatgataagtaatactcatattctgaagtgaatataagatcttacatagttagtcaaatttaatatcgtttatactagaatataaaattttaattattatctcgttattgttttattaacatatgattgattattaaaatacatagaagtaattttgattataagatctcattaagggagtaactgataagcaatgaaaagtaaattagaagttttgaaagaactagaagtttcaaaagaactaaaagtttcaaaagtatatttggcttaaccggattggtcatcctggtttaatgatgatgtgaaagtattgagaattatgtggacattaggtgaaaaaccagaagattctccctaatgatttatcaaatgttacttgctcagaaagcaatatgataatgtgatttttaccagtgtaagtaatttgaactttatctattcgtaagtatatacaaggagatgattatgggttgatcacccactatatgacatttagatacctaatggttataaaagatgcatcgattcaatggacgcattgactcgattgttgcatcgacaagaaggtcatatttatccttgttataaacctgcaacatagagtttgcgagattactttcttgattaaagtacaagagtatttcagtgtttatttataataaccattattggatatccgttgggataagtgtttaacattttgaaattcatgttcatacacaaaatggtttagtaacatcgatacgcatcaagccaatgaataattaatagttttccccattattattggttttgggtcagaaaccaaatagttttcatctaaaagctttgaatgtgaaaagtgctccaccacagcacgcagagatgaaccctcaaaggaggataagaatacatgttggatatgaatgataactaagccatcctagaaggatttatataccgctcgttttgaagactatcatattatatagtcagctattccaacataatggggagaatgtatacagctggtgaaaaagataaatagaaatgaattatcaatgatcctcggagtaaagaatgtatattaagagtccaaaagataattcaattacagaatttagcattgtaattgccagacgcatttgctaacccaaataaagtgatgaagtcacttataccagttgtaaattaaatgctccagaatataatgaatgtcctgtaaggaccaattttaaactgctattgagtcttaagatcgcatgaaacgtaatagaccttggttccaaatataaatatcctcgtaaaagtgaaggagcacaaaattaagaatgaccaaaattgaggaaataaatattttgatgatctcttgaagagagtgaatgatctctaaaagagacataaacatgacaaatgaaacattcaagtacttgacaatgacgagatctagctagctatgtcatgtcaaaatataatggaatcaaaagcaaatcgacgtcgtaatatatttgcatgctatgagcagttgatattatagacaaaaagaaggatcatgaaagaaagtctattgaaaagtgtacacaaagtaatgattagccaaaaatggaaaagaagaaatagacatataattataatctctagtagagatatttggactagtagtctatgcacatgatgtgtaaaacgagtggaaaataaatgagtctttatgtgaaagaatagtgaaattaatgagattttcacaaagataagaaatgtattatgaagagatatattctcttgtggtggatataatatttttttttaagtatctaaagtctgacaataagagacggaacactggatatgacatttatatgaaattcttgaaagatataatctctgaaggattaattatatgagaattatgttctctagaactctactcgatcgaataaaaagaaatatataacatggcatataatcatataaatgtatatttatgttgagtttgtcaaaatatattgatcaaactaatatttgttttgaaaatcattaaaactcctacagagttatcataagtaatacgatgacaataatgtatgataaaatatcactagataatgatatttataagtctatatgaaaaccaattaattttgatcattaagattatggttattaattccaacgagatattgtatttgattgaaaatcatctcctgaagaagatgtttccgagggggagattgaatgatatgcgtgtatgtaccctttttccttataatagtttttatcccacatgatttttttatgacaaggtttttaacgagacattaaagaacacgcaaataatacacttgataaatattaagaaattctatcaatcatccaaatgaatattatacactaatgatatttagagaaataaataagatggtcaagatgaatcatctaaaagattcatgagctgcagaagaatggcgttgtactttatctagaaatttgttcaagagaagatttggcagacttattctcaaatactgtttattctctgccacatcttctaatcatgcagagattttaccaattcatgaagctccccgcgagtgtgtatggctaagatccatagttcaccatatacaagaagactgtggtatgtatgcagggaaaaagactctaacaattatgtacgaagacaatg

SEQ ID NO: 36711 - DNA, 3003 bp, Unknown
  misc_feature (1)..( 3003): 2750-1469P.txt file - cDNA_ID_3099512; gDNA_ID_2936573; Annot_ID_194816
atttgtcaaaacctacaaaccaaaaagcacaacaataattctgattaaatacttttaactccataaacaagtactgacattgattttaatacttcaactcctactgttacttccataggaattctgggagacaagaactggtggaatgtgatatcactaatagtaaaacataatcgtgatactgaagaaattcgtaaattatatggattattctctaaagtttaaagctagaatatggtgaagttactcctttaggtccacatacacagagacactatcaaaaagatcttgcagagcagtttataatataaactagccaaccaaagcataaagattttataaagaatagtaatcgacagaagtgacactgcttggggacgaaaatgactcaactaattaagaaagaacaaaaaagaagaaaaacctctaaaacaaatgattaacattaatcaaaagactaacaaatttcaaaaagccagcttggatccttaaggtggagaacaaaaatgtcaagaaatatgatggagaattagataacaagtgcatatttgttatgatgttttattgaccaggcgccaaaataaagttgcctcttttttggtttgcctaattaatgtttgcaaactcaaaaatcacttatcccctatagatgattccttaaattgagcctgaaactcagcatgaaacaccaaaataatcaaagataccaaaatgtttcagaatctttatttgatgcaaactaatttttaaagaaaaataaaaatcactcaagggtttcatgaataaaataactacctaagaaccataaatacaaggttaaacagtgtaaaatccagcaataatggtgacttgaatgctatcatgcatgcaacaagttcaatcgccagatttcgaaaattttacagatttaacatttggtaaatacaaaagtagatttgattttcgatcaaactaacaattcttggtttaaaattagatgcgaggaaacataattattgacttgattagtgaatctataactagtaaatcgaagctcatgaatgattatatctaatttaaagttgatcatgttgagaaattcaagggaaaaaaacccaaatttgaaatacaaaatcatcccaaaacccaaattatgttcatcaattgcaaacttggtaaatccagaaaacagagaacaaaacactagattagatcgaaatttaactataaatggaaaacggaacaggaaacaacaaagataacatttttaccaaaaaaggaaagaaatcaaataactttaccagccaatgccaaccaccgagaccgacagcttttttgacaacaccttgaagaccaacaagcaccgatttcgtccggttgtttccggtgaccaccacttttgtatgacgtggcaataccgataactcttcttcactactgcaatcgccgtaaaagctctgaatctgcgggaatcctccattcaccactcctgagctatctacagcttccagcattcttcttcttcttctctaatctaatctgattttagacctgaagaaatcaacagacccagttcgatttttttcagctttgaacactgatagaaaatcgaagatcatgcattgctgagagagggaaagatcagatgattgagcgggaaaagtggagagatatcgaagtaaaataattagggtttgtcccacaagaagaagcagagagagaagaagagagatgagagaagaagaagcagagtaaagagaaggtagaggaggagggaaagagaggatgatagagacaggtttttcaccacggggaccaattagaagaagccatgtcagcattgtactgaaactatatgcgttatgcaaaaacagaaccggtttttttgtttggatttaaccggaggggtacttttggtaattacagaacacgcgattgacctgaatggttgactggtgtttaataaagacagagatagatgggacccgtttttatttaaatgacggttatacccttagtcacgtaacttttttccatagtttgaatttttttggatcttctttgtccttatcttataattttctttctttcataattattgctctctccattactagatttttattattattgagaacaatgttttactttatgaaaaccaggttctcaaaacagcaaaataaacgaaacaagtactgcttagtaagtgaaataaatggatcaaatacagtaagataaacattgaacataaactttaaactcatataatggctaaaaagcaatcaaattggtcgatgggataattgggtatattagatacagaaaatctaagggatttaatgttgtgtctctttaatgataacactattaaacacacatcgatattatcatcaaaagagctcaagagacgcaaatacaaaaaccttttttcgaccgattataagaaggttttataaaggttttataaaggtagatgatcgatatgatctatgaatattttatctttctttttttgtgttacatacaatcatacatgattttcttactatatgaaagttacatgtttggatcaattatttgtccaaaacttttatcgagtcattgtcattgtcacagttaacaaagcccacccaaaaataaaaccgtccccatatttggggaaactgtcaaagcgacccctcaccaaacgcctgcttcaattattcgtaacttttaatgcttacccttactaccattcccctcccataaaaatcaaaattttcattcttttgttctttattgtttttaaacataaacctacgaaatctagaggctggaacaaaatccattaattaccgggaaattttcagaggatttgcactaaattaggggttacttgttacatttcaaaattaggtgactaattgtggtcaattatgaaaattcgaggggttaatgagaataatcctacacgtctgtctctatcgtcgtctttgagggttttgtttgaacaaagagactagagagtgttggagccgttaaatg

SEQ ID NO: 36712 - DNA, 3003 bp, Unknown
  misc_feature (1)..( 3003): 2750-1469P.txt file - cDNA_ID_3099559; gDNA_ID_2936574; Annot_ID_194883
acaatcacacaattattttctccttttcactaattttatttttactattatttcatcatttagcaatgcctctttcactgtttttcttcttttaaatttataagttagtgtctttattttttaaacgtaaatgttaaaaaaaatacttttatgtcacaaatgttaaaatattctaaacaaggatgatatgcactaaaaatatctatgaaccattttgtcttattgttctcttgtaatttattttcttaatatgtagatttatttagtgtatcatataagatagtaaaatacatgaatatgttttttttaaaaataagcatagttaacaaaataaaaaattacacaaaattatttgtttttaacagaattatttgcatgccactagaaacccatatcaaaccattaagggtagggaaggacgctatgcagaggtgcaattcacatcggagaaccatgcagccaagattgttcagctagcccgtctatcttacaatagaaacaagctaaaggtttataatttggagttagatctctgccgtgaggatagagctacagttgaaaacatgattgagttgaggaaaagtttatttcggataccaaactacgcggaaatattctagtggctaaggcggggtgtttcctctctgggaatatgccaaactattagagttattttgaaaaattattcacctctccctaaactgggaagcaattccttatcgaataaagtttcattttggaaacattagagtagcgatgttgcattaaacccatataaggcccattaggttttatttttgccgctatcgtccttatatttaaaaactttcgactgtcaattagggtttacgccactaagagatgctggcggcaaaacagagaactcccaaaattaatatagaaactttattttaaaatatataatatataaaattttgtatgttgtagcatgggtcgagatacatatggttttatatggttttaatttatataaaataaaaaaactgtacaaaccaatcgtaaccaaatcgaattacatacagtttctatatggttttagtttttataaaaccaaaactaaacctaaccgaaaccaaaccaaaccaaaaaaattgtacccctatccctataacaagtaaatatttgtattatgtatagaatgattaaaattgtattataaaacagacaataatccaactttaaataaatatttaaaaattaatttttctccgtgctaaaccaaaacagattatgatctagtgtatactttatgattctttttcttatacttacgtttggtgtcgtgtattgtgttttttaaagctatataatacgtataagatataattgtaactcttactttatgtattatatgatgattcaaaacaatttaaaaagttaaacaaatatgatagaaaagtcataattttaaactttaatcaaatattctaagttttaactatgtatattgttaaatatgaaatatccggtgtaagagttggattaaatataacttatccaacaaaatttttatgaacaaaattgtttaacgggatggataccatttttatcaagaaaacacttttacttacccgccaaatagtaagtacaaaaatacttcatgtaaggcccaatgttttgcaataaaaacactttggtactaaaaatatcgagacccccatattaaagttttctaaaccatataagggcccattaggttttttattttctgctatctaaaagctcaatttagggtgtttagagctacaatggatggagttgaggaaagtttacttcggataccaaactacgtcggaaatattctagtggctaaggcggggtgtttcctctctaggaagatgccaaactattggagttagtttgaaaaatattcacctctccctgaactgggaagcaaatccttatcgaatggagttttcttttggaagcattagagtagcagtgttgaattaaacccatataaggcccattagattttatttttgccggtatcgtccttatatttaaaagctttcgactgtcaattagggtttacgccactaagagatgccgacggcaaaacagaaaaatcccaaaattaatatataaattttattttaaaatatataatatataaaattttgtatgttgtagcatgggtcgagatacatatggttttatatggttttaatttatataaaataaaaaattgtacaaaccaatcgtaaccaaatcgaattacatatagtttctatatggttttagtttttataaaaccaaaactaaacctaactgaaaccaaaccaaaccaaaaaaatcatacccctatccctataacaagtgaatatttgtattatgtatagaatgattaaaattgtattataaaacagacaataatccaactttaaataaatatttaaaaaataaatttttctccgtgctaaacaaatacagattatgatctagtgtatactttatgattctttttcttatgcttatgtttggtgtcgtgtattgtgtttttttaaagctatataatacgtataagatataattgtaactcttattttatgtattatatgatgattcaaatcaatttaaaaagttaaataaatatgataaaaaagtcataattttaaactttaatcaaatcttctaagttctaattatgtatattgttaaatatgaaatatccggtataagaattggattaaatataacttatccaacaaaatttttatgaacaaaattgtttaacgggatagatatcatttttatcaaaaaaacacttttacttacctgccaaatagtaagtacaaaaatacttcatttaaagcccaatattttgcaataacacacttttgcactagacccccatatgaagcccatattaaagtattctagaccataagggcccattaggtttttactttctgctatataaaagctcaatctagggtttatgtctctgatagattttacaccaccgaagccgaaaaaatg

SEQ ID NO: 36713 - DNA, 3003 bp, Unknown
  misc_feature (1)..( 3003): 2750-1469P.txt file - cDNA_ID_3099562; gDNA_ID_2936574; Annot_ID_194882
tgctctcagcacaagttcttagccagtctgggttgtggcatgatttctggcaagttgtgatcatctcggatatgttatccatgaagagcagtgctagaccaaccgtgagatccttgttcgtgcacatatcgttagtggtcttgtgaaatgaatccaaatccaagtaattgtggacaatagtcaccgcgttcttctctacagaactcaacatcattctgttctctagagcatcctcgtttttcctaatcaccgagtccaaggacttgctagcctgcagcaatataagccatcacatataaatatctcagagcttgatggcttacaggtcaaagttatagacatcttaccttgcacaagatgttgaccatctggtaattgccactccaacgagatgaagcatcgatgggtagtttccagttgccttcttgataagctgttgtcaactgaatgaaatcatcagatagctctgtggacgcgtttaactcttgtgtgaattctctaaccttagagataatgggctttatagttgctaacccctcatcaataatatcattcagagtttgagcggcacagggaatgtagcagaaaggtaagaccttttgaccatcaaagtactccttcaggctatgacaagcgtgaatagcgttttcgctgttgtcatgtgtacaacatagaatcctgtcttcaatggcatatgtcttaaggactttcaaaagggagttataaatctcagaacccccagagggataaggaatccgacatatgtcgagcagcaacctatgagacgaccaattttcatctatccattgacccgttacgctcatataaaaaatgttttcatatgaattccagaaacttaaagtgacagaaactttggactggatatgctccaaggttgtcttcacatctccccgcatacttgtgaaaacctcatcaagtatggctttatatttttcagccggccataactggatggatggcttaagaaatttgaaggagtttcccaaccatgtttcgtctacagtagagggaggaagtgatgacaaagcaagccacttgagaactaaccagttaagatgatcataatcgagttgtggtactttcgactgggattgtgacggtttaacaacagccggtggtgtctgtggtactgatgagctggtgacaacatctgctgctgccttatcatagcctggatgtcgattagtcagatgccttccaagatttccttaagagcaggaaaacagaacaagaacaaaaaatatgttgttagtaaaatcaaaaggacttggaataaaatgcagaggatataagaataataccagtagctgttgcaatggaatagctttgtccacagaacttgcatttccgagttttgctgtctggtgcagtctcgaaatatttaagataaactgatgtcattgtcttcttccgtttagggggaaccgaatttgacttatcagaagagcctaatccaatgtcaatgggatcagaatgtggaactagtgtcatgtccatcatggctttaggttccatttctacaccaagaagcagccacaaaatatcataagtggttctagtctcaattgaatgaacaaacacatacactgagaccaaggtaaacaagttccatactttatcacaaattatcagattgatgaatcttcatattcagttttcaatttacctttgtaggttttgaatgcattatttacattccactccattgattccaagcgtcttattagtctctgtgaaacgatccgtagagtaaaaaccgttgcgagagagagagggaagttatttttttggagggaaagcagaaacagcagctagagagaaagaggatcggcgctggatctatgagccacagatctgagccgatttaagggatatgaccttaggaggatcggcgagtcgggagattcgtcgatctgagagatgggttacgacggcggatccgttgatttggccggaggatttgacggaggagaggagctagggtaacgaggctggctcaataatcggtcggctggttttgggaattgagaagttgagaaagtaaaaggctcagctaaatgactccagcgaatggctcaggtctggtctgattttcggctcggataatatttaatttattaattttcggtttaacataccaccaaaattagtcatgattattgcttattggctcatcaggattttttttatgttttatataaatattaaatttcagttataaggctgattattttttattccgaagtgtatatatcttggaaaaagtgttcaatgagttggttttgctagaaagaaattataagaaaattctaattaattacataattcaaccaaaccgaaccgaaatagaaccaatgtatatcaactagtacattttatgattttcttaccaggacaattgaaactatttctttgattataattacttttcttatacaatgtgaataatatgatatgtcatggatcaacttaagctaaatttagtctctaacatcctgattaatcacagaaaggatttagttcttatgttttgtttggttttatttaggacaatcacaccaaagttacataccaaaccaaaatggtagatttaggcccaaatcaaaacggaaaacccaaatatattcgcatatttagaatttatgaaaaaagcaattatgttcccaatcgcacacctgtcacttatattaaaaaacaatattaactgggcccaaaaaaaagctatttatgaccgttacaataaagtttcaaaaaactctcatttttttttcttaatttgcgtttaatctaaagagtggaaaatagcaagcaattaatctacactctctcaaagctttttcattttgaccaacacacacttctccagtccaatcaacggcgtttgatcaatcatatatttcaactctaaagatcttcttctttgctgggttttgtattttggatggtgagaaaatcttagattctgaagaacgaaaaaagatg

SEQ ID NO: 36714 - DNA, 3000 bp, Unknown
  misc_feature (1)..( 3000): 2750-1469P.txt file - cDNA_ID_3099572; gDNA_ID_2936574; Annot_ID_194880
ctgtgccgctcaaactctgaatgatattattgatgaggggttagcaactataaagcccattatctctaaggttagagaattcacacaagagttaaacgcgtccacagagctatctgatgatttcattcagttgacaacagcttatcaagaaggcaactggaaactacccatcgatgcttcatctcgttggagtggcaattaccagatggtcaacatcttgtgcaaggtaagatgtctataactttgacctgtaagccatcaagctctgagatatttatatgtgatggcttatattgctgcaggctagcaagtccttggactcggtgattaggaaaaacgaggatgctctagagaacagaatgatgttgagttctgtagagaagaacgcggtgactattgtccacaattacttggatttggattcatttcacaagaccactaacgatatgtgcacgaacaaggatctcacggttggtctagcactgctcttcatggataacatatccgagatgatcacaacttgccagaaatcatgccacaacccagactggctaagaacttgtgctgagagcatggcccagaaggccagaagttacaacactcaagtgtgcaacgtattcacttacattacagccattcttgacccgcggatcaaaacagagtacattccagagacgattaatctcgagagctatatagatgaagcaagaagtcatttcattcgtaactattcttcctctcatttcacatcttcaatgactagcgggtatcgtcctcaggaggtagatgaaggaggaggaaatatctcatttgcagaggaaatcgctagaaggaaaagaagaggaagtatgagtaacaatgttgttgatgaactgactcagtacttatcagagtctatagttccaatgcagactgatgtgcttgattggtggaaggtaaacagtggaagatacccgcgactttccaacatggctcgggatttccttgcggttcaggcgacttctgctgcaccggaagagatcttttgtggtaaaggagaagagattgataagcagaagtattgcatgcctcatgatagcacacaatctgttatttgtatcagatcatggattgaagctggtatgaaactgaagtacaagtgtagtgagattgactatgaacgactaatggagttagctgccaccgtggccgctgataattctgccggaggtttagaaaaaattcaacaacataggtgagattattttttagtatttgtactaaagaactactgtaatttagttgtcatacttttagcatgaatcattgaatttagagttgggttgatgtaaaccaagctggttagctttcttcataaccgtatgtactttcatatcatattagagagaaaaaaaaacacaatgttgactaattaatgggttctgtctaactagaaaagtggaaattagttgtacgaaaaaagaaaatagcttatctctttctttgtaccttagatttttccttggtataatggatatcgatatgtccaagtccagtgtttgagtgaccaagttgttgctttaatttaatctagttcaaatacgactacttttgtgttgtacctctctaccttaccttcctcgaattttcaattcgtgtgctagtttgccaattgtttctttataattttgtcgtctctatgattgtttaagcatatttaaatatttgagagaaaaaaatactaagagttcagtcgtattttgaaaagtcctcgcactccaagttttaaagttgaattcattctgtcatggaaacgtacctttgtggtttttcatttcgatagacattttttaactcttctgataaattcaaaatgtttttttacattggttaaaatttgttgccaatttcaataaagctttttttttactcgttataaaattaaaaacttgctgagaaattatagtttcatatatactttggaccgacggtcaataccaaaaaactaaaataaaattttggtcaagaatcgggtcaatacaaaatatctccaaagatcgaagagaaagttcaacaggattttaatttaattggtgttccggacctgccggcgccgtattataattcttcaataaattttatattttggattgcataatcaaaactatttgcatagcagacatagatttcaaaataaattgatacgtaattagctatttacataggcaagacaattttacgttacatattttgcatgcttgatattcattctttttttttagcaacctttgctatattcattctattttttcccctttttttgctactatcaatatcatatcagatgtggcggttcttatgcatgggattatgaaaaatgatattatataatagatgtcttcgtagtatttttttattgacaatcaaaataaaataaattagtttaagaaagatcaaaagtctagtgtcaaaatgtccactgacaaaagttagcagtttttcttttatgtaataatccgattataaaaaattgcgttaaggaatcataatgagccatgtgtcagtcatatttaaacgacgacgttggcagcagccacacgtacagcctcaggcaagcataaatagagatgggctctttcctataagtttcccactttgcaaagtgtaacacaaacagttctctttagagaaaaaaagattctctctataaaaccttctctttgtgtctctctttgtggtaagaaaacagagcaactagatctctcttctcctctgctcgttcaatgttataacgatctcgagtatcacaaaagaacaagatgtctattcgaagaatctaccgatgtctgaattctttaatcaaaagatcttgtgctcaatctctatgatcatacgccccatttcacactttgtttcacctctcagtttttttttttgtgtttttttgtccctctttgtttcacttgagaacaaccccctttgaactcgatcaagaaagctaagtttgaagaatcaagaatg

SEQ ID NO: 36715 - DNA, 3000 bp, Unknown
  misc_feature (1)..( 3000): 2750-1469P.txt file - cDNA_ID_3099578; gDNA_ID_2936574; Annot_ID_194878
aatcaaccgggccatatctaattttctttttcttttcttcctttaatttcttaactttttgatctgatagtcgatttaaagaggttgatacagtagtttgtggataaatatatttaaaataatttctaatatcataaataatgcataagcatgtgggtcgtcactaagtcattgccggtctttgcagttggcactctgtgtagtggccacattcttgtgcatgcatgccttttgacatttcaaaagtcccatgacgtaacgatataaacagtagtatacccaaccacatatatgtattaatttttattttcaaggttgtgtcatcactttacatttttatgttcaaagtatacaggcgaaagaaattataaataaaaaattctgatatatgtatggttggaaaaatttatgctctctagttcaattaaggttcaatatttatattttttgacaccgtattttaacaagagaaaacatcccatataattaactatcaaaatttataattaagagaattatagaatgactcgttaacgggaaaaagtgagagaccatctatttaaaagatcaagtagataattatttgatgaaaactctccatttttaacttctttttagagtcgcattctgtttgccttttagagtaccatataccgtaattaaattttgaaaaatattcaaataattaaaatatgaatatgtaacattgttttataaaaacataaaatgaaaatataagtgtgtttttttagtcaaattattgagttctatttatcaatatgattttacttactgatataatacatattaggtgagtgttataagatggctgattctgatagattcggcacctatatatattccaattctacttttctgcatggggatgaatatggacgacctgacaaaaagtagtaccacttctgaagttgcatcatatcataccacttttgttttcacataagaacattgttgaaacgatgctaaattttaatatggtatttggttagtgttgtaaataatatataatactaataaattgcatattcacaggactgttttttcgctttaaatctgcattctatatatataggactataaatcttaataatctattcatattttactaaaaaacattttaaaggcttgtttttttaccgatttgaacaaacctgttacatcataatgacaacgttggacactaattaaatctaacatctgattaatttccgacaaaccttattggctgcttcttgaagcactaatatatagctttttaatttgtatttccagtaatatatgcttaagtcttaacatacaaaaggtaagagcactgagcacacatattcatagttgaataagagatccaagtaggatgcatacaaagtgattaaaaagaacaattcaatcaatcgatactgtatttactttgataggtgtatagaaaatatatgcgagtcgataatatatgcgattcgatgtaaaggtgctatcaccatccaacggtttcgtcgaaagatcaaaacaaaggtgattctatatatacactatttcccctaactttatttccacttgttacagataaattaaatctccattaaaggacaacattgattgctgatttttagaaaagtaaacaagtaaagttgtgattgctcgatccaacatgttacgtggagattattcagctctaaaacaatgaattcatagaaccttaattaatcattacagatacttgatttttttttttgggtttaaaataagttagttggcaccaataattctcatagcaccttaattgatccgttaataatagttagttccaatatcacctgtaggcaatacgtcgtattccctaactcgctttaatgggaatgagattattatcatcactataggctagtatatccactaaccacacatgcacttttaaagcatttttggaaatgagtataatttatcgatagctagctagtagagccgctaaccacacaattgtaaaaccgtcggcctttgtaaatgtgtcgaattcatttaaagtcaaaactccgtttcatttaatttacggatacaaatacaaatatagactcgtttttaggaaaaccaatcgaaaacaggtaactttgtgtagaaaaagaaagatttacggatttttggtctactaactaaacatgttatccgaacattgttactaagaaacttaagactaatacaacaaaacaaaaaaaatggatctagagatcttaaaagaagcgatattcgccacgaagatagatcactcgttttggcggtagattaactgtcgagaggttgccaaccaccttgaaatgcatattttgtgtatttggtttttctttttcaataacgtttgttaccgtttattcgatttttatatcgaaaaagtccaaactcgaaaaaatcgaaaagaaagaatttccaaatcaaacgaaatgaaagtagacaaagttttaggatagtaaattagtaacaatttcttataaaaccaaaacaaatcgaagaaacggaaccgaaaccctaatcgagatcccttccttacacaaatctatttaagactgagtgatagggtgttaatagacactttatatacttcatgtctcatctgtaaagaaaaaattattggaagattaatatgggaaaatttgaaaaagaagttaaaaacatttgataatacagtgtctgtcatttagtaagccaatgaatttagatctggaaaacaaaaataacatatttggacagtgaagaaagaattttgatacactcatagaaaacccgaaaggagaaaagcaaaaaagccagatcacaatctcaaactcgcttcttcttcttcctcactctcttattaggttcagttccttttcgattcttcgtgtggatcgctgtcggtagatttccgatttctttaggttctgctcgaaatcgtggtttagtgtttattatcatcgattcagaaaacggtgggtaaacttgtagcggaagatg

SEQ ID NO: 36716 - DNA, 3000 bp, Unknown
  misc_feature (1)..( 3000): 2750-1469P.txt file - cDNA_ID_3099589; gDNA_ID_2936574; Annot_ID_194875
tggaatatttagaaatgttaaattcaataaatggaattatatcgtttgacatacgtaaataaacaaaaatacacggaatgtttacatctattccatttaaatgttctgataacttaaaaaattctaatcataatatggagtaggatttaactcgtgctacaccacggagtaaatattttattcatacatttaataatattaatttttatggttttagtttaatattaaagttatataattttatattaataatataactaaaaaattggtgatgataaaataataaaataaatatttaacatgtgttatatcaatccaaacccgtcctgttatattttatatcaatccaaactcgttccgttatatttttcgtctcatgatctatttttttttatataagtttaaatattagttatggaattagtcgggattgtgattttatgccgaaaaagttatggacttttaattccatagaatattcaaaccaagataagaaatgtttttaggtgcacatataattgggtttgctcattttacgggatcgtaaatgtattttggtttgtttcacaatgtttgttttaatttattgccgaaatttaatacaaataattcaaatagttcaaattttggttgttttaagatttagtgaatattgtaggtgagataaggagaaaataatctattgtatttggcgtgacataagggattgccatatatttcgaatctttttggtttgttatagaattaattgccctaaaaaaattcaaaccattaattaaaaaaatcaaataattaaaatctagtggcagtcattgtaaataaattccaactccaagatttatttcataaaatggctgcaaaaatgtatatgtagattagtgaaaaagtatagatttgtttagtgctctgagcactgtgcttataacaaaaaaatatttatatatgtttcgcggttatggtttattatctactctgaacctaattatctttatagagtacattttaagtagatttttttatggtttattattaatttttttgtttcatctcttatgctttattttctaaaacatgattcagtttcaatcacgttaaatcatatatatgaaagttgaccaactctctccatatgattgacacatcatcactatcatcactttagcatttgctaattgtccactgaataattaatgtaaactcttcaacttataatttatagattaatgatgtatttattatttaattttatatatttaattgtactaatattaaatttatttgttattacatgtttttcaataaaattatttgattggttttctcatacttaaagattttttctgtaatcttaactcaaattatgagtgtatagtagttatagattagttaatagtttgaataatttgcatattgttaatgacacatcatcacacaacaaagtgacatatgtcattcgatgttttttaaattaataaaactaataaaattaaataaacaaattaaatatattatcaatcctactcttaattgatttctccaaaataaaaataaaaaataaaattatgtaaacaaattaagtactactttcattatactctttttatttattaattttttttatcatcaataatcataactaattttttattgtgttgtacttgtttgctacctaacctcttatttgtttagtaatttaattttgagtctttgataacattgacattcaaattttttcaaataataaaccttcaaaatattagacctaccaaataatgtaatacacgatcatttctcttatagtgatatatacaatgacaaaagatctaaaagtattgactttaatgatactttaatttttgaattctttttattcttttcatatgaatatttttgaaatcttgttcagtttatatcaattctatatatttaatcatgagcctataacaatattgttggagtattatatctggagaataaataaaactataaatagtttatttataatcaagttgaacaattttcaaatcatccaagacacaatcatttctctaatattgttatatgcaatgacaaaagatccaaaagtgttgacttcaatgacatcaatttttgctatatttttatttttttgtacgaatactcttaagatctttttcagttgatatcaatccaaactttaattatgaatctatcacaatatttttgaagtatacaaggaattgatttatttataatcaagttagaaaaattttaaactacaaaaataacattgttacacagaattgcatcaaaatatcattattgtttttatatgtatttatgaagtaaaaaaatattaaaatcttataaataatcagctttatacacaaaaatatataaattaatatttcaagtaacaaatgaatctaaccataaaaattgtaacttcaaattatgcatctaattttattaacaatacaaaaataaacaaatagtaaatataaattaacataaagaacaatcaagttctaaataaagtaacgaaggagagttgcggaaccgctagcagcacttgccaacactttaacaattttcaaaataaacccacgcgtaacatgagtactcatctagttattaaaaaaacacaaacgaaaatccttgtaacgtaaatccttaagcctcgggacccatttcactattttaagagacttataaacaaccagtaaatactcgacacgtcataaaagtgccacgtaataaagtaaagtttttttttttgtttttctcttcaccaggtttttcaattttttttgtttgttctcttctttaatttatttttccggtaaccgaataaaaaacctaagcaaaagaaatgaagcagctttatcatctgtaatcgcccataagatataatttggatttctgattttctttcttcctcattcctcctcctcctccaaaaaagaacccatttcattttcccgcactttctcaccccaaacgattctcgcccggaaaatg

SEQ ID NO: 36717 - DNA, 3000 bp, Unknown
  misc_feature (1)..( 3000): 2750-1469P.txt file - cDNA_ID_3099592; gDNA_ID_2936574; Annot_ID_194874
gacaggttgcggcaaatcccctttaattcacctattgcctatctgattcatagggacatctggacagggattttctcactctaatcatttttgtttccggttaataggtcttggatacgatgcaagatttgatcaaaatgtagggatgttgtctctaaagaagcaattgaagataaaatgccaagaacaaagtcatgcaagttccttgtacgataaatcacttgtcagaatcaatatggatcatcaaggtgtgtttaggcagactctgcgctagtcaatattagattgaaacatacaaaggtagcattttttctgtagcagaaactcactagtttgtatatgcttgattttattgtaggaagaggaaattttggtttgaacacttgccaatttaatgaaggaaagatgatgtttcaagcccggataaccgagagttacccggttggttacactatggaaacaatgatagatggaaaagtgcttcgtggtgttttgttttcaaacaagcgcagctctattctgccggcagatcaaagctttagtaggtgagtggttaaattaatcttcctctttccggggttttcagttgtgtgcatcgttttgtgaacaagtgtatttgttgtatagaaagaggccagctatgtcgaacggggatcaggacaatagatcaaagatatcaagaactttgatcaaggatcaagctaatgctgtagaatccaaagattctcaattaaacggtatggaggctggtattgataccatcagcaaccctctgggtgttaacataaccacagtggcagtggcaccacacgaaacagaaacctctgttgttacttctgatgccaagaaccaagatgcaagtcaactcgatatggtgcgtttttaaaatcatatatcctcaagaacctgtctttagtcatttcgtttctgaaaatgccgattatgcaatttcttgaccctaaaatactgaaaatctttgtgcagggcactgtgaatacagtgaatacagctccatcatcagttcctcaggttgatgaagcgtctttagaatctagaaatgcgattacgatagatgatagggctaacaagaccggacttggagagtcatagctacaaaaacaaaggtgggctaacgtctttaaagtccttatgatcgaatctttaggctacacaaaaacagaagaagccattgcatctaaaactagttgggtctaactctgttcgttttgagcatttgatttacagatgagagattctccgctatgaacagaggaacaacagcatgaacaacatcatttcttttcctgtacattagtctggagatagggtgggttttatttagaatctaagttagattatcgtggtcactggtgaggatgatgagaagctagctctgagttaggttttttcttttccttcttttcttattctctgcaattttctccttttttcgggtttaattcaacttccaagcaatgttatgcttcctccctcatagtttttatttttttgcacaatgaactagcttaaatgtcagataaaaatggtttattctagaatgtggagtgattcttctaaactggttttaccctttatcatgttatggttttcaatttcaactctagccttgtttactctttctagagctagattagaatttggtcgatcattcagtaggaaacataaattttggagataacgtagaagaaaagtcaaactagtcctagttggcaatccaactactaaaggctaaagcatgtagttccatatccaactaatttcgttgttgattagcatagcatgtgattctatcaacctgtttacatgaaaacaaaatttctaaatttcatgtaacaactacttcgtttttcttctttttgctcatgtaaaaacatagagaagaaaacttattttcatttattttgatggcctcctttatttcccattatatttaatagtgcttgcaatgtattttagaaaaaatgggaagaaataaaaagaaggataatttggagaaaatctaaactagaagacagaagtcacatgcagagggagacatctaaagaagtaatcacatcctacttccttcccacatggattcatgatttgagagaatgcgtctgtatctccaattctcatgaacgatctctctcatttctatttttattatccatattacttactaaagataatctaaaatcttggagcttttaagtctttaagagtgaggaattggaacaaacaaacaatatttacaaaccaacaagttcctccttcttatgtggctgtctttttgttttgttctctgagcagaaccaggaggaaacattttgcagaggttctttattcttcttcttctttgcttggcgctttctttctttccctaaggttttgaatgtacattctctgatcagtgatcttcttctgggagattaagttttcagacaaaagagcttttgttctgtaataatggagcttgtcttattccttttggggttagtggggatttgagaatctaggtgttgaaaatagggtttaatagattcatatgtttctgctagcctagactctacccaatttaccacgtataagaaaaaagcgaatttttcattatgatagggatttaagctatgtaatttagctggagagcaatgggaaatggcgttcacattgagctttgtcagggcaaattttattggaatgtgaattgataaaagctggaaacttttggaattatatgaaatatggaaagtggcgtcgttctcgttattagttggttccatggtggttgctattgatagagatataacgaaagcttacgtttttcccaaattaggatttactggaagcacaataaagaagagttaagacactgtcactacagagagaagagttcaaattctctcctttttgttaccagtagcaagttccggcgccggagattcgccggagaaccctcctggtttcaggtgaacttctagctatttttcaccattcatg

SEQ ID NO: 36718 - DNA, 3 bp, Unknown
  misc_feature (1)..( 3): 2750-1469P.txt file - cDNA_ID_3099603; gDNA_ID_2936579; Annot_ID_143746
atg

SEQ ID NO: 36719 - DNA, 3 bp, Unknown
  misc_feature (1)..( 3): 2750-1469P.txt file - cDNA_ID_3099611; gDNA_ID_2936579; Annot_ID_194892
atg

SEQ ID NO: 36720 - DNA, 3 bp, Unknown
  misc_feature (1)..( 3): 2750-1469P.txt file - cDNA_ID_3099623; gDNA_ID_2936580; Annot_ID_143747
atg

SEQ ID NO: 36721 - DNA, 3 bp, Unknown
  misc_feature (1)..( 3): 2750-1469P.txt file - cDNA_ID_3099633; gDNA_ID_2936580; Annot_ID_194893
atg

SEQ ID NO: 36722 - DNA, 3000 bp, Unknown
  misc_feature (1)..( 3000): 2750-1469P.txt file - cDNA_ID_3099640; gDNA_ID_2936581; Annot_ID_143764
gaaactaagatgtagctcttcaagattgagatactgagatacagattcggggatcgagccattgaattcgttttgagcaaagtttagaaacttgagactagacgatgaagacatgtttccaaactctacaggtcccttgagatggtttccctctaagttaaccctttctaacgtgggaattgtgaacaagaacgtagggaaagatccagttagattgttgaaactaagatctaactctatgagattgagatattgggatagagtatcagggattgggccatcaaatttgttttgagaaagaaatagatattgaagcctagtagatggtgaatacatattcctaaactctataggtcccttgaacatgtttccctctaaattagcccaacgtaatgaaggaattgtgaacaaagatttaggcaaagtcccggaaaatgagttttcaccaacattaaaatagtccaagttttggaatccactcatgtcaagtgggagcatggattcgaaggaattattatagaggttgacaacgagcagttttgttaaattggagaatgtaacaggaatattgccactgaatttgttgtgtgaaaagatcaagtattctagttgggttaggtttcctattgaagctggaagttgacctactaacttattatcccaaaggtcaagaattgtgagtcgagaaaggtttcctatagaaggtggaacttgaccaactaaataattatacgaaaggtcaagaagtgtgagacgaaaaaggtttcctaatgaagaaggaatatctccatagagactacaattactaagggttaagttatgaagatgttgaagtttgaaaagaccactatttggtttcaatgagttattaagaggaacatgactaaggttaagtgaaatcacctcgctagatatagcatcgcacgtgacaccctcccaagaacaacaatcaatgctcttgttccatgaacttaacgatacatcataaggaatttggttggattcatttacccgcggaaactcgtgtttgaactccagaagagcattcctttggtcatggcggcaatggcgaagcgtaggagaagcaagagtgtgtagaaagaatgaaaccatgaagaaaaaacagaagcaagattggcttggaatcatcattacttctttttttttttgttaggagtttgtgtggtagtttataggttatcctgatatggcttctttggctctgttcaaaaagcaaaaaaacgaaactcagttgcttaatttgacttgcgcaagtctttccaatgctctctttgactaatgatttggcctcttgccataatatccatcacaaaattgaaaactctcttcttcgttattaatgtcaagttactttgggtttctataggtcatgagtttgtatttgggctttttatttgggccagatagaatcagatgtaaccaagtctatttaatccgctgtcgtttttaaatagtttatctattttttttttataagaaaaaacaaaaatgattaaccctatctaaagttgttaaaaccaaatgttttagcaaatctaaccaaatatttttttctttgggaagctctaaccaaaaatgattatccttggataattactcaattagtaagatcttcaagaaactgatttcccccattattattttatttatatttttcggtttataaaactccagtaatttcaaatataatcctctgctaccgataccagaatccacacaagtgaaactaaaacaatccaacgatgtaaacaacctcacaatccacgtggacgttcaagatcacacatgcactagcttcagatattaagagtgaaacaaaataaaaggaagaaataaatcgaaaaaatggaaaaaagtgacaaatctggaaagctgattggctgaagtcgtccatgtattcaagtttcgcggcaacacctctcttctcatttttctcattccctaattcttctatatctctctctctttctctcacttcctttttttttttgtttttaaacaaataataatctttctttcttcttccttaatttgccttctctctctctaaaacccttgtttcaaatattttctcatcgatctctttttgaaactaaaggctcgagctttctctatctctctttcgaacccaccggtggttcgggtatctctctattcactcttcaagtcacctaattggttagtggatctgcttcgattagggtttttaaaaggcttttcctttttccgtttcaaattttttcttctttcgactctcaaaattttcccggattttttttttggattctttaacactttctgtgttagctctttttcttttgactcgagttccgttttttctcagctgaggtttagtgggtatttttggaagctcactcgattgaagttttttttttttttttgaggaatcagtttcagatttgtagaatctgcgttttatttatatttataggttagcgattgaagtttcgaattcgattttgttttactatctgaaatttaaacaattttctcaacacattttctcaaattttgtcaaagctcctgacttttgtggatgattttcgtgtttcttcactgtgtgtaattgattccttaatttggtgtgttttttaaaatacccaaattctgattttcgttaatatttcctctcatctcgattactgcagctatttatcttccccaacactgctttttactgatccaagaattggttctactcttttgttaaaaaacgtagagttttgatttttcttagctctaatccctaaaccctaaaccctaaaaacgtcttgatttttcccctggtgaaatgttgaaattcgtagtttgtacatgtcttagaggaagccaaatttgcttatcgacttagtgtcgtatcttgtccgtatcagtttaaagtgtgtcttttgtcacaattgcattttttggtttctaactatatatttgaatatacttgtgcagagaaacgtgcaaatg

SEQ ID NO: 36723 - DNA, 3000 bp, Unknown
  misc_feature (1)..( 3000): 2750-1469P.txt file - cDNA_ID_3099660; gDNA_ID_2936581; Annot_ID_143760
aaagaaaccaaaaattcctctgcattctcttcagtcaaaacagagcaagtaatcatttgtccacttttataaaccggagtgacacgaaccgaactcttccaaataacccaaattcgtcccaaacgatggtgttcatagttagtcatagaagaccacccaggaaataccttagaaatgatcttgctagcactagtttcatccaccctcgtttctaataaacccccaaaagttaaagactcctttctcacccaatcacgaacaacggaatgtttatttgatttgttaaaaccgcgcacattccagaagaaccccgacatttaatgatgttttttggagtttcttctgctcgaattgctggagacattgtctctagctttttgagtaaaagactccgaaaggactttgtgtgaactcttggaggagcgaggaagatttactctcaccgctcctgctttctctttatccgaagtggaattcttttcgatcgcttgagtagagacaacgtcatcaatagagttcgttcgctccgtctcaatgacttcctctgaggagattgtggggaactcatctttatccccattctcctcctgatcactcaggacagagtaccgagaagaggataaaattgttgcttggccaaaagttaatggtttcccatttgacttttctgtacttttgcttcctttacctggggagactatggaccaaccatctccttccgactgagattctggtggtaccaccttctctgctaccacttgttgttcaaaaacctcctgagaaatcaaaatcgagttctgaatcccatcctctttattcccactattagctgactcatggtcagcaactctcactgtggtagcagaagcagaaggatccgctaaaacttcaccttcttctagctcactttctatcaccagcgctggaggcttgagcttactcacacaaacatccactaggtgaccccacttactacaacaagtgcatttgggaggcaaccaggggtaaataaactccacgataacatctttttcctcctcaattttgaacctgtgacactttggaacgtcttgcgaaagatttacttcaacaaaaactttagcttcatcaaactttgtgcataattctgtttcaggatgtaaccgtattggatttcctactgaacttgtaataaaactcaaaccatcccaggagaacatggaatgaggaacattcttcactgtgacccacaacggcattgttttaatctctggctgggcttcttctttaatcggagaccacttggcaacaatcattggtaaaccagcaatgttccacatccctcttctgactattctcgaacgcgtggcggagtcacggattcgaaactttactgaagtagagtctatctcatagacgtcaatcttaattgctttgtccccaagagtccagatcttattgactatgacatggatcttagcgacatgcggagcttgtgatgggaaccgtcccaccagaaaatcatcccagagagggacagattcagtgataacttctttcggaactgcaatggttgggacaccgtcttgcacagagacttcatattcatcttttttcagagaaggccgtttagtaactactgctgcataggacttttgctggacagatccagatggagaaccaactgttcctgcctcagaagagactggtaaaacctggtcggacatgagaaaccgacggcaagccgccgctgaaaccctagcttgctgaaaaagaatgaaaaccctagtcgccaagaaaatcgccctagagctgacgtgtcattaaaaaaaaaaaacatcattcttatagtagaaacatttgattgttctgtggtaactggtaacgactaagtgatatggtttactagatcttgcaaacaaatctaattgatcatgagaaaaaattgtaagactagatcgattattttagtggtctaacaactagtttcaaagttgtaattttcaagattgtttattacatttagtacatgtttgaagtgaaacaatatatctcaatgtaagtacatgattctctttactactttgaatctatcacagaagttagtgcagacacccgattcgctatgattgttaagatcataaagtgacctagatcgatgagcatcaatgtttttttttttcttttgccaataagcatcaatgttttcttgacgagcaattgtcattttatttcaagaagcggaatctgttttatgaaagtgtttattgtttacgatatagaatcgaagcgtttggagggccaaaagaagtaggagaggcaatagtaagaacagtgacaggatctggtcaacgagcagatttgaaaggaactttgctagaatcaagtatcagacaagattcagagagaaacttgaagtactacgagttggagtttaaagtcgaatcacctcttttccggcggcataatgtagccgtttgttgcgctcacagtggccggctttatacactgaacgctcaagcgccagagtcagcttggtcagaggtgaaatcggaaatttacactactgcgaaatcgttcaatataatttcttgaatgtaaaggatcggaaaacaaattgtaaaaacccaaaaagaaacaagatactacaaagcaaagcttattttttcttcatattgatagggtctctttgtttttcttaattaattcacactattgagttgattacgatgattaaggtcaaaaatacgaagtgacaataaaaagagaaaagtttcgagcataatcatgtcttcttgatcgtgccgctcgctatataaacactgcaccaagcaattactataatttttgatcaattaaatattaaattttgagaatatgtttctatattaatgaaaataatttaaagtaatcataagtttgtatctttgaacaaacgaaactagaaaacgcctatctctgctcattggcttctccatctccgatcaaatccgcggtcgtagtcagagagagagacaaatg

SEQ ID NO: 36724 - DNA, 3003 bp, Unknown
  misc_feature (1)..( 3003): 2750-1469P.txt file - cDNA_ID_3099678; gDNA_ID_2936581; Annot_ID_194907
cttgccaatccttaaaattagggttacggaggaaccgataaagcatataaaggagagtacctgtgtcggcgaagcttggacaacgagctcgttaccgacgcgtgcgaggcagattatagacctagacaaggtcttgagcgcattgccactgatactcaactccatctctctctgtctctggagaaaaataaattcaaattttaatttaaaccttaaaaataaaataaaaattggtgaatgattttagtgggcgattggcgggattgccatgaaattcctgaaatcagcttaaagcgcgaaatatactaaaaagtcatagtatagtttcttaataatgggcctatattgatattagttaatgggcttttaaccgcacgatttaattgggcttatgtctcagatagagtgacgtcattgactagttcggtgccggtggtatactttaattggcatttattattgcgaaatatatttgttgcggtgacaaggacaaatctcgcaattgtactgttttcctttaccgaaccacaaatctaaaaatcgccaattatttgatttcatttttcagtttaaaataaaaagaaatgaaatatttgtctttcttttcttcttatttcttgcaaatggaatctacaattttctccaaactagcatgtgatatatctgacaatttatgggctagtatatttgttttaaattttttgtttgtttctccaaactgattatttactttattctcaagacaaagtgggtacaaacaactctctgtaaatgtggattccccttttttatgctaaatgtagacagaacacatcaactcataaaactcttctcaatatctctgagaaatgcagacaaaagttgtaactttctgcattcgacttttgaatatgaaaaaagttagatactttagcatatatatcatccctaaattatggtttcttactttttcattggtcttctcgatacgctgacttataatctttgactcctaaactccttttaatttatttgattgacaagtaacacctagactttgaaaatttgtaactaatcactcatgttagcattacgtgatctacggtaccgtgtatatgttatataatagagataacaaagtatgtagactattccaatataatacgtttaagtctctaagacaagttcatacaacattggccccacgtatatcaaatttgctgacacttgagaagttaaatgaaccaagtagaaagagtgaaaacaatagagaacaaatattgtgtacaagtctagtgatattcgcgaaaaaaaaaatgtctagtgatattcgttttactcaatctcaatggtaaaataaatcattcaatctagtaatctactactaagggaattttttaacatctttttctatcgacgtgagagataggattgaaacacacaattctcaacctctgctttgataccataaaaaatgatgaaagtaaatacaacttttccaatcatatgtctctccctcatttcaatattatgtccttgtaaacacattatatatgatcttattttgatgaactttgatataactattattaaaaacgcattcaaaggccaaacactagctttctaaaaagtcattcatcatatcaaactaagaaaatcatagtataaacttctcaacgaaatcaacatcatattctacaagataatattctttgcgacctattttgtgaaattatgaacaactaaccatctcactttgggaagctttagaatgtgacaagaaagatagagaagtttgcctaaattattaatttcaatttcgtcactacccacctattggtctgatttaccagaatccaatctaaagtccatatattttttaaaatacttttaattgaatattcatcagaattttggaaacttctaaccgtaagaataaatgttagattactaattatgggtgaattgagaattctttatccaacttatcatttatatagcaaaaacatcccccaactgacaacaattttgagtaaaactttataatctttcttatagccatatacgacagagaagggacatgtaaaggaaaatattttgtctatacagaaatttatgttttcctttgcatttgtaacatatttataccactaatattctatcaaatagtttcagtcaaaattaatttatctataatggcagttgcgtattgtgtgtgttacgaaactattacgacaatagagtttttttttctccgaacattcatatatccttaaataacccatgaataaaaaaacatatgaatgggaatcattcatacgtatgttgttaggtacgtgtatacgcacattcatatcaaaacacaagaataaattctatacaataaatgcaaaaattcgtttgtattgtaatttgcctcataaaacaatggtgggttgagaggaacaaagaaagcttgtacagtaaataaccaaatggctgaagaagccaaatgtgccaacaataagaggacccacttcacaccaacaccttcacgcttctttctatcttctctttgcttactagattttctcctttttaatctcttccttaaacaaaaaagctgttttcaaacttaaactaaaaagcttcatattgtcaccacattaattccaagaaaattcgcattaatgctctgcaaaatttaatgattttaaaattaacatttgttcctttattcaagaaaaattcgcattaatttatttatttaagagatgattacctaaaatggtgtgtataaattgcaaaattagctctgttgttctgctaggagagttaatggagaaagagggtgttaccattaccagtacaactatagttgcagagttcaggggttccttggagtagcattaaagtctcaaaggagagaaaaataaaaaaaaaatacattaaagacaaattgagtcttttctcataaatggtttctttgtagtgtttatgatttgtttttacagagaaaagatctaaaaagagaacaaagatatg

SEQ ID NO: 36725 - DNA, 3003 bp, Unknown; identical to SEQ ID NO: 36724
  misc_feature (1)..( 3003): 2750-1469P.txt file - cDNA_ID_3099678; gDNA_ID_2936581; Annot_ID_143755

SEQ ID NO: 36726 - DNA, 3000 bp, Unknown
  misc_feature (1)..( 3000): 2750-1469P.txt file - cDNA_ID_3099684; gDNA_ID_2936581; Annot_ID_143754
gtatcttccgacatgggttcggtatctttcaccgttttccaccgttaacaccttccagtcatcaagctctttagcattagcaacaatgcaaaagaatctaactttgcagcagtgtaatgaaactacaatgatcatgagaaaaatctgacgaaaataaaccatatctttgttctctttttagatcttttctctgtaaaaacaaatcataaacactacaaagaaaccatttatgagaaaagactcaatttgtctttaatgtattttttttttatttttctctcctttgagactttaatgctactccaaggaacccctgaactctgcaactatagttgtactggtaatggtaacaccctctttctccattaactctcctagcagaacaacagagctaattttgcaatttatacacaccattttaggtaatcatctcttaaataaataaattaatgcgaatttttcttgaataaaggaacaaatgttaattttaaaatcattaaattttgcagagcattaatgcgaattttcttggaattaatgtggtgacaatatgaagctttttagtttaagtttgaaaacagcttttttgtttaaggaagagattaaaaaggagaaaatctagtaagcaaagagaagatagaaagaagcgtgaaggtgttggtgtgaagtgggtcctcttattgttggcacatttggcttcttcagccatttggttatttactgtacaagctttctttgttcctctcaacccaccattgttttatgaggcaaattacaatacaaacgaatttttgcatttattgtatagaatttattcttgtgttttgatatgaatgtgcgtatacacgtacctaacaacatacgtatgaatgattcccattcatatgtttttttattcatgggttatttaaggatatatgaatgttcggagaaaaaaaaactctattgtcgtaatagtttcgtaacacacacaatacgcaactgccattatagataaattaattttgactgaaactatttgatagaatattagtggtataaatatgttacaaatgcaaaggaaaacataaatttctgtatagacaaaatattttcctttacatgtcccttctctgtcgtatatggctataagaaagattataaagttttactcaaaattgttgtcagttgggggatgtttttgctatataaatgataagttggataaagaattctcaattcacccataattagtaatctaacatttattcttacggttagaagtttccaaaattctgatgaatattcaattaaaagtattttaaaaaatatatggactttagattggattctggtaaatcagaccaataggtgggtagtgacgaaattgaaattaataatttaggcaaacttctctatctttcttgtcacattctaaagcttcccaaagtgagatggttagttgttcataatttcacaaaataggtcgcaaagaatattatcttgtagaatatgatgttgatttcgttgagaagtttatactatgattttcttagtttgatatgatgaatgactttttagaaagctagtgtttggcctttgaatgcgtttttaataatagttatatcaaagttcatcaaaataagatcatatataatgtgtttacaaggacataatattgaaatgagggagagacatatgattggaaaagttgtatttactttcatcattttttatggtatcaaagcagaggttgagaattgtgtgtttcaatcctatctctcacgtcgatagaaaaagatgttaaaaaattcccttagtagtagattactagattgaatgatttattttaccattgagattgagtaaaacgaatatcactagacattttttttttcgcgaatatcactagacttgtacacaatatttgttctctattgttttcactctttctacttggttcatttaacttctcaagtgtcagcaaatttgatatacgtggggccaatgttgtatgaacttgtcttagagacttaaacgtattatattggaatagtctacatactttgttatctctattatataacatatacacggtaccgtagatcacgtaatgctaacatgagtgattagttacaaattttcaaagtctaggtgttacttgtcaatcaaataaattaaaaggagtttaggagtcaaagattataagtcagcgtatcgagaagaccaatgaaaaagtaagaaaccataatttagggatgatatatatgctaaagtatctaacttttttcatattcaaaagtcgaatgcagaaagttacaacttttgtctgcatttctcagagatattgagaagagttttatgagttgatgtgttctgtctacatttagcataaaaaaggggaatccacatttacagagagttgtttgtacccactttgtcttgagaataaagtaaataatcagtttggagaaacaaacaaaaaatttaaaacaaatatactagcccataaattgtcagatatatcacatgctagtttggagaaaattgtagattccatttgcaagaaataagaagaaaagaaagacaaatatttcatttctttttattttaaactgaaaaatgaaatcaaataattggcgatttttagatttgtggttcggtaaaggaaaacagtacaattgcgagatttgtccttgtcaccgcaacaaatatatttcgcaataataaatgccaattaaagtataccaccggcaccgaactagtcaatgacgtcactctatctgagacataagcccaattaaatcgtgcggttaaaagcccattaactaatatcaatataggcccattattaagaaactatactatgactttttagtatatttcgcgctttaagctgatttcaggaatttcatggcaatcccgccaatcgcccactaaaatcattcaccaatttttattttatttttaaggtttaaattaaaatttgaatttatttttctccagagacagagagagatg

SEQ ID NO: 36727 - DNA, 3000 bp, Unknown
  misc_feature (1)..( 3000): 2750-1469P.txt file - cDNA_ID_3099689; gDNA_ID_2936581; Annot_ID_143751
ataatctgaaatgccgaatataaacagaatcatagccgcaaatgatttatttttatataaccaatgggtttgtaattaatattactcgaatctgtaatattttccctccaccaagtttgaaattggactaacaatggaatcaatagcacaatcaggtataagaagttttagtcatttgatcgagattaatgttggagtgtagctttgtttgggtcatgttttgggctcttctccatttcatactttgccgatgtgatgaaccacgcactaacatgggtatagttcgttcgatgtttctattgggcctttactcgtaatattgggccataatgatcacgtgacttagttttgttttgtttttgtttgtgttcatgtaattttaagtagtgggcttcaacttgttttgagcccatagcacatgatttccctttattgtttattggtctactttttttttttttttttttttgtgtgaacattggtctacttttaaaatcattaaactatgtaaattagaatctaaaataaattcctccattgactcccaagtcttcatcattagaacaagaatattcttgtatttattataatacttattataaacaatttccttttctggtgagaaaaaacaaaatcaaaataaaaaatttccttttcttagcgacacacatttacttaacccacaagtcgtcaacggcccaaagaatatggatggttacgagagagcgcatacaaagacgcgctcctaaccgacccaattagagaaaacacacgcttgcttacacgcgtaataaggttcttacacgtgccaaaaacccttgttatataaagaaacctaggtcacgtcaatttctcatcaccattgctttgttttgttcgtcaaatataatcaattttaaatttcttctcttctcttcaaacgaatcgcctttttcgataatctctttgcatcgatttcatcatggctactcaaacggatctcgctcagcccaagcttgatatggtaaattacgtaaatctctctcaatttcttatcgtttttcgtctcaaatcttgattttacgtttctgtgattgtaattttggaggatttttggttcaattttgttcacatgtctctacctatcgcattcatggatctgtagttcaattctttcagatcgtattcgtagtgcatgttaatgttttgtttatgtagaagattagattaatgaattgaaaacaaatgatattttgtgggctaattaatttgcatgttataattattgaattgtcagaccaaggaggagaaagagaggttgaagtatttgcaattcgtgcaagctgctgctgtggaagctctgcttcgctttgctcttatttacgctaaggcaaaggacaagtctggtcctttgaaacctggtgttgaatctgttgaaggagctgtcaagactgtcgttggtcctgtctacgagaaataccacgacgtccctgttgaggtccttaaatacatggaccagaaggtacaattttgactctttccctatctttggatcttgctgaaagtgcctttgttgatgaacaatgaatgaatctgtgttgttgattgtatatctacttcatcgaacatatgtgattaaaaaagtacagttaaagttgtgatgatttcatatcatctctttggtagaaggttcaggtaaacgggtcaatgtcattatgttctgtagagtccctctttttgaagctgacaagtttgttttgcgttgttgcaggttgatatgtctgtgactgagcttgaccgtcgtgtcccaccagtcgtcaagcaagtgtctgcccaagccatctccgctgctcagatagcacccattgtggcacgtgcgttggcctctgaggttcgacgtgctggtgttgttgaaaccgcttctggaatggctaaatccgtctactccaagtacgagcctgctgctaaggagttgtatgcaaactatgagccaaaagcagagcagtgtgccgtttcagcttggaagaagcttaaccagcttcctctattcccaaggctggctcaagttgctgtaccaacagctgctttctgctctgagaagtacaatgatactgtggttaaggctgcagagaaagggtacagagtcacatcgtacatgccattggttccaacagagaggatctcaaaaatcttcgctgaggagaaagctgagaccgagcctttggagttccatccacttgattgatatgggtgttttgttagtgtgattttttgttttgttgggattaaggtgaaccggatcttggttagcgattgatctctggttctcgttcttttttttctttgtcatgaacttttgttgtttcgtttaataatcaaaagttgtataatctaagtttgggattaccaccctattgagtattgagtgataaaaaaaaagttgcgtgaattatcgccctattgagtgatacatcatagtattacatatttatatcctcagaaaatggaccgagaatttttatcaagagatgaatattgttgtcggtaggatttaattatcagtttgtatatatgcagacatatgcaactcgtatgtattgtgatatgcagatattactgatatctataacaagtttgtgaaccttttttattgacgaggtatgtcatcatgtttgataatcgttagcgttattaacagcggtgagagaagcagacttgagatttgctttttcaagaaactatgggcccatgtcgcgctgatccgaaactttaatcccaatagctattatgcacacaagtcaccgccgttcacgttagcactccaaacccttggcacgtaaacctcccgacacttgctctctttctctcatctccacgatcttctcactctcttggtgagctttttctttcccggtcaaaatttcgactatagaagtttcgtccgtcggtctttctaactgaatcaaattttcacaagtaatctttcgcgcggctcgttttatagaaacacgattcagaatg

SEQ ID NO: 36728 - DNA, 3000 bp, Unknown
  misc_feature (1)..( 3000): 2750-1469P.txt file - cDNA_ID_3099698; gDNA_ID_2936581; Annot_ID_194902
gagtgcactgttgttcaatcttaaacttcgtgatcgatttcgaatcgccgtcgatgatcaccgtggtcgagctacggttttctcaccggatggttgcttctcttccactatccaccgctgggtgactcgattccggaactttcgccgggagtctctcccttctccaccggctttttatcgcagacgaggtttgaatgaatcattaccttttattaactctaatagtggatctgtgtaattgagctttgtgatttgaacttcagctgtttctctgagagatggtttgagtcgtaatattggcgtagattagctcgatggtgttatttgttttgtatcacctgaaggatttgtttttagcactttttggcaatagttttagctgtcattccaagctgctccaatgattctgtttgttattatgtctactatcttgatttgtgggaatttgaattgacaaaactccttgttcttgtagtttctaaggacttaacggcagaagaagagtctgctcttttccggatgctacaaactgtggctgttccccttattggaaatgcttgtcatgttttcatgaatggttttaaccgtgttcaggtttgagacatcttagatttctgcttcacaaatttcattcttatctttagtcctgttatcagttcttattttgtttatctttttaggtatatggtttagagaaattgcatgatgctttactcaacagaccaaagaacaagcctcttgtaacggtatgagttgacttatgttctgaaatgttgtgtgtttgtggttggggttttagatgaacctgcttgttttcttacccatgaacttcttaataatcttcaggtgagcaatcatgttgcatctgtggatgatccatttgtcattgcttcattacttccacctaaatttctacttgatgcccgtaatttgaggtggacgctctgtgctacagatagatgctttaaaaaccctgtaacttcagctttctctcgatctgtcaaagttttgccaatttctcgtggtgaaggaatttatcagcaggtaacacaggctgtttttgtagctagcttttcttgattgttacctgctattttatctatattcaaatttactgatgaaaacaagtgtcacatcttctgcagggaatggacattgcgatttcgaaattgaacaacggagggtgggttcacatctttccagaaggcagtcgctcccgggatggtggaaagactatgggctcagcgaagaggggtatcggaaggtgagtcatgtgtgatttgggttcacttcccttatataaagcactccactttaatgtgtcttatcattttattctataacaagttttatttgttttaggttgattttggacgcagatactctccctatggttgttccttttgtgcatactggtatgcaggatataatgccagttggagctagtgttccacggattggcaagacagtaagtatatctgaatctccaattttttcttcctcgtttgtagctttcatttttgatctcttaatagtttgatgcatcatgatctctgctccgcccaaaatcagaaaacaaataaaaaaccataactttcagagaagtagttagttgcctcgagttaaaatagtttaagagtgtattgctttgtttgatttgcaagcccttggatacagatctaagacctctcgcaatttttgttggacttgactttttagtgatccgaggagtgaatcggatctcgaattaatgatttaagaaagaaaggatctatcgataattgggtgattcatattttgagtaagtggatatgtattgtccatggaaggatatagagttcaaatgccagacattttgtagtgttactaattgtcattaggttattacattgcttaattatgtatttgcaatctttaatctgtttgatttacgtcaaacatttcgcaggtgacagtgatcattggagaccctattcattttaatgacattctcagcactgaaggagcccaacacgtctcaaggaaacacctgtatgacgccgtttcgtccagaattggacaaagactgtacgatttaaaagcacaagttgatagagtatatatagaacaacaatctatgatgtcacacaatgccaaaacaccctcggaccgtgctgctgagatctttcatagagtcgattgggactcatttgggatgggagcacaattttcagaagaatcatcacccagtagtaaaccgattggccaaagcgatgatcgcattgtcagatctcccaaaaggagagtctcacccgaaggaggggtcagcttgaagattaagaagctcatggactcaaccgagatgatggggtttgcggctagagggttactaatgaacgagtacaagagtcgggttgaatctgccaatgttggtaggcctttaaaggcttggagagagtattttatgaaccgtggattataacttgcaagttaaactcccgttaggaatattagtttagtaatgaggtttaagtcccacaggccacaacaaatggacatgtttttacttgtctaatatagatttagctagattttttttttcgatcacacatgaactcttatctatctcgttgttgttgttgtaaattagcttttaataaaatcccagtttctcgaacctttttaatcacagcaaatactacattaaagattagatttggtgtgttttgctaaagataatgcctttcatgcgcttaaattaatttgaatgggtttcgattgaaattgggatatttgctgcaaaaacgatgcggttcgagtaagaatggccacgtggcacaatctatcacatcaaaacgacaccgtcagaattcatcatggtaaacgaacggtcatgatttaatcgcgatccaacacaggaaagtttatgagtgtgcaatgacgaatgtatccctacagagttcagaatatcgacggcgacaatttctctctccggctaacttttttctagagaaagctatg

SEQ ID NO: 36729 - DNA, 3000 bp, Unknown; identical to SEQ ID NO: 36728
  misc_feature (1)..( 3000): 2750-1469P.txt file - cDNA_ID_3099698; gDNA_ID_2936581; Annot_ID_143749

SEQ ID NO: 36730 - DNA, 3000 bp, Unknown; identical to SEQ ID NO: 10587
  misc_feature (1)..( 3000): 2750-1469P.txt file - cDNA_ID_3099721; gDNA_ID_2213664; Annot_ID_132654

SEQ ID NO: 36731 - DNA, 3003 bp, Unknown
  misc_feature (1)..( 3003): 2750-1469P.txt file - cDNA_ID_3099721; gDNA_ID_2936581; Annot_ID_194922
gtcaacctctataataattccttcgaatccatgctcccacttgacatgagtggattccaaaacttggactattttaatgttggtgaaaactcattttccgggactttgcctaaatctttgttcacaattccttcattacgttgggctaatttagagggaaacatgttcaagggacctatagagtttaggaatatgtattcaccatctactaggcttcaatatctatttctttctcaaaacaaatttgatggcccaatccctgatactctatcccaatatctcaatctcatagagttagatcttagtttcaacaatctaactggatctttccctacgttcttgttcacaattcccacgttagaaagggttaacttagagggaaaccatctcaagggacctgtagagtttggaaacatgtcttcatcgtctagtctcaagtttctaaactttgctcaaaacgaattcaatggctcgatccccgaatctgtatctcagtatctcaatcttgaagagctacatcttagtttcaacaatttcattggtacaatcccaagatctatatcaaagttagccaaacttgaatatttttgtcttgaagacaataatatggtaggtgaagtaccaagttggctatggagattgacaatggtggcactttctaacaattctttcaacagttttggagaatcatcagaaggtcttgatgaaacacaagttcagtggttggatcttagttcaaattcatttcaaggaccatttcctcattggatatgcaagcttagatcgttggagatcttaattatgtccgataatcgcttcaacggctcaattcctccatgtttaagcagcttcatggtttctcttacagatttaattctacgtaacaacagtttgagtggacctcttcctgatatatttgtcaatgcgacaaagctactatcacttgacgttagtcgcaacaagttggatggagtactaccaaaatctttgatccattgcaaagctatgcaacttttgaatgtgagaagcaacaaaatcaaggacaagtttccttcttggttaggatctctaccgtcattacatgtcctcatcctacgatcaaatgagttttatgggacgttgtatcaaccccatgcatccattgggtttcaaagtttaagagtcattgatgtctcacacaatgacttgattgggacgttaccgtcattctatttttctagttggcgtgaaatgagcagattaacaggagaagatggcgactttagactttctgaggctccatacatgggaaaagttttgaatgctactgcattctttgttgattcaatggaaatcgtgaacaaaggagtagagacggagtttaagcggatcaacgaagaaaacaaagtcataaacttttctggaaacagattttctggaaatatacctgaatccattggattgttgaaagagttacgtcatctcaacttgtcaagtaatgcattcacaggaaatatcccacaatcattggcaaatttgatgaagcttgaggcgttagacttatctctgaatcagttgtctggtcaaattcctcaaggacttggtagtctctcgtttatgtcaacaatgaacttctcttacaactttcttgaaggtccagtgcctaaaagcacacagttccaaggtcaaaactgttctgcattcatggaaaaccccaagctcaatggtctcgaggaaatatgtagagaaactgatcgtgtcccgaatccaaaaccacaagaatcaaaagatttgtctgagccggaagaacatgtgattaactggatagccgcgggaatagcttatggtcctggtgtcgtctgtggattggtaattggacatatattcctttcacacaaacacgagtgttggttcatggaaaagtttcgtcgaaaaaagcccaaagtagtcaccagaattgctcgtccctctaagcattaatttgtgacgtatatgtttgttgactagcgtatattgtttattacaacagcttgtatatttttaacttatattacaacagccagcttgtgtaatcaattgttcaattttttttctttattcaacaaaagaattcatatattgttatatattactgactacagaagctgagagaagaatatgttcttacaagttgggatgtctatgagactagaaccaacaaggatgtctcttgctagttaatttatatgacaaaaggctgaaacatgaacttttaaagatgattccagtcttgattgcaccattaaacgtatcataatccagcgtcaacctcacataagccttcttgtgaacctcacgcaagccttactggttccagtctgatcaatgagttaaagtttcttggtcttatttaacatgtttagaaaatattcaactcacttagtttgattctttgaatcaagttttcagttattagttccaacttgtaaaaatggttgcagaacaaaatgatgaggaagttttttagtatcacataagtccagattcaagtttttttcaattgtatctaaaacacacacaactttcagattgaataaaatctgaatttcattctcagcagaggctaatataaaaatgacaaaagaagaggaggaggataggagctatatgtctactatttttatttttttagccaatgagagagctccacttcataccccacttttaccaatcgagcgatttcacaaccagtctcacccatgtcgcgttgagcgcgtgtctacgatttctaaaggggtttgtccacagaaatcatgccttttttgatccacgcaactcactctcaaaaatccatcgcgtgtcttattttttttggttttcttctctaaaccaaattaaaccgaaccgagatcaatttgaatttcaaaaccaatgtaaacccatcaaacccatcgctgtgaaaacaaaaagctcggccactgtaacaacaaaaatggagacgacacaacttggaagagaaatcaactctaaatagccaagagaatg

SEQ ID NO: 36732 - DNA, 3000 bp, Unknown; identical to SEQ ID NO: 10587
  misc_feature (1)..( 3000): 2750-1469P.txt file - cDNA_ID_3099721; gDNA_ID_2213664; Annot_ID_182041

SEQ ID NO: 36733 - DNA, 3000 bp, Unknown; identical to SEQ ID NO: 36722
  misc_feature (1)..( 3000): 2750-1469P.txt file - cDNA_ID_3099737; gDNA_ID_2936581; Annot_ID_194920

SEQ ID NO: 36734 - DNA, 3003 bp, Unknown
  misc_feature (1)..( 3003): 2750-1469P.txt file - cDNA_ID_3099737; gDNA_ID_2213664; Annot_ID_182044
gttgaaactaagatgtagctcttcaagattgagatactgagatacagattcggggatcgagccattgaattcgttttgagcaaagtttagaaacttgagactagacgatgaagacatgtttccaaactctacaggtcccttgagatggtttccctctaagttaaccctttctaacgtgggaattgtgaacaagaacgtagggaaagatccagttagattgttgaaactaagatctaactctatgagattgagatattgggatagagtatcagggattgggccatcaaatttgttttgagaaagaaatagatattgaagcctagtagatggtgaatacatattcctaaactctataggtcccttgaacatgtttccctctaaattagcccaacgtaatgaaggaattgtgaacaaagatttaggcaaagtcccggaaaatgagttttcaccaacattaaaatagtccaagttttggaatccactcatgtcaagtgggagcatggattcgaaggaattattatagaggttgacaacgagcagttttgttaaattggagaatgtaacaggaatattgccactgaatttgttgtgtgaaaagatcaagtattctagttgggttaggtttcctattgaagctggaagttgacctactaacttattatcccaaaggtcaagaattgtgagtcgagaaaggtttcctatagaaggtggaacttgaccaactaaataattatacgaaaggtcaagaagtgtgagacgaaaaaggtttcctaatgaagaaggaatatctccatagagactacaattactaagggttaagttatgaagatgttgaagtttgaaaagaccactatttggtttcaatgagttattaagaggaacatgactaaggttaagtgaaatcacctcgctagatatagcatcgcacgtgacaccctcccaagaacaacaatcaatgctcttgttccatgaacttaacgatacatcataaggaatttggttggattcatttacccgcggaaactcgtgtttgaactccagaagagcattcctttggtcatggcggcaatggcgaagcgtaggagaagcaagagtgtgtagaaagaatgaaaccatgaagaaaaaacagaagcaagattggcttggaatcatcattacttctttttttttttgttaggagtttgtgtggtagtttataggttatcctgatatggcttctttggctctgttcaaaaagcaaaaaaacgaaactcagttgcttaatttgacttgcgcaagtctttccaatgctctctttgactaatgatttggcctcttgccataatatccatcacaaaattgaaaactctcttcttcgttattaatgtcaagttactttgggtttctataggtcatgagtttgtatttgggctttttatttgggccagatagaatcagatgtaaccaagtctatttaatccgctgtcgtttttaaatagtttatctattttttttttataagaaaaaacaaaaatgattaaccctatctaaagttgttaaaaccaaatgttttagcaaatctaaccaaatatttttttctttgggaagctctaaccaaaaatgattatccttggataattactcaattagtaagatcttcaagaaactgatttcccccattattattttatttatatttttcggtttataaaactccagtaatttcaaatataatcctctgctaccgataccagaatccacacaagtgaaactaaaacaatccaacgatgtaaacaacctcacaatccacgtggacgttcaagatcacacatgcactagcttcagatattaagagtgaaacaaaataaaaggaagaaataaatcgaaaaaatggaaaaaagtgacaaatctggaaagctgattggctgaagtcgtccatgtattcaagtttcgcggcaacacctctcttctcatttttctcattccctaattcttctatatctctctctctttctctcacttcctttttttttttgtttttaaacaaataataatctttctttcttcttccttaatttgccttctctctctctaaaacccttgtttcaaatattttctcatcgatctctttttgaaactaaaggctcgagctttctctatctctctttcgaacccaccggtggttcgggtatctctctattcactcttcaagtcacctaattggttagtggatctgcttcgattagggtttttaaaaggcttttcctttttccgtttcaaattttttcttctttcgactctcaaaattttcccggattttttttttggattctttaacactttctgtgttagctctttttcttttgactcgagttccgttttttctcagctgaggtttagtgggtatttttggaagctcactcgattgaagttttttttttttttttgaggaatcagtttcagatttgtagaatctgcgttttatttatatttataggttagcgattgaagtttcgaattcgattttgttttactatctgaaatttaaacaattttctcaacacattttctcaaattttgtcaaagctcctgacttttgtggatgattttcgtgtttcttcactgtgtgtaattgattccttaatttggtgtgttttttaaaatacccaaattctgattttcgttaatatttcctctcatctcgattactgcagctatttatcttccccaacactgctttttactgatccaagaattggttctactcttttgttaaaaaacgtagagttttgatttttcttagctctaatccctaaaccctaaaccctaaaaacgtcttgatttttcccctggtgaaatgttgaaattcgtagtttgtacatgtcttagaggaagccaaatttgcttatcgacttagtgtcgtatcttgtccgtatcagtttaaagtgtgtcttttgtcacaattgcattttttggtttctaactatatatttgaatatacttgtgcagagaaacgtgcaaatg

SEQ ID NO: 36735 - DNA, 3000 bp, Unknown; identical to SEQ ID NO: 36723
  misc_feature (1)..( 3000): 2750-1469P.txt file - cDNA_ID_3099758; gDNA_ID_2936581; Annot_ID_194914

SEQ ID NO: 36736 - DNA, 3000 bp, Unknown; identical to SEQ ID NO: 36726
  misc_feature (1)..( 3000): 2750-1469P.txt file - cDNA_ID_3099777; gDNA_ID_2936581; Annot_ID_194906

SEQ ID NO: 36737 - DNA, 3000 bp, Unknown; identical to SEQ ID NO: 36727
  misc_feature (1)..( 3000): 2750-1469P.txt file - cDNA_ID_3099783; gDNA_ID_2936581; Annot_ID_194903

SEQ ID NO: 36738 - DNA, 3000 bp, Unknown
  misc_feature (1)..( 3000): 2750-1469P.txt file - cDNA_ID_3099795; gDNA_ID_2936582; Annot_ID_143790
aattggctcaaataacgagttctagtcagtcaaaaacttcataattcacaatgagggaaataaaaggaaaccgacaatagctactcataagtcataactctgactcacatgatacatgggttgagaaagatgctgagtaggtgcgccatggtgctgaaatccagtgtttggaccagtttgagcttgtccatattgatgatgatatggtctagactgttgctgtgccacatgaggacctccaccagagtgcattggttgttgttgcaactgagtggaggaagctggtatatcaagatgatgaaaaggaggttgctgggatgttggatgatgggaagccggaggaggcgcgttttgaacttgagaagactgtggatgagacatagaagtgacagcaggattcagatgtccctgacgctggggatgcgaaaaacgaggctgtgattgagcactatttgcagaaacagaargcggtggtggaggcataggcattggttgtggtgttgggtgttttcgaatcggggcttgtggctgcatcgyattggctggctcatgtacactgccaccgccttggaaagaagacatatgagcttgaacgtttggctttggcgggatagattgatgagattgttgaggttgttgtacagcttgtggctcaactttmggagtctaatagaaacagatttttgtaaaatttaagatgcttgaaatgaaatctattaacaaaatgacttaagaggacgcaagtacataccacttgaggaggctgaaccattccgagcatgatttgtgcctggcatttcaacaaacatagcatcatcatcaccatatacaaattctgaaatctatttgtaaatagaggcataaacctaaagattgttcatatctggaaactaacacaaaaccctaattgttaacctacctgcttcttcaacaatactaaacccaaactagtccaatcaatttactcaagtaagaagctccaaatcagaattcctcattgcttataagaccacacggattgcagatttagaagatggaaaagattagcgaagtgaagaagaacctggaaaagagccttcgtcaaaagagggttccgaatcagaatctccctcgcttgttgatggttttgatcaatcaacgtctgcacaattagattcgactgatcaaaaaaacagaattcgaaaaaaagaagaagaaatcaattgttctctattcaaatccgtaaaggatagtgttatagctgataatcggaaaagtatagaaaagaaagaagagagaaccttcatttgagacataatatcatagagctgacttttagtcattccggcgagatttgccggtaaacctccgtctccgccgatctgcttacccgccatggttctcgtcggtaatcgctaccgagcttaacctgtgtgttaaagacgcaacacaagagtacttgtgaacaaacctgggccaagtataatacgggcccaattagtataattccggcccatttaaaattctagacttattagtctatggcgcctgtagatcaactctttttttggtcaaaaatttaccatttttctcaaaacaaaacacaacaataaaatatagagatgcattagatatgtacgttaaatatatttatatgaaattattaatatgtttctttacatgtaccatgttaattgtacacgtaacatgcatgtatattgtataatatgtcttttggaaaagcaaaagcttataaacacaagtttacattagagagaagcgtgtgacacggttttggcctcttcactttcttgttgctccagaaatcttctttttatcttgtctccatccataattttcatacgaagatagttttctttatttcatccataatattcaatatatattggattcttgcctttggtaagtcggtaaacatcatcaactttatttttattctttcaggtaaaaatagagtcttccactacattcatcttccacaagttttgctaattttaagttttgggtaagaataactaacccatgtatatttcacaattcattcataacaaatcaaatgattatgagatatacttatgggttatatatctcaagggattcagtgatctttaaacttggcacttggtataatttcagcatgccctttaaagaatgagtaggcgtataatcttgtctcaagaaaattataagaagtccaaatttataaacatgtattgagacaattaaaagattagaattaaaaaaaagaaaaaaaaaagaaaaagagacgcactcaactcaactttctattttttatttttgtaaaactacaaactttgcttttgattttgtagccgaggtagtctctctctctccatttgataggaagaagaagaaagatacaaaaagataaaagaaagagagaaaaagagttttaattaaaatgcaatgttatacaaatgaagaagcactagcaagtctcttcatcaatgtctcaacatctttctttcttctcctcatcctcctctactccgccgtctccctcctaatcaagcttctccacttcatcggcggctaccctctcctccaaaggtctctatctatacatgcttatatgctcaccttactctatacacacacatatatatatatatatatatatatatatgtatatgatactaagtttcattttcccttgttttcggattttagcatattgcttagttttatattgaagatcttttaaattctgcaatgttttgtagagtagtttcatatttacgtgtttccggaagttagcatatatacagctaaaaataaaggtaaatggttgcttttgatgagtttttcatatagttctgaaaagtgataaaaaaaacaatcggtaaacattattgttctcagttgggacaaatcttaatagttttcttattatgtaggaatgaagatgaatatgattccgcggcatggtattccgaagaagaggaggaagaggaagaagaaggggaagaactcaagatg

SEQ ID NO: 36739 - DNA, 3003 bp, Unknown
  misc_feature (1)..( 3003): 2750-1469P.txt file - cDNA_ID_3099800; gDNA_ID_2936582; Annot_ID_143789
agtttattatgtacgtgtacatggtattttagaatgaggacttttcacgagttttttacttcaaatttacaatttttgttttcattatattacgtactttcaaataaatgtttagaaccatatactttttttttgaaaaattagaaccatatatatactttattcttaaataaaattttgaaccaatatgtctgtaattttgcgctctctccgttttcatgatatagtaaaatatgatcctcaaattcttaattacgatctaaccgctagttcatgtatggtactaaacttcatcattcttttcggaaaataagtcatagtgaaatacagtttggtgaagacactgttatagatggtgtttttttttcgttggcaaacactgttgaagatggttaatatcaaataataaaattgatcttgttgaaatattaaaagacaaaaaaaaatgaaaaatttaagttctgtgtaaaactagctattggtggttagtcaagaggaaacttataatggaacccactggtgatctgattctgcctccttattggttgaaatatactgtcatctccgtttttgcactctgattggctcaagttcttccatggagattcttacgtggaccccacattttcaagttttgttttgaaactattttgtttgttggtgcgtttgcatgaccgcaacgcagcgtgatactttaaacgcaggaagttacttttcatcttttcttttctttttttgtatagcaaacgacattcttttttggaacttccaacaacacctgtgaagttttgtagaacatttaacatccaacttctaatgtttgatgatagaaaaaaggattatatgtcactaaaaatgtaaaatttctgcttttgtgatcttagagatgggtgtttaatcagcacctaaagattcaaatgggtcctaaatttaattattatcatttattgtggatctaacataacggaaatgatatgagtaatggaattctagtcctttaaagaaaggaattgattgtggtgatatagcgacgtgacaatatatacaaatcaagaggttgtgacttcatcgaatttttggcaattttgcagtttacgccaaaagaaacaaggaaacaaacaattttacgccacatgacccacgaacaattgaacatctctctatcataggactcgttcctctgctttacaccaccattttatttatattactttatatggaatttacgcaagttatgtgacatgatatacaaaccttaattatatcaccattcaccaccaagttgaaatctgcacatttttgtgatacatgtgtagaattaataatataacctattgacgaacgagtgaatttcggaagtggaggcacaataggccttgattgatatgagagaccacttgctaacatagatgcgggaaatctttttgctttcatacgtccgattgctctgcgttgaagtgtgatagatcggtacttgaaacagttaaaattatcccaacactaattaataagtattaagtaacaacaataaaaacaaatattcctatattaaagctcgatatgataaataaatgtatcactacaacgttttccttaaatctgaagtattttcttgtctattttgaacgaaattaaagatcaatttaccactactatatttttggttttgttttcataacctatggttttaagtataaagtatgctaactctataatattgtagacggtggaagtaaagtaccacaacacgacgtgtgcccaaatcatacatgatacatattaaaatgttccgttggtcgtcgtaccccaattatatgttacaagttaatcgtttcttaatccaatttataatctgttaaaatactcgttaattttaggcaaggatttgccacgtgtaataaacccgtataaacgattggagaagccaaaaaagacttgttaattactgcgcgtcctcctacattcgcgctctctccctccgtacaacaaacaaaccccaattttttttttcctactctgtatagataatttttaatcattagagaaaaattaatcgtttaattagtttactattatccgctaataataatcaaaagatcaaatcaacccacattcccatcacgtctattttctccgtctctctgttttcttctctcaggttttagacctcctcaacgctcgtttccaagctttcccgataaaaacatcgtcttgattttctaaggtaatgagaacaaagatcgcatctttttttctttctcctcatatctttgttgccatgttgcgattttgctgatcgcgactttgagctatgttttgacttggtttttcaatgttgaatttttttttctcttgttgcaccaatgtacccttctggtaggttcgtctttagttttgtttccttctggctagttttgttttatcaagttttgttcgattgtctcacgttgctgtttttgtcttaatccctcaattcataatgctgtataacggttaaatcatgtgaatttatactgggaactagaaaaaatctcatctttgaatccctagattaatgaaattaatggaaatgtgattgttaggatttagtatcggctttaaatatggaaatatgagaaatttccttataataaattaagaattctcaaattcatcacagtaatccctgactctggttactatgttttattgtcagctaagattttttattacagagtaaagctgattacaatgatgactctgagatagttatgtctagcagtgccatttgatcatgttcttgcacgtctttgcatgtaggaaaagacaaaaagaactaggctttggttttcttttcatctagattgctcttctatgtgtgtgtgtgtgttcttatgaattttgtctaatgctcattttctttccctcaatcaactatgtttcaggagtttttgctaaagaatgcagcagttttggggtttccaggtgtttccataagtttgctttggacctcgaggcgtgatg

SEQ ID NO: 36740 - DNA, 3000 bp, Unknown
  misc_feature (1)..( 3000): 2750-1469P.txt file - cDNA_ID_3099805; gDNA_ID_2936582; Annot_ID_194965
ctgctagacataactatctcagagtcatcattgtaatcagctttactctgtaataaaaaatcttagctgacaataaaacatagtaaccagagtcagggattactgtgatgaatttgagaattcttaatttattataaggaaatttctcatatttccatatttaaagccgatactaaatcctaacaatcacatttccattaatttcattaatctagggattcaaagatgagattttttctagttcccagtataaattcacatgatttaaccgttatacagcattatgaattgagggattaagacaaaaacagcaacgtgagacaatcgaacaaaacttgataaaacaaaactagccagaaggaaacaaaactaaagacgaacctaccagaagggtacattggtgcaacaagagaaaaaaaaattcaacattgaaaaaccaagtcaaaacatagctcaaagtcgcgatcagcaaaatcgcaacatggcaacaaagatatgaggagaaagaaaaaaagatgcgatctttgttctcattaccttagaaaatcaagacgatgtttttatcgggaaagcttggaaacgagcgttgaggaggtctaaaacctgagagaagaaaacagagagacggagaaaatagacgtgatgggaatgtgggttgatttgatcttttgattattattagcggataatagtaaactaattaaacgattaatttttctctaatgattaaaaattatctatacagagtaggaaaaaaaaaattggggtttgtttgttgtacggagggagagagcgcgaatgtaggaggacgcgcagtaattaacaagtcttttttggcttctccaatcgtttatacgggtttattacacgtggcaaatccttgcctaaaattaacgagtattttaacagattataaattggattaagaaacgattaacttgtaacatataattggggtacgacgaccaacggaacattttaatatgtatcatgtatgatttgggcacacgtcgtgttgtggtactttacttccaccgtctacaatattatagagttagcatactttatacttaaaaccataggttatgaaaacaaaaccaaaaatatagtagtggtaaattgatctttaatttcgttcaaaatagacaagaaaatacttcagatttaaggaaaacgttgtagtgatacatttatttatcatatcgagctttaatataggaatatttgtttttattgttgttacttaatacttattaattagtgttgggataattttaactgtttcaagtaccgatctatcacacttcaacgcagagcaatcggacgtatgaaagcaaaaagatttcccgcatctatgttagcaagtggtctctcatatcaatcaaggcctattgtgcctccacttccgaaattcactcgttcgtcaataggttatattattaattctacacatgtatcacaaaaatgtgcagatttcaacttggtggtgaatggtgatataattaaggtttgtatatcatgtcacataacttgcgtaaattccatataaagtaatataaataaaatggtggtgtaaagcagaggaacgagtcctatgatagagagatgttcaattgttcgtgggtcatgtggcgtaaaattgtttgtttccttgtttcttttggcgtaaactgcaaaattgccaaaaattcgatgaagtcacaacctcttgatttgtatatattgtcacgtcgctatatcaccacaatcaattcctttctttaaaggactagaattccattactcatatcatttccgttatgttagatccacaataaatgataataattaaatttaggacccatttgaatctttaggtgctgattaaacacccatctctaagatcacaaaagcagaaattttacatttttagtgacatataatccttttttctatcatcaaacattagaagttggatgttaaatgttctacaaaacttcacaggtgttgttggaagttccaaaaaagaatgtcgtttgctatacaaaaaaagaaaagaaaagatgaaaagtaacttcctgcgtttaaagtatcacgctgcgttgcggtcatgcaaacgcaccaacaaacaaaatagtttcaaaacaaaacttgaaaatgtggggtccacgtaagaatctccatggaagaacttgagccaatcagagtgcaaaaacggagatgacagtatatttcaaccaataaggaggcagaatcagatcaccagtgggttccattataagtttcctcttgactaaccaccaatagctagttttacacagaacttaaatttttcatttttttttgtcttttaatatttcaacaagatcaattttattatttgatattaaccatcttcaacagtgtttgccaacgaaaaaaaaacaccatctataacagtgtcttcaccaaactgtatttcactatgacttattttccgaaaagaatgatgaagtttagtaccatacatgaactagcggttagatcgtaattaagaatttgaggatcatattttactatatcatgaaaacggagagagcgcaaaattacagacatattggttcaaaattttatttaagaataaagtatatatatggttctaatttttcaaaaaaaaagtatatggttctaaacatttatttgaaagtacgtaatataatgaaaacaaaaattgtaaatttgaagtaaaaaactcgtgaaaagtcctcattctaaaataccatgtacacgtacataataaactatgaatagaattatgagtttttatttatatttctatctccactccaaataatttagaccacacaaggtaatgaaaaaataataattctgaaaaaaatgaaaaatactgccgggaaatcgagacgccacacacactagtgaattcgttgcaaaaccatatatattacagtattttgttcttctcaaggcctctctctccatctcagcaactctctcactgtgtaatatacacacacaatg

SEQ ID NO: 36741 - DNA, 3000 bp, Unknown; identical to SEQ ID NO: 36740
  misc_feature (1)..( 3000): 2750-1469P.txt file - cDNA_ID_3099805; gDNA_ID_2936582; Annot_ID_143788

SEQ ID NO: 36742 - DNA, 3000 bp, Unknown
  misc_feature (1)..( 3000): 2750-1469P.txt file - cDNA_ID_3099810; gDNA_ID_2936582; Annot_ID_143787
tggtaggttcacgttgtgttatgttatcagctttgaccttggcttcacaatatattgttcaaggctgaaagctttgctttctattgttctcgatgttatttattttgtattagactcttactctactagtttcatcatttatgttatatttctgctgtgaatgcagatttgaacttctagaccatcaacatatagagtttgataaatttggtatgcgaaacaatgttgctcaactttgtgttttagaggtatgcaccgttttaagttatttctgtattgtcgtcttccccctcttttctcctctgtcttttcttgattctagaagcacagagatatgacaagcttaattgtgggcattattttatatatttttccctcctgttgtgttttcagctttgcaggctaattgcttaattttcttagtttcagcccttgcaattaattaatttacttgattgtctattacggaacagatgaactgtgaggaggacccaaagtctaaattacgggtgcgatcatcagagtatgtctgagttctgttctgattcctttactggagtgaatattgaacttacttttaagatccttactaaattttatgcgcacttccatgtttggttgatttatgcaaacttctactagtcctcgaaggctagtggttgggaatatacatgtcctattcaatcctaagcgtggggatatcaagcttggccaggtatgtcttgctagatccttacaaaattctgataaaaactggcttatccataaaatcggtagagcatttctgtcactacacatcctgagtttagaaatgtcaattttttagctagtactattttatggtattcatcagtacatcaatgcctgtcagtattgaaacttcattgaaattctaagtagctcgctcatttcttgatatttgatatgtcataacttataggtaagactctttctggagaaggcttacaagctatcacaggaatggggaaatattcctgtggcgattgcaggtgatctgaatagcactccacaggtgatctctaccaacttttgttttttttgttctaatacttattttttagctgaattctaaaacttactctggatttgctgtacagagtgcaatctatgatttcatagcttcagctgatgtgagttccattgagggttctggactctttcttttacatttcgcctggtcataatttttttcctttctttactgggaaagttagaatgaactctttatattccttttttaattttggacagttggatacacaacttcacgatcgcaggcaaatttctggccagactgaagtggaaccaaaggagaggtcattcagaaaccattatgcatttaggtagcttgtaattcaccggggtctttggtttctctaaataatgtatccatattccttttctgcctacctgatgaacggatagattgcttatatctcttctgtttacctgatgaactgatagagtgatagattacttatatttttctttggcctgcgcttaatcaactacgtaatcctcagatgaagtttctatctcaatttagtctaactaaacaactccctctttcgtcagtgcttcagcatccatctccggatcactactcaatgagtggagccaggaagaattacagcttgcaactggtggtcaagaaaccactcatgtccaacatcaactgaagcttaacagcgcatatagtggagttcctgtaagtgtttttgtttcttgttctcgactggtggacgcatcgaaaagagttgaaatctgccttacaggaaaactaagttcttaggaactgtggctttcttttatactagatactgaaaaacgtttagggaaagtagcatgttgtatgatgttatatatccttctagtatgctaagacctgagatcttgcagggtacatatagaactagagatcaacgcggtgaaccattggcaacaacgtatcattccaggttccttggaactgttgattatatatggtaagtctgttgtgcttatgaaatccgaatcattaatcagagctttcaattatatatggctatcaatgttgtgatatatgcacatgtaattttgaaatctcaataattaatctgaggttttgaacccaggcataccaaggaactcgttcctgtgagggttcttgagaccttgccagcagatgtattgagaagaacaggtggactacctagtgaggtaagtttttttttctaggctaaactttttttctggggcaaccctttactttctcgagttactctattcattttttcaagaatgtaaaaactgggattattggaagagttgcatacaagtctctgaccaatgaaaatttgcagaattggggaagcgaccatctcgctatcgcatgtgaactcggctttgtcaatgactggcaatgagccaaaatgttagcaccaaccactaaaccgagccacctgacttggccatcccttgaggtttttgaatgctcatcgaggcttctgaattggagttcggaaacagattcagtaaattgtaaaacataaacaagttttgggctcattcccatacatagatttgcttacttgaaacatttttttttaccttacctacccaagacttgcacctactctttctgcttttaaaaagttaataccaaaatagcatgttactggacgtgtacctatgaggagcgaagacccattttgctactagaagcaaaacaatgtaagagacgttgcgtaaaaagtatctcaatctgttcactccaaaataagctcttctcaagtgtcatctgacgctgcattaatcaaaataccacacggtattatcaaaagtgtcgtaagcattctttccaagtgttgggaatacattgggtacacaaatcggccatttacagttaacacacatctatttaaatcactcttttctctttgctccaccaaaacattccggcataaacaaaaaaaagtcccactagaaaagctcattatg

SEQ ID NO: 36743 - DNA, 3003 bp, Unknown
  misc_feature (1)..( 3003): 2750-1469P.txt file - cDNA_ID_3099833; gDNA_ID_2936582; Annot_ID_143781
gctttatggaggtctcatacttttatggaaaaaaaaacgatttggtctcatacttttatgacaaaaaataaagattcctattattcagttcatatgcaaagatgtggattttagaacttcaatataccagctttgctacatggttaatggttaattgctcaatacttcttgcctctttgtttccctggcagagtctaacgtttttggcccctcttctgaagcgcattgacagactcttgcagtttgacaggtaccctcatgtttgatgttaatgatttgataggttttaacagaacttattactgagagcttgttggagataaatgtactaggttgatgccaagctacaatggcatcttgacaattagctgcatccgaacattggcacagactgctctcaagctttctgattccatcagtttcgtaagttctttcctttcgcttttttcttccaattgctccttatgagatagataccagcggtgattaaaagcttgcaatttactgacttcaggatcacatctgtaaacttattgaacctttccggaattcggatacaatattgcaaattcgtatagaaggaagtagggcacttcttgacatcgagtaccaatccaaaggcataagttccgcacttttgttgtttatgaaatatttggtagaagaatcatctttgagaggttggttatattctcatgctggaacatagcagctttctatttctaatagagttcatttattgcttttatatctttggcccttgattacagggcaggtaaaattgtgtgtacacacaatgcggttatgtcaaatagcagttggatgtgactcagacgattgtgtcgacactgttactcttctggatttgctgcatctattcaagagccatgtagtatttaacaatgaacttcttcgctactacttgttctgcatttttcaaatcctcgctggaaggtctgtagtttacttccttcagtggattttgtttggaatccagttgttctatttgagcctagagggttatttttctctgttttcttctgcttatcaccataattatccacattctgaacagaatatacttattgttgtctcattttcagacccccaacgttgttcggagttcccaaagaaaaacctttgcagcttgttgatgtggaggcctgcattgaaccgaaaaatgtatttttggttcccggagcagaggcaggggagccttcactttcggcacttggagatgccaaaggacaatcgctggatgttgctccttatggtgttccaataataccacaggaaatgttcatgcctattgttcctgaactgatgttgccagaacctgttgcagcgtatgatgagacacagcatcttgaacctcgcatggaaagtcaaaaccaaccttcacatgaaaatcccatcgttcatgagattccatcagatgttgaaggtccaacagaagaattagctcatagggaagcaaaccctccaacaaaggaacctcaaaaagaacctgatgtggtttctgtgtctgttagtcatgaggtgaagaagtctgttatacggatcaaggtcagaccatctggggcaaccagcagagcggaaggatcagcacgaactatagaaagatctcaagggattgtggtacgccatgatatagaccgaggtcaaactagttcagcttcagtggacgccccacagagaatctcaactgacgctgtgagcataagcaatcagaatcacgtggaggaagtaaattcgtgtcacgatgttggttctcgcatgactgcaagcatcggcagtgtaaaatttgcaagcgaaggcgatatttttgggaaagagttgcaatgcactgctgagtctgggaaaccttcgacaagccagaaagcagataataacaaccgaactgtaccacctagcttcttaccactagaccacagtatggaaaacgaggcgcagcagaaatacgcgagcctccaaacactttcgattggtaaagaaaaggaaaagaagaaagacaaggaaaagaaagagaagaagaggaaaagagaagatcccgtttatctagagaagaaacggttaaagaaagagaagaaacgaaaggagaaggaaatggcgaagctcgtgagcagcactacggatccagctaaaaagaagatagagagtgttgcggaggttaaagaagaagaaccaagtgatggtgccatgttgattaaggttgaaccaaagactgaaccatcaacagcagaagctagaccgcttcccaaattccgaatcaaactgaaaagcaaagcgttcaacaactcataaggttagatccgagccagtccctccccgccaaaatctgagtagtaacttttatttccaaaagctttgttgttacaacttgcaaggtgttgtgattatatgtcaatgtaatctgtttattcaatgcgctttagcctctcttgtctagctttggttacacgccagagatgaagcgcgctccacgtcaaattcacgaactaacgttaggattgaaacagtgcacatttaatactaagggaacgatctgacaactacctttaattttatttgatttccagtgcgcaatgtcattaatttagactaatcatattacatcaagaggctaggctaaattacatcgatactaacaattaatggaacggttatctccaaattaaaacaatcagagcttgaatgattttctaaaattttgttaagaaaaataatccaaaaaaaaaaagaaaagaagagagagggttttagacagaaaataaacataaatgaaaagtaaatagagaaaaaacgaaagaggggaaagcgaaggagaagcactgtggaatcgaaaaaacacaaagctgcagcattttctctcaacttggtggcgtcttctctaaccaaccaaccaatcgtctctagtcaaagagaaaaagagcgagcatggaggcaaagctagaaatccttattccgtagtagggaagagaaacagagagaagaaagacgatg

SEQ ID NO: 36744 - DNA, 3003 bp, Unknown
  misc_feature (1)..( 3003): 2750-1469P.txt file - cDNA_ID_3099837; gDNA_ID_2936582; Annot_ID_143780
agactcagacggaagagatacatcttgaaaagctagtatagaaataagtagctttgcttggggatctgcaacatggatagtggactcagagctaaccaaagctctcaaagcttgaaggtaacgtgaatcaaagttttggttttgaagagattcacgaatctcagaccatgcttgaataatcgacctagcagatggagcagaattttgcttcactagatcaccagagacactacttccactcacagtccttaaccattcttcaaggaaaaaactattgttagcttttctcgccatctttaatacaactaattcagtaaatcctcatcaaggtataaaaccctaatcacgacagattatggattgatccaaaactgaaaaacccagaaaaatcgtcgctgaaagataaacagagaaagaacgaaatttcagcataaattcgtcaaactgactcttcaaaatacgcaaaaccagataattaagcgacggaattgaacaaaagagcaaaattgaagaggctttggctacgcagcgagttcaccccgaggtatttcctctctcactctctcgtagataacgagaaaccgccggaaaaccagataatctgcctagtttgcggtgacggagttgtgacgtttgttttgtggttaaggataaaccaaataaaccagaaaaccggagataaaaccgcacggttagtaaaccagctacagaattgttaaatgtctttttcaacttcaatgaggtcaacataatacgtaaacaaactgtaattgcaggtttcgaaatcacatgagctcatttcctcgttgtctacttcccacaaaattcagaaaaagttttgcacaaaacctggaaaaggaaactaattaagtcaacgattcacgtgactggtaacatcgaagctaatttaatttctctttcccttaacaaacacttcttaatcgaaaactagtatagattactgtggtgctaacttcttttttggcatttaaacaaatgtgtacatgatcttttcttttatttctgcttacatgatgctttattattacaacgattagtatcaaatgaagaaagaataaaaagatgagtaaattacatcattacaccagaagtgaaaaaaaataaatcacatgacaaagaagaataaataattcaagacatatacataccaagaaagaatattagctaatatcttatgaattaatcttctagtattagtaaaatatacgtgttttactatatctttgaaaaaataaagaaaacttaaagcaaaaattaagaagacaaatcagtggtgcaaggggtttggaccagatgggacgagtcgtttttcaacgccatatctcgggtcaatctcggatcctcccgccggcaaagctttccgatgattactccggcgaagatctttcaagaacggtgtgaagtcaaacgttttcaccgccaaagctcttcttcccggccggtagtaaagggccggcaaggtaataaccggagaaggaaaagggtttatgggtttggagctgaaattgccaaacaaccctatggagacgaagatgagaagagagatccatagaagaaaccctaagacatgtgagactctagtcgtcgccatggagattaaagatcataggaccatcgaagacataaatgaaatatagtgttaatatatatacgtatacgtatgtgtgtacagagggaaagagaaagagagagatgtgaattggagacagcgttttccaacgaagaaacttcctttgcgttcaaggaagaggaggcctcattaaatttgaagttcgtattaaagtcaaacctctcatcatatattatttattcattatgaatttcaaattgtttttgtacaacagcttaatttacaagcagcataggaaacacaggggaacaaaaattaaatgatcgcttcatgtttttatctaatttgttagcatattgaatgattgattttcttttaatttggatatgttgattgtcttgttgcatcatcaatgtatgttttatttaacaccggaagatcttatgatgggttcattacttcataataatctccgagttctacaagactacaactttcacgtgacttttacagcgacaaaaaatgcatctagcgaaaattaatccacaacctatgcatttttgtcactcttcacacgcgtatgtgcataaatatatagtatatactcgacaatcgatgcgtatgtgtacacaattaccaaaacaattatttgaatattcagacatgggttgacatcaccaagtaatattcacagtatctgaaaactatgttttgacatccctaaatagtttgactaaccagtttaatatgagagcatttgtaagaggcaagagccatggttttgttggctcgtttaatatgctcatttaacccccccaaaaaatactattagatttaaacgtaaaagaattaacgaacacaagaactgctaaaacaaaaaaaaatcaatggccgacatttcatagttcatacatcactaatactaaaagatgcatcatttcactagggtctcatgaaataggagttgacatttttttttgtaacgacagaagttgacatgttaagcatcaatttttttaagagtggattatactagtttttttttttttttttaatgtatggtatgatacaacaacaaaaactataaaatagaaaaagtcagtgaaacctcaaattgaaggaaaaacttttgcacaaaaagagagagagagagaaagaatgtaaatccaaataaatgggcctaattgagaatgctttaactttttttttttggctaaaagagaatgctttaactaagcccataaaatgaacatcaaactcaaagggtaagattaatacatttagaaaacaatagccgaatatttaataagtttaagacatagaggagttttatgtaatttaggaaccgatccatcgttggctgtataaaaaggttacatctccggctaacatatcggcaaaaaaggaacatg

SEQ ID NO: 36745 - DNA, 3000 bp, Unknown
  misc_feature (1)..( 3000): 2750-1469P.txt file - cDNA_ID_3099853; gDNA_ID_2936582; Annot_ID_194952
gtgtattaaaaagttaaaaacaactcataccaaaacatcattcacaagcctctccagctgtatctgttcaatatatgtatgtggaacatatgaaccttccagtccaagttggtctgccacatttttgacaaaggtacggtctttaccttgtaccttcaaaatagagttggacaaacttgatcattaatgtcaaaataccactctaaagacagtatatacgttttgagagacataagagaagcagatcttacctgtacatatgtccgattcagttgttccaaccaatcagttttcacaattaccttgtcatcatcaaagatatgactctttcttttcaggattgttgcaatggtataacccagtgccattaatcctccaagaagacgaacactaacttcaaaagttattctgggtgatataataaatggacgatctgtaacccactcctaagaacacatagaacggtaatcattcatcaaattaataaaccattcgttcagctttgatatgatatggtgtttacagaagaaaaactagtctggacaggtattggccaaacctcaaacatgagattgtattttccatctcggttcctcattctgaggtatgattggcatgcttcaggatcctcgcctggtggtaacagatagatgtcataagtttcctctgtacgttccttgaaatcttcagatagagctgccttcatttgttcgggtgttacagcctttgatgactacagtaagataacaaaaatcactccaaccgggaaagtattgctgctatagctagttgcagattatataatatgctacgatactacacttatgaacaatataaattctgtaacctttaaaatatatgttgggttctgaaagccactgaatgggttgaacttattaaggatcttaatctgagctgtcttcagatcaggttcaataaacgccttgtacataggataaacctggttggagaaaaaaacataagcaaaattttactgtaaaaaaaaactcaaaacatccagtaggagtaggagacatcgtttcatgttttttccatatttgaagcaactccaaacagcaggcatgacagcaagggtgattaatctgggctaaaaaataaaagatagcaaagactagcatgaaaaccgtctcagatatctgatggattatttcttcaggttcctggccagcacgttgaatgtcccgcaaaacacgcttaacaagatcaaaatgcactccaccagtgacagagacacgaagatctagcaaaggccgtagcttctcactcaaagcatatatgccttctagaataacaatgcgagagctaggcacctcaagcgttctatacaaagcacgaagaaactgataagtcattgcagctgtgtagctcttatcaactaacaagtggttcccaggaattcaagtataacgccgtctgtccacaagtttgaaatagtagtaaatgcaccaacgaagaatatatatacctgtaacctattcgagaactcgacttgaagtcatatattggaacctgaacaggttttccatcccttagaccatgtatattgtcaagaagtgtatcatagtcagtcaaccttggatctgtaacaaaatataacagaatcgcaaatgttctttatattcagattatatatacataagaaaggaatgattgaataaatccataaccagaatccagaagggtgaaacatagaggtgcataccatcaaagtttccatcgataacacgagtaccatcattatagttgtccatgttaatgatagcaatactaggcataaaattgagaatcttctcagtgaaaatggttttgccagctccagaaggaccagctaacccaaccaaaatgagcccatcgttcttctgagccaataattgacaagcacgaataacagcgtagaaacctttttcaaaagacaatggatcctctattggaactatctcatatcttccagagtcctttctttttataagctgaacctgatctcgcaacaagccatgccgccggcgaggtgacagagcaacagaactatcgagcgccattgcctcaaagttgcaaatgaagaagaatatctggaagctacaaatttcagacaaagacaagaatttgagatttttaatttcatacgagtgagcaaaaaatgttttttttagatcaatacgaacagttacctatcaatccacgatataagtctaatcaaatcaaagcatgagcagaaatttcattcaatttaacaagatcgatcaatattcatcagaagctgtggaaataattgacatgcacacactccaaatgtaagatttgagctttaatattactgcaacacgacttctaaaacacttggctacacgatcaatacgaaaaatcaaacaaatactcaacagataacatttcgaatctgatcgtaaacaaattagagacgaaaaagcgagaatctttaaacaaacttcacctaacggaagaagagtcaaattggggaaaaacgtcgccggagattattccatattttcgggaaacccagaagcgatagtaagaatatagttggagagatattttcgtagcagtcaatgagagtaagaagatgatggaaggaggaagacggaagctttaccagaaatcactagagaaatcaaacagtaaaccactcataccagattcatttgaaaattgaattttcttcggttattgattgagtcacctggtttatccatctttgtaccgaaccgagacatatacgatataaattaaaccaaatttggtttatactttggttcatattgctcttatttacgatgaaccgaacgaaaccgaaattggattagtgaaccattgcgagccgttagtccacgtaatgactttgaccgtcacacgtcactcacggtgaagcagtgacgacgtggaagaaactcaatctctttcttcttcaccttttttctttttcttcgcactggaaaattccgcaggtgagagagagaaacaatg

SEQ ID NO: 36746 - DNA, 3000 bp, Unknown; identical to SEQ ID NO: 36745
  misc_feature (1)..( 3000): 2750-1469P.txt file - cDNA_ID_3099853; gDNA_ID_2936582; Annot_ID_143777

SEQ ID NO: 36747 - DNA, 3000 bp, Unknown
  misc_feature (1)..( 3000): 2750-1469P.txt file - cDNA_ID_3099865; gDNA_ID_2936582; Annot_ID_194947
acgctttggtcgatccatgtttatatcggtatcaatgacattacaacagaagactcagtgaaaaagctgttcttttatttgtttttgtagaaaatctgatacttttcagagacagctacaacggagctgatactaggaggacctcatttggtttcacctaattctgtaagcaaaagccgccaatgagtgcctttctcgaatttctcatggtgatcggaaagcttcaccggcgtagcgcacattgccgagttcctcttcgatacggagaagctgcaatggaaataaatcaaactcaagggttcagatatgtggtatatagagtatagtattaagcataagttggatattagttaactacctggttgtattttgacaatcgttcacttcggcatggagcaccagttttgatctacaaaacagagaatgataagcaaacactagagagtaatacagacaggtttagaggatttgatgtacctgtccgcttgctaaaccaacagagagatctgcgatgaagttatcctctgtctcgccactcctgtgactaaccatcacaccccagcctgcagcttttgagtcaagtgctgcttgaattgactcagtgactgtcccaatctggttaacctgtgaaaccatgaattacaaacaaattgaaattcttctccaataacgggggttttgtcaaaatggtctagagaattgagattagaaaagagaaaataatataaaaacttttatttttaccttcaagagtagagcattgcaagactgtttcttaatagcttcagctatcctcttcgggttagtgactaacaagtcatctcccacgagttggatatccacagaggattgcaatgaagcccatgagctccaatcatcctggtcaaaaggatcttcgatagagacaattgggaaatccttgatgaattctctgtagaggtcagcaagactctcggctgacagtacgtgagctccatcgtttggctgtttcttgaagttcaaatcgtatctaccatctttcatgaaaaattctgatgcagcaacatccattcctattttgatctgcaaaaattatatattatgtgagtggtgtaagattgacaccgaagctgccagaagttgtttagggaaacacagatgacatgcaactttagcaagtattagcattaaaaagaaagagaacttgattacctttccagtgtaaccggccttttcaattgcatctatgagcagaactagtccctctctgttatcttgaacattcggcgcaaaccctccttcatctccgacattacaagcatcttgaccatacttagttttgattatccccttcaatgtatgataaactgtaatcaacaaagtacattaaatgcattactatcagaaaaacaattctttgtgataatccaaagaatagaagaactttggaaccaaaagagaaatatgaaacaggaagctgcttatcaaggcttttctgtttttctgacatttcattgcaaactcaagaaaaattaggagccgccatagtttcttaagttctagcaagttaaacccagttatcactaactgaccttcacttcccatctggaaggcctccgagaatgaggtagctcctacaggtagtatcataaactcttgcatagccaaactattcccagcatgactgcctccattgatcacattgaatgcaggaactggcatgacaagctcctttgttcctgatgtttcctggatgtgtttgtacaaaggcactcctttagctccagcacctgccctgcaaacgctcaatgacactcctaatatcgcattagccccgagtttcgacttgtttggggtcccatccagttccagcataagagcatcgacatcagcttggttccttaaagaaaataaggtaaaaatattacattcaactatccatcaccgattatagtttcccaacggttcagaatcagaaaccacaaacggaacaattcaacaatgacacctacttcaacacttagtagtatcaagtatgaagcaaaattaaaactacatgcaacaaacaaccttaataaccttaactagaattccaaattcaacagtcatgcattacgattcgaatccaagtccaccaaattgaccagtagtaatccagagcagagaaacaaagctaaaacaactccgaagatttctatctaactaagcataccaactccaaatcacgacgtttatatgttcatttagattgaggaacgaattcttattctcacctaacgtcaactccaatgagttttggagccacaagttcattgatgtttttaatagcctgtaatacacctttaccaccatagacgctcttgtctccatctctaagctcaagcgcttcgtagatcccggtagatgcaccacttggaacagccgaacgatacagatcatcggtaatcagatcaacctccaccgtcggattccctctactatcaataatctgtctcgctttcactcctttcactctgcactccttagccaccaccgagcattggacaccgctgcgacggaatctcagacatgatggcgcagattccaaatatcgttcgccggaaacacgcgacggagagaggaaagatctctgaagatggtgaggttttgtagtcaaagccattacacgatacctaaaaaaaatactctctgtgattcttttgactaaaatggagaagcggagaataaaatgatgttatataatttgaaaaacgtccttttggaggttggtgcaggcggaggcgatgaaaactaaggagtcaaaagaaccatacttaaaccggttcattttccaattggttgactgttaaagagaagtttctggttttggtttggttcggttcggttcggaacaattcaaataaataaaacaaatcaaaaatattcactagcaaagtagtaaccagagacactgtgccgtcgcccgtcgccgccgccgccacactatcatctctctcaggtttttgattttccacggcaatg

SEQ ID NO: 36748 - DNA, 3000 bp, Unknown; identical to SEQ ID NO: 36747
  misc_feature (1)..( 3000): 2750-1469P.txt file - cDNA_ID_3099865; gDNA_ID_2936582; Annot_ID_143772

SEQ ID NO: 36749 - DNA, 3003 bp, Unknown
  misc_feature (1)..( 3003): 2750-1469P.txt file - cDNA_ID_3099870; gDNA_ID_2936582; Annot_ID_194943
caaataaagaaatcattcgccagagtaagatttgtcaaaaaagtcacaagtcaccacgtctcacgagttgtggaaaaaaaaaagctgacctcgagagatggaaaactaaaatccatacaaaaacaaataatccgaaacgagaaagagtacgtgtaatgtatttttgtcggaataaaatcaactgtaaaagatggagtgcgagacttttctaaggaagaagacaagatggtgaatttaaaacattaacaagcaaattgaaaaactaaaacgcatttcaacgacaaaagcaaataataataagaaatagaaaacggttctaaacaaattgttggcggtatggtgttatacgaaaactgaagattcgaggaaagtggaaaattgtagtaaccaatattacggtcgtttggatttgatgacaaaaatataaactacaacttggtcgctcaaacactggacctggacagcatttagctgaatcaaatatccacaaaatggaaagaaaataatcacagcttttctaccttataattttccacggtttttaaaaaaatttagactaaaaagcattattccctttgaaaaatcatttgttgcttagttaactgaagatactcatactcttttggaagagcaacgctgaatacagtatacttatttcaaaaattcaattttcattactagacttgcacccaatgagtccgtacactacaaaaggcaagagctattccgatacaggagatacgatgatagcatcatacgtagtaaacaaacagtttcaacgattccatccatagcttgatttgtttaatggagaataattgaaaagacaattagatcggactcctcttaaagcttgctcgaacttagagcatctccaattctccaaaacgagtatataatttaaaccattggagatgttcttattatctttcttttttttgtttcatagttattgttttgtttttaagttttaacttagttttaggcaagcgaaatttgttgactaaattaattttgcgtgcgagatcagtagtaaaaagcaaacaccaaagcttttttgtcaataaaatgatacaatcaaaacgaatttcaaatttgtttttgagaaaattacaaacgcagtagatagacttcacaaagggccaaagcaaccaaactctttgacgactggcaagttcaagtcttcggtcttcctacgacccgccatcgtgaagtagtagtctctctcttacttatgaataagggttttgtatatgggcttgggctttagtttgggcttttaaaagattaataaaatgagaagtatgataaatccgattggttacgtttgtgtgacatgaaatgaaacggctaactttcgattccttatccacgaaatctagttaattatctatctccctccaccaatgatgacacacagtttcatcaggtagacaaaatgatgcaacccaatgcaaaacttttgtccccatccgctaaatttctaccgtcacctatagagccaccgcaacacaaccgtagaaccaccgtaggagcacctccgtcattggaacgaaactgcaaattatcgcgacggaatcttagtaaatcctcgttgcttctactcctcaccactcaaacaactctgacgccattgctcgacttctctaaagctcaagcagatacaattgctaaccctaatctcacaaattgcgaaaacagagtaaggaaaatgtttataaactggatttcaatttcaatgtctccttattaattcgatttctgtttccaattttccccagattccgactaagaaagcgttcatcgacgtgtcaatcgacggcgaaccaatcgggaggatcataatcggattatacggagacgatgtaccggcgggaacagctagattcagtagcattgtaagcgggaaagctggaattacttaccggagaaaagattttgtgaagattatgccaggttatgtccaacacggcggaattagatcgtacggtgtcgatgccgagcgtgccaccgccgcggtggggagtctccaaaacctaattgaagagtgggagagagggaagagaggagagatatgtaatgtaaataaggcgggaagcgttggaatcgtggtgagagatccgtcgaaaccgccgccgaagacgaagcttgtggcaaggaatgggaagcttgtggtcgaagaagaggtaattgcggtggggccaaacggaacggagtttgttataacggcggttgattcgccggagctggaggattcggttttggtgattgggaaagttttggaaggaatgggagttgttgagaagatgagagaagtgaagactgtgagggataacacttcatctccttatttcaggtaatatattactgaccgttggatttaacttgtgtttttgagatcaagggttgtgattgtggttctggtggtgtgaacagggtggctaaagtgatcggagataagagagctgtggtggcggagagagggtttaaccggccttattctaaggttgtagtcaccaattgtggtttgatcgagtcacaaactctatgaatgagctcattgtttgttggcaacgttttttgtgtgctatgcaagacaacttaaactgttaagcacatcaaccacatggaaagattgcagccatggtggtttggtggaactacattatcaattgagtaattataagcgtgtgattgagaaattgttgtcttgcgcggttaggccggagcatagtccacagaattgaattgcttgggccttaactggatattaaagagtgtaataaacaatttctactatttctatttgcccaaaacaaaactgtctcggtccataataaagcccgaatttactctaaagcccacgagcccacgcatcccctagggtttctgtgtcttcaaatgtgacctatcctcttctgctacactacccaatttattctcggccggaaagtctcttcttgattatcgtccagggattgcaacagagagaaagtaacgatg

SEQ ID NO: 36750 - DNA, 3003 bp, Unknown; identical to SEQ ID NO: 36749
  misc_feature (1)..( 3003): 2750-1469P.txt file - cDNA_ID_3099870; gDNA_ID_2936582; Annot_ID_143770

SEQ ID NO: 36751 - DNA, 3003 bp, Unknown
  misc_feature (1)..( 3003): 2750-1469P.txt file - cDNA_ID_3099875; gDNA_ID_2936582; Annot_ID_143769
tttggtaagaacattaaggcaaggatagatacgtcttattctgttattcctcgatactcgactttgctagcttttcgtaaactgaaattttgtgttctctctttacgaatatctcttattttttctttaagatgaagaagatagagaagagggagttttgtatgttcagccaagtaagaaatttaaagaaggaacgtagagctttttatcttgatttggcatggctcgtgtgtagccgacgccgtcgttttcaagtgtttgacacgtggatttgtagtttttcattggttataaataaatatctcatttgattaaaatgtgtagactttgtcagtggaaaataaattgagatggaggttcttgtacgtattctttatttcttacctagccatatattgtttctcctatgaattaaatttatcattaccaaattatacaatatattactccagtgatttttaattcttttagccaatgtaatcatcatttttactaatatcgaatcgttatagactaaaatccacattagttttggaattcatgaaacatataagataatactgtttaaaacgttcaatagtatgttggaacaattaaaaataggaaaaaataatataacattaacaatagtattttatatatattatggaagttctggaattttggagacgaacttaaaaatattcttaggaaaatatgaaatgtaccacctttcaaggttcagaaagacagaaactattttgtgtgtggctgaaaactcatactagtatataatttatttatctataatgctgtttaatctctaattgtataaccagatatttcatattaaatttctcacaatttttttttcttttgtttaaaaacaaatttgtttttgttagttaaaacttctaaagtgaatatatattgtacacagaatttctggaaagaaaattttgatctctaacataaattacacaattaaattcttgccacttgttttaattcaatattgccatatagttcatttttaattgattttatagaaaaacacacaaattaaaaaaatgtattagtttttgtgattaaaactgatcagaaatgtattagttttgtgatttatatttttctataattttaaaccaatgatattcaattatttgttttgaagtttatatactaatgtaggtcaagttagtttttttggaaagtaatacttcctctatttcttattatttgattttttagaaaataaaattgtcttaaaaaaattattttgtaagttttctatgcactatttattagttattattaatgaattttaatgtgacaaatttaaagaactctcatttaaataacaaaagattaaataatatttgccaaaaaaagatcgataaatatcccacgttaacttaacatcatacagtaatttagatgacaacgtaatagacaaaagatattttgataaaggatacattcgttttattcaacaattatgcttcaacgctgaagtagatgtacactattttactgttttttttttcagctgaattttctcatctgctagacaatatttcggacaaataaagaaatcattcgccagagtaagatttgtcaaaaaagtcacaagtcaccacgtctcacgagttgtggaaaaaaaaaagctgacctcgagagatggaaaactaaaatccatacaaaaacaaataatccgaaacgagaaagagtacgtgtaatgtatttttgtcggaataaaatcaactgtaaaagatggagtgcgagacttttctaaggaagaagacaagatggtgaatttaaaacattaacaagcaaattgaaaaactaaaacgcatttcaacgacaaaagcaaataataataagaaatagaaaacggttctaaacaaattgttggcggtatggtgttatacgaaaactgaagattcgaggaaagtggaaaattgtagtaaccaatattacggtcgtttggatttgatgacaaaaatataaactacaacttggtcgctcaaacactggacctggacagcatttagctgaatcaaatatccacaaaatggaaagaaaataatcacagcttttctaccttataattttccacggtttttaaaaaaatttagactaaaaagcattattccctttgaaaaatcatttgttgcttagttaactgaagatactcatactcttttggaagagcaacgctgaatacagtatacttatttcaaaaattcaattttcattactagacttgcacccaatgagtccgtacactacaaaaggcaagagctattccgatacaggagatacgatgatagcatcatacgtagtaaacaaacagtttcaacgattccatccatagcttgatttgtttaatggagaataattgaaaagacaattagatcggactcctcttaaagcttgctcgaacttagagcatctccaattctccaaaacgagtatataatttaaaccattggagatgttcttattatctttcttttttttgtttcatagttattgttttgtttttaagttttaacttagttttaggcaagcgaaatttgttgactaaattaattttgcgtgcgagatcagtagtaaaaagcaaacaccaaagcttttttgtcaataaaatgatacaatcaaaacgaatttcaaatttgtttttgagaaaattacaaacgcagtagatagacttcacaaagggccaaagcaaccaaactctttgacgactggcaagttcaagtcttcggtcttcctacgacccgccatcgtgaagtagtagtctctctcttacttatgaataagggttttgtatatgggcttgggctttagtttgggcttttaaaagattaataaaatgagaagtatgataaatccgattggttacgtttgtgtgacatgaaatgaaacggctaactttcgattccttatccacgaaatctagttaattatctatctccctccaccaatgatgacacacagtttcatcaggtagacaaaatg

SEQ ID NO: 36752 - DNA, 2583 bp, Unknown
  misc_feature (1)..( 2583): 2750-1469P.txt file - cDNA_ID_3099915; gDNA_ID_2936582; Annot_ID_194967
cattattgcatactcagcctgcaaaacatcaaacatatcgcctaaaggtcaaaaagtaagagtattaatacctgatatgttggctgactaggcagatgtggctgtccctgcgggaattgacctccaccggaagcagggggtctgttgcctgactgcaaaattggctcaaataacgagttctagtcagtcaaaaacttcataattcacaatgagggaaataaaaggaaaccgacaatagctactcataagtcataactctgactcacatgatacatgggttgagaaagatgctgagtaggtgcgccatggtgctgaaatccagtgtttggaccagtttgagcttgtccatattgatgatgatatggtctagactgttgctgtgccacatgaggacctccaccagagtgcattggttgttgttgcaactgagtggaggaagctggtatatcaagatgatgaaaaggaggttgctgggatgttggatgatgggaagccggaggaggcgcgttttgaacttgagaagactgtggatgagacatagaagtgacagcaggattcagatgtccctgacgctggggatgcgaaaaacgaggctgtgattgagcactatttgcagaaacagaargcggtggtggaggcataggcattggttgtggtgttgggtgttttcgaatcggggcttgtggctgcatcgyattggctggctcatgtacactgccaccgccttggaaagaagacatatgagcttgaacgtttggctttggcgggatagattgatgagattgttgaggttgttgtacagcttgtggctcaactttmggagtctaatagaaacagatttttgtaaaatttaagatgcttgaaatgaaatctattaacaaaatgacttaagaggacgcaagtacataccacttgaggaggctgaaccattccgagcatgatttgtgcctggcatttcaacaaacatagcatcatcatcaccatatacaaattctgaaatctatttgtaaatagaggcataaacctaaagattgttcatatctggaaactaacacaaaaccctaattgttaacctacctgcttcttcaacaatactaaacccaaactagtccaatcaatttactcaagtaagaagctccaaatcagaattcctcattgcttataagaccacacggattgcagatttagaagatggaaaagattagcgaagtgaagaagaacctggaaaagagccttcgtcaaaagagggttccgaatcagaatctccctcgcttgttgatggttttgatcaatcaacgtctgcacaattagattcgactgatcaaaaaaacagaattcgaaaaaaagaagaagaaatcaattgttctctattcaaatccgtaaaggatagtgttatagctgataatcggaaaagtatagaaaagaaagaagagagaaccttcatttgagacataatatcatagagctgacttttagtcattccggcgagatttgccggtaaacctccgtctccgccgatctgcttacccgccatggttctcgtcggtaatcgctaccgagcttaacctgtgtgttaaagacgcaacacaagagtacttgtgaacaaacctgggccaagtataatacgggcccaattagtataattccggcccatttaaaattctagacttattagtctatggcgcctgtagatcaactctttttttggtcaaaaatttaccatttttctcaaaacaaaacacaacaataaaatatagagatgcattagatatgtacgttaaatatatttatatgaaattattaatatgtttctttacatgtaccatgttaattgtacacgtaacatgcatgtatattgtataatatgtcttttggaaaagcaaaagcttataaacacaagtttacattagagagaagcgtgtgacacggttttggcctcttcactttcttgttgctccagaaatcttctttttatcttgtctccatccataattttcatacgaagatagttttctttatttcatccataatattcaatatatattggattcttgcctttggtaagtcggtaaacatcatcaactttatttttattctttcaggtaaaaatagagtcttccactacattcatcttccacaagttttgctaattttaagttttgggtaagaataactaacccatgtatatttcacaattcattcataacaaatcaaatgattatgagatatacttatgggttatatatctcaagggattcagtgatctttaaacttggcacttggtataatttcagcatgccctttaaagaatgagtaggcgtataatcttgtctcaagaaaattataagaagtccaaatttataaacatgtattgagacaattaaaagattagaattaaaaaaaagaaaaaaaaaagaaaaagagacgcactcaactcaactttctattttttatttttgtaaaactacaaactttgcttttgattttgtagccgaggtagtctctctctctccatttgataggaagaagaagaaagatacaaaaagataaaagaaagagagaaaaagagttttaattaaaatg

SEQ ID NO: 36753 - DNA, 3003 bp, Unknown; identical to SEQ ID NO: 36739
  misc_feature (1)..( 3003): 2750-1469P.txt file - cDNA_ID_3099921; gDNA_ID_2936582; Annot_ID_194966

SEQ ID NO: 36754 - DNA, 3000 bp, Unknown
  misc_feature (1)..( 3000): 2750-1469P.txt file - cDNA_ID_3099926; gDNA_ID_2936582; Annot_ID_194964
ttttacatttttagtgacatataatccttttttctatcatcaaacattagaagttggatgttaaatgttctacaaaacttcacaggtgttgttggaagttccaaaaaagaatgtcgtttgctatacaaaaaaagaaaagaaaagatgaaaagtaacttcctgcgtttaaagtatcacgctgcgttgcggtcatgcaaacgcaccaacaaacaaaatagtttcaaaacaaaacttgaaaatgtggggtccacgtaagaatctccatggaagaacttgagccaatcagagtgcaaaaacggagatgacagtatatttcaaccaataaggaggcagaatcagatcaccagtgggttccattataagtttcctcttgactaaccaccaatagctagttttacacagaacttaaatttttcatttttttttgtcttttaatatttcaacaagatcaattttattatttgatattaaccatcttcaacagtgtttgccaacgaaaaaaaaacaccatctataacagtgtcttcaccaaactgtatttcactatgacttattttccgaaaagaatgatgaagtttagtaccatacatgaactagcggttagatcgtaattaagaatttgaggatcatattttactatatcatgaaaacggagagagcgcaaaattacagacatattggttcaaaattttatttaagaataaagtatatatatggttctaatttttcaaaaaaaaagtatatggttctaaacatttatttgaaagtacgtaatataatgaaaacaaaaattgtaaatttgaagtaaaaaactcgtgaaaagtcctcattctaaaataccatgtacacgtacataataaactatgaatagaattatgagtttttatttatatttctatctccactccaaataatttagaccacacaaggtaatgaaaaaataataattctgaaaaaaatgaaaaatactgccgggaaatcgagacgccacacacactagtgaattcgttgcaaaaccatatatattacagtattttgttcttctcaaggcctctctctccatctcagcaactctctcactgtgtaatatacacacacaatggtggtcgatgtagagagccgaaccgcgagcgtgacaggagagaagatggcggcgcgtggctgtgatgcgtgcatgaagagatcacgtgctagttggtactgtccagccgatgacgctttcctatgccaaagctgcgacgcctcgatccactcggctaaccatttagcgaaacggcacgaacgtgtccggttacaatcatcttcgccgacggagacggcagacaaaacgacgtcggtatggtacgaaggattcaggagaaaggcgagaacgcctaggagcaagagttgtgcgtttgagaagttgttgcaaatcgagtcaaacgatcctcttgttccggagcttggtggagacgaagatgatggctttttctcgttctcctccgtagaagaaaccgaggagagtctgaattgttgcgtgcctgttttcgatcctttctcagacatgctgattgatgatataaacggcttttgcttagttcctgatgaagtcaataacactactactaatggagaattaggagaagtcgagaaggcaatcatggacgatgaaggttttatggggttcgtgccattggatatggatcttgaggatctcactatggacgtggagagtttacttgaggaagaacaactttgcttgggattcaaggaaccaaacgatgttggagtcatcaaagaagagaataaagtagggtttgagattaattgtaaggatttgaagagggtgaaagatgaagatgaagaagaagaagaagccaagtgtgaaaatggaggatcaaaggatagtgatagagaagcatcaaatgataaagatagaaagacaagtttgtttctgagattagattatggagctgtgattagtgcttgggataatcacggttcgccgtggaaaaccggaatcaaaccggagtgcatggtaagttggtgtctctagctatatctctcatctctatgttagtctttagtagtgtcgagttccgttgactttgagctgatatatattgattataaaagacgaaataacgttataaagttcactgatccagttgggagggaacacgtgtctgcctcatgttgtgggtgggtacgagaaattgatgtcgagcgacggatcggtgacacgtcagcaagggagagacggaggaggatcggacggggagagagaggcgagggttttgaggtacaaggagaagcggaggacgaggttgttctcaaagaaaataagatatgaggttcggaaacttaacgctgagcagagacctcgaatcaaaggtcgtttcgtgaagaggacgtcacttttgacgtgatttgatttactttaatcaacactttaaagatcttgtaattaagacctttgaagtaattgtcgtaatgtactgaataatgaactgaaactcttggggccgatggttgtgtagacttgtagccggcaactatgattttatagattgattgattgagtaatttattgtatatatcaaatgaaaactctttgtttatcaaatgaattggagaaaaaagccataatgtgtgataataacgaacactaaaaaattcgtagcgaagacatgttacaaagaaaacaagtgtaattaaaaaaaacaaaaaaaaaacaagaaacaagttcaaattagaacatgccatttccaacaatttacaaatgaagcaagaaataaaagccattaaggcctagttatggctgaatagcccatcacacaattaaaaaaaccaacataaagagcccaactaggcaactacttaagccaaccggtttgggttatcaagtacgtattttaatcgttaaccagtaaaaatcgtgaatttcaaccgactgaatttggttaacttcacaaggttgacgcatagctcacgcgccgccgacttgctacgattgacatg

SEQ ID NO: 36755 - DNA, 3003 bp, Unknown; identical to SEQ ID NO: 36743
  misc_feature (1)..( 3003): 2750-1469P.txt file - cDNA_ID_3099943; gDNA_ID_2936582; Annot_ID_194957

SEQ ID NO: 36756 - DNA, 3003 bp, Unknown; identical to SEQ ID NO: 36744
  misc_feature (1)..( 3003): 2750-1469P.txt file - cDNA_ID_3099947; gDNA_ID_2936582; Annot_ID_194956

SEQ ID NO: 36757 - DNA, 3003 bp, Unknown; identical to SEQ ID NO: 36751
  misc_feature (1)..( 3003): 2750-1469P.txt file - cDNA_ID_3099973; gDNA_ID_2936582; Annot_ID_194942

SEQ ID NO: 36758 - DNA, 3000 bp, Unknown
  misc_feature (1)..( 3000): 2750-1469P.txt file - cDNA_ID_3100007; gDNA_ID_2936583; Annot_ID_143802
tccctgtggaatgactcctgaaaagttgttgtatgagacattaaagacctcaagattgctcaactccgttagttgtggtgggatctgaccttgtaatctgttgaaagaaagatcaaggctttccacattcttcagtcctgaaaagctttctggtatactcctgataagttgttgtgagatagattgagagcatgtagtttccgaagatctccaaactctattgggatctcaccgctcagctcattttttgagagatccagtccaaacaataatttgagatttccacccctgtaggcatcatatctgtgttttgttgcaaactcaattttcgtttgggtgcttaactcataatcgatagcaaacccatcttgcacgagcagagatttgaaaaatgtactgacaggtgctcccaaagaaaaaacgtaatgattataaataatcgtctaatgtatcctcctctccccaaaccaagtgatgcattcctaagacatgaaggtatggatccatttaatttgttgttagcaagatccaggaggtgaatgcttcttacggcacacaaccggcgaggaatactgcctgttaaattattccctcggagaagaagaattctgatgtattgggtgttgatgaactccggaatattcccagacaatctgttatttctcagatcaagcacaatgatattcttccctagcagtgtatctggaataacccctgataaattattgtctcgcaggagtaacacttttaatgccccatatccagaaatggcttgaggtaagtcccctgataaactgtttgcagagagggccagtagttgaagactggacatgttgaataacgatataggtacttcaccttccaacaagttgttagaaatctgtagcgaatgtaagtcttgaagttggtcaaaccaacttggaataacacctgagagattgttgttcgaaatgtcaagcataatcaaagatctcaagctctgcaaacctcttccaatctttcctgtaaacagattgttatccatagacagctctagtattgaaaaaaagtttgatgcttctggaaaaacctcctcacttagtttcttatgtgatagtttcaagactatcaaggaatcacaacccttcaaaaaacttcttggtagcttcccatggaaactgttgtgagatatatccagaaattcaatcatttccatgttacccagagaagatggtagatttctttgaaaaccattagtcgttagattcatataatgtaagcaaggaagtattcacccaatgttctgaggaaagagttgatcaaatccattaactgaaacatccaggtaaagcagattatgatcagattgcggtagctgcaagcttgtaaaagagttattctgtagaagcaaagcctcgagttttgtattgttctccagcagccacgatggaaacttattattgttagagagatcaacatgacgcaaatccttctggtataggaaaatgaggaaccttcaccaaattgcaagctcctagtgaaataacactcaactgaaatttcggcttccaagaacttcccaactctacttgaagtgagttagattttgaagaaaggtttaccaaaggaaagcttgataacccgcccgctagtgcgatcactcaatgaccttccacagacagtaatcactctttgtgtcattagtccaacaaagcgttcttttcattctgaatacagcttttggatccatgtatctgtcccagcagtaacataatccatatcaagtattggcccaaaaacaccttcccttccatagcaaatatcaatatgagacaaaaagtgaaacaaaagaaactcaaacgcaatatgtgaatatgagttcaagcaaacatctccccacctctataagaatttcaaatttccagcggaaaacaccaagttcttcaagaaatatctgtaaatttgaaaagtcatatctttagcgtctaactaactcacttagagtagtatggtaagactcgttgggcatacaagtcaaagtctctctagaaaatgagtggtttagcatatgatatttcgcttgtcagtagccaagtaaattaacgaatgagattattgcaacacaggcccaagaattaaatttttgaattgattttttaaaacaactactcacaatcatatataccacaaaatgattcaagtgttgcttacacattcagtgaataaagttataaactttgaattctgttaaacatgtgaataactaaagcattatatgaacaaaaaaatctaacctttaaagtttaaactctctgcggtaactgtattgattatgtggcataatatgccacgtcagaaacaatggatgttaccgccaacaccaaaaacgccaccgtttccagcaaacattttatttttgtctccgcccaaataaaaaccctacatcctcacgaaacggcggctaccaccgtcgctgtccatcaatcggagttataaacagcaattgggtcgacccagaccttagaaatgaagctggaacagcgatcaagacgtaccggaccttcgactgggagtcaaaaagtatattccggcgagctccggcgagacgcataatgaggtttcgatggtgaggatcaatattaaaaaaagttggtaatgcatcgcttttttttggtgggggaatataaaagatgggaggatgttctttgcaattttagcatggagaggcgttgcttggtagtattactactttttattcagaaatataaaatgcaaccttaaaaagtctttgtcaaccaaaaacaaatggaatattcggaaaacgtgaattgaagaagaaagatataatattcgcccaagagcggtaagccaagaaacaggtcaatggagtaagagtgatatatcatatatgtatatcattagaaacactttattataaatggacaagaactgatagagtgggataagagacaaataaggagaatcaaacaagcaatccgatcgatctaccagatcgccatg

SEQ ID NO: 36759 - DNA, 3000 bp, Unknown
  misc_feature (1)..( 3000): 2750-1469P.txt file - cDNA_ID_3100018; gDNA_ID_2936583; Annot_ID_194995
ttggcgagaagcgcaacattggcacattgctttcattaaaacctcataaaccctaacaactcttggaagcttcgagaagattattttccttctctctgcaacggaaatggcgacgaagagctcggattcgagccataagcaatctcctccgagttttcgtaagagcgtcgaaatcaaagccacgcatgatcaatttttcggtaagcgacgagtctctcttctcccgactcatcgtttcggtttctctttgggtttattgcggcgaaaatcgttgtggatttgattgatgatcatgatttcgcttagaagatgagttcttcttagcgaaatgttgagatttcgtctggtgattatgatgagaacacctggatcatgttttagtggcattgatttttcactttcatcggaatcgaatagttgcaagtggggtcaattagtctaacgttcaacacattgatgtagtttggagagagttcttatggggaggtattgctggagcttttggagaaggaatgatgcatcccgttgatactctcaaaactagacttcaaagtcaaattatcatgaatgcaactcaggtatgattaaccagacttcactttcaggggcctttggcttaggaaatacagattagacctgattgtgtgtacttaccttcatttttggagtatatcatctctaatcgtgtttagttgttgatttcagagacaaaagagtattctacaaatgctccgaactgtctgggttggtgatggcttaaaaggtactttatccattctcttttctcttcttgaggcatgcatatggcatatgtgtggttcactgtcctacttatcatctttataagcaacagactgcctatgctggtacatgtttgtgctgagaacctggaatagaaaactatctatgctctgtatttcttttttttttttttttgctactgaccttgttttaggcttttataggggcattgctcctggagtcactggatctcttgccactggagcaacttactttggttttattgagtcaacaaagaaatggattgaagagtctcatcccagcttagcagggcactgggcgcattttatagcaggagcagttggtatgttatctaagtgtctcctctctcagtcatatcatcattaatataatggtaaagataggagggaaatatatggtcgctcaagtggaaattgatttagaatgccaagcatgcagcagaaatgagactagatataacctgcctgaagaaacgaaatgttatcaaacatgtcaatgttatatgatgattctaacttacggaaatggtgggtctttaaaagataagatccaagttattatcaaaccacacaagagcaaggattgctgattgcttacttaagatatgttccaatttttattactctttcatgatacgtcatggactgtccttgttgtgaatatcatcgtgaaggattgtggctgtgtgtatacatacacgtcatgagggggttccccaaatagttggaaaatgaaagtaaacgtagagttatttgaagttagaaagtttctgattcgtttgtgttttgctgcttctttccttgtttcaggcgatacacttggttctttcatatatgttccttgtgaagtcataaagcagcgaatgcaaattcaaggcactagtagctcctggagctcttatatttcgaggaacagcgttccggtgcaaccaagaggtgacatgtatggttattacactggaatgttccaggctggatgctcaatatggaaagagcaagggccaaaaggactatatgctgggtatgtaacttattttcaggctattatgatgtgaattggatacatcattctaattgttgactcgtgtcaagagacccatgttattattttcctttttcctgtggcagatattggtctacactagcgagggatgtgccttttgctggtcttatggtatgactatgtaatatggcacttcagtgaaactattacctccgttcaacttagggtctttgtctcctcatgttcggtctgtttttccattcaggtagtgttttatgaaggattaaaggatctaacagatcaaggaaagaaaaagtttccacagtatggagtcaacagttcgatagagggtctcgtattgggaggattagctggtggtacgttagaattagatcagttataaaagaaatccgtttcaaatagcttatccaacatattgacccatgtatgtctcctcaggactaagtgcttatctcacaactccactggatgttgtaaaaacaagactgcaagtgcaaggatcaacgatcaagtatgcctcgtgtgttaacagattaatatgatcaactaaatatcatccgcaattagattcaagaacttgtttcgattaagctttggtaacctcgttgagttttaggtacaagggatggttggatgcagttggacagatatggaggaaggaaggtccacaagggtttttccgaggaagcgtcccaagggtcatgtggtatcttccggcctcggcactcaccttcatggccgttgagttccttagagataacttcagagagaaaagtaataataataacaatgtcgtctcaaatttgagcatagagaggaaaacatcttctacttcagtgcatgaaggttagtgaggactagcgagattcttgtctccaagtataaagagtgagaggagcattcacaaacttgtctataaatggctcagtgttttgttttctcttctaagatactgtgaacaacaatctgattccttattaataagatactgtacttaatctttaattttcgttgatataagcctggtgatccctaaaactaaagtattaagagaaagaaaaattgaattataagtttatttattgttttgttcctatatatacatctccaaggtcaaatcttggacagctcgaactgggtatgcgtttaaaatcgacaaaagagaaatagcctaaaccctaaaaaccagagatg

SEQ ID NO: 36760 - DNA, 3000 bp, Unknown; identical to SEQ ID NO: 36759
  misc_feature (1)..( 3000): 2750-1469P.txt file - cDNA_ID_3100018; gDNA_ID_2936583; Annot_ID_143798

SEQ ID NO: 36761 - DNA, 3003 bp, Unknown
  misc_feature (1)..( 3003): 2750-1469P.txt file - cDNA_ID_3100023; gDNA_ID_2936583; Annot_ID_143797
ctagctcttcaatatccgaaaccaagcttcgcggtgtacgacttggatgcggatcactctcacaatagcccggtctgtcgaatgaaaccatatatacacctagttcctctactaaatcctataaaatgtattgacacactgttagaggtcccaataaaaaaccgaaaacgtcactctcaaataactttctcactaaacttctctatactacaaggatttttaacaacactacttgctacaaattaacatgccactaactaaataaatgattaaaacatagtgatcaaagtattattacataacaactatctatcaaatcaacgatagaagcatatagacatgcataatcttgattgtgtaaaacttaccggagaaagcagagtggcgaaaacggcatcgtgtctacaacaatcggatccatggatgaagacgattttgcggttagctttctctcttggaagtccatgctctttgtaagccaaatacctcccatcttgaagctttatccgcggcgctgtgatcggtggaccaccggaggagccacatagcttcggcggaggtggtttcaacttggactgataagtaaacgccacgattatcccaacaatgacaatcacaacagaaggaaaaagaaatttttttcgaggccatggctttaatgagctgttccttgatgaatctctcgtcatttaaaagaatgggaagttgatcggagaggcacggaggtcaacggcgacgattcttgaaaagagagccaactgttcaagaactacaacatagagatcgtttttttgttgttgttttgagataaaaatagagaagcccatttttatatgttattcattatagtaatggcccaagatgcttaatatactaatgccccaatagtgttaaggcccataagcccatattagggcttcttcttcgtttttctccctcgagtagcagcagcagcctttggatattcggcggaatcgaaaatggtcaagggacgccaaggagaacgagtcaggtctttcttcttctatttctcttttcgttcttcttcaagtttgatctatatcaccaagatggttttctatcggtgtatcatttgagatttgctctgttttcctcacttctgaaactgttttgctactattgttattgtctagatttgagctgattcttcatggtttagtaatcttgtaatcatcgataatgcgaaagtctgattctttttatgttatctaattttgcagactctacgtgaggggaaccatcctcggatacaaaaggtgacccatttctttcatcgctttcgttttccattttacactgcttatagcttatgattggacgccaataagattccatgtaatgaacgttgattggtatttatgtaagccaatttgacagaaacgagtcctataaccaagcttctcgtccacttatgatcagattatgtgtctgatgctttcactaaatgggaacattttgactcttgattagttagttgtctacatttcttaggacacttatctggcattttatttttgagctgctttgtatttctattaatcaacactgttgttaactgagttctgctttaataaccttgtcatgctgaaaaccgagaccttactgtttgatacttcctctggtctgacatttactatggtgtgcaggtcgaagtccaaccagtatccaaacacgtccctcgtccagatcgaaggagttaacactcaggaggaggtaaactggtacaagggaaagaggatggcttacatctacaaggctaagacaaagaagaacggtagccactaccgctgtatctggggaaaggttaccaggcctcacggtaacagcggtgttgtccgtgccaaattcacatccaaccttcctcccaagtccatggtacttaaacagattctataatcatcttctctgtttagaagtgaaatcttttgcttgggtttttaacaagatattattccttatgttcttgcagggaagcagagtgagagtcttcatgtatccgagtaacatatgaagcaatgcaaaaatggcttaaacttataatttagccgccttggttttgttcactagtttgttattttgtattttgatattgaaagcatttcctttctttgtttgaagtgtttggagattctctaaattgactttgatcatggatccggtttttcatcccaaattagactcccttttccccttttataacgaattaaaacagacgaatggtaacatattttctcaaatcactattacaactttataattagttcttagaaacacttaaattctcagaatcatccatggcatatgttaattgttgaagtctgaaaatcgaaaatcactcaaaataatcaaaaaacaagagctgattgaagttgtaaactgaaacatttgaaactcgatttgtgatatcggcccttaggcccattagacctttattgggcttacctaggctcaactttagaattttcaatcagaattttgttctcatgtaaacaaaaaagtaccaacaaacctaagattcgttgagaagagagaccagacaagaactctgtgtcgactgccgtactctcggagtcggagcttcggtcccgttaagacagtaacagagaaaaaccctaaaccctcttttcactttgtttgctgttccggtcatatctcgcgacgatgaatacctcccaagcaactcgtgcggctctgtttctaaacgtaaatattctcttactgctattcttatcagtggtccaagttttgtgtcgattgatcgatgaacttatttgattccgttctgttgcttaatcttttcatagattgattataaggatgatttcgaaaagtactttatattgagaatttgaagttctgttgatgttgaatgcagtaacttaggactctgatttactggaaacttcttggtatttggcatccataatgttttcgttttaacaagttagtgtttttttgcagggttccaatagacaagcgatg

SEQ ID NO: 36762 - DNA, 3000 bp, Unknown
  misc_feature (1)..( 3000): 2750-1469P.txt file - cDNA_ID_3100029; gDNA_ID_2936583; Annot_ID_194991
cagcatgacaaggttattaaagcagaactcagttaacaacagtgttgattaatagaaatacaaagcagctcaaaaataaaatgccagataagtgtcctaagaaatgtagacaactaactaatcaagagtcaaaatgttcccatttagtgaaagcatcagacacataatctgatcataagtggacgagaagcttggttataggactcgtttctgtcaaattggcttacataaataccaatcaacgttcattacatggaatcttattggcgtccaatcataagctataagcagtgtaaaatggaaaacgaaagcgatgaaagaaatgggtcaccttttgtatccgaggatggttcccctcacgtagagtctgcaaaattagataacataaaaagaatcagactttcgcattatcgatgattacaagattactaaaccatgaagaatcagctcaaatctagacaataacaatagtagcaaaacagtttcagaagtgaggaaaacagagcaaatctcaaatgatacaccgatagaaaaccatcttggtgatatagatcaaacttgaagaagaacgaaaagagaaatagaagaagaaagacctgactcgttctccttggcgtcccttgaccattttcgattccgccgaatatccaaaggctgctgctgctactcgagggagaaaaacgaagaagaagccctaatatgggcttatgggccttaacactattggggcattagtatattaagcatcttgggccattactataatgaataacatataaaaatgggcttctctatttttatctcaaaacaacaacaaaaaaacgatctctatgttgtagttcttgaacagttggctctcttttcaagaatcgtcgccgttgacctccgtgcctctccgatcaacttcccattcttttaaatgacgagagattcatcaaggaacagctcattaaagccatggcctcgaaaaaaatttctttttccttctgttgtgattgtcattgttgggataatcgtggcgtttacttatcagtccaagttgaaaccacctccgccgaagctatgtggctcctccggtggtccaccgatcacagcgccgcggataaagcttcaagatgggaggtatttggcttacaaagagcatggacttccaagagagaaagctaaccgcaaaatcgtcttcatccatggatccgattgttgtagacacgatgccgttttcgccactctgctttctccggtaagttttacacaatcaagattatgcatgtctatatgcttctatcgttgatttgatagatagttgttatgtaataatactttgatcactatgttttaatcatttatttagttagtggcatgttaatttgtagcaagtagtgttgttaaaaatccttgtagtatagagaagtttagtgagaaagttatttgagagtgacgttttcggttttttattgggacctctaacagtgtgtcaatacattttataggatttagtagaggaactaggtgtatatatggtttcattcgacagaccgggctattgtgagagtgatccgcatccaagtcgtacaccgcgaagcttggtttcggatattgaagagctagctgatcagttgagtctaggatcgaaattttatgtgctcgggtactcgatgggaggacaagcagcatggggatgtcttaaatacattcctcataggttagccggagtaacactagttgctccagtggttaactattattggaagaacttacctttgaacgtttccactgaaggttttaactttcaacaaaagagagatcaattggcagttcgtgttgctcactatactccttggcttatctattggtggaacacacaaaaatggttccctggttcgagtattgcaaaccgagatcacagtctcttggcacagccggataaagatatcatttcgaagcttggttcttcgaggaaaccacattgggcagaggtaaggcagcaaggaatacatgagagtattaaccgtgacatgatcgttggttttgggaactgggaatttggtcctttagacctcgagaatccgtttttgaataaggaaggctctgtgcatttgtggcaaggagatgaggacatgttagtacctgcgaagctgcagcgttaccttgctcatcagcttccatgggttcactatcatgaggttccgagaagtggccacttcttccactacactaaaggtgtagttgatgacattgtaaagtcgctcttaacctccgatgtaagagcatctagagtttgtatttgatcatttgtagcttccaaaaactctgaaaaaaaatcccaaaaaaatacacggatacaatagagttatgtactagttacatttgtcagcatcgtagtttatttttatttggttacacgtgtaatttaatcgaccaagccttcatcaattgtcttgtcaagcttatcatgttctttaatttgatcttttagcaacatgtgtttggtctttttgttttatattctatgttagtcttttaattaagagaatgaagaattcatctacttgagtgtctactagatttgccttagtgtctaatacatcattaattaaagtttttggtacaatctaaactaggcctaatcacattatctaagtgaggcagcacatgcttgtgctacaaccaagtggcaatcaccaaagtggtcattgaagataaccaagaaagctggaatctaagacatttggaatagtttttagccaaagtgtagcattttaacttgatagcttaacatgtatctttttcttttcctttttttggcaaccacacaattgaagtatcaaatcactgtaacgtatttgaatttaatgcatccctgatattgacgtggctgagaagacttatcacaaaaaaaaacacacgatatgttgtagttcttgaacagttggctctctttttcaagaatcgtcgccattgccgccgtgcctctccgatcatcttaccgttcgtgaaatg

SEQ ID NO: 36763 - DNA, 3000 bp, Unknown; identical to SEQ ID NO: 36762
  misc_feature (1)..( 3000): 2750-1469P.txt file - cDNA_ID_3100029; gDNA_ID_2936583; Annot_ID_143794

SEQ ID NO: 36764 - DNA, 3000 bp, Unknown
  misc_feature (1)..( 3000): 2750-1469P.txt file - cDNA_ID_3100034; gDNA_ID_2936583; Annot_ID_194990
ttgtgacctctaacattgtgtcatttacattttataggatttagtagaggaactaggtgtatatatggtttcattcgacagaccaggctattgtgagagtgatccgcatccaagtcgtacaccgcgaagcttggtttcggatattgaagagctcgatgatcaactgagtctaggatcaaagttctacgtgattgggaaatcaatgggaggacaagcggcgtggggatgccttaagtagaaccgtcaaatggtcatctgaccatgggctaagcccagtccacaacattatggacagtccatggtcgacccgtcacgaaaacgggttaaatggtctaaagaccaattatgtccgcggatttaatgggctagcccacacggtctatggttggtccatcaattttctcaacacatcaattttcttctcttctctatctcggcgacgaagctctctctctctcgcttcgacctctctctcaactcctactcccgttagttctactataatatgaatccgttgattagaataagttctctctaaaatatgcgttcatatgatagtctcatcgattttgttctctaagtccttatgcaatttcatcgctttgttattttctgttccttaattgtgattctgcatatgctttctttgatttcagcttgtgggtttgtccaaatttcacttgtttgctattctttgttattctctctctcccttcctttgatgccaaccatgtgtttgatgaaatgcctcacagaatatgtagagtttggttttggtagagcttgtaattacttgtgtagagcttggtgtttatgtatggagctaagtgtatgaacgtttagtgtgtgtttgctaatgtttatgaacgtttagagcttgtaattaagtaatcgtttctcaccaaaatccatcacttgtttgacaaacgttgttttgcaggaaacggattagaggtagcaagttcatgactcattggtttattaattttttgcagagagtggccatacatggaatcatcagctttacaagattggcgatcaaacattggcaaataatattcagatatttgttaattcccaaatctaagcttaactcttttgatgaacttattttcagacattggcaaataacattaagttatgggctgaccatgggctgaccattggacatggtccttaatggtcttgaacaaattttcagaccattgtccaataaagaccatccattaaaacccattaaaactaatggtccaattggacataaccattgggctttggacagcccaattgacacttctagccttaagtacatccctcatcgattagccggagtaacactagttgctcctgtggttaactactattggaggaacttacctttgaacgtttccactgaaggttttaactttcaacaaaagagagatcaatgggcggttcgtgttgctcactatgctccttggcttatttattggtggaacacacaaaaatggttccctggttcgagtattgcgaaccgagacagtctcttgtcacaatcggatagagatatcatttcgaagcgtggttatacgaggaaaccacattgggcagaggtaaggcagcaaggaatacatgagagtattaaccgtgacatgatcgttggttttgggaactgggaatttgatcctttagacctagacaatccgtttttgaacaatgaaggctttgtgcatttgtggcagggagatgaggacatgttagtgcctgtgaagctgcagcgttaccttgctcatcagcttccatgggttcactatcatgaggttccgagaagtggccacttcttccacttcactaaaggtgtggttgataacattgtaacgacgctcttaaccaccgatactgatacgattcgtcagtaagaagatgaggtggcagtcgagttggcacaggcagatgagtcagcaaagaagaataaagactctggataagccagaggttttgctgttacggagtcttcttctatatatagctactgtgatctatctttgagttttatgcttttgatgttgtgagattctcgactctcgagagagacttggcctggtgatgtgccagaggaagagatcaatatcggttacttagatctatcttgatctaagtatacgattcttatcttctcgttgtggtttcttaatcgattctacatttctatcaagtgtttacagagctaaggtattgaaaccttaataagagattaagtaaagagcgtctagagtttgtatttgttcatttgtactttgtagtttccagaaacacggatatacaatagacccgttacaattggtcagcattatatgtttgtttaattcggttactcgtaatttacttcgtaaagtgacaactaaggctggtcaattgtcctttcaagcttaccatgttctttactttgatcttttaaacatgtgtctggtctttttggttatattttctatgtttgtcttttaattaagggaatggagaattcatctaattgattgtgtacttgctttgcttagtttctatacatatattaattaggtctaattggtatatctaaactagacctaatctcactaatgtaagtgctgcggcacatgcttgtgctgcaaccaagtgacacctcaccaaaataatctaaaaagactctcagtggtcattggagataacgaagaaacctggagtcttagacatttggagtaatttttagccaaattgtagcattgtaattcgacagcttaacatgtatctttttcttttccttttttggcaaccacacaattaaagtatcaaatcactgcaacatatttgaatttaattcatccctgaaattgacgtggctgagaagacttgtcacaagcctaagagcccttcttcatctataaatatactcttgttcagtgatgaaaacttaatataatttggtttctccccaaattctccacttgttcacttaatctttctcactacctgatcgtggaaatg

SEQ ID NO: 36765 - DNA, 3000 bp, Unknown; identical to SEQ ID NO: 36764
  misc_feature (1)..( 3000): 2750-1469P.txt file - cDNA_ID_3100034; gDNA_ID_2936583; Annot_ID_143793

SEQ ID NO: 36766 - DNA, 3003 bp, Unknown
  misc_feature (1)..( 3003): 2750-1469P.txt file - cDNA_ID_3100039; gDNA_ID_2936583; Annot_ID_143792
accaatactgctcgaacctttgtcttgcatactccatgtagtcaaagtcgatttcattcacatgttcctgtaaagttttacaaaatgaaaatcaagcctatatatggttcagaaaatgcaagtatgatagaagagtattgtagaaattaccgatataattccccataaaccccaaattagatgactagcaagtgtatatttctcaacgtcttctaggagttttttgaccatagtatcgctgggcttttcatctggactcacaagaacaaatacaaatagagaattatggctgtacagtgatttattgctgaagctcatagcaagaaagtgtgataaaataatcacctgaataactcatatatgttttcagaaatctttgtcgctcctccacacctgttataatttagtcacatattaagatatatgattgatcttctatcatttcaaaagataaagaaagatgactttgaaatagacacttaccagggtatttactataatccatgatgtgaggtgtttcagtgtggtaatcggcagccatctcacagaagtgattggcaatgtcataagccacaggattatagcatgaatattcataatcctattttttataagacaaaataataaaatcagagttaggatccattttttctagtaatggtatacgaaaaaaggagagctgactaaacaaattcatgaaaccttacaatgatggttattgctttggtctcttcatccatcatgatgttcccatactgtaaatcattgtggcaaaatccaatattttcatcattgtcaaagagagatttctcaagcatattaatttccatctccataacatcgagacgaaaggacttagcttcttctggtgaagccagtctcttgcatgcagtgagccaatttctgaagttacaaaaaaaacaaagtggagaaaaagattacaaaaaagaacaaaattttaatgatttgttagaaagcaaagtagaatctggtagaaagcaaagtagaatctggtagaaaacaaagaaatgtaccgtaatctgtcccaaagcaaagcctttttcgcaccaggcatttcaagaccatgaaactccttcatcctagttgctattcgaccagatatttcaggatcacgcaagtcacaagcagatagggtctgaaagttcatagttcagcaaacaagttacaaattcagtaaacaaatacaaaaagattcacaagaattacctgaagaatgaaaaaaaccagggaagtgcaaagatactcaataacttaggaacacacagaatcagatattaaaaaaataattacccgtgcatggaggaactcttcgatacgaccattaccaaaccgacctaacaacaaaggtccatgaccatgcttcgacatgaactcaaatgtcctgatctcatcctcacgatcaaagaaaatctcaacaccttcaccataaatcctaaccaaaaccttacgagaaggacctttttccctagttggccatttgatctgaaacacctcatttgtcattgcaccttttaaaggaataacttgcagagcctttgaatcaatcacatcttcccactctgatgctattgcttgtaaagcttccttgacttctcgaggcaaacgatattgtttattctctacattcttttcagtaccacccatcgtcatttgaatgccacacacaaagataaatctctctgtacaagataaaaacagatacttttagcgaatacttataacaacactgtgttttgtccaattcaggggaggttctacgatcaacccaatgcaacaattctatatgcttccgtttcataaaaattctgaatatcaatctaaacctatacaattacatccttactaatctagataaagtgtatacaataaaatgagagcaataaggttcattaatctttatacttagctcctccacaggacgatatactttgagactgacacaaaacaaaataaggaagaaagcttacgtttttgaaggaaaatcacaggagggacgcggaagcaagattggtctgagaggaaaattgaggaagaggggttaatcgagatgaaaatggagtttgaagtaatagagagaacgttgcgcagatcgaggaagaacagaggataggatcaacacaaggatcttgtgaaaatgaaaatggctgaggaaatgaaggactatttgttaaataagatataatattatttctgaaatatttccatctgactcctttaatttatacaagcctccttttttgtacatctattttcagaagatccaaataattgtttcttctatttgtgtatttttgatatttaaacgtaaatctttggattttgatcaataatagacaattagccaagttcagttttcattaattagatttataattttaattatttttagcattcgtctaaaattaaataatgcggcaaaagaggagaaattaatttttgttgttattaattcaaagcgttacaaataaaaaaggaaattccacgctggcaataaaataagcgaaaattccacgtgacatctacctgtcggatcaaaaagagtggaattgacatttgtttctctcacactctctctcgaattctctggtagcttctagttctatgcaaaaaaacgacgatagttctctatctttccagatgaatctccttccatatacaaaagcagtcatgcctcctcgctctctcgcaattcacaaagtatccaaacatctaaagttatcaattttacaacattaccgctataatctgcttgattctctgcaaaaagagaagactttttaccgagaagaagtcctctggctcattgaagaaactcaacgaaacaaacccagttctcatatatcgttttaaggtaaatgatcgcgacaatcttgttctcatttgtgtgtttttgtgtttgtgattagggtttacaaaagatactgagattagtttttttttttttttttttttttcagggattacaaaagctaatcgaagatg

SEQ ID NO: 36767 - DNA, 3000 bp, Unknown
  misc_feature (1)..( 3000): 2750-1469P.txt file - cDNA_ID_3100064; gDNA_ID_2936583; Annot_ID_194992
attttccaaaagtggctccttgctgaacaaaaggtacctccttgacctttccaagcgagtcacctcgtctaacccacatgctctacatatcgaaaccgcattggtggaccatgctgttgtgaaagacaatctggggccaacttcaacaataacagcatggagtccttcttgcttcttcctctcaagaaaactatccgtacctgaaatttaactcaatcgtcaataacagagaggcctaacaatattgtaaccatatcatgatatagcatgcaaataacagtacctaaattctctggctcatatgtttcttgaagaatccactttagaacagaaagtttttcatcttttaacttggattcaagcccaatattgaaagactgttctgtagtcaaactgacaatctggttgctgattttggtttgaacagccttgaggagttccgcgttcgcgctttcttgaatcaaaggcacgcgataaaaatggataacctcagcagcaggtttctcaaccaagcttggtagctcatcagcagtaacaaaagaaccagtagaaacagctgctttaggtttattaggttgagcagaacatctcaagctaacagcttttgttcgattcagagacagccgtgaagttctcattctaacagaaccccacaattgactcattgagctccgctgcaaaagcatcgcttgtctattggaaccctgcaaaaaaacactaacttgttaaaacgaaaacattatggatgccaaataccaagaagtttccagtaaatcagagtcctaagttactgcattcaacatcaacagaacttcaaattctcaatataaagtacttttcgaaatcatccttataatcaatctatgaaaagattaagcaacagaacggaatcaaataagttcatcgatcaatcgacacaaaacttggaccactgataagaatagcagtaagagaatatttacgtttagaaacagagccgcacgagttgcttgggaggtattcatcgtcgcgagatatgaccggaacagcaaacaaagtgaaaagagggtttagggtttttctctgttactgtcttaacgggaccgaagctccgactccgagagtacggcagtcgacacagagttcttgtctggtctctcttctcaacgaatcttaggtttgttggtacttttttgtttacatgagaacaaaattctgattgaaaattctaaagttgagcctaggtaagcccaataaaggtctaatgggcctaagggccgatatcacaaatcgagtttcaaatgtttcagtttacaacttcaatcagctcttgttttttgattattttgagtgattttcgattttcagacttcaacaattaacatatgccatggatgattctgagaatttaagtgtttctaagaactaattataaagttgtaatagtgatttgagaaaatatgttaccattcgtctgttttaattcgttataaaaggggaaaagggagtctaatttgggatgaaaaaccggatccatgatcaaagtcaatttagagaatctccaaacacttcaaacaaagaaaggaaatgctttcaatatcaaaatacaaaataacaaactagtgaacaaaaccaaggcggctaaattataagtttaagccatttttgcattgcttcatatgttactcggatacatgaagactctcactctgcttccctgcaagaacataaggaataatatcttgttaaaaacccaagcaaaagatttcacttctaaacagagaagatgattatagaatctgtttaagtaccatggacttgggaggaaggttggatgtgaatttggcacggacaacaccgctgttaccgtgaggcctggtaacctttccccagatacagcggtagtggctaccgttcttctttgtcttagccttgtagatgtaagccatcctctttcccttgtaccagtttacctcctcctgagtgttaactccttcgatctggacgagggacgtgtttggatactggttggacttcgacctgcacaccatagtaaatgtcagaccagaggaagtatcaaacagtaaggtctcggttttcagcatgacaaggttattaaagcagaactcagttaacaacagtgttgattaatagaaatacaaagcagctcaaaaataaaatgccagataagtgtcctaagaaatgtagacaactaactaatcaagagtcaaaatgttcccatttagtgaaagcatcagacacataatctgatcataagtggacgagaagcttggttataggactcgtttctgtcaaattggcttacataaataccaatcaacgttcattacatggaatcttattggcgtccaatcataagctataagcagtgtaaaatggaaaacgaaagcgatgaaagaaatgggtcaccttttgtatccgaggatggttcccctcacgtagagtctgcaaaattagataacataaaaagaatcagactttcgcattatcgatgattacaagattactaaaccatgaagaatcagctcaaatctagacaataacaatagtagcaaaacagtttcagaagtgaggaaaacagagcaaatctcaaatgatacaccgatagaaaaccatcttggtgatatagatcaaacttgaagaagaacgaaaagagaaatagaagaagaaagacctgactcgttctccttggcgtcccttgaccattttcgattccgccgaatatccaaaggctgctgctgctactcgagggagaaaaacgaagaagaagccctaatatgggcttatgggccttaacactattggggcattagtatattaagcatcttgggccattactataatgaataacatataaaaatgggcttctctatttttatctcaaaacaacaacaaaaaaacgatctctatgttgtagttcttgaacagttggctctcttttcaagaatcgtcgccgttgacctccgtgcctctccgatcaacttcccattcttttaaatg

SEQ ID NO: 36768 - DNA, 3000 bp, Unknown; identical to SEQ ID NO: 36767
  misc_feature (1)..( 3000): 2750-1469P.txt file - cDNA_ID_3100064; gDNA_ID_2936583; Annot_ID_143795

SEQ ID NO: 36769 - DNA, 3000 bp, Unknown
  misc_feature (1)..( 3000): 2750-1469P.txt file - cDNA_ID_3100082; gDNA_ID_2936583; Annot_ID_195000
atgaattaaaccaaccaccaaaccagtccaagatatgttttgaggcattacttttattcaaagacaaaaagacagtacagaggaaccaaaacataagctatgttctggttttgtgaaacaaagcaggaggtttgagaagaagaacaacagaaggggacgacaatgaaactagcacgtaagaaacattttgtcacctgcagtattttaccataacaatttcctaaccttgtgaaccaaagcatcgacgatgtagaaccaaactctgctccaaggagaatcaaatgagagtgatgcgagtaacccaagaaggattgttatgtatgctgcaacaaaactccagtagaaagaaaccatgtcgatcgtgttttcaacagcttccactccataatctgcttcttgaaaggtattaccaatgcatcttatgtcggttggttgcccacagagaagaggattgcctatgtagcttcgcatgtcaaagctgttaaactgttttccctgtggaatgactcctgaaaagttgttgtatgagacattaaagacctcaagattgctcaactccgttagttgtggtgggatctgaccttgtaatctgttgaaagaaagatcaaggctttccacattcttcagtcctgaaaagctttctggtatactcctgataagttgttgtgagatagattgagagcatgtagtttccgaagatctccaaactctattgggatctcaccgctcagctcattttttgagagatccagtccaaacaataatttgagatttccacccctgtaggcatcatatctgtgttttgttgcaaactcaattttcgtttgggtgcttaactcataatcgatagcaaacccatcttgcacgagcagagatttgaaaaatgtactgacaggtgctcccaaagaaaaaacgtaatgattataaataatcgtctaatgtatcctcctctccccaaaccaagtgatgcattcctaagacatgaaggtatggatccatttaatttgttgttagcaagatccaggaggtgaatgcttcttacggcacacaaccggcgaggaatactgcctgttaaattattccctcggagaagaagaattctgatgtattgggtgttgatgaactccggaatattcccagacaatctgttatttctcagatcaagcacaatgatattcttccctagcagtgtatctggaataacccctgataaattattgtctcgcaggagtaacacttttaatgccccatatccagaaatggcttgaggtaagtcccctgataaactgtttgcagagagggccagtagttgaagactggacatgttgaataacgatataggtacttcaccttccaacaagttgttagaaatctgtagcgaatgtaagtcttgaagttggtcaaaccaacttggaataacacctgagagattgttgttcgaaatgtcaagcataatcaaagatctcaagctctgcaaacctcttccaatctttcctgtaaacagattgttatccatagacagctctagtattgaaaaaaagtttgatgcttctggaaaaacctcctcacttagtttcttatgtgatagtttcaagactatcaaggaatcacaacccttcaaaaaacttcttggtagcttcccatggaaactgttgtgagatatatccagaaattcaatcatttccatgttacccagagaagatggtagatttctttgaaaaccattagtcgttagattcatataatgtaagcaaggaagtattcacccaatgttctgaggaaagagttgatcaaatccattaactgaaacatccaggtaaagcagattatgatcagattgcggtagctgcaagcttgtaaaagagttattctgtagaagcaaagcctcgagttttgtattgttctccagcagccacgatggaaacttattattgttagagagatcaacatgacgcaaatccttctggtataggaaaatgaggaaccttcaccaaattgcaagctcctagtgaaataacactcaactgaaatttcggcttccaagaacttcccaactctacttgaagtgagttagattttgaagaaaggtttaccaaaggaaagcttgataacccgcccgctagtgcgatcactcaatgaccttccacagacagtaatcactctttgtgtcattagtccaacaaagcgttcttttcattctgaatacagcttttggatccatgtatctgtcccagcagtaacataatccatatcaagtattggcccaaaaacaccttcccttccatagcaaatatcaatatgagacaaaaagtgaaacaaaagaaactcaaacgcaatatgtgaatatgagttcaagcaaacatctccccacctctataagaatttcaaatttccagcggaaaacaccaagttcttcaagaaatatctgtaaatttgaaaagtcatatctttagcgtctaactaactcacttagagtagtatggtaagactcgttgggcatacaagtcaaagtctctctagaaaatgagtggtttagcatatgatatttcgcttgtcagtagccaagtaaattaacgaatgagattattgcaacacaggcccaagaattaaatttttgaattgattttttaaaacaactactcacaatcatatataccacaaaatgattcaagtgttgcttacacattcagtgaataaagttataaactttgaattctgttaaacatgtgaataactaaagcattatatgaacaaaaaaatctaacctttaaagtttaaactctctgcggtaactgtattgattatgtggcataatatgccacgtcagaaacaatggatgttaccgccaacaccaaaaacgccaccgtttccagcaaacattttatttttgtctccgcccaaataaaaaccctacatcctcacgaaacggcggctaccaccgtcgctgtccatcaatcggagttataaacagcaattgggtcgacccagaccttagaaatg

SEQ ID NO: 36770 - DNA, 3003 bp, Unknown; identical to SEQ ID NO: 36761
  misc_feature (1)..( 3003): 2750-1469P.txt file - cDNA_ID_3100091; gDNA_ID_2936583; Annot_ID_194994

SEQ ID NO: 36771 - DNA, 3003 bp, Unknown
  misc_feature (1)..( 3003): 2750-1469P.txt file - cDNA_ID_3100103; gDNA_ID_2936583; Annot_ID_194986
aggttaggctctttgcattgcagaaagaagaggcttggaccttaggtacagttagaattggaaagaaatggttaggacatggattgaagaaagtcaaagagtcagaaatcaaaggtttggcggatagtaactctaccttgagtcaaatatcttgccacagaaaggcaggcatggaaacagatcattggtataagatcttgcttagaatatggatggaggacgtgctaagaacctctgcagatagaagcgaggagtttgtcttgtccaagcatgttgtagaacctactgttcctcaagaactaagagatgcgttttacaagttccaaaacgctgctgcggcatatgtttcatcagagacggctaatctggaagcgcttttgccatgtccacaatctcatgatagacctgttttctttggtgatgttgtcgctccgactaatgctataggaaggcgtctttatcgctacggattaataacagccaagggttatgctcgttcaaattctatgcttattttgctagatactgcccaaataattgattggtattcaggacttgttcggcgatgggtgatttggtatgaaggctgtagtaattttgatgagataaaggctcttattgataatcagatcagaatgtcatgcatccgtactttggcagcaaaatatcgaatacatgaaaatgaaatagagaaacgccttgatttggaactgagcactattccctctgctgaagatatagaacaggaaatacaacatgagaaactagattctcctgcttttgacagggatgaacatctaacatacggcctttccaatagtggtttgtgtttattgtctttagctcgattagtgagcgaatcaaggccttgcaattgcttcgtaattggttgttcgatggctgcacctgctgtttatactttacatgcaatggagagacagaagtttccaggttggaaaactggattttctgtttgtattccttctagcttaaatggaaggagaatagggctgtgtaagcaacacctcaaagatctgtatataggtcaaatatcacttcaagctgttgattttggagcctggagatgattactactctccacgacaagagtcttgcaagtgtttgattcttcctaggtcaactctgattcgttttaggcagttgttgagctttgtgtatctgatgtctagcaaatcatatgtccggtgattatcgttcttcaaatgttttaatttctagaggccttgtgcagtagcacagtttgcataccctcagaacataaaaccatggcattagctggtctaatgggaaaagtctaggtgaaatggtctcattgacattcacaatataacttccttcacttttgactgtatcttccaatgcttagcttcttgaatttttctgatttttttctcacaattgatttgcggtgctgcaggttttgaacttgacaaaatggaattagcggatcgagcagtcgggcttctactatcttcaatcagcttgtccatattcacgtactatactttttgggtcatcatcctggtaagtgacaacatctcccccaagttccttaaaaagacattgtcagtttgatgtaccaatgtcatctaatgtttaggatattactaggaaaaagctgacataatagaattttcgttttgtacagccatttgtagatagtgatcacttcatccacaagtacttcttaccccaagactatgccattctcgtacctgtctttgccggcatagctcttctctctctcatttccgtattcatcggcatggtcatgctcaaatccaaaaagaagaaggcttaatttcattcaactcttgccgtaagacaaagttctgtccttgtttcttaagttgtccctacattgttttggtctttcagaggtttagtccggaaactttaaatgggtgtcgttgaaccgtacgagactatatcttattgactctaaatacatacacatgttaagctcaaataaattcttgagagaatatatactaatgatgatggattttaggctccctgacaattcaactaaaaaactatttacagaatatacgaatgatttagatgaatgatgcatttcacgaatatatatatttgtttcttattttgtcttttgtgtattctccatatggcagttactgatctattttcttttctggtttcgtcttttttagagagaaaaataaataaaattgactgataggaattcagtttgttagcaatataagcaccttaaatcataattagtgcttttgaaagttgagaaacagatatattatgaaaaatatcagtagtagtagtcatcataggctaagagctggcaaagcattagagacacaagtgagttttctctttgcaattattctatgtctgtaatgaattttggttttgacttatcttatgaaatttaatcatagttttagctttttctaatctcattagcactacttagtgcttatggataaatcatttcaagtcatcttcgtacaattaataaaatcaatagcccattcacttgtactgtactagagaccaaaacttaatacatacaaccaaaaatcaatttccttttttattttattttccaacacgctttgaattctgttctaccacatttgtatagtcaattctttatttcaacaaaaaagctgtcattaactatttgctaaaataggtttcaaaattttggaaggtgtagattcgtttttttggaccagactaataaatgcatgttttctttttgaagtaatgtaccgtcttcttctgataaaaaagtgaagagcctaaaacattctcttctgaaccttcattataaaaatatatacgaaacctctcaagttttcaggagattcactttggttccggatccgaattacggcgacggatcttatcgtgacggcgccggaatatacggatacgaaatcagctagtcacttgtggtggttgtgaagttacgaactaatcggaattctgttaaaaatg

SEQ ID NO: 36772 - DNA, 3000 bp, Unknown
  misc_feature (1)..( 3000): 2750-1469P.txt file - cDNA_ID_3100120; gDNA_ID_2936584; Annot_ID_143819
tgaaatgttttattgcttgtcataatttagttgttgaatactgtgctcttgaagaggccaccaagtttcatttataagaggatgcctctccttgccagttccgttagtttctaactcttagaaaagtgttatagtttgttctgagatctcataaatttgatgcttatttgataaaattagttttaatctgtgatttttgtttaactaatatagctttaatgaagctcgaagttatatatggttcttagaaaagtgttttccctttgcttccgttgacttcaattcttgtgtatgcaattgtaaggcatttgatatactgatctaggccggagtttattaatcgagctttttgttgcttggttgttagagctgggagaaaacagtggactgtcacagccctggcccggggctaatgccagcgagttttaaagtgaaatctgcgccacttgagggaaatgatggttcatttgaggagtttttagatccagactttggtggatcagccattggacgtgttagccctgttgactctggtaactctttgtgctctaacattttctatttatcatagataaacatacacccttgacattccagctactaaatcacattctactttcaaagttgtgaaactataaacattagtttaataataatatgattggaatctttcttaatttggctaggtttgtggtggatcatattgctgagagcttatggaaagctcacgggtgactacacgttgcaagagagaattgatgttcaaacagggatcaagttgatactcaagctttgtctagccgacggttttgacatgttcccgactctacttgtcactgacggatcatgtatggttgatcgaagaatggggattcatgggcatccacttgaaatccaagtaaagtgactgatcatccatgattgatcaaagaatggacttttcataactgataattaacggtcgtgattttttcattctcaggcattattctactccgctctccgttgtgctcgagagatgcttattgtgaatgatggaaccaagagcttagttactgcagtcaacaatcgcctaagtgctttatcattccatatcagagagtactattgggtggatattaagaaaatcaacgagatataccgttacaacacagaggagtattcagcagatgcaacaaacaagtttaacatatatccagaacagatccctacttggcttgtcgactggattcctgataaaggcggttacttcataggaaatctccagcctgctcacatggatttcagattcttcacacttggaaacctctgggccgttatttcgtctttgggaaaccaagaacagaatgaaggagtcatgacattgattgaagagaaatgggatgatcttgttgcaaacatgcctctcaagatctgttttccggctctggagaaagatgaatggcgaataatcaccggatctgatccaaagaatacgtgagtccattcaaaataacattctctttttcgttctttaggaattctgtagatctttggcttcatactttgtcattgcaggccttggtcatatcacaatggcggatcctggccaactctcctctggcaggtacaaaacaaacatgtattagttctaaagtagctgtgttttcagattatagaaactctaaaacccttttactgcatggttttttgtagttcacattggcttgtattaagatgggaaagctagaactggcgaagaaagcagttgctgtagcagaaaaaaggctaaaggaagatgagtggcctgagtattatgacacgaaaagcggaaggtttgtggggaaacaatcaaggctttaccagacttggaccatagcgggtttcttggcagctaagaaactaatagagcaacctgagaaagcatcactcttgttctgggaagaggactatcagctgctcgagacttgtgtctgtggcctcagtaaaagcagcggaaggaagaacaagtgttcgcgtttcacacctccaagatcttagtttcctgaaacttaataaactcacgaaccaaagtccatatttaatcatattttgcttctgacgtttagcaaaacatccttgctaattaggacgatgaatcagtttcaaacttaacgtatttttaatttgaaaaaaggaatatatatgtttatgtttgccttttccttcttgtcggattacttttaaatctcaatgatgtggatataaataaaaccagattcagtaatctgaagtaaataggatttgtttatagatttgtttttcagtttgacaattggatacgctagacattattggtcaaatcaaaaatggatatttgaaggaaaaggaaattaatgtagatgtcgtactacctttttcttagtataaaggcaattattaatgtgtgatactgccaaaagagtgagacgagagaaaaagacatgagatttgaagtggctgaggaagaagataagaaaatctaagtggaccactcaccagaatacacacatactatactagtatattaataagacaaaatctttggacaacaatcataaatatattacaaccacaaattcaaaataatctacagtaaatgtaaaaataaaaatctcgaaagaaacaatcaaccacaaattacatatcacatgtcaagttacttgaaatcaaacattaatcaaattggatattaactttcaataaattactattagtgtacttgctaaatagagaagctcctataatgtcaaaagaccgacaacatacgatgtcgtattagggacacatagagagacgtacacggactttggagctgagccatccacacacgggacacgataaggttgcgagcaaagtgatcaccaccaaccacttcttatcacgccgtttcaatgggcctttaatgggctctttttttcataaacccgttttgttttatcttttctcagtgtcggtaaaaactagaaagatccggtgattatttcatcatcggcgattatg

SEQ ID NO: 36773 - DNA, 3000 bp, Unknown
  misc_feature (1)..( 3000): 2750-1469P.txt file - cDNA_ID_3100130; gDNA_ID_2936584; Annot_ID_143817
gcctttggcgccattagagacgattcaccgttttgttgttaatgtttaaataaaggcaaaacggcatgatgttcggatgaggtgctttgttttttacatacgcctcgggactttaaccaacgacatttggttggaccaattaatagtaagtttaaccgacccaatgtccggtttttgttcagcttgataccttaccctggttggaacttggaaacggcaagcattcagctatttgtataaaaaggaaaggtggaaaaactacacgacttctctggagcaaaattttaggatgaggtaggctaggcccattttaatgtccatgagtgatttactagacttgagatccacggtagtcccagatcaacggctcttattttgacacgtgaacaaaacacaaaaaacacctcgcgttgtgatctgaaggataaagaaaaacaacaggacgttgtattacataaattagaaacgaggtgctgttttggtgttttccttttttcggcattgacctatcttgaccgactcataatataagcatgcttgtgtcgccactgtctctttctctatatataatagctctcactcttctctgattttcttctgttgaatcaaggtctctggaaatttcatcatcttcagtcttactcctatccctattttctcgttgggttgcacaaattgtttactgatgacgagcgatcgattttggcgcggcggtgaccgcgttgaggtggaacgactagtttctggcgcgacggcatattttccggcgagtgttgttagcgcgccttcggtgagaaagaaactcgtttgggtggagcatgaatccctaactgttggaggttccgtttccgtacgtatgaaggagtacgtcactcccacgcgcctccgtccatctccaccgcgtgaactcaacagacggttcaaagctgacgatgaggtcgatgtcttcagagatagcgaaggttgctgggttagaggcaatgttacgaccgtacttgaagattcaaggtacattgtggagtttaaaggggaaaatcgtccagaaatagaggttgatcagttcaatttgaggcttcatcgtgaatggctagatggtgggtgggttccttctcttctccaacaggtaaaacatttctctgcgtttgaattgaatctagggtttgtagaaaaatagtgaatttaatgttttagggattaagatacattgaaagatttgacgaattaattgtaaatttagtaaaaccaaaaaaaaaaaaaaaaaaaaaaaaaaaaaaaaattgtaaatttagaaaaaagacttaattatactatatatactgtatgtcaagcaatttgaatttgaagatttgttggaatttggcataataaactcacactgcttttttgatttacagagcaatttctcggaatcgacagcccaaagaattaaactgaagataaaaatcaagagaagagatcaatatgagaagggagctcttgtcgaagtcagaagtgaagaaaaagcttacaagggttcttggtattgtgctcgtatactttgtttattaggtgatgataagtacattgttgaacacttgaaatttagtagagatgatggtgagtcgatccctctgagagatgtggtagaagccaaggacataagaccagttcctccttcagaactctcgcctgttgtgtgctatgaaccaggggttatagttgatgcttggttcaacaaacggtggtggaccagtagggtttccaaagtcctaggaggaggttctaataagtattcagtttttatcatctcaactggtgaagaaacgacaatcttaaatttcaacttaaggccccacaaagattggatcaatggacaatgggtcattccttccaaggtattgactgatgtgccggaagaatgttacaaacctccattgaagaagctgaaatcttgtgagagagcagagaaggtgtttaacaatggaatggaggtggaagttagaagcgacgaaccaggttacgaagcctcatggttctctgcaaagatcgtaagttacttgggcgaaaacagatacacagtggagtatcaaacactaaaaacagacgatgaaagagagttgttgaaggaagaagcaagaggttcagatataagacctcctcctcctccactgattccaaaggggtatcgatatgaattgtatgaacttgtggatgcttggtacaatgaaggatggtggtctggtcgagtatataagataaacaacaacaaaacgagatatggtgtctacttccaaacgactgatgagagtttggagtttgcttacaatgaccttaggccttgccaagtgtggagaaacggaaaatggagtcgtgtataaggatgagaagaagttggctaacggttacaactattaatgaagaggataaggaaaatgacttgtttatagtacattttttgtttatgaacatatgtttgaagttgatgatgtcgttaattgtctgcgtataatataatatttaacttctaatgaaagaggtcaggtgttaagtttcttttttgttctctgttctcacttccattttactgaaattcttggatagatgggtttgttaatcttggcaaatgtgatgtgaacagtgattgtatcttgactttcttacacttgtttcaagactttctcgattgaggaattaaaacgcacagttttgtaatagtagcggcagattagagatgggctttattatcaagttgtaaaactattggggtttaaattcgaaaaacaaaaaaataggtcatggtttaaaacgcaattccattataactcaggggtttccttgtttctttatattactatatcttccagattaaaaataaaaggatcgttaaaccctaaacccgcttcttcttcttctttctcttcttctccctcaacgccgctctctatctctctatctctctctacctcaaacttattcttcgaatttcctctgaagaataatcttatcccaatagcgagtatg

SEQ ID NO: 36774 - DNA, 3003 bp, Unknown
  misc_feature (1)..( 3003): 2750-1469P.txt file - cDNA_ID_3100136; gDNA_ID_2936584; Annot_ID_143816
aatcgggatgctatatgcatactaccacccaactgtaagttcccaatactagaacttcacatcaactctgttcacaaatggttagctcagtgataaagacttaccgtttcatttccttgattatgtatcttataggttgaaagttggatggataaactggaggaagctgagatgaaattcagggtggctatcaaaacatctgtggcactgatagcactaacggtattacaagtcatcatttgactttctttcaggtgaaagaagcctcttgcatattgttcttccagctaatctatctttgttattatgaaacttttaggtgggatatttttggtacgagtatatatacaagatggacaagttaacttacaacaaatatcatccttacacctcttggattccaataacgtagtccactttacctgcaaatctctatacaaccactcttctaagaaccagtccttacttgtgtacctcgttttgcttttctttcagtgtttatatctgtctccggaacatcacccagtctttccgcggctacagtttgacccttctggcgtaagtaaaaaataattcagtcaatagatatgtttatcctcttataacgattttttcaagaaaaatttgttcatgaactttcaggtggcttggaaagataacactggagacatatatctcccagtttcatatatggctcaggtatgtcacacttttcttgcccaagttctcaattgtagagtaagtgggaaattgatggtggagcatgctaatacaataagctattaagatttttcctgacccattgaactatgaaataatctaattcacccacagatctggagttcctgatggtcaacccaaattactactatctcttgtcccggattacccattgttgaacttcatgctcactacttcgatttacgtcgctgtaagcaaaccctgctacaacagatagaaacaagttgaaagccagacagatacaaacaaactgattggctttttgttgctctgttttcagatctcttataggctctttgagcttaccaacactttgaaaacagccttcataccaaccaaggacgacaaacgccttgtctacaacacgatctcagcactcataatctgcacttgtctctactttttctcatttattcttatcacaattccccaaaaactggtaagtcaaaattttatctttttgtgtgggagaaagcttttttttccctggtacttgagttcattgatatgttagtgcatacacaaagcgaggacgaatgtcatcctctcatattcgattgaaccatctcacgttttattatttcactggaaacaaacaggtgtgaagcacttctgaaccggaccagagtggactattcgaatgaattcataggagttgaactacgcgatatggtagatatacgaagatagaaatcagaggtagatgcatacaatgttgctgtaatgtcatctttctgtatatttatttatgaataaggtgttctttcttgtttatttgtgtttctgttcacgatgatgttaagacttattattgtctattacaagttaaaggaaatccatatgagtaattgtatagctataaaatccagattaatcttacatcaaagtaaaatatgatggacttgcaaaagccattactttaatgtaaggaaacattgatatacttagatagaaagtgtagtcatagcatgtgtgtcaagcttgtcctctattgctcggtaggcagagaaagtgtccgagtcttcccatttggagaaattatacgcgggcccaaaggaaagcaaaaaatgaggtactgatattaaaaacaataacagtaccttatagtcaccccggtatagattgttagacatgctaaagagacaagataaccaaccgaggaagagcgtgtacaaagcatgtccgatctccatcctaaacttatccgatagctgaatcagccctaaccctccggtgaacaacgagatggtgaataacgacatggacaattcaaactctttgtttgtcaatagctcatatattaagggcaatgccaacgctaaatttgcggaaaatgtcgaaaacaaaacctgaggtactctctccaactttgtagtaaactccttgtagcaagcggaaggaggagcggtgaaaaaaagatatctgagtagcgtcactgcgtagaatgttgtgacactgaccgcaccgtccctaaaggactgagacgatgaatctccaggtggccagagaagattgagtgatttggagaggccaaaaagtgagagtagagtcattatataccatattcctctgcaaacaaacacatccatatcactaatcttcttctccatcgtgtgtgtgtttttactaggactatggggtttcggagatttaatagtcgtcgtgaattcgtttttcgatttcttttatttagttagttaaatctgcttttatccagaagaatgtggtatatctctattattagttaaaagtggttagaagattttcataatcacaacaaacaaaagaaatcttcgcaatctttatctaacacttttttttttcaagatatataaaattcttttatattcaacaaagaaaatagttcaaaaaatcacattataagtggaccactgaccagtaaagtgaacgaagaaagtataaactctattttcttcaattaaaccgtttatataaaaaaaaaaatcatattttaagtttctaacataagaaaaacagtagaccctatagtctatgcgttgattaagaagatgggccatgttgggccgattcacacttacctcttttattcatttacatcttaggcccattacgtttgtatatgtaatgtaagaagaaacttcttcttctcttgaacctcttcctcgattctcctcactcatctcaacatcttcccagattattcaacgctcgtgtatcgatcaagctactgaagtcacgttggttcgacttttgatacacaaatctgttcgagccaccatg

SEQ ID NO: 36775 - DNA, 3003 bp, Unknown
  misc_feature (1)..( 3003): 2750-1469P.txt file - cDNA_ID_3100141; gDNA_ID_2936584; Annot_ID_143815
tattacctctaaggaaggcactaattgaagtatgcatttatttgcacgaactccagacaagattttccaacttgtctcatcaatgtccctcagaaagaaaggattaagcacatctacattctgaagttctcgcagttaatatcaaaatcattttagtgtctctaagtaaagcaactagaactatagaaagttttgaaaacgaacgtttggaatggataatactctaagctgagcatatggaagatcaaccaagatcccatcaaacttaaagcggatgagaggaacttttgcatctttaacacaatgaagctcggaaacttctcgtctgcttttcaacatatcacgcaaggagatgaaaaaatcctcctgtaccaataagagaagaatctcaacttcacgggaaacaaaaacaaatgtgaatcagatcattcaacgaaacaaggaaaactcacagcaatagaggcaaagaaaggaccaatgcagagagcgtcaatgtctgattcagaaccataaacctggatgacaatgaaagacaacaagagttagctaaaagtttcagcattatagagtcgtttactagaacaatatatataaagattttgaaaaagaagacaagtgaaagagaaatctcaccccaagaccataagaaccataaggtaaaatggtggcgttggtggcgtcaatctgattttgtggaagacggtgttgccaggcaacattcttaacccatctcacaactatctgttcattagaaagaaactcagagacatcagtaatcactgtccaactactcaagaaacaaaactgaatgtacctttcgtagctgattgataacacctcttcgtttcacctcatcttcaagagatggaatgagtccttcattaaccatcagctacgaaattttgaaagaaagtgaaatcttggttttttttaagtccttaaattgagaatgagtaaaaaccctaatatattacctgacgaagcgagatcgagctttcgtcatcttgagggaaacctagggacaagaccagagccgtaacgtgaggaacaaggatccggcaagggagaaagggtttatcgaaataaaacgtggaatccaaggcagtgacggcgttgacaattagcataatccgccgttacacaaaacgaaaacacggaaagagaaagaagaatttgccgggaaaaaggactaacctttatttctcccacctccctttttcattgccaggaatgtcagactttgtttcccgagaaaatctttgaagaaaaagaaagcaaaattggtggagtctctccgcttcgccttcgcctttgttttgaacttcgaactaaaaattgccttaaatccagcgcagcaatagatttggccccaccaaattattgacgtggaatatgtattacttttttttttaatagtatagctttatttctctacttattatatttttctagtttataatctgaaaaagagataaattgaaattttatcgaaaatttctgttttcaaaggatggtttttatggaacaaaaaaaaataatcttccactaacactgattttttttttaacgactttcttcattgattcgatcaagtataatactgattatactgattataaaacaaaaaaaatgtatgtgaatgatcgttttctgttttttttttctttcgaataagatttcaaattttatttatgcatcctggcgtatcattttttctgatgagattgtgattctgaacatggcaattaaaatgagtgattctaaacactgttttagagactacagtctacatgcgacacgaatataaaatgatttgatcagatgtggacactcattatcatataatattataatggaatctaagatcagttagtatacgaatatgtatagagtccgaagcatataatgtcggtgaattccaattttcttactccaaactgattgcatgttaataaaattcttacttaatgtagtttgactatttaagtctaaagaaacgcgtctttgacaaacacacgcccacatcgcatcagccagcctcctaataattaaggtttaaatgaaagttaattgctaattacaatctgaaaatatgtgacaatgactctcataggttattatacatggtggtttatacgaacgatacacttcagttcaccggcattgaggattgtgatccaaaatcatccactctttcaattgctagtgagtacaattaatgagataaaggtttgaaactttacatgtcacacaaaaatgtggaaatcataatacgtattatcttcagaatcacgactcaaaataacatccagaaatatatatccttcttatattactggaagttatatacatacatacatactgaaatctcaaaatgtaatgggaatcaaaatgtatgatccaccgagtgtgaaaacaaaatattaaattgtctctttattatctttagttgtctcgttcttattacgacaccgatctgaaaaaaacgtttatttggttgttaaaaatctcactacacaatgacaacttttatctttgtatccatgcaagcatttcctttctattaacagcacccgattatgatagaagtgaataaaaaccaaaaatggtattgtcatacggaatttattgttggttttaatttgtaattaaatctgtcggttagtcatttttgtatttctattcttttcgtgggagaataaaataattgttttgaggtagcagctgcaaaccgctcaaacagttgcgcattaggcattacacagttccactcgttccttttgaagcttatctgtgtgactctaatctgttactataataggaacgaaagagagaactaggatctatacttgctccaaccttgctttgtttctcttctgcgatttatctctagatctactagatctggacaaggagcgaagcgaattgctggcaaattttagttttggagttttgaaacccgacgattatcgcgcttgatcgttgcttctctgatcggaaatg

SEQ ID NO: 36776 - DNA, 3003 bp, Unknown
  misc_feature (1)..( 3003): 2750-1469P.txt file - cDNA_ID_3100177; gDNA_ID_2936584; Annot_ID_195012
tctggtgtaggcgatgcatccttaacatagcgagcataaccagctctcccacagtgccttttgctggagtcttcgtgagatcttctgtgtctagaatgcattgtaccactatcttcccctcttttgatactaattgcttcatgttctgcaagtctagcttcttgtggtggggtactgacttcacgttggtcatcagtagcactgtctttcaatgactctgtttcataatcatcagattcctcatttataccaacagaagaagaagaggtagggctcaaacgaatgcgatctccaagagatgattccctctccactgaggatggatccgtctcatcagaattgcaaacactctcttctttctccttctcaagcatttccttatcactaggtgttgcttccctactgcagcaattctctgttggaagagatttctcgccactgaaacttccagcgttttcttcttgacaccccacaaaagcttcatcttttggagaaccatagactgaattcaaatccttgctaccatatgaatgagaaacgtcacttctagatgcttcatttgatgttatgcatcttgctttctcaggtgtcctgactggtagctcctcaacatcattagtaactgggatctggtttcatacatttaatcagcaatggaagataagggaagcaaaacccagcaaaccaagaatcattcaatctctaacctgtatcaccacgccagggtcaggatcacgtggacgacgcaaatctgcagaaggtattcgctcaagagtaccacctctaacctcaattgctcttcccttcagttgaataggtaagtaattcattaagatcaaaccaactacgccattgacacaacgatacgaaaaaaggaacgaaaacatgtctacttaccaacggtttacagtaatctttccagctctgctcgttaagcccaaaattaaaaaagtcactggtatccgtaccaggatccctccatggcttcttctctaacacatcgagatttacatcaaaaggtgtcctgagaataagagaaacacacatcatgatcttcaaacacataaaccattactcatatcaatcacattcaataaacctaaaacacacatttatcatctaaacaccactgtgactaacctggaccaagggtttgggaaactatatctgtattgagacattcctaaagaaggatcgatgcaagcattattagctgaagcgtttctagtccaccgtctctgaaacgaggaagctttggatgcttcgtatccgccaaagttggtgttaaacacacaagaagcaggaagggctttagagtcgtcgtctttgagcactatattcaaatcatcatcactatcactaaattccgattcttcatcggcctcagtcagattcatagcacaatcgtcgtcgtcacacggactcgaatccttagcaacaacatcaaatttcttcacttcaccttccgaatcagactttaccgtctcttcaaaacccttatcctcgccggagttcgtagcacactccgattcgaaagcatcagtcgcctgaaacttggcatcatcaacgtacaagtcaccgaaatcatcatcagtagaatccattcaaaagaaactcgatgaacaaatccaaatttgacactagaatcatctattccataaagtgagagtcttgacacttgacagttgcataaacccaaaagagatttgggagtgacagaaaacgccttaaaccctaacacgattaattcatatattattcttttctactacataaaatcttatatcataattaaaataaaaattatgcttgtgttgtggctgtggccacacaaaatatgagtatgtttttaatataaataaaatttaaaatttaaaattatttaaaatcaaaatttagaaatatgaacaaaaattataagaagttagataatatatggtaaacttagcaaacataaaaattaaaagaaatattagctgttttctttaattgatgccaaaaaaaaaaaaaaatctctttaattaatattaatatatatccaacatagaaataatcttcaatctatttttttacttaatacttaaagagttagagttgtatcttttcatttactcaaatttgtatttttttttaacaacaactcaattttttttatttttttgtttccatagaaagacatctttatgcttttccttaaaaaaaaatggacttcacaacaacaaccaaaaaaaagaataaaaagatttggatcggagatccggagctgtgacttgtgagctaactaccacgggccacgtgattacacctttaatataatattgtcttctctatctggcagtggtagctgagctcatcttatttgtttcttccctcccatttaatggtttcctcttaaaccattcccttcccttcctcctaactgcaatctactctccacctaacattgctccgttttgactcgctcgactcggctaagtgaccacaggttcgttttcctatttctctaacttttcattggagatttccatgactcagatccgtgtttttttcgaatccgatccggttaatctcaaacaaaacttgtcgatccggtttgggttttagggcctatagaggggatagtgatgagtcgatagtggaatgatttcgtttctacaaagactgagatcttaagtaatatggaattctgtaatgcagtggttgagatttgcagtagtgggtccctggtttcgatcccaaatcgttatcttttaatccagaacaactggaataaagaaacaaagcttcttcttgtttgattcagttctcgatcatggtttgattaaatgaatcaactttattaaagttgtgttagcttgaaaagggagaaactttttgttggtgtgtaaccgatgatctgtttgatctgtttcagtgtttgcttttttgcatgtcaatattttattcacgacttctaaatttcacctttttctgattctcagttcctttcgagccaataaaatg

SEQ ID NO: 36777 - DNA, 3003 bp, Unknown; identical to SEQ ID NO: 36776
  misc_feature (1)..( 3003): 2750-1469P.txt file - cDNA_ID_3100177; gDNA_ID_2936584; Annot_ID_143805

SEQ ID NO: 36778 - DNA, 3000 bp, Unknown
  misc_feature (1)..( 3000): 2750-1469P.txt file - cDNA_ID_3100192; gDNA_ID_2936584; Annot_ID_195029
aatttgtattttttcgtcattatttataaaacattttttttgttacagacttgagattattatcatctaaattcagactgctatattaatattgtaaatacttccatccatttttaaaaaccaattgttataaaacatcctaccataatatagatgttaatttagaattagaagtatgctaaagcagtaacgataacataatttcgaataatcgtaaatacatattcttgtcaacattataatatggtaacgggactaatacaaactattatactagaaacttagtcttaatcaattgctttaatattgtttgtttgttctttttcctttttgtggatataagcatttttagccacaaaagtctctaaagctctagccagaaaccatgctaatcacgtgataaatcaacaattcaattgaattaatgctttaatagagaacccataacattggatcgagacgcaaactcaatactaatcacattaacgaatacccaaatcgtgtactcgatacgacacaagaatattcggttttattgaaatttcttattattaccaatttaggaaaatattgatttttcggtttccgtacctttggacaagaggtttatgttttgtctatcccgtcgtaagttgattgatacctgccttgaaatttgccataccttcttagcaaccacttgtttgtttgtctctctgtcttttgtggttatctttaattagattcataataatttcacacatttttcgttagaatttaatgcaaagtaatttcacaattatgcattatatataattacttatgtatacatgtaaggaatatagggtttttgagctttaataatggttaccgtaagaaagtaggacatatatacatttgttttgcatttaatttgtctatatgtttatattagtgtatgtttcaatattgaatttttttctcccatgttaagattgatgaccaatattatatatgttaagagagtgatattaaacatatgaatgaaatagtaagattagtgtgcttttaacaaacaaacaacaaaaaactagtgtgtattccatatcttaccttaattactgtatcgtatcagggttttgtttttggacaaaatcgtatcagattttcaagatgtcaaagtttactatatatgatttttcccgatataaaataaaatgtgtaggcctaattaggaaatattcttttgatctttattctttatacgtatacattatttttaaacagataatcaatgtgtttttacataatggataagataattcaaaaagtaatgtgtaagtacatgaattcatgtatatacataatcaaactttcatgtaaaactagatcattgtgtgtgtttaactttccatgtttccagattgcatgagtagtactagttgcgagcttgtgaatttatctatccactaagttataaaaagagacccttcaattcccaccattcagactaacaaatattttttcttataaatataaacaatatggggttgtggataagatcgtataagctaatatcaacaagaaaaactgaagcacgttagatgaatgacatgctccagtccctttctaggttattcaaaagcaaacgtttagtattaaacccacatgcttcaatcctcgtggttaggcatctaatatgaacacttaagatatttagttcttaacttcttatgagtttgcagattttaacttatccgttttctttcttcaccaagtaatatagataactccactatttatgtatgaaactgggtatatacataatttggagtcagaaaagtgatttgactttatttttctaaattcaagttccaatagtagaaaggaaattagtttacatgttgtggttatagctgataaaattgtggaccaaggactacagaaacttcggtaaaaggaaaatttagattatatgttgatgtgaaaaaagattatttatgtcagtcacgtaatggaaattttgttttacaagtaaaaagtatataaaccaaaggttaaaattttgctcacatttttttttaaaaatggtctacgtagattatgctgcaagatgggcttatttaggctatataattgacaaattagtacatcataaacccatacggttaacttattacgctcaaactgggcctcatctttgtagtaatgggctggtatgattcgaaacgtgaatctttgtatgcgcttgaatagcacgctcaatttagagcgcgtgggtatgtttatgtgacgaagcaagattccttccttggccgccagacaaattgcaaaccgaaattgatcacggcgacgcgtttgcacaaattaaatttcagacaaagacgtctgcgtgcacatccagaaacattgactaatcaaaatatgccacgtatgcgaggatttggcttcccagggttaatttcgtaaaatggaatcgtgtcaaggaccagtaaggttattatcatcatgtatttctccacatttatttaatgaagaattcttgtgggctctaccaccggcccatctgatccatacaaaaacagagagcaaaatcggaaatgtcacttctaccctaactcgctcgacgataaattagtgacaaaacacaaaagaaacacgtatctgagcctattttcgtagttttacaataactgaaaaaagaagaaggaaaaacataaagtacacgcgcgtcaacatgttaactaatttacatttttgtccacggatctttttttctttttaagcaaccttcagatttcattccatcatcttcaccaaaccatttattcagacaacaaaaatatcttgcattcatttttgttactctcttaaaatctcattctttgattatcttctcttcccctgtaagtactccgatctaattatttgttcctatcagacatcccccaatttctacgatcggatttattcgtcgatcaagaagctggctaagttgtattgttggtgattgtatagtttttattattattcgagagaatg

SEQ ID NO: 36779 - DNA, 3000 bp, Unknown
  misc_feature (1)..( 3000): 2750-1469P.txt file - cDNA_ID_3100192; gDNA_ID_2936584; Annot_ID_143820
catgctaatcacgtgataaatcaacaattcaattgaattaatgctttaatagagaacccataacattggatcgagacgcaaactcaatactaatcacattaacgaatacccaaatcgtgtactcgatacgacacaagaatattcggttttattgaaatttcttattattaccaatttaggaaaatattgatttttcggtttccgtacctttggacaagaggtttatgttttgtctatcccgtcgtaagttgattgatacctgccttgaaatttgccataccttcttagcaaccacttgtttgtttgtctctctgtcttttgtggttatctttaattagattcataataatttcacacatttttcgttagaatttaatgcaaagtaatttcacaattatgcattatatataattacttatgtatacatgtaaggaatatagggtttttgagctttaataatggttaccgtaagaaagtaggacatatatacatttgttttgcatttaatttgtctatatgtttatattagtgtatgtttcaatattgaatttttttctcccatgttaagattgatgaccaatattatatatgttaagagagtgatattaaacatatgaatgaaatagtaagattagtgtgcttttaacaaacaaacaacaaaaaactagtgtgtattccatatcttaccttaattactgtatcgtatcagggttttgtttttggacaaaatcgtatcagattttcaagatgtcaaagtttactatatatgatttttcccgatataaaataaaatgtgtaggcctaattaggaaatattcttttgatctttattctttatacgtatacattatttttaaacagataatcaatgtgtttttacataatggataagataattcaaaaagtaatgtgtaagtacatgaattcatgtatatacataatcaaactttcatgtaaaactagatcattgtgtgtgtttaactttccatgtttccagattgcatgagtagtactagttgcgagcttgtgaatttatctatccactaagttataaaaagagacccttcaattcccaccattcagactaacaaatattttttcttataaatataaacaatatggggttgtggataagatcgtataagctaatatcaacaagaaaaactgaagcacgttagatgaatgacatgctccagtccctttctaggttattcaaaagcaaacgtttagtattaaacccacatgcttcaatcctcgtggttaggcatctaatatgaacacttaagatatttagttcttaacttcttatgagtttgcagattttaacttatccgttttctttcttcaccaagtaatatagataactccactatttatgtatgaaactgggtatatacataatttggagtcagaaaagtgatttgactttatttttctaaattcaagttccaatagtagaaaggaaattagtttacatgttgtggttatagctgataaaattgtggaccaaggactacagaaacttcggtaaaaggaaaatttagattatatgttgatgtgaaaaaagattatttatgtcagtcacgtaatggaaattttgttttacaagtaaaaagtatataaaccaaaggttaaaattttgctcacatttttttttaaaaatggtctacgtagattatgctgcaagatgggcttatttaggctatataattgacaaattagtacatcataaacccatacggttaacttattacgctcaaactgggcctcatctttgtagtaatgggctggtatgattcgaaacgtgaatctttgtatgcgcttgaatagcacgctcaatttagagcgcgtgggtatgtttatgtgacgaagcaagattccttccttggccgccagacaaattgcaaaccgaaattgatcacggcgacgcgtttgcacaaattaaatttcagacaaagacgtctgcgtgcacatccagaaacattgactaatcaaaatatgccacgtatgcgaggatttggcttcccagggttaatttcgtaaaatggaatcgtgtcaaggaccagtaaggttattatcatcatgtatttctccacatttatttaatgaagaattcttgtgggctctaccaccggcccatctgatccatacaaaaacagagagcaaaatcggaaatgtcacttctaccctaactcgctcgacgataaattagtgacaaaacacaaaagaaacacgtatctgagcctattttcgtagttttacaataactgaaaaaagaagaaggaaaaacataaagtacacgcgcgtcaacatgttaactaatttacatttttgtccacggatctttttttctttttaagcaaccttcagatttcattccatcatcttcaccaaaccatttattcagacaacaaaaatatcttgcattcatttttgttactctcttaaaatctcattctttgattatcttctcttcccctgtaagtactccgatctaattatttgttcctatcagacatcccccaatttctacgatcggatttattcgtcgatcaagaagctggctaagttgtattgttggtgattgtatagtttttattattattcgagagaatgaacagtagaagctgtatctgtgtctctgcgatgaaaccctgttgtagatttcttattagttttagaagttcctcgcttttcggtttttctcccccgaactctggcaaattcatcaattcgtcgaagttacactgtacaaagattgattccaggagtattagatctggtattcattgccgtcggattgttctggatcggaatgctttttgtgattccgattccattagctggggaggaggaggatctagagttttaagagctagaggtagtagtagaggaagaggaaggggtgttttagtaattccccatgtagcttcagattttaggaactattcgacctcttcgttggattctcatgtaaatgataagagctttgagagtatg

SEQ ID NO: 36780 - DNA, 3000 bp, Unknown; identical to SEQ ID NO: 36772
  misc_feature (1)..( 3000): 2750-1469P.txt file - cDNA_ID_3100197; gDNA_ID_2936584; Annot_ID_195028

SEQ ID NO: 36781 - DNA, 3000 bp, Unknown
  misc_feature (1)..( 3000): 2750-1469P.txt file - cDNA_ID_3100202; gDNA_ID_2936584; Annot_ID_195027
ctttaggatgggagtcgattggtctaggatcatgccagttgagcccaccaaaggaattaaggaagcagtgagtcaagaaaatattatgacacgttatgttttacatatactatatgtgtcaatgcattttcttttgttttgccattttttgctaaaactttgtatttctattgttatgctttgtaggttaactatgaggctgtcgaacactataaatggatacttaaaaaagttcgttcaaatggaatgaaggtgatgctaacgctgtttcatcattcattgccaccatgggcagctgactatggtggctggaaaatggagaagacagtcgactactttatggactttaccaggtgactgtctcatcaaatgagctatttatggacattctgtaggtcttaatcatctttctataacatgccaggattgttgtggattccatgtatgatttggtagactcttgggtaacatttaatgaaccccatatcttcaccatgcttacctacatgtgtggatcttggcccggtaacaaccctgattttctggagatagctacatctactctaccaatgggtgtattccatcgagccttacactggatggctgttgctcactcaaaggcctatgactacatccatgggaaaatgttagtttttctcctttttcttaaaaaaaaatcctatgaatttctctcactagcacatcttaatagtttccaactcttattttgcagttctttgaaaaaacctttggtaggggttgcgcaccacgtctcctttatgcgaccatatgggctctttgatatcggggctgttaccattagtaattccctcactatatttccatatatcgatagcatttgtgagaagttggatttcataggcatcaactactacggacaggtaagagagctacaagtaaaaattgctattaggtctcaaattttgattaataatattgctttctctcgaataagtatgttggaatctgactcgagaaatcaggaagcagtgtgtggtgctggactaaagcttgtagagactgatgaatacagtgaatcgggaagaggggtatatcctgatggtctctaccgcgtgttgttgatgttccacgagagatacaaacacctgaaagttccttttatcgtcacagaaaatggcgtgtctgatgaaacagatgtgattcgacgaccttacctgatcgagcatctccttgccttatatgctgcaatgctaaaggtctttgtccctgaaactctctgaatcatgcaaaacgttatttccagcttaactattgaaatttggtagcattgttgtgatgagcctggtctgttaaaacctcatctagacctcaaaatccagccatgattttagtccacgggccatcctggacccattaaggcaaaatggcgggtacctggctcatccagcatgtgacgggcttagactcaaaaaggtcatccgttgcagggctgggctggctttgggtcgccataacaaccctacgtattggcatatctctcacttgtgtttgtggctttcacaacagggtgttcctgtgctcggttacatattctggactatttcggacaattgggaatgggctgatggatatggtccaaaatttggacttgttgcggttgaccgatcccatgatcttgcccgaactcttcggcaatcataccatctcttttccaaggtttattataaccccttgtggtttttactacgcttgagagttgagatcaccagatcgctgttcgtctcatatggcttttgtgttttccttgctctttccagatagttaaaagtggaaaagtcactcggaaagatcggtctcttgcatggaacgaactccaaaaagctgccaaagcaggaaaactacggccattctaccgaggcgttgataatcataatcttatgtacgcaggttggtttacaacttccaaccttgcgtattttttttttgtttttccaacttttactttatataatcttacttccaaggctttgttttgtttgtttaaaagatggtctcgacaagcctcaatggagaccgtttgttgaccgcgactggcggtttggtcactaccaaatggatggtcttcaagacccgttgagtcgcgtggctcgaacccttctcatatggccgcttatcatgaaaaagaggataagaaaagttaagatcaagcacaccgatgatgctgggcttgttctacatcctgctttagcctcaccctttgactagagaaagaggtagaagaaatccgagtgtacaaactcatttccctgtatgatttgccaaacctttgggcctttggcgccattagagacgattcaccgttttgttgttaatgtttaaataaaggcaaaacggcatgatgttcggatgaggtgctttgttttttacatacgcctcgggactttaaccaacgacatttggttggaccaattaatagtaagtttaaccgacccaatgtccggtttttgttcagcttgataccttaccctggttggaacttggaaacggcaagcattcagctatttgtataaaaaggaaaggtggaaaaactacacgacttctctggagcaaaattttaggatgaggtaggctaggcccattttaatgtccatgagtgatttactagacttgagatccacggtagtcccagatcaacggctcttattttgacacgtgaacaaaacacaaaaaacacctcgcgttgtgatctgaaggataaagaaaaacaacaggacgttgtattacataaattagaaacgaggtgctgttttggtgttttccttttttcggcattgacctatcttgaccgactcataatataagcatgcttgtgtcgccactgtctctttctctatatataatagctctcactcttctctgattttcttctgttgaatcaaggtctctggaaatttcatcatcttcagtcttactcctatccctattttctcgttgggttgcacaaattgtttactgatg

SEQ ID NO: 36782 - DNA, 3003 bp, Unknown; identical to SEQ ID NO: 36774
  misc_feature (1)..( 3003): 2750-1469P.txt file - cDNA_ID_3100211; gDNA_ID_2936584; Annot_ID_195026

SEQ ID NO: 36783 - DNA, 3003 bp, Unknown; identical to SEQ ID NO: 36775
  misc_feature (1)..( 3003): 2750-1469P.txt file - cDNA_ID_3100220; gDNA_ID_2936584; Annot_ID_195024

SEQ ID NO: 36784 - DNA, 3000 bp, Unknown
  misc_feature (1)..( 3000): 2750-1469P.txt file - cDNA_ID_3100250; gDNA_ID_2936584; Annot_ID_195011
gacttgaatagacgtgcacaagtcccgctgacccaagcaaccactggtttggtcacttttccctgtttcatggcttcaactagagaatattcatctcttcctccaagctctccaagtacaaccaccatcttaatctgcaatattgaaaaaatgaaaacaaaattttggagttaaagaggctagctgaacaagagagggaaggtcagatgcctctaagtacagtatagctttctcatggttaaacagtagaaaaaatggataggccgcatgaggatatcccagtgagcaacaaaattttaaaagtcaagaagaatatacctgtgggatgttgttaaaccgcaggatatggtcagataaagttgagcccgggaacacatccccaccaatagcaatgcctacggccatcccaaatcataaactcatcttaagaatcttcagaaatgataagcataaggaacatattcattagtaaattctgaacaaaaaaatagaaactcaccttcatagatcccatctgtcacacgggcaatggtattgtacatttcattagacatgccaccctatagaaaatagtgaatgagaaataaactctcagattaagattcaaaagaggataatcatgagcttaggtagactacaaaatgcgaaaaaaacaatctccacagctcatacagattttgagacaaagccaacagatccaggcctgtacaacttgcattggatgatattgtcaatagttccagctgtgtcaccaattttaaaggctccagcttgaacgcctccaacagtagctggtccaataataacctgtaatgaccaatcagtaaaagaagattaactcggaaagctcacatcaataagaaaagatcgatcaatagtaagttcctaggaatactgcatcatgaggaatgagtcagtttagtgttataaccaaccttattattagcacgagcataagcaatcaactgcttagtgtctgactccggaacaccttctgctataatggccactactttaatagttggctgcttcaaagcagccatggatgaagcagcagcactaaaatacaaggggaaaagaaaacattacaagagaatcacatagtaaaacaggaaaatcgcattcacagaataaaacaataataaccttctaaacgatgcgaagttgatgaatacatctgctgtgggatgcgcagcgcatgctgcctcaatgctgcaagaaacagacaactaagataaaaaattctgaactatgtatttctctctttctttatgtagatggtatttaacttacgctgcgtggacagggatggcgatctcctcctgaccaaaaaatagcttttggaatccctcggaacctgggtttatgataccagcaacagaaggagtttctcgccctgtaaagagttaagataattaaagaaaccaaatttaatagtgaagtaaatccagagaataactgattaagacattaagaaagatacaaaagaagatacactcaccacagaggaaatcaaaatcaagcatacgctgaatgggaagctgcttataattgtagaacaacgcttgtgtgttgcgtgaaaatagctgtcccgtagccattttattggctcgaaaggaactgagaatcagaaaaaggtgaaatttagaagtcgtgaataaaatattgacatgcaaaaaagcaaacactgaaacagatcaaacagatcatcggttacacaccaacaaaaagtttctcccttttcaagctaacacaactttaataaagttgattcatttaatcaaaccatgatcgagaactgaatcaaacaagaagaagctttgtttctttattccagttgttctggattaaaagataacgatttgggatcgaaaccagggacccactactgcaaatctcaaccactgcattacagaattccatattacttaagatctcagtctttgtagaaacgaaatcattccactatcgactcatcactatcccctctataggccctaaaacccaaaccggatcgacaagttttgtttgagattaaccggatcggattcgaaaaaaacacggatctgagtcatggaaatctccaatgaaaagttagagaaataggaaaacgaacctgtggtcacttagccgagtcgagcgagtcaaaacggagcaatgttaggtggagagtagattgcagttaggaggaagggaagggaatggtttaagaggaaaccattaaatgggagggaagaaacaaataagatgagctcagctaccactgccagatagagaagacaatattatattaaaggtgtaatcacgtggcccgtggtagttagctcacaagtcacagctccggatctccgatccaaatctttttattcttttttttggttgttgttgtgaagtccatttttttttaaggaaaagcataaagatgtctttctatggaaacaaaaaaataaaaaaaattgagttgttgttaaaaaaaaatacaaatttgagtaaatgaaaagatacaactctaactctttaagtattaagtaaaaaaatagattgaagattatttctatgttggatatatattaatattaattaaagagatttttttttttttttggcatcaattaaagaaaacagctaatatttcttttaatttttatgtttgctaagtttaccatatattatctaacttcttataatttttgttcatatttctaaattttgattttaaataattttaaattttaaattttatttatattaaaaacatactcatattttgtgtggccacagccacaacacaagcataatttttattttaattatgatataagattttatgtagtagaaaagaataatatatgaattaatcgtgttagggtttaaggcgttttctgtcactcccaaatctcttttgggtttatgcaactgtcaagtgtcaagactctcactttatggaatagatgattctagtgtcaaatttggatttgttcatcgagtttcttttgaatg

SEQ ID NO: 36785 - DNA, 3003 bp, Unknown
  misc_feature (1)..( 3003): 2750-1469P.txt file - cDNA_ID_3100255; gDNA_ID_2936585; Annot_ID_143855
tatcgctctctttgctcttgtggacgccacttgtttccaggtctgcttactttacctgaactctttaagagttatgttgatagattcttgtctgcatgttggtgatgcttgttaggattatggttcagggatttcttgctcaagggttacagagaacttctgctggtttaggaagtgtaagtttttttctatctctcaagtcttatctgtgttcttgtctaggcctgagaaaggcttttgggtttgttaatccgtcacgctgcaggtcataattgattctcagccactgactgtagctgtgttagcatctttcttgtttggtgagtcaattggaatagtgagagctggaggtttgcttcttggtgttgctggacttttgcttcttgaggtaaacgatctacttaaccatctaaccaagtctgagctagtttctgtttagtgcaacttgatgatatgtttgattcactacaggttccatcagtaacttcagatggtaataatttttccttgtggggaagtggagaatggtggatgcttcttgcagctcagagcatggctattggcactgtcatggttcgatgggtctcaaaatactcagatccaattatggcaaccggttgggtaatgatgctcgatccttctcgcccctttcaatccttacttgtccccatttttgttcaatggcttgtcttcgagagttcttcttacaagaactaaactaaactaaacatgtctctcattttatctgcagcatatggttatcggtggccttcctcttttggcgatttctgttataaatcatgacccggtttttaatggtagtcttcaagatctatccacaaatgatgttatagcacttctctacacatccatttttggcagcgcagttagctacggtgtttacttctatagcgctactaaaggtccactctttcactgccttctcgagagactatcgctacttctggtttcagatctctgatacttgtatgatgtctatttttgcaggaagcctaactaaactcagctcactcaccttcttgacaccaatgtttgcatcaatctttgggtaagaccataatcagcaacccataaatccatgattttaatagagtttctttagtcatttggttcatagttctgatattattggtttgaccaggtatctgtacctcaatgagactttctcctcattgcaactggtcggagcagcagtgactttggtcgctatatacttggtgaactttcccgaaggcaacgactgagacactctttgagttcttacttacactctttgagttcttacgtcatttttaaacttgttatgaaggtggaaatgtatcatagtttcattatcttcaatcttattgtatataataaaatgaagcatcatagttcagtgttaatcaaaagccaagtttcgtaattacataaacaaatgttgcacaacacgatacagcagaagcagattctcttacttccgccacaacatttacaatcagagatcaaccagtatggtaatacaggtgtgagcagttttggattaagtagtcttctcatcttctggtttagcttccatgtccgacatacaagccacatcagcaactagtctctcaacaggcaccttgctcacatcccatcgcatgcctatatctgaaactaagcgactggtgcagtacatgccatagccagccacagccaaaccaccaaaacctgctacaaacctgagtggtgaagaaagaagaacactggcagctgcaacaattgaagcagcttgaccactccttcccacgtcggtgtttgccactagcaaacccgttttgcaatagatggcaaaatcttcacagttgttcttgaagacattgtacacaccaaaaccattttgcaagagaaaatttgctcgatagatgacttcttctggaggatctgaagatgctatagtgcatacgccgcctcgaggtttggcaagaaagatagcaggggaaacactgtactcaaagacatagagatcacctccggcaaggaaacattcaaggcaggaagatataacaccgccaagattggatcgatctccacaatcaggacatgggttgtctccatgattatgagatgaactaacaatgatgttgtccaagaaagtcccagttccagtctcttgaccatcaccacgagtaaaatggttgacttgtccattacctacatagattcctgcaaatcacacacacatacaagttaacgtgatagattacataacaaagaaaagataaattcaaggattacaatctagcctagtaacagagaatagctgttaaaatcacattttcctaaaccttctactaatttggatccaaacgaaagaatcacattatttcccccaaatttgaaattttcgcaaaatctaaccagttgcacaaataatcaaattgagacagctaaaattggaaattgaatcatctcgtatcatcatgaatgtacaatgtatgtatctctctgtaaaaagggaattacaaagagagagataagagtgagatcgaaccgtgatgagcgtaaatgtaggcttgacgccatgaatagatgtgatcgcctggtttcacatcgtctctggagattttattggaaaggaatcccatcttctccgccgacgaacggagaaccagaaattagggattgcgtcgtcagagagagaaagatcttattttttgcttagtgtgtagggttttccatcttccttggataacatcataacttttttaaagttccataaagacattgatcttttgacttttgagtttttgaccccagaaaaaatatagtttattagaaatttaaattctaattgcttaaatcttaaacgacaccgttacaccattgggcctcaaatgacattgactcttcatttaataaaaagcccaaattaaaattcagactcgtcagtcgtcaccattatttcatcccttaaaccaaaaatcttagtttcagacggaaagagagagtatagccatg

SEQ ID NO: 36786 - DNA, 3003 bp, Unknown
  misc_feature (1)..( 3003): 2750-1469P.txt file - cDNA_ID_3100258; gDNA_ID_2936585; Annot_ID_143853
acaaaaaccccacatttcttcttgggtttatgctagaggagtgagtttgatcttgctttttaagaatctctagttttgtaaccttgatgagttgttaaatggtttgaatcaggtgaagataaatactatatcttttcaaagggtatttacaaggttggtcgaaaaggtaatgttattacactttcatcatcgtcttgctcgtgttctgtgccttcatgggttgttctttctctgtaggatgtgatataattatcaataaggataagggggtatctaggatccacgctgagttaacttttgatgcaacaactgtttcaacctctcggaggaacaagtcttcttcagatacatcatcctttgttatccgtgtcaaagattgttcaaagtatgggacttttgtcaaaactgacctggggacaaaagataaagttcatgagctatctaataaggagaaaattctccaagatggagatgttatcgcgtttggtacaggttctgcaatttacaggtattccaggtgtgatgttttttttggttgtaacttcgtgtagtatggcttatattttttaatcattgtaggttgtccttaattccgcttgttttttacttgtgcccttcctctgagacctttaaggtggatcagcctgtacaagatgcagtttcatcaattggttagtgaaaaacattattccctgcctcatggagtagttttcatattaccagcattgcctgaaactacgtagatattcaggtgctcgtatttctcctacattgagtgaggagtgcactcatgtgcttcttgagccacgtatgcaagtgaatgaagctctgatcaatgcaattttagccaaaaaaacaatcattttgacaaactgggttatggtatgtctgagaattccattgtcatcacttgtctgttaattggtttttaacttcaatggtttgtctagcttctcgcagagaaaagtatctgcagcgaaattcctggatacagccagtgagcattacttactgttttccggttattgaattaaaatatattagttactgacattcaagtaatcaatgttaatttaggtacagaccatcagtgatggttgaagaagctttggtggatgtactagaattaaacgtccgtgaaaaatgtctagaaggatttacctttgtcttggaaccaacagacacggtataatctcttatttgtctcaagaagaatcagattcaactgatggttccaagtgatttttgttataggtctcagtagatcttagtcttactaaattattgataaactatgcatttacctatccgtgccattttctttatgcagtatagatttggttgcagcttcccatctttacttgaagtatgtggtgcagagaccgttaccatagaagacattagctccatgagtcaggtttgtgcttttatattgttttgctcatttgctctttctgtaggtagtcctaatcgtaatcaactctgcaggattctcagtttggagagattaatcgcatgatatgtgtcatcccaaaaagtgcaggagacaaatttggccgtttcaagcatctcagtttgttatctagagtgaacgagatggatttagtatgcgccgtcttttccggaaatctaccttcgacttcactgataccaccatccggtgagtaaccaaagccaaatatatttgcttttctcgggactatgacactgatcttgaaacatttcctgtttgtagttgtaatttcatcctcgtgctctacagatgagacagtggtagcggattctgaagccgaagaggaagaaacaacatcgtctgttcatatgattgatgctactgaaaaggcagaaacgccagagaagcctgctgctattgtaatagaggatagccctgttactatattggaagaaacttcgaatttgaacgagtttaaaagcgtgaacttattagcggatacagaaagtagaggccacatggatgaaaagaactcaagtgatagtgtgacaatccgaagggatcggaacgatgaggctgaaactgggaaatcggagattatatacactcaagatcttattgttagggacttgcgatcgactagaaaagttcaatcgacaggaggggaaggagttgtggacttcaagcgattcagaaaggtaaaacagaacctttggattctggacaaatgttgtgtttgcgagatgatgattttgcttgttttgttagggaaatgttacatgcggaaacagcttcagtagcctaataccttttgcgaaggatccatacaagtaattccgggtcttatctcttgcttattggctcataatgttttctcctctatgttttcttgaccgtttacttcggtgatgccagagaatacgatagctgggacgtgacagattttatgaaagaagagaagaaaaggaagcagatggaagccattgcagaggacttgtttaaaactgaaaaggtgtcaaactttattattatccaatatcaaaatataaagatcatcctgcgattctctttacactaatatcgtaatgtgcaggctagaaagcgtggaacggctggttccattcgcgggtttctctctggaagttgaggttttaaggtaaaatggttgctgtgggatcttaactctgtaaatttctcaggcttgtttagtcttcttcgaaagatctaagctttcattttttttctttgcgtgttttattgcaggactcttttagagtgaatcagaagaaaaagtctctggaagaacgcatgattctggatcagtggatcactaggaactaaacaaaatcttgtcttttattttttgttcttcatgagttaaaaaatgatgtatgtatagtgagtgatctttggtatctctgatgaaaacaaaaattgattatctcttttcagaaatttaaaaacagaaaacatgtggccattacttctctgttaactcgaaaagatacaaaatttatcctttctctttgttctaagtacaagcaacaatg

SEQ ID NO: 36787 - DNA, 3003 bp, Unknown
  misc_feature (1)..( 3003): 2750-1469P.txt file - cDNA_ID_3100272; gDNA_ID_2936585; Annot_ID_143846
agtttttgttgcggcggtgggaggtggagaagttagggatgggtttgtccggcgaaggaaggagagcacaggattatctgtgtaccttgccgcagaggatcaggaggttagaggaaagagctaacgatagagtcaaacttgcgtcaaagtcaaaaccttctgtttccttcagctggatttatgggagagaagttgaactataaaacgacacatgttgttgtgttctgtactagactctaaaaggttaatgcgagcttatgggccttagagcatgtccattgcagggaccttacaagttttttaagagaattctaatggaaagaagcaaaaaaaaaaaaaaaaattgtctaattaaccaaggtgcgaaccttgaataaggtatttttgggtgagtaaggttcgctgacgtggcactatatcattggaggaccaataaaacaaaacaagttttttttcttttttctttctctcctctctcttggtttcgtatagagtttctaggctttggtttatgttcaaatttgtgtttgatctgttggtttttaagataaaaatgtgaccattttgctgcttattcacttctcattagcattacaacggattggtgacacaaaataattggttctaggtttatgtttatgctcttttgtttgctcatttagttgatgttatcaaataattggttctcggtacgtgctttcatttaagttcatgacagtgtcttgagctggagatagattattctatgtttttcctttggtgacaatttcattaatagacctctcatcttggactttagtttcctcttgtaagccttttgatttgtattctttttctcttttttttttgcttttatgtcatcatatatgtttacaatttgtaatattttctaataacttttaagttttatcaaataaattattttaaaaatatttttgctttttaaagaaattttcataaggactccaccattggataacaaaaaatttagagactcaacaaaaactctaaactttaaaattaccaaaatatattattaaaaaatgttaaggattttttataaggattcaatcaatgggcatgctcttagtaatgtaatgaagaaagtaattaataataaaacgctaaatgatctgttcgtttgagtgaaaaactgggttataactaccatgcggcccacgggcttgtaaaataagcaaagaaatatctgagtggcatagacgtaattaaaagagtatctgagggatattatagagaataaaaacgttgtatattaaatcgaaagtttcttctgcacattctcttatttcgcagtctcatagcatagatataatcaaaagtttttcgttcattgatcatcttcgattgattgagtttgttggataagaaaagaatggcggtggctatggatcggatagttaatccccgtcatcgtacgtctatcgtccttgtcaagttaggggatccagatctttgtttatagtgtgtgcgttgttttttattcatacacttgtggactttgccctaaacagaattttgaaatcatttttgggtcaaaactcgaaaaaatgtgtagatagttttattgtggtgcttgttgttgggtaaaactacgaagacatatttttattttattttcatccaaaagccaaaaacacataaggatttgttttagtacgtattattattattattttttatttttttctgtatgggagttaattgttgaatacttccaactctctaatgaagtaattgcatttaagtttcttattcttttcttgtattcttatttcataaagaatgtcattttaaaattttaattttgttttataaaaattattgttttttattttcaatgcagttgtaaagatcaaatatcttttttttatctctactatttaaactaattaatgaaaaaaagagagtattatttagtatattaatagcaggtacaaatgaaatttgtttgctttccttaatttgcgtgaaaataatagaatgacattctttgtgaaacatataaatattgaaagttttgtaaaatttgattttcatagccatttccaacttgatggaaaaagtacattactttctaaatttatgtgaaaaatggtaaaatgacactctttgtaaaaacatatagaatttcgaaagttttgttacgtttgattttcacagccatttttcaacttggtgaaaaagacaagacacgagtaagccaactttctcgatcaagccgatttgttttttacaaatgtcattctttttcaataaaaagcattcaagattattaaagtaatattcattgggctacttccagaatatgctcatataaaatccatcagaatccagtccaattacaccaatctgatcaaaaatccgatcaaaaccgagggacatagagaccagaaaacccgattgaacccgtctttcaaagaagcatcgattgaaactttattatataccagaaacgatccgttaagaatatagaaacctaaccataccatcaatgcgatgttttgtttagtgtaaaaccgaataattgtgtatccatatgaattatatatatatatatatatataaaattataacaaatttatgatcgactgtatataaaaatacaatatttaaatggcaatgcaaacggcaaggaattatattatttgcgtagacaattttatataattaaaattgtaagaaatttatgatcgaatgtatataaaaacaatatttcaagggcaatgcaaacggcaagaagttatattatttgcgtagagattttctgtctttgcgataacatgtttaatagatctttaagtctatgacaactcgtcatattgatcatagaagaataaataattacaactggctaggggtaacatgtataacactctatcttttgtcaactcactcactatatacatatatactcttctctcctcctaacgcagaggcacaagggcaataagaaaagagagagatagataaatgacgatgatg

SEQ ID NO: 36788 - DNA, 3000 bp, Unknown
  misc_feature (1)..( 3000): 2750-1469P.txt file - cDNA_ID_3100282; gDNA_ID_2936585; Annot_ID_143839
tttcgtagaaaggtttgtcttttcttttcactctgtttcaaaaatgttgcattgaagcaatttctattgcatttcacttgtcttcctttgtttgaacatattcgttgaaattggagttccctgtatagaaatcaaagctaagttacatagttgcttcaagtggtttacctatctttgtgacttccaaagcaattctccatatatgattcttgttctgctttctataagttggtttgcacattgaatcaattcttagctatatagtagcatataaagattgatcttttgttgaaactgtaaagctactgtccacattttgtgtattgagatctatttcttgtcttcttctttctctaggaatcagtatcatctagatcacccccatttttccttgggtctccccctagccgagcagcaaacccgttagctcaagatgcacgctttggagatgagaaactcaacactgtctcaccctcactctcccctcttctcccatctgcatctcgtgttaaaagtggttgtggtagaatgaagtttggggtgaaaccagcaactgttagagtagaagggtttgattgcttgaacagggaccgcccaaactcaagtatccctgccatggcctagaaagaagaagaaggaacaaagaggattcacaaagtgtacataaaatccagactcaaagactccattttttgaagaagtatatatagttttgcagaagaagaggaaaaggaagattaacgatcgctcaagcttttaccgcagttttctgtgattatgatgaggttcaatgttgtgtatatatatgtatctaccgtaattaagaggtaaggtcgagactttatgtgttaacttcttatttctgaagtctcgttgtaacatattaaaccaatttgggagtgttgttctcttttctgtgtataataaccattcttcttttttggagattctcaagtctttgtaaattgtaatcttgataaattcaaaatgctttgtattattcgaacaagcttccgtctttagagattctaattgtcttgtctctctggaatggacaagagaaacgaaacggaaaataatgcgaatgaaacggagccatcagcgttgactacgtaacttgacacttacgaattacgtacggtctattcaacgaacgaagattccttcaatattgtcgtgaacaagaacactaatctcatggacgcattaaatgaatggaaatagtatttgactagttaatgtcgtttagaacttagtaaattttgaaccaaacccatggatatgaattgcagtagaatcataataccaatcggaaatactagttaattattttttacaactcattaaattttgaaccaaagacatgaatatgaattgatgtatgaaacgctacatttttgtctttttgctacgtggtttgttgttaaatgtacatgtttttttaatagaaaacaaggatttaactcacggtttaccgcgggcaatcggtttatttggtttttatactaaatatttgagtaaatttgatatcctaaacttataaatataaattttttaatcaaacataactaaaaaataatttggattttttttgttgttatttagtgataagaagaatgtgttaaaatgtgattaaattttttttgcttgttatttatttatttttgttgaacggtttagattgaagggaattaattttattgaacggtttagatttaatcgaatcatataaagtttagaagattgttaagaccaaattacccttaatgattttgaataacaaagaacaaaatccaaatttgaaataaaaattaagatcaaattagacaaaattcaatttgtacttcccttataataataagaggatacataacagaatccactaaactcaaatcaaatgtgctacaaaatgggtctcacaatattgtaatgtaatctggtacaaagttaaatttaagtggattacgtaagaaagaatatcaaagctgagttttggttgtctggattaaactataaggtggggaaaataagaattaatctaaaggtgattaaagataaaatttattaagtaaaagatgatttaagattacgttttttacgaaagcgtcggctaacagagagagtcacaaagatccgcccacagggagagaagaagaaaagatcaaaaaccggaaaccataaaaccagaaaccagtcaatagttttggacatagttgaaagcagtattgttaaaacagattcttttccagaaaaccaggagctaagtgtgggccccagttcttccaaatgctcctcaaatgactcaaatcccatctggatgacttacgtggcgattcgaccaaatttcttactcgcgagcgtggaggccacgtgtcttatcacagtctcttcaaacacatttaagacaatttaaccaaaatcctactccatagatactctgaattggtcagatactttaatcaacaaccatattaaatcgttttagaacgaattagattgtataatccagaatttatagactattcactagtaattaaaaaatggtaacttgatatgtcacgtgtatgacacgcgcattggatagagtggggacaaaaacataacttggggaagaaacacaagaagcaaaaccttgaatcagggtgaagaaaaacagcggcggttctgggaaaataaaggaaggattttgtaattaaaagacaaaacaacccttgtctttagagaaaaacagctcttcttatcttgttttctttgtcttctgccttcttcccttggttttataatctctctccgcttcccccaaaaatccaggggcttcttacacgcacacaatcctttaaagctatcgtctttcttatataatcagtgaatcttcattaacacctcccacaaaatctcagaaataactttcacaacagagtcaaagagttccaaatcgtttgtttgtattttgtacgatcaaagttgttggtacttgtaagataatcgaaaccaaagatg

SEQ ID NO: 36789 - DNA, 3000 bp, Unknown
  misc_feature (1)..( 3000): 2750-1469P.txt file - cDNA_ID_3100288; gDNA_ID_2936585; Annot_ID_143835
tcatgttttcgtttcgttttgtggacttaatcttctctgtgttcgttgttatctggagatctggcaaaatctcgaatgattttgatagattctaggtttctaggtgtatctatcggtatagtgttcgttttgtcttgatttgttggtctcgacgatttatctgttgtttcttttgttttgttgggaataatgttgatatagccaagctactgtgatgttgatgaagtttgaaatgaatttttgaaaacaggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggtaaactctttaagtttcaacatctatctatcttattttgctgcttgagaccagtaaaggagctgtcatgatgaatgcttatgtgtgtttttcttctaatgtaggatattgcacttgctgatttagctcctactcatccgattagactgggacttgctcttaacttctctgtcttctactacgagattctcaactcacctgatcgtgcctgcagtctcgcaaaacaggtttgtattttgtcatacgggatgttatgatgcttccagactttgtaacacttattccagcaccaaattgcttaatgatattctctcaattgttttgacaggcttttgatgaggccatttctgagctggatacattaggagaagaatcatacaaagacagtacgttgataatgcaacttctccgtgacaatctgaccctttggaactctgacatcaatgtacacctttgtcttcctccttttgcttttccctataaactcttatatatgcagtctaagcttcttttactcagaaatttctctcaaacgctgattgtgttgctgatttttaggatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtctttggttcctgcttcgttgcttgttagtatttaggaagtgaagaaacaaaactttgaattattgctttccattcaactcgtcataaattatcataatcagtgtattatttacttagttcttattagggtattctgatttttgcttaacgcaacagaatttgtgttaacccatttttaaagaatcttcaatcttgtatcattggtcgggtcagtcggatatatggtccgcttttggtttaagaccggaacaacgaaagccggggatattgagcctttctgatgatgcgcctccgggcggtaatgctattgggacatggattacattctgatcaatagggactaatagtatggatttactttgtacttcagactagggtttttttttttttttttttttttttttttttaaatattattaatcctcatcccaaatgaccttgggccgcaacaaaaacaacatcaaatccagttacaaaattagcaaatcggaaaacatgtcggcaaagaaggaagatcgccgcttgttgatggaagctagcagagagaccggagcattagatccggcgggctcaagccctacagtttcgaggccgcaaccgatgctcgagaaactccgacgaaagagaccggttttcgtcctcgaatcaaccccaccggcgcaccaacccaccacaagactcccagaaagctagtctccccaacaagcacatcgacggcaccggattctgaagaagcaatccgatacactggacggtaacccttccttcccaaaccggtacagatccgaaatcccagagctattgcgtttcaaccggctcgatggatgcaaaattgtgacaaatctaaaggaaggtggctcaaccgaagccttcagatccgtaactcacaaccgccctctaagatcctgaggatctgcagttaaccaccaagcaaacaacactcccaccagatgccctccaacttccgccgtgggcgcagctcaagaccgacggatgagccggaggacccgaagcactcacgacgtccataaacgtgagacaaacgctgcaggttcctcttccgccagaacttgagccacaaccacatcggagggaaatcgccacaccaccgttgacggagagaacgcaaagactcactcctggaccgacgttgaacagctacgtccggagagtgaagagcaactgaacctaaagatctagatctgagaagaagaaatcgccttcaagtgagagagaaaagcgtggaaaccaaagcaacgattgtgccttccacttttcttcaatggttaaatgtttggttgtctccagactaggttttggtctcttccgttttagtagttgttctcgtgtcgcttagagtctctgtaggtggtcaaagagatgataatattctgatttgtagagtattatctatctcattgtggtttaaaaatgcaatg

SEQ ID NO: 36790 - DNA, 3003 bp, Unknown
  misc_feature (1)..( 3003): 2750-1469P.txt file - cDNA_ID_3100304; gDNA_ID_2936585; Annot_ID_143830
agccaaaaaccgcagcttcatcccaaaagatcaaacctgggaagcaaccagatcgaataactacttaaatcaagaaagggctgttaaaagatcacttaaagactgacctctacgagcagcaagcaatgcagcttcattgacaatattggcgagatcagcacctacaaatccgggagttaaagaagcaaccagatcacatatgagaaatgcatcttcttctaaaggaacgtctctcagatgtatggccaagattttccgacggccttcttggtctggttctgcaaccaaaacttttctagagaaccttccaggccgacaaagagccgagtctaacgcttctggtcggttagttgctgcaattacaatgactttcgtgtctgactcgaatccatccatctcagtaagcaactacaaaggaagtatatcagcaatggagtctacatggttaaaagggtactaaatgttgattctttacctggtttaacgtctggtcacgttcatcgttgaaactcctaccgcgttttcctccaaccgcatcaagctcatcaatgaatataatggaaggtgagtttttccttgctgcattgaaaagatctctgattcgcgctgcgcctcttccaacaaacaattcaacaaactcactagcggagacagagaaaaatggaactcccgcttctccagctacagcccgagccaacaaggttttaccggtccctggtggaccgaccaaaagcacacctctcggtaatcttgctcctagttttttgtagtttatacttccttgaagacatgagactatctacaaagaaaaacagaacacatggaggttggacttcaaacttaattctataaacgttgcatttacgtatctttttacctccacgagctcgtctttagcagaatcaacaccctcaacatcatcgaagccaacagtgggatttttagaccgtcgtttcttcgcagggctgttagatgctgagagttgccgataaagaagccacataagaggtgtcaaaggaatccacagagagatgattgttatcaaagtagttctcattgacatcaatgcggattgaggagctgaactataagtaatgcctttctctctcattaaactaagaagaaacttctcatcatgatcgacttttcttgtcacatacttccacacaggaggcaaagctcgaacctttcgcggagtatcgtctttcgtaacagcttctgtcactgtgccgccatcaatttggattgccggatcttctaaagtttcagacttgtgaacatcatcaacaacctcaacattctcatcagtgttgtaatagattcgacgtgagccttcttcgagcaaaacctttgaaacagaaccacctcgaagattcgtaacgaaatctgagtaaggaacaatggatggggacggaacagcagttaacctcaagaacaaataacacagtccaaagattaaagccacaccggtggacaagatcactcttttgagattctttttcaaaaaatatcgaaaatcttccattgatgctctgaaatcaaatctgccaagtctcattctcactaatcgtaatctaggtcgaagcctaagagaaaaccttcttctcttccctttgtttctaccattttcaccaatacgagtctccttatctccgtaatcaccagtcacaagtcgcttaatctcgctattacaagaaaatctattacgagaatcgccatgaactctaataacccctaatctggtttcaccaatttccataaacccaccaagtctcctgcaactaaacgattgagtcctgattctagagacacaaacattaagctcactactcctcgaagacacctttctattaaatttctccggagaataacctccattgaatctaaatcgattgctacaaagaacattgaaagtagccatggattctctatcctggaatccgaatcatgcgttgatcattcttgtgcaaaaatcctaagaaaaccgaccaagcgcaagagtagacgaacgtgtcatacaagtgaagaagattggaattagaaaggctttcgtcttcaagctgatgactctgttaaattgaaaggataagaagagttcgcaaaagctcttttttggttgacagataaaaaacaaaacacagaacaggaaaaactgtatgaataagcattgggcattataaatcgagtcatggcctcatgggccttttagctattgggctatctttcattttgggcttattttaaaaaataggttactgatttttttgaattggtataattaatttgacgcctatatatatatatatacccaattaaattgttttgttcctaaaactttatgaatcataaattcataatcgtcgtgataaagcctctaattacccaaaatcgtgctcaatttagaaaatagaatcttttagttgtcaccaaacttagcaagttggcataaccaccatttaatcataataatactctctcgacggcgtcgtttcgtgctggcttcacttgaattattatttttctggctggactcatattttctccggcaaggaaaaaagaaaaacatcactttcttcaagcggatgaaaaattcaaagattgagtcaccaccaccatagtaatatacgcgtatgagttcccagatgtgatctccatccaacgttgtatttctttcgttttggttatcttcttcggttccatcgaattccaacaattcccatcgaggaatttggttacgaatcttttgatctgactaaacctaggtgagttttaatttctcctggattttttacgatcacgtttctgctgattatgattactggttacagtttttggacgatcgacgttactagatttaggattttactttgagaacctgtttatactttgatggtataaatttcactattgggatatattggtctatgattgtgtcattagggagcttgatcacaaggagactgaaaccaatgctaggaggagtctcttcaggttagtagaatg

SEQ ID NO: 36791 - DNA, 3000 bp, Unknown
  misc_feature (1)..( 3000): 2750-1469P.txt file - cDNA_ID_3100362; gDNA_ID_2936585; Annot_ID_195072
atttctaacttctttctttccttctctaaatcacatcgctgatatgaacaactgaattctcgcctgtcctcgttccttctcctctgctccatcaagatctccaatgttgtcgtgatactcctgtttaagggtttatattattagcaaatgcaagggaagcaaccacaaaagataaaattgggtaacagagagttttcattacaaacttatgtttcacagtccgtatcactaagtctgatggtttcagtgattcaaattgttcaaatgttgtttttatccatatcaagtcgagtcactggttaattggtgtgtatactactttttagacgagggaagagatagaaaacctgaagaatctgcttgacatcggttttactaagcttctgttgcttcagtagcagctccacccgcgctctcattccagaatgcctacatcaagtattgattacaaattagtatgtccgaaaagcgaaagctcaggtaagtatctttttggtgggtgctttaagggtgggacttactcagaacaccaaatatgccccaggataacagcaacaagctgcaatttcagagaaaatgttactcaagattaacaacaactagaaaaagaagataaaatcaagtgtagaggcctgaataagtgtgtaatgtagtatatatacacatattaggcacatttgccatttcccaaacggacatgaaactggataaattaaacttaatcgaacctgaagactgtagagacctgattctagcttccgattatatttctcatcttcatccaactgaaaagtaaaacagtgaaatcagttcataaacagattcaagctcagaatgaaaacatcaaaatatgaaaatgataaaagtgaaattacctcaaggtcatcaagctcaagctggtctaacctttccgcctctgatctaaccctatcagagtatctgccaagtgcaaaacaataatgagagaggaaacacaactttgaggtaactgcattttaccatcgcgttcaccatatagaagccttagctttttaatcaaaatgcttaaaatggtagactactgaagagaaagagaacatttctattacctcaaatataattccatgagccggtcaatcttctcaaattcattctccacgaatttactcaacaatcgatctctcctagaaccccttaatatcccagctgaaagatacagccaacaaacaagaaaaccaagaaattaacatcaagaacatgcaaagaaaacacgtcacttttactgaaacatatgacttgccttcttaccaaataatgacgcaatcagggaaataacccgctcctctagctcctccttataccgctcccttttgattctcttgtttagcggaatctaaacattcaaagaactaaacaaaatcaatagacaagaatgcctcagaatcgcctctttcacatgactttgatctactacgcaagcatttactaacaaaagatacagacttcaatacccaataagtcactagacagttcataaagatggtaaaaagaaacgggattgaaaaacttgccttacccatgaaagcagcaaatgctgttttcagtcccataacatccacaaacctctcacatgctggtggataattggtcatggcgaagtctagagctcgaatagcagacccgtaagcatatttcttctgtttcatgataataatcatcagctctacaccttccgcattcacaaacctctccttgttctccaatggcatcaagaggcaacacaaacaatcaaacagattctctaacatctcttcctcatcaggagttttaggatcctttgacttatacatcgccacaccttcaagcacagcgtctacaccattcatctgacctagccgtttctgattcgccgtactgttttgcagcagaattgcaagaatctcagacgcgtactgcttgattccttcgaattccctcaccttaatcttcgtcagaagccaccgcaatagcttcgtcctttcacacaccaattgagcaacagccggctttacttccaccaaattctcaatcaccgtcaaagttgcgtatatagccgtagcttcgtcagggtcagcctcagacaaacgattcatattctgaaccaagagctcgagcacattgttttcaaccaaggcgtcgactaacacacgcgcaggctcatcgttatcctctaaggcatcttcgtcagtcagatcctgaagaagctgaacaacatcgttggcgatatcggagttttcatgagagaggagattgacaatcgaaggaaccgtattggaagcaacaaggtccgggtaaagttccggagctccagcgagcaccttgagcttctgaagatcgtcgtgtaggtcaacctctgagtcagcgaacttttctggattctccacatacttgagacgagcagctatgttgtctctaagacgccgctcgaaggagaggacaagcttttttagggttttaagatcaagcgcttctactccattatgcgaagacttctcaagtgcttcaaggagagaaagatctacaccatctgagcctcgatacgccgtcggctgcgagccatgtccggcgtcgattgctttccgttttctggtctgatttgagacttccatggctatactctctctttccgtctgaaactaagatttttggtttaagggatgaaataatggtgacgactgacgagtctgaattttaatttgggctttttattaaatgaagagtcaatgtcatttgaggcccaatggtgtaacggtgtcgtttaagatttaagcaattagaatttaaatttctaataaactatattttttctggggtcaaaaactcaaaagtcaaaagatcaatgtctttatggaactttaaaaaagttatgatgttatccaaggaagatggaaaaccctacacactaagcaaaaaataagatctttctctctctgacgacgcaatccctaatttctggttctccgttcgtcggcggagaagatg

SEQ ID NO: 36792 - DNA, 3000 bp, Unknown; identical to SEQ ID NO: 36791
  misc_feature (1)..( 3000): 2750-1469P.txt file - cDNA_ID_3100362; gDNA_ID_2936585; Annot_ID_143854

SEQ ID NO: 36793 - DNA, 3003 bp, Unknown; identical to SEQ ID NO: 36785
  misc_feature (1)..( 3003): 2750-1469P.txt file - cDNA_ID_3100400; gDNA_ID_2936585; Annot_ID_195073

SEQ ID NO: 36794 - DNA, 3003 bp, Unknown; identical to SEQ ID NO: 36786
  misc_feature (1)..( 3003): 2750-1469P.txt file - cDNA_ID_3100405; gDNA_ID_2936585; Annot_ID_195071

SEQ ID NO: 36795 - DNA, 3003 bp, Unknown
  misc_feature (1)..( 3003): 2750-1469P.txt file - cDNA_ID_3100410; gDNA_ID_2936585; Annot_ID_195070
gctttgtttacctaatcctaggtcctagcgaaattgactgattgtttccgaggatgaaacgatgtgtggttcacggattaagtattaagtaagacatttgtgggtatatgtgtgtgtagtgtgactgtgtaagtgaggtctttttttgtttttttacagcatgtaaaatgtgtggttcagattgaagattcatagagaagctagaatttgtggaaactagtaggaacaaattaactcctctaaaagaattagaaaatctacgatctaaaacctcacctccttcaaaggtttgatcaaaactatattaatcagaaataccaagaaatttttaaaacaacacattcaacttaagctttcacaaatacaatgattcattttacttaaatacaccgtcgacgtattggactgaactcaaatcaaagtctttatttaatagataaacatacacttacataatgtaagttacattacacgacacagaatactcattttataaatatcataagagtacacatgatcattatcgatacactagcatgagcttaattattcaatatccaacgggatacgttcactgagtcgacggtgggaggaatggtaacggaggaaacctaaatccagggaaactgggaatagttaccggaggtaatggcgggaacggtaatggaagaccgggaatagttactggaggtaatggcgggaacggtaatggaagaccgggaatacctcctcctgatggagggaatggaaacggaagtctaaaaccaggcgaaccgggaataccgggaatacttcctcctccaggtgatgacgggaatggaaacggaagcctaaagccaggggaaccaggaataccgggaagaccaggaataccaggaataccgggaataccgggattacctccaggtgatgacgggaatggaaacggaagcctaaagccaggagaaccgggaataccgggattacctccaggtgatgacgggaatggaaacggaagtctaaagccaggagaaccgggaataggtgatgttggaggtgatgactgcaaactggagaacggatcagatacaaaggctaggttgttggcttcgttggtggtggtggttacgactctatcaaccggcttcgcatcggcatcgttgagagggcgagctacagttgtttctggtgtgaggtggaagatcaagaatagtattagggctaaagtggtcgctaaagatgccattgtgtggaaatgtttttgtctgttagtagcaggtgtttagtgcttgtttatataggcgcctatatttaggttggctccatctttatttttgttataatttaattataaggaaattttcaaaaaatatatacacattataagaagttttaatctctctatggacatgacaaccaattttgggttaatgttgactattttttacaaatttataatacattctataatatatatcaaagaataagctagtttaggaattaaacaagccaaattcgttttgctagcctgtgttcatttctggataaactttgtaaggctcaagaaagaccttgacagcaaggttttgttctgtccttagtcaaactattgggcctaagatatgcctgttttcttcgtttggtttcaatcctaatgttttaaaattttgtcatcttttcatcatcaactccaaggttttgtaatttcttgtggagaggaagcaagaggatgtgcttggttgtggaaatatagggcccttaaaatatattcatcgtattcactcacataacaaaaattccacaagtaagcacatcatcttgcttcctccacaagaaattacaatgagaggagatcaataatgctctcaacgttcaattcgttgttgacttggaataattaattctatttgttaataaaagactgatgatttggtttttagatatttcagagacctcaaatcataattaatctgaagaaacgcgagaacgagctaatatttattctacctaccatgattatccacaaatttgaacacaaccaaaggcaggctacgtactacacaacaactagatcagctagatcatcataatacaccgctagagctttactaggtttgaaaagattaagatcgactgaaattgccactttttcccttgttgcggctgcaagatctgccaactcggctccaagatctgaatcacacaaagagaatgcagcgaagaagatgagaaagaatagcaatcaatgcttttgttcaagtgcttaactattgattttgttcttacctagtgcctccctcatgtatcgagccttttgtcctagctggaatatatatggatatctttttctctacatacagatgccaaaattccatgctatgtacttccttgatccatatcgatggctctgcaatcaaaagaagaaaccacaaatcctaattacaaagacatgattagtgaccgagatttgtagatctggtaccatttttggtaggtgatgatgatgaagagaaaccgcgagattggcgatttccaatcgatctccctccacggtaacactgtacaattcttctatcaacagatcactcgtgaaaaaaacgagaatcagatattcggcgtacgtaccttggcaacgaagggtctcagattctgcatgatccaagaattaattaggtggtttgttagtgggggtgacttggttgttattatttccttaaaaagttttatacaaggacagatgggcctcatattttatttatgggccttttaacttgggctagacatccttgtacttcctttcataacaaattcccaaattatgtctatctttctcataacaaagaccataggggcctaatggtttattagtgggcctaagaatctccggttgatcttaaaaaacccgatataagttcggttttactaaaccggtctccttaaaacacagtaaacaaacaccaaagtctctgaagaaagaaatcaaaacccctttcgaacaaggatttcttggagcgaagcaaaatg

SEQ ID NO: 36796 - DNA, 3000 bp, Unknown
  misc_feature (1)..( 3000): 2750-1469P.txt file - cDNA_ID_3100415; gDNA_ID_2936585; Annot_ID_195069
agctatcgtattctctggcatcaccgaagtaaacggtcaagaaaacatagaggagaaaacattatgagccaataagcaagagataagacccggaattacttgtatggatccttcgcaaaaggtattaggctactgaagctgtttccgcatgtaacatttccctaacaaaacaagcaaaatcatcatctcgcaaacacaacatttgtccagaatccaaaggttctgttttacctttctgaatcgcttgaagtccacaactccttcccctcctgtcgattgaacttttctagtcgatcgcaagtccctaacaataagatcttgagtgtatataatctccgatttcccagtttcagcctcatcgttccgatcccttcggattgtcacactatcacttgagttcttttcatccatgtggcctctactttctgtatccgctaataagttcacgcttttaaactcgttcaaattcgaagtttcttccaatatagtaacagggctatcctctattacaatagcagcaggcttctctggcgtttctgccttttcagtagcatcaatcatatgaacagacgatgttgtttcttcctcttcggcttcagaatccgctaccactgtctcatctgtagagcacgaggatgaaattacaactacaaacaggaaatgtttcaagatcagtgtcatagtcccgagaaaagcaaatatatttggctttggttactcaccggatggtggtatcagtgaagtcgaaggtagatttccggaaaagacggcgcatactaaatccatctcgttcactctagataacaaactgagatgcttgaaacggccaaatttgtctcctgcactttttgggatgacacatatcatgcgattaatctctccaaactgagaatcctgcagagttgattacgattaggactacctacagaaagagcaaatgagcaaaacaatataaaagcacaaacctgactcatggagctaatgtcttctatggtaacggtctctgcaccacatacttcaagtaaagatgggaagctgcaaccaaatctatactgcataaagaaaatggcacggataggtaaatgcatagtttatcaataatttagtaagactaagatctactgagacctataacaaaaatcacttggaaccatcagttgaatctgattcttcttgagacaaataagagattataccgtgtctgttggttccaagacaaaggtaaatccttctagacatttttcacggacgtttaattctagtacatccaccaaagcttcttcaaccatcactgatggtctgtacctaaattaacattgattacttgaatgtcagtaactaatatattttaattcaataaccggaaaacagtaagtaatgctcactggctgtatccaggaatttcgctgcagatacttttctctgcgagaagctagacaaaccattgaagttaaaaaccaattaacagacaagtgatgacaatggaattctcagacataccataacccagtttgtcaaaatgattgtttttttggctaaaattgcattgatcagagcttcattcacttgcatacgtggctcaagaagcacatgagtgcactcctcactcaatgtaggagaaatacgagcacctgaatatctacgtagtttcaggcaatgctggtaatatgaaaactactccatgaggcagggaataatgtttttcactaaccaattgatgaaactgcatcttgtacaggctgatccaccttaaaggtctcagaggaagggcacaagtaaaaaacaagcggaattaaggacaacctacaatgattaaaaaatataagccatactacacgaagttacaaccaaaaaaaacatcacacctggaatacctgtaaattgcagaacctgtaccaaacgcgataacatctccatcttggagaattttctccttattagatagctcatgaactttatcttttgtccccaggtcagttttgacaaaagtcccatactttgaacaatctttgacacggataacaaaggatgatgtatctgaagaagacttgttcctccgagaggttgaaacagttgttgcatcaaaagttaactcagcgtggatcctagatacccccttatccttattgataattatatcacatcctacagagaaagaacaacccatgaaggcacagaacacgagcaagacgatgatgaaagtgtaataacattaccttttcgaccaaccttgtaaataccctttgaaaagatatagtatttatcttcacctgattcaaaccatttaacaactcatcaaggttacaaaactagagattcttaaaaagcaagatcaaactcactcctctagcataaacccaagaagaaatgtggggtttttgtaacacattgatcagaccgaagttgttaataagtagagaacaactaaaaactaaagggtcatcacgaatttcactgattcctagagcataacatagttgagattgagaactgcaattactggaggaaaaaattatcgtaatgatgaaaaaaatgaacagtaaacaataaagctcgttcacttgcaagacaatcgaattctaatggagaaaaacctgaaagaggatcaacgggaaagagaccccaaaccattttgcttcgctccaagaaatccttgttcgaaaggggttttgatttctttcttcagagactttggtgtttgtttactgtgttttaaggagaccggtttagtaaaaccgaacttatatcgggttttttaagatcaaccggagattcttaggcccactaataaaccattaggcccctatggtctttgttatgagaaagatagacataatttgggaatttgttatgaaaggaagtacaaggatgtctagcccaagttaaaaggcccataaataaaatatgaggcccatctgtccttgtataaaactttttaaggaaataataacaaccaagtcacccccactaacaaaccacctaattaattcttggatcatg

SEQ ID NO: 36797 - DNA, 3000 bp, Unknown
  misc_feature (1)..( 3000): 2750-1469P.txt file - cDNA_ID_3100424; gDNA_ID_2936585; Annot_ID_195066
ttttaaaacattaggattgaaaccaaacgaagaaaacaggcatatcttaggcccaatagtttgactaaggacagaacaaaaccttgctgtcaaggtctttcttgagccttacaaagtttatccagaaatgaacacaggctagcaaaacgaatttggcttgtttaattcctaaactagcttattctttgatatatattatagaatgtattataaatttgtaaaaaatagtcaacattaacccaaaattggttgtcatgtccatagagagattaaaacttcttataatgtgtatatattttttgaaaatttccttataattaaattataacaaaaataaagatggagccaacctaaatataggcgcctatataaacaagcactaaacacctgctactaacagacaaaaacatttccacacaatggcatctttagcgaccactttagccctaatactattcttgatcttccacctcacaccagaaacaactgtagctcgccctctcaacgatgccgatgcgaagccggttgatagagtcgtaaccaccaccaccaacgaagccaacaacctagcctttgtatctgatccgttctccagtttgcagtcatcacctccaacatcacctattcccggttctcctggctttagacttccgtttccattcccgtcatcacctggaggtaatcccggtattcccggttctcctggctttaggcttccgtttccattcccgtcatcacctggaggtaatcccggtattcccggtattcctggtattcctggtcttcccggtattcctggttcccctggctttaggcttccgtttccattcccgtcatcacctggaggaggaagtattcccggtattcccggttcgcctggttttagacttccgtttccattccctccatcaggaggaggtattcccggtcttccattaccgttcccgccattacctccagtaactattcccggtcttccattaccgttcccgccattacctccggtaactattcccagtttccctggatttaggtttcctccgttaccattcctcccaccgtcgactcagtgaacgtatcccgttggatattgaataattaagctcatgctagtgtatcgataatgatcatgtgtactcttatgatatttataaaatgagtattctgtgtcgtgtaatgtaacttacattatgtaagtgtatgtttatctattaaataaagactttgatttgagttcagtccaatacgtcgacggtgtatttaagtaaaatgaatcattgtatttgtgaaagcttaagttgaatgtgttgttttaaaaatttcttggtatttctgattaatatagttttgatcaaacctttgaaggaggtgaggttttagatcgtagattttctaattcttttagaggagttaatttgttcctactagtttccacaaattctagcttctctatgaatcttcaatctgaaccacacattttacatgctgtaaaaaaacaaaaaaagacctcacttacacagtcacactacacacacatatacccacaaatgtcttacttaatacttaatccgtgaaccacacatcgtttcatcctcggaaacaatcagtcaatttcgctaggacctaggattaggtaaacaaagctttgattttctggattttatttttgttttacgtaaattgatttttcatcatctaattaatgtttgttagataattcacaaatataatcttgtgaaaaataaattttatataaattaatttatagtagttgtgagagtaaccaaatgaaatgaaatggaaataagtgttaaaataattattaaaaatatatgagacaataagtcaacaaaaagtaagtaaggtaaaaaaaaaaaagtaagtaaggtaagataattaaaaaatatatatatatatattttttttttaacaggtatgaaatcccaaatcagtattttaggaatacaaggatataaaacaatggaatatataaaatgtgaaatgtcaaaaggatatgtatatatgtaaaagtacagccggtttcgaagtcaaaattggtattgaaaaaatgtaagataaaataattagtaaaaattagatatattcttgtttcttattttgtgtgtatatataatcagaattttaggaatataaggatataaaacaataaatatgaaatgtgaatgttaaaaaggaatatgtaaatatgtaatcataaagctggttctgatttttatatataattagtcaaatatatgagctgtatgcatgcctattgtatataaattagtcaaagtttcaagtatagattattttcctttttcaaccaatttttatgtcatatttgaaattgtacatgcatttgtagttttaaaatcagtctacttatatagctatatattcgaattcttcacattcgatgttacacacaaatttgcatcaattaattttgtttgtgtatatagggaaggagcccagtttgcttttaacgggccgtaaagtggtttacaatataaaaacaacacgggccgtaaagcaaacccgaaagagattattacatgaactgggtttatggatctcggttttccatcttaaccgattcaaattgaacagataccggttattaaaataaaccggagactttaggttcaatctcggtttcggctaatctgaagcaattgatctgtggaaaaagcaaagcaaaggtcgaaaacaaattccattcttgaagctgtgaacaagtaagctctttcacttcatcatcttcttcttcttcctcaaagtttaattgggtatccacttaggtgtgttgtaatgtcgctgaagttgggattgttatctccaagtagttagcttctctgggtctgtttcgatgcaatggtgggagattccttcataacttggtgtagaattataggattccctctatagttctgtttgaagttcccatttctggagattgacttgttcacggttctatggggacaatatgagacaatg

SEQ ID NO: 36798 - DNA, 3003 bp, Unknown; identical to SEQ ID NO: 36787
  misc_feature (1)..( 3003): 2750-1469P.txt file - cDNA_ID_3100435; gDNA_ID_2936585; Annot_ID_195062

SEQ ID NO: 36799 - DNA, 3003 bp, Unknown
  misc_feature (1)..( 3003): 2750-1469P.txt file - cDNA_ID_3100440; gDNA_ID_2936585; Annot_ID_195060
tgaatctaggatagcactgtgatgcagcaggtaaatttttgtagagaactcaatattatactacgaatagcttttctaatgagtccatgaaactattctgacccacaacagcgatctcttactgattctttacttttcacacactaccaagtacctttcttacttagattgttggcttttccatcattgtgtctgcattgaaatataaagatataaaaggaaaattatttgattatggtgtattttatgcctctaagcagcacaggatgagagaggcacagctaggcggtcacactctgaggtcccatggaatgactgttgcaaggactcacatgcatgattggatcattctcgtgttacttgttattctcgagtgtgtactccttataatccacccattttatcgctttgttggtaaagatatgatgactgatctaagttacccgttaaagagtaacaccgtaccaatttggtctgtcccggtaagcttccattaagacaacttctaagttctaacattggccttagacgtttttcacaatataaattacatttcttttctttggaatgacaggtatatgcgatgctgttacctttggtaatcttcatctttatctacttccgtcgaagagatgtttatgatcttcatcacgcggtgctaggttagaaacttagaatttctgaaggagagtaccgtttgcttcaaaatgtcttctttcgcatatataattaacagtaaagttggcctttcttgatgtgcaggtctcttatactctgttctggtgacagcagtacttaccgatgcaataaagaatgcagttggtcgaccacgtcctgacttcttctggcgttgttttccagatggcaaagctgtacatgtttcaatgagtttttacttatctcgttttaaatcttgttctgcctcttgaatctcgattttgcttatcagctttatgatagccttggagatgttatatgccatggtgataaaagcgtcataagggaaggtcacaaaagctttccaagtggacacacgtcatgtaagaccaagttactggtttataattcagaactagaaagaagcaaaagagtaaaaactgtggggttgaattgtttttgcagggtctttttcgggtctcggatttctttcgctttacttatcgggaaagattcaagcatttgacggtaaaggccacgttgcaaagctatgcatagtcatactccctttgctatttgcagctcttgtcggcatttcccgtgttgatgactattggcatcattggcaagacgtctttgcaggaggcttgctaggtttgttttcactctctagtcacaaaggtcaaaactttttccctttaaacatcattcaaaacttataccattgtctgaaaccgcaggtcttgcgatctctacaatctgttatcttcaatttttcccgccaccatatcacaccgaaggtgcaaacgaactgtggattcattttatggtttgctgaaaagaagtattatttttattgtgaattgatcgaaaaaggtttgatatatttttaggttggggaccatatgcttacttccaagtgttggaggctgcgagagtgcaaggagcagcgaatggagcagtgcagcagccgccgccccaagttaacaacggtgaagaagaagacggtgggtttatgggtttacatttggtggataatccgactatgaggagagaagaggatgtagaaactggtagaggctgagatgaagaaactctgaagctggtttggttacttgttaggacactttctcttgttcttttgattctttgttggacaactttagtagatttctctaagataactaatagagtcgtttggttttggttttggtttaaatggatgaccggttttatggttccggtattggtggttaaagtttatgtttttcaaaaaagttcactggataaatgtagctttattttcaatattttaaggattgaaatcggatttgaacttaatcgaaactcgtagtcaacttaaacacaagaaaaaatgatatctaaactatctttgtgctttgttacaaaacaaaaactacatcttttacaactataatcaatgtgtatattcgtatccaaatagtatgatatttttgtgtgcgttgtttattcatacacttgtggactttaccctacacagaattttgagatcatttttggtttgaaacttgaaaaaatgtgtagatagtttactagttagtactactgttgttgttgggtcacaatcaaaacacgaagaaatttataatatatatatataaaaaatcaaggatgctttttaaaaatattcttttgtatttgtttctgtatgggtgttgaatacttccaactctctaattaagtattgcatttatgtttcgtgttcttttctaatattgcaagttttgtaacgtttgattttctagctattacatattcaacttggtagataatagacacgacacgagtaagccaactttcttgatcaagccgatttgttttttacaaacggcatgcgttaccaaactttattatgtaccaaaaacgatccgttaagaatataaaaacctaaacataccatccttgtgatgttttgtttattgtaaaaccaaacaaatgtgttttcatgtgaattatgtacatttaaaattataacaaaatttatgatcttttgtatgtataacatgaaatatttgaacgccaatgcaaacggaaagaaattatattatttgcgttgagatttatgtctttgcgattacgtttaatagatctttaagactaactaacccaaattaatataagtaataaggactcgtcatatatatttatcatataagaataataataaattataagagctggctagggggtgacatgtttaacactccatcttttgtcaactcactatatactcctctctcctcctaacacagaggcacaagggcaagaagaaaagagagagatagagatatataaatgaagatg

SEQ ID NO: 36800 - DNA, 3003 bp, Unknown; identical to SEQ ID NO: 36799
  misc_feature (1)..( 3003): 2750-1469P.txt file - cDNA_ID_3100440; gDNA_ID_2936585; Annot_ID_143845

SEQ ID NO: 36801 - DNA, 3003 bp, Unknown
  misc_feature (1)..( 3003): 2750-1469P.txt file - cDNA_ID_3100446; gDNA_ID_2936585; Annot_ID_195059
gatggattggatgtttggctctcttagggatcctctcttagaagaagatgacaacaaagacagcttcaagaaagcagagtgagaatgcccacttgggttttgttcttctgttttgtcttgtgttgttgttgttcaaagtttcagcctttcttgttctttttcttcttcttcttattcatgtgtctctctcaacctttccaattatattgttacaaacatttgctgtctagtttaaaacatgtaaatgtttgatgatctttgcaagactccatttttgtttaaggtaaaccttgaatctcatagattgtcgattgttggtatttccattttcaggtacggttctgtagactgtagtcttgctgaccagtccggcttaaccacccaaatttcaaagatctacaacaatcaaaatgctggctggcccaatatatagatgggccagttaatccgtctagctttactctttagacctaccttagacagttagacacctgctaattaatgagtttcctttttcttgttcagcaagttacctgtgttacttgagagttgagttaatggtagtaaacgcaatttaacccttataagtttaatcgtattcaacgaatgacccagagactttaaataaatccatcgtaaccctccacttcaaaattctttttaaaaagtagcaaatcatttaaatattgtaagtttgcttcattcgaaattgtagctacagatctcaaagctcctcctgttggccatatctctctctaacaaacgcatagtaacacttgaccacagtttgacttctcggcggtttcatggcggcgactatggcagattataatgatcagatcgtcaatgagacctctttttacaaccgaatggttctgagtcaccttttgccggtgaatctatgggaacctttaccacatttcctccagacatggctccggaactacctcgccggaaacatactctacttcatctccggcttcctctggtgcttctacatctattaccttaaactcaacgtttacgtccccaaaggttacttttttcaatttcgatgttctgttttgaaacctttcttttgttgattccttcgattgtatcgcctgatagattgtgttatacgttaaccttttttcttactgttactttcagttcttgtcttctacttctcatttaattagttttaaagtttaatatttttggctaatccacattttttaagttgaatcttccatgaaatttgagctcaaaatataccatgaaattgaaatttgtggttcttagttctatttcttgcttggtttcttctatttttgtggttagaatccattcctacgagaaaggcaatgcttttgcaaatatacgtggcaatgaaggctatgccttggtacactcttcttccagctgtctctgagtatatgatcgagcatggttggaccaaatgttactctacacttgaccatttcaactggttcctctgtttcctctacatagctctctatcttgttttagttgagtttatgatttattgggttcacaaagagcttcatgacattaaatttctctataagcatctccatgctacccatcatatgtacaacaagcaaaacacactctctccatttgccggtatgtcaaagctatatgttctcaatctaaattcaagagcttgtatcaatggtgacttctttacttgatgtttttcgggttttcagggctcgcattccatccgctggacgggatacttcaggctataccgcacgtgatagcgctgtttatagtgccgattcatctcataacacatctgagtcttttgtttttggaagggatatggacagcaagcatccatgattgcatacatggtaacatctggcctataatgggtgcaggataccataccatacaccatacaacatacaagcataactatggtcattataccatatggatggactggatgtttggctctcttatggttcctttagcagaaaaagacagtttcaaggagaaagaaaagtgagaatgttcaatgctcacatgtattcttcatatgttgctcttctcgtgactcttattaaaacctttctaatcactttgttggaattaaaaacatgactgcataatttgatgcaaagtttcagacttttattgctaaaaatctctgatgattattaacctcaattatataattgctggatgaagagtttcaaatttggactaaatctgaagggtttaataggtcagttgcggtgtcagttttaccacagaccacagtaatctttgaatcttccaaacttgtaaaataaataattatactcatatggtaggtgaggttgctcaagatatgatgacatgtaagaggcaaagtttcctcttttgtcggttaaggttaagaatttgaatagcaagaacaaatcaaagtttgaaaacataagaatttacgaaaattaaagacctaaaatttattattatctgaaacgtgtagacgcatactctctctttcatccgccatggaagtataagacaccttttttcgcaaccccacacttttttctttttggctaagcatcaaacaattcaaaaggccgagtcgattctaattcagatataaaagaattctcctttttgcttcttttttttcacacgaagcaaatcgactagagtctggtaaattttcttctgtaattcatttataaaaaaatcttcttttgcatatccatgggggaataattataaaggtcgttactttccacatgggttttttttttggtagatatagcgaaacatttatattgcccactcccacttgtttgtgttgattagattgtccctaggagtcactgttatcgctctttcaattactgtaatgttgaatttgggtttcatctactaactaagatgaagtttcttgtctctttctgtctccctctttcttaattcctctctacttttcggttaattgctcctcttcagctaactttggggctttaaagtgataggatg

SEQ ID NO: 36802 - DNA, 3000 bp, Unknown
  misc_feature (1)..( 3000): 2750-1469P.txt file - cDNA_ID_3100455; gDNA_ID_2936585; Annot_ID_195056
ctgcacccattactggccagatgttgccatggatgcagtcatggatgttcgccgtccatatcgcttccatgaacaaaagacctatatgagttgtgaaatgaattggcactataaacagcgctatcacatgcggtacagcctgaagtatcccgtctactgggtgaaatgcaagccctgtaaacaaaaacgtaaggaagttacaagtaatattagatgtcacatccttggattaaccaagatacactccagggaagtagataaaagaacttctcgtcatttccaatcagtccgagaccagaagagaaacacaaagatctaaactctggttaagtcagaagtctctctgacatatgtgaagtaatgcagctgacatttatataattctagcctttctggttactttatggataaggaatgcaaaatgtgatttggagtacaagcagctgctgacaaagtcttttctggtaagaaactaaatgctaccaatcttttacaagaactaaagaagaacaaactgaaaacacttaccggcaaatggagagagtgtattctgcttgttgtagatatgatgggtggcatggagatacttatagagaggcttaatgtcatgaagctctctgtgcatccaataaataccaaactcaacgaaaacaagatagatggcgatgtaaacaaaatacagaatccagccgaattcgcctatgctagcaaaacatttggtccaaccacgttcaatcatactctcggagacagttggaagaagagtgtaccatggcatagccttcattgccacaaacatttgcaaacgcatagcctttattgtaggaattgcatctgaagcaaaacagaccaaaaaagatttcaaactaagacagagtctcagagaagcagaaaaagaatgtgtctgaaagtagacaatcacttcaacaaacaatttaagtggacttaaatggcaagtagaaaattcaacttcaaagatgtacgacttctcattggttgcacaaaaacttatataagccactaactgttcaatcccttagatggagaatatgcacaaataatcaataaatgcaaacatgaactatccacatcaaatccaaattactgtacagtacacgaagaaaccctcttcctttaaattgaaaaatcgataacatagaaagcgattaagcaatagtgaatacaaaagtgaaagtcgagacctttgggaaggtaaacgttgattttaaggtaatagatgtagaagcaccagaggaaaccggagatgaagtatagtagggttccggcgaggtaatttcggagccatgtctggagaaaatgaggtaagggttcccatagattcgccggcaaaagatgactcagaacgattcggttgtaaaaagaggtttcgtcaacaaactgcatcagataagcattatccgccgccatgtgaatcggagatccaccgagatcggtgccggaaaacgaaagaagattcgccggattgatcttactttacctttattgaacaagtcaacagtagtaatgcatgtggcacacagagagtttgatgattgattgatcgatcttcttctctcactctctcatgttcatggtaaatttttaattcttggcccattgttttggttttatcgaaatagctcccaatattttgttatatttacaaattgaaccttttacttgtatatcaaaataaatccacgtcaccaagtttatgaatgaaaatgaaaggtgggaaatattcaacataatagtaccaaaacacattttgataacagactctttggaatggcctgttactagttttttttttttaatattcgaattaatgaaaattttggttgaactgaaataagttaaacaatagaatacatgaattgtctataacaacaaatctcaaaattttgagatttagtggagagtatgacaaagagaatatcatgtgcctatgagtaagtgtgattcatatgggtaagggtgtgtcataatttttttatagggttgaaatttgtaaaaatctaaaagttaagggggagttgcaaaaagaaagagagaaagaagtaggagttgatttagattccgacgggagacaaaagatgctggttgtttggtccttgtacagttgtacttggtagtatataagatgacgtgcccgcacgtggaatgggacgacagtcacgcgccgtcagaacaaaacaaacggcgttggaccctttttattttaatgggctaataacatttggcccaaaatgtaaaacccaaaccaaatattttaaaatagccaattaagattataaaacttattaagaaatattcaatatttcaattattttatccgtaattcaaacagatttttttaaataaatattaaacaatttgaaaattccaattctgttatttagttactgtttgatgtcggatgtatgacgtttacaacactacaaaaatgaagatttattggtctgaatagatttttcatgtttttaaattatagtttatcatttcttacattagatatatttattgataaaagagtgaatttggaattatcgtaataaaatgagaacgtttagaacattttatattggtacattttgtcggtttagtttacactagtacaaaataatttaaagacgtgagagtgagtcatcattagagtccacgtggacagctagcaaacggcccacaaccaacggacggacgttaataccgtcggcaaaacacgtgatttctttgaacatctgtcacttttgcactttcttaagttaaacatcgcaaccctacatttatattttattccaacttttgacccccatacttttgattttacaatcataccttcctctgtttataaaacataaaaaaatccacgattcgggggtaaagagaaaagctttgagtcttccattgacatgggcgcttagcttatgcttgagatattttgtttttacctccgagaaacggatttagattcgtaatcgtgagttttttggtgtaatg

SEQ ID NO: 36803 - DNA, 3000 bp, Unknown; identical to SEQ ID NO: 36802
  misc_feature (1)..( 3000): 2750-1469P.txt file - cDNA_ID_3100455; gDNA_ID_2936585; Annot_ID_143841

SEQ ID NO: 36804 - DNA, 3003 bp, Unknown
  misc_feature (1)..( 3003): 2750-1469P.txt file - cDNA_ID_3100460; gDNA_ID_2936585; Annot_ID_195055
ggtattatgattctactgcaattcatatccatgggtttggttcaaaatttactaagttctaaacgacattaactagtcaaatactatttccattcatttaatgcgtccatgagattagtgttcttgttcacgacaatattgaaggaatcttcgttcgttgaatagaccgtacgtaattcgtaagtgtcaagttacgtagtcaacgctgatggctccgtttcattcgcattattttccgtttcgtttctcttgtccattccagagagacaagacaattagaatctctaaagacggaagcttgttcgaataatacaaagcattttgaatttatcaagattacaatttacaaagacttgagaatctccaaaaaagaagaatggttattatacacagaaaagagaacaacactcccaaattggtttaatatgttacaacgagacttcagaaataagaagttaacacataaagtctcgaccttacctcttaattacggtagatacatatatatacacaacattgaacctcatcataatcacagaaaactgcggtaaaagcttgagcgatcgttaatcttccttttcctcttcttctgcaaaactatatatacttcttcaaaaaatggagtctttgagtctggattttatgtacactttgtgaatcctctttgttccttcttcttctttctaggccatggcagggatacttgagtttgggcggtccctgttcaagcaatcaaacccttctactctaacagttgctggtttcaccccaaacttcattctaccacaaccacttttaacacgagatgcagatgggagaagaggggagagtgagggtgagacagtgttgagtttctcatctccaaagcgtgcatcttgagctaacgggtttgctgctcggctagggggagacccaaggaaaaatgggggtgatctagatgatactgattcctagagaaagaagaagacaagaaatagatctcaatacacaaaatgtggacagtagctttacagtttcaacaaaagatcaatctttatatgctactatatagctaagaattgattcaatgtgcaaaccaacttatagaaagcagaacaagaatcatatatggagaattgctttggaagtcacaaagataggtaaaccacttgaagcaactatgtaacttagctttgatttctatacagggaactccaatttcaacgaatatgttcaaacaaaggaagacaagtgaaatgcaatagaaattgcttcaatgcaacatttttgaaacagagtgaaaagaaaagacaaacctttctacgaaatatgtccaaaagatcttccccggctttagaatcacatacatcatcagctcctgaaagactgtcaatccccaaaacaaagcaaatcaagactttgttaaacaaaaacaacaatatgatgttttgtggacaaagataataaaggaagaaactttatacctaaaatgtaatctaaagggacgaataacgttgtttgcacgacggggcttagggcaaacaacagagtccactggatgagaatagataggaacaaatcctctcgattcttcacgagacaagaatgcattctgctgaaggctacaatgattcatcttttatccacagaagaacacctaatctgtgcatcaagtgaaaaaattaggttttaaaagaaaaaagaagtgaaagatgtgtaatttaagaccccaatggataagaaatcggatttacttggtaaaatctgaacaaatttgccctaaattcgtccagagtcccgttgaatttgagagaattgacaaaaactcgtttggtgatcatatcgaaattcaaagagagagatggatataaaaagggtgtttagaagcagaaatgccaactaatacattgactaaaagaaaccaatttcacagaaatagatatcaaagaatacacaaagtattgacgatactaaaaacagaaatttttcacaagactaaagaagatgaaacaagataaaaaaaattataaaccttagatctgtaacaaactgtttacaaggtagataaattccgccattaacggaccttaaagaaagagggagagagaaacaaacctgattgttcaagacgaaacagcggcgataagggtgagggaaagagaagaagaaacagagcggctatgtaatgaatgcactttataaaaatgtgaagtaaggtcggtttttgtgtactaaaaacgatatcgttttatgagatgataattatcgcctatattctatggagttatttaatgggctagtcccaggaagagtatacattgggcccattggttttaacggcccattttaagtatgattagatctagaccgtccaaaatagggatctcaaaaaaccctaaatatttaaagctttccttcaccagcattgtattgcctccctggaacaccgaagctctggattaacctattttcaccttctaaggttcttcgtcgttcttattggtacgcttcaaaagccttcctttctctgtagctttagttaaaatccaagaaatgggtgtttttgttggaggctaatcgacgtttttgtaattgctctctctctcagtttttttggagaaatatattagctttagtgagaggtgtagttcagggattacaattagtttgatctgcttaattttgtgatcattggactaataaaaaacttcctgtagggtttataagctctcttgctttgatgcacttattaatgtggttaatgtctcttatttggaaaattagatggttgagttgcatatagctcgcataatttagctgaggtaactgagtatttcggttttgtgaacttaattatcagtaaattgggaatttcagtgaatgccagacctaatttctgggaaattgatcaaatttgtggatttagttacaagttgaaataccgtttgctatgtcacaatctaaaaaatgataggctaatttttgtgtcttttatcttgttactgttgtagatctgtgaagatg

SEQ ID NO: 36805 - DNA, 3003 bp, Unknown; identical to SEQ ID NO: 36804
  misc_feature (1)..( 3003): 2750-1469P.txt file - cDNA_ID_3100460; gDNA_ID_2936585; Annot_ID_143840

SEQ ID NO: 36806 - DNA, 3000 bp, Unknown; identical to SEQ ID NO: 36788
  misc_feature (1)..( 3000): 2750-1469P.txt file - cDNA_ID_3100464; gDNA_ID_2936585; Annot_ID_195053

SEQ ID NO: 36807 - DNA, 3000 bp, Unknown
  misc_feature (1)..( 3000): 2750-1469P.txt file - cDNA_ID_3100469; gDNA_ID_2936585; Annot_ID_195051
aagaagaacatagagagtgtgcagggcgcagatgtgtatcctgctgcaaaacagatgcttattcaccaaggtaaagtgcttaaagatgagacaactattgaggaaaacaaagttgctgagaacagttttattgtcattatgatgaacaaggtacgttttggatctggggaataaataagtaattctgttgttttctgtttagctctttgattacccgattctgatttatgctctctggtgctaaacatgtaatagagtaaacctgcttcagctgcagcatctagtgcatctgctggcacatcgcaggtgagttggttctgttgttatgacatcattataaaggctcagatgctgcaacttgggatttttggaaaaacttcttgcctctgcaactaatgaaacgaaagtgtcaaatgcttctatgtattttcttgtttgttgaatgatctaactttggtgttggtttaggccaagtcgatacctccctcaacatcacagccttcaatttcccctcagactccagcttctgtatcagcgtgagttttcgagacaagtactctctgtttgaaaaattcctagaatctatctgaaaaaactgtggctacattctacaactaatttcaatattttgcccccaatttgaaaactgtgcagaccagtggcacctgcaccaacacgtccaccaccacctgcaccgacaccgacacctgcacctgtagctgcaactgaaactgtgactacccctatacctgaacctgtacctgctactatatcatcaagcactcctgcaccagactcagctcctgtggggttagcatctcgtttcagtcttctgcgcagctcagaaattgacctactcttattctgtttcctatttgttttgattaaaatagaagtcaaggtgatgtttacggacaagcagcatcaaatctagccgctggaagtaatttagagagtaccattcagcagattcttgacatgggtggaggaacctgggatcgtgagactgttgtccttgcacttcgtgctgcatttaacaaccctgaaagagctgtggaatatctttatactgtgagttcaattattttctctctattttcgtaccgtcatgcaacttaagaggcagattttggtcactaatcaatcactatgccgagaatagatttcctttttattatgattggctacctactaagtgagagaatacatatttaaacaccgaaattcatgtcttaggggatccctgagcaagctgaagttccaccagttgcccgtcctccagctagtgccggacagcctgcaaatcctccagcacagactcaacaacctgcagcagcacccgcaagtggtcctaatgcaaatccgttagatctcttcccacaggtaatacaccttgagatagaaagcagatttggttcatttaaactcttgattatagatgggtgtgcagctaaaatctgctctttatctctgacagggcttgccaaatgttggaggaaatcctggtgctggaacacttgacttcttgcgcaacagccaacaggtataagctgtttttttcttttctcgtacacttgcttacagagtttatcagacatcaatgtgaaacataaatactatttttgtatatattagttccaagctctgcgagcaatggtgcaagcaaaccctcaagttctgcaggtatgttgttctaattcacagaagaactgaaatcactgtcggttttcattaaatattgtttcaaataattttgtccttgcgttttttcttcagcccatgcttcaggaactgggaaaacagaacccaaacttgatgcggttgattcaagaccaccaagctgacttcttacgcttaatcaatgaacccgttgaaggagggggagaaaggtatgcatatgatgactttacgattatgaattaatgattcatatgtaacatatatatcaacagcaaaacgttgggaggattttgattacctaaatagttattctgtgcttggataatttgttgtgcattgtgtaattcagtggcaacctccttggccaaatggcggcgggaatgccacagccacaggcgattcaagtcacacatgaggaacgtgaagccattgaacgggtctgttccttattttctctcttttttttttttttttacttctagaactttgatctttcctctgaaaaagaaagtttgtatcactctttataatcgatgaactcggtttcacattgataaatacagcttgaagcgatgggatttgagagagcattggtgttggaagtgttctttgcgtgcaacaagaatgaagagttggctgcaaactatcttctagatcacatgcatgaattcgaggaataagcttcttcagattactttacctactctctatctttcgcattggtccatatgttttagctatatatgtgtgggatgccaaatccatgacctcgtcactttgtccatgttcatggctcagttctcagtttaaaatgaagtttgtcatgtgttctttctttgtattgtcgttagtccttacaaaatatcttgttccagttatttttgttgaattggggacaggtattatttctgtatgtgcctaaatagtaaaattattaaattataaataattttttttaaaaaaaaaaggaaaactcgataatcttataatcgtttcttttgtatgtatgcgaatacacaacaaaaagtgactttggtcttcgttggactattttgtggaaaagtcttatatcccagaagcccaaaacttgtaaaatccgaagtctatggcccaagtagagttctccacatctgacaaaacgacatcgttcgatggaactttacgaggcttcttttccctcacatcgtcctccgagccctcacttgacagaactcagaaatttgaaagagaaataaaagagagagaagctcccagagaagaaaagccctaaaagccccactcctctttccagtttcttttgatctctcagcatcgaaaatg

SEQ ID NO: 36808 - DNA, 3000 bp, Unknown; identical to SEQ ID NO: 36807
  misc_feature (1)..( 3000): 2750-1469P.txt file - cDNA_ID_3100469; gDNA_ID_2936585; Annot_ID_143837

SEQ ID NO: 36809 - DNA, 3000 bp, Unknown
  misc_feature (1)..( 3000): 2750-1469P.txt file - cDNA_ID_3100474; gDNA_ID_2936585; Annot_ID_195050
aatttcttcagtcggaatttactctattaaaatgacttgtgtatgtgattaaaatctttttactggtagtggtcgtgaatcaaatatatcatcttaatgcactcggtgtgaatgtaacatggattatttctcttgtaataggttgaggggcttgttcttgatcatggttcgagacaccctgacatgaagcgacgtgcggagaattgtcacatcctgacttgcaatgtgtcattagagtacgagaagaggtacataagacaaatctctggttgattaattgaatagatatgaaagactataacttagaagaattctcccgtgtattagtgattgtgtagcctaactttgtctatatatcagtgaaattaatgcaggattcttctactcgaatgcggagcagagggaagccatggttactgctgagcgacgttccgttgatgaaagagttcagaaaattattgagctgaagaacaaggtgagtttgaaactactacctccaagctatatgctgtattctttcagatatttatttatattattctttcagatatttatttatattttctttttctgatgcaggtttgtgctggtaatgataacagctttgttatcctaaatcaaaagggtattgatcccccgtcattggatcttcttgctagagaaggggtaagctatgattggctttgtatttttttccggcatctgattgtgagaaaagcatgaaaaaatgtagacgaagattgtgaaatcaagtgaactgaaattttaaccaaatagagaaaaggttatccactaagagtattcacctagaatctcttaaatgcctggatcttccaccaagcttgtttttttttgtcttgtgctctgtttcttgtgtctacaagttgttacaagagaattatctttctgttccttatatatgtatatatgtatctccagataatcgcccttagaagggcaaagaggaggaacatggaacgtttggttttggcatgtggtggagaagctgtgaactctgtcgatgacttgacccctgattgtcttggttgggctggacttgtatatgagcacgttcttggagaggagaagtacacatttgttgagcaagtgaagaatcctcattcatgtactatcctcataaaaggtacaaatgcccaaacttctatctcttgccagctaagttttgaagatcaattttgcttatcttcatatgtgtggtcattgattatctatgattatgatttggttttctttatagggcctaatgaccacactattgctcaaattaaggacgctgtccgtgatggtttaagatcagttaagaataccctagaagatgagtgtgtcgtattagtaagtaccttcttctccacaaagatcaaatccattgctatatcagtgtgattgttttggttttgggcgcatgtggtttattgacatctgtttctttctgtagggagctggagcttttgaagttgcagcaagacaacacttaatcaatgaagtcaagaaaaccgttcaaggggtgagtagaaagcaatattcctttgctccaataccaattcttgtttttttccggttgctaatgtaaattgtgggcaaattgcagcgcgctcaactcggtgttgaagcttttgctaatgcccttctcgtagtgcctaagacgcttgctgaaaatgctgggcttgacactcaagacgttatcatttctctaacggtattattcttgtattttcctcttctgccactatcgattatgctccaagtaaaattatgtttgtgtttatctactgagtttcgatgtatatacagagtgagcatgacaaaggaaacatcgtgggactagacctacaggatggagaacccgtcgaccctcagcttgccggcattttcgacaattactcggtgaaacgccaacttatcaattcagggtatgtgcagaaccaaatggaaatttgtataatggagtcttttaattcagttgcggttgagttcaggttgttaaaacggttgtttggtattgtattgcaggccggtgattgcttcgcagttgctattagtggatgaagtgattcgtgcaggaagaaatatgaggaagcctacttaaaacaagactatcttttgttttcaattttttcttactttccctttcgtgttttgagtattagcatatgaatactatttattttttactcgttatcctttgttgtcttagataattttgaatgtatcttttttttctatcttttgtatcaaacaaacatgatgaatgttttgattgtggtttctagcgaaaacagaacaagataaagatttcagaattttaagaaaatggaaccagatttatgtgtaaacaaacgcaattaaaagtcaaatcaacaacaatgcacggcatactttaattgatttttatttttctagtaacggagtcaaggcccaattaaattatttattttccacgatcattaaagtctttaacgggtcaacaccgttagacacttgtcatactattactgggccttatttttctctttactttctctgaaaatcaaagcccatctcttcttccttttttttcccctaatttctcacttccccctcatttcgcgtctcgaccttcgaattcgacaaatccctaattccaaaatcctctcggtaagctacggatctagtctctcttttgctcatagttcgacgaaatcgtctctctgttgctcgttcatgttttcgtttcgttttgtggacttaatcttctctgtgttcgttgttatctggagatctggcaaaatctcgaatgattttgatagattctaggtttctaggtgtatctatcggtatagtgttcgttttgtcttgatttgttggtctcgacgatttatctgttgtttcttttgttttgttgggaataatgttgatatagccaagctactgtgatgttgatgaagtttgaaatgaatttttgaaaacaggatctaaaagagtgtgtgataacataagatg

SEQ ID NO: 36810 - DNA, 3000 bp, Unknown; identical to SEQ ID NO: 36809
  misc_feature (1)..( 3000): 2750-1469P.txt file - cDNA_ID_3100474; gDNA_ID_2936585; Annot_ID_143836

SEQ ID NO: 36811 - DNA, 3000 bp, Unknown
  misc_feature (1)..( 3000): 2750-1469P.txt file - cDNA_ID_3100480; gDNA_ID_2936585; Annot_ID_195049
tgtgtttatctactgagtttcgatgtatatacagagtgagcatgacaaaggaaacatcgtgggactagacctacaggatggagaacccgtcgaccctcagcttgccggcattttcgacaattactcggtgaaacgccaacttatcaattcagggtatgtgcagaaccaaatggaaatttgtataatggagtcttttaattcagttgcggttgagttcaggttgttaaaacggttgtttggtattgtattgcaggccggtgattgcttcgcagttgctattagtggatgaagtgattcgtgcaggaagaaatatgaggaagcctacttaaaacaagactatcttttgttttcaattttttcttactttccctttcgtgttttgagtattagcatatgaatactatttattttttactcgttatcctttgttgtcttagataattttgaatgtatcttttttttctatcttttgtatcaaacaaacatgatgaatgttttgattgtggtttctagcgaaaacagaacaagataaagatttcagaattttaagaaaatggaaccagatttatgtgtaaacaaacgcaattaaaagtcaaatcaacaacaatgcacggcatactttaattgatttttatttttctagtaacggagtcaaggcccaattaaattatttattttccacgatcattaaagtctttaacgggtcaacaccgttagacacttgtcatactattactgggccttatttttctctttactttctctgaaaatcaaagcccatctcttcttccttttttttcccctaatttctcacttccccctcatttcgcgtctcgaccttcgaattcgacaaatccctaattccaaaatcctctcggtaagctacggatctagtctctcttttgctcatagttcgacgaaatcgtctctctgttgctcgttcatgttttcgtttcgttttgtggacttaatcttctctgtgttcgttgttatctggagatctggcaaaatctcgaatgattttgatagattctaggtttctaggtgtatctatcggtatagtgttcgttttgtcttgatttgttggtctcgacgatttatctgttgtttcttttgttttgttgggaataatgttgatatagccaagctactgtgatgttgatgaagtttgaaatgaatttttgaaaacaggatctaaaagagtgtgtgataacataagatgtcgtcttctcgggaagagaatgtgtacttagccaagttagctgagcaagctgaacgttatgaggaaatggttgagttcatggagaaagttgcaaagactgttgacaccgatgagcttactgtcgaagagagaaacctcttgtctgttgcttacaagaacgtcattggtgctaggagagcttcctggaggatcatatcttccattgaacagaaggaagaaagcagaggaaacgatgatcatgtttccattatcaaggactacagaggaaagatcgaaactgaactcagcaaaatctgtgatggaatactcaatcttctggattctcaccttgttcccactgcatctttggccgagtccaaagtcttttacctcaaaatgaaaggagattaccacaggtaccttgctgagtttaagactggagctgagaggaaagaagctgctgagagcactctggttgcttacaagtcagctcaggtaaactctttaagtttcaacatctatctatcttattttgctgcttgagaccagtaaaggagctgtcatgatgaatgcttatgtgtgtttttcttctaatgtaggatattgcacttgctgatttagctcctactcatccgattagactgggacttgctcttaacttctctgtcttctactacgagattctcaactcacctgatcgtgcctgcagtctcgcaaaacaggtttgtattttgtcatacgggatgttatgatgcttccagactttgtaacacttattccagcaccaaattgcttaatgatattctctcaattgttttgacaggcttttgatgaggccatttctgagctggatacattaggagaagaatcatacaaagacagtacgttgataatgcaacttctccgtgacaatctgaccctttggaactctgacatcaatgtacacctttgtcttcctccttttgcttttccctataaactcttatatatgcagtctaagcttcttttactcagaaatttctctcaaacgctgattgtgttgctgatttttaggatgaggcgggcggtgatgagatcaaggaggcgtcaaaacatgagccggaagaggggaaaccagctgagacagggcagtgaccagagagagagggagagacatttctaagtatgtatggtatggattttccaaaaacatatgatatgattaggggatttgtagaagcagagagaaagatctttatttgattttctccaaaaatctctgttcccttttttttttattgggttattaaagctgtttgagtctttggttcctgcttcgttgcttgttagtatttaggaagtgaagaaacaaaactttgaattattgctttccattcaactcgtcataaattatcataatcagtgtattatttacttagttcttattagggtattctgatttttgcttaacgcaacagaatttgtgttaacccatttttaaagaatcttcaatcttgtatcattggtcgggtcagtcggatatatggtccgcttttggtttaagaccggaacaacgaaagccggggatattgagcctttctgatgatgcgcctccgggcggtaatgctattgggacatggattacattctgatcaatagggactaatagtatggatttactttgtacttcagactagggtttttttttttttttttttttttttttttttaaatattattaatcctcatcccaaatgaccttgggccgcaacaaaaacaacatcaaatccagttacaaaattagcaaatcggaaaacatg

SEQ ID NO: 36812 - DNA, 3003 bp, Unknown; identical to SEQ ID NO: 36790
  misc_feature (1)..( 3003): 2750-1469P.txt file - cDNA_ID_3100492; gDNA_ID_2936585; Annot_ID_195045

SEQ ID NO: 36813 - DNA, 3000 bp, Unknown
  misc_feature (1)..( 3000): 2750-1469P.txt file - cDNA_ID_3100497; gDNA_ID_2936585; Annot_ID_195044
atacctgccatgaacaaacaaaaaaacacagttgttgattattcaagaaagctgagagcgtttttcaagtataccatcagatttaacaacatcaatgccctcaattaatcactacaagtaagattaaattatctatcaagttaatcatgtcgatatcgagaatctgattctttcatatctctcccgagttatcatggaaattttaccagaacattaacttttcgaaaacgaaagagaaccttgatagagtaagccaatggaagcaaggtatccggattcattgcgtcttccgggaaagttttcagagcatgtattagtttctcaaacggtaactttacctgcagagttaatttttttaaaaaggttggttttgcgaaattaacttacagctcgtaaataaacctcactcaccaactcatcttggcaatacttgagcaatgctaagcccactttgaacacgattttaacacccttaagaaacaatgaccatagaagataacagaatgaaactttgatcacaacaaacgttaaagagattttaaggatgcgcatttagttacctcggagagaaacacatcccatatccgtagagccaaagggaaaggaaatgagtatgagaagacggtgatgaaccattgacttgcatacatactcggattaatcatttcttgagtaaaatgttctccgagcttcggaattagctcttttaccaagctttctaactgaaacaggtattgctgtacaaggggaagccctgcctacattacacacaaaccactgactcttaagaaatagatgaaatgtgcggcaaagacattaccttgttaaatcaaggaacgaactatacagtagccttttaaattggatagttgattcataatcaatgacgaaaaactctcaccagaatcgttataaacttaatctacagagaacttttttaaaacgtggtcacaaactctaactcacgcagaaaatactctttttgtttcattcaactatacaacattttcttgcaatcttctaataattaaaagactcacatgatacagtccttccattggagcatgaacagctcctttaagtaatgcaactaataaccagaaggcatcttcttcgctcatatagagaagcaacaaaccggctataaaccccatcccctgcagatattagaatcatgaatcttagtcccatactaaaagaaagaaaaatgggaaacaagggaaatatctagaggatagacctgaacatatccgacatctctgtcataaactgagtatgccttaaggacattgtacaaggatctttgcccaggtccatgtctcttctgaaagaaaacatgtgatgggaaagtacgggatatgtctcgaatgatatcaagctctgatgcagatgtttcataaatcaccaattgcttcataggaaaatcgatagatgatcagaatatgactcagagaagaaacaatgtaaggatataaacggcgaagattacctcataaacaccaggattcataagcaaaaggtctcgacttcctgagattaactgccaaacaagacctcgtaagcaatcagggatcccttttcgtatacgccttctgacaacattaggttttctcctaacataatgcttccaatcactccctccaaccccaatcatcttcctccattttctcacctttctctcctctctatagatagccaacaacaaaaacacactctcactctctcaatcatattcttttaaaattattcgctccctcaggacatacctgtcatgatcagtggatgatgtagttttagacttgctaaaacgctcaggcgaattggcatgttcttgcttgagaaacccgaatctatccacaggaacatgagaagtggctggtcctgattcactgccattttccgttctttttctactcattctactaacctgaagagactcctcctagcattggtttcagtctccttgtgatcaagctccctaatgacacaatcatagaccaatatatcccaatagtgaaatttataccatcaaagtataaacaggttctcaaagtaaaatcctaaatctagtaacgtcgatcgtccaaaaactgtaaccagtaatcataatcagcagaaacgtgatcgtaaaaaatccaggagaaattaaaactcacctaggtttagtcagatcaaaagattcgtaaccaaattcctcgatgggaattgttggaattcgatggaaccgaagaagataaccaaaacgaaagaaatacaacgttggatggagatcacatctgggaactcatacgcgtatattactatggtggtggtgactcaatctttgaatttttcatccgcttgaagaaagtgatgtttttcttttttccttgccggagaaaatatgagtccagccagaaaaataataattcaagtgaagccagcacgaaacgacgccgtcgagagagtattattatgattaaatggtggttatgccaacttgctaagtttggtgacaactaaaagattctattttctaaattgagcacgattttgggtaattagaggctttatcacgacgattatgaatttatgattcataaagttttaggaacaaaacaatttaattgggtatatatatatatataggcgtcaaattaattataccaattcaaaaaaatcagtaacctattttttaaaataagcccaaaatgaaagatagcccaatagctaaaaggcccatgaggccatgactcgatttataatgcccaatgcttattcatacagtttttcctgttctgtgttttgttttttatctgtcaaccaaaaaagagcttttgcgaactcttcttatcctttcaatttaacagagtcatcagcttgaagacgaaagcctttctaattccaatcttcttcacttgtatgacacgttcgtctactcttgcgcttggtcggttttcttaggatttttgcacaagaatgatcaacgcatgattcggattccaggatagagaatccatg

SEQ ID NO: 36814 - DNA, 3000 bp, Unknown; identical to SEQ ID NO: 36813
  misc_feature (1)..( 3000): 2750-1469P.txt file - cDNA_ID_3100497; gDNA_ID_2936585; Annot_ID_143829

SEQ ID NO: 36815 - DNA, 3000 bp, Unknown
  misc_feature (1)..( 3000): 2750-1469P.txt file - cDNA_ID_3100513; gDNA_ID_2936585; Annot_ID_195037
aagctagcaaaatgggatcaaatcaacttagtacttagtcgcccttttccttttgctctgcaatatgcttgtgaactctcatactcttacttctcatgggctcaatcatcttctctgtttcttcaattgtctgttttggcagttgaacctctatggcatcaaaccattctcttagtttcattttttctaaatatacttctaccctctctactttcttattgttccatccctgcccaaccttttcctcatctaatgtcgcaaatccagcctcctcgaccttgcagtcactttcctcgtcgtgacactcttcttcaatttcttgtaagttttctgtctctccatcttctctaacagtacagttcaggtcatcttctcctacggtgcttttcttccttaactcaatctccacctgctctaccctcttagccccaccaccaaccctctcatattctttatcacttctttcactgcaaccttcttgagcttctttttcattttcattttctctttctctttcaatatcttgtgagttctctgtttctccatcttctttatcagtgcatttcaggccttctactgtgcttttcttccttaactcaatctccacctgctctaccctcttagatccatcgcattccttctcatcttcttgatcacatatgtcatcacttcttccactgcaaccttcctgagcttcattttccttatcttcttcaacatgacagttcttcaaaacctcttctccggcatcatcatttctagtctccttggatggctcctcatccattttcttcctctttgcacggcttttccgggcttggttcaggaccatctccaactccagaaaagactctccaccaatttcagtcgtcttgcttctggtagaccttgtagttctcttctcatctttaacctccaatccaaaacattcattttctatctgcttgctccttgtcactctcttcctgcttttcacctctgagatttccactgccttgggagtatcctcaacttccaatttgattgatttctggacaatctcactgttcttacctctccgagccctagagttgccttttttctcctccacaacttcttcttcctccgtaattgcactacttgcgttcttccggggcctcccaaccctttttttctcctccacaacttcttcttccttcgcaattgcactgcctgcgttcttccgaggcctcccaaccctagctttgaccaccttctcaatttccacatccaattcctcttctttatcggcgatatcgtccagattctttttcctcgaagccctagtactcttgggcagttcattttcctcttgcttcgacgatccacgcgtgcgctttggtttctcctgaaccgactcaataggatccggatccggatccgaagcagcaagccgcttgttgttcctccttggcctgggcggaagcttatgctcctgcggcgcctgaacaacatcactcccaaagttcaccaaaatggaagtgtactcaccaagcttaatttcgtctccatggctaagattgacgggcgtatctgagtcgatagtgtcagagttcaatatggtgccgttggaagaaccaagatcgtggattatccagttctcggaatcggaaacgatccggaggtgcttggtggagattccggcgtctttgatggcgatttcattaccacggacgattcgaccaattcggatagtggatccgggtttaaaccctagagaatcgccagctcttggaccctgggtgaagtcgagcttcagcaatggcggaaccatcgtgcgtctcggggaagctttgctttgattcaaaataatggaattttgaaatttcggatttatgtcaaactcaaaatcgaacggaacagtcctgaaacaaagaaaccctttcaagcccaatgggcttttgcattgtacaaactatgaatatacagtccagtccataagttaccaaaatatcttcttgttactacagagtacagcccatccaagttttttttttgttgttgttgttgttgttgtaaaatgatgatttatgcatgattgactatcaaattgaaacaagaaatgagttatagttgatttagatatattatatatataatatttgttgatataagtaaaaaaccaaaacaaagggagtaaatattcatttcatgatctaataatttcccaaaaaattaaattacaattttggcaatattgtttcagtgaacaactgaaaaactcaacttatcaacattactccacaattcacaaaaaaaaaaagatttatttcttggtaactggaagtgatgttgatataagctaatatataacattataacttgtggctcatgagcatcctaatctcttcactaaaggcttatttgtcacattctcattggtcactctagattcaccactttgccatgtcagctttttcttctcatccacctgcaaaacaacatttaaaaccaaaatgagtttcacttttatgtattactttgtataatctttggtcactacctgattacttaccatgtatgttccaataagaaaagtttccatctttgcttaaaagcaaaaaactaaaataccaaaagattcaaaaaaaaaccaaaacagtaaaagtaaatagcaatctctgagaatcttatccacgtcagctcacgggtcctacagagaaagctacaataggaagagatgttttcacttacagaagatttacttggtctagatttgttctcctttgtgaaggttatgagaaaaaaacttttttgatgattcatgaccttgttcaaaactcagacagccacaagatgatccaactacttttaacaaccactaactctgcgccacgtgtatatctccaaagattctatctttcccctctcaccacctagatatagtctcattagccttccctcctttctaattacaatctctccttttgccaacaatcattgcttaaaaaacacataccttcttctttagttataaaaatg

SEQ ID NO: 36816 - DNA, 3000 bp, Unknown; identical to SEQ ID NO: 36815
  misc_feature (1)..( 3000): 2750-1469P.txt file - cDNA_ID_3100513; gDNA_ID_2936585; Annot_ID_143823

SEQ ID NO: 36817 - DNA, 3003 bp, Unknown
  misc_feature (1)..( 3003): 2750-1469P.txt file - cDNA_ID_3100536; gDNA_ID_2936586; Annot_ID_143868
tcgcgactaaaacctcgatgtaagcttttccaagacccgcttgtaccaaaggaagttctattgtactacgggaaggaacaccgaaagggcacttctcttgtgtgataaatttcacatatgtctcattcgccacagcaaattcactcatgtcagagatatatagatgaatgtacaatacatgctgccagttatacccgtgttttaaaagctgggattcaagttctgtaagaacagtctcgagatcttctttcagacctgttttaagaggataaagcaaatatcaagtacatatgcggggagatcttgaagatttggtctgtttctgagttaccttttgacgattcactagaatcttccaaccagcagcagatggagaacgtgttgtgtttctcagcccttgatatgtgaagtctgttacttgtgtgttcaactagatcaacgattccattatctcgttggcgagtagaatctgatgtgttaggaccatctcctagtacctcagacactaaacttgattcctcttcaggggaatgggagtctggattccctttcttttcaagatggaacgtagatggatgaagaacaccaacaggtgcaatggaatctggagagtgtagcacaacttgatattcatcaagcacgatactcgcattctacaaatatgcaaattgtcaaactacaataaatgtgagaaatcaatgaacacaaactgttcttaagattgttgtttaaagaacatacagtgaaaagcgggcaatctagagtcagagtttcatattctcctccttccccgcaaacattacttccatatttcctaagtagagatgcaatcagaagctttagaaacaatgtaacacaaatagataaatgaagccataaaaaagagctgtggcatactcttttaacttcaaaagatatggttccatgaaggctaagtctttccctaaatgctttgagggatctaaccctattgccgcgacctgtaaaggttttacaaaccataattataagacgatgttgacgttaatagaagcaggaataatataacaacaatccttatctaccttgactaaaatagctttgatcccatttgctatctgcaagtaaacgagaaacgagttaagtaaaacatatacgaaaaagaaaaataaaaaattgagattgaaataggcttgaatctagattttctcttatactgaaacagtttaccatgtcctgaagaagcaatgtctgatcttgtttccacaaaaatgccaaagaaacaaggcctaaccttgaacaaatactctccacacgcagtcgttggtagtctgatgcaatggcaccagacgatactgcagtgatggaaggtatctgtctcttcacttcacttaacaagacaaacatatcttccacttcatcatctggagtcatttggtagctaagtttctgatgcctgcaaataaaactcgtcagaaattgttcataaaatcaagccttgccttggaaagcctaaggattctcaccttgaagaacctcggattcttcttctgaacaatggcacattcatacattctgcataacccactaaaatctggtggcctacctgaaaaaggtgcatccaatcaaagaaattagatgcgaggaaacataaatcattcttgctctcaaatatctaatcttattactcttctcaagaagaagaaccagatttacaaatcatgaaaacattgaccagattcacgtaaaacaccaatgagatagaaaaggctcaatttttattcaagcccttgttcatattaaatatccggttttagctcatactcaagcatatatagacaagagtagacagagaagaagcagaatcttacagtttgatacatatagctgtccaattcatcgacggaatcatcaaccggcaacaaattagccaatgccacgatctgtgcaaacacaaatcgagaaaccccaagtgagatttaagttcgtatagcttaaaaaattgaacttttgagaggcaatttcagggaaactctgaacaactaacaaaacttcgaaaattagacagaatccgaggtaagagacgtacctcgtgaccgtattggatacacttcatcatagcataacagctatctttgcctccactcactaaagccacgaccttcatctttctctctctctctctctctcgagttggagtgaggttcttatgtcgtcgaagaaactctgagaaagtcaagtcaatacaaaactttgaaggacgacttaaaaaataaaataaaaagaattttataaaagtttaggaatctagcatgacgtttctacttgttattcgattggcccctatattttttaatttgtcaagttctttctaaattagtaaattctaatttagggtttggaatcttttttttctattgctttaggtcgaaatccatatgatacgatatgatatcaccacgatagagatgtgtttgtatataaaacaacacaccaaaacgtctgaaacaatcccgtccacaaatgagtattcaactacctagttatgatagatattataatcttctcaatttaattgctaaactagattagaaaacatttgatattaacattgtattgatataacagttcgttattcaacctcaaaatcttttttctaaattactttcaaggaaactaatgaataagctaggttttcatctattttgagaaaacagaatattggccgaataaagagattaatgggcctgattaaatgggcacttagcttttggtaattaagctttgggtttcgatttgggtttagtgtttaaagcccaattcttctttatggtcgtgtacttagcttttcttcttctctgtaaacaggatcgaaagatcactaaacaaaacaatcatcttcttcctaaatttcttctgattcctcatctttttcttctacttctcatcttaattctgttatttctttgataagtctatttcgtgtttatcactactcttctcttctccagaaggacgaaaatg

SEQ ID NO: 36818 - DNA, 3000 bp, Unknown
  misc_feature (1)..( 3000): 2750-1469P.txt file - cDNA_ID_3100541; gDNA_ID_2936586; Annot_ID_143867
cagtatgatgaatcattttttttttgctcagaatctgtagaatagagagactaagtaatggattaagttttaactctcaccttgtgatcatcaattatctatcttctaaatttctaatgaaaacaaaaacaaagtatacgaatcagaaagacttccaaagactcattctttattcatcttcagggtctcagacaaggaagattcagtgaagatgagtagacaacatgaaaagaaaatcaacttgcattaatctttactgacaacgtaattcttgtaaaaatgtattgcatgtcgcagtgtgatataacctatccttatgaacaaaaattagtagactgaaacatattactaataaacagtaaccaagtttagaactatatgtgtttaccagaccagaagcgttgcgtatcttccttctgttcattctagtaatagcggttgacacaaaggctatagaattgtgctatggagatccataaaatatgttacaacaactccaacaagcgagcatagagctggtctgagctggaacaagtcctaacacataccctgtcaccaagaagtaaaaaatatcgtttgatgttcacgaccttcggtgaagtgcctgcaccattttccaaatcatacttccatgaacaacctgtagatgttaagataatatcagaaagaaaaaacaaaaacttactttgatgtgactgaagaacatataaagcaagcccacatgacattttgtttaagaattatcctgagcctttggaaaataaaagaaaatcaactcattctcaataaatataccatctataatggcataaaaaacttcggtaaaaactgatttgagcatttcagaaaaatgtgcattaccttggtttctgtccctataagaaatatgttaaaaaaacagcagccaacggtgatggatgaataagcaatccaacgatactgtagacttaagccaggcttagaatcatatcaaaacgacattaacataaacaagtcgatagaagcacaaacctgagtttcggcatttcttctgtcacggcctcgctaacaccaaataaaacaactaaagcaacaacctgaatacacagtcactggaaatgttacatataaacctagaagggcgttttccaaaaaaatgttttttgatcctctgttttttactctatgaaaacagaatcgtttataatgatgaattattgccagcatacaaatcacaaaattttctgttttttggtgacatacaaatgatttcaaaataacccaaaacctttattagaatcaactgtatgttaaaaaaaactgaactttgatcagattgatagaagaaacaaaaaactaaataataacaataggagctagcaacatgtatactatttcactttttttagagtttctaagccaatcagaaggctctatttcacacccactcgcacaaagtgagcgttgagcgcgtgagagcatttctgtgggtatacccctttccaaatcatgcctttttcaatcgacgcactagtctccaaaattcccatcgcgtgaaaatttgtgttttcttctctaaaccagtataaaccaaaccacaaatcaattctaatttcaataccaatgtataccgaacctaaaaatcaattttaatttcaaaaccgatgtaaacctagtaaatatcatctacaaatataagcacaaaaaccacagtaaatttcaagtgaacacagatacaaattgaaatcgattaacctgtgagatcttctgatccaagtactgatcagctttcgagcacctttgtcttcaacaagtttagaatggttgaaccacacctgtaaacaaaatcagaatcaatccttaatttgggaatacaaaatcaaaccaaaacaaaatcagacacagagcttcagagctacctcatcacggagaacgatatacttgaggaatcggaacggtggaattccttcttcaagagcaattccgttcgagttgagccttttgatggcttctacattattcaaatctagctcacatggtagtacctcgaccgtgctccggtaacgaaccagaagatgagtcaggtcaacaggatttgggcaacgaagctaatggagaaagagagcttcaggtagcattaagtgatttgaataaaaaccgccattttcgtccttctggagaagagaagagtagtgataaacacgaaatagacttatcaaagaaataacagaattaagatgagaagtagaagaaaaagatgaggaatcagaagaaatttaggaagaagatgattgttttgtttagtgatctttcgatcctgtttacagagaagaagaaaagctaagtacacgaccataaagaagaattgggctttaaacactaaacccaaatcgaaacccaaagcttaattaccaaaagctaagtgcccatttaatcaggcccattaatctctttattcggccaatattctgttttctcaaaatagatgaaaacctagcttattcattagtttccttgaaagtaatttagaaaaaagattttgaggttgaataacgaactgttatatcaatacaatgttaatatcaaatgttttctaatctagtttagcaattaaattgagaagattataatatctatcataactaggtagttgaatactcatttgtggacgggattgtttcagacgttttggtgtgttgttttatatacaaacacatctctatcgtggtgatatcatatcgtatcatatggatttcgacctaaagcaatagaaaaaaaagattccaaaccctaaattagaatttactaatttagaaagaacttgacaaattaaaaaatataggggccaatcgaataacaagtagaaacgtcatgctagattcctaaacttttataaaattctttttattttattttttaagtcgtccttcaaagttttgtattgacttgactttctcagagtttcttcgacgacataagaacctcactccaactcgagagagagagagagagagaaagatg

SEQ ID NO: 36819 - DNA, 3000 bp, Unknown
  misc_feature (1)..( 3000): 2750-1469P.txt file - cDNA_ID_3100547; gDNA_ID_2936586; Annot_ID_143866
actctttgtggttttctgttcagcacgcacaaaacaatcagagaggaaccaacttcatgaaaagtttgttactttcttgggtttggcaaagtcttctcggagggtacagaatgtcctagatcctatgttcctttacattcttgtccccgatcttccgaaaaggttaaaatactgcatagaatcttcctttacatccgtgtccccgatcttcccaacagttttgggtttttgacagtaattgttgttctccagggcccttgttgaagtgaaacctattttatacgtggaagaagatacagacaccgaagatgaaaccagccgagatcaatcgggtgaaggacattacagtatttggggatataagccagagaaatggcaccaagattgtgtgcagaaacgagttgttgatgggaaagtgtgtgtggccgttctctctatctcagctgaactaatgaggaaacttcagggagaagaagaagaactggagatagtatcaagattctgtgtatatcttctcaacaaaaccttgtctgaaaattcgttttcttggcaagacactacggtgagaatgagattcttttaaacaatgttagcctatcatcaaaagctttgcttatatcttgttgttttggttgatgcagagcttaagaatacacttctctactagtattggtgtgtccgtagagagattatcggccatttttgtgtctgcgttcagagagcttaacgagatgagtgatggagtaaaaatggacagtttgaaagaacctatcttcaatctcgtccctgtccttggtgctggaaactcttctgcttcactcgacaacataatcacctgtgaactatttgccctaaggtcgtagctttcctgtttctcaaggaacacaaaggtttacttacttgatcttggggtcatcaaggtcatcaagggccatttgattttgcaatgggtaagccaaattgaacggccctatgttttaggcggacagttccatgccgttttttttgaataccttttccatttgcgaaagaacaacacgtagttgttttgttccaaatggaaacggcacgatgtttgttattcttttcttttctttttttccagttggaggtgcaaagactgattactttttgccaaacccagtccaaatggaatttatttttatcgaaaggcatgatattattggtcaatacattataacaatatgaatattatttaccagaaatatttaacttggatttggttttaccacatactgtatgtaactttcctgtcacaggtcattattattaaacgtattttagaatttaatgcaaagaatgtgacatgttacacgacaatatatatctcagaaaggtgtgttttttgattaaagattattagtctttttcacgaggatataataagaggagagattccaaatgtcaagtgctattttcaaattgttaaacagagattgaagatctttagcataaaatgttaactatgacttgtctattcacaaccaaagtcttacctcaatgtataaaccgacgtctttccaacataacacatttgtattctcatatatttaaataaaagtgaagcttttctttgatctagatcgtggttattttaaaaatataataaaatcaaataactatggttacttaccaaagtaaagtggggttattttttgctgtggtgatgttttatgctttgtataagacacttttgcatctctagtttatttctaagcattttggagtaaagagagaacaaaaaacaaagtataaaaatatccaacaagatgcttttgggggaaacactgcattgtggtctgtggggacaaatttgctggcacaaaaattctgcagaagaaaatgaaaataatttgatatcactataggatggtccaaaaaagtactaacaagtttaaatatttaatttgattcacagcatcctttttagcaccgtaaatttgagtcttatgtagtactgattattaatacaaaactaacaagattatatatcgataaatatgaagcatcctattcctatggttgattatatgaatcttttatgtcacacaccctattacgacaggttttaatgatacccacatcacacgtgtataagttaaatgcaatgataacatcctttactctgaatacagatacatttgtggctaaaaaattgtaaatgcaaatctttggactttggttcagaaatgaaaacaaatgtattttttattcgaaactgtgtcttaaaaagaatccaaagtggaaatgtccaacctggaaattcagacgtaaagcgaacccaaaagaaaagaaaaaatgaaaaatggtaaaaccgtaattaagtgtaaagtcaagggtagttccatatttctcccttgttggtcgagcgagaccagaaaattcgcagagagagagagagagagagatagatctgagagtagtggtggtggcattaataatggcgtaagtggaagaaaggaacctagccgttagatcttctcaatcgctacaaacattcattgttcaccgatcgattctctctctttcttcttccccattgctccttccttcgtacccctctctctgtcttttgaggtttccgggtcgggttggtgagaaaactccagcggcttaacggatcttccactggtagttttctgttcctcacaaggaaatcgaaaatttgataaagcgaaagtgaaaaaggcgtgtgttttctttgtaaaggctccaacttttttgatgaacagcttgtgcttgttgtgaaggttgttactttttgtgtattggaatttgggttttttctttatgttctgaggaggagaaaggaggaagctttcttgaattggattcaaatttgagctcatatggtgagtttctagggttttgtttgtgattcctggaagaatctgattccttttctattagggttggagagaagtaaagcagaaaagcttttttgttttggagcttagtgagtgttgtggataaacaatg

SEQ ID NO: 36820 - DNA, 3003 bp, Unknown
  misc_feature (1)..( 3003): 2750-1469P.txt file - cDNA_ID_3100551; gDNA_ID_2936586; Annot_ID_143865
aaacgaatttgtttttttttctttgtctttttcgacttggtttctctgtaagattcttgttccttgaagtgatgaggtttctattagataagagttgattagaatgatataatgtgctcatggtgactctcatccttgcacgtccctgtggtttatgaaaagccatattgctttcctctttagccaaattgcgtgttaatatccttcccgttgcatttgattctatatcttgtttctgtttgatttttatgcatctgtcacctccatgatagtttctcttggttaatggctgaaacaagtttagttttggatagagaatcaaagagtctcttcttgttcgtttgtatctttcctcttgcggtatatgttgaagaactttagggaaacaaagtgaatgaaagctaagagttttttttatgaccaaaggcaaaacaaaaagtgaagaatattcctttggaaagttttgaaagggaaatacatataggatattaactaggcgaatggaattttttcactcatacagagtcattttctgtatatataacttagtgattgtgagttctcatattgcttctatgtaacactccttgtaaagctaaatagcccttttgtgctaagtctctgatatctattgttatcttctcaatactgcacttgttcaatgacacttgctagcgattttggttttccatccgctatatcttcatcttttacaattctagaagagagataccacaataactttcctaacactttgtgtgtttcatcaggacaggaatcgatgaataacaaccccgtcccctgtcaggtgtttcctctggtctctggtggtagttctggtgggaatttgttttcatcttcttccggattctgcaatggtgtctatgtttcatcttcctcccaggcacggccatctgtttctaccgtgccaagagacagaattactgttgctcacgtctctggtgaagggcagaggcaggaatgccctgtggaaacacattccttgcaattgatcaatcaacctcaagaacagaaaattatgacttggtcttcagaccagattcggggcttcttcgattttcctgttccagatccacaagcagcgagcagcagaactatggtttcatccaaggaagtgctttcaaaatgcgaatggccagactgggcggatcagttgatctctgatgatagtcttgaaccaaattggtcggagcttctaggtgatcctaatgtactcaatctatattcaaaggttcgtttctttcagctaaatatgaatctctacgcttatttcagctaaatatgattcttctattaagactgactctgataatgtcttacagatagaaacacagtcttctgatatagcaaggcaagagatcgtctttagaaatcagcatcaggtggatccatcaatggagccgtttaatgccaaaagcccaccagctagttcaatgacatctaagcaaagaatgcgttggacaccagaacttcatgaagcatttgtcgaagctatcaatcagctcggtggtagtgaacgtgcgtatgccctttttttttccttctcatgcctgcaaaatttagctgaacaacttattattattctcttggcttataatttcaaaccacaggagccacccctaaggctgttttgaagctcatcaatagccctgggttgaccgtttatcatgtcaaaagccatttgcaggttactattctccatctatgttttcggtttgtatgcttacagctcatcttaaacgtctttatattattggcttgtccagaaatacagaactgcaaggtataaaccagagctttccaaagatacaggtacttgaggcatctaaggattcaaactgtcttctcaatatttcacataagcttattatactttggaaacataatggcatttaaaagactcttgtgtgatgaaacacgtctttatacataatcagcttttcttcttggacagaagaacctctagtaaagaatttgaaaaccattgaagatatcaaatctcttgacttgaagacgtaaggaacattttacttctctgtcagaacagactaagtatcacctaggataatatttcttcatatctaagattttttttttttattcttcttcaggagcattgaaatcactgaagctctccggttacagatgaaagttcaaaaacaactccacgagcaacttgaggtataataattcaaactgcctaaaagaagcttttataaaacaaaacagtgtcctttcctcttcatttgtctgatttcttagtttttggttttagctggtgattttgatcttatattggtcttaatacaatgcagatccaaagatcactgcagttacaaatcgaagaacaaggtcggtatcttcagatgatgattgagaaacaacagaagatgcaagagaacaaaaaagactctacttcctcatcatcaatgccagaagctgacccttcagctccatcaccaaacctttcacaacctttcctccataaagcaaccaattcagaaccatcaataactcagaaactgcagaatggttctagcacaatggatcaaagtgaatctacttctgggactagtaatagaaaacgggttagagaagattagacatctcatgagtatgatccaaagatgttgcaaacatatgtaattgtgtatataaaattgaaaatatcacagcagcaagaaaatgaaaatttcttcttaatggagatgacgtggacaaatcactgtcgagttggaatgttgtcggctgatgagtcagcaatttagatgacgtggctaaagaacatccttatttatgacgtaattaataatgatctctcgaaatgcgtcttttcttcgtctgttctatcttctttaccaatttctgcaattctggagaagctaaaggtctcaatctctcagtcaaaaacaaaaggtctctcctttattaaactatctatcactaactagaagaagagattagaggaggaggaagaagatg

SEQ ID NO: 36821 - DNA, 3003 bp, Unknown
  misc_feature (1)..( 3003): 2750-1469P.txt file - cDNA_ID_3100563; gDNA_ID_2936586; Annot_ID_143861
taaattttccctattgtatgtgtgccccaatatataaaaccggtgaatttgtgatataatgagaagtggttcgagaagacaaagttggataatttcatttcatacactatacaactaataaaatggtcaagttttcattgacatagcaatcaacatcgagtctttttaagtcctacctaatacccccaaaagatttcaggttctcaacaagagaaagcaaggataatatcaaatgaagatgcttctattttagacttttagtctacatcttacgtgcagcatgtcacttttatgttttaagtccaaaccccattagactaagagaatattacgtgattagactctttaaaacactttaaatggagaagacactttagataaattattttacttatttaccctttaactacattttttccatcggtcatcttttctctctccttttcccatctcttctctctttttttctttttttttctcactttatcgaagaaaaaaacctttccgagagtatcttcaattccaaatctgcaattaatctccaaatccactcaacgcgatggctttctttaagattgttaatgggtaaataagtaaaagttctaataaggttaatctccgcaattttaatctccgcaattttaatctccgcaatctccgcaattttaaatggagaaggcactttaaataagcaaaataaatcacaatcttaaagaaaccaagacctcatattctccaattaatcaagagagaagaactttggtttctttacaaaccacggttaattgaatctcttgttattatggacatcgtatatagaatgaatatgaatcagtaaaaagttttctgaatgaatatatttaaatggactcgttattatggacaccaaaaaattgtttgttgattttgttacagtttgcagagacctccacctccaagaccttatggacatagaacttttaccaaattcctgagataatcgagatcgaattgtttaaaaaaattcgccaaaagttatggaaacgtggagagagagagaggcgctacaaatcatggagagagagagagattttatttattttggataaggatcgtggaagaggaataacaagaaagagaaattgagaattaaaaacataaatattgaattaagagtaaaaaagtctttagaaaaatgaattagtagaaaaagtgcatattccctataaagttcctcaaacggaaaaacattttctaaaagtgcctaatagtagaacattcccttagactaatgctaacattttttttcttttttcattttgatatttttttattttataatttataaacaaatacttgaacaagattctttgagtaaaatactttagccaatctaaatcaaaaatatttcagcaaaactgttgttaccaaacatttctctaaaatcgataccaaaaatcaaaagagaaaaaaaaaaaaaacattttgtaaattgaaagttgaaactgtgccttggttgaaaagtaagaacggcgcgtgtagttacacgcttctacgtggcccaacttgttcacatattttagatttggtcgttgttggtgtttggtaacatgtcctggcccaccaccaattaattctataattggtcttatgactcttatctttctatcaaaatcctaaattgcaacttgctgacgctttaccggtccaacgtaactttactacaccttggtaacgtgtctaataagctgtatttagcaaaattttaccatgtaatatgtggtttacttttttggcatcatttgtttcgacataaataattaatggaccatcgacgttaatgaacactcattctatattttcttccaaaatggaccatcaaatttaacaaagaaaaacatgtttaaaaaacaaatgtagtttcatacttcgtattgggattaacaactgtcacatgataagtgcaatagttatatgaataattcacgtcacagtatgtcaaatttttatattaaaattttaaaatcgcaacttgcaaatacaaatactactcttttcccctccatttctattatagtattaaaactaaaaaggtcagaaggtatgcataatttgtgatagaacatttttcttgttcatgaatcgaaagatgacaatatccaaacttcccacgtggttatcattccaaaactgaactacgccgtcgcatataacatatcttattttatttatccatttttacaatttaatactcactctaatttgtatgcgcatgccaattctttcttcacttaaactaaggtttatgttatttcttgttaggcttctacgaagcttcctattatgagtatatagaggaactttttgtcatcgtatctatgtttctgtttcgacatagataacggaccatcgacgttaacgttaatcagatactcactatataaatggaccaacaaattaaatgtaataaaggaaaacatcaaatatattccaagaaataattgtaatttcgtagttacgtgttgggagaaactaccgtcacatgatgaaagatatatgtcaaaattgcaacttgtaaagcctccttttctgatatatatatattctttttttttttttaagtcacaaagtaagggaatttgtggggaatatttttctttttcatgaacaaagcttcgtgtggacaataaaacaattgatatagtgtataatcttacccacaaagataaataaaataataagacaagtgattaataaacgtgccacgtattaaaaccatcccaaagaaacttaaccctttgaatgtcttaacgtccattatttaataaatttactatttttcaattgtttattatttatatttatttttgaaatttagaatctgcgcatataaatacataaaaccctattcgatctctttcttctccaatctaagttgcagaaccatggccaaaactctctactgcaattttttttgatcttttcttttactttttctcttcgtaatcgctggttcgagaaatg

SEQ ID NO: 36822 - DNA, 3003 bp, Unknown
  misc_feature (1)..( 3003): 2750-1469P.txt file - cDNA_ID_3100592; gDNA_ID_2936586; Annot_ID_195120
tatactagggtttttaaactaaaagggacatttcgtttttaaaaacagccgtggactgatttactaaataattcttttctatataaaaatatcttatagccaaaataaaatattattagtatatatgtgaaagaatatccaccaatgttaagaaacaaatctttttttaagtcaaaataaaatatggttggtatattgatatatggaagatacatcaatggtgagaaagagaaatgtcaaccttgaacctaaatgttctataaattcatcttttacttacaatccagaaaatcacaacatcttttttgaatagattttatagctgatacaacgagcaagagaaaatggccatcacaaagacttcagtgactcttttacttttaataataatggctgcttcgttgtctaatttcagcgtcttggcttcaggtatgtttgaaataattctatgctgttaatttcttattaggtttcatcacttgaaagcaatgacattgatatgtatgtatgtacttaaatcatgcatatatatatatatatatatatatatagtcatatagatatgatattcatgttgtgagtttgtggacatgcagagatcaaacctacaggaagagttgataatcaatgcaaggagatgtgttcggcaacgtttggggacggtaaatgtgccgcagactgtaggaaggctggtttctcatccggacgatgtcttacttcttctcctttcggaaataaatgttgttgcacctagtgatagctagaaccaatctatatgactatatgagttttctcttgttgtattgccacatattataattgtactgcaatagaataaaataattttattgttatatttttctttaatcatcaaaagtaggagctacaattacaatgcacgagtcgattaacatactcttatgactctttaactactcaattattacgtacgagaagttttctaaaatttcaatactgaagtggtgatattgtttacacaacgcaatgtcaagttttttcataaaaaaataaaataatcataaaaatatatgtttgcttgtgtttaaacaatcctaaacattttgtaaaacttcagaataaaaatgattaatttcaaattatgattgtcagttaggtcgaaatcccaaatcgaccatacccttatcggattggactttagatcttttgttaacaatgacgtgcataaatgaattatgaaaagttgagttaataaggctttttttgttcctgctctaaaaagatggccaatattgccagtaaagaaaagaaaacaaaaagaagcaagcaaataagtgttaacattcatggcttaactatgatgaatattgatgattacttttctatatccaacataatgatacctgttacttacattcataaacaagtttgaaaaaatcgcctagagatgctagattagtttagttattgcaaggagagatgagccattgatgtatgggtgaaagctcgattcgattagtcaacgtagctgagaaagttaagttggaaacattattttgtaacgtttcggaacaaaaaggatcttttgggcctatctagcaaatttgtgggccgttctcaggctaattatggtttgcttataacttagttattcgcatcactcctacgatttgttctaggatctgtggtcaaccttggttttgaaacaaaaagggacattttgtatttcaaaatagccacggattgatttgttaaacaatacattttacaaaagaaaaaatcttttagtcccaaataaaatgttattagatacatgtggaagatccaccaaatccaatgttaaggaaaaaatctttttaaatcaaaataaaatattattaatatagaaagatccatcaacggtcttcttttctacaaccacaataacctaaaatgttgtataaataaagcttctacttacaatctacgaaaacacaacatttttttgaatagattttatagttaatacaacgaggaagacaaaataatggccatcacaaagacttcagcaacgtttgtactcttaataatattggctgcttcgttgtccaatttcaacgtcttggcatcaggtatctttctaatttctacgtactttaattgtagttaggataactttatttgaaagcaataacattgatatgtatgtatgttattattcatgtggtgatattgtggacatgcagatatcaaacctaccgggagaattgataatcaatgcaagcggatgtgttcggcaacgtatgggaacggtaaatgtgccgcagactgtagaagtgatggtttctcatccggacaatgttttacttctccacctttcgacaatagatgttgttgcaacaattgatcgaaatcgatcttgtttttgcattgatctatgttttctttttttctgttgttgacttgccataatacgcaaatggaataaaactataactttactattttatgctttcaaaaaactaaaagtacgagctattattagtctatcaccatgcacatgagtcgatttaatttgcagcccactcttattcctcgtatcatattagtcacttactacgacaagtttaactttggaaacctccaacaaacctatttgagactatgtggtttcgatatgattagggtttagagttaaagagtggcatcagataccgctgttgaggttgaatagtttaattatttgtatctgaactataaaaacaggaaataaaatattttaaatctacatatttgtaaagaagaaatagaaaaagtcaaaaacaattctgatttgttactataatttcttccaggctccactaaaaataaaaatatcttcttcttttttttttttttttttgtaaaagacagaaatatctaatccggtttatacgaatccggtttaaaatcggtttggttttgttacaaagataagaccagattaataacatcttcgtcttcacacactctgcaacacctctcactcaaatttcattcaccatg

SEQ ID NO: 36823 - DNA, 3003 bp, Unknown
  misc_feature (1)..( 3003): 2750-1469P.txt file - cDNA_ID_3100599; gDNA_ID_2936586; Annot_ID_195117
aagcatccatacacgtatacgagtaaatgaaatcagagaaaatgcaaatgaaaacgaattatgtgtatactaaccacagaagcgttgaaaatcctagctccgtcaatgtgaagcttcaaaccatgtttcttggctaattctccgactttgtctatatattctataggaaggcatctacctccacaactacatcaacaaaaatccggttttgtcaaaccacaatgagtttatcgaaccggaaaatttaacacgaccaaaatactagtccacaattaatattcttttgaacaaccatgaaattttagaacatttggtcatatttgtgggacggttctatataatacttgtaagtttgtaactcatttctcttcaaccagaaatgagacaaccctaatacataaccggttaattacgaattatactctacaataatttcatttttctattattagtcctctaaaagaaacctaaaataaacctctacaccaactttagctaacacatgttcacaaaacattatgaaattataattaggctttgtttttatttgcttgataaaactaacacttactttgcttgagtattctcaagacatataagcttagtaaccggatgatggagatctcctttgggactcctcacggcagcttcaatagcaccaatctccatcgtaccgtcttcctcattcttcaccgtcctcggatgcacaccaccgaggcttgaaacgccgccgttttcatatatatgaatgtgagagtcgtctccaagaatcacttcactccctctctcatcacaatggaccaacacgcttatcagattccccattgtccctgacggaacaaacatcgccgcctcttttccagcgatctcagccacctctttctccaaacgcagagccgttggatcgtttcccaaaacgtcgtcgtctacttccgcgtttgccattgctgaacgcattgactctgttggtttagtcaccgtgtcggagcggagatcgacggttctaattgtagttggcgtcaccatcttgatttggctcactgcgttggattataaccaaaacattaaataaaagatcccattagaatgaaactcatctaaataaatataaagtcacttgagttttacttaagcatacctagattctgttctgttaggctatgctttttgttttcttggcgaagagataaaaagagatgtgcttcgggtgactcaaatggttgagagaatgagtgatcaaatcaaatacgaaatgacgacagggaatcttatagaaagaagatcggtccaaccaaataagtgttggatgcattatgacaaattggtaaagtaaggttttcttaacgtttttgcctaatttcttaacttatactgtactagtttccttgtttttcagtctatactttttagttgtatgtaagtaaataattctatgataactatcaaaataaaagttatgatagttaatattaaataaatcaatccaataaacatattaattttttatgatcgcaagaaacaattgttatgttattggtgtaatgttttgtattcttcattttatatattcatattattaaacattattctctatgaattttttatatatatagaaaagttacatagtgtaaattatatattagaccgttgttctagtatattctaatctggttaataatgaacgtttgcgtggcctaatggataaggcgctcgcctccgaagcgggagattgtgggttcgaatcccatcgcgaacgtagttttttgttttcagcaatttgcttatttcgttgaaacttggataacaacattcatatgtggctcttagtcgacgaatatgtatgcgtcggctaatttggaaaatctgatagcggcatcccaataactatactcgtaatttagcaagatgattacatgcataaccactctgacttataagagcgagacatgtatatagtgtagagtgtacatacgtaagcaaacatcaatcaattttgtcttgattggtgatggtatattcattttttatgtagcatctctagatgctttcggataaaggtgatatgaatatgtttacaagaaagagaaagaaaatgatatatttctgaataatgtttttttggataaatcctcaataatgttgtttcgaatctatgatctctacaatattattaaacatatatacctacaaatttagcatctatacgggtaagacgaccattcatatatataagggatcatgaagacaacacaaataagacatccacaaataaattaataagccaacttggtcttaaaaatcaggcatcttattcttaacaaactttagctgatcgattagtatttgcactaaccaaagaaataataatttagtttactaacataattgcatatatatatatattatacaattagtagagtggctataaagcatgccacatgcacattctttaatggacagacatttgaatattgaagagtttatcgtaaactaaatgtcatttgaaaactgctaaaggtcttttattttatatactcacataatcacatcaagaatatgacttattatattcatcgtttttggtcgataataatgattctttacaataaggacatgttgagcatgtttataacttatttaatttgactcgttgaattgttattattttgttaatatgcttagattccacatctaaaataatatctaatgcagatcatatgtaatgcacattaaaggttttacctccgataatttaatattccaattaattaatatgcaatggcagtgtaactaacggcagccgttagttaatggagtcggttgcttgcttagtttttgttctcgaagcttgacttttgaaacagaatgctgtttaacctccttaaacggaatattctcttttttagtactttgattctattcctctatataaacctctctctctctcacgaatcagagatacgaagaaactaacaacaacaagaaaaaaggaatattccgatg

SEQ ID NO: 36824 - DNA, 3 bp, Unknown
  misc_feature (1)..( 3): 2750-1469P.txt file - cDNA_ID_3100599; gDNA_ID_1972105; Annot_ID_178686
gaa

SEQ ID NO: 36825 - DNA, 3000 bp, Unknown
  misc_feature (1)..( 3000): 2750-1469P.txt file - cDNA_ID_3100604; gDNA_ID_2936586; Annot_ID_195116
ttgctgaaacacacaactacgtttgactattcgaatcaaacaattacacactcacatctatattacgacttctctaattacactctctaatcacatatctgaaaagcttcgactaattgctttggaggtttccaacgttcatcatccatgaatgtcctgcaattcaccattacaaattgatgagcaaactcaaaaaaaaaaaaaaaatcgagaaaaaaaagatgacttacgaagagcatcctctgcagaaaatcgccgagaaacatcacgacatatcattttcctcaacaaatccttcgcttccgatgatacagacccaaacttcttcggcggaaacctcaaattccctctcaatatcgattcaaatatatcttccgccgtctcaccgttaaacggcggttctccagctagcatcgtgtatatcactacaccagcgctccatatatcaaccttctcgtcgtacttcctccccatcactacctccggcgccacgtaatacggtgttcccacaactccctccgccgtttctccgcctaaccacaccgctgatccgaaatcacagagcttaacaccgccgcttacgagatcgactaagacgttgtcaggtttcacatcccgatgaacgacgtcgcaccggtgacaatgagcaagcgcactgaggatctgtttcgcgtatgaggcggattctgattctgataacctccccccggcggagattaaccgatcgtaaatcgtcatcggcggatcgactaattccatgacgatcgcaagagaatcctctgtttcgtagagatcgaagatcctgatgatattcggatgcggcggtaacatcgccatgatcctcggctccgtctctatacactcgcgatctaatgcgtcgatgagcacgcgcttgtcaatggttttgcaggcgtagaattctttagtcgcgggtgagaaacagcgagtgattgttccgaatctacctctgccgatctcgtcgcaaagctggtagttgttttccagttcgaattctctggtcatcggaatattccttttttcttgttgttgttagtttcttcgtatctctgattcgtgagagagagagaggtttatatagaggaatagaatcaaagtactaaaaaagagaatattccgtttaaggaggttaaacagcattctgtttcaaaagtcaagcttcgagaacaaaaactaagcaagcaaccgactccattaactaacggctgccgttagttacactgccattgcatattaattaattggaatattaaattatcggaggtaaaacctttaatgtgcattacatatgatctgcattagatattattttagatgtggaatctaagcatattaacaaaataataacaattcaacgagtcaaattaaataagttataaacatgctcaacatgtccttattgtaaagaatcattattatcgaccaaaaacgatgaatataataagtcatattcttgatgtgattatgtgagtatataaaataaaagacctttagcagttttcaaatgacatttagtttacgataaactcttcaatattcaaatgtctgtccattaaagaatgtgcatgtggcatgctttatagccactctactaattgtataatatatatatatatgcaattatgttagtaaactaaattattatttctttggttagtgcaaatactaatcgatcagctaaagtttgttaagaataagatgcctgatttttaagaccaagttggcttattaatttatttgtggatgtcttatttgtgttgtcttcatgatcccttatatatatgaatggtcgtcttacccgtatagatgctaaatttgtaggtatatatgtttaataatattgtagagatcatagattcgaaacaacattattgaggatttatccaaaaaaacattattcagaaatatatcattttctttctctttcttgtaaacatattcatatcacctttatccgaaagcatctagagatgctacataaaaaatgaatataccatcaccaatcaagacaaaattgattgatgtttgcttacgtatgtacactctacactatatacatgtctcgctcttataagtcagagtggttatgcatgtaatcatcttgctaaattacgagtatagttattgggatgccgctatcagattttccaaattagccgacgcatacatattcgtcgactaagagccacatatgaatgttgttatccaagtttcaacgaaataagcaaattgctgaaaacaaaaaactacgttcgcgatgggattcgaacccacaatctcccgcttcggaggcgagcgccttatccattaggccacgcaaacgttcattattaaccagattagaatatactagaacaacggtctaatatataatttacactatgtaacttttctatatatataaaaaattcatagagaataatgtttaataatatgaatatataaaatgaagaatacaaaacattacaccaataacataacaattgtttcttgcgatcataaaaaattaatatgtttattggattgatttatttaatattaactatcataacttttattttgatagttatcatagaattatttacttacatacaactaaaaagtatagactgaaaaacaaggaaactagtacagtataagttaagaaattaggcaaaaacgttaagaaaaccttactttaccaatttgtcataatgcatccaacacttatttggttggaccgatcttctttctataagattccctgtcgtcatttcgtatttgatttgatcactcattctctcaaccatttgagtcacccgaagcacatctctttttatctcttcgccaagaaaacaaaaagcatagcctaacagaacagaatctaggtatgcttaagtaaaactcaagtgactttatatttatttagatgagtttcattctaatgggatcttttatttaatgttttggttataatccaacgcagtgagccaaatcaagatg

SEQ ID NO: 36826 - DNA, 3003 bp, Unknown; identical to SEQ ID NO: 36817
  misc_feature (1)..( 3003): 2750-1469P.txt file - cDNA_ID_3100609; gDNA_ID_2936586; Annot_ID_195113

SEQ ID NO: 36827 - DNA, 3000 bp, Unknown; identical to SEQ ID NO: 36818
  misc_feature (1)..( 3000): 2750-1469P.txt file - cDNA_ID_3100615; gDNA_ID_2936586; Annot_ID_195112

SEQ ID NO: 36828 - DNA, 3003 bp, Unknown; identical to SEQ ID NO: 36820
  misc_feature (1)..( 3003): 2750-1469P.txt file - cDNA_ID_3100620; gDNA_ID_2936586; Annot_ID_195110

SEQ ID NO: 36829 - DNA, 3003 bp, Unknown
  misc_feature (1)..( 3003): 2750-1469P.txt file - cDNA_ID_3100629; gDNA_ID_2936586; Annot_ID_195108
aagaataatgtctcctcttcctccttcttcttctccattcgccttcaaggtatttctctcttttgaatcaagaatcaggaaacaccttgatctctgtatcttctctctctctgggttctgttttgctttctactttatgctctctgttttgatcctctctcgttgacttccatcactatttcttgactcaagaacaaaaccaagacccagcttctcttttgtctcttcttgttttcttcatggtgctttttacttgcatgttcataacgaattcacattaatcagctttgaataacctgttgatgagacaccattttgtttctttttttttgcaggaacaacaaggtagaccacctccaacaacacaacaaaccatagcaggaaaactctttagaactcttttcaagggtcttctcttctcacaactaaccttaatctcacttttggtgatcgttctcaccattcgcggtctcatctcagcaagtacacaccatttccacctcaagaaatggtaccctcctttactagcatctgttgctgtctcaggaattgcatctttagcatggcaatgcatctttatctacaatccatcaagagcagtcaaagcaacgttctggcttagcccaatactcacctgctcggtaggaatcttgcttgttttgattggctcagcggtagatgcaggtataggtgcagtgtttgtccttttcgccattactcagtccctctatggttgctggattactccgaggcttgagtacaccgataaaatattatcacttgccacagcatttccacctgcaagaaccagagaagtagtctgcttatcaatcatagtcagtgtcgtttactctggtttcttggtgactggaattggaggagcaacttccactagaacaaatcttgatatcttgttcatatccgtaatcataataagcttagcatggacgatgcaagttatcaagaatgttcaacaagttgcgatttcacgggcgagatatgtaaactttgcacatggagaagatatggacgcttggaatgctttccgcatcactatgaaacacttgactgggagcatctgcgttggctcgacgcttgttccaatcatcgtattcataagaggatcaataagaagtgttaatctaatgtcagggagcagcgatgaggtcatgtattcaggtgctgattgcttctctaccattgctaacaaactcattacacttggaaacagatggggctttgtacatgttggaacctatgataaaggattcatggaggcttcgagtgatacctggaagaagttcagaagcacaacagggttggagaaactgattgactcggatctcactagctccttctgttttctcagtgctgtttctgttggagctgtctcttcattaactgctgggatatggatgttgttaatacacaaggactatgccctggaagtgactctctatgctttcataattggatattttgtggtaagatagctaattttataaaaatatgaagaagacttttagacaaagtggtttatgttgtgtacctggttttgagtgttttcagggaagggtaggtttggcgtggctacaggcatgtgtattggcttactatgtagcttattctgaagatcctcagagcatgagatttgatggaacaattccacaacgtattcagcgtcttcaaatgttaagtgctcaccgagataacagggagcttgaggtgggtagagacagagaagaagatagttataacaattgttgagtcatgaaggagtctcgctacatacatgtaaagaaaaacaaggattactactttatttcttcaaacttatagattcttctattgataggcaaaaatcttagcttcaatgtgtttatatgtatgccaaaactccaactaaagaaagaatgcacatactttttctctcaacttagcaatatgtcccattatacagtgggacttaagattactgaaattttcaacacttagaaatcttgagtttttagcatactaccaatttacagcaaaaaataactaaatttgttccatatgtgacagaagtatactagtgatcataatcacaatcattatcaacattaagcacaagtacattctaatgattaacgaaaaaacaataatctgaagcaatagaaggaagagaagctactgtacatttggaatcgaatagccgataggggaatccgccgcagattctggagaagaatttgcagttcatcggagagagcctatgattgaagaaatcagacaaaagtttcggaggagagatctcgaaccggaacaaaaagtttatattggtattgaaattaaaatcgattttgggtttggtttagactggtttagagaggaaaagaaaaaaatattcacgcgatggtgattttggagacaagtgcgttgataaaaaaaggcatgatttcagaaggtaaacccctacagaattgctctcacgctctctacgcgcactttgtgcgagtggttctgaaatagagcctcttgattggctaaaaaactctaaaaaaatagcaatagtagacatgttgctagctcttgttattatttagcttttctacaaaacgccgtcgtttctatttcgatcgtttcagcttttgacattgatccgaaccaatcggttcaactggcttagtctatccacaggttcgtataaaaaaatctcattttgtcatcaaattaagcagtaaatttatattaattaatcataagttaatgtttaaagacaaattctatttcaaatttctaacgaatcagacctaattgtccggaataaatgattggttctgaaaatatcaattgggaaattaaaacccggttcaatttgaaaccggaaacaagactagctacgcctggaaactcacacagagtcacaggagaagctcccgcgtctgcaaggaacggataaagtctctctctttctcacacacactctctctctctctctctctctcaaagaagaagaagatg

SEQ ID NO: 36830 - DNA, 3003 bp, Unknown; identical to SEQ ID NO: 36821
  misc_feature (1)..( 3003): 2750-1469P.txt file - cDNA_ID_3100639; gDNA_ID_2936586; Annot_ID_195105

SEQ ID NO: 36831 - DNA, 3003 bp, Unknown
  misc_feature (1)..( 3003): 2750-1469P.txt file - cDNA_ID_3100648; gDNA_ID_2936586; Annot_ID_195103
aaagattgtttctgctaaaaaacaacaaggtgagaaagaatgtctaagatgatataaccttagaggcttagcatcaattatccctgcctaaagcttgagatcctttagaatttctctaaagtgtatgattcagtcgttgaggtaacaaccgccaattcttaaaatgcaggttccaaagaggtgtctaaaaagcgcaaatgagactggtcattatttagagttaaacattaaagaaagcatgagctcacaaaacactatgatccatcgcgagctctgcatgattcaactagcttttccttcttgatgacatatacaacttttatggtctgcagttttttctcatttacaatctcttctttaggtaaaaaaaagtgttatgttgcctaaccaaagaaactcactgtttagttctgttcttcaaatttcatggcatatgtcaaaataaataaaccttttttaatagagttctagagcgtaaagactggatcgaaaaggagcccatcactggtaaattcagccaagagtgatccatcgcatcaatgatttgtaatgttaaacaaaattttaatatttagacttagaagttgtaatttattggtttattttggtcatcatagaagaattatttacatattttatatttttatttatacattgttgctagtttttttggaactatcaaattttacattctttgtttttttttctccaagaagttactgatttgaagaaacctatatctttgtaatgttacatgtactggagactggaagttacttacatatatgactttgaccaacatttctattcggattaaacaaagtataatcctaggttcatcagttccaaatttgtttctaccaattcagaagtgcttcttcttatggttgcataccttgagaagagaaagggaatgttgtgagtaaagcatcttcttaaggtattttttagtttccaggtccgcaagtgagtaaagctcatggtttaatccatgtatgagctgcatctccccacttgagctcttcgaaagctaccctcagcgaatggtgttgaaattgtgtttagatgtaacaggctccaattttgctataatatgcttaacatcgtctaaaactgcaggaccatacatatcagagctcgcagaagcagcagtaggtgacgcattaggaacctattaagaggcaatcaaaacgacaagagagcaataaaagtttgtgaggcatttggaacctattaagagacgacaaaaatgataagagagaacaataacagttttgtcttggccaaagtccacagagtacatgtaaccgagttagaggtaccttgtatgtgcttgtttctgacacaaaaaccgaactaaggggaatgttaaaggccgctgcagcaacctttgtatgcatatccttaacccatttcaacacctccatgtgtcaccaaaacagtcccattggtgcaaacatgaacaagagcaccggaagtatcttaaaatccagattctagatttgcaagcaacggtagtgcaatgctgagatttccaaacaagctttatattattcttttaactttaaagtgaatcctttttctagcaaaatgaggacaaacttttaccaattttcacatttttagaaaaatattcaactcactttgatttcttaagggctcagctgaatctagttttcaatgtctgcagaacaaaatgaaaatgaaaattttattatctcaaaatccattctattttttttttgtgtgacattaatcaatgatttcaaaataaccaaaaacatacaaattttatgtttcattcttattattatcaatttatcatcctcatcctccctcagctcctgaaaactatgtcgttttggaaaatgacgaaaatacccttgtatctgtattgctatgtaaactactgttgtttcaacaaacataaaattttgaaaaagtaataataagaataaaataatttatttcataatctaaaaaaaaacgaataatctaatagattgaaggaggacttaataattagaacaaggttatataattagatatattctttttttttttaaggttatataattagatatattcgtttttttaaaaggttatagaataagatttcattgcatcttaaaaccagacaactttcagaactgaagaatgacgaaaaattaataatagaggaggagaggaggagctacatcaacattatttctattttttcagccaatcagagcgctccggacttcgcccactcgcaccaacctcgcgccacgcgctccattccatgcccactcgcaccaacctcgcgttgaacgcgtgtcgtcgatttctgtaggggtaaacccacaaaatcatgcctattttacatctactcgctttgtttccaaaacagcctcgagtgacttttttcttttgttttttttctcaaaaccgtattaattctaatgcaaaccgaaccaaaattaatttttatttcaaaaccatctaaaccaaacagaaatcacatgtaatttcaaacccgaaccgaaatcaattgtcatttcatcaaaaccatgtaaaaagcttctacgattgttttaacttgcaactgaaaatagcaatcctaatttatcaacagataaagatagatacatgcaacactttacttttttatttttggttttgagaagatgattacagttgtgattttggtggagacaaaaatgtccatctctgtatgttgctagccgatcaaattttacattcaaaatcctttttgataaaaaaaataaaaaaattcaaaatcctttatgatatattgggcctaagatgatttccaaaaaaaagatgatgagaaaagaaagagaacattattgggcttattgttaaattatttcggcccataaaataaagtccaggtcagctcacaatacatgaagaaaaccctagttcaagcgtatataaaccctctcggcgctgccattgaaactctttcaaggagagagctgctactctgcaaccatg

SEQ ID NO: 36832 - DNA, 3003 bp, Unknown; identical to SEQ ID NO: 36831
  misc_feature (1)..( 3003): 2750-1469P.txt file - cDNA_ID_3100648; gDNA_ID_2936586; Annot_ID_143859

SEQ ID NO: 36833 - DNA, 3003 bp, Unknown
  misc_feature (1)..( 3003): 2750-1469P.txt file - cDNA_ID_3100659; gDNA_ID_1620852; Annot_ID_50997
tacctccaatagcctctatttcccttacaaggcgaaaatggcttctgttcaatgtactcttgaatgccatcctttcaagcaagtgcgtcgctccacggaattgaggagtctcataaatagaaccacagtcaacgtataaaccaatggaagctgctggattctgaacaaaatttcactcaaaatcactttccagtagtttttaacaggaagttgatgttgggattactaaaagaagctctcaccggagacatctcagtggctatagtcagaccatttggaagagtagtggtcttaagtttgctaggctcaacatggtcagagagtggtggtggaagagagacaccagccaagggaatgttcatagaaggaagtgaactagagtagcctccacttagccagctggaggaagaagagctcgttgcaacagcactagaacttgcataacgagaagctcgaaaattgtggtttagaatgccctataaacacacacacacacacacacatcctaagcatcattaatctcttgattcaattaacattgtaaaaataagaactttcgaaacagagacatttcataaacctgcaaaaagcatgaataatggcaccagctactataaagcgataaaattgaatcaagatctataagaatctaagagaccctttaatccaaatccaaaaacaatgaatcatacaaattgttcaatactaagcattctcctaaaaaaaccagaatctcaatggaaacaagtgaagtaggacattgaccttaagggccttggctcgagaagctgccgtacggtacatgatgatgactgcgaaaccctagcttggtcagatgagtaccggtgaatgtggctgacgacgggagagagatagaggccgagtcagagctgaaaagaaacgagagaagggaacgattttttttcctaattaaggttattggatcgggcaattgcttctaattacattgataggcccatatgatataatagtcttggcccaaattataacatatagaaaagatgaatttaaagcccatgtattgtagtggtgtgatcctattatattttctctcaattatattttttttcttttctttttcacgtaccattgtgtaaaaattcaagtaaggtaacgacatttacatgcagtcacaaatgaaacaagaatttttttgaggtgtgtgtaaagtgaaacgaaaaaagtactaagaaagtttatcttctctaagttaatagaattattttgaaacgtagtatccacatatatagaagactcgtgtgtggtgcatatatatactgcataacttcaattgaactgtattatataactatgactatccatccatgggaagataagaatgagagccgaatgctaaaaagcaagggacccgaattaaacaaaaatgaataaaggagaaaggtttgtgtgattttgtcaattgtcgtcgtttagtggatgtgtaaaaatactaaatactataacaggtggtgtgggtctatctttttttttttttggtctaatgttaaatgtgggtctatcttaataatgcagaaatagtgcaatacgattcatgagtggaaaaaatcatatttgggtactctcatatatagtctcattaatcattatcaccgagtggggcgtacgatacactttttcttctttatctgttttcatctaatcatcatactgtatgtctatattatcgtagcattcatcatcgagttatgaaacttatgccaaaagaaaagaaaaaaaaatcatttgagattggttaaatttctattttaagatttaaaccaaaatgtttaaagttctataagctctaattaaagtctctgcagtccattaaaatggataattaggatttgccgaacttgaaaggagtaatgcacattttgatgctcacgtgaacaacgagttgtaacggtttcgctataattggaggcagatgagaaatggtcgtgtgtgagttttaataccacgtgattaacggagccacaatcatattcatgggccattctcatgagctataatttgaggtgtagctgagagatggtcaaatgccacgaactttgagtatttctttcttaactttgcatttttttagacgtaagttttttttttcatagcctacatttctttgacaactcataacctacattttgagaatttataaatgtcaatttatcatttaaccttctcacgataatgcaattcctatggtaaatgtcaactcataacagactctacgaagaatctacgacactgtgaaaatctctaatccaatattcaaaagagagttaaaaaaaaaaaaaaaaaacagaagagaacatctttacgatgctgctttcacgattttaaaattttaggtgattttttttggaattttggaattctctttacaaattttatgttgtaaggtagattcaattttaaaaaaaaaaagatatttagattaatacaagttcctaagtcctaactaatcaaagcttccatccctcgtgaagcacgagttggttgaatataaagtctctcaaaaagaaaagaaaaagtggttagtattggcagaaaaaaaaagtggttagtattggatgaaaagagaatttaatgttcgtattcaaaaatgttttatatatactatatagtatatatacaaaatcccaagattaactcattcatattccatcttcatctccatttctcacactcaaaggtgtttcttccttccctttaatgtactccttttttctttctttcacaaaatcgttatattgatttttactagttttatttgaattattgaatttctttatatgataatgaatctatgagaatatgataccattgtttaaagtaatgtcctagtggaagtattatagtcctcagattagattagtttcatcatcatgaaagtgcttgagtagtgtctgttcatggctcttgtgcgtttacagtttctaagaaatgggtactataactttaggttaagaagaaaagatg

SEQ ID NO: 36834 - DNA, 3003 bp, Unknown
  misc_feature (1)..( 3003): 2750-1469P.txt file - cDNA_ID_3100661; gDNA_ID_2214611; Annot_ID_135745
gtggagcatttgtttatacagccatggttaattatccaactgcagctaatttcatggcgccactgcctggttatcccgtagagcaggtgagatattcattcgttaaagtgtgtcatcgagtattttctttttcccgaccgtcattttctcttgcatcagatgtgcaagatcatcgacgggttccctcgaggatccagtaatcttgaccgtgcctttgctgctgcaagcttatactacaactattcgggatcagaaaaatgcttcgagatggaacaacaaactgatgatcatggacttgatggttggcaatatcaggtaaactcatttagaccgtcatttagatatttgaacatattctaatagatttgacgatttgcagtcgctagagcaagaaatggttttatgttatgaaacttaaaacttataaatgacacaaaatgattattgaatggaaacaggcgtgtacagagatggtgatgccaatgagctgctcgaaccagagcatgctccctccgtacgaaaatgactctgaggcattccaagaacaatgcatgactagatacggagtcaagcctcgaccccattggatcaccacagaatttggtggaatggtcagtttttttcttcccctccattggatcagtttcttcggctgtaagattcaatatcctgctctttggtcatcttttgcagaggatagagacagtactgaagagatttggaagcaacatcatattctccaatggaatgcaggacccttggagccgtggagggtaagtggtactacacagtactattcggttttggttcttaaacagatggattattttcatcaaattttcagggttctgaagaacatttcaagtagcatcgttgcgcttgtgaccaagaaaggtaaacacttctgttatgtttatgaatgttggggaaagttagacagagatagatttgagtgaaaaatcgaaacctaacattgttttgtgtggaacaggagctcaccatgcagatctcagggctgctacaaaagatgacccagagtggctgaaagagcagaggaggcaagaggttgccattatagagaaatggatcagtgagtattacagagatttaagagaagagcaatagaggagccaaacaaaagtttattgcactaaaaatcaacaaataaagaaactaggtgtttttgattcggttcgtgtaacaaagtaaaagcttcaccaggaatttgtattccctcaaacaaaataatctgatgtttgtttctctatggagtgaattctgtaactaatatctgattatatcgtggcattcatgaaaatgttatggaacaaagagggtatcatcgcaaatagtcaaaaatgtcacgcgtatttaaaccctaattagacaccgagaacataagtaacgtacgacacattcttcatgaaacaaatgcgaattcaattagattcctattcttcttcttcgctctcttggtccaaatctgttgtcgaggtaggagagttacaagtcccgaaagtgtatcccttctgtgtcaacttgacggagaccatcatgaataaaggttcttgtggcaagtcagatttttgacttcttatcccgtttggcttggacaatctgatcagctatatgttcggacaagacatgatcgtggaattggcttaggagaagttgatagacgtagtttggttcgaagtttctgaagtctagaaagattagtgggtcgggacctcgagaaggattctggtaagatccgagactcgtgacgctaccatccctgtcgtttatgataaattcctcgaagtctctgtctcgactgatcattaccgagtttaagaaacctgacgatgatggagtacgagaccaagcggttacatgaacatcgagtttcattaattcagtatccattgtcgaatttttattcgacaaaatcagagagaaaatatgattcgtggagaattaaagtgtaatgttatgtttttataagcatagatctgattataatttgttctaacttctaacgcgtttatggaatttccttttttgtctccattttttttcttttttcgttcttattttctttttgtttaaattgtttaatattatttgcgggtttacgatgtgtttatagataagatattttataaaacaaagaaaaaaagaaaatctttctaaaaactgtaattaatatttgctataatacaataaaaagtaaagtttggtagtggatcatgctgaaatttaaccttgaaataactaagttaatgaaatttgatcattttataaaaagttaaactaaattttaggatttaagtgttttttcgaaagttcataattttttcgttcaaaatttaaaagttttttttttttttggttcagactatgaatgatcatttgatcgataacttgttttttattgggttttgttggatttctcatagtaatttcattgttcctccttgtctttgcgattgtcctctttgacttcatggtactgaaatcttttttggatctttctattttttggaaattgcttggatagctcccgatcgtttatctttcaatcaaactacggtttcatttttctaagcccaaataatctcgatttccgaaatttcatttcacaaggcttcaaactaactccgaaagatgtggaaaaatttagtgaatacgaaaagatgtgggacgcttcataaataaagatgtgcggcaattttgtaattacgcaaagatgtaggcaattacgtaactacccaaagatgtgaggggatttcgtaaataggggaaaggtatgggataatgtcgtaattaccaaacgatgtgggggtgatagagttactagtgccaatcttggaatagatagtctccctccagttacagtgctctcttttccactatcgccatgattgctcaaacgtgaattgaatgatctgatccataatctaaaaaattgagctttcatcagtaaccgaagcaatggcacggaggtctggaaattgcatg

SEQ ID NO: 36835 - DNA, 3000 bp, Unknown; identical to SEQ ID NO: 4735
  misc_feature (1)..( 3000): 2750-1469P.txt file - cDNA_ID_3100665; gDNA_ID_2926149; Annot_ID_139240

SEQ ID NO: 36836 - DNA, 3000 bp, Unknown; identical to SEQ ID NO: 4735
  misc_feature (1)..( 3000): 2750-1469P.txt file - cDNA_ID_3100665; gDNA_ID_1620725; Annot_ID_49267

SEQ ID NO: 36837 - DNA, 3000 bp, Unknown; identical to SEQ ID NO: 14136
  misc_feature (1)..( 3000): 2750-1469P.txt file - cDNA_ID_3100679; gDNA_ID_2214702; Annot_ID_136889

SEQ ID NO: 36838 - DNA, 3003 bp, Unknown; identical to SEQ ID NO: 28332
  misc_feature (1)..( 3003): 2750-1469P.txt file - cDNA_ID_3100683; gDNA_ID_1971823; Annot_ID_58359

SEQ ID NO: 36839 - DNA, 3003 bp, Unknown; identical to SEQ ID NO: 28332
  misc_feature (1)..( 3003): 2750-1469P.txt file - cDNA_ID_3100683; gDNA_ID_2926152; Annot_ID_139355

SEQ ID NO: 36840 - DNA, 3003 bp, Unknown; identical to SEQ ID NO: 27963
  misc_feature (1)..( 3003): 2750-1469P.txt file - cDNA_ID_3100686; gDNA_ID_1620823; Annot_ID_57821

SEQ ID NO: 36841 - DNA, 3003 bp, Unknown; identical to SEQ ID NO: 28334
  misc_feature (1)..( 3003): 2750-1469P.txt file - cDNA_ID_3100714; gDNA_ID_2214482; Annot_ID_133290

SEQ ID NO: 36842 - DNA, 3003 bp, Unknown; identical to SEQ ID NO: 28335
  misc_feature (1)..( 3003): 2750-1469P.txt file - cDNA_ID_3100721; gDNA_ID_1620666; Annot_ID_48060

SEQ ID NO: 36843 - DNA, 3003 bp, Unknown; identical to SEQ ID NO: 28335
  misc_feature (1)..( 3003): 2750-1469P.txt file - cDNA_ID_3100721; gDNA_ID_2926191; Annot_ID_141034

SEQ ID NO: 36844 - DNA, 3000 bp, Unknown
  misc_feature (1)..( 3000): 2750-1469P.txt file - cDNA_ID_3100726; gDNA_ID_1621153; Annot_ID_56915
gattattagtttaagttgttccttgttactattggaagcctacagatgaatggctaaatgccgatgaagaagatatttaatagtatgcacaacatgcgcatgttatcactcacctccagagcagcttgatcctgaggcgtgccattgagagttgtttcaaactctttgagcctttgctgcaaaatgaaaaaaaatcgagatgtttactacgtatcttactttattcagattatcaaagttcatgaacgaaatcttcatgatcagcccctaatattacctgaagcgtggctttctcttcttctgaaatttgatttttaactactgttgtgttcttagttggactatcactgaaaagtggtaaaaacattgttagaactgacaccggctaaattacatgacaacatgacttggtatgacaaaaatgtgaaattacggaaaccaacccagctgatcctaagaacatatgatgtcatcagaatctttacacaaacaattacaaactggaataaaaagaaggaaaatgacaaacagtaacatggtgtaaatgacacagttatgacttggacttcacttaacgcaccttcccgtgggaagaaagtcaccaagagcaaaaaccaaaccaaatacaacaacagctatgccaactccaacctgtcatggcatgggcccaagttttgtcatgttatgtatgagtagcttataggcctcaagtggttttagaacaaaataaaaaataaacacttgcaagatgttatgtatgcgtaccttagtaccaagaccaattgttttctggtcagacttgactggtgcatcatagtcaattggaccaaattctttaactacttctgtctttttctgctcaagagctgacctgattcatcaaaagagcagaggtcacagaaataacattccgatcagtgggaggacaatgatcttgactatgtctagggggtgagggaagtggaaagcaagacaagtgatgaacaaatcaagaaaaaaaaagaatcaaactttcataggaagatcatgtcgttgtgggtataatgagaaagtcaagtgtgattgtcagaggaataatcctattgtaacctatatatctctaaagccaatcttcatgctagaatcataaaacataggtaccttctgatgttttccagccgttcatcgaagtctatatcaaaagatcgaccagattttccttcaaactgagtattcagaccaggtgcctctgcaaacaaatgcaggagtttcttgagcaaacctttcaattgaaaccaactttttgagataaactgaagaatgcaaaaatgaagttatgttcgagacaccatgaaggagagcagcaacatctgttacgtacaatatgctttaaaatcaaattatacttacttctgggtacagaaacagactgtttagaagatgatttcctgcagcaaagaagtccatatgaaaatataacaacagcaatttaaaattctaaatgctttaaacaaacacaaaaactatttatacctttgctgcaatgccgggtctttctcttcctgtgatgcgatttcacatttttgtctcagtactttgaatcaacaaaattaagttgaacaaagaagaatttggaatcaaaccttttttgagccgaagccacgcttagggttagaatccgagcaacgtattcgaaataggagaagcttcgagttaaatgaaacggaggtcgtcgccgctagtgtcatcaacatcctctgtttgtattgtcctaaccaaaacagagaattttctaagaaagtttcaaagaaataatgagaagtaacggctacgaagagaaattcgtccgccggagattgacgatgaaaggtgagctccgtgatcgggccggtaagataacgttagtggttcttcttcttcttcactttgcagattgtctattatatgggccgaatggcaaaacataattttgggctaggcccatataatattcaaatgttaatattccaaaattgatgggtatttttgataatttaactcgatctatataatttaacaaacgaggatgattttaagtttttaactttttaagtgagaatagtgattaagtgtcaacgactcattggataggatgtgtcataaaattagtattgaaccactgaggagtgaaaataaaattaaaggtagaaaaattaatttaggaaaaaaatattcggaaagttctgtgaaaagtcttcggatttagaacggagacagcgagaggatagagcgcttcttcggctacaacaagctttcgctaatggcggtttccttctgatcactctcaccggagccgtcatcttctctgttttaccgatttttagggtttgtttccggataaactcttcgtatgctttttttttttcgttggattcgtttctggaaacgtatccatttcctgtctagagatcatgtgaatttctcttagaacagaactcagatctaaattaaagtaacggtgcttgattcattaaactcggaatgcaaagtcccttgcgttttattcactgaaatcttagtcgattagatcttgaggtctgtttgttaatcgcacttttctggggaattgatcgtagaagcaattacgctcatgggaaatgatgaaagttatagctaaactttactgtagaaccttactctgattatatttcatttaaaaatgctatttggttggtaaagagaaacatcacaacttttcatacttttctatttttttcagaaattttgattgtggtggaaacttgttgtggcaactctactgagaaagtttgaagaagctggaatcaaagatatagctagagttaagagggttcatactaacttgtgctcgttttgtgatgtgctgttgttaacgtttggaggaaaaagttgtagtgtattaaaattcagcgtccgagttctggggcggagttgccccatagcattgactttacgcctctacacatagtccgaagggctaattcagctcaaaacatgatgatg

SEQ ID NO: 36845 - DNA, 3000 bp, Unknown; identical to SEQ ID NO: 13841
  misc_feature (1)..( 3000): 2750-1469P.txt file - cDNA_ID_3100736; gDNA_ID_2214656; Annot_ID_136501

SEQ ID NO: 36846 - DNA, 3003 bp, Unknown; identical to SEQ ID NO: 27818
  misc_feature (1)..( 3003): 2750-1469P.txt file - cDNA_ID_3100742; gDNA_ID_2926238; Annot_ID_142792

SEQ ID NO: 36847 - DNA, 3003 bp, Unknown; identical to SEQ ID NO: 27818
  misc_feature (1)..( 3003): 2750-1469P.txt file - cDNA_ID_3100742; gDNA_ID_2926206; Annot_ID_141752

SEQ ID NO: 36848 - DNA, 3000 bp, Unknown; identical to SEQ ID NO: 28271
  misc_feature (1)..( 3000): 2750-1469P.txt file - cDNA_ID_3100748; gDNA_ID_2926230; Annot_ID_142617

SEQ ID NO: 36849 - DNA, 3000 bp, Unknown
  misc_feature (1)..( 3000): 2750-1469P.txt file - cDNA_ID_3100758; gDNA_ID_1621127; Annot_ID_56391
caaagctaatgactcggtcgttccggtagacagtcaaccgatctacacatctcttttgtcaatacgtgggagccctttaaggcttttatcactattattcttattataacatgataaaataaaataaacatgatctctctttctttctgtctatttgtttctcttatttctacgtgtgtggactcaaactaaaatttagtttttattatcttctcgaattttaaattataaggtcatgccaaataaggtgacacgtttcttcactatctagttattttagtcatttgacatagcatatcagtttttttttgtttttttcgttggtggttttaatcatcaaactttggcgatgaaaacataaaaaggaaatcaacagtaaaacaaatatcaaatataattatgatactataaatttgtaacattactatatgaacaacataactaattcaccaaccaaattttttttttctttctaataaggtttattatgggcaacacatgttatcacgataaatataatatagactatttggatatgtgttattagttgtattctttttctttcttatttttttttatttttatttttttctatattttcattaactattattttataaggtaaaaatataaatattaaaatacattcgtctgctaaaattatccaatgtaatattgcaattcaaaattaattgtttcagaaaataatctcagtagaatgcgctcttataaccgcatgtagccaaccaatgagcgattccaatgattagtaacactaaatctcttcgacttttctaaatttgttgaacctgtttcgatttctttatccggtttgtatagtaccattttttggttatccttcaacaaatttaacaaaaaaaataaaaaaattgcatttacattatgtagtagtctaataaaatataattatagataatagaaaagtcaatagttctaatatgataacaacaaaagaaaatgtatactttaaaatctgaaaattaccattcttttatttgttatcccaaacataagccatgtactataattaggttattgtaatttattataaaaaaaaaagaaagaatattcctgtacttcatgatttctttttgtaacgaagtacataaaattttcaaatcacatgtggtaaccatgatttaacaaaaaattaagtcggtgacaagcaacgaaacataaataatcgactttgtcaagatatgtataaaaatcgactttgtatttagagaacaaggtcttcattatttttcttttttaacattagagaaagagaactaaaggtctacttcaagaaaacaagaaactaggtgcttagctttaataatatatcaaagaaaaatgggtcaaaaaataaattattacatgagtggggcccggccggccacggaagtaagacctaacgaccagcgcaaccggtcaccagtcaagactattagaagccgggccgtcaaaatcgttgactcggtttttgtttccaactgtttttgtattttgttaaaaataaattaatactaataaataagctgaaaaaaaagaaaagagaaaaggtataatcacgtggaacgcgccgcagtaaacggagcggtggatcaaacttttcgtccgtttgatcaaacagaagagaactagtcaatgctctttcttcatatcacaatttaatagtctcaagacgattacgccacataaccattttctcgtgatttcgacatcaaaatttaataaaaggaactgattgattggtcatcatgttacaagtgtcaaatgagctaatccgttttacagtggcatagtttacgatcaatttacaaatttttggttttataacatacttgtagttaaaactatttataagctatttatagtgagttagcttataaaaccctattcttttatctaaaattatgttttgactcgtttcatgataaaattttatccttttcatcggaataaaaaactttattatttatttggcaaaataattggtgtaaaaattatgtatatgttaataacaaaaaatattaatctgattcataatcttaaaaaagaaaaatttcttgaaataaactttagacattgtaaataaaaaaacattatttttatataatgggatgtttatatgtaattttttataaaaaaataaaagttgtttactagtaatccgattggctttaactatcgtcgccaaaagaataatgtagaactgactttgaggtaaaactaaaagaaatttgtaagataatagtcacattaaatgctaaaattaatacatactgatatatcgtataaaatttatgaaaactacaccttaacctgaatcatacactgtaataaaaaaaacaaattatatataaaccctaaaaactaatcataaatcccaaacggtgtactctctattagctttgaaaggattgcccaattgtttgttaaaaatttctaataatagtacaatgttttgtttcatttttccttttcgtcaacctgttacccaatagcaaatgaagtttttatgtgtgtgtgtgtgtgtgaatttccatgaaaatgaaacgggcttagaatcccggtgtattatgggtcgggtcgtaaccgggcaatgacgcaggatctgacgtaaaactcccaagaatttttttaaaaagtctccggaaaataaaatcaaagttcattaacttaaaaagaaaaaacaaaatcggtccacgtcccaaaccctttttataggagagtcttatgttctggcagaagacttcacagactctttcttaatctctctctctttcaaccaaacccctaaacaaaaaaaaaatacattttctgatctctctaaaaatctttctccttcgttaatctcgtgatctctttctttttctatatatggacagaggatggtctggtctcactcttgattcatcttctcttgatcttttaaaccctaatcgtatttctcataagaatcaccgacgtttctcaaatcctttggcgatg

SEQ ID NO: 36850 - DNA, 3000 bp, Unknown; identical to SEQ ID NO: 5721
  misc_feature (1)..( 3000): 2750-1469P.txt file - cDNA_ID_3100768; gDNA_ID_1620813; Annot_ID_50610

SEQ ID NO: 36851 - DNA, 3000 bp, Unknown
  misc_feature (1)..( 3000): 2750-1469P.txt file - cDNA_ID_3100772; gDNA_ID_2926240; Annot_ID_142870
gtcaaatcaccatttcatcttttccttttcactttattcagttttctattatagaacatttaacttgaaaaaaactttagcagtcgttcaacctgagaccagcagatgcctcagggagaccaaactttcaagtagctgttcccaaaaccaacttgaaggtggctgcaattctagagaaagccaacactcttcgccaggtctctccctctctccttcttggttaaatttggacacttgatataataatctgttgcacaaagaaaaagatataataatcttggggatcgataaagtggttttgtgacatacatataaataggcaatggcgggaagtgacgacgagcacgattcagatagctggagcgagtgagtcgttgaatcaaatctgcaggtaacaaacatatagatcacactctgtatagaagaattctcacattgtatgtattctcacaagtaatgtttttattgctgtatttttgacacattgtaagtcactctgtttttttcccctttatatgtacacccaattttaccctcttttaaagggaatcaatccagttgatgtttcagcatatttgcatgtttgatcttttcacataaacaaatactttacataagtaaaagtaagtgttataggacttgtaatttacatcaagatacattttaaattcaaccttcatcagtgcatatgcacaaatcaacaagtatgataaatactgatagtagatgaaaaacgatgttggagagcaaagtatttttaaaagtcaagaaacgctaagtttttgttatgacttctctgatttgttcaaactttttgaaatttgaagtgtgaactggaatgctactagtcgtcgttggaatatttagccacgtagtgtatgtctgagtctccttgaacaatcgtttccaagttgaaaaaagaaaagaagtgataataaaaagtcaagtctaagagttgaattgtcatcaaagtacgattagtggaagtggtacggtatacgtgtaaacgatcctaggaatattccgtacgatatccggcctaacacggtcaagagtcataacgtctcgtgaattctgtacttttttgtgcctggtagagttgacacgtctcttactatgacgacgttctgtttcgcaaagggtagtttggtcatttcaaaaaaatagccgtagtttggagtcgtccaaatcccaccgtcgccggctatactcgttatcctaattatatacgctctctgttttctaattggtgaaaaaagctttgtttaaactctttttttttataggagttcaattgtagttgcgctggagatgagtcggattcaattttgaaaggattttggcattgaagtttctataaaactccttgtttgaacttggaaattcactaaatctgttgaccaaaaaaagattattagcaaatgttttaggtgtttggcatataacttttctctaactttaagactaatatttaatcatgacgtaacttgattcaaatttggatttacagctaaaagaaataacacatctcatgagtcctcctttttagctgatttctattgctgttgtagaaccccatgataactcaggtttcctcttacacgtctgtttcaatatcaattttgttttagactaaaccatcttcttctttctttcctttttctctttcctgtccacgttagtttccagaatttggtatttgtagtatgtgttgaaaaatggtttgttttggagaaacggccagaaatattctagaaattcacagccttgttttcttatttgatgataacacgtattataacgctataagacacatgtatgcgtgacagaaagattattaaatatgaaattgtgcgtactgatatatatcatgccccttataataaaacttataaagaattggatcgttacctagaatagttttaggttattataagtacggtcacacaccttggagtttgaaataatatttcccagtctacatttactgttttgtctttgctgcgcactctcgttgtccattcaataatatttttgttggtttgtcaacttgtccatacaataattattttatctgacttttaactccttttcttttcttttctttttcatatgtataattaagctaaaaaatataatcaaaaattaggtcgggacaaaagaaaaggcacttactggttttttacaattatgtggttgtgacataatacacacagaaaactaataaaacgtgaaaaagaaaagttttagatatggaatatatcattggcaatggagaatcactagttttttttaaaaaaagttgggagacaagaataagattacacatttgatgaaaaagaacatatatctcccgaatattttcttggtcggcttgtctaattttttttttttttttatttacatgatatcaagtatatgttttgtgaagacgtcaaaagagtatttgtaaagattagatggtgttggaaaataagtaaaataatttagccgattattaaaggttaagaatataataattaaagtagaatggaggaaaagataaaaaggatatttaatgagagggaggtaagaaagataagagaggttctttcaatctatcgtactgtccgcactcgaatctgtccttcctcgcatgcttactccaccatatacttctactaccaatggcctaacttgttgattgcgacttctctcttccttttacctttttgcccctcccgtccttccccgtacggttctctttctttattttatttaccttttaccaaagttacacttctacccctatttttcttcaataagagatggaagagcaagggcaattaagtaatttgacaatatccttctccttcaagactctctctctcccacagaaaacaaactgtttgttgttaataactgtgggttttttccaaaatcctcaaagagagactatacttctctcggatccttcctgatttcaaaatttcttcaacccaccagcagcagcagcagatg

SEQ ID NO: 36852 - DNA, 3000 bp, Unknown; identical to SEQ ID NO: 5560
  misc_feature (1)..( 3000): 2750-1469P.txt file - cDNA_ID_3100778; gDNA_ID_1620803; Annot_ID_50512

SEQ ID NO: 36853 - DNA, 3003 bp, Unknown; identical to SEQ ID NO: 35460
  misc_feature (1)..( 3003): 2750-1469P.txt file - cDNA_ID_3100788; gDNA_ID_2926123; Annot_ID_138623

SEQ ID NO: 36854 - DNA, 3000 bp, Unknown; identical to SEQ ID NO: 11425
  misc_feature (1)..( 3000): 2750-1469P.txt file - cDNA_ID_3100792; gDNA_ID_2214495; Annot_ID_133558

SEQ ID NO: 36855 - DNA, 572 bp, Unknown; identical to SEQ ID NO: 15284
  misc_feature (1)..( 572): 2750-1469P.txt file - cDNA_ID_3100800; gDNA_ID_2926123; Annot_ID_138622

SEQ ID NO: 36856 - DNA, 3003 bp, Unknown; identical to SEQ ID NO: 27472
  misc_feature (1)..( 3003): 2750-1469P.txt file - cDNA_ID_3100805; gDNA_ID_1621103; Annot_ID_55932

SEQ ID NO: 36857 - DNA, 3003 bp, Unknown; identical to SEQ ID NO: 27477
  misc_feature (1)..( 3003): 2750-1469P.txt file - cDNA_ID_3100809; gDNA_ID_2926232; Annot_ID_142679

SEQ ID NO: 36858 - DNA, 3000 bp, Unknown; identical to SEQ ID NO: 4851
  misc_feature (1)..( 3000): 2750-1469P.txt file - cDNA_ID_3100820; gDNA_ID_1620736; Annot_ID_49494

SEQ ID NO: 36859 - DNA, 3000 bp, Unknown; identical to SEQ ID NO: 4851
  misc_feature (1)..( 3000): 2750-1469P.txt file - cDNA_ID_3100820; gDNA_ID_2926157; Annot_ID_139568

SEQ ID NO: 36860 - DNA, 3000 bp, Unknown; identical to SEQ ID NO: 6487
  misc_feature (1)..( 3000): 2750-1469P.txt file - cDNA_ID_3100843; gDNA_ID_1621095; Annot_ID_55635

SEQ ID NO: 36861 - DNA, 3000 bp, Unknown; identical to SEQ ID NO: 6487
  misc_feature (1)..( 3000): 2750-1469P.txt file - cDNA_ID_3100843; gDNA_ID_2926162; Annot_ID_139780

SEQ ID NO: 36862 - DNA, 3003 bp, Unknown
  misc_feature (1)..( 3003): 2750-1469P.txt file - cDNA_ID_3100848; gDNA_ID_2214479; Annot_ID_133209
taatgtcaccttatcatcaccagaggaggcttattacccgaacaagcctcttctttcattgaaccaagatctatcaccctatattttggagaacatgtatgtgggcttctcagcctcaacggggtctgttagagcaatgcattacatgttgagttggtttgtacatggcggcgttgatgttccaaacctggacttgggaataccaacatttcctccatatcccaaggaaaaatctctggtttatcggattgttttggtgaccagcttggcattggttctctttgttgcgcttgttgcatcagctttaagtatctttttctacaggagacataaaaaggttaaagaggttctagaggaatgggagatccaatgtgggcctcataggtttgcttacaaagaactctttaaagccacaaaaggtttcaaacaacttctaggcaaaggagggtttggtcaggtctttaagggtacacttccaggttctgatgcagagattgccgttaaacgaatttcacatgattcaaaacaaggaatgcaggaattcttggctgagatatcgacaattggtcggcttagacaccagaacctagtcaggcttcagggttattgtaggtacaaggaggaactctacttggtttatgactttatgcccaatggaagtcttgacaagtacctctaccacagagcgaatcaagagcaactcacttggaatcaacgtttcaagatcatcaaagacatagcctctgcactctgctatttgcatcatgaatgggtacaagttgtaattcatcgagacatcaagccggcaaatgtcctgattgaccaccaaatgaatgcaaggctcggggattttgggttggctaagttgtacgatcagggttatgatcctcagacatctagagttgctgggacattctggtacattgcaccggagctcataagaagcggaagagcaaccacagggacagacgtctatgccttcgggctgtttatgctagaagtctcttgcggtaggaggctgatagagcgaagaacagcctccgacgaggtcgtcctagctgaatggacattaaagtgctgggaaaacggagatattctcgaggcagtcaatgatggaatccgtcacgaagacaatagagaacagctcgagcttgttttgaaattgggagtgttgtgttcgcaccaggctgtagcaattaggccagacatgtctaaggtggtccagatcttgggtggtgatctgcagcttccagataatctactcgatatagtcaaagcagagaaggtcagaatgtggtctgagacatctgagagtgtacttggtgttttgacatcacaagggtccattggtaccttgacgttaacggaaccttttacctcccggggacgctgagacgtgatgctgagttcggtcgtgaaatgatatatgacatgtttgtttgtaaatattttatgttttcgattgatgacaaaggagtcagaaaggacacttgaccatcacggaagcgatgacttccgtcggacggtaaaaagtgatggtcgaggtttggtgagaaatctaaaaatgtgacggtgtttgcttgataaatatctttattttggtgattgtattgaatgtatcgttttgatttctgtttatacttatatcggcggtggaataattacacatgacctgaaaagtatgcgtttgtgtttacttttatgttgtagtacttgttgtgtttttcagctatgaaaagtctacatatttcttctgtgtgctaacttattggataaattggatatttttaagagatctaatgtttacacaaacgtatggtgaacaccaatggggatgtttacacacacttatgatttatgactgaaagagatgttaatcgaagtatatactccattgattaatgttaatcaccgaaagagatgttaaacaagcattaatgtttacacttaaatgtgatggaacgaaaacaaagaataagtttaaatttgttgtcatggtctcaatgaaaaaccgaaaacgttgtgctatcaaattactcaaaacgttgagctagctaaacttggcagaaaagtatcgaatgatgctaaaatgcaaaaaaccattaaacccaatgtacggtttatagagttttcatatgccaagtgggacatccacgtggagatcctatgccacttgtcccctctctgtctctttcatgcttcaaacttatttggcttttacgtggattctcacgcccgagtacgtcgattattacaaaactcacataaattaatataaacactttatattttgttttgacctttttaccccttctcattgctcatcaattttcatagatctaataccaaattatcacacatataggagagtcatctaacaattagcacaagtcatgagtgaaagagactaagcatgaatcataatcatctttgacataggtgctcaaaagtaatcaattttttcaactttactattcaactcaataaaagaatttttaatcaacaattcttttcaagatgtatcccttttttttcttgcaactttttctcaactatattaatatttagtatactgctacttagctactcgatgttttgatgtatcattgatcattattgttgactaataattatttgatacaaatattttaccgacatatgtaagaacaatagtgtcaaaattgaagcatctcaagggtattttagaacagatacccaatttatttatttttataatttgtcaccttgtttttcacacacaaatgacaatatgacgtcattttccttattagaataatttttttaacaaaaaaaagaattatttattttcgtctctcttattgcttgctacgctcaacgctgtgcataagcattctctttctgtggacgaaactaaacctgagagaaaaagccagaagaaccaaactcagaccgagagatagagattgagggagagctctagctctgtagaaaagaaggattcattcatcatatccagaaatg

SEQ ID NO: 36863 - DNA, 3013 bp, Unknown
  misc_feature (1)..( 3013): 2750-1469P.txt file - cDNA_ID_3100853; gDNA_ID_2214624; Annot_ID_135931
  misc_feature (3003)..(3003): n is a, c, g, or t
  misc_feature (3006)..(3006): n is a, c, g, or t
  misc_feature (3011)..(3011): n is a, c, g, or t
ccaattggtagagaatgtaggactaatgataagagaggaagtttactacttatatagattttaattgcttcttactctttttcctaatcaattcctttgtctttattttttattttcacaaaaagtaatttaatttgtctttttcgtatattctgattggttgttcttttcttttattgctaaaatatattttcttttaacataattaatgattttcaattatgttttagtcaaacccgaaagaaaaaggaaacaaattttttatatttccattcatgctaaaaagaaatgaaagtgtcacgaggtccgacccaaaggtcatacatgctaagcagcttatggttacttattcattttatgctttgcttatcaccaattttgttttatgattatggtaccaaatttgtttttactaaatagttgttgttcataaatatctgatactattttttaattaatgtgtggttgacaaaaaaaataatagaaaaaggtcatgtaaccgttttttttattcggacaactatttttattggaccggccatgcgtataacttccctatttggcaagttttggtctaccattctatcccaaataacaaaacttgggttttatggtctggtctacaactcacaaatcacaagcatagacaaatccgatcatgtggcaaattcaagcttcagattgttgttgccacacaccaagttaatttgttgatttttaaatttaaatttgttttcttttcgcttcttaactatttctttttggttgtcttttttcggaactattacttaattattactactactacacatttggatttgaagcactccataacctaaatcaggttttgtttttcattcactacatgaaattataaaacagagaaatgttttgtatggatttatattgcgtttgggataggtcggaattggttatataggatggaagaagctgatcgaatattcgaactagaggttaagaagcaacatgaaaacaagaaaccctaaattttgtttgtttgatatattggcttacctcgattaaatctgcatgatagcattgattcaacacattaattttaagcaacaaatctcgaactggtttcagataattaagaaagaacataaactagtttatggatccttttattaactctcaaaggtcaaagcagttgaataaaaaatttaactctaaacaacttattccctacccaaaaaaaaactctaaacaacttattgataagacacgaaaagaattgtaaaacccctaaaattcaattttgattttcataattcttaagtttttttttttagttaaagagataattctaagacttgtaaatactaattttaataaaacttgattgacacggaaatagagctacaaagtccacaataaacagagattaatcacaaatcatagctattctgttcgttgacataaaagcgaaattaaatcgaaaaaactatataggacaaaacgaaaaaaaaaaaatgttgaaaatatcctgaaatctactgcaaataagaaagaaaaaaaaaaagaaaaaacttttattgctctttttttacctctcaacgcaattgaataaaattttaatcctgaacaactaaattcacaagaaacacgaaagaattgtaagaaccctatgtagaattaagactttgattatagatgcaagattataaaagactattcttttattccttcgaaaacttactcaaaacccaagttcttacaatctcttaatctctctctcaaccatctaaggttttccacaacttggaaactcatatatttagagactaacatatccaaaacttactaggattgtaattagataactccaaacttttttttttccgctagataactcctaacttatcctttagatatctcctaaagatttaatataatcctatttaaactaaatcacttatatctcaagttattaccaagcttagtccaagaccctaaaactcaaatttgattttaataattctaagttgcaaactcatgacacggtaatagagatatagtccgaatacacagagattggtcacacagctgagccggagtcggcagtggagctacaacaacaacaggatccagccggagccggtgacggaactggagctggaaccgagttggatccggtgctggagtcggggctggagcaggagccagtgctagatccagacaatccagcgtcgtcctgacggagaccattgagtctagttgcaacaaaagctggagctgaagttggagcaggagtaggaacagcggaagacaaagctgaagcttgacaatccagggtcttcctctctgtgactgagttcctcctgcttctctttctccttggaacatcatcaaatattctccggcatctctcacgatccattctccgcgtacacctagctgactctgacaaaagaaagtgttgtttgctccacaaggaacagataataagaaatagattgactagggtgaatgagagaggagattatatatgttttctgttttgtaaatagttttttttcttatttattctttctctcagtcctaatttttaggcttttatttcttttatttacaaaagtatatcagtgattctaaatgtaatatttaagataagttcactaccattagtccgttaccgacttaccgtcctgtgttattagcgaaaaaaaacaaaaaaaaacatttttgagttacaacaacaatatgttcatgacgtgtcattttcttatttgatagtttttagtctacgattctatcccaaataacaaaacagaggtttctatagggttttaagtgttttgtttttgctgctggggaagaagaagaagcagtggcaaatacagttctgttgctgggtttgttgattttttagtcaattctttttttttttcttggcgatttaattttggaattgaacttgaaaaatctcattgggttttcgattaatttaatcttgttcattttgtttcaggaggaatgatntcntdktnag

SEQ ID NO: 36864 - DNA, 3 bp, Unknown
  misc_feature (1)..( 3): Matrix.001 file - promoters75/1007152
tct

SEQ ID NO: 36865 - DNA, 9 bp, Unknown
  misc_feature (1)..( 9): Matrix.001 file - promoters75/1007152
attttgatt

SEQ ID NO: 36866 - DNA, 8 bp, Unknown
  misc_feature (1)..( 8): Matrix.001 file - promoters75/1007273
aaagaacc

SEQ ID NO: 36867 - DNA, 7 bp, Unknown
  misc_feature (1)..( 7): Matrix.001 file - promoters75/1007273
agattac

SEQ ID NO: 36868 - DNA, 12 bp, Unknown
  misc_feature (1)..( 12): Matrix.001 file - promoters75/1007370
caaaaatttaca

SEQ ID NO: 36869 - DNA, 8 bp, Unknown
  misc_feature (1)..( 8): Matrix.001 file - promoters75/1007967
attcttaa

SEQ ID NO: 36870 - DNA, 9 bp, Unknown
  misc_feature (1)..( 9): Matrix.001 file - promoters75/1007967
aatttgaac

SEQ ID NO: 36871 - DNA, 10 bp, Unknown
  misc_feature (1)..( 10): Matrix.001 file - promoters75/1008148
atatgtgaaa

SEQ ID NO: 36872 - DNA, 8 bp, Unknown
  misc_feature (1)..( 8): Matrix.001 file - promoters75/1008218
atttattt

SEQ ID NO: 36873 - DNA, 9 bp, Unknown
  misc_feature (1)..( 9): Matrix.001 file - promoters75/1008218
catttaatt

SEQ ID NO: 36874 - DNA, 8 bp, Unknown
  misc_feature (1)..( 8): Matrix.001 file - promoters75/1008218
gtatagtt

SEQ ID NO: 36875 - DNA, 10 bp, Unknown
  misc_feature (1)..( 10): Matrix.001 file - promoters75/1008218
cttaaatcaa

SEQ ID NO: 36876 - DNA, 8 bp, Unknown
  misc_feature (1)..( 8): Matrix.001 file - promoters75/1008218
tagtattt

SEQ ID NO: 36877 - DNA, 10 bp, Unknown
  misc_feature (1)..( 10): Matrix.001 file - promoters75/1008218
atatttcttg

SEQ ID NO: 36878 - DNA, 10 bp, Unknown
  misc_feature (1)..( 10): Matrix.001 file - promoters75/1008443
ataaaaaatt

SEQ ID NO: 36879 - DNA, 12 bp, Unknown
  misc_feature (1)..( 12): Matrix.001 file - promoters75/1008443
acaaaaaaaata

SEQ ID NO: 36880 - DNA, 9 bp, Unknown
  misc_feature (1)..( 9): Matrix.001 file - promoters75/1008732
agtagtttc

SEQ ID NO: 36881 - DNA, 9 bp, Unknown
  misc_feature (1)..( 9): Matrix.001 file - promoters75/1008732
aaatttgtt

SEQ ID NO: 36882 - DNA, 8 bp, Unknown
  misc_feature (1)..( 8): Matrix.001 file - promoters75/1008732
acatatta

SEQ ID NO: 36883 - DNA, 11 bp, Unknown
  misc_feature (1)..( 11): Matrix.001 file - promoters75/1008732
tttttattcta

SEQ ID NO: 36884 - DNA, 9 bp, Unknown
  misc_feature (1)..( 9): Matrix.001 file - promoters75/1008732
aatactttt

SEQ ID NO: 36885 - DNA, 8 bp, Unknown
  misc_feature (1)..( 8): Matrix.001 file - promoters75/1008732
ataatatt

SEQ ID NO: 36886 - DNA, 8 bp, Unknown
  misc_feature (1)..( 8): Matrix.001 file - promoters75/1008732
ttacttca

SEQ ID NO: 36887 - DNA, 6 bp, Unknown
  misc_feature (1)..( 6): Matrix.001 file - promoters75/1008732
atatag

SEQ ID NO: 36888 - DNA, 13 bp, Unknown
  misc_feature (1)..( 13): Matrix.001 file - promoters75/1008732
aaataaataaaaa

SEQ ID NO: 36889 - DNA, 7 bp, Unknown
  misc_feature (1)..( 7): Matrix.001 file - promoters75/1008808
cgaagaa

SEQ ID NO: 36890 - DNA, 8 bp, Unknown
  misc_feature (1)..( 8): Matrix.001 file - promoters75/1008808
acttcctt

SEQ ID NO: 36891 - DNA, 7 bp, Unknown
  misc_feature (1)..( 7): Matrix.001 file - promoters75/1008808
gtttgaa

SEQ ID NO: 36892 - DNA, 9 bp, Unknown
  misc_feature (1)..( 9): Matrix.001 file - promoters75/1008808
aaatgatta

SEQ ID NO: 36893 - DNA, 7 bp, Unknown
  misc_feature (1)..( 7): Matrix.001 file - promoters75/1008808
aatattg

SEQ ID NO: 36894 - DNA, 5 bp, Unknown
  misc_feature (1)..( 5): Matrix.001 file - promoters75/1009030
tattt

SEQ ID NO: 36895 - DNA, 8 bp, Unknown
  misc_feature (1)..( 8): Matrix.001 file - promoters75/1009211
ttcattac

SEQ ID NO: 36896 - DNA, 7 bp, Unknown
  misc_feature (1)..( 7): Matrix.001 file - promoters75/1009941
ttttgaa

SEQ ID NO: 36897 - DNA, 7 bp, Unknown
  misc_feature (1)..( 7): Matrix.001 file - promoters75/1009941
cctaaat

SEQ ID NO: 36898 - DNA, 8 bp, Unknown
  misc_feature (1)..( 8): Matrix.001 file - promoters75/1009941
tcaatttc

SEQ ID NO: 36899 - DNA, 10 bp, Unknown
  misc_feature (1)..( 10): Matrix.001 file - promoters75/1009941
ttttcttctc

SEQ ID NO: 36900 - DNA, 9 bp, Unknown
  misc_feature (1)..( 9): Matrix.001 file - promoters75/1009941
acaataaaa

SEQ ID NO: 36901 - DNA, 11 bp, Unknown
  misc_feature (1)..( 11): Matrix.001 file - promoters75/1010094
ggaagaaaaaa

SEQ ID NO: 36902 - DNA, 8 bp, Unknown
  misc_feature (1)..( 8): Matrix.001 file - promoters75/1010094
atataaaa

SEQ ID NO: 36903 - DNA, 8 bp, Unknown
  misc_feature (1)..( 8): Matrix.001 file - promoters75/1010094
ctttctac

SEQ ID NO: 36904 - DNA, 10 bp, Unknown
  misc_feature (1)..( 10): Matrix.001 file - promoters75/1010094
ataataaaaa

SEQ ID NO: 36905 - DNA, 8 bp, Unknown
  misc_feature (1)..( 8): Matrix.001 file - promoters75/1010367
ttaaaaaa

SEQ ID NO: 36906 - DNA, 8 bp, Unknown
  misc_feature (1)..( 8): Matrix.001 file - promoters75/1010367
aaaccaat

SEQ ID NO: 36907 - DNA, 7 bp, Unknown
  misc_feature (1)..( 7): Matrix.001 file - promoters75/1010367
taacaaa

SEQ ID NO: 36908 - DNA, 7 bp, Unknown
  misc_feature (1)..( 7): Matrix.001 file - promoters75/1010367
tcttttt

SEQ ID NO: 36909 - DNA, 8 bp, Unknown
  misc_feature (1)..( 8): Matrix.001 file - promoters75/1010385
gctttttg

SEQ ID NO: 36910 - DNA, 10 bp, Unknown
  misc_feature (1)..( 10): Matrix.001 file - promoters75/1010435
aatctgaatc

SEQ ID NO: 36911 - DNA, 9 bp, Unknown
  misc_feature (1)..( 9): Matrix.001 file - promoters75/1010819
atttttggt

SEQ ID NO: 36912 - DNA, 9 bp, Unknown
  misc_feature (1)..( 9): Matrix.001 file - promoters75/1011923
ttgttgttt

SEQ ID NO: 36913 - DNA, 11 bp, Unknown
  misc_feature (1)..( 11): Matrix.001 file - promoters75/1011923
atcttcatgtt

SEQ ID NO: 36914 - DNA, 7 bp, Unknown
  misc_feature (1)..( 7): Matrix.001 file - promoters75/1011972
gcataat

SEQ ID NO: 36915 - DNA, 7 bp, Unknown
  misc_feature (1)..( 7): Matrix.001 file - promoters75/1011972
tttaaag

SEQ ID NO: 36916 - DNA, 9 bp, Unknown
  misc_feature (1)..( 9): Matrix.001 file - promoters75/1011972
ttctgctaa

SEQ ID NO: 36917 - DNA, 9 bp, Unknown
  misc_feature (1)..( 9): Matrix.001 file - promoters75/1011972
ctatataaa

SEQ ID NO: 36918 - DNA, 9 bp, Unknown
  misc_feature (1)..( 9): Matrix.001 file - promoters75/1011972
atctacata

SEQ ID NO: 36919 - DNA, 8 bp, Unknown
  misc_feature (1)..( 8): Matrix.001 file - promoters75/1012003
cagagaga

SEQ ID NO: 36920 - DNA, 8 bp, Unknown
  misc_feature (1)..( 8): Matrix.001 file - promoters75/1012074
agtgttca

SEQ ID NO: 36921 - DNA, 10 bp, Unknown
  misc_feature (1)..( 10): Matrix.001 file - promoters75/1012074
ttttaataag

SEQ ID NO: 36922 - DNA, 11 bp, Unknown
  misc_feature (1)..( 11): Matrix.001 file - promoters75/1012110
ccataattaag

SEQ ID NO: 36923 - DNA, 12 bp, Unknown
  misc_feature (1)..( 12): Matrix.001 file - promoters75/1012128
tcaaagaccaca

SEQ ID NO: 36924 - DNA, 12 bp, Unknown
  misc_feature (1)..( 12): Matrix.001 file - promoters75/1012128
attcaaaaagca

SEQ ID NO: 36925 - DNA, 5 bp, Unknown
  misc_feature (1)..( 5): Matrix.001 file - promoters75/1012128
aatat

SEQ ID NO: 36926 - DNA, 10 bp, Unknown
  misc_feature (1)..( 10): Matrix.001 file - promoters75/1012128
catttaattt

SEQ ID NO: 36927 - DNA, 8 bp, Unknown
  misc_feature (1)..( 8): Matrix.001 file - promoters75/1012334
gtttttct

SEQ ID NO: 36928 - DNA, 12 bp, Unknown
  misc_feature (1)..( 12): Matrix.001 file - promoters75/1012349
caaaaatttaca

SEQ ID NO: 36929 - DNA, 9 bp, Unknown
  misc_feature (1)..( 9): Matrix.001 file - promoters75/1012673
tatcatttt

SEQ ID NO: 36930 - DNA, 11 bp, Unknown
  misc_feature (1)..( 11): Matrix.001 file - promoters75/1012757
tgtttgaacat

SEQ ID NO: 36931 - DNA, 8 bp, Unknown
  misc_feature (1)..( 8): Matrix.001 file - promoters75/1012757
caacgaaa

SEQ ID NO: 36932 - DNA, 7 bp, Unknown
  misc_feature (1)..( 7): Matrix.001 file - promoters75/1013128
gaaattg

SEQ ID NO: 36933 - DNA, 9 bp, Unknown
  misc_feature (1)..( 9): Matrix.001 file - promoters75/1013128
aaaaaaaag

SEQ ID NO: 36934 - DNA, 11 bp, Unknown
  misc_feature (1)..( 11): Matrix.001 file - promoters75/1013208
aaagtaattta

SEQ ID NO: 36935 - DNA, 11 bp, Unknown
  misc_feature (1)..( 11): Matrix.001 file - promoters75/1013208
tttttattcta

SEQ ID NO: 36936 - DNA, 8 bp, Unknown
  misc_feature (1)..( 8): Matrix.001 file - promoters75/1013384
aaaacaga

SEQ ID NO: 36937 - DNA, 15 bp, Unknown
  misc_feature (1)..( 15): Matrix.001 file - promoters75/1013540
acagagacaataaaa

SEQ ID NO: 36938 - DNA, 11 bp, Unknown
  misc_feature (1)..( 11): Matrix.001 file - promoters75/1013893
aagaaaattga

SEQ ID NO: 36939 - DNA, 11 bp, Unknown
  misc_feature (1)..( 11): Matrix.001 file - promoters75/1013893
aaatttctctt

SEQ ID NO: 36940 - DNA, 9 bp, Unknown
  misc_feature (1)..( 9): Matrix.001 file - promoters75/1013904
ttagtaatt

SEQ ID NO: 36941 - DNA, 8 bp, Unknown
  misc_feature (1)..( 8): Matrix.001 file - promoters75/1013904
aattatat

SEQ ID NO: 36942 - DNA, 10 bp, Unknown
  misc_feature (1)..( 10): Matrix.001 file - promoters75/1013904
tgataaaatt

SEQ ID NO: 36943 - DNA, 7 bp, Unknown
  misc_feature (1)..( 7): Matrix.001 file - promoters75/1013904
aataaaa

SEQ ID NO: 36944 - DNA, 8 bp, Unknown
  misc_feature (1)..( 8): Matrix.001 file - promoters75/1013904
gtttaggt

SEQ ID NO: 36945 - DNA, 11 bp, Unknown
  misc_feature (1)..( 11): Matrix.001 file - promoters75/1013904
aagaaaaaaat

SEQ ID NO: 36946 - DNA, 8 bp, Unknown
  misc_feature (1)..( 8): Matrix.001 file - promoters75/1013904
ttaataat

SEQ ID NO: 36947 - DNA, 7 bp, Unknown
  misc_feature (1)..( 7): Matrix.001 file - promoters75/1013904
taataat

SEQ ID NO: 36948 - DNA, 8 bp, Unknown
  misc_feature (1)..( 8): Matrix.001 file - promoters75/1013904
caatattt

SEQ ID NO: 36949 - DNA, 7 bp, Unknown
  misc_feature (1)..( 7): Matrix.001 file - promoters75/1013904
tttatat

SEQ ID NO: 36950 - DNA, 11 bp, Unknown
  misc_feature (1)..( 11): Matrix.001 file - promoters75/1014125
aaaatgtgaaa

SEQ ID NO: 36951 - DNA, 10 bp, Unknown
  misc_feature (1)..( 10): Matrix.001 file - promoters75/1014125
ccaattttaa

SEQ ID NO: 36952 - DNA, 8 bp, Unknown
  misc_feature (1)..( 8): Matrix.001 file - promoters75/1014180
tcaatttt

SEQ ID NO: 36953 - DNA, 7 bp, Unknown
  misc_feature (1)..( 7): Matrix.001 file - promoters75/1014180
caatatt

SEQ ID NO: 36954 - DNA, 7 bp, Unknown
  misc_feature (1)..( 7): Matrix.001 file - promoters75/1014525
aaaaata

SEQ ID NO: 36955 - DNA, 8 bp, Unknown
  misc_feature (1)..( 8): Matrix.001 file - promoters75/1014525
aatcaaaa

SEQ ID NO: 36956 - DNA, 9 bp, Unknown
  misc_feature (1)..( 9): Matrix.001 file - promoters75/1014525
tatatatac

SEQ ID NO: 36957 - DNA, 8 bp, Unknown
  misc_feature (1)..( 8): Matrix.001 file - promoters75/1014662
aaaaaaga

SEQ ID NO: 36958 - DNA, 8 bp, Unknown
  misc_feature (1)..( 8): Matrix.001 file - promoters75/1014662
ttttgtca

SEQ ID NO: 36959 - DNA, 8 bp, Unknown
  misc_feature (1)..( 8): Matrix.001 file - promoters75/1014662
atatttat

SEQ ID NO: 36960 - DNA, 8 bp, Unknown
  misc_feature (1)..( 8): Matrix.001 file - promoters75/1014662
aaatcaaa

SEQ ID NO: 36961 - DNA, 7 bp, Unknown
  misc_feature (1)..( 7): Matrix.001 file - promoters75/1014662
actttac

SEQ ID NO: 36962 - DNA, 7 bp, Unknown
  misc_feature (1)..( 7): Matrix.001 file - promoters75/1014662
tataata

SEQ ID NO: 36963 - DNA, 8 bp, Unknown
  misc_feature (1)..( 8): Matrix.001 file - promoters75/1014991
tacagtaa

SEQ ID NO: 36964 - DNA, 8 bp, Unknown
  misc_feature (1)..( 8): Matrix.001 file - promoters75/1015214
gaaagaaa

SEQ ID NO: 36965 - DNA, 8 bp, Unknown
  misc_feature (1)..( 8): Matrix.001 file - promoters75/1015214
tatttaaa

SEQ ID NO: 36966 - DNA, 7 bp, Unknown
  misc_feature (1)..( 7): Matrix.001 file - promoters75/1015214
ttaaaaa

SEQ ID NO: 36967 - DNA, 9 bp, Unknown
  misc_feature (1)..( 9): Matrix.001 file - promoters75/1015214
aaattcctt

SEQ ID NO: 36968 - DNA, 10 bp, Unknown
  misc_feature (1)..( 10): Matrix.001 file - promoters75/1015214
aattttgacc

SEQ ID NO: 36969 - DNA, 11 bp, Unknown
  misc_feature (1)..( 11): Matrix.001 file - promoters75/1015261
ttgtaaatgtt

SEQ ID NO: 36970 - DNA, 7 bp, Unknown
  misc_feature (1)..( 7): Matrix.001 file - promoters75/1015261
tttcatt

SEQ ID NO: 36971 - DNA, 12 bp, Unknown
  misc_feature (1)..( 12): Matrix.001 file - promoters75/1015261
attaatgggctt

SEQ ID NO: 36972 - DNA, 8 bp, Unknown
  misc_feature (1)..( 8): Matrix.001 file - promoters75/1015261
atagagaa

SEQ ID NO: 36973 - DNA, 8 bp, Unknown
  misc_feature (1)..( 8): Matrix.001 file - promoters75/1015261
caagcaaa

SEQ ID NO: 36974 - DNA, 12 bp, Unknown
  misc_feature (1)..( 12): Matrix.001 file - promoters75/1015337
tactaaatttta

SEQ ID NO: 36975 - DNA, 6 bp, Unknown
  misc_feature (1)..( 6): Matrix.001 file - promoters75/1015337
attttt

SEQ ID NO: 36976 - DNA, 9 bp, Unknown
  misc_feature (1)..( 9): Matrix.001 file - promoters75/1015475
gtttccttt

SEQ ID NO: 36977 - DNA, 9 bp, Unknown
  misc_feature (1)..( 9): Matrix.001 file - promoters75/1015848
gtttccttt

SEQ ID NO: 36978 - DNA, 9 bp, Unknown
  misc_feature (1)..( 9): Matrix.001 file - promoters75/1016250
gttaaattg

SEQ ID NO: 36979 - DNA, 9 bp, Unknown
  misc_feature (1)..( 9): Matrix.001 file - promoters75/1016250
taattttta

SEQ ID NO: 36980 - DNA, 9 bp, Unknown
  misc_feature (1)..( 9): Matrix.001 file - promoters75/1016278
gggattttt

SEQ ID NO: 36981 - DNA, 7 bp, Unknown
  misc_feature (1)..( 7): Matrix.001 file - promoters75/1016278
taattat

SEQ ID NO: 36982 - DNA, 9 bp, Unknown
  misc_feature (1)..( 9): Matrix.001 file - promoters75/1016468
ttgaatttt

SEQ ID NO: 36983 - DNA, 8 bp, Unknown
  misc_feature (1)..( 8): Matrix.001 file - promoters75/1016468
taaaaaaa

SEQ ID NO: 36984 - DNA, 8 bp, Unknown
  misc_feature (1)..( 8): Matrix.001 file - promoters75/1016468
ttataaaa

SEQ ID NO: 36985 - DNA, 11 bp, Unknown
  misc_feature (1)..( 11): Matrix.001 file - promoters75/1016468
aagaaaaaaac

SEQ ID NO: 36986 - DNA, 9 bp, Unknown
  misc_feature (1)..( 9): Matrix.001 file - promoters75/1016468
atataatta

SEQ ID NO: 36987 - DNA, 9 bp, Unknown
  misc_feature (1)..( 9): Matrix.001 file - promoters75/1016468
tggtcaaaa

SEQ ID NO: 36988 - DNA, 8 bp, Unknown
  misc_feature (1)..( 8): Matrix.001 file - promoters75/1016468
aaattgtc

SEQ ID NO: 36989 - DNA, 8 bp, Unknown
  misc_feature (1)..( 8): Matrix.001 file - promoters75/1016468
tatatata

SEQ ID NO: 36990 - DNA, 8 bp, Unknown
  misc_feature (1)..( 8): Matrix.001 file - promoters75/1016468
taattttt

SEQ ID NO: 36991 - DNA, 8 bp, Unknown
  misc_feature (1)..( 8): Matrix.001 file - promoters75/1016771
attaatgt

SEQ ID NO: 36992 - DNA, 8 bp, Unknown
  misc_feature (1)..( 8): Matrix.001 file - promoters75/1016771
tttactaa

SEQ ID NO: 36993 - DNA, 8 bp, Unknown
  misc_feature (1)..( 8): Matrix.001 file - promoters75/1016771
tttcactt

SEQ ID NO: 36994 - DNA, 14 bp, Unknown
  misc_feature (1)..( 14): Matrix.001 file - promoters75/1016886
tccacttttaaaaa

SEQ ID NO: 36995 - DNA, 9 bp, Unknown
  misc_feature (1)..( 9): Matrix.001 file - promoters75/1017282
ttttccgct

SEQ ID NO: 36996 - DNA, 9 bp, Unknown
  misc_feature (1)..( 9): Matrix.001 file - promoters75/1017618
ttatgaaaa

SEQ ID NO: 36997 - DNA, 7 bp, Unknown
  misc_feature (1)..( 7): Matrix.001 file - promoters75/1018052
tcagttt

SEQ ID NO: 36998 - DNA, 9 bp, Unknown
  misc_feature (1)..( 9): Matrix.001 file - promoters75/1018052
cttcaacat

SEQ ID NO: 36999 - DNA, 8 bp, Unknown
  misc_feature (1)..( 8): Matrix.001 file - promoters75/1018052
attgttgt

SEQ ID NO: 37000 - DNA, 7 bp, Unknown
  misc_feature (1)..( 7): Matrix.001 file - promoters75/1018190
atttgtt

SEQ ID NO: 37001 - DNA, 7 bp, Unknown
  misc_feature (1)..( 7): Matrix.001 file - promoters75/1018190
ttgattg

SEQ ID NO: 37002 - DNA, 9 bp, Unknown
  misc_feature (1)..( 9): Matrix.001 file - promoters75/1018190
cttttttta

SEQ ID NO: 37003 - DNA, 9 bp, Unknown
  misc_feature (1)..( 9): Matrix.001 file - promoters75/1018276
tcttcttat

SEQ ID NO: 37004 - DNA, 13 bp, Unknown
  misc_feature (1)..( 13): Matrix.001 file - promoters75/1018391
ctagtttattgtt

SEQ ID NO: 37005 - DNA, 8 bp, Unknown
  misc_feature (1)..( 8): Matrix.001 file - promoters75/1018391
agatcatg

SEQ ID NO: 37006 - DNA, 8 bp, Unknown
  misc_feature (1)..( 8): Matrix.001 file - promoters75/1018523
tacaaaaa

SEQ ID NO: 37007 - DNA, 7 bp, Unknown
  misc_feature (1)..( 7): Matrix.001 file - promoters75/1018523
aaacaat

SEQ ID NO: 37008 - DNA, 10 bp, Unknown
  misc_feature (1)..( 10): Matrix.001 file - promoters75/1018523
attaatatag

SEQ ID NO: 37009 - DNA, 12 bp, Unknown
  misc_feature (1)..( 12): Matrix.001 file - promoters75/1018523
taaaaaaactaa

SEQ ID NO: 37010 - DNA, 6 bp, Unknown
  misc_feature (1)..( 6): Matrix.001 file - promoters75/1018523
taaaat

SEQ ID NO: 37011 - DNA, 5 bp, Unknown
  misc_feature (1)..( 5): Matrix.001 file - promoters75/1018523
caaaa

SEQ ID NO: 37012 - DNA, 13 bp, Unknown
  misc_feature (1)..( 13): Matrix.001 file - promoters75/1018523
taacaaatttctt

SEQ ID NO: 37013 - DNA, 10 bp, Unknown
  misc_feature (1)..( 10): Matrix.001 file - promoters75/1018523
agttaataaa

SEQ ID NO: 37014 - DNA, 8 bp, Unknown
  misc_feature (1)..( 8): Matrix.001 file - promoters75/1018536
atttgtta

SEQ ID NO: 37015 - DNA, 7 bp, Unknown
  misc_feature (1)..( 7): Matrix.001 file - promoters75/1018536
ttttaat

SEQ ID NO: 37016 - DNA, 8 bp, Unknown
  misc_feature (1)..( 8): Matrix.001 file - promoters75/1018536
aaattctc

SEQ ID NO: 37017 - DNA, 11 bp, Unknown
  misc_feature (1)..( 11): Matrix.001 file - promoters75/1018536
tttataactat

SEQ ID NO: 37018 - DNA, 9 bp, Unknown
  misc_feature (1)..( 9): Matrix.001 file - promoters75/1018770
taaaaccga

SEQ ID NO: 37019 - DNA, 8 bp, Unknown
  misc_feature (1)..( 8): Matrix.001 file - promoters75/1018770
aacaaaac

SEQ ID NO: 37020 - DNA, 12 bp, Unknown
  misc_feature (1)..( 12): Matrix.001 file - promoters75/1018770
atactttttgaa

SEQ ID NO: 37021 - DNA, 11 bp, Unknown
  misc_feature (1)..( 11): Matrix.001 file - promoters75/1018770
actattttaca

SEQ ID NO: 37022 - DNA, 9 bp, Unknown
  misc_feature (1)..( 9): Matrix.001 file - promoters75/1019734
tcaatcata

SEQ ID NO: 37023 - DNA, 9 bp, Unknown
  misc_feature (1)..( 9): Matrix.001 file - promoters75/1019734
taatttcat

SEQ ID NO: 37024 - DNA, 8 bp, Unknown
  misc_feature (1)..( 8): Matrix.001 file - promoters75/1019928
atttgtta

SEQ ID NO: 37025 - DNA, 7 bp, Unknown
  misc_feature (1)..( 7): Matrix.001 file - promoters75/1019928
ttttaat

SEQ ID NO: 37026 - DNA, 8 bp, Unknown
  misc_feature (1)..( 8): Matrix.001 file - promoters75/1019928
aaattctc

SEQ ID NO: 37027 - DNA, 11 bp, Unknown
  misc_feature (1)..( 11): Matrix.001 file - promoters75/1019928
tttataactat

SEQ ID NO: 37028 - DNA, 8 bp, Unknown
  misc_feature (1)..( 8): Matrix.001 file - promoters75/1020223
atcatatt

SEQ ID NO: 37029 - DNA, 9 bp, Unknown
  misc_feature (1)..( 9): Matrix.001 file - promoters75/1020223
tttgtagtg

SEQ ID NO: 37030 - DNA, 8 bp, Unknown
  misc_feature (1)..( 8): Matrix.001 file - promoters75/1020223
tgatttgt

SEQ ID NO: 37031 - DNA, 7 bp, Unknown
  misc_feature (1)..( 7): Matrix.001 file - promoters75/1020223
gtttgtt

SEQ ID NO: 37032 - DNA, 8 bp, Unknown
  misc_feature (1)..( 8): Matrix.001 file - promoters75/1020223
gatttgtt

SEQ ID NO: 37033 - DNA, 8 bp, Unknown
  misc_feature (1)..( 8): Matrix.001 file - promoters75/1020265
atgactta

SEQ ID NO: 37034 - DNA, 8 bp, Unknown
  misc_feature (1)..( 8): Matrix.001 file - promoters75/1020543
gaaaaaaa

SEQ ID NO: 37035 - DNA, 12 bp, Unknown
  misc_feature (1)..( 12): Matrix.001 file - promoters75/1020543
aaaaaagaagaa

SEQ ID NO: 37036 - DNA, 11 bp, Unknown
  misc_feature (1)..( 11): Matrix.001 file - promoters75/1020701
tgtttgaacat

SEQ ID NO: 37037 - DNA, 8 bp, Unknown
  misc_feature (1)..( 8): Matrix.001 file - promoters75/1020701
caacgaaa

SEQ ID NO: 37038 - DNA, 6 bp, Unknown
  misc_feature (1)..( 6): Matrix.001 file - promoters75/1020786
tataaa

SEQ ID NO: 37039 - DNA, 6 bp, Unknown
  misc_feature (1)..( 6): Matrix.001 file - promoters75/1020786
caaaaa

SEQ ID NO: 37040 - DNA, 14 bp, Unknown
  misc_feature (1)..( 14): Matrix.001 file - promoters75/1020786
aacaacaaaacaag

SEQ ID NO: 37041 - DNA, 9 bp, Unknown
  misc_feature (1)..( 9): Matrix.001 file - promoters75/1020863
aaaaattaa

SEQ ID NO: 37042 - DNA, 10 bp, Unknown
  misc_feature (1)..( 10): Matrix.001 file - promoters75/1020863
ataaaattaa

SEQ ID NO: 37043 - DNA, 9 bp, Unknown
  misc_feature (1)..( 9): Matrix.001 file - promoters75/1020863
aataaaatt

SEQ ID NO: 37044 - DNA, 7 bp, Unknown
  misc_feature (1)..( 7): Matrix.001 file - promoters75/1020863
aaacaaa

SEQ ID NO: 37045 - DNA, 10 bp, Unknown
  misc_feature (1)..( 10): Matrix.001 file - promoters75/1020863
atattattag

SEQ ID NO: 37046 - DNA, 9 bp, Unknown
  misc_feature (1)..( 9): Matrix.001 file - promoters75/1021549
gtatatata

SEQ ID NO: 37047 - DNA, 10 bp, Unknown
  misc_feature (1)..( 10): Matrix.001 file - promoters75/1021549
agttatatat

SEQ ID NO: 37048 - DNA, 7 bp, Unknown
  misc_feature (1)..( 7): Matrix.001 file - promoters75/1021952
ctaaaaa

SEQ ID NO: 37049 - DNA, 12 bp, Unknown
  misc_feature (1)..( 12): Matrix.001 file - promoters75/1021968
caaaaatttaca

SEQ ID NO: 37050 - DNA, 9 bp, Unknown
  misc_feature (1)..( 9): Matrix.001 file - promoters75/1022324
agaaccaac

SEQ ID NO: 37051 - DNA, 11 bp, Unknown
  misc_feature (1)..( 11): Matrix.001 file - promoters75/1022662
atctttataaa

SEQ ID NO: 37052 - DNA, 10 bp, Unknown
  misc_feature (1)..( 10): Matrix.001 file - promoters75/1022662
aataaaaatc

SEQ ID NO: 37053 - DNA, 15 bp, Unknown
  misc_feature (1)..( 15): Matrix.001 file - promoters75/1022748
ttatttttgtaataa

SEQ ID NO: 37054 - DNA, 12 bp, Unknown
  misc_feature (1)..( 12): Matrix.001 file - promoters75/1022748
ctgatggatttg

SEQ ID NO: 37055 - DNA, 7 bp, Unknown
  misc_feature (1)..( 7): Matrix.001 file - promoters75/1022748
agaaaat

SEQ ID NO: 37056 - DNA, 11 bp, Unknown
  misc_feature (1)..( 11): Matrix.001 file - promoters75/1022748
taaagttttaa

SEQ ID NO: 37057 - DNA, 8 bp, Unknown
  misc_feature (1)..( 8): Matrix.001 file - promoters75/1022932
catcagct

SEQ ID NO: 37058 - DNA, 8 bp, Unknown
  misc_feature (1)..( 8): Matrix.001 file - promoters75/1022932
gttatgtt

SEQ ID NO: 37059 - DNA, 8 bp, Unknown
  misc_feature (1)..( 8): Matrix.001 file - promoters75/1022932
ttactttt

SEQ ID NO: 37060 - DNA, 7 bp, Unknown
  misc_feature (1)..( 7): Matrix.001 file - promoters75/1022932
ttacttt

SEQ ID NO: 37061 - DNA, 9 bp, Unknown
  misc_feature (1)..( 9): Matrix.001 file - promoters75/1022932
tacaataaa

SEQ ID NO: 37062 - DNA, 8 bp, Unknown
  misc_feature (1)..( 8): Matrix.001 file - promoters75/1022983
atttctta

SEQ ID NO: 37063 - DNA, 4 bp, Unknown
  misc_feature (1)..( 4): Matrix.001 file - promoters75/1022983
attt

SEQ ID NO: 37064 - DNA, 10 bp, Unknown
  misc_feature (1)..( 10): Matrix.001 file - promoters75/1022983
tattttatta

SEQ ID NO: 37065 - DNA, 9 bp, Unknown
  misc_feature (1)..( 9): Matrix.001 file - promoters75/1023297
taaaagttt

SEQ ID NO: 37066 - DNA, 9 bp, Unknown
  misc_feature (1)..( 9): Matrix.001 file - promoters75/1023297
tttttgtct

SEQ ID NO: 37067 - DNA, 7 bp, Unknown
  misc_feature (1)..( 7): Matrix.001 file - promoters75/1023453
ctgggaa

SEQ ID NO: 37068 - DNA, 11 bp, Unknown
  misc_feature (1)..( 11): Matrix.001 file - promoters75/1023453
aaaagaaaaaa

SEQ ID NO: 37069 - DNA, 11 bp, Unknown
  misc_feature (1)..( 11): Matrix.001 file - promoters75/1023453
aatctaattga

SEQ ID NO: 37070 - DNA, 8 bp, Unknown
  misc_feature (1)..( 8): Matrix.001 file - promoters75/1023634
ttttgaat

SEQ ID NO: 37071 - DNA, 11 bp, Unknown
  misc_feature (1)..( 11): Matrix.001 file - promoters75/1023634
aaaatgtgaaa

SEQ ID NO: 37072 - DNA, 8 bp, Unknown
  misc_feature (1)..( 8): Matrix.001 file - promoters75/1023634
agcccaaa

SEQ ID NO: 37073 - DNA, 10 bp, Unknown
  misc_feature (1)..( 10): Matrix.001 file - promoters75/1024015
tcaaaccaaa

SEQ ID NO: 37074 - DNA, 9 bp, Unknown
  misc_feature (1)..( 9): Matrix.001 file - promoters75/1024015
aaatcgtaa

SEQ ID NO: 37075 - DNA, 6 bp, Unknown
  misc_feature (1)..( 6): Matrix.001 file - promoters75/1024126
aaaaaa

SEQ ID NO: 37076 - DNA, 8 bp, Unknown
  misc_feature (1)..( 8): Matrix.001 file - promoters75/1024126
attgaaaa

SEQ ID NO: 37077 - DNA, 15 bp, Unknown
  misc_feature (1)..( 15): Matrix.001 file - promoters75/1024126
tcaaataccacggtt

SEQ ID NO: 37078 - DNA, 10 bp, Unknown
  misc_feature (1)..( 10): Matrix.001 file - promoters75/1024126
attgaaaaat

SEQ ID NO: 37079 - DNA, 8 bp, Unknown
  misc_feature (1)..( 8): Matrix.001 file - promoters75/1024126
atgattaa

SEQ ID NO: 37080 - DNA, 7 bp, Unknown
  misc_feature (1)..( 7): Matrix.001 file - promoters75/1024126
atattat

SEQ ID NO: 37081 - DNA, 7 bp, Unknown
  misc_feature (1)..( 7): Matrix.001 file - promoters75/1024126
tatttaa

SEQ ID NO: 37082 - DNA, 8 bp, Unknown
  misc_feature (1)..( 8): Matrix.001 file - promoters75/1024189
aaaaaaga

SEQ ID NO: 37083 - DNA, 8 bp, Unknown
  misc_feature (1)..( 8): Matrix.001 file - promoters75/1024189
ttttgtca

SEQ ID NO: 37084 - DNA, 8 bp, Unknown
  misc_feature (1)..( 8): Matrix.001 file - promoters75/1024189
atatttat

SEQ ID NO: 37085 - DNA, 8 bp, Unknown
  misc_feature (1)..( 8): Matrix.001 file - promoters75/1024189
aaatcaaa

SEQ ID NO: 37086 - DNA, 7 bp, Unknown
  misc_feature (1)..( 7): Matrix.001 file - promoters75/1024189
actttac

SEQ ID NO: 37087 - DNA, 7 bp, Unknown
  misc_feature (1)..( 7): Matrix.001 file - promoters75/1024189
tataata

SEQ ID NO: 37088 - DNA, 9 bp, Unknown
  misc_feature (1)..( 9): Matrix.001 file - promoters75/1024199
aaacaaaat

SEQ ID NO: 37089 - DNA, 13 bp, Unknown
  misc_feature (1)..( 13): Matrix.001 file - promoters75/1024234
ttgattcaaaatt

SEQ ID NO: 37090 - DNA, 10 bp, Unknown
  misc_feature (1)..( 10): Matrix.001 file - promoters75/1024236
tatataaaga

SEQ ID NO: 37091 - DNA, 8 bp, Unknown
  misc_feature (1)..( 8): Matrix.001 file - promoters75/1024367
attaactt

SEQ ID NO: 37092 - DNA, 6 bp, Unknown
  misc_feature (1)..( 6): Matrix.001 file - promoters75/1024367
tatata

SEQ ID NO: 37093 - DNA, 10 bp, Unknown
  misc_feature (1)..( 10): Matrix.001 file - promoters75/1024367
ttaaaaaaaa

SEQ ID NO: 37094 - DNA, 10 bp, Unknown
  misc_feature (1)..( 10): Matrix.001 file - promoters75/1024367
tttgaatttt

SEQ ID NO: 37095 - DNA, 14 bp, Unknown
  misc_feature (1)..( 14): Matrix.001 file - promoters75/1024367
cttcctcgcaactc

SEQ ID NO: 37096 - DNA, 10 bp, Unknown
  misc_feature (1)..( 10): Matrix.001 file - promoters75/1024499
ctataaatag

SEQ ID NO: 37097 - DNA, 11 bp, Unknown
  misc_feature (1)..( 11): Matrix.001 file - promoters75/1024853
caaccttcttt

SEQ ID NO: 37098 - DNA, 10 bp, Unknown
  misc_feature (1)..( 10): Matrix.001 file - promoters75/1024853
aaaaccaaaa

SEQ ID NO: 37099 - DNA, 16 bp, Unknown
  misc_feature (1)..( 16): Matrix.001 file - promoters75/1024853
tgtttaaaaatgaaat

SEQ ID NO: 37100 - DNA, 11 bp, Unknown
  misc_feature (1)..( 11): Matrix.001 file - promoters75/1024889
ttttaaattat

SEQ ID NO: 37101 - DNA, 7 bp, Unknown
  misc_feature (1)..( 7): Matrix.001 file - promoters75/1024889
tcataaa

SEQ ID NO: 37102 - DNA, 8 bp, Unknown
  misc_feature (1)..( 8): Matrix.001 file - promoters75/1024889
aaagtttt

SEQ ID NO: 37103 - DNA, 9 bp, Unknown
  misc_feature (1)..( 9): Matrix.001 file - promoters75/1024993
aaaaaggtg

SEQ ID NO: 37104 - DNA, 14 bp, Unknown
  misc_feature (1)..( 14): Matrix.001 file - promoters75/1025471
aatagtaaaaaaat

SEQ ID NO: 37105 - DNA, 9 bp, Unknown
  misc_feature (1)..( 9): Matrix.001 file - promoters75/1025471
taaaaaaga

SEQ ID NO: 37106 - DNA, 9 bp, Unknown
  misc_feature (1)..( 9): Matrix.001 file - promoters75/1025683
agaaaattg

SEQ ID NO: 37107 - DNA, 8 bp, Unknown
  misc_feature (1)..( 8): Matrix.001 file - promoters75/1025683
cctatata

SEQ ID NO: 37108 - DNA, 14 bp, Unknown
  misc_feature (1)..( 14): Matrix.001 file - promoters75/1025683
tatgaatcagctaa

SEQ ID NO: 37109 - DNA, 8 bp, Unknown
  misc_feature (1)..( 8): Matrix.001 file - promoters75/1026622
aaattttc

SEQ ID NO: 37110 - DNA, 8 bp, Unknown
  misc_feature (1)..( 8): Matrix.001 file - promoters75/1026622
agacacaa

SEQ ID NO: 37111 - DNA, 8 bp, Unknown
  misc_feature (1)..( 8): Matrix.001 file - promoters75/1026622
acattttt

SEQ ID NO: 37112 - DNA, 11 bp, Unknown
  misc_feature (1)..( 11): Matrix.001 file - promoters75/1026705
gaagatgtgaa

SEQ ID NO: 37113 - DNA, 7 bp, Unknown
  misc_feature (1)..( 7): Matrix.001 file - promoters75/1026883
tgaaaac

SEQ ID NO: 37114 - DNA, 9 bp, Unknown
  misc_feature (1)..( 9): Matrix.001 file - promoters75/1026883
aatagatta

SEQ ID NO: 37115 - DNA, 9 bp, Unknown
  misc_feature (1)..( 9): Matrix.001 file - promoters75/1026883
acaaataat

SEQ ID NO: 37116 - DNA, 9 bp, Unknown
  misc_feature (1)..( 9): Matrix.001 file - promoters75/1026883
atttgtcta

SEQ ID NO: 37117 - DNA, 7 bp, Unknown
  misc_feature (1)..( 7): Matrix.001 file - promoters75/1026983
tttcaac

SEQ ID NO: 37118 - DNA, 10 bp, Unknown
  misc_feature (1)..( 10): Matrix.001 file - promoters75/1026987
tattttactt

SEQ ID NO: 37119 - DNA, 11 bp, Unknown
  misc_feature (1)..( 11): Matrix.001 file - promoters75/1026987
tatttaaaaag

SEQ ID NO: 37120 - DNA, 8 bp, Unknown
  misc_feature (1)..( 8): Matrix.001 file - promoters75/1026987
tttgtttt

SEQ ID NO: 37121 - DNA, 8 bp, Unknown
  misc_feature (1)..( 8): Matrix.001 file - promoters75/1026987
aaaacatt

SEQ ID NO: 37122 - DNA, 11 bp, Unknown
  misc_feature (1)..( 11): Matrix.001 file - promoters75/1027327
ttgtaaatgtt

SEQ ID NO: 37123 - DNA, 7 bp, Unknown
  misc_feature (1)..( 7): Matrix.001 file - promoters75/1027327
tttcatt

SEQ ID NO: 37124 - DNA, 12 bp, Unknown
  misc_feature (1)..( 12): Matrix.001 file - promoters75/1027327
attaatgggctt

SEQ ID NO: 37125 - DNA, 8 bp, Unknown
  misc_feature (1)..( 8): Matrix.001 file - promoters75/1027327
atagagaa

SEQ ID NO: 37126 - DNA, 8 bp, Unknown
  misc_feature (1)..( 8): Matrix.001 file - promoters75/1027327
caagcaaa

SEQ ID NO: 37127 - DNA, 10 bp, Unknown
  misc_feature (1)..( 10): Matrix.001 file - promoters75/1027760
tatattaatt

SEQ ID NO: 37128 - DNA, 12 bp, Unknown
  misc_feature (1)..( 12): Matrix.001 file - promoters75/1027760
ataaatgaaatt

SEQ ID NO: 37129 - DNA, 8 bp, Unknown
  misc_feature (1)..( 8): Matrix.001 file - promoters75/1027760
tcattttt

SEQ ID NO: 37130 - DNA, 7 bp, Unknown
  misc_feature (1)..( 7): Matrix.001 file - promoters75/1027760
agaaacg

SEQ ID NO: 37131 - DNA, 14 bp, Unknown
  misc_feature (1)..( 14): Matrix.001 file - promoters75/1027760
ataaatattgttaa

SEQ ID NO: 37132 - DNA, 12 bp, Unknown
  misc_feature (1)..( 12): Matrix.001 file - promoters75/1027760
aacaattttatt

SEQ ID NO: 37133 - DNA, 9 bp, Unknown
  misc_feature (1)..( 9): Matrix.001 file - promoters75/1027760
attaatttt

SEQ ID NO: 37134 - DNA, 8 bp, Unknown
  misc_feature (1)..( 8): Matrix.001 file - promoters75/1027760
agaaaaat

SEQ ID NO: 37135 - DNA, 8 bp, Unknown
  misc_feature (1)..( 8): Matrix.001 file - promoters75/1027760
tttaccaa

SEQ ID NO: 37136 - DNA, 9 bp, Unknown
  misc_feature (1)..( 9): Matrix.001 file - promoters75/1027760
ataatttac

SEQ ID NO: 37137 - DNA, 9 bp, Unknown
  misc_feature (1)..( 9): Matrix.001 file - promoters75/1028368
ttgttttct

SEQ ID NO: 37138 - DNA, 9 bp, Unknown
  misc_feature (1)..( 9): Matrix.001 file - promoters75/1029485
caaacaaaa

SEQ ID NO: 37139 - DNA, 9 bp, Unknown
  misc_feature (1)..( 9): Matrix.001 file - promoters75/1029485
aaaagtttt

SEQ ID NO: 37140 - DNA, 12 bp, Unknown
  misc_feature (1)..( 12): Matrix.001 file - promoters75/1029485
cacaattattat

SEQ ID NO: 37141 - DNA, 11 bp, Unknown
  misc_feature (1)..( 11): Matrix.001 file - promoters75/1029952
aatgggcccat

SEQ ID NO: 37142 - DNA, 9 bp, Unknown
  misc_feature (1)..( 9): Matrix.001 file - promoters75/1029952
aagaaaaaa

SEQ ID NO: 37143 - DNA, 12 bp, Unknown
  misc_feature (1)..( 12): Matrix.001 file - promoters75/1030324
gtctatgaataa

SEQ ID NO: 37144 - DNA, 9 bp, Unknown
  misc_feature (1)..( 9): Matrix.001 file - promoters75/1030528
ataataatt

SEQ ID NO: 37145 - DNA, 13 bp, Unknown
  misc_feature (1)..( 13): Matrix.001 file - promoters75/1030528
ttatatttttaaa

SEQ ID NO: 37146 - DNA, 7 bp, Unknown
  misc_feature (1)..( 7): Matrix.001 file - promoters75/1030528
ttaaaaa

SEQ ID NO: 37147 - DNA, 9 bp, Unknown
  misc_feature (1)..( 9): Matrix.001 file - promoters75/1030547
atctttata

SEQ ID NO: 37148 - DNA, 10 bp, Unknown
  misc_feature (1)..( 10): Matrix.001 file - promoters75/1030547
taatatattt

SEQ ID NO: 37149 - DNA, 9 bp, Unknown
  misc_feature (1)..( 9): Matrix.001 file - promoters75/1030547
ataaatatc

SEQ ID NO: 37150 - DNA, 13 bp, Unknown
  misc_feature (1)..( 13): Matrix.001 file - promoters75/1030547
atctttataagta

SEQ ID NO: 37151 - DNA, 8 bp, Unknown
  misc_feature (1)..( 8): Matrix.001 file - promoters75/1030821
tattttta

SEQ ID NO: 37152 - DNA, 9 bp, Unknown
  misc_feature (1)..( 9): Matrix.001 file - promoters75/1030821
tttgataca

SEQ ID NO: 37153 - DNA, 8 bp, Unknown
  misc_feature (1)..( 8): Matrix.001 file - promoters75/1030821
aaaacata

SEQ ID NO: 37154 - DNA, 8 bp, Unknown
  misc_feature (1)..( 8): Matrix.001 file - promoters75/1030821
ataacaaa

SEQ ID NO: 37155 - DNA, 7 bp, Unknown
  misc_feature (1)..( 7): Matrix.001 file - promoters75/1030821
acaaaca

SEQ ID NO: 37156 - DNA, 14 bp, Unknown
  misc_feature (1)..( 14): Matrix.001 file - promoters75/1030821
aaacaatatactta

SEQ ID NO: 37157 - DNA, 8 bp, Unknown
  misc_feature (1)..( 8): Matrix.001 file - promoters75/1030821
acaccttt

SEQ ID NO: 37158 - DNA, 9 bp, Unknown
  misc_feature (1)..( 9): Matrix.001 file - promoters75/1030940
tataaaaag

SEQ ID NO: 37159 - DNA, 10 bp, Unknown
  misc_feature (1)..( 10): Matrix.001 file - promoters75/1030940
aaatagaaaa

SEQ ID NO: 37160 - DNA, 11 bp, Unknown
  misc_feature (1)..( 11): Matrix.001 file - promoters75/1030940
caaaatatctt

SEQ ID NO: 37161 - DNA, 14 bp, Unknown
  misc_feature (1)..( 14): Matrix.001 file - promoters75/1030940
aaaggcccataaaa

SEQ ID NO: 37162 - DNA, 13 bp, Unknown
  misc_feature (1)..( 13): Matrix.001 file - promoters75/1030940
aaactttatattt

SEQ ID NO: 37163 - DNA, 9 bp, Unknown
  misc_feature (1)..( 9): Matrix.001 file - promoters75/1031052
gaaaaaaaa

SEQ ID NO: 37164 - DNA, 11 bp, Unknown
  misc_feature (1)..( 11): Matrix.001 file - promoters75/1031267
tttatttttat

SEQ ID NO: 37165 - DNA, 13 bp, Unknown
  misc_feature (1)..( 13): Matrix.001 file - promoters75/1031291
gaataaaaattca

SEQ ID NO: 37166 - DNA, 7 bp, Unknown
  misc_feature (1)..( 7): Matrix.001 file - promoters75/1031291
aaaggac

SEQ ID NO: 37167 - DNA, 18 bp, Unknown
  misc_feature (1)..( 18): Matrix.001 file - promoters75/1031799
acgactcttcatattatt

SEQ ID NO: 37168 - DNA, 11 bp, Unknown
  misc_feature (1)..( 11): Matrix.001 file - promoters75/1031799
atgaaacaaaa

SEQ ID NO: 37169 - DNA, 11 bp, Unknown
  misc_feature (1)..( 11): Matrix.001 file - promoters75/1032381
tactttggatt

SEQ ID NO: 37170 - DNA, 9 bp, Unknown
  misc_feature (1)..( 9): Matrix.001 file - promoters75/1032381
aaaccaaaa

SEQ ID NO: 37171 - DNA, 9 bp, Unknown
  misc_feature (1)..( 9): Matrix.001 file - promoters75/1032381
tttactttg

SEQ ID NO: 37172 - DNA, 7 bp, Unknown
  misc_feature (1)..( 7): Matrix.001 file - promoters75/1032498
ttttcta

SEQ ID NO: 37173 - DNA, 8 bp, Unknown
  misc_feature (1)..( 8): Matrix.001 file - promoters75/1032498
ataataat

SEQ ID NO: 37174 - DNA, 12 bp, Unknown
  misc_feature (1)..( 12): Matrix.001 file - promoters75/1032498
taattttatata

SEQ ID NO: 37175 - DNA, 11 bp, Unknown
  misc_feature (1)..( 11): Matrix.001 file - promoters75/1032498
aaacaaaaaaa

SEQ ID NO: 37176 - DNA, 10 bp, Unknown
  misc_feature (1)..( 10): Matrix.001 file - promoters75/1032676
aaacttaaga

SEQ ID NO: 37177 - DNA, 8 bp, Unknown
  misc_feature (1)..( 8): Matrix.001 file - promoters75/1032676
attttttt

SEQ ID NO: 37178 - DNA, 8 bp, Unknown
  misc_feature (1)..( 8): Matrix.001 file - promoters75/1032676
gatattaa

SEQ ID NO: 37179 - DNA, 12 bp, Unknown
  misc_feature (1)..( 12): Matrix.001 file - promoters75/1032897
ataaaaatttat

SEQ ID NO: 37180 - DNA, 9 bp, Unknown
  misc_feature (1)..( 9): Matrix.001 file - promoters75/1032897
gtatcaaac

SEQ ID NO: 37181 - DNA, 9 bp, Unknown
  misc_feature (1)..( 9): Matrix.001 file - promoters75/1032897
cataaattt

SEQ ID NO: 37182 - DNA, 8 bp, Unknown
  misc_feature (1)..( 8): Matrix.001 file - promoters75/1032897
aaaacaaa

SEQ ID NO: 37183 - DNA, 8 bp, Unknown
  misc_feature (1)..( 8): Matrix.001 file - promoters75/1033781
tcttatta

SEQ ID NO: 37184 - DNA, 10 bp, Unknown
  misc_feature (1)..( 10): Matrix.001 file - promoters75/1033781
accattttct

SEQ ID NO: 37185 - DNA, 10 bp, Unknown
  misc_feature (1)..( 10): Matrix.001 file - promoters75/1033781
gcccatttaa

SEQ ID NO: 37186 - DNA, 7 bp, Unknown
  misc_feature (1)..( 7): Matrix.001 file - promoters75/1033781
taaaaaa

SEQ ID NO: 37187 - DNA, 12 bp, Unknown
  misc_feature (1)..( 12): Matrix.001 file - promoters75/1033781
tccatataaatt

SEQ ID NO: 37188 - DNA, 9 bp, Unknown
  misc_feature (1)..( 9): Matrix.001 file - promoters75/1033781
catgaattg

SEQ ID NO: 37189 - DNA, 8 bp, Unknown
  misc_feature (1)..( 8): Matrix.001 file - promoters75/1033781
aaacaaat

SEQ ID NO: 37190 - DNA, 7 bp, Unknown
  misc_feature (1)..( 7): Matrix.001 file - promoters75/1033841
tccttcc

SEQ ID NO: 37191 - DNA, 8 bp, Unknown
  misc_feature (1)..( 8): Matrix.001 file - promoters75/1033841
atttgctt

SEQ ID NO: 37192 - DNA, 10 bp, Unknown
  misc_feature (1)..( 10): Matrix.001 file - promoters75/1034137
tcaataaatg

SEQ ID NO: 37193 - DNA, 10 bp, Unknown
  misc_feature (1)..( 10): Matrix.001 file - promoters75/1034137
ttaaaaaaaa

SEQ ID NO: 37194 - DNA, 33 bp, Unknown
  misc_feature (1)..( 33): romoters75/1034137
aagtatactataaaggcaataagcatgagtgac

SEQ ID NO: 37195 - DNA, 32 bp, Unknown
  misc_feature (1)..( 32): Matrix.001 file - promoters75/1034137
agtatactataaaggcaataagcatgagtgac

SEQ ID NO: 37196 - DNA, 15 bp, Unknown
  misc_feature (1)..( 15): romoters75/1034137
attgaagacttttca

SEQ ID NO: 37197 - DNA, 14 bp, Unknown
  misc_feature (1)..( 14): Matrix.001 file - promoters75/1034137
ctataagcatttaa

SEQ ID NO: 37198 - DNA, 25 bp, Unknown
  misc_feature (1)..( 25): Matrix.001 file - promoters75/1034137
agcatttaagtctatcgctagactg

SEQ ID NO: 37199 - DNA, 8 bp, Unknown
  misc_feature (1)..( 8): Matrix.001 file - promoters75/1034322
attttaat

SEQ ID NO: 37200 - DNA, 11 bp, Unknown
  misc_feature (1)..( 11): Matrix.001 file - promoters75/1034322
ttaacgaataa

SEQ ID NO: 37201 - DNA, 9 bp, Unknown
  misc_feature (1)..( 9): Matrix.001 file - promoters75/1034322
aatttaatt

SEQ ID NO: 37202 - DNA, 7 bp, Unknown
  misc_feature (1)..( 7): Matrix.001 file - promoters75/1035267
ccacaga

SEQ ID NO: 37203 - DNA, 8 bp, Unknown
  misc_feature (1)..( 8): Matrix.001 file - promoters75/1375471
aaaataat

SEQ ID NO: 37204 - DNA, 8 bp, Unknown
  misc_feature (1)..( 8): Matrix.001 file - promoters75/1375615
atcatatt

SEQ ID NO: 37205 - DNA, 9 bp, Unknown
  misc_feature (1)..( 9): Matrix.001 file - promoters75/1375615
tttgtagtg

SEQ ID NO: 37206 - DNA, 8 bp, Unknown
  misc_feature (1)..( 8): Matrix.001 file - promoters75/1375615
tgatttgt

SEQ ID NO: 37207 - DNA, 7 bp, Unknown
  misc_feature (1)..( 7): Matrix.001 file - promoters75/1375615
gtttgtt

SEQ ID NO: 37208 - DNA, 8 bp, Unknown
  misc_feature (1)..( 8): Matrix.001 file - promoters75/1375615
gatttgtt

SEQ ID NO: 37209 - DNA, 8 bp, Unknown
  misc_feature (1)..( 8): Matrix.001 file - promoters75/1376650
gaaatcaa

SEQ ID NO: 37210 - DNA, 8 bp, Unknown
  misc_feature (1)..( 8): Matrix.001 file - promoters75/1376650
gaactcag

SEQ ID NO: 37211 - DNA, 9 bp, Unknown
  misc_feature (1)..( 9): Matrix.001 file - promoters75/1376650
aagaaaaaa

SEQ ID NO: 37212 - DNA, 6 bp, Unknown
  misc_feature (1)..( 6): Matrix.001 file - promoters75/1376881
agtaaa

SEQ ID NO: 37213 - DNA, 10 bp, Unknown
  misc_feature (1)..( 10): Matrix.001 file - promoters75/1376881
gaaacaaaaa

SEQ ID NO: 37214 - DNA, 7 bp, Unknown
  misc_feature (1)..( 7): Matrix.001 file - promoters75/1377564
attttac

SEQ ID NO: 37215 - DNA, 7 bp, Unknown
  misc_feature (1)..( 7): Matrix.001 file - promoters75/1377564
caaaatc

SEQ ID NO: 37216 - DNA, 7 bp, Unknown
  misc_feature (1)..( 7): Matrix.001 file - promoters75/1377642
taaaaag

SEQ ID NO: 37217 - DNA, 9 bp, Unknown
  misc_feature (1)..( 9): Matrix.001 file - promoters75/1377642
aatgaatat

SEQ ID NO: 37218 - DNA, 6 bp, Unknown
  misc_feature (1)..( 6): Matrix.001 file - promoters75/1377642
ataata

SEQ ID NO: 37219 - DNA, 12 bp, Unknown
  misc_feature (1)..( 12): Matrix.001 file - promoters75/1377642
atataataaata

SEQ ID NO: 37220 - DNA, 8 bp, Unknown
  misc_feature (1)..( 8): Matrix.001 file - promoters75/1377642
aaatatat

SEQ ID NO: 37221 - DNA, 9 bp, Unknown
  misc_feature (1)..( 9): Matrix.001 file - promoters75/1377642
aaattaata

SEQ ID NO: 37222 - DNA, 6 bp, Unknown
  misc_feature (1)..( 6): Matrix.001 file - promoters75/1377642
aaatat

SEQ ID NO: 37223 - DNA, 7 bp, Unknown
  misc_feature (1)..( 7): Matrix.001 file - promoters75/1377642
ttatata

SEQ ID NO: 37224 - DNA, 8 bp, Unknown
  misc_feature (1)..( 8): Matrix.001 file - promoters75/1377642
tgtatcta

SEQ ID NO: 37225 - DNA, 8 bp, Unknown
  misc_feature (1)..( 8): Matrix.001 file - promoters75/1377642
atccaaac

SEQ ID NO: 37226 - DNA, 9 bp, Unknown
  misc_feature (1)..( 9): Matrix.001 file - promoters75/1377642
tttattgat

SEQ ID NO: 37227 - DNA, 9 bp, Unknown
  misc_feature (1)..( 9): Matrix.001 file - promoters75/1377642
aatttattt

SEQ ID NO: 37228 - DNA, 10 bp, Unknown
  misc_feature (1)..( 10): Matrix.001 file - promoters75/1377642
aaaaagacac

SEQ ID NO: 37229 - DNA, 9 bp, Unknown
  misc_feature (1)..( 9): Matrix.001 file - promoters75/1377642
gggattttt

SEQ ID NO: 37230 - DNA, 11 bp, Unknown
  misc_feature (1)..( 11): Matrix.001 file - promoters75/1377680
tgtttgaacat

SEQ ID NO: 37231 - DNA, 8 bp, Unknown
  misc_feature (1)..( 8): Matrix.001 file - promoters75/1377680
caacgaaa

SEQ ID NO: 37232 - DNA, 8 bp, Unknown
  misc_feature (1)..( 8): Matrix.001 file - promoters75/1378049
tatatata

SEQ ID NO: 37233 - DNA, 12 bp, Unknown
  misc_feature (1)..( 12): Matrix.001 file - promoters75/1378393
gtttctttatct

SEQ ID NO: 37234 - DNA, 7 bp, Unknown
  misc_feature (1)..( 7): Matrix.001 file - promoters75/1378393
tttaaca

SEQ ID NO: 37235 - DNA, 7 bp, Unknown
  misc_feature (1)..( 7): Matrix.001 file - promoters75/1380389
tttggtt

SEQ ID NO: 37236 - DNA, 11 bp, Unknown
  misc_feature (1)..( 11): Matrix.001 file - promoters75/1380708
taaaatttttt

SEQ ID NO: 37237 - DNA, 9 bp, Unknown
  misc_feature (1)..( 9): Matrix.001 file - promoters75/1380708
tttattcag

SEQ ID NO: 37238 - DNA, 9 bp, Unknown
  misc_feature (1)..( 9): Matrix.001 file - promoters75/1381704
gtttccttt

SEQ ID NO: 37239 - DNA, 11 bp, Unknown
  misc_feature (1)..( 11): Matrix.001 file - promoters75/1383485
ccataattaag

SEQ ID NO: 37240 - DNA, 10 bp, Unknown
  misc_feature (1)..( 10): Matrix.001 file - promoters75/1383552
gtaaaaataa

SEQ ID NO: 37241 - DNA, 7 bp, Unknown
  misc_feature (1)..( 7): Matrix.001 file - promoters75/1383552
ggcccat

SEQ ID NO: 37242 - DNA, 7 bp, Unknown
  misc_feature (1)..( 7): Matrix.001 file - promoters75/1383552
aaaattt

SEQ ID NO: 37243 - DNA, 10 bp, Unknown
  misc_feature (1)..( 10): Matrix.001 file - promoters75/1384016
tttaataata

SEQ ID NO: 37244 - DNA, 14 bp, Unknown
  misc_feature (1)..( 14): Matrix.001 file - promoters75/1384016
tacttttattataa

SEQ ID NO: 37245 - DNA, 10 bp, Unknown
  misc_feature (1)..( 10): Matrix.001 file - promoters75/1384016
aaaaaaatta

SEQ ID NO: 37246 - DNA, 12 bp, Unknown
  misc_feature (1)..( 12): Matrix.001 file - promoters75/1384016
tttcaaaaaaaa

SEQ ID NO: 37247 - DNA, 10 bp, Unknown
  misc_feature (1)..( 10): Matrix.001 file - promoters75/1384016
ttcaaaaaaa

SEQ ID NO: 37248 - DNA, 14 bp, Unknown
  misc_feature (1)..( 14): Matrix.001 file - promoters75/1384016
agatgaaattaatt

SEQ ID NO: 37249 - DNA, 10 bp, Unknown
  misc_feature (1)..( 10): Matrix.001 file - promoters75/1384016
tttttagcaa

SEQ ID NO: 37250 - DNA, 11 bp, Unknown
  misc_feature (1)..( 11): Matrix.001 file - promoters75/1384016
tattaaataaa

SEQ ID NO: 37251 - DNA, 12 bp, Unknown
  misc_feature (1)..( 12): Matrix.001 file - promoters75/1384016
tgtttttggtta

SEQ ID NO: 37252 - DNA, 8 bp, Unknown
  misc_feature (1)..( 8): Matrix.001 file - promoters75/1384016
tttataaa

SEQ ID NO: 37253 - DNA, 8 bp, Unknown
  misc_feature (1)..( 8): Matrix.001 file - promoters75/1384016
ataaatat

SEQ ID NO: 37254 - DNA, 11 bp, Unknown
  misc_feature (1)..( 11): Matrix.001 file - promoters75/1387123
tgtttgaacat

SEQ ID NO: 37255 - DNA, 8 bp, Unknown
  misc_feature (1)..( 8): Matrix.001 file - promoters75/1387123
caacgaaa

SEQ ID NO: 37256 - DNA, 9 bp, Unknown
  misc_feature (1)..( 9): Matrix.001 file - promoters75/1387349
tttgataca

SEQ ID NO: 37257 - DNA, 12 bp, Unknown
  misc_feature (1)..( 12): Matrix.001 file - promoters75/1387671
tactattaaaac

SEQ ID NO: 37258 - DNA, 12 bp, Unknown
  misc_feature (1)..( 12): Matrix.001 file - promoters75/1387671
ttcttataattc

SEQ ID NO: 37259 - DNA, 11 bp, Unknown
  misc_feature (1)..( 11): Matrix.001 file - promoters75/1387906
ttttaataaca

SEQ ID NO: 37260 - DNA, 10 bp, Unknown
  misc_feature (1)..( 10): Matrix.001 file - promoters75/1387906
aaaatctgtt

SEQ ID NO: 37261 - DNA, 9 bp, Unknown
  misc_feature (1)..( 9): Matrix.001 file - promoters75/1388973
ttttgcata

SEQ ID NO: 37262 - DNA, 9 bp, Unknown
  misc_feature (1)..( 9): Matrix.001 file - promoters75/1390146
aatttgaac

SEQ ID NO: 37263 - DNA, 9 bp, Unknown
  misc_feature (1)..( 9): Matrix.001 file - promoters75/1390240
acttgctga

SEQ ID NO: 37264 - DNA, 8 bp, Unknown
  misc_feature (1)..( 8): Matrix.001 file - promoters75/1390240
aaaataaa

SEQ ID NO: 37265 - DNA, 7 bp, Unknown
  misc_feature (1)..( 7): Matrix.001 file - promoters75/1390240
gggatgg

SEQ ID NO: 37266 - DNA, 15 bp, Unknown
  misc_feature (1)..( 15): Matrix.001 file - promoters75/1393787
gattaatgtctcttg

SEQ ID NO: 37267 - DNA, 10 bp, Unknown
  misc_feature (1)..( 10): Matrix.001 file - promoters75/1393787
ctatgttttg

SEQ ID NO: 37268 - DNA, 11 bp, Unknown
  misc_feature (1)..( 11): Matrix.001 file - promoters75/1393787
atttaaatttt

SEQ ID NO: 37269 - DNA, 7 bp, Unknown
  misc_feature (1)..( 7): Matrix.001 file - promoters75/1393787
taaaaat

SEQ ID NO: 37270 - DNA, 7 bp, Unknown
  misc_feature (1)..( 7): Matrix.001 file - promoters75/1393787
ttattct

SEQ ID NO: 37271 - DNA, 9 bp, Unknown
  misc_feature (1)..( 9): Matrix.001 file - promoters75/1393787
cattttcaa

SEQ ID NO: 37272 - DNA, 11 bp, Unknown
  misc_feature (1)..( 11): Matrix.001 file - promoters75/1393787
taaccattttc

SEQ ID NO: 37273 - DNA, 9 bp, Unknown
  misc_feature (1)..( 9): Matrix.001 file - promoters75/1393787
ttatgtttt

SEQ ID NO: 37274 - DNA, 8 bp, Unknown
  misc_feature (1)..( 8): Matrix.001 file - promoters75/1393787
caagaaat

SEQ ID NO: 37275 - DNA, 7 bp, Unknown
  misc_feature (1)..( 7): Matrix.001 file - promoters75/1393787
aaaatga

SEQ ID NO: 37276 - DNA, 11 bp, Unknown
  misc_feature (1)..( 11): Matrix.001 file - promoters75/1394510
taaaatttttt

SEQ ID NO: 37277 - DNA, 9 bp, Unknown
  misc_feature (1)..( 9): Matrix.001 file - promoters75/1394510
tttattcag

SEQ ID NO: 37278 - DNA, 9 bp, Unknown
  misc_feature (1)..( 9): Matrix.001 file - promoters75/1394592
ataattata

SEQ ID NO: 37279 - DNA, 9 bp, Unknown
  misc_feature (1)..( 9): Matrix.001 file - promoters75/1395095
aaaataatc

SEQ ID NO: 37280 - DNA, 7 bp, Unknown
  misc_feature (1)..( 7): Matrix.001 file - promoters75/1395095
aatagat

SEQ ID NO: 37281 - DNA, 8 bp, Unknown
  misc_feature (1)..( 8): Matrix.001 file - promoters75/1395095
tttatttc

SEQ ID NO: 37282 - DNA, 7 bp, Unknown
  misc_feature (1)..( 7): Matrix.001 file - promoters75/1395095
aaaaaaa

SEQ ID NO: 37283 - DNA, 11 bp, Unknown
  misc_feature (1)..( 11): Matrix.001 file - promoters75/1395095
caaattttttt

SEQ ID NO: 37284 - DNA, 8 bp, Unknown
  misc_feature (1)..( 8): Matrix.001 file - promoters75/1395095
aaagtctt

SEQ ID NO: 37285 - DNA, 8 bp, Unknown
  misc_feature (1)..( 8): Matrix.001 file - promoters75/1395095
catttttt

SEQ ID NO: 37286 - DNA, 8 bp, Unknown
  misc_feature (1)..( 8): Matrix.001 file - promoters75/1395095
aaaattct

SEQ ID NO: 37287 - DNA, 8 bp, Unknown
  misc_feature (1)..( 8): Matrix.001 file - promoters75/1395095
tataaaaa

SEQ ID NO: 37288 - DNA, 9 bp, Unknown
  misc_feature (1)..( 9): Matrix.001 file - promoters75/1396182
aagaataag

SEQ ID NO: 37289 - DNA, 7 bp, Unknown
  misc_feature (1)..( 7): Matrix.001 file - promoters75/1396182
aaaacaa

SEQ ID NO: 37290 - DNA, 11 bp, Unknown
  misc_feature (1)..( 11): Matrix.001 file - promoters75/1396182
ggaaatgaaat

SEQ ID NO: 37291 - DNA, 7 bp, Unknown
  misc_feature (1)..( 7): Matrix.001 file - promoters75/1396182
gtatata

SEQ ID NO: 37292 - DNA, 9 bp, Unknown
  misc_feature (1)..( 9): Matrix.001 file - promoters75/1396308
gggattttt

SEQ ID NO: 37293 - DNA, 7 bp, Unknown
  misc_feature (1)..( 7): Matrix.001 file - promoters75/1396308
taattat

SEQ ID NO: 37294 - DNA, 6 bp, Unknown
  misc_feature (1)..( 6): Matrix.001 file - promoters75/1396354
tacatt

SEQ ID NO: 37295 - DNA, 7 bp, Unknown
  misc_feature (1)..( 7): Matrix.001 file - promoters75/1396354
tttgatt

SEQ ID NO: 37296 - DNA, 7 bp, Unknown
  misc_feature (1)..( 7): Matrix.001 file - promoters75/1397231
tttgctt

SEQ ID NO: 37297 - DNA, 7 bp, Unknown
  misc_feature (1)..( 7): Matrix.001 file - promoters75/1397231
ttccttt

SEQ ID NO: 37298 - DNA, 9 bp, Unknown
  misc_feature (1)..( 9): Matrix.001 file - promoters75/1397231
aacaaaaca

SEQ ID NO: 37299 - DNA, 9 bp, Unknown
  misc_feature (1)..( 9): Matrix.001 file - promoters75/1397231
aaaattata

SEQ ID NO: 37300 - DNA, 6 bp, Unknown
  misc_feature (1)..( 6): Matrix.001 file - promoters75/1397263
tttcaa

SEQ ID NO: 37301 - DNA, 12 bp, Unknown
  misc_feature (1)..( 12): Matrix.001 file - promoters75/1397753
ttctaaaataat

SEQ ID NO: 37302 - DNA, 11 bp, Unknown
  misc_feature (1)..( 11): Matrix.001 file - promoters75/1398337
gaaacaaaaac

SEQ ID NO: 37303 - DNA, 8 bp, Unknown
  misc_feature (1)..( 8): Matrix.001 file - promoters75/1399325
aaattttt

SEQ ID NO: 37304 - DNA, 8 bp, Unknown
  misc_feature (1)..( 8): Matrix.001 file - promoters75/1399325
aaaataaa

SEQ ID NO: 37305 - DNA, 11 bp, Unknown
  misc_feature (1)..( 11): Matrix.001 file - promoters75/1441657
aacttctattt

SEQ ID NO: 37306 - DNA, 7 bp, Unknown
  misc_feature (1)..( 7): Matrix.001 file - promoters75/1441657
ccaaacc

SEQ ID NO: 37307 - DNA, 9 bp, Unknown
  misc_feature (1)..( 9): Matrix.001 file - promoters75/1441657
aaattttca

SEQ ID NO: 37308 - DNA, 7 bp, Unknown
  misc_feature (1)..( 7): Matrix.001 file - promoters75/1441657
caatatt

SEQ ID NO: 37309 - DNA, 12 bp, Unknown
  misc_feature (1)..( 12): Matrix.001 file - promoters75/1441665
gatacaaaacca

SEQ ID NO: 37310 - DNA, 10 bp, Unknown
  misc_feature (1)..( 10): Matrix.001 file - promoters75/1441665
ccaaacaaaa

SEQ ID NO: 37311 - DNA, 11 bp, Unknown
  misc_feature (1)..( 11): Matrix.001 file - promoters75/1441835
gcataaataaa

SEQ ID NO: 37312 - DNA, 11 bp, Unknown
  misc_feature (1)..( 11): Matrix.001 file - promoters75/1441835
ttcattttatt

SEQ ID NO: 37313 - DNA, 11 bp, Unknown
  misc_feature (1)..( 11): Matrix.001 file - promoters75/1441835
agggccatatt

SEQ ID NO: 37314 - DNA, 12 bp, Unknown
  misc_feature (1)..( 12): Matrix.001 file - promoters75/1441835
taattaaaaaaa

SEQ ID NO: 37315 - DNA, 12 bp, Unknown
  misc_feature (1)..( 12): Matrix.001 file - promoters75/1442476
ctttttgttttt

SEQ ID NO: 37316 - DNA, 9 bp, Unknown
  misc_feature (1)..( 9): Matrix.001 file - promoters75/1442476
caaacaaaa

SEQ ID NO: 37317 - DNA, 9 bp, Unknown
  misc_feature (1)..( 9): Matrix.001 file - promoters75/1442880
acctctttt

SEQ ID NO: 37318 - DNA, 7 bp, Unknown
  misc_feature (1)..( 7): Matrix.001 file - promoters75/1442880
aatttac

SEQ ID NO: 37319 - DNA, 10 bp, Unknown
  misc_feature (1)..( 10): Matrix.001 file - promoters75/1442880
aaaaaattgt

SEQ ID NO: 37320 - DNA, 8 bp, Unknown
  misc_feature (1)..( 8): Matrix.001 file - promoters75/1442880
aagctata

SEQ ID NO: 37321 - DNA, 11 bp, Unknown
  misc_feature (1)..( 11): Matrix.001 file - promoters75/1442880
ttacttaaatt

SEQ ID NO: 37322 - DNA, 9 bp, Unknown
  misc_feature (1)..( 9): Matrix.001 file - promoters75/1442880
aaagaattg

SEQ ID NO: 37323 - DNA, 13 bp, Unknown
  misc_feature (1)..( 13): Matrix.001 file - promoters75/1442880
aatatcaacgacg

SEQ ID NO: 37324 - DNA, 8 bp, Unknown
  misc_feature (1)..( 8): Matrix.001 file - promoters75/1442880
aaataata

SEQ ID NO: 37325 - DNA, 12 bp, Unknown
  misc_feature (1)..( 12): Matrix.001 file - promoters75/1442975
ctttttgtatat

SEQ ID NO: 37326 - DNA, 8 bp, Unknown
  misc_feature (1)..( 8): Matrix.001 file - promoters75/1442975
tctgaatt

SEQ ID NO: 37327 - DNA, 11 bp, Unknown
  misc_feature (1)..( 11): Matrix.001 file - promoters75/1442993
ataattgtata

SEQ ID NO: 37328 - DNA, 10 bp, Unknown
  misc_feature (1)..( 10): Matrix.001 file - promoters75/1442993
gaaatagatt

SEQ ID NO: 37329 - DNA, 10 bp, Unknown
  misc_feature (1)..( 10): Matrix.001 file - promoters75/1443306
ctataaatag

SEQ ID NO: 37330 - DNA, 9 bp, Unknown
  misc_feature (1)..( 9): Matrix.001 file - promoters75/1443683
tattagctt

SEQ ID NO: 37331 - DNA, 9 bp, Unknown
  misc_feature (1)..( 9): Matrix.001 file - promoters75/1444441
aatattttt

SEQ ID NO: 37332 - DNA, 11 bp, Unknown
  misc_feature (1)..( 11): Matrix.001 file - promoters75/1444441
gttatattaat

SEQ ID NO: 37333 - DNA, 12 bp, Unknown
  misc_feature (1)..( 12): Matrix.001 file - promoters75/1444441
ttgtttttgaaa

SEQ ID NO: 37334 - DNA, 13 bp, Unknown
  misc_feature (1)..( 13): Matrix.001 file - promoters75/1444441
agaataaaaaaat

SEQ ID NO: 37335 - DNA, 9 bp, Unknown
  misc_feature (1)..( 9): Matrix.001 file - promoters75/1444441
tttataaat

SEQ ID NO: 37336 - DNA, 11 bp, Unknown
  misc_feature (1)..( 11): Matrix.001 file - promoters75/1444441
tttctaattat

SEQ ID NO: 37337 - DNA, 7 bp, Unknown
  misc_feature (1)..( 7): Matrix.001 file - promoters75/1444460
tgaaaca

SEQ ID NO: 37338 - DNA, 7 bp, Unknown
  misc_feature (1)..( 7): Matrix.001 file - promoters75/1446636
aaaggat

SEQ ID NO: 37339 - DNA, 9 bp, Unknown
  misc_feature (1)..( 9): Matrix.001 file - promoters75/1446636
gaggttaaa

SEQ ID NO: 37340 - DNA, 10 bp, Unknown
  misc_feature (1)..( 10): Matrix.001 file - promoters75/1447646
ggaagtagag

SEQ ID NO: 37341 - DNA, 9 bp, Unknown
  misc_feature (1)..( 9): Matrix.001 file - promoters75/1447646
aagatgatg

SEQ ID NO: 37342 - DNA, 6 bp, Unknown
  misc_feature (1)..( 6): Matrix.001 file - promoters75/1447953
cttctt

SEQ ID NO: 37343 - DNA, 7 bp, Unknown
  misc_feature (1)..( 7): Matrix.001 file - promoters75/1448231
cttaacc

SEQ ID NO: 37344 - DNA, 8 bp, Unknown
  misc_feature (1)..( 8): Matrix.001 file - promoters75/1450625
aattttaa

SEQ ID NO: 37345 - DNA, 6 bp, Unknown
  misc_feature (1)..( 6): Matrix.001 file - promoters75/1450625
ttattc

SEQ ID NO: 37346 - DNA, 6 bp, Unknown
  misc_feature (1)..( 6): Matrix.001 file - promoters75/1459039
tataaa

SEQ ID NO: 37347 - DNA, 9 bp, Unknown
  misc_feature (1)..( 9): Matrix.001 file - promoters75/1459039
ggtcaattt

SEQ ID NO: 37348 - DNA, 7 bp, Unknown
  misc_feature (1)..( 7): Matrix.001 file - promoters75/1459039
gccaaac

SEQ ID NO: 37349 - DNA, 8 bp, Unknown
  misc_feature (1)..( 8): Matrix.001 file - promoters75/1459223
aaaaaaat

SEQ ID NO: 37350 - DNA, 10 bp, Unknown
  misc_feature (1)..( 10): Matrix.001 file - promoters75/1459223
tttataaata

SEQ ID NO: 37351 - DNA, 6 bp, Unknown
  misc_feature (1)..( 6): Matrix.001 file - promoters75/1459223
caaaca

SEQ ID NO: 37352 - DNA, 7 bp, Unknown
  misc_feature (1)..( 7): Matrix.001 file - promoters75/1461791
gaaatcg

SEQ ID NO: 37353 - DNA, 7 bp, Unknown
  misc_feature (1)..( 7): Matrix.001 file - promoters75/1461839
ataatcc

SEQ ID NO: 37354 - DNA, 7 bp, Unknown
  misc_feature (1)..( 7): Matrix.001 file - promoters75/1461839
acacata

SEQ ID NO: 37355 - DNA, 11 bp, Unknown
  misc_feature (1)..( 11): Matrix.001 file - promoters75/1461839
aaaaagaaaag

SEQ ID NO: 37356 - DNA, 7 bp, Unknown
  misc_feature (1)..( 7): Matrix.001 file - promoters75/1461839
ggatgat

SEQ ID NO: 37357 - DNA, 10 bp, Unknown
  misc_feature (1)..( 10): Matrix.001 file - promoters75/1461839
aaaaaaagaa

SEQ ID NO: 37358 - DNA, 7 bp, Unknown
  misc_feature (1)..( 7): Matrix.001 file - promoters75/1461839
ggatgat

SEQ ID NO: 37359 - DNA, 7 bp, Unknown
  misc_feature (1)..( 7): Matrix.001 file - promoters75/1461839
ttatcag

SEQ ID NO: 37360 - DNA, 12 bp, Unknown
  misc_feature (1)..( 12): Matrix.001 file - promoters75/1461839
ttgagattatca

SEQ ID NO: 37361 - DNA, 10 bp, Unknown
  misc_feature (1)..( 10): Matrix.001 file - promoters75/1472778
ttttagttta

SEQ ID NO: 37362 - DNA, 8 bp, Unknown
  misc_feature (1)..( 8): Matrix.001 file - promoters75/1472799
atcatatt

SEQ ID NO: 37363 - DNA, 9 bp, Unknown
  misc_feature (1)..( 9): Matrix.001 file - promoters75/1472799
tttgtagtg

SEQ ID NO: 37364 - DNA, 8 bp, Unknown
  misc_feature (1)..( 8): Matrix.001 file - promoters75/1472799
tgatttgt

SEQ ID NO: 37365 - DNA, 7 bp, Unknown
  misc_feature (1)..( 7): Matrix.001 file - promoters75/1472799
gtttgtt

SEQ ID NO: 37366 - DNA, 8 bp, Unknown
  misc_feature (1)..( 8): Matrix.001 file - promoters75/1472799
gatttgtt

SEQ ID NO: 37367 - DNA, 7 bp, Unknown
  misc_feature (1)..( 7): Matrix.001 file - promoters75/1481696
tttactt

SEQ ID NO: 37368 - DNA, 10 bp, Unknown
  misc_feature (1)..( 10): Matrix.001 file - promoters75/1481696
aaaaagaaac

SEQ ID NO: 37369 - DNA, 12 bp, Unknown
  misc_feature (1)..( 12): Matrix.001 file - promoters75/1481696
tatattcaattc

SEQ ID NO: 37370 - DNA, 9 bp, Unknown
  misc_feature (1)..( 9): Matrix.001 file - promoters75/1481696
ttttattat

SEQ ID NO: 37371 - DNA, 13 bp, Unknown
  misc_feature (1)..( 13): Matrix.001 file - promoters75/1481696
tgcttatgttaga

SEQ ID NO: 37372 - DNA, 7 bp, Unknown
  misc_feature (1)..( 7): Matrix.001 file - promoters75/1532660
ggagcaa

SEQ ID NO: 37373 - DNA, 7 bp, Unknown
  misc_feature (1)..( 7): Matrix.001 file - promoters75/1532660
aaaattt

SEQ ID NO: 37374 - DNA, 7 bp, Unknown
  misc_feature (1)..( 7): Matrix.001 file - promoters75/1532660
aaagaat

SEQ ID NO: 37375 - DNA, 10 bp, Unknown
  misc_feature (1)..( 10): Matrix.001 file - promoters75/1532660
caaataattt

SEQ ID NO: 37376 - DNA, 7 bp, Unknown
  misc_feature (1)..( 7): Matrix.001 file - promoters75/1532660
aagaagg

SEQ ID NO: 37377 - DNA, 7 bp, Unknown
  misc_feature (1)..( 7): Matrix.001 file - promoters75/1532937
cttcaaa

SEQ ID NO: 37378 - DNA, 6 bp, Unknown
  misc_feature (1)..( 6): Matrix.001 file - promoters75/1532937
aataaa

SEQ ID NO: 37379 - DNA, 10 bp, Unknown
  misc_feature (1)..( 10): Matrix.001 file - promoters75/1532937
ttcttcttct

SEQ ID NO: 37380 - DNA, 12 bp, Unknown
  misc_feature (1)..( 12): Matrix.001 file - promoters75/1532937
aaaaaaattcca

SEQ ID NO: 37381 - DNA, 9 bp, Unknown
  misc_feature (1)..( 9): Matrix.001 file - promoters75/1532937
aatttttgg

SEQ ID NO: 37382 - DNA, 9 bp, Unknown
  misc_feature (1)..( 9): Matrix.001 file - promoters75/1532937
aattggtta

SEQ ID NO: 37383 - DNA, 8 bp, Unknown
  misc_feature (1)..( 8): Matrix.001 file - promoters75/1532948
ttttgtaa

SEQ ID NO: 37384 - DNA, 8 bp, Unknown
  misc_feature (1)..( 8): Matrix.001 file - promoters75/1532948
cccactaa

SEQ ID NO: 37385 - DNA, 9 bp, Unknown
  misc_feature (1)..( 9): Matrix.001 file - promoters75/1557606
ttggcgaga

SEQ ID NO: 37386 - DNA, 10 bp, Unknown
  misc_feature (1)..( 10): Matrix.001 file - promoters75/1557769
aaacttaaga

SEQ ID NO: 37387 - DNA, 8 bp, Unknown
  misc_feature (1)..( 8): Matrix.001 file - promoters75/1557769
attttttt

SEQ ID NO: 37388 - DNA, 8 bp, Unknown
  misc_feature (1)..( 8): Matrix.001 file - promoters75/1557769
gatattaa

SEQ ID NO: 37389 - DNA, 12 bp, Unknown
  misc_feature (1)..( 12): Matrix.001 file - promoters75/1567092
caaaaatttaca

SEQ ID NO: 37390 - DNA, 9 bp, Unknown
  misc_feature (1)..( 9): Matrix.001 file - promoters75/1567092
ttgtttata

SEQ ID NO: 37391 - DNA, 10 bp, Unknown
  misc_feature (1)..( 10): Matrix.001 file - promoters75/1567092
tgactatatg

SEQ ID NO: 37392 - DNA, 8 bp, Unknown
  misc_feature (1)..( 8): Matrix.001 file - promoters75/1567092
aaactaat

SEQ ID NO: 37393 - DNA, 8 bp, Unknown
  misc_feature (1)..( 8): Matrix.001 file - promoters75/1567092
tttgtttg

SEQ ID NO: 37394 - DNA, 8 bp, Unknown
  misc_feature (1)..( 8): Matrix.001 file - promoters75/1567092
tttgaatt

SEQ ID NO: 37395 - DNA, 6 bp, Unknown
  misc_feature (1)..( 6): Matrix.001 file - promoters75/1567092
attttt

SEQ ID NO: 37396 - DNA, 8 bp, Unknown
  misc_feature (1)..( 8): Matrix.001 file - promoters75/1567092
atattagt

SEQ ID NO: 37397 - DNA, 8 bp, Unknown
  misc_feature (1)..( 8): Matrix.001 file - promoters75/1567547
actcttag

SEQ ID NO: 37398 - DNA, 13 bp, Unknown
  misc_feature (1)..( 13): Matrix.001 file - promoters75/1567547
actatataaagaa

SEQ ID NO: 37399 - DNA, 9 bp, Unknown
  misc_feature (1)..( 9): Matrix.001 file - promoters75/1570116
ttagaaaat

SEQ ID NO: 37400 - DNA, 8 bp, Unknown
  misc_feature (1)..( 8): Matrix.001 file - promoters75/1570116
tattaaaa

SEQ ID NO: 37401 - DNA, 7 bp, Unknown
  misc_feature (1)..( 7): Matrix.001 file - promoters75/1570116
aaaaata

SEQ ID NO: 37402 - DNA, 7 bp, Unknown
  misc_feature (1)..( 7): Matrix.001 file - promoters75/1570116
aaaataa

SEQ ID NO: 37403 - DNA, 10 bp, Unknown
  misc_feature (1)..( 10): Matrix.001 file - promoters75/1570474
cattctctga

SEQ ID NO: 37404 - DNA, 12 bp, Unknown
  misc_feature (1)..( 12): Matrix.001 file - promoters75/1570606
taaacattttaa

SEQ ID NO: 37405 - DNA, 11 bp, Unknown
  misc_feature (1)..( 11): Matrix.001 file - promoters75/1570606
aagaaaagtaa

SEQ ID NO: 37406 - DNA, 8 bp, Unknown
  misc_feature (1)..( 8): Matrix.001 file - promoters75/1570606
tatatttg

SEQ ID NO: 37407 - DNA, 9 bp, Unknown
  misc_feature (1)..( 9): Matrix.001 file - promoters75/1570606
gtaaaaaat

SEQ ID NO: 37408 - DNA, 8 bp, Unknown
  misc_feature (1)..( 8): Matrix.001 file - promoters75/1570606
aaaattta

SEQ ID NO: 37409 - DNA, 9 bp, Unknown
  misc_feature (1)..( 9): Matrix.001 file - promoters75/1570622
tcgtttcaa

SEQ ID NO: 37410 - DNA, 8 bp, Unknown
  misc_feature (1)..( 8): Matrix.001 file - promoters75/1570622
aaacataa

SEQ ID NO: 37411 - DNA, 19 bp, Unknown
  misc_feature (1)..( 19): Matrix.001 file - promoters75/1570622
taaaacaaaaaaaagaaaa

SEQ ID NO: 37412 - DNA, 9 bp, Unknown
  misc_feature (1)..( 9): Matrix.001 file - promoters75/1570622
tactctttt

SEQ ID NO: 37413 - DNA, 9 bp, Unknown
  misc_feature (1)..( 9): Matrix.001 file - promoters75/1570622
tatgattaa

SEQ ID NO: 37414 - DNA, 9 bp, Unknown
  misc_feature (1)..( 9): Matrix.001 file - promoters75/1570622
tcttcttat

SEQ ID NO: 37415 - DNA, 9 bp, Unknown
  misc_feature (1)..( 9): Matrix.001 file - promoters75/1570622
tttaacaat

SEQ ID NO: 37416 - DNA, 7 bp, Unknown
  misc_feature (1)..( 7): Matrix.001 file - promoters75/1570966
attttta

SEQ ID NO: 37417 - DNA, 9 bp, Unknown
  misc_feature (1)..( 9): Matrix.001 file - promoters75/1570966
agttaactt

SEQ ID NO: 37418 - DNA, 8 bp, Unknown
  misc_feature (1)..( 8): Matrix.001 file - promoters75/1580932
aataaaag

SEQ ID NO: 37419 - DNA, 8 bp, Unknown
  misc_feature (1)..( 8): Matrix.001 file - promoters75/1580932
tcatttaa

SEQ ID NO: 37420 - DNA, 8 bp, Unknown
  misc_feature (1)..( 8): Matrix.001 file - promoters75/1580932
aaaaacca

SEQ ID NO: 37421 - DNA, 8 bp, Unknown
  misc_feature (1)..( 8): Matrix.001 file - promoters75/1595794
aaatgtat

SEQ ID NO: 37422 - DNA, 7 bp, Unknown
  misc_feature (1)..( 7): Matrix.001 file - promoters75/1595794
aaaaaat

SEQ ID NO: 37423 - DNA, 9 bp, Unknown
  misc_feature (1)..( 9): Matrix.001 file - promoters75/1595794
aatttaatc

SEQ ID NO: 37424 - DNA, 9 bp, Unknown
  misc_feature (1)..( 9): Matrix.001 file - promoters75/1595794
agtctttta

SEQ ID NO: 37425 - DNA, 11 bp, Unknown
  misc_feature (1)..( 11): Matrix.001 file - promoters75/1595794
catttgtataa

SEQ ID NO: 37426 - DNA, 11 bp, Unknown
  misc_feature (1)..( 11): Matrix.001 file - promoters75/1595794
catttctatag

SEQ ID NO: 37427 - DNA, 11 bp, Unknown
  misc_feature (1)..( 11): Matrix.001 file - promoters75/1595794
aaataattcaa

SEQ ID NO: 37428 - DNA, 9 bp, Unknown
  misc_feature (1)..( 9): Matrix.001 file - promoters75/1595794
attttctta

SEQ ID NO: 37429 - DNA, 9 bp, Unknown
  misc_feature (1)..( 9): Matrix.001 file - promoters75/1595794
aaaacaaaa

SEQ ID NO: 37430 - DNA, 10 bp, Unknown
  misc_feature (1)..( 10): Matrix.001 file - promoters75/1662827
ttttcataat

SEQ ID NO: 37431 - DNA, 10 bp, Unknown
  misc_feature (1)..( 10): Matrix.001 file - promoters75/1662827
agttaataaa

SEQ ID NO: 37432 - DNA, 6 bp, Unknown
  misc_feature (1)..( 6): Matrix.001 file - promoters75/1662827
tacatt

SEQ ID NO: 37433 - DNA, 7 bp, Unknown
  misc_feature (1)..( 7): Matrix.001 file - promoters75/1662827
tttttac

SEQ ID NO: 37434 - DNA, 8 bp, Unknown
  misc_feature (1)..( 8): Matrix.001 file - promoters75/1662827
agacaaaa

SEQ ID NO: 37435 - DNA, 8 bp, Unknown
  misc_feature (1)..( 8): Matrix.001 file - promoters75/1662917
atttgtta

SEQ ID NO: 37436 - DNA, 7 bp, Unknown
  misc_feature (1)..( 7): Matrix.001 file - promoters75/1662917
ttttaat

SEQ ID NO: 37437 - DNA, 8 bp, Unknown
  misc_feature (1)..( 8): Matrix.001 file - promoters75/1662917
aaattctc

SEQ ID NO: 37438 - DNA, 11 bp, Unknown
  misc_feature (1)..( 11): Matrix.001 file - promoters75/1662917
tttataactat

SEQ ID NO: 37439 - DNA, 8 bp, Unknown
  misc_feature (1)..( 8): Matrix.001 file - promoters75/1663221
gataattt

SEQ ID NO: 37440 - DNA, 8 bp, Unknown
  misc_feature (1)..( 8): Matrix.001 file - promoters75/1663221
agagaagg

SEQ ID NO: 37441 - DNA, 11 bp, Unknown
  misc_feature (1)..( 11): Matrix.001 file - promoters75/1663221
agtatatcatt

SEQ ID NO: 37442 - DNA, 7 bp, Unknown
  misc_feature (1)..( 7): Matrix.001 file - promoters75/1664931
gaagttt

SEQ ID NO: 37443 - DNA, 11 bp, Unknown
  misc_feature (1)..( 11): Matrix.001 file - promoters75/1664981
aatatataaag

SEQ ID NO: 37444 - DNA, 18 bp, Unknown
  misc_feature (1)..( 18): Matrix.001 file - promoters75/1664981
tattcaaaacaaatattc

SEQ ID NO: 37445 - DNA, 8 bp, Unknown
  misc_feature (1)..( 8): Matrix.001 file - promoters75/1665272
ttccaaaa

SEQ ID NO: 37446 - DNA, 11 bp, Unknown
  misc_feature (1)..( 11): Matrix.001 file - promoters75/1665272
ttcttgttcgt

SEQ ID NO: 37447 - DNA, 9 bp, Unknown
  misc_feature (1)..( 9): Matrix.001 file - promoters75/1665272
agaaataga

SEQ ID NO: 37448 - DNA, 7 bp, Unknown
  misc_feature (1)..( 7): Matrix.001 file - promoters75/1711228
aagattt

SEQ ID NO: 37449 - DNA, 12 bp, Unknown
  misc_feature (1)..( 12): Matrix.001 file - promoters75/1711228
tgtattttatgt

SEQ ID NO: 37450 - DNA, 9 bp, Unknown
  misc_feature (1)..( 9): Matrix.001 file - promoters75/1714831
tcaaaatgc

SEQ ID NO: 37451 - DNA, 10 bp, Unknown
  misc_feature (1)..( 10): Matrix.001 file - promoters75/1714831
catttgattt

SEQ ID NO: 37452 - DNA, 7 bp, Unknown
  misc_feature (1)..( 7): Matrix.001 file - promoters75/1714989
aaaaata

SEQ ID NO: 37453 - DNA, 8 bp, Unknown
  misc_feature (1)..( 8): Matrix.001 file - promoters75/1714989
aaaataaa

SEQ ID NO: 37454 - DNA, 7 bp, Unknown
  misc_feature (1)..( 7): Matrix.001 file - promoters75/1714989
aaaaaaa

SEQ ID NO: 37455 - DNA, 10 bp, Unknown
  misc_feature (1)..( 10): Matrix.001 file - promoters75/1714989
caaaccaaag

SEQ ID NO: 37456 - DNA, 11 bp, Unknown
  misc_feature (1)..( 11): Matrix.001 file - promoters75/1714989
atttgaataaa

SEQ ID NO: 37457 - DNA, 9 bp, Unknown
  misc_feature (1)..( 9): Matrix.001 file - promoters75/1714989
cctctttcc

SEQ ID NO: 37458 - DNA, 10 bp, Unknown
  misc_feature (1)..( 10): Matrix.001 file - promoters75/1714989
tatacaaaaa

SEQ ID NO: 37459 - DNA, 11 bp, Unknown
  misc_feature (1)..( 11): Matrix.001 file - promoters75/1714989
aaacaataaaa

SEQ ID NO: 37460 - DNA, 10 bp, Unknown
  misc_feature (1)..( 10): Matrix.001 file - promoters75/1714989
atattattag

SEQ ID NO: 37461 - DNA, 7 bp, Unknown
  misc_feature (1)..( 7): Matrix.001 file - promoters75/1714989
tttattt

SEQ ID NO: 37462 - DNA, 7 bp, Unknown
  misc_feature (1)..( 7): Matrix.001 file - promoters75/1714989
aaccaat

SEQ ID NO: 37463 - DNA, 8 bp, Unknown
  misc_feature (1)..( 8): Matrix.001 file - promoters75/1714989
aacaaaag

SEQ ID NO: 37464 - DNA, 8 bp, Unknown
  misc_feature (1)..( 8): Matrix.001 file - promoters75/1714989
ttacaaac

SEQ ID NO: 37465 - DNA, 8 bp, Unknown
  misc_feature (1)..( 8): Matrix.001 file - promoters75/1715347
tttttgtt

SEQ ID NO: 37466 - DNA, 8 bp, Unknown
  misc_feature (1)..( 8): Matrix.001 file - promoters75/1807771
acttatat

SEQ ID NO: 37467 - DNA, 12 bp, Unknown
  misc_feature (1)..( 12): Matrix.001 file - promoters75/1807771
tttgtttttttt

SEQ ID NO: 37468 - DNA, 12 bp, Unknown
  misc_feature (1)..( 12): Matrix.001 file - promoters75/1808172
aattaaccatga

SEQ ID NO: 37469 - DNA, 7 bp, Unknown
  misc_feature (1)..( 7): Matrix.001 file - promoters75/1808172
tctttct

SEQ ID NO: 37470 - DNA, 8 bp, Unknown
  misc_feature (1)..( 8): Matrix.001 file - promoters75/1808172
acaaaaca

SEQ ID NO: 37471 - DNA, 8 bp, Unknown
  misc_feature (1)..( 8): Matrix.001 file - promoters75/1808172
caattata

SEQ ID NO: 37472 - DNA, 7 bp, Unknown
  misc_feature (1)..( 7): Matrix.001 file - promoters75/1808172
ctctttc

SEQ ID NO: 37473 - DNA, 8 bp, Unknown
  misc_feature (1)..( 8): Matrix.001 file - promoters75/1808172
tatatata

SEQ ID NO: 37474 - DNA, 9 bp, Unknown
  misc_feature (1)..( 9): Matrix.001 file - promoters75/1808172
aaattttga

SEQ ID NO: 37475 - DNA, 9 bp, Unknown
  misc_feature (1)..( 9): Matrix.001 file - promoters75/1808172
tatgagaaa

SEQ ID NO: 37476 - DNA, 7 bp, Unknown
  misc_feature (1)..( 7): Matrix.001 file - promoters75/1808172
ttgtttt

SEQ ID NO: 37477 - DNA, 7 bp, Unknown
  misc_feature (1)..( 7): Matrix.001 file - promoters75/1808172
attttta

SEQ ID NO: 37478 - DNA, 9 bp, Unknown
  misc_feature (1)..( 9): Matrix.001 file - promoters75/1808172
agttaactt

SEQ ID NO: 37479 - DNA, 9 bp, Unknown
  misc_feature (1)..( 9): Matrix.001 file - promoters75/1809157
aaaaacata

SEQ ID NO: 37480 - DNA, 11 bp, Unknown
  misc_feature (1)..( 11): Matrix.001 file - promoters75/1809157
cgaaacaaaaa

SEQ ID NO: 37481 - DNA, 9 bp, Unknown
  misc_feature (1)..( 9): Matrix.001 file - promoters75/1957212
gattcttac

SEQ ID NO: 37482 - DNA, 9 bp, Unknown
  misc_feature (1)..( 9): Matrix.001 file - promoters75/1957212
tatttaaac

SEQ ID NO: 37483 - DNA, 8 bp, Unknown
  misc_feature (1)..( 8): Matrix.001 file - promoters75/1957212
agagaaac

SEQ ID NO: 37484 - DNA, 10 bp, Unknown
  misc_feature (1)..( 10): Matrix.001 file - promoters75/1975923
gataaaattt

SEQ ID NO: 37485 - DNA, 8 bp, Unknown
  misc_feature (1)..( 8): Matrix.001 file - promoters75/1975923
atataaag

SEQ ID NO: 37486 - DNA, 10 bp, Unknown
  misc_feature (1)..( 10): Matrix.001 file - promoters75/1975923
taaaaataat

SEQ ID NO: 37487 - DNA, 9 bp, Unknown
  misc_feature (1)..( 9): Matrix.001 file - promoters75/1976019
aatttttgg

SEQ ID NO: 37488 - DNA, 9 bp, Unknown
  misc_feature (1)..( 9): Matrix.001 file - promoters75/1976019
aattggtta

SEQ ID NO: 37489 - DNA, 10 bp, Unknown
  misc_feature (1)..( 10): Matrix.001 file - promoters75/1976078
ccagatacag

SEQ ID NO: 37490 - DNA, 12 bp, Unknown
  misc_feature (1)..( 12): Matrix.001 file - promoters75/1976078
aaatccaaaccc

SEQ ID NO: 37491 - DNA, 9 bp, Unknown
  misc_feature (1)..( 9): Matrix.001 file - promoters75/1976078
acttttttt

SEQ ID NO: 37492 - DNA, 4 bp, Unknown
  misc_feature (1)..( 4): Matrix.001 file - promoters75/1976078
attg

SEQ ID NO: 37493 - DNA, 9 bp, Unknown
  misc_feature (1)..( 9): Matrix.001 file - promoters75/1976078
tttcaagtt

SEQ ID NO: 37494 - DNA, 9 bp, Unknown
  misc_feature (1)..( 9): Matrix.001 file - promoters75/1976236
ttcaaaaaa

SEQ ID NO: 37495 - DNA, 7 bp, Unknown
  misc_feature (1)..( 7): Matrix.001 file - promoters75/1976236
ttttgac

SEQ ID NO: 37496 - DNA, 8 bp, Unknown
  misc_feature (1)..( 8): Matrix.001 file - promoters75/1976236
caaacctg

SEQ ID NO: 37497 - DNA, 8 bp, Unknown
  misc_feature (1)..( 8): Matrix.001 file - promoters75/1976236
agatacag

SEQ ID NO: 37498 - DNA, 9 bp, Unknown
  misc_feature (1)..( 9): Matrix.001 file - promoters75/1976236
tttcaagtt

SEQ ID NO: 37499 - DNA, 9 bp, Unknown
  misc_feature (1)..( 9): Matrix.001 file - promoters75/1976354
aataaaaaa

SEQ ID NO: 37500 - DNA, 11 bp, Unknown
  misc_feature (1)..( 11): Matrix.001 file - promoters75/1976354
aatatgtgtaa

SEQ ID NO: 37501 - DNA, 9 bp, Unknown
  misc_feature (1)..( 9): Matrix.001 file - promoters75/1976354
acagttatc

SEQ ID NO: 37502 - DNA, 10 bp, Unknown
  misc_feature (1)..( 10): Matrix.001 file - promoters75/1976354
atcagtttga

SEQ ID NO: 37503 - DNA, 8 bp, Unknown
  misc_feature (1)..( 8): Matrix.001 file - promoters75/2104991
aaatttca

SEQ ID NO: 37504 - DNA, 8 bp, Unknown
  misc_feature (1)..( 8): Matrix.001 file - promoters75/2104991
taaatcag

SEQ ID NO: 37505 - DNA, 14 bp, Unknown
  misc_feature (1)..( 14): Matrix.001 file - promoters75/2104991
taaaagtttgatat

SEQ ID NO: 37506 - DNA, 14 bp, Unknown
  misc_feature (1)..( 14): Matrix.001 file - promoters75/2104991
taaaagtttgatat

SEQ ID NO: 37507 - DNA, 9 bp, Unknown
  misc_feature (1)..( 9): Matrix.001 file - promoters75/2105514
tatataaaa

SEQ ID NO: 37508 - DNA, 10 bp, Unknown
  misc_feature (1)..( 10): Matrix.001 file - promoters75/2106017
aaataaaaaa

SEQ ID NO: 37509 - DNA, 9 bp, Unknown
  misc_feature (1)..( 9): Matrix.001 file - promoters75/2106017
gcagtaaca

SEQ ID NO: 37510 - DNA, 12 bp, Unknown
  misc_feature (1)..( 12): Matrix.001 file - promoters75/2106017
gtttgaaatctg

SEQ ID NO: 37511 - DNA, 9 bp, Unknown
  misc_feature (1)..( 9): Matrix.001 file - promoters75/2107065
tgaagaaaa

SEQ ID NO: 37512 - DNA, 10 bp, Unknown
  misc_feature (1)..( 10): Matrix.001 file - promoters75/2113502
acattaaaaa

SEQ ID NO: 37513 - DNA, 13 bp, Unknown
  misc_feature (1)..( 13): Matrix.001 file - promoters75/2113502
ctccactataaaa

SEQ ID NO: 37514 - DNA, 11 bp, Unknown
  misc_feature (1)..( 11): Matrix.001 file - promoters75/2113502
cgaaacaatta

SEQ ID NO: 37515 - DNA, 8 bp, Unknown
  misc_feature (1)..( 8): Matrix.001 file - promoters75/2113846
tataattt

SEQ ID NO: 37516 - DNA, 9 bp, Unknown
  misc_feature (1)..( 9): Matrix.001 file - promoters75/2113846
aatttaacg

SEQ ID NO: 37517 - DNA, 8 bp, Unknown
  misc_feature (1)..( 8): Matrix.001 file - promoters75/2113889
gttgactg

SEQ ID NO: 37518 - DNA, 7 bp, Unknown
  misc_feature (1)..( 7): Matrix.001 file - promoters75/2114200
aatcctt

SEQ ID NO: 37519 - DNA, 8 bp, Unknown
  misc_feature (1)..( 8): Matrix.001 file - promoters75/2114200
gaataaaa

SEQ ID NO: 37520 - DNA, 11 bp, Unknown
  misc_feature (1)..( 11): Matrix.001 file - promoters75/2187156
ccataattaag

SEQ ID NO: 37521 - DNA, 8 bp, Unknown
  misc_feature (1)..( 8): Matrix.001 file - promoters75/2217732
gaaagaaa

SEQ ID NO: 37522 - DNA, 7 bp, Unknown
  misc_feature (1)..( 7): Matrix.001 file - promoters75/2217817
atagatt

SEQ ID NO: 37523 - DNA, 9 bp, Unknown
  misc_feature (1)..( 9): Matrix.001 file - promoters75/2218207
gcagaaaaa

SEQ ID NO: 37524 - DNA, 10 bp, Unknown
  misc_feature (1)..( 10): Matrix.001 file - promoters75/2218207
aatataaagg

SEQ ID NO: 37525 - DNA, 11 bp, Unknown
  misc_feature (1)..( 11): Matrix.001 file - promoters75/2218271
ataaaaactgg

SEQ ID NO: 37526 - DNA, 7 bp, Unknown
  misc_feature (1)..( 7): Matrix.001 file - promoters75/2724699
cattatc

SEQ ID NO: 37527 - DNA, 9 bp, Unknown
  misc_feature (1)..( 9): Matrix.001 file - promoters75/2724699
aaatgtttt

SEQ ID NO: 37528 - DNA, 8 bp, Unknown
  misc_feature (1)..( 8): Matrix.001 file - promoters75/2781251
ttctccgc

SEQ ID NO: 37529 - DNA, 9 bp, Unknown
  misc_feature (1)..( 9): Matrix.001 file - promoters75/2781251
aaaacatat

SEQ ID NO: 37530 - DNA, 9 bp, Unknown
  misc_feature (1)..( 9): Matrix.001 file - promoters75/2781341
aaatcgtaa

SEQ ID NO: 37531 - DNA, 10 bp, Unknown
  misc_feature (1)..( 10): Matrix.001 file - promoters75/2781341
aaaaccaaaa

SEQ ID NO: 37532 - DNA, 7 bp, Unknown
  misc_feature (1)..( 7): Matrix.001 file - promoters75/2990611
tttgttt

SEQ ID NO: 37533 - DNA, 10 bp, Unknown
  misc_feature (1)..( 10): Matrix.001 file - promoters75/2991239
tcaataaatg

SEQ ID NO: 37534 - DNA, 10 bp, Unknown
  misc_feature (1)..( 10): Matrix.001 file - promoters75/2991239
ttaaaaaaaa

SEQ ID NO: 37535 - DNA, 33 bp, Unknown; identical to SEQ ID NO: 37194
  misc_feature (1)..( 33): Matrix.001 file - promoters75/2991239

SEQ ID NO: 37536 - DNA, 32 bp, Unknown; identical to SEQ ID NO: 37195
  misc_feature (1)..( 32): Matrix.001 file - promoters75/2991239

SEQ ID NO: 37537 - DNA, 15 bp, Unknown
  misc_feature (1)..( 15): Matrix.001 file - promoters75/2991239
attgaagacttttca

SEQ ID NO: 37538 - DNA, 14 bp, Unknown
  misc_feature (1)..( 14): Matrix.001 file - promoters75/2991239
ctataagcatttaa

SEQ ID NO: 37539 - DNA, 25 bp, Unknown
  misc_feature (1)..( 25): Matrix.001 file - promoters75/2991239
agcatttaagtctatcgctagactg

SEQ ID NO: 37540 - DNA, 8 bp, Unknown
  misc_feature (1)..( 8): Matrix.001 file - promoters75/2991281
ttttgaat

SEQ ID NO: 37541 - DNA, 11 bp, Unknown
  misc_feature (1)..( 11): Matrix.001 file - promoters75/2991281
aaaatgtgaaa

SEQ ID NO: 37542 - DNA, 8 bp, Unknown
  misc_feature (1)..( 8): Matrix.001 file - promoters75/2991281
agcccaaa

SEQ ID NO: 37543 - DNA, 8 bp, Unknown
  misc_feature (1)..( 8): Matrix.001 file - promoters75/2991281
tgtttaga

SEQ ID NO: 37544 - DNA, 10 bp, Unknown
  misc_feature (1)..( 10): Matrix.001 file - promoters75/2991300
ttatattatt

SEQ ID NO: 37545 - DNA, 10 bp, Unknown
  misc_feature (1)..( 10): Matrix.001 file - promoters75/2991300
attaatatat

SEQ ID NO: 37546 - DNA, 9 bp, Unknown
  misc_feature (1)..( 9): Matrix.001 file - promoters75/2991300
taaatatat

SEQ ID NO: 37547 - DNA, 8 bp, Unknown
  misc_feature (1)..( 8): Matrix.001 file - promoters75/2991489
tttttgta

SEQ ID NO: 37548 - DNA, 12 bp, Unknown
  misc_feature (1)..( 12): Matrix.001 file - promoters75/2991489
aaattttaatat

SEQ ID NO: 37549 - DNA, 7 bp, Unknown
  misc_feature (1)..( 7): Matrix.001 file - promoters75/2992722
aatttac

SEQ ID NO: 37550 - DNA, 11 bp, Unknown
  misc_feature (1)..( 11): Matrix.001 file - promoters75/2992722
ataattgtata

SEQ ID NO: 37551 - DNA, 10 bp, Unknown
  misc_feature (1)..( 10): Matrix.001 file - promoters75/2992722
gaaatagatt

SEQ ID NO: 37552 - DNA, 8 bp, Unknown
  misc_feature (1)..( 8): Matrix.001 file - promoters75/2992722
aagctata

SEQ ID NO: 37553 - DNA, 9 bp, Unknown
  misc_feature (1)..( 9): Matrix.001 file - promoters75/2992722
ttattaatt

SEQ ID NO: 37554 - DNA, 14 bp, Unknown
  misc_feature (1)..( 14): Matrix.001 file - promoters75/2993642
tttatatattttta

SEQ ID NO: 37555 - DNA, 8 bp, Unknown
  misc_feature (1)..( 8): Matrix.001 file - promoters75/2993642
aaatgttt

SEQ ID NO: 37556 - DNA, 12 bp, Unknown
  misc_feature (1)..( 12): Matrix.001 file - promoters75/3043962
atttgaaatttt

SEQ ID NO: 37557 - DNA, 9 bp, Unknown
  misc_feature (1)..( 9): Matrix.001 file - promoters75/3043962
actatttaa

SEQ ID NO: 37558 - DNA, 8 bp, Unknown
  misc_feature (1)..( 8): Matrix.001 file - promoters75/3043962
ttataaaa

SEQ ID NO: 37559 - DNA, 7 bp, Unknown
  misc_feature (1)..( 7): Matrix.001 file - promoters75/3409165
ttcataa

SEQ ID NO: 37560 - DNA, 7 bp, Unknown
  misc_feature (1)..( 7): Matrix.001 file - promoters75/3409489
cgaagaa

SEQ ID NO: 37561 - DNA, 8 bp, Unknown
  misc_feature (1)..( 8): Matrix.001 file - promoters75/3409489
acttcctt

SEQ ID NO: 37562 - DNA, 9 bp, Unknown
  misc_feature (1)..( 9): Matrix.001 file - promoters75/3409489
aaatgatta

SEQ ID NO: 37563 - DNA, 9 bp, Unknown
  misc_feature (1)..( 9): Matrix.001 file - promoters75/3433904
atattaaaa

SEQ ID NO: 37564 - DNA, 8 bp, Unknown
  misc_feature (1)..( 8): Matrix.001 file - promoters75/3433904
tataaatt

SEQ ID NO: 37565 - DNA, 8 bp, Unknown
  misc_feature (1)..( 8): Matrix.001 file - promoters75/3433904
gttggata

SEQ ID NO: 37566 - DNA, 11 bp, Unknown
  misc_feature (1)..( 11): Matrix.001 file - promoters75/3433904
ttaattctttt

SEQ ID NO: 37567 - DNA, 10 bp, Unknown
  misc_feature (1)..( 10): Matrix.001 file - promoters75/3433944
aaacttaaga

SEQ ID NO: 37568 - DNA, 8 bp, Unknown
  misc_feature (1)..( 8): Matrix.001 file - promoters75/3433944
attttttt

SEQ ID NO: 37569 - DNA, 8 bp, Unknown
  misc_feature (1)..( 8): Matrix.001 file - promoters75/3433944
gatattaa

SEQ ID NO: 37570 - DNA, 13 bp, Unknown
  misc_feature (1)..( 13): Matrix.001 file - promoters75/3434108
gattaatttctct

SEQ ID NO: 37571 - DNA, 9 bp, Unknown
  misc_feature (1)..( 9): Matrix.001 file - promoters75/3434108
tgttgttac

SEQ ID NO: 37572 - DNA, 10 bp, Unknown
  misc_feature (1)..( 10): Matrix.001 file - promoters75/3434108
aaataaattg

SEQ ID NO: 37573 - DNA, 8 bp, Unknown
  misc_feature (1)..( 8): Matrix.001 file - promoters75/3434108
tcttaaaa

SEQ ID NO: 37574 - DNA, 8 bp, Unknown
  misc_feature (1)..( 8): Matrix.001 file - promoters75/3434108
ttttttta

SEQ ID NO: 37575 - DNA, 7 bp, Unknown
  misc_feature (1)..( 7): Matrix.001 file - promoters75/3434108
aattttg

SEQ ID NO: 37576 - DNA, 9 bp, Unknown
  misc_feature (1)..( 9): Matrix.001 file - promoters75/3434108
ctaattaat

SEQ ID NO: 37577 - DNA, 7 bp, Unknown
  misc_feature (1)..( 7): Matrix.001 file - promoters75/3434108
ttataat

SEQ ID NO: 37578 - DNA, 10 bp, Unknown
  misc_feature (1)..( 10): Matrix.001 file - promoters75/3434108
caaaataaaa

SEQ ID NO: 37579 - DNA, 10 bp, Unknown
  misc_feature (1)..( 10): Matrix.001 file - promoters75/3434108
ttaaaaaaac

SEQ ID NO: 37580 - DNA, 8 bp, Unknown
  misc_feature (1)..( 8): Matrix.001 file - promoters75/3434108
tattatta

SEQ ID NO: 37581 - DNA, 8 bp, Unknown
  misc_feature (1)..( 8): Matrix.001 file - promoters75/3434108
aaaacaaa

SEQ ID NO: 37582 - DNA, 6 bp, Unknown
  misc_feature (1)..( 6): Matrix.001 file - promoters75/3434233
acatat

SEQ ID NO: 37583 - DNA, 13 bp, Unknown
  misc_feature (1)..( 13): Matrix.001 file - promoters75/3434233
agaaaaagaaaaa

SEQ ID NO: 37584 - DNA, 8 bp, Unknown
  misc_feature (1)..( 8): Matrix.001 file - promoters75/3434233
aaaagaaa

SEQ ID NO: 37585 - DNA, 7 bp, Unknown
  misc_feature (1)..( 7): Matrix.001 file - promoters75/3434233
gaaagaa

SEQ ID NO: 37586 - DNA, 7 bp, Unknown
  misc_feature (1)..( 7): Matrix.001 file - promoters75/3434233
tcaaagc

SEQ ID NO: 37587 - DNA, 8 bp, Unknown
  misc_feature (1)..( 8): Matrix.001 file - promoters75/3434233
gaaaaaga

SEQ ID NO: 37588 - DNA, 12 bp, Unknown
  misc_feature (1)..( 12): Matrix.001 file - promoters75/3434279
gacgataattta

SEQ ID NO: 37589 - DNA, 12 bp, Unknown
  misc_feature (1)..( 12): Matrix.001 file - promoters75/3434279
aaaaacaaataa

SEQ ID NO: 37590 - DNA, 9 bp, Unknown
  misc_feature (1)..( 9): Matrix.001 file - promoters75/3434279
acattaatt

SEQ ID NO: 37591 - DNA, 10 bp, Unknown
  misc_feature (1)..( 10): Matrix.001 file - promoters75/3434563
ctaaaaataa

SEQ ID NO: 37592 - DNA, 7 bp, Unknown
  misc_feature (1)..( 7): Matrix.001 file - promoters75/3435133
atagatt

SEQ ID NO: 37593 - DNA, 9 bp, Unknown
  misc_feature (1)..( 9): Matrix.001 file - promoters75/3435833
ttaagaaaa

SEQ ID NO: 37594 - DNA, 8 bp, Unknown
  misc_feature (1)..( 8): Matrix.001 file - promoters75/3435833
tatataaa

SEQ ID NO: 37595 - DNA, 7 bp, Unknown
  misc_feature (1)..( 7): Matrix.001 file - promoters75/3436196
actaaaa

SEQ ID NO: 37596 - DNA, 10 bp, Unknown
  misc_feature (1)..( 10): Matrix.001 file - promoters75/3436196
atcataaaat

SEQ ID NO: 37597 - DNA, 8 bp, Unknown
  misc_feature (1)..( 8): Matrix.001 file - promoters75/3437244
gaatcaac

SEQ ID NO: 37598 - DNA, 10 bp, Unknown
  misc_feature (1)..( 10): Matrix.001 file - promoters75/3437244
cactgcgtgt

SEQ ID NO: 37599 - DNA, 8 bp, Unknown
  misc_feature (1)..( 8): Matrix.001 file - promoters75/3437710
acaaaaaa

SEQ ID NO: 37600 - DNA, 10 bp, Unknown
  misc_feature (1)..( 10): Matrix.001 file - promoters75/3437710
aataaaaatc

SEQ ID NO: 37601 - DNA, 8 bp, Unknown
  misc_feature (1)..( 8): Matrix.001 file - promoters75/3437710
tatccaag

SEQ ID NO: 37602 - DNA, 10 bp, Unknown
  misc_feature (1)..( 10): Matrix.001 file - promoters75/3438077
ataaaaacac

SEQ ID NO: 37603 - DNA, 11 bp, Unknown
  misc_feature (1)..( 11): Matrix.001 file - promoters75/3438194
atagaacaaac

SEQ ID NO: 37604 - DNA, 12 bp, Unknown
  misc_feature (1)..( 12): Matrix.001 file - promoters75/3438236
caaataaatctc

SEQ ID NO: 37605 - DNA, 11 bp, Unknown
  misc_feature (1)..( 11): Matrix.001 file - promoters75/3438512
caaaaatttac

SEQ ID NO: 37606 - DNA, 6 bp, Unknown
  misc_feature (1)..( 6): Matrix.001 file - promoters75/3438512
ataact

SEQ ID NO: 37607 - DNA, 12 bp, Unknown
  misc_feature (1)..( 12): Matrix.001 file - promoters75/3438512
tacacaagtttt

SEQ ID NO: 37608 - DNA, 7 bp, Unknown
  misc_feature (1)..( 7): Matrix.001 file - promoters75/3438512
aaacttt

SEQ ID NO: 37609 - DNA, 11 bp, Unknown
  misc_feature (1)..( 11): Matrix.001 file - promoters75/3438512
ttttacttttt

SEQ ID NO: 37610 - DNA, 9 bp, Unknown
  misc_feature (1)..( 9): Matrix.001 file - promoters75/3438512
tcaaaaaaa

SEQ ID NO: 37611 - DNA, 8 bp, Unknown
  misc_feature (1)..( 8): Matrix.001 file - promoters75/3438632
agatatta

SEQ ID NO: 37612 - DNA, 7 bp, Unknown
  misc_feature (1)..( 7): Matrix.001 file - promoters75/3438632
aaaagaa

SEQ ID NO: 37613 - DNA, 9 bp, Unknown
  misc_feature (1)..( 9): Matrix.001 file - promoters75/3439213
attttgatt

SEQ ID NO: 37614 - DNA, 7 bp, Unknown
  misc_feature (1)..( 7): Matrix.001 file - promoters75/3439472
gaaacaa

SEQ ID NO: 37615 - DNA, 12 bp, Unknown
  misc_feature (1)..( 12): Matrix.001 file - promoters75/3439472
gacaaaacttga

SEQ ID NO: 37616 - DNA, 10 bp, Unknown
  misc_feature (1)..( 10): Matrix.001 file - promoters75/3439614
tattagcttc

SEQ ID NO: 37617 - DNA, 7 bp, Unknown
  misc_feature (1)..( 7): Matrix.001 file - promoters75/3439614
ttagaga

SEQ ID NO: 37618 - DNA, 13 bp, Unknown
  misc_feature (1)..( 13): Matrix.001 file - promoters75/3593205
aattagatctttt

SEQ ID NO: 37619 - DNA, 8 bp, Unknown
  misc_feature (1)..( 8): Matrix.001 file - promoters75/3593205
ttatcctt

SEQ ID NO: 37620 - DNA, 8 bp, Unknown
  misc_feature (1)..( 8): Matrix.001 file - promoters75/3593230
cacattca

SEQ ID NO: 37621 - DNA, 8 bp, Unknown
  misc_feature (1)..( 8): Matrix.001 file - promoters75/3593230
tcttcttg

SEQ ID NO: 37622 - DNA, 8 bp, Unknown
  misc_feature (1)..( 8): Matrix.001 file - promoters75/4254434
tttagatt

SEQ ID NO: 37623 - DNA, 5 bp, Unknown
  misc_feature (1)..( 5): Matrix.001 file - promoters75/4254434
agatt

SEQ ID NO: 37624 - DNA, 10 bp, Unknown
  misc_feature (1)..( 10): Matrix.001 file - promoters75/4262420
cctattggtt

SEQ ID NO: 37625 - DNA, 6 bp, Unknown
  misc_feature (1)..( 6): Matrix.001 file - promoters75/4262420
tgggat

SEQ ID NO: 37626 - DNA, 7 bp, Unknown
  misc_feature (1)..( 7): Matrix.001 file - promoters75/4262428
attaaat

SEQ ID NO: 37627 - DNA, 7 bp, Unknown
  misc_feature (1)..( 7): Matrix.001 file - promoters75/4262428
tatataa

SEQ ID NO: 37628 - DNA, 7 bp, Unknown
  misc_feature (1)..( 7): Matrix.001 file - promoters75/4262428
tataaat

SEQ ID NO: 37629 - DNA, 7 bp, Unknown
  misc_feature (1)..( 7): Matrix.001 file - promoters75/4281773
ttagggc

SEQ ID NO: 37630 - DNA, 7 bp, Unknown
  misc_feature (1)..( 7): Matrix.001 file - promoters75/4281773
cagtatt

SEQ ID NO: 37631 - DNA, 13 bp, Unknown
  misc_feature (1)..( 13): Matrix.001 file - promoters75/4281773
atgcatagtttat

SEQ ID NO: 37632 - DNA, 7 bp, Unknown
  misc_feature (1)..( 7): Matrix.001 file - promoters75/4281773
aaagaca

SEQ ID NO: 37633 - DNA, 9 bp, Unknown
  misc_feature (1)..( 9): Matrix.001 file - promoters75/4281773
aagaaaaag

SEQ ID NO: 37634 - DNA, 11 bp, Unknown
  misc_feature (1)..( 11): Matrix.001 file - promoters75/4281925
aaaataaaaca

SEQ ID NO: 37635 - DNA, 8 bp, Unknown
  misc_feature (1)..( 8): Matrix.001 file - promoters75/4281925
taaatttt

SEQ ID NO: 37636 - DNA, 14 bp, Unknown
  misc_feature (1)..( 14): Matrix.001 file - promoters75/4281925
aatttacatatcta

SEQ ID NO: 37637 - DNA, 7 bp, Unknown
  misc_feature (1)..( 7): Matrix.001 file - promoters75/4282316
cattatc

SEQ ID NO: 37638 - DNA, 9 bp, Unknown
  misc_feature (1)..( 9): Matrix.001 file - promoters75/4282316
aaatgtttt

SEQ ID NO: 37639 - DNA, 9 bp, Unknown
  misc_feature (1)..( 9): Matrix.001 file - promoters75/4282418
aaaataaaa

SEQ ID NO: 37640 - DNA, 7 bp, Unknown
  misc_feature (1)..( 7): Matrix.001 file - promoters75/4282503
taaaatc

SEQ ID NO: 37641 - DNA, 10 bp, Unknown
  misc_feature (1)..( 10): Matrix.001 file - promoters75/4282503
ttttaataac

SEQ ID NO: 37642 - DNA, 11 bp, Unknown
  misc_feature (1)..( 11): Matrix.001 file - promoters75/4282503
tttattaaatg

SEQ ID NO: 37643 - DNA, 8 bp, Unknown
  misc_feature (1)..( 8): Matrix.001 file - promoters75/4282667
aatgggcc

SEQ ID NO: 37644 - DNA, 8 bp, Unknown
  misc_feature (1)..( 8): Matrix.001 file - promoters75/4282667
attgttac

SEQ ID NO: 37645 - DNA, 8 bp, Unknown
  misc_feature (1)..( 8): Matrix.001 file - promoters75/4282667
taaacaaa

SEQ ID NO: 37646 - DNA, 12 bp, Unknown
  misc_feature (1)..( 12): Matrix.001 file - promoters75/4282667
ctcttatgattc

SEQ ID NO: 37647 - DNA, 8 bp, Unknown
  misc_feature (1)..( 8): Matrix.001 file - promoters75/4282788
tttgattt

SEQ ID NO: 37648 - DNA, 9 bp, Unknown
  misc_feature (1)..( 9): Matrix.001 file - promoters75/4283355
gaaacaaaa

SEQ ID NO: 37649 - DNA, 13 bp, Unknown
  misc_feature (1)..( 13): Matrix.001 file - promoters75/4283355
gctcttcccctta

SEQ ID NO: 37650 - DNA, 10 bp, Unknown
  misc_feature (1)..( 10): Matrix.001 file - promoters75/4283355
taaagttttt

SEQ ID NO: 37651 - DNA, 9 bp, Unknown
  misc_feature (1)..( 9): Matrix.001 file - promoters75/4283378
aatatatac

SEQ ID NO: 37652 - DNA, 9 bp, Unknown
  misc_feature (1)..( 9): Matrix.001 file - promoters75/4283378
tatataaat

SEQ ID NO: 37653 - DNA, 15 bp, Unknown
  misc_feature (1)..( 15): Matrix.001 file - promoters75/4283378
ataactttataagta

SEQ ID NO: 37654 - DNA, 8 bp, Unknown
  misc_feature (1)..( 8): Matrix.001 file - promoters75/4283378
aaatgtca

SEQ ID NO: 37655 - DNA, 11 bp, Unknown
  misc_feature (1)..( 11): Matrix.001 file - promoters75/4577400
ccataattaag

SEQ ID NO: 37656 - DNA, 7 bp, Unknown
  misc_feature (1)..( 7): Matrix.001 file - promoters75/4608096
tttttgt

SEQ ID NO: 37657 - DNA, 10 bp, Unknown
  misc_feature (1)..( 10): Matrix.001 file - promoters75/4608096
tttataaaac

SEQ ID NO: 37658 - DNA, 11 bp, Unknown
  misc_feature (1)..( 11): Matrix.001 file - promoters75/4608965
cttagtttcct

SEQ ID NO: 37659 - DNA, 14 bp, Unknown
  misc_feature (1)..( 14): Matrix.001 file - promoters75/4608965
caaacgaaatcact

SEQ ID NO: 37660 - DNA, 7 bp, Unknown
  misc_feature (1)..( 7): Matrix.001 file - promoters75/4608985
taaaaat

SEQ ID NO: 37661 - DNA, 8 bp, Unknown
  misc_feature (1)..( 8): Matrix.001 file - promoters75/4608985
aataaaat

SEQ ID NO: 37662 - DNA, 13 bp, Unknown
  misc_feature (1)..( 13): Matrix.001 file - promoters75/4608985
taacaaatttctt

SEQ ID NO: 37663 - DNA, 7 bp, Unknown
  misc_feature (1)..( 7): Matrix.001 file - promoters75/4608985
gttatta

SEQ ID NO: 37664 - DNA, 11 bp, Unknown
  misc_feature (1)..( 11): Matrix.001 file - promoters75/4608985
aaaaaactaat

SEQ ID NO: 37665 - DNA, 10 bp, Unknown
  misc_feature (1)..( 10): Matrix.001 file - promoters75/4608985
agttaataaa

SEQ ID NO: 37666 - DNA, 10 bp, Unknown
  misc_feature (1)..( 10): Matrix.001 file - promoters75/4608985
caaacaaaaa

SEQ ID NO: 37667 - DNA, 8 bp, Unknown
  misc_feature (1)..( 8): Matrix.001 file - promoters75/4608985
tttattat

SEQ ID NO: 37668 - DNA, 7 bp, Unknown
  misc_feature (1)..( 7): Matrix.001 file - promoters75/4608985
aaaaaag

SEQ ID NO: 37669 - DNA, 8 bp, Unknown
  misc_feature (1)..( 8): Matrix.001 file - promoters75/4608985
cttttatt

SEQ ID NO: 37670 - DNA, 9 bp, Unknown
  misc_feature (1)..( 9): Matrix.001 file - promoters75/4608985
aataatata

SEQ ID NO: 37671 - DNA, 8 bp, Unknown
  misc_feature (1)..( 8): Matrix.001 file - promoters75/4608985
cagtcaag

SEQ ID NO: 37672 - DNA, 8 bp, Unknown
  misc_feature (1)..( 8): Matrix.001 file - promoters75/4608985
cctatata

SEQ ID NO: 37673 - DNA, 14 bp, Unknown
  misc_feature (1)..( 14): Matrix.001 file - promoters75/4610551
tttaaaaaataaat

SEQ ID NO: 37674 - DNA, 10 bp, Unknown
  misc_feature (1)..( 10): Matrix.001 file - promoters75/4610551
gaaagaaaaa

SEQ ID NO: 37675 - DNA, 10 bp, Unknown
  misc_feature (1)..( 10): Matrix.001 file - promoters75/4610551
ggtagttttt

SEQ ID NO: 37676 - DNA, 10 bp, Unknown
  misc_feature (1)..( 10): Matrix.001 file - promoters75/4610551
tatatctaaa

SEQ ID NO: 37677 - DNA, 12 bp, Unknown
  misc_feature (1)..( 12): Matrix.001 file - promoters75/4610551
aaagtttttgta

SEQ ID NO: 37678 - DNA, 8 bp, Unknown
  misc_feature (1)..( 8): Matrix.001 file - promoters75/4766490
gaaaaaaa

SEQ ID NO: 37679 - DNA, 12 bp, Unknown
  misc_feature (1)..( 12): Matrix.001 file - promoters75/4766490
aaaaaagaagaa

SEQ ID NO: 37680 - DNA, 10 bp, Unknown
  misc_feature (1)..( 10): Matrix.001 file - promoters75/4766977
ctataaatag

SEQ ID NO: 37681 - DNA, 15 bp, Unknown
  misc_feature (1)..( 15): Matrix.001 file - promoters75/4767487
ttaattttttcaaaa

SEQ ID NO: 37682 - DNA, 10 bp, Unknown
  misc_feature (1)..( 10): Matrix.001 file - promoters75/4767487
ttatgattaa

SEQ ID NO: 37683 - DNA, 9 bp, Unknown
  misc_feature (1)..( 9): Matrix.001 file - promoters75/4767487
tatataaac

SEQ ID NO: 37684 - DNA, 11 bp, Unknown
  misc_feature (1)..( 11): Matrix.001 file - promoters75/4767701
tctatgaatca

SEQ ID NO: 37685 - DNA, 12 bp, Unknown
  misc_feature (1)..( 12): Matrix.001 file - promoters75/4767701
aaataaactatt

SEQ ID NO: 37686 - DNA, 10 bp, Unknown
  misc_feature (1)..( 10): Matrix.001 file - promoters75/4767982
ttaaacttgt

SEQ ID NO: 37687 - DNA, 6 bp, Unknown
  misc_feature (1)..( 6): Matrix.001 file - promoters75/4768285
atgatc

SEQ ID NO: 37688 - DNA, 7 bp, Unknown
  misc_feature (1)..( 7): Matrix.001 file - promoters75/4768285
tttaatt

SEQ ID NO: 37689 - DNA, 9 bp, Unknown
  misc_feature (1)..( 9): Matrix.001 file - promoters75/4768289
gtttattaa

SEQ ID NO: 37690 - DNA, 11 bp, Unknown
  misc_feature (1)..( 11): Matrix.001 file - promoters75/4768354
taaaatttttt

SEQ ID NO: 37691 - DNA, 9 bp, Unknown
  misc_feature (1)..( 9): Matrix.001 file - promoters75/4768354
tttattcag

SEQ ID NO: 37692 - DNA, 7 bp, Unknown
  misc_feature (1)..( 7): Matrix.001 file - promoters75/4768615
taaaaat

SEQ ID NO: 37693 - DNA, 8 bp, Unknown
  misc_feature (1)..( 8): Matrix.001 file - promoters75/4768615
aataaaat

SEQ ID NO: 37694 - DNA, 13 bp, Unknown
  misc_feature (1)..( 13): Matrix.001 file - promoters75/4768615
taacaaatttctt

SEQ ID NO: 37695 - DNA, 7 bp, Unknown
  misc_feature (1)..( 7): Matrix.001 file - promoters75/4768615
gttatta

SEQ ID NO: 37696 - DNA, 11 bp, Unknown
  misc_feature (1)..( 11): Matrix.001 file - promoters75/4768615
aaaaaactaat

SEQ ID NO: 37697 - DNA, 10 bp, Unknown
  misc_feature (1)..( 10): Matrix.001 file - promoters75/4768615
agttaataaa

SEQ ID NO: 37698 - DNA, 10 bp, Unknown
  misc_feature (1)..( 10): Matrix.001 file - promoters75/4768615
caaacaaaaa

SEQ ID NO: 37699 - DNA, 8 bp, Unknown
  misc_feature (1)..( 8): Matrix.001 file - promoters75/4768615
tttattat

SEQ ID NO: 37700 - DNA, 7 bp, Unknown
  misc_feature (1)..( 7): Matrix.001 file - promoters75/4768615
aaaaaag

SEQ ID NO: 37701 - DNA, 8 bp, Unknown
  misc_feature (1)..( 8): Matrix.001 file - promoters75/4768615
cttttatt

SEQ ID NO: 37702 - DNA, 9 bp, Unknown
  misc_feature (1)..( 9): Matrix.001 file - promoters75/4768615
aataatata

SEQ ID NO: 37703 - DNA, 8 bp, Unknown
  misc_feature (1)..( 8): Matrix.001 file - promoters75/4768615
cagtcaag

SEQ ID NO: 37704 - DNA, 8 bp, Unknown
  misc_feature (1)..( 8): Matrix.001 file - promoters75/4768615
cctatata

SEQ ID NO: 37705 - DNA, 15 bp, Unknown
  misc_feature (1)..( 15): Matrix.001 file - promoters75/4768635
aattttaattttttt

SEQ ID NO: 37706 - DNA, 8 bp, Unknown
  misc_feature (1)..( 8): Matrix.001 file - promoters75/4768635
tttttgtt

SEQ ID NO: 37707 - DNA, 11 bp, Unknown
  misc_feature (1)..( 11): Matrix.001 file - promoters75/4768635
taattgatttt

SEQ ID NO: 37708 - DNA, 7 bp, Unknown
  misc_feature (1)..( 7): Matrix.001 file - promoters75/4768635
tttggtt

SEQ ID NO: 37709 - DNA, 8 bp, Unknown
  misc_feature (1)..( 8): Matrix.001 file - promoters75/4768635
atttttgg

SEQ ID NO: 37710 - DNA, 8 bp, Unknown
  misc_feature (1)..( 8): Matrix.001 file - promoters75/4768635
tatttcaa

SEQ ID NO: 37711 - DNA, 12 bp, Unknown
  misc_feature (1)..( 12): Matrix.001 file - promoters75/4769059
ttatatctttat

SEQ ID NO: 37712 - DNA, 8 bp, Unknown
  misc_feature (1)..( 8): Matrix.001 file - promoters75/4770305
tgtttaga

SEQ ID NO: 37713 - DNA, 11 bp, Unknown
  misc_feature (1)..( 11): Matrix.001 file - promoters75/4770443
aaaagaagttt

SEQ ID NO: 37714 - DNA, 12 bp, Unknown
  misc_feature (1)..( 12): Matrix.001 file - promoters75/4770443
tctaattttatc

SEQ ID NO: 37715 - DNA, 9 bp, Unknown
  misc_feature (1)..( 9): Matrix.001 file - promoters75/4770443
atagacaaa

SEQ ID NO: 37716 - DNA, 9 bp, Unknown
  misc_feature (1)..( 9): Matrix.001 file - promoters75/4770443
aaaaatgat

SEQ ID NO: 37717 - DNA, 12 bp, Unknown
  misc_feature (1)..( 12): Matrix.001 file - promoters75/4770443
aaaaattttttt

SEQ ID NO: 37718 - DNA, 11 bp, Unknown
  misc_feature (1)..( 11): Matrix.001 file - promoters75/4770477
tatacttcagt

SEQ ID NO: 37719 - DNA, 9 bp, Unknown
  misc_feature (1)..( 9): Matrix.001 file - promoters75/4771239
ttggcgaga

SEQ ID NO: 37720 - DNA, 7 bp, Unknown
  misc_feature (1)..( 7): Matrix.001 file - promoters75/4771271
ttttgct

SEQ ID NO: 37721 - DNA, 9 bp, Unknown
  misc_feature (1)..( 9): Matrix.001 file - promoters75/4771271
aaattaaac

SEQ ID NO: 37722 - DNA, 8 bp, Unknown
  misc_feature (1)..( 8): Matrix.001 file - promoters75/4771271
tatgatta

SEQ ID NO: 37723 - DNA, 10 bp, Unknown
  misc_feature (1)..( 10): Matrix.001 file - promoters75/4771271
aacaaaattg

SEQ ID NO: 37724 - DNA, 13 bp, Unknown
  misc_feature (1)..( 13): Matrix.001 file - promoters75/4771271
gtttttcatagaa

SEQ ID NO: 37725 - DNA, 8 bp, Unknown
  misc_feature (1)..( 8): Matrix.001 file - promoters75/4771271
gttaaata

SEQ ID NO: 37726 - DNA, 12 bp, Unknown
  misc_feature (1)..( 12): Matrix.001 file - promoters75/4771271
tgataaaaaaaa

SEQ ID NO: 37727 - DNA, 9 bp, Unknown
  misc_feature (1)..( 9): Matrix.001 file - promoters75/4771271
taaacaaaa

SEQ ID NO: 37728 - DNA, 9 bp, Unknown
  misc_feature (1)..( 9): Matrix.001 file - promoters75/4771271
aatattttg

SEQ ID NO: 37729 - DNA, 10 bp, Unknown
  misc_feature (1)..( 10): Matrix.001 file - promoters75/4771271
ttaggttttt

SEQ ID NO: 37730 - DNA, 8 bp, Unknown
  misc_feature (1)..( 8): Matrix.001 file - promoters75/4771271
attatttt

SEQ ID NO: 37731 - DNA, 10 bp, Unknown
  misc_feature (1)..( 10): Matrix.001 file - promoters75/4771321
tgtgacgggt

SEQ ID NO: 37732 - DNA, 9 bp, Unknown
  misc_feature (1)..( 9): Matrix.001 file - promoters75/4771321
gaaaacaga

SEQ ID NO: 37733 - DNA, 10 bp, Unknown
  misc_feature (1)..( 10): Matrix.001 file - promoters75/4771334
aaaaataaat

SEQ ID NO: 37734 - DNA, 14 bp, Unknown
  misc_feature (1)..( 14): Matrix.001 file - promoters75/4771334
gtgcttctaacaaa

SEQ ID NO: 37735 - DNA, 9 bp, Unknown
  misc_feature (1)..( 9): Matrix.001 file - promoters75/4771334
taaaaaata

SEQ ID NO: 37736 - DNA, 9 bp, Unknown
  misc_feature (1)..( 9): Matrix.001 file - promoters75/4771334
attaaaaaa

SEQ ID NO: 37737 - DNA, 8 bp, Unknown
  misc_feature (1)..( 8): Matrix.001 file - promoters75/4771495
aattgtag

SEQ ID NO: 37738 - DNA, 9 bp, Unknown
  misc_feature (1)..( 9): Matrix.001 file - promoters75/4771495
gcaaaacta

SEQ ID NO: 37739 - DNA, 7 bp, Unknown
  misc_feature (1)..( 7): Matrix.001 file - promoters75/4771495
atgtttc

SEQ ID NO: 37740 - DNA, 8 bp, Unknown
  misc_feature (1)..( 8): Matrix.001 file - promoters75/4771495
aacatatt

SEQ ID NO: 37741 - DNA, 4 bp, Unknown
  misc_feature (1)..( 4): Matrix.001 file - promoters75/4771677
aaac

SEQ ID NO: 37742 - DNA, 10 bp, Unknown
  misc_feature (1)..( 10): Matrix.001 file - promoters75/4771769
tttttgttta

SEQ ID NO: 37743 - DNA, 9 bp, Unknown
  misc_feature (1)..( 9): Matrix.001 file - promoters75/4771769
gttttttaa

SEQ ID NO: 37744 - DNA, 12 bp, Unknown
  misc_feature (1)..( 12): Matrix.001 file - promoters75/4771769
atgcatagttta

SEQ ID NO: 37745 - DNA, 9 bp, Unknown
  misc_feature (1)..( 9): Matrix.001 file - promoters75/4771853
gtttccttt

SEQ ID NO: 37746 - DNA, 11 bp, Unknown
  misc_feature (1)..( 11): Matrix.001 file - promoters75/4772336
attgaccatga

SEQ ID NO: 37747 - DNA, 9 bp, Unknown
  misc_feature (1)..( 9): Matrix.001 file - promoters75/4772336
tgtattgac

SEQ ID NO: 37748 - DNA, 9 bp, Unknown
  misc_feature (1)..( 9): Matrix.001 file - promoters75/4772336
aaattgaca

SEQ ID NO: 37749 - DNA, 7 bp, Unknown
  misc_feature (1)..( 7): Matrix.001 file - promoters75/4772336
tatataa

SEQ ID NO: 37750 - DNA, 8 bp, Unknown
  misc_feature (1)..( 8): Matrix.001 file - promoters75/4772346
agatacag

SEQ ID NO: 37751 - DNA, 7 bp, Unknown
  misc_feature (1)..( 7): Matrix.001 file - promoters75/4772346
tttcaag

SEQ ID NO: 37752 - DNA, 8 bp, Unknown
  misc_feature (1)..( 8): Matrix.001 file - promoters75/4772346
caaacctg

SEQ ID NO: 37753 - DNA, 6 bp, Unknown
  misc_feature (1)..( 6): Matrix.001 file - promoters75/4772398
atttga

SEQ ID NO: 37754 - DNA, 11 bp, Unknown
  misc_feature (1)..( 11): Matrix.001 file - promoters75/4772398
gtcataaattt

SEQ ID NO: 37755 - DNA, 13 bp, Unknown
  misc_feature (1)..( 13): Matrix.001 file - promoters75/4772398
tgttataggccca

SEQ ID NO: 37756 - DNA, 11 bp, Unknown
  misc_feature (1)..( 11): Matrix.001 file - promoters75/4772398
attgttaattt

SEQ ID NO: 37757 - DNA, 15 bp, Unknown
  misc_feature (1)..( 15): Matrix.001 file - promoters75/4772398
ttattcttttaacat

SEQ ID NO: 37758 - DNA, 14 bp, Unknown
  misc_feature (1)..( 14): Matrix.001 file - promoters75/4772398
agttaaaggcccaa

SEQ ID NO: 37759 - DNA, 9 bp, Unknown
  misc_feature (1)..( 9): Matrix.001 file - promoters75/4772398
aaatttgaa

SEQ ID NO: 37760 - DNA, 7 bp, Unknown
  misc_feature (1)..( 7): Matrix.001 file - promoters75/4772776
atataaa

SEQ ID NO: 37761 - DNA, 11 bp, Unknown
  misc_feature (1)..( 11): Matrix.001 file - promoters75/4772776
cttcttgttac

SEQ ID NO: 37762 - DNA, 11 bp, Unknown
  misc_feature (1)..( 11): Matrix.001 file - promoters75/4772776
aagtgtctttt

SEQ ID NO: 37763 - DNA, 8 bp, Unknown
  misc_feature (1)..( 8): Matrix.001 file - promoters75/4772776
aatcaaaa

SEQ ID NO: 37764 - DNA, 7 bp, Unknown
  misc_feature (1)..( 7): Matrix.001 file - promoters75/4772879
taaaaag

SEQ ID NO: 37765 - DNA, 9 bp, Unknown
  misc_feature (1)..( 9): Matrix.001 file - promoters75/4772879
aatgaatat

SEQ ID NO: 37766 - DNA, 6 bp, Unknown
  misc_feature (1)..( 6): Matrix.001 file - promoters75/4772879
ataata

SEQ ID NO: 37767 - DNA, 12 bp, Unknown
  misc_feature (1)..( 12): Matrix.001 file - promoters75/4772879
atataataaata

SEQ ID NO: 37768 - DNA, 8 bp, Unknown
  misc_feature (1)..( 8): Matrix.001 file - promoters75/4772879
aaatatat

SEQ ID NO: 37769 - DNA, 9 bp, Unknown
  misc_feature (1)..( 9): Matrix.001 file - promoters75/4772879
aaattaata

SEQ ID NO: 37770 - DNA, 6 bp, Unknown
  misc_feature (1)..( 6): Matrix.001 file - promoters75/4772879
aaatat

SEQ ID NO: 37771 - DNA, 7 bp, Unknown
  misc_feature (1)..( 7): Matrix.001 file - promoters75/4772879
ttatata

SEQ ID NO: 37772 - DNA, 8 bp, Unknown
  misc_feature (1)..( 8): Matrix.001 file - promoters75/4772879
tgtatcta

SEQ ID NO: 37773 - DNA, 8 bp, Unknown
  misc_feature (1)..( 8): Matrix.001 file - promoters75/4772879
atccaaac

SEQ ID NO: 37774 - DNA, 9 bp, Unknown
  misc_feature (1)..( 9): Matrix.001 file - promoters75/4772879
tttattgat

SEQ ID NO: 37775 - DNA, 9 bp, Unknown
  misc_feature (1)..( 9): Matrix.001 file - promoters75/4772879
aatttattt

SEQ ID NO: 37776 - DNA, 10 bp, Unknown
  misc_feature (1)..( 10): Matrix.001 file - promoters75/4772879
aaaaagacac

SEQ ID NO: 37777 - DNA, 9 bp, Unknown
  misc_feature (1)..( 9): Matrix.001 file - promoters75/4772879
gggattttt

SEQ ID NO: 37778 - DNA, 17 bp, Unknown
  misc_feature (1)..( 17): Matrix.001 file - promoters75/4773074
tataaataaacccttaa

SEQ ID NO: 37779 - DNA, 10 bp, Unknown
  misc_feature (1)..( 10): Matrix.001 file - promoters75/4773074
ctataaaaaa

SEQ ID NO: 37780 - DNA, 9 bp, Unknown
  misc_feature (1)..( 9): Matrix.001 file - promoters75/4773823
agaaaattc

SEQ ID NO: 37781 - DNA, 12 bp, Unknown
  misc_feature (1)..( 12): Matrix.001 file - promoters75/4899830
aagaaaaagtaa

SEQ ID NO: 37782 - DNA, 10 bp, Unknown
  misc_feature (1)..( 10): Matrix.001 file - promoters75/4899830
aatatataac

SEQ ID NO: 37783 - DNA, 11 bp, Unknown
  misc_feature (1)..( 11): Matrix.001 file - promoters75/4900353
taatataaatt

SEQ ID NO: 37784 - DNA, 8 bp, Unknown
  misc_feature (1)..( 8): Matrix.001 file - promoters75/4900353
gggcctaa

SEQ ID NO: 37785 - DNA, 10 bp, Unknown
  misc_feature (1)..( 10): Matrix.001 file - promoters75/4901171
caaaacttcc

SEQ ID NO: 37786 - DNA, 10 bp, Unknown
  misc_feature (1)..( 10): Matrix.001 file - promoters75/4901171
aaaaattcca

SEQ ID NO: 37787 - DNA, 11 bp, Unknown
  misc_feature (1)..( 11): Matrix.001 file - promoters75/4901736
aaaaattaaac

SEQ ID NO: 37788 - DNA, 15 bp, Unknown
  misc_feature (1)..( 15): Matrix.001 file - promoters75/4901736
cgttttttaattttc

SEQ ID NO: 37789 - DNA, 7 bp, Unknown
  misc_feature (1)..( 7): Matrix.001 file - promoters75/4901736
ttgttta

SEQ ID NO: 37790 - DNA, 12 bp, Unknown
  misc_feature (1)..( 12): Matrix.001 file - promoters75/4909449
atataaaagcca

SEQ ID NO: 37791 - DNA, 10 bp, Unknown
  misc_feature (1)..( 10): Matrix.001 file - promoters75/4909449
aaaaaagttt

SEQ ID NO: 37792 - DNA, 9 bp, Unknown
  misc_feature (1)..( 9): Matrix.001 file - promoters75/4909449
atattaata

SEQ ID NO: 37793 - DNA, 7 bp, Unknown
  misc_feature (1)..( 7): Matrix.001 file - promoters75/4911485
atgtttg

SEQ ID NO: 37794 - DNA, 12 bp, Unknown
  misc_feature (1)..( 12): Matrix.001 file - promoters75/4911485
tgagtatatttt

SEQ ID NO: 37795 - DNA, 8 bp, Unknown
  misc_feature (1)..( 8): Matrix.001 file - promoters75/4911485
ttttaatt

SEQ ID NO: 37796 - DNA, 8 bp, Unknown
  misc_feature (1)..( 8): Matrix.001 file - promoters75/4911485
taagccca

SEQ ID NO: 37797 - DNA, 7 bp, Unknown
  misc_feature (1)..( 7): Matrix.001 file - promoters75/4911485
ttggata

SEQ ID NO: 37798 - DNA, 10 bp, Unknown
  misc_feature (1)..( 10): Matrix.001 file - promoters75/4911485
aaaagtttta

SEQ ID NO: 37799 - DNA, 8 bp, Unknown
  misc_feature (1)..( 8): Matrix.001 file - promoters75/4911485
aataattt

SEQ ID NO: 37800 - DNA, 12 bp, Unknown
  misc_feature (1)..( 12): Matrix.001 file - promoters75/4911485
aaaaaagaaaaa

SEQ ID NO: 37801 - DNA, 8 bp, Unknown
  misc_feature (1)..( 8): Matrix.001 file - promoters75/4911485
attttgtt

SEQ ID NO: 37802 - DNA, 13 bp, Unknown
  misc_feature (1)..( 13): Matrix.001 file - promoters75/4911485
tataaatgggcct

SEQ ID NO: 37803 - DNA, 13 bp, Unknown
  misc_feature (1)..( 13): Matrix.001 file - promoters75/4915127
cactgatttattt

SEQ ID NO: 37804 - DNA, 13 bp, Unknown
  misc_feature (1)..( 13): Matrix.001 file - promoters75/4915606
aattattatataa

SEQ ID NO: 37805 - DNA, 9 bp, Unknown
  misc_feature (1)..( 9): Matrix.001 file - promoters75/4978201
tttattttt

SEQ ID NO: 37806 - DNA, 16 bp, Unknown
  misc_feature (1)..( 16): Matrix.001 file - promoters75/4978201
aaattatgcaaaaaaa

SEQ ID NO: 37807 - DNA, 12 bp, Unknown
  misc_feature (1)..( 12): Matrix.001 file - promoters75/4978201
acaaacaaaaaa

SEQ ID NO: 37808 - DNA, 8 bp, Unknown
  misc_feature (1)..( 8): Matrix.001 file - promoters75/5662799
tttgacca

SEQ ID NO: 37809 - DNA, 8 bp, Unknown
  misc_feature (1)..( 8): Matrix.001 file - promoters75/5662893
tttgtatt

SEQ ID NO: 37810 - DNA, 10 bp, Unknown
  misc_feature (1)..( 10): Matrix.001 file - promoters75/5662914
ggaagtagag

SEQ ID NO: 37811 - DNA, 9 bp, Unknown
  misc_feature (1)..( 9): Matrix.001 file - promoters75/5662914
aagatgatg

SEQ ID NO: 37812 - DNA, 9 bp, Unknown
  misc_feature (1)..( 9): Matrix.001 file - promoters75/5663003
acctctttt

SEQ ID NO: 37813 - DNA, 7 bp, Unknown
  misc_feature (1)..( 7): Matrix.001 file - promoters75/5663003
aatttac

SEQ ID NO: 37814 - DNA, 10 bp, Unknown
  misc_feature (1)..( 10): Matrix.001 file - promoters75/5663003
aaaaaattgt

SEQ ID NO: 37815 - DNA, 8 bp, Unknown
  misc_feature (1)..( 8): Matrix.001 file - promoters75/5663003
aagctata

SEQ ID NO: 37816 - DNA, 11 bp, Unknown
  misc_feature (1)..( 11): Matrix.001 file - promoters75/5663003
ttacttaaatt

SEQ ID NO: 37817 - DNA, 9 bp, Unknown
  misc_feature (1)..( 9): Matrix.001 file - promoters75/5663003
aaagaattg

SEQ ID NO: 37818 - DNA, 13 bp, Unknown
  misc_feature (1)..( 13): Matrix.001 file - promoters75/5663003
aatatcaacgacg

SEQ ID NO: 37819 - DNA, 8 bp, Unknown
  misc_feature (1)..( 8): Matrix.001 file - promoters75/5663003
aaataata

SEQ ID NO: 37820 - DNA, 5 bp, Unknown
  misc_feature (1)..( 5): Matrix.001 file - promoters75/5663116
catta

SEQ ID NO: 37821 - DNA, 9 bp, Unknown
  misc_feature (1)..( 9): Matrix.001 file - promoters75/5663862
caactttat

SEQ ID NO: 37822 - DNA, 14 bp, Unknown
  misc_feature (1)..( 14): Matrix.001 file - promoters75/5663934
tatagtttttgtaa

SEQ ID NO: 37823 - DNA, 9 bp, Unknown
  misc_feature (1)..( 9): Matrix.001 file - promoters75/5663970
gagtttctt

SEQ ID NO: 37824 - DNA, 8 bp, Unknown
  misc_feature (1)..( 8): Matrix.001 file - promoters75/5664294
aaaatcga

SEQ ID NO: 37825 - DNA, 8 bp, Unknown
  misc_feature (1)..( 8): Matrix.001 file - promoters75/5664294
gataaaaa

SEQ ID NO: 37826 - DNA, 7 bp, Unknown
  misc_feature (1)..( 7): Matrix.001 file - promoters75/5664311
tttctca

SEQ ID NO: 37827 - DNA, 9 bp, Unknown
  misc_feature (1)..( 9): Matrix.001 file - promoters75/5664311
aataaattt

SEQ ID NO: 37828 - DNA, 9 bp, Unknown
  misc_feature (1)..( 9): Matrix.001 file - promoters75/5664362
ttgttttct

SEQ ID NO: 37829 - DNA, 7 bp, Unknown
  misc_feature (1)..( 7): Matrix.001 file - promoters75/5664465
ttcacaa

SEQ ID NO: 37830 - DNA, 12 bp, Unknown
  misc_feature (1)..( 12): Matrix.001 file - promoters75/5664703
ctttttgtatat

SEQ ID NO: 37831 - DNA, 8 bp, Unknown
  misc_feature (1)..( 8): Matrix.001 file - promoters75/5664703
tctgaatt

SEQ ID NO: 37832 - DNA, 12 bp, Unknown
  misc_feature (1)..( 12): Matrix.001 file - promoters75/5664873
aaaataaaaaaa

SEQ ID NO: 37833 - DNA, 9 bp, Unknown
  misc_feature (1)..( 9): Matrix.001 file - promoters75/5664885
attttgacc

SEQ ID NO: 37834 - DNA, 8 bp, Unknown
  misc_feature (1)..( 8): Matrix.001 file - promoters75/5664885
cattcata

SEQ ID NO: 37835 - DNA, 11 bp, Unknown
  misc_feature (1)..( 11): Matrix.001 file - promoters75/5665347
agttataaatc

SEQ ID NO: 37836 - DNA, 9 bp, Unknown
  misc_feature (1)..( 9): Matrix.001 file - promoters75/5667720
taaccaaaa

SEQ ID NO: 37837 - DNA, 12 bp, Unknown
  misc_feature (1)..( 12): Matrix.001 file - promoters75/5667720
aaaataaaaata

SEQ ID NO: 37838 - DNA, 10 bp, Unknown
  misc_feature (1)..( 10): Matrix.001 file - promoters75/5667812
gagttggata

SEQ ID NO: 37839 - DNA, 14 bp, Unknown
  misc_feature (1)..( 14): Matrix.001 file - promoters75/5667812
aaaagttttattta

SEQ ID NO: 37840 - DNA, 9 bp, Unknown
  misc_feature (1)..( 9): Matrix.001 file - promoters75/5667849
gtgaatgat

SEQ ID NO: 37841 - DNA, 8 bp, Unknown
  misc_feature (1)..( 8): Matrix.001 file - promoters75/5667849
cattttgt

SEQ ID NO: 37842 - DNA, 9 bp, Unknown
  misc_feature (1)..( 9): Matrix.001 file - promoters75/5668065
aaagaaaat

SEQ ID NO: 37843 - DNA, 14 bp, Unknown
  misc_feature (1)..( 14): Matrix.001 file - promoters75/5668065
ctcttattatttgc

SEQ ID NO: 37844 - DNA, 13 bp, Unknown
  misc_feature (1)..( 13): Matrix.001 file - promoters75/5668292
ctcttatgatttt

SEQ ID NO: 37845 - DNA, 10 bp, Unknown
  misc_feature (1)..( 10): Matrix.001 file - promoters75/5668292
aaaagtttta

SEQ ID NO: 37846 - DNA, 15 bp, Unknown
  misc_feature (1)..( 15): Matrix.001 file - promoters75/5668292
attaaagttgggccc

SEQ ID NO: 37847 - DNA, 8 bp, Unknown
  misc_feature (1)..( 8): Matrix.001 file - promoters75/5668292
atgggcca

SEQ ID NO: 37848 - DNA, 13 bp, Unknown
  misc_feature (1)..( 13): Matrix.001 file - promoters75/5668435
gagacaaaaccaa

SEQ ID NO: 37849 - DNA, 12 bp, Unknown
  misc_feature (1)..( 12): Matrix.001 file - promoters75/5668435
cattatttaaaa

SEQ ID NO: 37850 - DNA, 8 bp, Unknown
  misc_feature (1)..( 8): Matrix.001 file - promoters75/5668435
tatgggcc

SEQ ID NO: 37851 - DNA, 9 bp, Unknown
  misc_feature (1)..( 9): Matrix.001 file - promoters75/5668493
aataaatgt

SEQ ID NO: 37852 - DNA, 9 bp, Unknown
  misc_feature (1)..( 9): Matrix.001 file - promoters75/5668493
gtttattta

SEQ ID NO: 37853 - DNA, 9 bp, Unknown
  misc_feature (1)..( 9): Matrix.001 file - promoters75/5668493
tacaatatt

SEQ ID NO: 37854 - DNA, 7 bp, Unknown
  misc_feature (1)..( 7): Matrix.001 file - promoters75/5668509
agaggag

SEQ ID NO: 37855 - DNA, 13 bp, Unknown
  misc_feature (1)..( 13): Matrix.001 file - promoters75/5668720
ctaaaggcccaat

SEQ ID NO: 37856 - DNA, 11 bp, Unknown
  misc_feature (1)..( 11): Matrix.001 file - promoters75/5668720
ttcaaaaatac

SEQ ID NO: 37857 - DNA, 8 bp, Unknown
  misc_feature (1)..( 8): Matrix.001 file - promoters75/5668720
gaatttga

SEQ ID NO: 37858 - DNA, 8 bp, Unknown
  misc_feature (1)..( 8): Matrix.001 file - promoters75/5668720
tgaattgg

SEQ ID NO: 37859 - DNA, 9 bp, Unknown
  misc_feature (1)..( 9): Matrix.001 file - promoters75/5669025
tggttttat

SEQ ID NO: 37860 - DNA, 8 bp, Unknown
  misc_feature (1)..( 8): Matrix.001 file - promoters75/5669025
atatcatg

SEQ ID NO: 37861 - DNA, 7 bp, Unknown
  misc_feature (1)..( 7): Matrix.001 file - promoters75/5669250
actataa

SEQ ID NO: 37862 - DNA, 8 bp, Unknown
  misc_feature (1)..( 8): Matrix.001 file - promoters75/5670592
aaataatt

SEQ ID NO: 37863 - DNA, 14 bp, Unknown
  misc_feature (1)..( 14): Matrix.001 file - promoters75/5674194
aatcattaaagttt

SEQ ID NO: 37864 - DNA, 11 bp, Unknown
  misc_feature (1)..( 11): Matrix.001 file - promoters75/5674194
aataaaaaaaa

SEQ ID NO: 37865 - DNA, 10 bp, Unknown
  misc_feature (1)..( 10): Matrix.001 file - promoters75/5674634
aaaataaatt

SEQ ID NO: 37866 - DNA, 7 bp, Unknown
  misc_feature (1)..( 7): Matrix.001 file - promoters75/5674666
taatgaa

SEQ ID NO: 37867 - DNA, 6 bp, Unknown
  misc_feature (1)..( 6): Matrix.001 file - promoters75/5674666
atttgt

SEQ ID NO: 37868 - DNA, 7 bp, Unknown
  misc_feature (1)..( 7): Matrix.001 file - promoters75/5674666
tttattt

SEQ ID NO: 37869 - DNA, 10 bp, Unknown
  misc_feature (1)..( 10): Matrix.001 file - promoters75/5674666
gtttgtattt

SEQ ID NO: 37870 - DNA, 7 bp, Unknown
  misc_feature (1)..( 7): Matrix.001 file - promoters75/5674666
tgtattt

SEQ ID NO: 37871 - DNA, 7 bp, Unknown
  misc_feature (1)..( 7): Matrix.001 file - promoters75/5675661
aatttct

SEQ ID NO: 37872 - DNA, 8 bp, Unknown
  misc_feature (1)..( 8): Matrix.001 file - promoters75/5675661
ttggttgg

SEQ ID NO: 37873 - DNA, 7 bp, Unknown
  misc_feature (1)..( 7): Matrix.001 file - promoters75/5677230
aagtaaa

SEQ ID NO: 37874 - DNA, 7 bp, Unknown
  misc_feature (1)..( 7): Matrix.001 file - promoters75/5677230
aaaatat

SEQ ID NO: 37875 - DNA, 10 bp, Unknown
  misc_feature (1)..( 10): Matrix.001 file - promoters75/5677309
cacaaaaact

SEQ ID NO: 37876 - DNA, 11 bp, Unknown
  misc_feature (1)..( 11): Matrix.001 file - promoters75/5677309
taatttgacaa

SEQ ID NO: 37877 - DNA, 7 bp, Unknown
  misc_feature (1)..( 7): Matrix.001 file - promoters75/5677309
aaaagta

SEQ ID NO: 37878 - DNA, 7 bp, Unknown
  misc_feature (1)..( 7): Matrix.001 file - promoters75/5677344
aaaattt

SEQ ID NO: 37879 - DNA, 9 bp, Unknown
  misc_feature (1)..( 9): Matrix.001 file - promoters75/5753942
tacattgtt

SEQ ID NO: 37880 - DNA, 9 bp, Unknown
  misc_feature (1)..( 9): Matrix.001 file - promoters75/5753942
caaacaaaa

SEQ ID NO: 37881 - DNA, 9 bp, Unknown
  misc_feature (1)..( 9): Matrix.001 file - promoters75/5753942
tgttcaaaa

SEQ ID NO: 37882 - DNA, 13 bp, Unknown
  misc_feature (1)..( 13): Matrix.001 file - promoters75/5753942
gcccaaattaaaa

SEQ ID NO: 37883 - DNA, 11 bp, Unknown
  misc_feature (1)..( 11): Matrix.001 file - promoters75/5753942
tttgtgttttt

SEQ ID NO: 37884 - DNA, 7 bp, Unknown
  misc_feature (1)..( 7): Matrix.001 file - promoters75/5753942
catattt

SEQ ID NO: 37885 - DNA, 10 bp, Unknown
  misc_feature (1)..( 10): Matrix.001 file - promoters75/5753942
tttcgtacat

SEQ ID NO: 37886 - DNA, 8 bp, Unknown
  misc_feature (1)..( 8): Matrix.001 file - promoters75/5753942
gggccata

SEQ ID NO: 37887 - DNA, 7 bp, Unknown
  misc_feature (1)..( 7): Matrix.001 file - promoters75/5754280
ggcccaa

SEQ ID NO: 37888 - DNA, 11 bp, Unknown
  misc_feature (1)..( 11): Matrix.001 file - promoters75/5754280
aagcccaaata

SEQ ID NO: 37889 - DNA, 8 bp, Unknown
  misc_feature (1)..( 8): Matrix.001 file - promoters75/5756166
ttacaatg

SEQ ID NO: 37890 - DNA, 7 bp, Unknown
  misc_feature (1)..( 7): Matrix.001 file - promoters75/5756166
tcttaaa

SEQ ID NO: 37891 - DNA, 11 bp, Unknown
  misc_feature (1)..( 11): Matrix.001 file - promoters75/5758021
tcttaggattt

SEQ ID NO: 37892 - DNA, 4 bp, Unknown
  misc_feature (1)..( 4): Matrix.001 file - promoters75/5776417
caag

SEQ ID NO: 37893 - DNA, 9 bp, Unknown
  misc_feature (1)..( 9): Matrix.001 file - promoters75/5776417
cgattcaat

SEQ ID NO: 37894 - DNA, 7 bp, Unknown
  misc_feature (1)..( 7): Matrix.001 file - promoters75/5776417
agttttt

SEQ ID NO: 37895 - DNA, 8 bp, Unknown
  misc_feature (1)..( 8): Matrix.001 file - promoters70/1007030
aaacgaat

SEQ ID NO: 37896 - DNA, 11 bp, Unknown
  misc_feature (1)..( 11): Matrix.001 file - promoters70/1007030
gaaaatataca

SEQ ID NO: 37897 - DNA, 12 bp, Unknown
  misc_feature (1)..( 12): Matrix.001 file - promoters70/1007030
atccaaatctaa

SEQ ID NO: 37898 - DNA, 7 bp, Unknown
  misc_feature (1)..( 7): Matrix.001 file - promoters70/1007030
aatctga

SEQ ID NO: 37899 - DNA, 12 bp, Unknown
  misc_feature (1)..( 12): Matrix.001 file - promoters70/1007030
ttatcaaaatta

SEQ ID NO: 37900 - DNA, 9 bp, Unknown
  misc_feature (1)..( 9): Matrix.001 file - promoters70/1007030
taaacatat

SEQ ID NO: 37901 - DNA, 9 bp, Unknown
  misc_feature (1)..( 9): Matrix.001 file - promoters70/1007273
aaagaacct

SEQ ID NO: 37902 - DNA, 8 bp, Unknown
  misc_feature (1)..( 8): Matrix.001 file - promoters70/1007273
attccaaa

SEQ ID NO: 37903 - DNA, 9 bp, Unknown
  misc_feature (1)..( 9): Matrix.001 file - promoters70/1007273
gaaagaacc

SEQ ID NO: 37904 - DNA, 7 bp, Unknown
  misc_feature (1)..( 7): Matrix.001 file - promoters70/1007273
agattac

SEQ ID NO: 37905 - DNA, 8 bp, Unknown
  misc_feature (1)..( 8): Matrix.001 file - promoters70/1007273
atgaatca

SEQ ID NO: 37906 - DNA, 10 bp, Unknown
  misc_feature (1)..( 10): Matrix.001 file - promoters70/1007273
agagaagaaa

SEQ ID NO: 37907 - DNA, 8 bp, Unknown
  misc_feature (1)..( 8): Matrix.001 file - promoters70/1007273
aaaagaaa

SEQ ID NO: 37908 - DNA, 7 bp, Unknown
  misc_feature (1)..( 7): Matrix.001 file - promoters70/1007273
cttaaat

SEQ ID NO: 37909 - DNA, 6 bp, Unknown
  misc_feature (1)..( 6): Matrix.001 file - promoters70/1007273
caaaac

SEQ ID NO: 37910 - DNA, 10 bp, Unknown
  misc_feature (1)..( 10): Matrix.001 file - promoters70/1007639
ataaaaacaa

SEQ ID NO: 37911 - DNA, 12 bp, Unknown
  misc_feature (1)..( 12): Matrix.001 file - promoters70/1007639
cagaaatataaa

SEQ ID NO: 37912 - DNA, 11 bp, Unknown
  misc_feature (1)..( 11): Matrix.001 file - promoters70/1007639
agttttgtatt

SEQ ID NO: 37913 - DNA, 12 bp, Unknown
  misc_feature (1)..( 12): Matrix.001 file - promoters70/1007639
aattatttgtgg

SEQ ID NO: 37914 - DNA, 9 bp, Unknown
  misc_feature (1)..( 9): Matrix.001 file - promoters70/1007639
atatcattc

SEQ ID NO: 37915 - DNA, 8 bp, Unknown
  misc_feature (1)..( 8): Matrix.001 file - promoters70/1007759
aagaagaa

SEQ ID NO: 37916 - DNA, 9 bp, Unknown
  misc_feature (1)..( 9): Matrix.001 file - promoters70/1007759
agctaaaca

SEQ ID NO: 37917 - DNA, 8 bp, Unknown
  misc_feature (1)..( 8): Matrix.001 file - promoters70/1007759
gagttaga

SEQ ID NO: 37918 - DNA, 14 bp, Unknown
  misc_feature (1)..( 14): Matrix.001 file - promoters70/1007759
gagtgggaggaaaa

SEQ ID NO: 37919 - DNA, 8 bp, Unknown
  misc_feature (1)..( 8): Matrix.001 file - promoters70/1007967
attcttaa

SEQ ID NO: 37920 - DNA, 9 bp, Unknown
  misc_feature (1)..( 9): Matrix.001 file - promoters70/1007967
aatttgaac

SEQ ID NO: 37921 - DNA, 9 bp, Unknown
  misc_feature (1)..( 9): Matrix.001 file - promoters70/1008070
aaaacaaac

SEQ ID NO: 37922 - DNA, 9 bp, Unknown
  misc_feature (1)..( 9): Matrix.001 file - promoters70/1008070
atttcataa

SEQ ID NO: 37923 - DNA, 11 bp, Unknown
  misc_feature (1)..( 11): Matrix.001 file - promoters70/1008070
ccatttatata

SEQ ID NO: 37924 - DNA, 9 bp, Unknown
  misc_feature (1)..( 9): Matrix.001 file - promoters70/1008070
aaaatgaaa

SEQ ID NO: 37925 - DNA, 12 bp, Unknown
  misc_feature (1)..( 12): Matrix.001 file - promoters70/1008148
ctataatacaaa

SEQ ID NO: 37926 - DNA, 11 bp, Unknown
  misc_feature (1)..( 11): Matrix.001 file - promoters70/1008148
atatagattta

SEQ ID NO: 37927 - DNA, 9 bp, Unknown
  misc_feature (1)..( 9): Matrix.001 file - promoters70/1008148
atcatagat

SEQ ID NO: 37928 - DNA, 12 bp, Unknown
  misc_feature (1)..( 12): Matrix.001 file - promoters70/1008148
ctatataaagac

SEQ ID NO: 37929 - DNA, 8 bp, Unknown
  misc_feature (1)..( 8): Matrix.001 file - promoters70/1008148
aaataaat

SEQ ID NO: 37930 - DNA, 10 bp, Unknown
  misc_feature (1)..( 10): Matrix.001 file - promoters70/1008148
agattagaga

SEQ ID NO: 37931 - DNA, 6 bp, Unknown
  misc_feature (1)..( 6): Matrix.001 file - promoters70/1008148
attaat

SEQ ID NO: 37932 - DNA, 9 bp, Unknown
  misc_feature (1)..( 9): Matrix.001 file - promoters70/1008218
catttaagt

SEQ ID NO: 37933 - DNA, 9 bp, Unknown
  misc_feature (1)..( 9): Matrix.001 file - promoters70/1008218
ttatttata

SEQ ID NO: 37934 - DNA, 7 bp, Unknown
  misc_feature (1)..( 7): Matrix.001 file - promoters70/1008218
tagtatt

SEQ ID NO: 37935 - DNA, 10 bp, Unknown
  misc_feature (1)..( 10): Matrix.001 file - promoters70/1008425
caaatacatt

SEQ ID NO: 37936 - DNA, 8 bp, Unknown
  misc_feature (1)..( 8): Matrix.001 file - promoters70/1008425
cttttgaa

SEQ ID NO: 37937 - DNA, 9 bp, Unknown
  misc_feature (1)..( 9): Matrix.001 file - promoters70/1008443
agaaatgac

SEQ ID NO: 37938 - DNA, 8 bp, Unknown
  misc_feature (1)..( 8): Matrix.001 file - promoters70/1008443
caaaaaaa

SEQ ID NO: 37939 - DNA, 14 bp, Unknown
  misc_feature (1)..( 14): Matrix.001 file - promoters70/1008443
tatagaaaagacaa

SEQ ID NO: 37940 - DNA, 15 bp, Unknown
  misc_feature (1)..( 15): Matrix.001 file - promoters70/1008443
ataataatgtaatat

SEQ ID NO: 37941 - DNA, 11 bp, Unknown
  misc_feature (1)..( 11): Matrix.001 file - promoters70/1008732
aaaataattta

SEQ ID NO: 37942 - DNA, 7 bp, Unknown
  misc_feature (1)..( 7): Matrix.001 file - promoters70/1008808
cgaagaa

SEQ ID NO: 37943 - DNA, 8 bp, Unknown
  misc_feature (1)..( 8): Matrix.001 file - promoters70/1008808
acttcctt

SEQ ID NO: 37944 - DNA, 7 bp, Unknown
  misc_feature (1)..( 7): Matrix.001 file - promoters70/1008808
gtttgaa

SEQ ID NO: 37945 - DNA, 9 bp, Unknown
  misc_feature (1)..( 9): Matrix.001 file - promoters70/1008808
aaatgatta

SEQ ID NO: 37946 - DNA, 7 bp, Unknown
  misc_feature (1)..( 7): Matrix.001 file - promoters70/1008808
aatattg

SEQ ID NO: 37947 - DNA, 12 bp, Unknown
  misc_feature (1)..( 12): Matrix.001 file - promoters70/1008836
taaaatacaaat

SEQ ID NO: 37948 - DNA, 10 bp, Unknown
  misc_feature (1)..( 10): Matrix.001 file - promoters70/1008836
atatttttat

SEQ ID NO: 37949 - DNA, 8 bp, Unknown
  misc_feature (1)..( 8): Matrix.001 file - promoters70/1008836
tcaaaaga

SEQ ID NO: 37950 - DNA, 8 bp, Unknown
  misc_feature (1)..( 8): Matrix.001 file - promoters70/1008836
aaaacttt

SEQ ID NO: 37951 - DNA, 9 bp, Unknown
  misc_feature (1)..( 9): Matrix.001 file - promoters70/1008836
aattaaatg

SEQ ID NO: 37952 - DNA, 10 bp, Unknown
  misc_feature (1)..( 10): Matrix.001 file - promoters70/1008836
aaagaattta

SEQ ID NO: 37953 - DNA, 10 bp, Unknown
  misc_feature (1)..( 10): Matrix.001 file - promoters70/1008836
taattatcca

SEQ ID NO: 37954 - DNA, 8 bp, Unknown
  misc_feature (1)..( 8): Matrix.001 file - promoters70/1008836
tccaaata

SEQ ID NO: 37955 - DNA, 8 bp, Unknown
  misc_feature (1)..( 8): Matrix.001 file - promoters70/1009030
atttttag

SEQ ID NO: 37956 - DNA, 11 bp, Unknown
  misc_feature (1)..( 11): Matrix.001 file - promoters70/1009030
tctcttttcat

SEQ ID NO: 37957 - DNA, 11 bp, Unknown
  misc_feature (1)..( 11): Matrix.001 file - promoters70/1009234
cgatacttgtc

SEQ ID NO: 37958 - DNA, 10 bp, Unknown
  misc_feature (1)..( 10): Matrix.001 file - promoters70/1009234
aagaactcat

SEQ ID NO: 37959 - DNA, 12 bp, Unknown
  misc_feature (1)..( 12): Matrix.001 file - promoters70/1009234
ttaaatgaagat

SEQ ID NO: 37960 - DNA, 10 bp, Unknown
  misc_feature (1)..( 10): Matrix.001 file - promoters70/1009234
tgtggtccat

SEQ ID NO: 37961 - DNA, 8 bp, Unknown
  misc_feature (1)..( 8): Matrix.001 file - promoters70/1009387
tctttgtc

SEQ ID NO: 37962 - DNA, 8 bp, Unknown
  misc_feature (1)..( 8): Matrix.001 file - promoters70/1009387
cttcttca

SEQ ID NO: 37963 - DNA, 8 bp, Unknown
  misc_feature (1)..( 8): Matrix.001 file - promoters70/1009387
ttatatgg

SEQ ID NO: 37964 - DNA, 7 bp, Unknown
  misc_feature (1)..( 7): Matrix.001 file - promoters70/1009520
aatatat

SEQ ID NO: 37965 - DNA, 9 bp, Unknown
  misc_feature (1)..( 9): Matrix.001 file - promoters70/1009520
ttgtatatt

SEQ ID NO: 37966 - DNA, 9 bp, Unknown
  misc_feature (1)..( 9): Matrix.001 file - promoters70/1009520
aaagaaaaa

SEQ ID NO: 37967 - DNA, 9 bp, Unknown
  misc_feature (1)..( 9): Matrix.001 file - promoters70/1009520
tttgtctat

SEQ ID NO: 37968 - DNA, 9 bp, Unknown
  misc_feature (1)..( 9): Matrix.001 file - promoters70/1009520
tcttctttg

SEQ ID NO: 37969 - DNA, 11 bp, Unknown
  misc_feature (1)..( 11): Matrix.001 file - promoters70/1009941
actatatatat

SEQ ID NO: 37970 - DNA, 11 bp, Unknown
  misc_feature (1)..( 11): Matrix.001 file - promoters70/1009941
aaattggatta

SEQ ID NO: 37971 - DNA, 9 bp, Unknown
  misc_feature (1)..( 9): Matrix.001 file - promoters70/1010025
agattttct

SEQ ID NO: 37972 - DNA, 11 bp, Unknown
  misc_feature (1)..( 11): Matrix.001 file - promoters70/1010025
atttatttgtg

SEQ ID NO: 37973 - DNA, 8 bp, Unknown
  misc_feature (1)..( 8): Matrix.001 file - promoters70/1010025
atgtacta

SEQ ID NO: 37974 - DNA, 7 bp, Unknown
  misc_feature (1)..( 7): Matrix.001 file - promoters70/1010055
aaaaata

SEQ ID NO: 37975 - DNA, 9 bp, Unknown
  misc_feature (1)..( 9): Matrix.001 file - promoters70/1010055
aaaacaaat

SEQ ID NO: 37976 - DNA, 9 bp, Unknown
  misc_feature (1)..( 9): Matrix.001 file - promoters70/1010055
atattatta

SEQ ID NO: 37977 - DNA, 9 bp, Unknown
  misc_feature (1)..( 9): Matrix.001 file - promoters70/1010055
tcaacatat

SEQ ID NO: 37978 - DNA, 8 bp, Unknown
  misc_feature (1)..( 8): Matrix.001 file - promoters70/1010115
caaacctg

SEQ ID NO: 37979 - DNA, 8 bp, Unknown
  misc_feature (1)..( 8): Matrix.001 file - promoters70/1010115
agatacag

SEQ ID NO: 37980 - DNA, 9 bp, Unknown
  misc_feature (1)..( 9): Matrix.001 file - promoters70/1010115
tttcaagtt

SEQ ID NO: 37981 - DNA, 7 bp, Unknown
  misc_feature (1)..( 7): Matrix.001 file - promoters70/1010367
aaaaata

SEQ ID NO: 37982 - DNA, 7 bp, Unknown
  misc_feature (1)..( 7): Matrix.001 file - promoters70/1010367
aaaataa

SEQ ID NO: 37983 - DNA, 9 bp, Unknown
  misc_feature (1)..( 9): Matrix.001 file - promoters70/1010367
aaaaaaaat

SEQ ID NO: 37984 - DNA, 12 bp, Unknown
  misc_feature (1)..( 12): Matrix.001 file - promoters70/1010367
atttggataaaa

SEQ ID NO: 37985 - DNA, 9 bp, Unknown
  misc_feature (1)..( 9): Matrix.001 file - promoters70/1010367
cctctttcc

SEQ ID NO: 37986 - DNA, 11 bp, Unknown
  misc_feature (1)..( 11): Matrix.001 file - promoters70/1010367
aaatacaaaaa

SEQ ID NO: 37987 - DNA, 7 bp, Unknown
  misc_feature (1)..( 7): Matrix.001 file - promoters70/1010367
aaaaact

SEQ ID NO: 37988 - DNA, 11 bp, Unknown
  misc_feature (1)..( 11): Matrix.001 file - promoters70/1010367
aaaaaataaaa

SEQ ID NO: 37989 - DNA, 8 bp, Unknown
  misc_feature (1)..( 8): Matrix.001 file - promoters70/1010367
aaaccaat

SEQ ID NO: 37990 - DNA, 8 bp, Unknown
  misc_feature (1)..( 8): Matrix.001 file - promoters70/1010367
aatgaatt

SEQ ID NO: 37991 - DNA, 7 bp, Unknown
  misc_feature (1)..( 7): Matrix.001 file - promoters70/1010367
taacaaa

SEQ ID NO: 37992 - DNA, 8 bp, Unknown
  misc_feature (1)..( 8): Matrix.001 file - promoters70/1010385
gctttttg

SEQ ID NO: 37993 - DNA, 7 bp, Unknown
  misc_feature (1)..( 7): Matrix.001 file - promoters70/1010429
taataat

SEQ ID NO: 37994 - DNA, 7 bp, Unknown
  misc_feature (1)..( 7): Matrix.001 file - promoters70/1010429
atgttct

SEQ ID NO: 37995 - DNA, 9 bp, Unknown
  misc_feature (1)..( 9): Matrix.001 file - promoters70/1010429
aattataca

SEQ ID NO: 37996 - DNA, 10 bp, Unknown
  misc_feature (1)..( 10): Matrix.001 file - promoters70/1010429
gttattaatt

SEQ ID NO: 37997 - DNA, 8 bp, Unknown
  misc_feature (1)..( 8): Matrix.001 file - promoters70/1010435
tcttcttc

SEQ ID NO: 37998 - DNA, 10 bp, Unknown
  misc_feature (1)..( 10): Matrix.001 file - promoters70/1010435
attatcaaag

SEQ ID NO: 37999 - DNA, 10 bp, Unknown
  misc_feature (1)..( 10): Matrix.001 file - promoters70/1010435
aatctgaatc

SEQ ID NO: 38000 - DNA, 8 bp, Unknown
  misc_feature (1)..( 8): Matrix.001 file - promoters70/1010449
gagtttat

SEQ ID NO: 38001 - DNA, 7 bp, Unknown
  misc_feature (1)..( 7): Matrix.001 file - promoters70/1010449
tgtgttt

SEQ ID NO: 38002 - DNA, 8 bp, Unknown
  misc_feature (1)..( 8): Matrix.001 file - promoters70/1010636
gcttggat

SEQ ID NO: 38003 - DNA, 8 bp, Unknown
  misc_feature (1)..( 8): Matrix.001 file - promoters70/1010636
cgaaagtt

SEQ ID NO: 38004 - DNA, 10 bp, Unknown
  misc_feature (1)..( 10): Matrix.001 file - promoters70/1010636
tttaaaccct

SEQ ID NO: 38005 - DNA, 8 bp, Unknown
  misc_feature (1)..( 8): Matrix.001 file - promoters70/1010636
gtggcatt

SEQ ID NO: 38006 - DNA, 7 bp, Unknown
  misc_feature (1)..( 7): Matrix.001 file - promoters70/1010636
ttttcta

SEQ ID NO: 38007 - DNA, 11 bp, Unknown
  misc_feature (1)..( 11): Matrix.001 file - promoters70/1010815
aaattgtttgt

SEQ ID NO: 38008 - DNA, 9 bp, Unknown
  misc_feature (1)..( 9): Matrix.001 file - promoters70/1010819
atttttggt

SEQ ID NO: 38009 - DNA, 11 bp, Unknown
  misc_feature (1)..( 11): Matrix.001 file - promoters70/1010993
aaaataataaa

SEQ ID NO: 38010 - DNA, 9 bp, Unknown
  misc_feature (1)..( 9): Matrix.001 file - promoters70/1010993
aaaaaacta

SEQ ID NO: 38011 - DNA, 8 bp, Unknown
  misc_feature (1)..( 8): Matrix.001 file - promoters70/1010993
taaaaaac

SEQ ID NO: 38012 - DNA, 10 bp, Unknown
  misc_feature (1)..( 10): Matrix.001 file - promoters70/1010993
tatagaattt

SEQ ID NO: 38013 - DNA, 7 bp, Unknown
  misc_feature (1)..( 7): Matrix.001 file - promoters70/1011337
aaaaaaa

SEQ ID NO: 38014 - DNA, 11 bp, Unknown
  misc_feature (1)..( 11): Matrix.001 file - promoters70/1011358
cgatacttgtc

SEQ ID NO: 38015 - DNA, 10 bp, Unknown
  misc_feature (1)..( 10): Matrix.001 file - promoters70/1011358
aagaactcat

SEQ ID NO: 38016 - DNA, 12 bp, Unknown
  misc_feature (1)..( 12): Matrix.001 file - promoters70/1011358
ttaaatgaagat

SEQ ID NO: 38017 - DNA, 10 bp, Unknown
  misc_feature (1)..( 10): Matrix.001 file - promoters70/1011358
tgtggtccat

SEQ ID NO: 38018 - DNA, 12 bp, Unknown
  misc_feature (1)..( 12): Matrix.001 file - promoters70/1011780
tgtaaattttgc

SEQ ID NO: 38019 - DNA, 7 bp, Unknown
  misc_feature (1)..( 7): Matrix.001 file - promoters70/1011780
aaaaata

SEQ ID NO: 38020 - DNA, 7 bp, Unknown
  misc_feature (1)..( 7): Matrix.001 file - promoters70/1011780
tttgtta

SEQ ID NO: 38021 - DNA, 8 bp, Unknown
  misc_feature (1)..( 8): Matrix.001 file - promoters70/1011780
gtaataat

SEQ ID NO: 38022 - DNA, 11 bp, Unknown
  misc_feature (1)..( 11): Matrix.001 file - promoters70/1011780
aaaggcccata

SEQ ID NO: 38023 - DNA, 7 bp, Unknown
  misc_feature (1)..( 7): Matrix.001 file - promoters70/1011780
caaaaaa

SEQ ID NO: 38024 - DNA, 6 bp, Unknown
  misc_feature (1)..( 6): Matrix.001 file - promoters70/1011780
tcaaaa

SEQ ID NO: 38025 - DNA, 11 bp, Unknown
  misc_feature (1)..( 11): Matrix.001 file - promoters70/1011780
catgaatttaa

SEQ ID NO: 38026 - DNA, 9 bp, Unknown
  misc_feature (1)..( 9): Matrix.001 file - promoters70/1011923
ttgttgttt

SEQ ID NO: 38027 - DNA, 11 bp, Unknown
  misc_feature (1)..( 11): Matrix.001 file - promoters70/1011923
atcttcatgtt

SEQ ID NO: 38028 - DNA, 10 bp, Unknown
  misc_feature (1)..( 10): Matrix.001 file - promoters70/1011972
aaactttttt

SEQ ID NO: 38029 - DNA, 10 bp, Unknown
  misc_feature (1)..( 10): Matrix.001 file - promoters70/1011972
ttttaacaaa

SEQ ID NO: 38030 - DNA, 8 bp, Unknown
  misc_feature (1)..( 8): Matrix.001 file - promoters70/1011972
tgcataag

SEQ ID NO: 38031 - DNA, 9 bp, Unknown
  misc_feature (1)..( 9): Matrix.001 file - promoters70/1011972
gaatctctt

SEQ ID NO: 38032 - DNA, 7 bp, Unknown
  misc_feature (1)..( 7): Matrix.001 file - promoters70/1011972
tttaaag

SEQ ID NO: 38033 - DNA, 11 bp, Unknown
  misc_feature (1)..( 11): Matrix.001 file - promoters70/1011972
aatctttttaa

SEQ ID NO: 38034 - DNA, 9 bp, Unknown
  misc_feature (1)..( 9): Matrix.001 file - promoters70/1011972
ttctgctaa

SEQ ID NO: 38035 - DNA, 9 bp, Unknown
  misc_feature (1)..( 9): Matrix.001 file - promoters70/1011972
ctatataaa

SEQ ID NO: 38036 - DNA, 12 bp, Unknown
  misc_feature (1)..( 12): Matrix.001 file - promoters70/1011972
actgtttgatat

SEQ ID NO: 38037 - DNA, 8 bp, Unknown
  misc_feature (1)..( 8): Matrix.001 file - promoters70/1011972
attttcaa

SEQ ID NO: 38038 - DNA, 9 bp, Unknown
  misc_feature (1)..( 9): Matrix.001 file - promoters70/1011972
ctaatcaac

SEQ ID NO: 38039 - DNA, 9 bp, Unknown
  misc_feature (1)..( 9): Matrix.001 file - promoters70/1011972
atctacata

SEQ ID NO: 38040 - DNA, 8 bp, Unknown
  misc_feature (1)..( 8): Matrix.001 file - promoters70/1011972
atcaatat

SEQ ID NO: 38041 - DNA, 7 bp, Unknown
  misc_feature (1)..( 7): Matrix.001 file - promoters70/1011972
tgacatt

SEQ ID NO: 38042 - DNA, 7 bp, Unknown
  misc_feature (1)..( 7): Matrix.001 file - promoters70/1011972
tttcgga

SEQ ID NO: 38043 - DNA, 6 bp, Unknown
  misc_feature (1)..( 6): Matrix.001 file - promoters70/1012003
aagttt

SEQ ID NO: 38044 - DNA, 15 bp, Unknown
  misc_feature (1)..( 15): Matrix.001 file - promoters70/1012003
agcaaaaaaatctca

SEQ ID NO: 38045 - DNA, 9 bp, Unknown
  misc_feature (1)..( 9): Matrix.001 file - promoters70/1012003
tatatataa

SEQ ID NO: 38046 - DNA, 9 bp, Unknown
  misc_feature (1)..( 9): Matrix.001 file - promoters70/1012003
tgaagaaaa

SEQ ID NO: 38047 - DNA, 11 bp, Unknown
  misc_feature (1)..( 11): Matrix.001 file - promoters70/1012003
gaaaaaaatcc

SEQ ID NO: 38048 - DNA, 15 bp, Unknown
  misc_feature (1)..( 15): Matrix.001 file - promoters70/1012003
aaaggcccaatttca

SEQ ID NO: 38049 - DNA, 8 bp, Unknown
  misc_feature (1)..( 8): Matrix.001 file - promoters70/1012074
agtgttca

SEQ ID NO: 38050 - DNA, 10 bp, Unknown
  misc_feature (1)..( 10): Matrix.001 file - promoters70/1012074
ttttaataag

SEQ ID NO: 38051 - DNA, 11 bp, Unknown
  misc_feature (1)..( 11): Matrix.001 file - promoters70/1012110
ccataattaag

SEQ ID NO: 38052 - DNA, 10 bp, Unknown
  misc_feature (1)..( 10): Matrix.001 file - promoters70/1012334
gttttttcgt

SEQ ID NO: 38053 - DNA, 12 bp, Unknown
  misc_feature (1)..( 12): Matrix.001 file - promoters70/1012349
aaacgtttgtta

SEQ ID NO: 38054 - DNA, 11 bp, Unknown
  misc_feature (1)..( 11): Matrix.001 file - promoters70/1012349
tttcttaaaaa

SEQ ID NO: 38055 - DNA, 8 bp, Unknown
  misc_feature (1)..( 8): Matrix.001 file - promoters70/1012407
ccatctga

SEQ ID NO: 38056 - DNA, 8 bp, Unknown
  misc_feature (1)..( 8): Matrix.001 file - promoters70/1012407
aattttaa

SEQ ID NO: 38057 - DNA, 6 bp, Unknown
  misc_feature (1)..( 6): Matrix.001 file - promoters70/1012407
ttattc

SEQ ID NO: 38058 - DNA, 10 bp, Unknown
  misc_feature (1)..( 10): Matrix.001 file - promoters70/1012407
ccaaataatt

SEQ ID NO: 38059 - DNA, 9 bp, Unknown
  misc_feature (1)..( 9): Matrix.001 file - promoters70/1012580
tcttataat

SEQ ID NO: 38060 - DNA, 8 bp, Unknown
  misc_feature (1)..( 8): Matrix.001 file - promoters70/1012580
tcttataa

SEQ ID NO: 38061 - DNA, 9 bp, Unknown
  misc_feature (1)..( 9): Matrix.001 file - promoters70/1012673
tatcatttt

SEQ ID NO: 38062 - DNA, 11 bp, Unknown
  misc_feature (1)..( 11): Matrix.001 file - promoters70/1012757
tgtttgaacat

SEQ ID NO: 38063 - DNA, 8 bp, Unknown
  misc_feature (1)..( 8): Matrix.001 file - promoters70/1012757
caacgaaa

SEQ ID NO: 38064 - DNA, 8 bp, Unknown
  misc_feature (1)..( 8): Matrix.001 file - promoters70/1012883
aaagattg

SEQ ID NO: 38065 - DNA, 7 bp, Unknown
  misc_feature (1)..( 7): Matrix.001 file - promoters70/1012883
ccattaa

SEQ ID NO: 38066 - DNA, 9 bp, Unknown
  misc_feature (1)..( 9): Matrix.001 file - promoters70/1012883
actaaatta

SEQ ID NO: 38067 - DNA, 9 bp, Unknown
  misc_feature (1)..( 9): Matrix.001 file - promoters70/1013128
gtagtgaaa

SEQ ID NO: 38068 - DNA, 10 bp, Unknown
  misc_feature (1)..( 10): Matrix.001 file - promoters70/1013128
agaaaaaaaa

SEQ ID NO: 38069 - DNA, 11 bp, Unknown
  misc_feature (1)..( 11): Matrix.001 file - promoters70/1013128
atttttctaat

SEQ ID NO: 38070 - DNA, 7 bp, Unknown
  misc_feature (1)..( 7): Matrix.001 file - promoters70/1013128
gaaattg

SEQ ID NO: 38071 - DNA, 7 bp, Unknown
  misc_feature (1)..( 7): Matrix.001 file - promoters70/1013128
atataaa

SEQ ID NO: 38072 - DNA, 11 bp, Unknown
  misc_feature (1)..( 11): Matrix.001 file - promoters70/1013208
attttattcta

SEQ ID NO: 38073 - DNA, 11 bp, Unknown
  misc_feature (1)..( 11): Matrix.001 file - promoters70/1013208
cttctttatag

SEQ ID NO: 38074 - DNA, 9 bp, Unknown
  misc_feature (1)..( 9): Matrix.001 file - promoters70/1013242
tctttataa

SEQ ID NO: 38075 - DNA, 9 bp, Unknown
  misc_feature (1)..( 9): Matrix.001 file - promoters70/1013242
atgatttag

SEQ ID NO: 38076 - DNA, 8 bp, Unknown
  misc_feature (1)..( 8): Matrix.001 file - promoters70/1013242
tctttctc

SEQ ID NO: 38077 - DNA, 9 bp, Unknown
  misc_feature (1)..( 9): Matrix.001 file - promoters70/1013242
aaaaacata

SEQ ID NO: 38078 - DNA, 12 bp, Unknown
  misc_feature (1)..( 12): Matrix.001 file - promoters70/1013314
taaaatacaaat

SEQ ID NO: 38079 - DNA, 10 bp, Unknown
  misc_feature (1)..( 10): Matrix.001 file - promoters70/1013314
atatttttat

SEQ ID NO: 38080 - DNA, 8 bp, Unknown
  misc_feature (1)..( 8): Matrix.001 file - promoters70/1013314
tcaaaaga

SEQ ID NO: 38081 - DNA, 8 bp, Unknown
  misc_feature (1)..( 8): Matrix.001 file - promoters70/1013314
aaaacttt

SEQ ID NO: 38082 - DNA, 9 bp, Unknown
  misc_feature (1)..( 9): Matrix.001 file - promoters70/1013314
aattaaatg

SEQ ID NO: 38083 - DNA, 10 bp, Unknown
  misc_feature (1)..( 10): Matrix.001 file - promoters70/1013314
aaagaattta

SEQ ID NO: 38084 - DNA, 10 bp, Unknown
  misc_feature (1)..( 10): Matrix.001 file - promoters70/1013314
taattatcca

SEQ ID NO: 38085 - DNA, 8 bp, Unknown
  misc_feature (1)..( 8): Matrix.001 file - promoters70/1013314
tccaaata

SEQ ID NO: 38086 - DNA, 8 bp, Unknown
  misc_feature (1)..( 8): Matrix.001 file - promoters70/1013384
aaaacaga

SEQ ID NO: 38087 - DNA, 14 bp, Unknown
  misc_feature (1)..( 14): Matrix.001 file - promoters70/1013540
aatcctcaaaacta

SEQ ID NO: 38088 - DNA, 8 bp, Unknown
  misc_feature (1)..( 8): Matrix.001 file - promoters70/1013540
cctcacac

SEQ ID NO: 38089 - DNA, 11 bp, Unknown
  misc_feature (1)..( 11): Matrix.001 file - promoters70/1013690
taagaggtata

SEQ ID NO: 38090 - DNA, 11 bp, Unknown
  misc_feature (1)..( 11): Matrix.001 file - promoters70/1013786
agtctaggaac

SEQ ID NO: 38091 - DNA, 6 bp, Unknown
  misc_feature (1)..( 6): Matrix.001 file - promoters70/1013786
aaaaat

SEQ ID NO: 38092 - DNA, 9 bp, Unknown
  misc_feature (1)..( 9): Matrix.001 file - promoters70/1013786
tatataaat

SEQ ID NO: 38093 - DNA, 12 bp, Unknown
  misc_feature (1)..( 12): Matrix.001 file - promoters70/1013786
aaaaatttaata

SEQ ID NO: 38094 - DNA, 9 bp, Unknown
  misc_feature (1)..( 9): Matrix.001 file - promoters70/1013904
ttagtaatt

SEQ ID NO: 38095 - DNA, 8 bp, Unknown
  misc_feature (1)..( 8): Matrix.001 file - promoters70/1013904
aattatat

SEQ ID NO: 38096 - DNA, 10 bp, Unknown
  misc_feature (1)..( 10): Matrix.001 file - promoters70/1013904
tgataaaatt

SEQ ID NO: 38097 - DNA, 7 bp, Unknown
  misc_feature (1)..( 7): Matrix.001 file - promoters70/1013904
aataaaa

SEQ ID NO: 38098 - DNA, 8 bp, Unknown
  misc_feature (1)..( 8): Matrix.001 file - promoters70/1013904
gtttaggt

SEQ ID NO: 38099 - DNA, 11 bp, Unknown
  misc_feature (1)..( 11): Matrix.001 file - promoters70/1013904
aagaaaaaaat

SEQ ID NO: 38100 - DNA, 8 bp, Unknown
  misc_feature (1)..( 8): Matrix.001 file - promoters70/1013904
ttaataat

SEQ ID NO: 38101 - DNA, 7 bp, Unknown
  misc_feature (1)..( 7): Matrix.001 file - promoters70/1013904
taataat

SEQ ID NO: 38102 - DNA, 8 bp, Unknown
  misc_feature (1)..( 8): Matrix.001 file - promoters70/1013904
caatattt

SEQ ID NO: 38103 - DNA, 7 bp, Unknown
  misc_feature (1)..( 7): Matrix.001 file - promoters70/1013904
tttatat

SEQ ID NO: 38104 - DNA, 7 bp, Unknown
  misc_feature (1)..( 7): Matrix.001 file - promoters70/1014010
tattaaa

SEQ ID NO: 38105 - DNA, 9 bp, Unknown
  misc_feature (1)..( 9): Matrix.001 file - promoters70/1014050
aaaatagtt

SEQ ID NO: 38106 - DNA, 11 bp, Unknown
  misc_feature (1)..( 11): Matrix.001 file - promoters70/1014125
aaaatgtgaaa

SEQ ID NO: 38107 - DNA, 10 bp, Unknown
  misc_feature (1)..( 10): Matrix.001 file - promoters70/1014125
ccaattttaa

SEQ ID NO: 38108 - DNA, 10 bp, Unknown
  misc_feature (1)..( 10): Matrix.001 file - promoters70/1014176
attctaattt

SEQ ID NO: 38109 - DNA, 8 bp, Unknown
  misc_feature (1)..( 8): Matrix.001 file - promoters70/1014180
tcaatttt

SEQ ID NO: 38110 - DNA, 7 bp, Unknown
  misc_feature (1)..( 7): Matrix.001 file - promoters70/1014180
caatatt

SEQ ID NO: 38111 - DNA, 10 bp, Unknown
  misc_feature (1)..( 10): Matrix.001 file - promoters70/1014452
aacattaata

SEQ ID NO: 38112 - DNA, 8 bp, Unknown
  misc_feature (1)..( 8): Matrix.001 file - promoters70/1014452
tataaata

SEQ ID NO: 38113 - DNA, 7 bp, Unknown
  misc_feature (1)..( 7): Matrix.001 file - promoters70/1014525
aaaaata

SEQ ID NO: 38114 - DNA, 8 bp, Unknown
  misc_feature (1)..( 8): Matrix.001 file - promoters70/1014525
aatcaaaa

SEQ ID NO: 38115 - DNA, 9 bp, Unknown
  misc_feature (1)..( 9): Matrix.001 file - promoters70/1014525
tatatatac

SEQ ID NO: 38116 - DNA, 8 bp, Unknown
  misc_feature (1)..( 8): Matrix.001 file - promoters70/1014641
ttttgttt

SEQ ID NO: 38117 - DNA, 8 bp, Unknown
  misc_feature (1)..( 8): Matrix.001 file - promoters70/1014641
gttcttct

SEQ ID NO: 38118 - DNA, 8 bp, Unknown
  misc_feature (1)..( 8): Matrix.001 file - promoters70/1014662
aaaaaaga

SEQ ID NO: 38119 - DNA, 8 bp, Unknown
  misc_feature (1)..( 8): Matrix.001 file - promoters70/1014662
ttttgtca

SEQ ID NO: 38120 - DNA, 8 bp, Unknown
  misc_feature (1)..( 8): Matrix.001 file - promoters70/1014662
aaatttat

SEQ ID NO: 38121 - DNA, 8 bp, Unknown
  misc_feature (1)..( 8): Matrix.001 file - promoters70/1014662
aatcaaaa

SEQ ID NO: 38122 - DNA, 11 bp, Unknown
  misc_feature (1)..( 11): Matrix.001 file - promoters70/1014662
aaaaacacgaa

SEQ ID NO: 38123 - DNA, 7 bp, Unknown
  misc_feature (1)..( 7): Matrix.001 file - promoters70/1014662
actttac

SEQ ID NO: 38124 - DNA, 8 bp, Unknown
  misc_feature (1)..( 8): Matrix.001 file - promoters70/1014662
atataata

SEQ ID NO: 38125 - DNA, 9 bp, Unknown
  misc_feature (1)..( 9): Matrix.001 file - promoters70/1014662
tttattgat

SEQ ID NO: 38126 - DNA, 12 bp, Unknown
  misc_feature (1)..( 12): Matrix.001 file - promoters70/1014662
ataaaatcaata

SEQ ID NO: 38127 - DNA, 10 bp, Unknown
  misc_feature (1)..( 10): Matrix.001 file - promoters70/1014662
ctaacaaaaa

SEQ ID NO: 38128 - DNA, 6 bp, Unknown
  misc_feature (1)..( 6): Matrix.001 file - promoters70/1014885
ttaaaa

SEQ ID NO: 38129 - DNA, 7 bp, Unknown
  misc_feature (1)..( 7): Matrix.001 file - promoters70/1014885
aaaaagt

SEQ ID NO: 38130 - DNA, 10 bp, Unknown
  misc_feature (1)..( 10): Matrix.001 file - promoters70/1015030
ttttgaccta

SEQ ID NO: 38131 - DNA, 7 bp, Unknown
  misc_feature (1)..( 7): Matrix.001 file - promoters70/1015030
tctttag

SEQ ID NO: 38132 - DNA, 11 bp, Unknown
  misc_feature (1)..( 11): Matrix.001 file - promoters70/1015030
cttatctcgtg

SEQ ID NO: 38133 - DNA, 8 bp, Unknown
  misc_feature (1)..( 8): Matrix.001 file - promoters70/1015214
aaaacaaa

SEQ ID NO: 38134 - DNA, 11 bp, Unknown
  misc_feature (1)..( 11): Matrix.001 file - promoters70/1015214
tatttaaaaag

SEQ ID NO: 38135 - DNA, 10 bp, Unknown
  misc_feature (1)..( 10): Matrix.001 file - promoters70/1015214
tttaaaaaaa

SEQ ID NO: 38136 - DNA, 12 bp, Unknown
  misc_feature (1)..( 12): Matrix.001 file - promoters70/1015337
tactaaatttta

SEQ ID NO: 38137 - DNA, 8 bp, Unknown
  misc_feature (1)..( 8): Matrix.001 file - promoters70/1015337
atatgagt

SEQ ID NO: 38138 - DNA, 6 bp, Unknown
  misc_feature (1)..( 6): Matrix.001 file - promoters70/1015337
attttt

SEQ ID NO: 38139 - DNA, 10 bp, Unknown
  misc_feature (1)..( 10): Matrix.001 file - promoters70/1015337
agtaatattt

SEQ ID NO: 38140 - DNA, 9 bp, Unknown
  misc_feature (1)..( 9): Matrix.001 file - promoters70/1015475
gtttccttt

SEQ ID NO: 38141 - DNA, 11 bp, Unknown
  misc_feature (1)..( 11): Matrix.001 file - promoters70/1015524
aaacgtgaaag

SEQ ID NO: 38142 - DNA, 8 bp, Unknown
  misc_feature (1)..( 8): Matrix.001 file - promoters70/1015524
agatatac

SEQ ID NO: 38143 - DNA, 9 bp, Unknown
  misc_feature (1)..( 9): Matrix.001 file - promoters70/1015524
ttgtttctc

SEQ ID NO: 38144 - DNA, 9 bp, Unknown
  misc_feature (1)..( 9): Matrix.001 file - promoters70/1015848
gtttccttt

SEQ ID NO: 38145 - DNA, 11 bp, Unknown
  misc_feature (1)..( 11): Matrix.001 file - promoters70/1016056
aataaaataaa

SEQ ID NO: 38146 - DNA, 11 bp, Unknown
  misc_feature (1)..( 11): Matrix.001 file - promoters70/1016056
aataaaaactt

SEQ ID NO: 38147 - DNA, 13 bp, Unknown
  misc_feature (1)..( 13): Matrix.001 file - promoters70/1016176
aaaattataaatc

SEQ ID NO: 38148 - DNA, 13 bp, Unknown
  misc_feature (1)..( 13): Matrix.001 file - promoters70/1016176
gataacaaaacaa

SEQ ID NO: 38149 - DNA, 9 bp, Unknown
  misc_feature (1)..( 9): Matrix.001 file - promoters70/1016250
gttaaattg

SEQ ID NO: 38150 - DNA, 9 bp, Unknown
  misc_feature (1)..( 9): Matrix.001 file - promoters70/1016250
ttttacata

SEQ ID NO: 38151 - DNA, 9 bp, Unknown
  misc_feature (1)..( 9): Matrix.001 file - promoters70/1016250
taattttta

SEQ ID NO: 38152 - DNA, 9 bp, Unknown
  misc_feature (1)..( 9): Matrix.001 file - promoters70/1016250
atctttttt

SEQ ID NO: 38153 - DNA, 11 bp, Unknown
  misc_feature (1)..( 11): Matrix.001 file - promoters70/1016250
aacattaaaaa

SEQ ID NO: 38154 - DNA, 12 bp, Unknown
  misc_feature (1)..( 12): Matrix.001 file - promoters70/1016250
catttctttgta

SEQ ID NO: 38155 - DNA, 10 bp, Unknown
  misc_feature (1)..( 10): Matrix.001 file - promoters70/1016250
ttttgtaaat

SEQ ID NO: 38156 - DNA, 9 bp, Unknown
  misc_feature (1)..( 9): Matrix.001 file - promoters70/1016278
gggattttt

SEQ ID NO: 38157 - DNA, 7 bp, Unknown
  misc_feature (1)..( 7): Matrix.001 file - promoters70/1016278
taattat

SEQ ID NO: 38158 - DNA, 8 bp, Unknown
  misc_feature (1)..( 8): Matrix.001 file - promoters70/1016418
taatcaat

SEQ ID NO: 38159 - DNA, 9 bp, Unknown
  misc_feature (1)..( 9): Matrix.001 file - promoters70/1016418
ttatttgga

SEQ ID NO: 38160 - DNA, 7 bp, Unknown
  misc_feature (1)..( 7): Matrix.001 file - promoters70/1016418
tataaat

SEQ ID NO: 38161 - DNA, 8 bp, Unknown
  misc_feature (1)..( 8): Matrix.001 file - promoters70/1016418
attgttga

SEQ ID NO: 38162 - DNA, 6 bp, Unknown
  misc_feature (1)..( 6): Matrix.001 file - promoters70/1016418
agcaat

SEQ ID NO: 38163 - DNA, 9 bp, Unknown
  misc_feature (1)..( 9): Matrix.001 file - promoters70/1016468
ttgaatttt

SEQ ID NO: 38164 - DNA, 10 bp, Unknown
  misc_feature (1)..( 10): Matrix.001 file - promoters70/1016468
tataagaaaa

SEQ ID NO: 38165 - DNA, 8 bp, Unknown
  misc_feature (1)..( 8): Matrix.001 file - promoters70/1016468
aaataaaa

SEQ ID NO: 38166 - DNA, 9 bp, Unknown
  misc_feature (1)..( 9): Matrix.001 file - promoters70/1016468
aatgaaaaa

SEQ ID NO: 38167 - DNA, 10 bp, Unknown
  misc_feature (1)..( 10): Matrix.001 file - promoters70/1016468
aagaaaaaac

SEQ ID NO: 38168 - DNA, 14 bp, Unknown
  misc_feature (1)..( 14): Matrix.001 file - promoters70/1016468
atataattattttg

SEQ ID NO: 38169 - DNA, 10 bp, Unknown
  misc_feature (1)..( 10): Matrix.001 file - promoters70/1016468
attaactttg

SEQ ID NO: 38170 - DNA, 10 bp, Unknown
  misc_feature (1)..( 10): Matrix.001 file - promoters70/1016468
gttaattttt

SEQ ID NO: 38171 - DNA, 10 bp, Unknown
  misc_feature (1)..( 10): Matrix.001 file - promoters70/1016771
aaaatgaatt

SEQ ID NO: 38172 - DNA, 9 bp, Unknown
  misc_feature (1)..( 9): Matrix.001 file - promoters70/1016771
taaaaagat

SEQ ID NO: 38173 - DNA, 12 bp, Unknown
  misc_feature (1)..( 12): Matrix.001 file - promoters70/1016771
aaaatgcattaa

SEQ ID NO: 38174 - DNA, 14 bp, Unknown
  misc_feature (1)..( 14): Matrix.001 file - promoters70/1016886
tccacttttaaaaa

SEQ ID NO: 38175 - DNA, 8 bp, Unknown
  misc_feature (1)..( 8): Matrix.001 file - promoters70/1017358
gaaaaaaa

SEQ ID NO: 38176 - DNA, 11 bp, Unknown
  misc_feature (1)..( 11): Matrix.001 file - promoters70/1017358
acttatatata

SEQ ID NO: 38177 - DNA, 13 bp, Unknown
  misc_feature (1)..( 13): Matrix.001 file - promoters70/1017358
ccaatgatattca

SEQ ID NO: 38178 - DNA, 8 bp, Unknown
  misc_feature (1)..( 8): Matrix.001 file - promoters70/1017434
ttgaattc

SEQ ID NO: 38179 - DNA, 10 bp, Unknown
  misc_feature (1)..( 10): Matrix.001 file - promoters70/1017434
tttattttaa

SEQ ID NO: 38180 - DNA, 9 bp, Unknown
  misc_feature (1)..( 9): Matrix.001 file - promoters70/1017434
aattgattt

SEQ ID NO: 38181 - DNA, 9 bp, Unknown
  misc_feature (1)..( 9): Matrix.001 file - promoters70/1017618
ttatgaaaa

SEQ ID NO: 38182 - DNA, 7 bp, Unknown
  misc_feature (1)..( 7): Matrix.001 file - promoters70/1017770
gtttgaa

SEQ ID NO: 38183 - DNA, 7 bp, Unknown
  misc_feature (1)..( 7): Matrix.001 file - promoters70/1017770
aatattg

SEQ ID NO: 38184 - DNA, 7 bp, Unknown
  misc_feature (1)..( 7): Matrix.001 file - promoters70/1017770
gattatg

SEQ ID NO: 38185 - DNA, 7 bp, Unknown
  misc_feature (1)..( 7): Matrix.001 file - promoters70/1018052
tcagttt

SEQ ID NO: 38186 - DNA, 9 bp, Unknown
  misc_feature (1)..( 9): Matrix.001 file - promoters70/1018052
cttcaacat

SEQ ID NO: 38187 - DNA, 8 bp, Unknown
  misc_feature (1)..( 8): Matrix.001 file - promoters70/1018052
attgttgt

SEQ ID NO: 38188 - DNA, 9 bp, Unknown
  misc_feature (1)..( 9): Matrix.001 file - promoters70/1018159
agtaagaaa

SEQ ID NO: 38189 - DNA, 7 bp, Unknown
  misc_feature (1)..( 7): Matrix.001 file - promoters70/1018190
atttgtt

SEQ ID NO: 38190 - DNA, 7 bp, Unknown
  misc_feature (1)..( 7): Matrix.001 file - promoters70/1018190
ttgattg

SEQ ID NO: 38191 - DNA, 9 bp, Unknown
  misc_feature (1)..( 9): Matrix.001 file - promoters70/1018190
cttttttta

SEQ ID NO: 38192 - DNA, 9 bp, Unknown
  misc_feature (1)..( 9): Matrix.001 file - promoters70/1018276
tcttcttat

SEQ ID NO: 38193 - DNA, 13 bp, Unknown
  misc_feature (1)..( 13): Matrix.001 file - promoters70/1018391
ctagtttattgtt

SEQ ID NO: 38194 - DNA, 8 bp, Unknown
  misc_feature (1)..( 8): Matrix.001 file - promoters70/1018391
agatcatg

SEQ ID NO: 38195 - DNA, 9 bp, Unknown
  misc_feature (1)..( 9): Matrix.001 file - promoters70/1018523
tacaaaaat

SEQ ID NO: 38196 - DNA, 12 bp, Unknown
  misc_feature (1)..( 12): Matrix.001 file - promoters70/1018523
aaataataaaac

SEQ ID NO: 38197 - DNA, 6 bp, Unknown
  misc_feature (1)..( 6): Matrix.001 file - promoters70/1018523
tattta

SEQ ID NO: 38198 - DNA, 14 bp, Unknown
  misc_feature (1)..( 14): Matrix.001 file - promoters70/1018523
aaaaaaaagtataa

SEQ ID NO: 38199 - DNA, 8 bp, Unknown
  misc_feature (1)..( 8): Matrix.001 file - promoters70/1018523
taaaaatt

SEQ ID NO: 38200 - DNA, 11 bp, Unknown
  misc_feature (1)..( 11): Matrix.001 file - promoters70/1018523
agttaaaaaat

SEQ ID NO: 38201 - DNA, 14 bp, Unknown
  misc_feature (1)..( 14): Matrix.001 file - promoters70/1018523
aaaacaaatttctg

SEQ ID NO: 38202 - DNA, 11 bp, Unknown
  misc_feature (1)..( 11): Matrix.001 file - promoters70/1018523
agattattatt

SEQ ID NO: 38203 - DNA, 12 bp, Unknown
  misc_feature (1)..( 12): Matrix.001 file - promoters70/1018529
tcataattaata

SEQ ID NO: 38204 - DNA, 7 bp, Unknown
  misc_feature (1)..( 7): Matrix.001 file - promoters70/1018529
aataaaa

SEQ ID NO: 38205 - DNA, 9 bp, Unknown
  misc_feature (1)..( 9): Matrix.001 file - promoters70/1018536
tagagaaat

SEQ ID NO: 38206 - DNA, 8 bp, Unknown
  misc_feature (1)..( 8): Matrix.001 file - promoters70/1018536
atttgtta

SEQ ID NO: 38207 - DNA, 8 bp, Unknown
  misc_feature (1)..( 8): Matrix.001 file - promoters70/1018536
attttaaa

SEQ ID NO: 38208 - DNA, 9 bp, Unknown
  misc_feature (1)..( 9): Matrix.001 file - promoters70/1018536
ttttgatga

SEQ ID NO: 38209 - DNA, 11 bp, Unknown
  misc_feature (1)..( 11): Matrix.001 file - promoters70/1018536
attttcataaa

SEQ ID NO: 38210 - DNA, 17 bp, Unknown
  misc_feature (1)..( 17): Matrix.001 file - promoters70/1018536
taaatgttaaaattatt

SEQ ID NO: 38211 - DNA, 13 bp, Unknown
  misc_feature (1)..( 13): Matrix.001 file - promoters70/1018536
taatccaacggca

SEQ ID NO: 38212 - DNA, 6 bp, Unknown
  misc_feature (1)..( 6): Matrix.001 file - promoters70/1018536
tatata

SEQ ID NO: 38213 - DNA, 10 bp, Unknown
  misc_feature (1)..( 10): Matrix.001 file - promoters70/1018536
tataaacaaa

SEQ ID NO: 38214 - DNA, 8 bp, Unknown
  misc_feature (1)..( 8): Matrix.001 file - promoters70/1018536
aaattctc

SEQ ID NO: 38215 - DNA, 11 bp, Unknown
  misc_feature (1)..( 11): Matrix.001 file - promoters70/1018536
tttataagtat

SEQ ID NO: 38216 - DNA, 8 bp, Unknown
  misc_feature (1)..( 8): Matrix.001 file - promoters70/1018536
tgaatgta

SEQ ID NO: 38217 - DNA, 10 bp, Unknown
  misc_feature (1)..( 10): Matrix.001 file - promoters70/1018536
atttaaattg

SEQ ID NO: 38218 - DNA, 10 bp, Unknown
  misc_feature (1)..( 10): Matrix.001 file - promoters70/1018755
actaaacaaa

SEQ ID NO: 38219 - DNA, 9 bp, Unknown
  misc_feature (1)..( 9): Matrix.001 file - promoters70/1018755
acaatcacg

SEQ ID NO: 38220 - DNA, 8 bp, Unknown
  misc_feature (1)..( 8): Matrix.001 file - promoters70/1018770
caaagaaa

SEQ ID NO: 38221 - DNA, 10 bp, Unknown
  misc_feature (1)..( 10): Matrix.001 file - promoters70/1018956
ggaaaagaaa

SEQ ID NO: 38222 - DNA, 7 bp, Unknown
  misc_feature (1)..( 7): Matrix.001 file - promoters70/1018956
aaaagaa

SEQ ID NO: 38223 - DNA, 5 bp, Unknown
  misc_feature (1)..( 5): Matrix.001 file - promoters70/1018973
ttata

SEQ ID NO: 38224 - DNA, 7 bp, Unknown
  misc_feature (1)..( 7): Matrix.001 file - promoters70/1019257
aaaaaag

SEQ ID NO: 38225 - DNA, 9 bp, Unknown
  misc_feature (1)..( 9): Matrix.001 file - promoters70/1019257
attataaaa

SEQ ID NO: 38226 - DNA, 9 bp, Unknown
  misc_feature (1)..( 9): Matrix.001 file - promoters70/1019508
agatggaaa

SEQ ID NO: 38227 - DNA, 6 bp, Unknown
  misc_feature (1)..( 6): Matrix.001 file - promoters70/1019537
aaaaca

SEQ ID NO: 38228 - DNA, 11 bp, Unknown
  misc_feature (1)..( 11): Matrix.001 file - promoters70/1019537
tttgttttcta

SEQ ID NO: 38229 - DNA, 8 bp, Unknown
  misc_feature (1)..( 8): Matrix.001 file - promoters70/1019537
tatataaa

SEQ ID NO: 38230 - DNA, 11 bp, Unknown
  misc_feature (1)..( 11): Matrix.001 file - promoters70/1019537
atatatgtaaa

SEQ ID NO: 38231 - DNA, 9 bp, Unknown
  misc_feature (1)..( 9): Matrix.001 file - promoters70/1019734
tcaatcata

SEQ ID NO: 38232 - DNA, 9 bp, Unknown
  misc_feature (1)..( 9): Matrix.001 file - promoters70/1019734
taatttcat

SEQ ID NO: 38233 - DNA, 8 bp, Unknown
  misc_feature (1)..( 8): Matrix.001 file - promoters70/1019928
atttgtta

SEQ ID NO: 38234 - DNA, 7 bp, Unknown
  misc_feature (1)..( 7): Matrix.001 file - promoters70/1019928
ttttaat

SEQ ID NO: 38235 - DNA, 8 bp, Unknown
  misc_feature (1)..( 8): Matrix.001 file - promoters70/1019928
aaattctc

SEQ ID NO: 38236 - DNA, 11 bp, Unknown
  misc_feature (1)..( 11): Matrix.001 file - promoters70/1019928
tttataactat

SEQ ID NO: 38237 - DNA, 10 bp, Unknown
  misc_feature (1)..( 10): Matrix.001 file - promoters70/1020023
tcctatatat

SEQ ID NO: 38238 - DNA, 8 bp, Unknown
  misc_feature (1)..( 8): Matrix.001 file - promoters70/1020223
atcatatt

SEQ ID NO: 38239 - DNA, 9 bp, Unknown
  misc_feature (1)..( 9): Matrix.001 file - promoters70/1020223
tttgtagtg

SEQ ID NO: 38240 - DNA, 8 bp, Unknown
  misc_feature (1)..( 8): Matrix.001 file - promoters70/1020223
tgatttgt

SEQ ID NO: 38241 - DNA, 7 bp, Unknown
  misc_feature (1)..( 7): Matrix.001 file - promoters70/1020223
gtttgtt

SEQ ID NO: 38242 - DNA, 8 bp, Unknown
  misc_feature (1)..( 8): Matrix.001 file - promoters70/1020223
gatttgtt

SEQ ID NO: 38243 - DNA, 8 bp, Unknown
  misc_feature (1)..( 8): Matrix.001 file - promoters70/1020265
atgactta

SEQ ID NO: 38244 - DNA, 9 bp, Unknown
  misc_feature (1)..( 9): Matrix.001 file - promoters70/1020313
gtgtatata

SEQ ID NO: 38245 - DNA, 8 bp, Unknown
  misc_feature (1)..( 8): Matrix.001 file - promoters70/1020430
acaaaaaa

SEQ ID NO: 38246 - DNA, 11 bp, Unknown
  misc_feature (1)..( 11): Matrix.001 file - promoters70/1020430
aattaaaataa

SEQ ID NO: 38247 - DNA, 8 bp, Unknown
  misc_feature (1)..( 8): Matrix.001 file - promoters70/1020430
cttaaata

SEQ ID NO: 38248 - DNA, 8 bp, Unknown
  misc_feature (1)..( 8): Matrix.001 file - promoters70/1020543
gaaaaaaa

SEQ ID NO: 38249 - DNA, 12 bp, Unknown
  misc_feature (1)..( 12): Matrix.001 file - promoters70/1020543
aaaaaagaagaa

SEQ ID NO: 38250 - DNA, 11 bp, Unknown
  misc_feature (1)..( 11): Matrix.001 file - promoters70/1020646
aataatttgta

SEQ ID NO: 38251 - DNA, 10 bp, Unknown
  misc_feature (1)..( 10): Matrix.001 file - promoters70/1020666
tggtaaataa

SEQ ID NO: 38252 - DNA, 13 bp, Unknown
  misc_feature (1)..( 13): Matrix.001 file - promoters70/1020666
gaaacaaacctga

SEQ ID NO: 38253 - DNA, 11 bp, Unknown
  misc_feature (1)..( 11): Matrix.001 file - promoters70/1020701
tgtttgaacat

SEQ ID NO: 38254 - DNA, 8 bp, Unknown
  misc_feature (1)..( 8): Matrix.001 file - promoters70/1020701
caacgaaa

SEQ ID NO: 38255 - DNA, 10 bp, Unknown
  misc_feature (1)..( 10): Matrix.001 file - promoters70/1020701
aaatcatatt

SEQ ID NO: 38256 - DNA, 9 bp, Unknown
  misc_feature (1)..( 9): Matrix.001 file - promoters70/1020701
ataagaaaa

SEQ ID NO: 38257 - DNA, 9 bp, Unknown
  misc_feature (1)..( 9): Matrix.001 file - promoters70/1020701
tcaatcata

SEQ ID NO: 38258 - DNA, 8 bp, Unknown
  misc_feature (1)..( 8): Matrix.001 file - promoters70/1020701
taatttca

SEQ ID NO: 38259 - DNA, 9 bp, Unknown
  misc_feature (1)..( 9): Matrix.001 file - promoters70/1020701
ataataaaa

SEQ ID NO: 38260 - DNA, 8 bp, Unknown
  misc_feature (1)..( 8): Matrix.001 file - promoters70/1020701
aaatatct

SEQ ID NO: 38261 - DNA, 7 bp, Unknown
  misc_feature (1)..( 7): Matrix.001 file - promoters70/1020701
tatcata

SEQ ID NO: 38262 - DNA, 8 bp, Unknown
  misc_feature (1)..( 8): Matrix.001 file - promoters70/1020701
taataaag

SEQ ID NO: 38263 - DNA, 12 bp, Unknown
  misc_feature (1)..( 12): Matrix.001 file - promoters70/1020701
ataaattaatgt

SEQ ID NO: 38264 - DNA, 10 bp, Unknown
  misc_feature (1)..( 10): Matrix.001 file - promoters70/1020786
atttatttcg

SEQ ID NO: 38265 - DNA, 10 bp, Unknown
  misc_feature (1)..( 10): Matrix.001 file - promoters70/1020786
acaaactaat

SEQ ID NO: 38266 - DNA, 6 bp, Unknown
  misc_feature (1)..( 6): Matrix.001 file - promoters70/1020786
tataaa

SEQ ID NO: 38267 - DNA, 10 bp, Unknown
  misc_feature (1)..( 10): Matrix.001 file - promoters70/1020786
ttaagatctt

SEQ ID NO: 38268 - DNA, 10 bp, Unknown
  misc_feature (1)..( 10): Matrix.001 file - promoters70/1020786
gcaaaaaaca

SEQ ID NO: 38269 - DNA, 14 bp, Unknown
  misc_feature (1)..( 14): Matrix.001 file - promoters70/1020786
aacaacaaaaaaag

SEQ ID NO: 38270 - DNA, 10 bp, Unknown
  misc_feature (1)..( 10): Matrix.001 file - promoters70/1020786
aaatcgaaga

SEQ ID NO: 38271 - DNA, 10 bp, Unknown
  misc_feature (1)..( 10): Matrix.001 file - promoters70/1020786
atttactctc

SEQ ID NO: 38272 - DNA, 8 bp, Unknown
  misc_feature (1)..( 8): Matrix.001 file - promoters70/1020786
cctatata

SEQ ID NO: 38273 - DNA, 9 bp, Unknown
  misc_feature (1)..( 9): Matrix.001 file - promoters70/1020786
caacaaaaa

SEQ ID NO: 38274 - DNA, 7 bp, Unknown
  misc_feature (1)..( 7): Matrix.001 file - promoters70/1020786
agaaatg

SEQ ID NO: 38275 - DNA, 13 bp, Unknown
  misc_feature (1)..( 13): Matrix.001 file - promoters70/1020818
ataatttttcctt

SEQ ID NO: 38276 - DNA, 11 bp, Unknown
  misc_feature (1)..( 11): Matrix.001 file - promoters70/1020818
caataattttt

SEQ ID NO: 38277 - DNA, 10 bp, Unknown
  misc_feature (1)..( 10): Matrix.001 file - promoters70/1020818
taaaaaagaa

SEQ ID NO: 38278 - DNA, 11 bp, Unknown
  misc_feature (1)..( 11): Matrix.001 file - promoters70/1020863
ggaacaattaa

SEQ ID NO: 38279 - DNA, 8 bp, Unknown
  misc_feature (1)..( 8): Matrix.001 file - promoters70/1020863
taaacaaa

SEQ ID NO: 38280 - DNA, 12 bp, Unknown
  misc_feature (1)..( 12): Matrix.001 file - promoters70/1020863
ttttatttctca

SEQ ID NO: 38281 - DNA, 8 bp, Unknown
  misc_feature (1)..( 8): Matrix.001 file - promoters70/1020940
taaaattg

SEQ ID NO: 38282 - DNA, 8 bp, Unknown
  misc_feature (1)..( 8): Matrix.001 file - promoters70/1020940
aaaataga

SEQ ID NO: 38283 - DNA, 8 bp, Unknown
  misc_feature (1)..( 8): Matrix.001 file - promoters70/1020940
aaacaaag

SEQ ID NO: 38284 - DNA, 7 bp, Unknown
  misc_feature (1)..( 7): Matrix.001 file - promoters70/1020940
aaattat

SEQ ID NO: 38285 - DNA, 10 bp, Unknown
  misc_feature (1)..( 10): Matrix.001 file - promoters70/1020940
tatataaacc

SEQ ID NO: 38286 - DNA, 9 bp, Unknown
  misc_feature (1)..( 9): Matrix.001 file - promoters70/1021079
ttgaaacac

SEQ ID NO: 38287 - DNA, 11 bp, Unknown
  misc_feature (1)..( 11): Matrix.001 file - promoters70/1021079
aggaaaacata

SEQ ID NO: 38288 - DNA, 9 bp, Unknown
  misc_feature (1)..( 9): Matrix.001 file - promoters70/1021079
aaaattttg

SEQ ID NO: 38289 - DNA, 8 bp, Unknown
  misc_feature (1)..( 8): Matrix.001 file - promoters70/1021079
agtaaaat

SEQ ID NO: 38290 - DNA, 7 bp, Unknown
  misc_feature (1)..( 7): Matrix.001 file - promoters70/1021079
taaaaat

SEQ ID NO: 38291 - DNA, 9 bp, Unknown
  misc_feature (1)..( 9): Matrix.001 file - promoters70/1021079
tttaatata

SEQ ID NO: 38292 - DNA, 8 bp, Unknown
  misc_feature (1)..( 8): Matrix.001 file - promoters70/1021079
taaaacaa

SEQ ID NO: 38293 - DNA, 11 bp, Unknown
  misc_feature (1)..( 11): Matrix.001 file - promoters70/1021079
cttaaatatca

SEQ ID NO: 38294 - DNA, 9 bp, Unknown
  misc_feature (1)..( 9): Matrix.001 file - promoters70/1021079
tgaatgatt

SEQ ID NO: 38295 - DNA, 6 bp, Unknown
  misc_feature (1)..( 6): Matrix.001 file - promoters70/1021079
tttagt

SEQ ID NO: 38296 - DNA, 9 bp, Unknown
  misc_feature (1)..( 9): Matrix.001 file - promoters70/1021104
attttgacc

SEQ ID NO: 38297 - DNA, 8 bp, Unknown
  misc_feature (1)..( 8): Matrix.001 file - promoters70/1021104
cattcata

SEQ ID NO: 38298 - DNA, 7 bp, Unknown
  misc_feature (1)..( 7): Matrix.001 file - promoters70/1021104
ttcttct

SEQ ID NO: 38299 - DNA, 10 bp, Unknown
  misc_feature (1)..( 10): Matrix.001 file - promoters70/1021104
tcttcattta

SEQ ID NO: 38300 - DNA, 6 bp, Unknown
  misc_feature (1)..( 6): Matrix.001 file - promoters70/1021218
aaagaa

SEQ ID NO: 38301 - DNA, 8 bp, Unknown
  misc_feature (1)..( 8): Matrix.001 file - promoters70/1021218
ttgaattt

SEQ ID NO: 38302 - DNA, 10 bp, Unknown
  misc_feature (1)..( 10): Matrix.001 file - promoters70/1021218
atttcttaga

SEQ ID NO: 38303 - DNA, 9 bp, Unknown
  misc_feature (1)..( 9): Matrix.001 file - promoters70/1021218
gtaagaaaa

SEQ ID NO: 38304 - DNA, 8 bp, Unknown
  misc_feature (1)..( 8): Matrix.001 file - promoters70/1021218
aaagaaaa

SEQ ID NO: 38305 - DNA, 9 bp, Unknown
  misc_feature (1)..( 9): Matrix.001 file - promoters70/1021218
gtttaaacg

SEQ ID NO: 38306 - DNA, 9 bp, Unknown
  misc_feature (1)..( 9): Matrix.001 file - promoters70/1021218
attcgaaaa

SEQ ID NO: 38307 - DNA, 8 bp, Unknown
  misc_feature (1)..( 8): Matrix.001 file - promoters70/1021218
tttcctat

SEQ ID NO: 38308 - DNA, 12 bp, Unknown
  misc_feature (1)..( 12): Matrix.001 file - promoters70/1021218
agtaaataaatg

SEQ ID NO: 38309 - DNA, 12 bp, Unknown
  misc_feature (1)..( 12): Matrix.001 file - promoters70/1021218
aaaccaaacatg

SEQ ID NO: 38310 - DNA, 8 bp, Unknown
  misc_feature (1)..( 8): Matrix.001 file - promoters70/1021218
taaagatg

SEQ ID NO: 38311 - DNA, 7 bp, Unknown
  misc_feature (1)..( 7): Matrix.001 file - promoters70/1021438
aaaagta

SEQ ID NO: 38312 - DNA, 8 bp, Unknown
  misc_feature (1)..( 8): Matrix.001 file - promoters70/1021445
gtttctat

SEQ ID NO: 38313 - DNA, 9 bp, Unknown
  misc_feature (1)..( 9): Matrix.001 file - promoters70/1021445
aatcaaaaa

SEQ ID NO: 38314 - DNA, 9 bp, Unknown
  misc_feature (1)..( 9): Matrix.001 file - promoters70/1021445
taaaaaaaa

SEQ ID NO: 38315 - DNA, 12 bp, Unknown
  misc_feature (1)..( 12): Matrix.001 file - promoters70/1021445
taaaaaacaaat

SEQ ID NO: 38316 - DNA, 6 bp, Unknown
  misc_feature (1)..( 6): Matrix.001 file - promoters70/1021445
tggtat

SEQ ID NO: 38317 - DNA, 7 bp, Unknown
  misc_feature (1)..( 7): Matrix.001 file - promoters70/1021445
attaaag

SEQ ID NO: 38318 - DNA, 7 bp, Unknown
  misc_feature (1)..( 7): Matrix.001 file - promoters70/1021445
agaagat

SEQ ID NO: 38319 - DNA, 17 bp, Unknown
  misc_feature (1)..( 17): Matrix.001 file - promoters70/1021445
ctttataaacgctgcgt

SEQ ID NO: 38320 - DNA, 8 bp, Unknown
  misc_feature (1)..( 8): Matrix.001 file - promoters70/1021445
attttgtg

SEQ ID NO: 38321 - DNA, 16 bp, Unknown
  misc_feature (1)..( 16): Matrix.001 file - promoters70/1021445
tcttcataatcccttc

SEQ ID NO: 38322 - DNA, 9 bp, Unknown
  misc_feature (1)..( 9): Matrix.001 file - promoters70/1021549
gtatataaa

SEQ ID NO: 38323 - DNA, 9 bp, Unknown
  misc_feature (1)..( 9): Matrix.001 file - promoters70/1021549
aatagttta

SEQ ID NO: 38324 - DNA, 10 bp, Unknown
  misc_feature (1)..( 10): Matrix.001 file - promoters70/1021549
agttatatat

SEQ ID NO: 38325 - DNA, 7 bp, Unknown
  misc_feature (1)..( 7): Matrix.001 file - promoters70/1021862
aaatcgt

SEQ ID NO: 38326 - DNA, 10 bp, Unknown
  misc_feature (1)..( 10): Matrix.001 file - promoters70/1021862
catttaagtt

SEQ ID NO: 38327 - DNA, 9 bp, Unknown
  misc_feature (1)..( 9): Matrix.001 file - promoters70/1021862
aaattttca

SEQ ID NO: 38328 - DNA, 8 bp, Unknown
  misc_feature (1)..( 8): Matrix.001 file - promoters70/1021862
aaacttcc

SEQ ID NO: 38329 - DNA, 6 bp, Unknown
  misc_feature (1)..( 6): Matrix.001 file - promoters70/1021862
taaaat

SEQ ID NO: 38330 - DNA, 9 bp, Unknown
  misc_feature (1)..( 9): Matrix.001 file - promoters70/1021870
aaaatctgg

SEQ ID NO: 38331 - DNA, 8 bp, Unknown
  misc_feature (1)..( 8): Matrix.001 file - promoters70/1021870
ccataatt

SEQ ID NO: 38332 - DNA, 9 bp, Unknown
  misc_feature (1)..( 9): Matrix.001 file - promoters70/1021952
tcattaaat

SEQ ID NO: 38333 - DNA, 10 bp, Unknown
  misc_feature (1)..( 10): Matrix.001 file - promoters70/1021968
taaaataata

SEQ ID NO: 38334 - DNA, 10 bp, Unknown
  misc_feature (1)..( 10): Matrix.001 file - promoters70/1021968
aaataacaaa

SEQ ID NO: 38335 - DNA, 9 bp, Unknown
  misc_feature (1)..( 9): Matrix.001 file - promoters70/1021968
aaataattc

SEQ ID NO: 38336 - DNA, 8 bp, Unknown
  misc_feature (1)..( 8): Matrix.001 file - promoters70/1021968
gtattttt

SEQ ID NO: 38337 - DNA, 9 bp, Unknown
  misc_feature (1)..( 9): Matrix.001 file - promoters70/1021968
cttaattca

SEQ ID NO: 38338 - DNA, 9 bp, Unknown
  misc_feature (1)..( 9): Matrix.001 file - promoters70/1021968
ataaaaaat

SEQ ID NO: 38339 - DNA, 9 bp, Unknown
  misc_feature (1)..( 9): Matrix.001 file - promoters70/1021987
atttgattt

SEQ ID NO: 38340 - DNA, 7 bp, Unknown
  misc_feature (1)..( 7): Matrix.001 file - promoters70/1022245
aaaatca

SEQ ID NO: 38341 - DNA, 9 bp, Unknown
  misc_feature (1)..( 9): Matrix.001 file - promoters70/1022296
cagatggaa

SEQ ID NO: 38342 - DNA, 7 bp, Unknown
  misc_feature (1)..( 7): Matrix.001 file - promoters70/1022296
tatttat

SEQ ID NO: 38343 - DNA, 9 bp, Unknown
  misc_feature (1)..( 9): Matrix.001 file - promoters70/1022296
ttgtaattt

SEQ ID NO: 38344 - DNA, 7 bp, Unknown
  misc_feature (1)..( 7): Matrix.001 file - promoters70/1022324
aaaaaag

SEQ ID NO: 38345 - DNA, 8 bp, Unknown
  misc_feature (1)..( 8): Matrix.001 file - promoters70/1022364
tttgattg

SEQ ID NO: 38346 - DNA, 10 bp, Unknown
  misc_feature (1)..( 10): Matrix.001 file - promoters70/1022662
tatttgtata

SEQ ID NO: 38347 - DNA, 7 bp, Unknown
  misc_feature (1)..( 7): Matrix.001 file - promoters70/1022662
aacttta

SEQ ID NO: 38348 - DNA, 17 bp, Unknown
  misc_feature (1)..( 17): Matrix.001 file - promoters70/1022748
tgtaaagaaaaaagttt

SEQ ID NO: 38349 - DNA, 7 bp, Unknown
  misc_feature (1)..( 7): Matrix.001 file - promoters70/1022764
tttatat

SEQ ID NO: 38350 - DNA, 8 bp, Unknown
  misc_feature (1)..( 8): Matrix.001 file - promoters70/1022932
catcagct

SEQ ID NO: 38351 - DNA, 8 bp, Unknown
  misc_feature (1)..( 8): Matrix.001 file - promoters70/1022932
gttatgtt

SEQ ID NO: 38352 - DNA, 8 bp, Unknown
  misc_feature (1)..( 8): Matrix.001 file - promoters70/1022932
ttactttt

SEQ ID NO: 38353 - DNA, 7 bp, Unknown
  misc_feature (1)..( 7): Matrix.001 file - promoters70/1022932
ttacttt

SEQ ID NO: 38354 - DNA, 9 bp, Unknown
  misc_feature (1)..( 9): Matrix.001 file - promoters70/1022932
tacaataaa

SEQ ID NO: 38355 - DNA, 7 bp, Unknown
  misc_feature (1)..( 7): Matrix.001 file - promoters70/1022983
gaatcaa

SEQ ID NO: 38356 - DNA, 8 bp, Unknown
  misc_feature (1)..( 8): Matrix.001 file - promoters70/1022983
atttctta

SEQ ID NO: 38357 - DNA, 4 bp, Unknown
  misc_feature (1)..( 4): Matrix.001 file - promoters70/1022983
attt

SEQ ID NO: 38358 - DNA, 10 bp, Unknown
  misc_feature (1)..( 10): Matrix.001 file - promoters70/1022983
tattttatta

SEQ ID NO: 38359 - DNA, 9 bp, Unknown
  misc_feature (1)..( 9): Matrix.001 file - promoters70/1023237
ttgttgttt

SEQ ID NO: 38360 - DNA, 11 bp, Unknown
  misc_feature (1)..( 11): Matrix.001 file - promoters70/1023237
atcttcatgtt

SEQ ID NO: 38361 - DNA, 11 bp, Unknown
  misc_feature (1)..( 11): Matrix.001 file - promoters70/1023453
gacagataatg

SEQ ID NO: 38362 - DNA, 14 bp, Unknown
  misc_feature (1)..( 14): Matrix.001 file - promoters70/1023453
gaagaaaaaaaaga

SEQ ID NO: 38363 - DNA, 11 bp, Unknown
  misc_feature (1)..( 11): Matrix.001 file - promoters70/1023453
gaaagaaaaaa

SEQ ID NO: 38364 - DNA, 6 bp, Unknown
  misc_feature (1)..( 6): Matrix.001 file - promoters70/1023490
aaaaaa

SEQ ID NO: 38365 - DNA, 11 bp, Unknown
  misc_feature (1)..( 11): Matrix.001 file - promoters70/1023490
agtcaaacaaa

SEQ ID NO: 38366 - DNA, 8 bp, Unknown
  misc_feature (1)..( 8): Matrix.001 file - promoters70/1023634
ttttgaat

SEQ ID NO: 38367 - DNA, 11 bp, Unknown
  misc_feature (1)..( 11): Matrix.001 file - promoters70/1023634
aaaatgtgaaa

SEQ ID NO: 38368 - DNA, 8 bp, Unknown
  misc_feature (1)..( 8): Matrix.001 file - promoters70/1023634
agcccaaa

SEQ ID NO: 38369 - DNA, 8 bp, Unknown
  misc_feature (1)..( 8): Matrix.001 file - promoters70/1023634
tgtttaga

SEQ ID NO: 38370 - DNA, 9 bp, Unknown
  misc_feature (1)..( 9): Matrix.001 file - promoters70/1023698
aagcaaaaa

SEQ ID NO: 38371 - DNA, 8 bp, Unknown
  misc_feature (1)..( 8): Matrix.001 file - promoters70/1023698
ctttattt

SEQ ID NO: 38372 - DNA, 7 bp, Unknown
  misc_feature (1)..( 7): Matrix.001 file - promoters70/1023698
atttttt

SEQ ID NO: 38373 - DNA, 8 bp, Unknown
  misc_feature (1)..( 8): Matrix.001 file - promoters70/1023698
aaaaataa

SEQ ID NO: 38374 - DNA, 9 bp, Unknown
  misc_feature (1)..( 9): Matrix.001 file - promoters70/1023698
tcttaattt

SEQ ID NO: 38375 - DNA, 10 bp, Unknown
  misc_feature (1)..( 10): Matrix.001 file - promoters70/1023698
atatttagtt

SEQ ID NO: 38376 - DNA, 11 bp, Unknown
  misc_feature (1)..( 11): Matrix.001 file - promoters70/1023782
aaaataaaata

SEQ ID NO: 38377 - DNA, 10 bp, Unknown
  misc_feature (1)..( 10): Matrix.001 file - promoters70/1023782
ggaaatgaaa

SEQ ID NO: 38378 - DNA, 10 bp, Unknown
  misc_feature (1)..( 10): Matrix.001 file - promoters70/1023963
ttctacttta

SEQ ID NO: 38379 - DNA, 8 bp, Unknown
  misc_feature (1)..( 8): Matrix.001 file - promoters70/1023963
atttcgta

SEQ ID NO: 38380 - DNA, 8 bp, Unknown
  misc_feature (1)..( 8): Matrix.001 file - promoters70/1023963
aaatgtag

SEQ ID NO: 38381 - DNA, 8 bp, Unknown
  misc_feature (1)..( 8): Matrix.001 file - promoters70/1023963
atgtaaat

SEQ ID NO: 38382 - DNA, 7 bp, Unknown
  misc_feature (1)..( 7): Matrix.001 file - promoters70/1023963
ttttgta

SEQ ID NO: 38383 - DNA, 7 bp, Unknown
  misc_feature (1)..( 7): Matrix.001 file - promoters70/1023963
aaaaaat

SEQ ID NO: 38384 - DNA, 9 bp, Unknown
  misc_feature (1)..( 9): Matrix.001 file - promoters70/1024126
gaaaaagaa

SEQ ID NO: 38385 - DNA, 7 bp, Unknown
  misc_feature (1)..( 7): Matrix.001 file - promoters70/1024126
aaaccaa

SEQ ID NO: 38386 - DNA, 9 bp, Unknown
  misc_feature (1)..( 9): Matrix.001 file - promoters70/1024126
acaataaca

SEQ ID NO: 38387 - DNA, 8 bp, Unknown
  misc_feature (1)..( 8): Matrix.001 file - promoters70/1024189
aaaaaaga

SEQ ID NO: 38388 - DNA, 8 bp, Unknown
  misc_feature (1)..( 8): Matrix.001 file - promoters70/1024189
ttttgtca

SEQ ID NO: 38389 - DNA, 8 bp, Unknown
  misc_feature (1)..( 8): Matrix.001 file - promoters70/1024189
aaatttat

SEQ ID NO: 38390 - DNA, 8 bp, Unknown
  misc_feature (1)..( 8): Matrix.001 file - promoters70/1024189
aatcaaaa

SEQ ID NO: 38391 - DNA, 11 bp, Unknown
  misc_feature (1)..( 11): Matrix.001 file - promoters70/1024189
aaaaacacgaa

SEQ ID NO: 38392 - DNA, 7 bp, Unknown
  misc_feature (1)..( 7): Matrix.001 file - promoters70/1024189
actttac

SEQ ID NO: 38393 - DNA, 8 bp, Unknown
  misc_feature (1)..( 8): Matrix.001 file - promoters70/1024189
atataata

SEQ ID NO: 38394 - DNA, 9 bp, Unknown
  misc_feature (1)..( 9): Matrix.001 file - promoters70/1024189
tttattgat

SEQ ID NO: 38395 - DNA, 12 bp, Unknown
  misc_feature (1)..( 12): Matrix.001 file - promoters70/1024189
ataaaatcaata

SEQ ID NO: 38396 - DNA, 10 bp, Unknown
  misc_feature (1)..( 10): Matrix.001 file - promoters70/1024189
ctaacaaaaa

SEQ ID NO: 38397 - DNA, 11 bp, Unknown
  misc_feature (1)..( 11): Matrix.001 file - promoters70/1024199
catttaaatga

SEQ ID NO: 38398 - DNA, 10 bp, Unknown
  misc_feature (1)..( 10): Matrix.001 file - promoters70/1024199
ttataaaccc

SEQ ID NO: 38399 - DNA, 12 bp, Unknown
  misc_feature (1)..( 12): Matrix.001 file - promoters70/1024199
ggcctatataaa

SEQ ID NO: 38400 - DNA, 9 bp, Unknown
  misc_feature (1)..( 9): Matrix.001 file - promoters70/1024203
agaaaagac

SEQ ID NO: 38401 - DNA, 7 bp, Unknown
  misc_feature (1)..( 7): Matrix.001 file - promoters70/1024203
acaagcg

SEQ ID NO: 38402 - DNA, 7 bp, Unknown
  misc_feature (1)..( 7): Matrix.001 file - promoters70/1024203
tcgatga

SEQ ID NO: 38403 - DNA, 13 bp, Unknown
  misc_feature (1)..( 13): Matrix.001 file - promoters70/1024234
ttgattcaaaatt

SEQ ID NO: 38404 - DNA, 11 bp, Unknown
  misc_feature (1)..( 11): Matrix.001 file - promoters70/1024236
agcacaagaat

SEQ ID NO: 38405 - DNA, 11 bp, Unknown
  misc_feature (1)..( 11): Matrix.001 file - promoters70/1024236
aaaaaagtttt

SEQ ID NO: 38406 - DNA, 13 bp, Unknown
  misc_feature (1)..( 13): Matrix.001 file - promoters70/1024236
cattactggaaag

SEQ ID NO: 38407 - DNA, 9 bp, Unknown
  misc_feature (1)..( 9): Matrix.001 file - promoters70/1024257
atctctaaa

SEQ ID NO: 38408 - DNA, 7 bp, Unknown
  misc_feature (1)..( 7): Matrix.001 file - promoters70/1024367
attaact

SEQ ID NO: 38409 - DNA, 8 bp, Unknown
  misc_feature (1)..( 8): Matrix.001 file - promoters70/1024367
tttatata

SEQ ID NO: 38410 - DNA, 11 bp, Unknown
  misc_feature (1)..( 11): Matrix.001 file - promoters70/1024367
ctaaaaaaaac

SEQ ID NO: 38411 - DNA, 9 bp, Unknown
  misc_feature (1)..( 9): Matrix.001 file - promoters70/1024367
tttcccaat

SEQ ID NO: 38412 - DNA, 7 bp, Unknown
  misc_feature (1)..( 7): Matrix.001 file - promoters70/1024367
aatttta

SEQ ID NO: 38413 - DNA, 9 bp, Unknown
  misc_feature (1)..( 9): Matrix.001 file - promoters70/1024367
agaaacaaa

SEQ ID NO: 38414 - DNA, 8 bp, Unknown
  misc_feature (1)..( 8): Matrix.001 file - promoters70/1024499
tttgtaat

SEQ ID NO: 38415 - DNA, 12 bp, Unknown
  misc_feature (1)..( 12): Matrix.001 file - promoters70/1024499
taaaatattttt

SEQ ID NO: 38416 - DNA, 7 bp, Unknown
  misc_feature (1)..( 7): Matrix.001 file - promoters70/1024499
tttattt

SEQ ID NO: 38417 - DNA, 7 bp, Unknown
  misc_feature (1)..( 7): Matrix.001 file - promoters70/1024499
cataaac

SEQ ID NO: 38418 - DNA, 11 bp, Unknown
  misc_feature (1)..( 11): Matrix.001 file - promoters70/1024499
tatatataaat

SEQ ID NO: 38419 - DNA, 10 bp, Unknown
  misc_feature (1)..( 10): Matrix.001 file - promoters70/1024499
ttaattttac

SEQ ID NO: 38420 - DNA, 9 bp, Unknown
  misc_feature (1)..( 9): Matrix.001 file - promoters70/1024756
ataattttt

SEQ ID NO: 38421 - DNA, 11 bp, Unknown
  misc_feature (1)..( 11): Matrix.001 file - promoters70/1024756
taacagtcaaa

SEQ ID NO: 38422 - DNA, 9 bp, Unknown
  misc_feature (1)..( 9): Matrix.001 file - promoters70/1024756
ttaccaaag

SEQ ID NO: 38423 - DNA, 11 bp, Unknown
  misc_feature (1)..( 11): Matrix.001 file - promoters70/1024853
agaattgacat

SEQ ID NO: 38424 - DNA, 8 bp, Unknown
  misc_feature (1)..( 8): Matrix.001 file - promoters70/1024853
caaaaaaa

SEQ ID NO: 38425 - DNA, 15 bp, Unknown
  misc_feature (1)..( 15): Matrix.001 file - promoters70/1024889
actatcaattaaggt

SEQ ID NO: 38426 - DNA, 11 bp, Unknown
  misc_feature (1)..( 11): Matrix.001 file - promoters70/1024889
ataattttatt

SEQ ID NO: 38427 - DNA, 6 bp, Unknown
  misc_feature (1)..( 6): Matrix.001 file - promoters70/1024889
attttt

SEQ ID NO: 38428 - DNA, 12 bp, Unknown
  misc_feature (1)..( 12): Matrix.001 file - promoters70/1024889
tagattttgttt

SEQ ID NO: 38429 - DNA, 18 bp, Unknown
  misc_feature (1)..( 18): Matrix.001 file - promoters70/1024889
tcgatttagtttttacag

SEQ ID NO: 38430 - DNA, 10 bp, Unknown
  misc_feature (1)..( 10): Matrix.001 file - promoters70/1024993
tgaaatgatc

SEQ ID NO: 38431 - DNA, 13 bp, Unknown
  misc_feature (1)..( 13): Matrix.001 file - promoters70/1024993
ttgtctaatattc

SEQ ID NO: 38432 - DNA, 15 bp, Unknown
  misc_feature (1)..( 15): Matrix.001 file - promoters70/1024993
aacttgttacaaaat

SEQ ID NO: 38433 - DNA, 7 bp, Unknown
  misc_feature (1)..( 7): Matrix.001 file - promoters70/1025211
aaacaaa

SEQ ID NO: 38434 - DNA, 9 bp, Unknown
  misc_feature (1)..( 9): Matrix.001 file - promoters70/1025211
atattatta

SEQ ID NO: 38435 - DNA, 10 bp, Unknown
  misc_feature (1)..( 10): Matrix.001 file - promoters70/1025211
gtttcaaata

SEQ ID NO: 38436 - DNA, 8 bp, Unknown
  misc_feature (1)..( 8): Matrix.001 file - promoters70/1025211
agtcaaaa

SEQ ID NO: 38437 - DNA, 9 bp, Unknown
  misc_feature (1)..( 9): Matrix.001 file - promoters70/1025211
aaataaaca

SEQ ID NO: 38438 - DNA, 10 bp, Unknown
  misc_feature (1)..( 10): Matrix.001 file - promoters70/1025211
aatgaaattc

SEQ ID NO: 38439 - DNA, 10 bp, Unknown
  misc_feature (1)..( 10): Matrix.001 file - promoters70/1025582
gagacaattg

SEQ ID NO: 38440 - DNA, 10 bp, Unknown
  misc_feature (1)..( 10): Matrix.001 file - promoters70/1025642
tcataattaa

SEQ ID NO: 38441 - DNA, 12 bp, Unknown
  misc_feature (1)..( 12): Matrix.001 file - promoters70/1025642
ccaatgatttag

SEQ ID NO: 38442 - DNA, 9 bp, Unknown
  misc_feature (1)..( 9): Matrix.001 file - promoters70/1025642
tatataata

SEQ ID NO: 38443 - DNA, 9 bp, Unknown
  misc_feature (1)..( 9): Matrix.001 file - promoters70/1025683
agaaaattg

SEQ ID NO: 38444 - DNA, 8 bp, Unknown
  misc_feature (1)..( 8): Matrix.001 file - promoters70/1025683
cctatata

SEQ ID NO: 38445 - DNA, 14 bp, Unknown
  misc_feature (1)..( 14): Matrix.001 file - promoters70/1025683
tatgaatcagctaa

SEQ ID NO: 38446 - DNA, 13 bp, Unknown
  misc_feature (1)..( 13): Matrix.001 file - promoters70/1025791
caaaagaaccaat

SEQ ID NO: 38447 - DNA, 12 bp, Unknown
  misc_feature (1)..( 12): Matrix.001 file - promoters70/1025791
aaccaaaaaaat

SEQ ID NO: 38448 - DNA, 13 bp, Unknown
  misc_feature (1)..( 13): Matrix.001 file - promoters70/1026160
ttaaaaacaatac

SEQ ID NO: 38449 - DNA, 7 bp, Unknown
  misc_feature (1)..( 7): Matrix.001 file - promoters70/1026160
aaacaaa

SEQ ID NO: 38450 - DNA, 8 bp, Unknown
  misc_feature (1)..( 8): Matrix.001 file - promoters70/1026551
aatatata

SEQ ID NO: 38451 - DNA, 11 bp, Unknown
  misc_feature (1)..( 11): Matrix.001 file - promoters70/1026551
aagtataactt

SEQ ID NO: 38452 - DNA, 7 bp, Unknown
  misc_feature (1)..( 7): Matrix.001 file - promoters70/1026551
aaatatg

SEQ ID NO: 38453 - DNA, 15 bp, Unknown
  misc_feature (1)..( 15): Matrix.001 file - promoters70/1026551
aaggatgatggacca

SEQ ID NO: 38454 - DNA, 21 bp, Unknown
  misc_feature (1)..( 21): Matrix.001 file - promoters70/1026551
tacacattaataacgtggtcc

SEQ ID NO: 38455 - DNA, 7 bp, Unknown
  misc_feature (1)..( 7): Matrix.001 file - promoters70/1026551
ttaattt

SEQ ID NO: 38456 - DNA, 8 bp, Unknown
  misc_feature (1)..( 8): Matrix.001 file - promoters70/1026551
attttata

SEQ ID NO: 38457 - DNA, 14 bp, Unknown
  misc_feature (1)..( 14): Matrix.001 file - promoters70/1026622
ggagcatatttcaa

SEQ ID NO: 38458 - DNA, 13 bp, Unknown
  misc_feature (1)..( 13): Matrix.001 file - promoters70/1026622
gaatttaaaaaaa

SEQ ID NO: 38459 - DNA, 11 bp, Unknown
  misc_feature (1)..( 11): Matrix.001 file - promoters70/1026705
gaagatgtgaa

SEQ ID NO: 38460 - DNA, 7 bp, Unknown
  misc_feature (1)..( 7): Matrix.001 file - promoters70/1026861
tataaaa

SEQ ID NO: 38461 - DNA, 9 bp, Unknown
  misc_feature (1)..( 9): Matrix.001 file - promoters70/1026883
aaataattt

SEQ ID NO: 38462 - DNA, 7 bp, Unknown
  misc_feature (1)..( 7): Matrix.001 file - promoters70/1026883
tagaaca

SEQ ID NO: 38463 - DNA, 7 bp, Unknown
  misc_feature (1)..( 7): Matrix.001 file - promoters70/1026883
tgaaaac

SEQ ID NO: 38464 - DNA, 9 bp, Unknown
  misc_feature (1)..( 9): Matrix.001 file - promoters70/1026883
aatagatta

SEQ ID NO: 38465 - DNA, 9 bp, Unknown
  misc_feature (1)..( 9): Matrix.001 file - promoters70/1026883
acaaataat

SEQ ID NO: 38466 - DNA, 9 bp, Unknown
  misc_feature (1)..( 9): Matrix.001 file - promoters70/1026883
atttgtcta

SEQ ID NO: 38467 - DNA, 10 bp, Unknown
  misc_feature (1)..( 10): Matrix.001 file - promoters70/1026883
aattatttat

SEQ ID NO: 38468 - DNA, 10 bp, Unknown
  misc_feature (1)..( 10): Matrix.001 file - promoters70/1026883
aattaattta

SEQ ID NO: 38469 - DNA, 8 bp, Unknown
  misc_feature (1)..( 8): Matrix.001 file - promoters70/1026883
aattataa

SEQ ID NO: 38470 - DNA, 9 bp, Unknown
  misc_feature (1)..( 9): Matrix.001 file - promoters70/1026883
caacaacca

SEQ ID NO: 38471 - DNA, 13 bp, Unknown
  misc_feature (1)..( 13): Matrix.001 file - promoters70/1026976
ttgaatcaaaatt

SEQ ID NO: 38472 - DNA, 8 bp, Unknown
  misc_feature (1)..( 8): Matrix.001 file - promoters70/1026976
atttctgc

SEQ ID NO: 38473 - DNA, 8 bp, Unknown
  misc_feature (1)..( 8): Matrix.001 file - promoters70/1026987
aaaacaaa

SEQ ID NO: 38474 - DNA, 11 bp, Unknown
  misc_feature (1)..( 11): Matrix.001 file - promoters70/1026987
tatttaaaaag

SEQ ID NO: 38475 - DNA, 10 bp, Unknown
  misc_feature (1)..( 10): Matrix.001 file - promoters70/1026987
tttaaaaaaa

SEQ ID NO: 38476 - DNA, 7 bp, Unknown
  misc_feature (1)..( 7): Matrix.001 file - promoters70/1027189
aaaaaat

SEQ ID NO: 38477 - DNA, 10 bp, Unknown
  misc_feature (1)..( 10): Matrix.001 file - promoters70/1027189
ggtttgtttt

SEQ ID NO: 38478 - DNA, 9 bp, Unknown
  misc_feature (1)..( 9): Matrix.001 file - promoters70/1027276
agtagtttc

SEQ ID NO: 38479 - DNA, 9 bp, Unknown
  misc_feature (1)..( 9): Matrix.001 file - promoters70/1027276
aaatttgaa

SEQ ID NO: 38480 - DNA, 8 bp, Unknown
  misc_feature (1)..( 8): Matrix.001 file - promoters70/1027276
acatatta

SEQ ID NO: 38481 - DNA, 10 bp, Unknown
  misc_feature (1)..( 10): Matrix.001 file - promoters70/1027276
aaaagaaatt

SEQ ID NO: 38482 - DNA, 7 bp, Unknown
  misc_feature (1)..( 7): Matrix.001 file - promoters70/1027276
gaaaaaa

SEQ ID NO: 38483 - DNA, 6 bp, Unknown
  misc_feature (1)..( 6): Matrix.001 file - promoters70/1027276
atatag

SEQ ID NO: 38484 - DNA, 12 bp, Unknown
  misc_feature (1)..( 12): Matrix.001 file - promoters70/1027276
aaaaaaaaagaa

SEQ ID NO: 38485 - DNA, 7 bp, Unknown
  misc_feature (1)..( 7): Matrix.001 file - promoters70/1027276
tcaaaat

SEQ ID NO: 38486 - DNA, 11 bp, Unknown
  misc_feature (1)..( 11): Matrix.001 file - promoters70/1027327
ttgtaaatgtt

SEQ ID NO: 38487 - DNA, 13 bp, Unknown
  misc_feature (1)..( 13): Matrix.001 file - promoters70/1027327
cattaataagctt

SEQ ID NO: 38488 - DNA, 10 bp, Unknown
  misc_feature (1)..( 10): Matrix.001 file - promoters70/1027399
ataactctat

SEQ ID NO: 38489 - DNA, 8 bp, Unknown
  misc_feature (1)..( 8): Matrix.001 file - promoters70/1027406
tataaaat

SEQ ID NO: 38490 - DNA, 7 bp, Unknown
  misc_feature (1)..( 7): Matrix.001 file - promoters70/1027406
atgaaat

SEQ ID NO: 38491 - DNA, 16 bp, Unknown
  misc_feature (1)..( 16): Matrix.001 file - promoters70/1027406
ttttaaaaaactatat

SEQ ID NO: 38492 - DNA, 8 bp, Unknown
  misc_feature (1)..( 8): Matrix.001 file - promoters70/1027590
ttatagag

SEQ ID NO: 38493 - DNA, 12 bp, Unknown
  misc_feature (1)..( 12): Matrix.001 file - promoters70/1027590
taaaaaaataaa

SEQ ID NO: 38494 - DNA, 12 bp, Unknown
  misc_feature (1)..( 12): Matrix.001 file - promoters70/1027760
aaagtttataga

SEQ ID NO: 38495 - DNA, 11 bp, Unknown
  misc_feature (1)..( 11): Matrix.001 file - promoters70/1027760
aaaaaaattaa

SEQ ID NO: 38496 - DNA, 16 bp, Unknown
  misc_feature (1)..( 16): Matrix.001 file - promoters70/1027760
aataattttccaaata

SEQ ID NO: 38497 - DNA, 9 bp, Unknown
  misc_feature (1)..( 9): Matrix.001 file - promoters70/1027760
tccatttca

SEQ ID NO: 38498 - DNA, 10 bp, Unknown
  misc_feature (1)..( 10): Matrix.001 file - promoters70/1028243
aaaaccaaaa

SEQ ID NO: 38499 - DNA, 13 bp, Unknown
  misc_feature (1)..( 13): Matrix.001 file - promoters70/1028243
atatcaatttaaa

SEQ ID NO: 38500 - DNA, 10 bp, Unknown
  misc_feature (1)..( 10): Matrix.001 file - promoters70/1028368
aagaaaaaat

SEQ ID NO: 38501 - DNA, 10 bp, Unknown
  misc_feature (1)..( 10): Matrix.001 file - promoters70/1028368
atataaatca

SEQ ID NO: 38502 - DNA, 11 bp, Unknown
  misc_feature (1)..( 11): Matrix.001 file - promoters70/1028368
atctaaaaaat

SEQ ID NO: 38503 - DNA, 7 bp, Unknown
  misc_feature (1)..( 7): Matrix.001 file - promoters70/1028368
aaaagta

SEQ ID NO: 38504 - DNA, 8 bp, Unknown
  misc_feature (1)..( 8): Matrix.001 file - promoters70/1028413
aaaagaaa

SEQ ID NO: 38505 - DNA, 11 bp, Unknown
  misc_feature (1)..( 11): Matrix.001 file - promoters70/1028413
gtgaaccagga

SEQ ID NO: 38506 - DNA, 10 bp, Unknown
  misc_feature (1)..( 10): Matrix.001 file - promoters70/1028413
aaaacgaaat

SEQ ID NO: 38507 - DNA, 9 bp, Unknown
  misc_feature (1)..( 9): Matrix.001 file - promoters70/1028413
tttaaaggg

SEQ ID NO: 38508 - DNA, 10 bp, Unknown
  misc_feature (1)..( 10): Matrix.001 file - promoters70/1028470
ctaaatactc

SEQ ID NO: 38509 - DNA, 9 bp, Unknown
  misc_feature (1)..( 9): Matrix.001 file - promoters70/1028470
tttaatata

SEQ ID NO: 38510 - DNA, 12 bp, Unknown
  misc_feature (1)..( 12): Matrix.001 file - promoters70/1028470
gactctttttct

SEQ ID NO: 38511 - DNA, 9 bp, Unknown
  misc_feature (1)..( 9): Matrix.001 file - promoters70/1028682
ttttcaatt

SEQ ID NO: 38512 - DNA, 7 bp, Unknown
  misc_feature (1)..( 7): Matrix.001 file - promoters70/1028682
catatat

SEQ ID NO: 38513 - DNA, 10 bp, Unknown
  misc_feature (1)..( 10): Matrix.001 file - promoters70/1028863
agattttttt

SEQ ID NO: 38514 - DNA, 7 bp, Unknown
  misc_feature (1)..( 7): Matrix.001 file - promoters70/1028937
tattttg

SEQ ID NO: 38515 - DNA, 6 bp, Unknown
  misc_feature (1)..( 6): Matrix.001 file - promoters70/1028955
attatc

SEQ ID NO: 38516 - DNA, 9 bp, Unknown
  misc_feature (1)..( 9): Matrix.001 file - promoters70/1028955
gatgtctca

SEQ ID NO: 38517 - DNA, 10 bp, Unknown
  misc_feature (1)..( 10): Matrix.001 file - promoters70/1028963
aaataaaata

SEQ ID NO: 38518 - DNA, 8 bp, Unknown
  misc_feature (1)..( 8): Matrix.001 file - promoters70/1028963
tatcttct

SEQ ID NO: 38519 - DNA, 12 bp, Unknown
  misc_feature (1)..( 12): Matrix.001 file - promoters70/1029485
taatggcccaaa

SEQ ID NO: 38520 - DNA, 7 bp, Unknown
  misc_feature (1)..( 7): Matrix.001 file - promoters70/1029908
aagattt

SEQ ID NO: 38521 - DNA, 12 bp, Unknown
  misc_feature (1)..( 12): Matrix.001 file - promoters70/1029908
tgtattttatgt

SEQ ID NO: 38522 - DNA, 12 bp, Unknown
  misc_feature (1)..( 12): Matrix.001 file - promoters70/1029952
aatgggcccaaa

SEQ ID NO: 38523 - DNA, 11 bp, Unknown
  misc_feature (1)..( 11): Matrix.001 file - promoters70/1030231
atttgaatttt

SEQ ID NO: 38524 - DNA, 8 bp, Unknown
  misc_feature (1)..( 8): Matrix.001 file - promoters70/1030283
aaaaaaga

SEQ ID NO: 38525 - DNA, 7 bp, Unknown
  misc_feature (1)..( 7): Matrix.001 file - promoters70/1030283
tcctttg

SEQ ID NO: 38526 - DNA, 8 bp, Unknown
  misc_feature (1)..( 8): Matrix.001 file - promoters70/1030283
aaaaaaga

SEQ ID NO: 38527 - DNA, 7 bp, Unknown
  misc_feature (1)..( 7): Matrix.001 file - promoters70/1030283
ttccaaa

SEQ ID NO: 38528 - DNA, 9 bp, Unknown
  misc_feature (1)..( 9): Matrix.001 file - promoters70/1030283
tttattttt

SEQ ID NO: 38529 - DNA, 10 bp, Unknown
  misc_feature (1)..( 10): Matrix.001 file - promoters70/1030283
tttgaataaa

SEQ ID NO: 38530 - DNA, 10 bp, Unknown
  misc_feature (1)..( 10): Matrix.001 file - promoters70/1030283
tataaaaatt

SEQ ID NO: 38531 - DNA, 7 bp, Unknown
  misc_feature (1)..( 7): Matrix.001 file - promoters70/1030283
gaaacaa

SEQ ID NO: 38532 - DNA, 9 bp, Unknown
  misc_feature (1)..( 9): Matrix.001 file - promoters70/1030528
ataataatt

SEQ ID NO: 38533 - DNA, 13 bp, Unknown
  misc_feature (1)..( 13): Matrix.001 file - promoters70/1030528
ttatatttttaaa

SEQ ID NO: 38534 - DNA, 7 bp, Unknown
  misc_feature (1)..( 7): Matrix.001 file - promoters70/1030528
ttaaaaa

SEQ ID NO: 38535 - DNA, 9 bp, Unknown
  misc_feature (1)..( 9): Matrix.001 file - promoters70/1030547
aatgtttgt

SEQ ID NO: 38536 - DNA, 9 bp, Unknown
  misc_feature (1)..( 9): Matrix.001 file - promoters70/1030547
ttttgatga

SEQ ID NO: 38537 - DNA, 14 bp, Unknown
  misc_feature (1)..( 14): Matrix.001 file - promoters70/1030547
attcaaaaatatta

SEQ ID NO: 38538 - DNA, 10 bp, Unknown
  misc_feature (1)..( 10): Matrix.001 file - promoters70/1030547
tatataaata

SEQ ID NO: 38539 - DNA, 10 bp, Unknown
  misc_feature (1)..( 10): Matrix.001 file - promoters70/1030547
tataaacaaa

SEQ ID NO: 38540 - DNA, 9 bp, Unknown
  misc_feature (1)..( 9): Matrix.001 file - promoters70/1030547
ttttgatta

SEQ ID NO: 38541 - DNA, 13 bp, Unknown
  misc_feature (1)..( 13): Matrix.001 file - promoters70/1030547
atctttataagta

SEQ ID NO: 38542 - DNA, 9 bp, Unknown
  misc_feature (1)..( 9): Matrix.001 file - promoters70/1030547
atctttata

SEQ ID NO: 38543 - DNA, 10 bp, Unknown
  misc_feature (1)..( 10): Matrix.001 file - promoters70/1030547
taatatattt

SEQ ID NO: 38544 - DNA, 11 bp, Unknown
  misc_feature (1)..( 11): Matrix.001 file - promoters70/1030605
aaaaaaagaat

SEQ ID NO: 38545 - DNA, 10 bp, Unknown
  misc_feature (1)..( 10): Matrix.001 file - promoters70/1030605
taaattgaaa

SEQ ID NO: 38546 - DNA, 16 bp, Unknown
  misc_feature (1)..( 16): Matrix.001 file - promoters70/1030605
ccttactatataaaaa

SEQ ID NO: 38547 - DNA, 14 bp, Unknown
  misc_feature (1)..( 14): Matrix.001 file - promoters70/1030605
ttaaaaaatattga

SEQ ID NO: 38548 - DNA, 10 bp, Unknown
  misc_feature (1)..( 10): Matrix.001 file - promoters70/1030605
tatttagaaa

SEQ ID NO: 38549 - DNA, 10 bp, Unknown
  misc_feature (1)..( 10): Matrix.001 file - promoters70/1030757
caaatacatt

SEQ ID NO: 38550 - DNA, 8 bp, Unknown
  misc_feature (1)..( 8): Matrix.001 file - promoters70/1030757
cttttgaa

SEQ ID NO: 38551 - DNA, 9 bp, Unknown
  misc_feature (1)..( 9): Matrix.001 file - promoters70/1030821
aataaaaaa

SEQ ID NO: 38552 - DNA, 12 bp, Unknown
  misc_feature (1)..( 12): Matrix.001 file - promoters70/1030821
acaataaacaaa

SEQ ID NO: 38553 - DNA, 7 bp, Unknown
  misc_feature (1)..( 7): Matrix.001 file - promoters70/1030821
aaaacat

SEQ ID NO: 38554 - DNA, 12 bp, Unknown
  misc_feature (1)..( 12): Matrix.001 file - promoters70/1030902
gtcatataaata

SEQ ID NO: 38555 - DNA, 10 bp, Unknown
  misc_feature (1)..( 10): Matrix.001 file - promoters70/1030916
ttttactaac

SEQ ID NO: 38556 - DNA, 9 bp, Unknown
  misc_feature (1)..( 9): Matrix.001 file - promoters70/1030916
atttcaaaa

SEQ ID NO: 38557 - DNA, 10 bp, Unknown
  misc_feature (1)..( 10): Matrix.001 file - promoters70/1030916
actttataat

SEQ ID NO: 38558 - DNA, 9 bp, Unknown
  misc_feature (1)..( 9): Matrix.001 file - promoters70/1031084
tagagaatg

SEQ ID NO: 38559 - DNA, 9 bp, Unknown
  misc_feature (1)..( 9): Matrix.001 file - promoters70/1031267
caaagaaag

SEQ ID NO: 38560 - DNA, 8 bp, Unknown
  misc_feature (1)..( 8): Matrix.001 file - promoters70/1031267
aaatcaaa

SEQ ID NO: 38561 - DNA, 7 bp, Unknown
  misc_feature (1)..( 7): Matrix.001 file - promoters70/1031267
aagtcaa

SEQ ID NO: 38562 - DNA, 8 bp, Unknown
  misc_feature (1)..( 8): Matrix.001 file - promoters70/1031291
aataaaat

SEQ ID NO: 38563 - DNA, 11 bp, Unknown
  misc_feature (1)..( 11): Matrix.001 file - promoters70/1031291
aaaaaaaattc

SEQ ID NO: 38564 - DNA, 9 bp, Unknown
  misc_feature (1)..( 9): Matrix.001 file - promoters70/1031429
taaccaata

SEQ ID NO: 38565 - DNA, 10 bp, Unknown
  misc_feature (1)..( 10): Matrix.001 file - promoters70/1031429
aatacaaatc

SEQ ID NO: 38566 - DNA, 7 bp, Unknown
  misc_feature (1)..( 7): Matrix.001 file - promoters70/1031429
taaggca

SEQ ID NO: 38567 - DNA, 11 bp, Unknown
  misc_feature (1)..( 11): Matrix.001 file - promoters70/1031429
aaagaaacaaa

SEQ ID NO: 38568 - DNA, 8 bp, Unknown
  misc_feature (1)..( 8): Matrix.001 file - promoters70/1031706
tatatata

SEQ ID NO: 38569 - DNA, 8 bp, Unknown
  misc_feature (1)..( 8): Matrix.001 file - promoters70/1031799
acaaaaca

SEQ ID NO: 38570 - DNA, 9 bp, Unknown
  misc_feature (1)..( 9): Matrix.001 file - promoters70/1031799
atataaata

SEQ ID NO: 38571 - DNA, 13 bp, Unknown
  misc_feature (1)..( 13): Matrix.001 file - promoters70/1031799
aaaaataaatcca

SEQ ID NO: 38572 - DNA, 7 bp, Unknown
  misc_feature (1)..( 7): Matrix.001 file - promoters70/1032047
caatatt

SEQ ID NO: 38573 - DNA, 7 bp, Unknown
  misc_feature (1)..( 7): Matrix.001 file - promoters70/1032047
tttttac

SEQ ID NO: 38574 - DNA, 12 bp, Unknown
  misc_feature (1)..( 12): Matrix.001 file - promoters70/1032047
aaaggaaaaaat

SEQ ID NO: 38575 - DNA, 13 bp, Unknown
  misc_feature (1)..( 13): Matrix.001 file - promoters70/1032047
ctcctataaattg

SEQ ID NO: 38576 - DNA, 15 bp, Unknown
  misc_feature (1)..( 15): Matrix.001 file - promoters70/1032047
acataaaagaaatat

SEQ ID NO: 38577 - DNA, 9 bp, Unknown
  misc_feature (1)..( 9): Matrix.001 file - promoters70/1032047
ataggaata

SEQ ID NO: 38578 - DNA, 13 bp, Unknown
  misc_feature (1)..( 13): Matrix.001 file - promoters70/1032047
ccataaaggaaaa

SEQ ID NO: 38579 - DNA, 8 bp, Unknown
  misc_feature (1)..( 8): Matrix.001 file - promoters70/1032313
cgtttttc

SEQ ID NO: 38580 - DNA, 7 bp, Unknown
  misc_feature (1)..( 7): Matrix.001 file - promoters70/1032381
attattt

SEQ ID NO: 38581 - DNA, 6 bp, Unknown
  misc_feature (1)..( 6): Matrix.001 file - promoters70/1032381
aataaa

SEQ ID NO: 38582 - DNA, 11 bp, Unknown
  misc_feature (1)..( 11): Matrix.001 file - promoters70/1032381
agaataaaaaa

SEQ ID NO: 38583 - DNA, 8 bp, Unknown
  misc_feature (1)..( 8): Matrix.001 file - promoters70/1032400
aattgatt

SEQ ID NO: 38584 - DNA, 11 bp, Unknown
  misc_feature (1)..( 11): Matrix.001 file - promoters70/1032498
acaaaccaaaa

SEQ ID NO: 38585 - DNA, 9 bp, Unknown
  misc_feature (1)..( 9): Matrix.001 file - promoters70/1032498
tatatcaaa

SEQ ID NO: 38586 - DNA, 10 bp, Unknown
  misc_feature (1)..( 10): Matrix.001 file - promoters70/1032498
gcaaaccaaa

SEQ ID NO: 38587 - DNA, 10 bp, Unknown
  misc_feature (1)..( 10): Matrix.001 file - promoters70/1032676
aaacttaaga

SEQ ID NO: 38588 - DNA, 8 bp, Unknown
  misc_feature (1)..( 8): Matrix.001 file - promoters70/1032676
attttttt

SEQ ID NO: 38589 - DNA, 9 bp, Unknown
  misc_feature (1)..( 9): Matrix.001 file - promoters70/1032676
agatattaa

SEQ ID NO: 38590 - DNA, 11 bp, Unknown
  misc_feature (1)..( 11): Matrix.001 file - promoters70/1032676
ttcaaaatttc

SEQ ID NO: 38591 - DNA, 7 bp, Unknown
  misc_feature (1)..( 7): Matrix.001 file - promoters70/1032676
aaaagaa

SEQ ID NO: 38592 - DNA, 7 bp, Unknown
  misc_feature (1)..( 7): Matrix.001 file - promoters70/1032788
ttacaaa

SEQ ID NO: 38593 - DNA, 13 bp, Unknown
  misc_feature (1)..( 13): Matrix.001 file - promoters70/1032897
aatcttgttttaa

SEQ ID NO: 38594 - DNA, 10 bp, Unknown
  misc_feature (1)..( 10): Matrix.001 file - promoters70/1032897
ctttttctac

SEQ ID NO: 38595 - DNA, 7 bp, Unknown
  misc_feature (1)..( 7): Matrix.001 file - promoters70/1033184
aatatat

SEQ ID NO: 38596 - DNA, 8 bp, Unknown
  misc_feature (1)..( 8): Matrix.001 file - promoters70/1033184
gcccaaag

SEQ ID NO: 38597 - DNA, 12 bp, Unknown
  misc_feature (1)..( 12): Matrix.001 file - promoters70/1033184
tataaatccttc

SEQ ID NO: 38598 - DNA, 8 bp, Unknown
  misc_feature (1)..( 8): Matrix.001 file - promoters70/1033184
gtttttat

SEQ ID NO: 38599 - DNA, 8 bp, Unknown
  misc_feature (1)..( 8): Matrix.001 file - promoters70/1033184
attttttt

SEQ ID NO: 38600 - DNA, 8 bp, Unknown
  misc_feature (1)..( 8): Matrix.001 file - promoters70/1033184
gttaactt

SEQ ID NO: 38601 - DNA, 7 bp, Unknown
  misc_feature (1)..( 7): Matrix.001 file - promoters70/1033184
aaaaaat

SEQ ID NO: 38602 - DNA, 9 bp, Unknown
  misc_feature (1)..( 9): Matrix.001 file - promoters70/1033184
agtcatatt

SEQ ID NO: 38603 - DNA, 8 bp, Unknown
  misc_feature (1)..( 8): Matrix.001 file - promoters70/1033262
aagttgat

SEQ ID NO: 38604 - DNA, 10 bp, Unknown
  misc_feature (1)..( 10): Matrix.001 file - promoters70/1033262
gaagttgact

SEQ ID NO: 38605 - DNA, 7 bp, Unknown
  misc_feature (1)..( 7): Matrix.001 file - promoters70/1033262
agttttt

SEQ ID NO: 38606 - DNA, 11 bp, Unknown
  misc_feature (1)..( 11): Matrix.001 file - promoters70/1033262
gttaagaagcc

SEQ ID NO: 38607 - DNA, 7 bp, Unknown
  misc_feature (1)..( 7): Matrix.001 file - promoters70/1033262
gaaagaa

SEQ ID NO: 38608 - DNA, 8 bp, Unknown
  misc_feature (1)..( 8): Matrix.001 file - promoters70/1033262
atttcttg

SEQ ID NO: 38609 - DNA, 7 bp, Unknown
  misc_feature (1)..( 7): Matrix.001 file - promoters70/1033262
ctttatt

SEQ ID NO: 38610 - DNA, 7 bp, Unknown
  misc_feature (1)..( 7): Matrix.001 file - promoters70/1033262
aaagaaa

SEQ ID NO: 38611 - DNA, 8 bp, Unknown
  misc_feature (1)..( 8): Matrix.001 file - promoters70/1033262
tgatttgc

SEQ ID NO: 38612 - DNA, 9 bp, Unknown
  misc_feature (1)..( 9): Matrix.001 file - promoters70/1033262
agataaaga

SEQ ID NO: 38613 - DNA, 8 bp, Unknown
  misc_feature (1)..( 8): Matrix.001 file - promoters70/1033262
gaagttga

SEQ ID NO: 38614 - DNA, 9 bp, Unknown
  misc_feature (1)..( 9): Matrix.001 file - promoters70/1033262
agttttttt

SEQ ID NO: 38615 - DNA, 7 bp, Unknown
  misc_feature (1)..( 7): Matrix.001 file - promoters70/1033262
aaagaag

SEQ ID NO: 38616 - DNA, 9 bp, Unknown
  misc_feature (1)..( 9): Matrix.001 file - promoters70/1033781
aataaaaaa

SEQ ID NO: 38617 - DNA, 14 bp, Unknown
  misc_feature (1)..( 14): Matrix.001 file - promoters70/1033781
acttattatcgaag

SEQ ID NO: 38618 - DNA, 10 bp, Unknown
  misc_feature (1)..( 10): Matrix.001 file - promoters70/1033781
accattttct

SEQ ID NO: 38619 - DNA, 9 bp, Unknown
  misc_feature (1)..( 9): Matrix.001 file - promoters70/1033781
catgaattg

SEQ ID NO: 38620 - DNA, 14 bp, Unknown
  misc_feature (1)..( 14): Matrix.001 file - promoters70/1033781
gtaattttttattt

SEQ ID NO: 38621 - DNA, 9 bp, Unknown
  misc_feature (1)..( 9): Matrix.001 file - promoters70/1033841
atctccatt

SEQ ID NO: 38622 - DNA, 10 bp, Unknown
  misc_feature (1)..( 10): Matrix.001 file - promoters70/1034137
tcaataaatg

SEQ ID NO: 38623 - DNA, 10 bp, Unknown
  misc_feature (1)..( 10): Matrix.001 file - promoters70/1034137
ttaaaaaaaa

SEQ ID NO: 38624 - DNA, 33 bp, Unknown; identical to SEQ ID NO: 37194
  misc_feature (1)..( 33): Matrix.001 file - promoters70/1034137

SEQ ID NO: 38625 - DNA, 32 bp, Unknown; identical to SEQ ID NO: 37195
  misc_feature (1)..( 32): Matrix.001 file - promoters70/1034137

SEQ ID NO: 38626 - DNA, 15 bp, Unknown
  misc_feature (1)..( 15): Matrix.001 file - promoters70/1034137
attgaagacttttca

SEQ ID NO: 38627 - DNA, 14 bp, Unknown
  misc_feature (1)..( 14): Matrix.001 file - promoters70/1034137
ctataagcatttaa

SEQ ID NO: 38628 - DNA, 25 bp, Unknown
  misc_feature (1)..( 25): Matrix.001 file - promoters70/1034137
agcatttaagtctatcgctagactg

SEQ ID NO: 38629 - DNA, 10 bp, Unknown
  misc_feature (1)..( 10): Matrix.001 file - promoters70/1034322
tatataaata

SEQ ID NO: 38630 - DNA, 13 bp, Unknown
  misc_feature (1)..( 13): Matrix.001 file - promoters70/1034322
attttaataactt

SEQ ID NO: 38631 - DNA, 13 bp, Unknown
  misc_feature (1)..( 13): Matrix.001 file - promoters70/1034322
aatttaataactt

SEQ ID NO: 38632 - DNA, 9 bp, Unknown
  misc_feature (1)..( 9): Matrix.001 file - promoters70/1034652
aaaaacata

SEQ ID NO: 38633 - DNA, 11 bp, Unknown
  misc_feature (1)..( 11): Matrix.001 file - promoters70/1034652
ctaaacaaaaa

SEQ ID NO: 38634 - DNA, 9 bp, Unknown
  misc_feature (1)..( 9): Matrix.001 file - promoters70/1034652
caatcaaat

SEQ ID NO: 38635 - DNA, 11 bp, Unknown
  misc_feature (1)..( 11): Matrix.001 file - promoters70/1034652
tatccttcttt

SEQ ID NO: 38636 - DNA, 10 bp, Unknown
  misc_feature (1)..( 10): Matrix.001 file - promoters70/1035083
tattagttct

SEQ ID NO: 38637 - DNA, 11 bp, Unknown
  misc_feature (1)..( 11): Matrix.001 file - promoters70/1035083
aatctttggaa

SEQ ID NO: 38638 - DNA, 11 bp, Unknown
  misc_feature (1)..( 11): Matrix.001 file - promoters70/1035083
atttgatgaat

SEQ ID NO: 38639 - DNA, 9 bp, Unknown
  misc_feature (1)..( 9): Matrix.001 file - promoters70/1035083
tataaaaac

SEQ ID NO: 38640 - DNA, 10 bp, Unknown
  misc_feature (1)..( 10): Matrix.001 file - promoters70/1035083
tataaaaaaa

SEQ ID NO: 38641 - DNA, 10 bp, Unknown
  misc_feature (1)..( 10): Matrix.001 file - promoters70/1035083
caatatttta

SEQ ID NO: 38642 - DNA, 8 bp, Unknown
  misc_feature (1)..( 8): Matrix.001 file - promoters70/1035172
tttaaccc

SEQ ID NO: 38643 - DNA, 7 bp, Unknown
  misc_feature (1)..( 7): Matrix.001 file - promoters70/1035172
gttgact

SEQ ID NO: 38644 - DNA, 7 bp, Unknown
  misc_feature (1)..( 7): Matrix.001 file - promoters70/1035172
actattt

SEQ ID NO: 38645 - DNA, 12 bp, Unknown
  misc_feature (1)..( 12): Matrix.001 file - promoters70/1035172
gaaaaagaaaaa

SEQ ID NO: 38646 - DNA, 8 bp, Unknown
  misc_feature (1)..( 8): Matrix.001 file - promoters70/1035172
taaaaaat

SEQ ID NO: 38647 - DNA, 16 bp, Unknown
  misc_feature (1)..( 16): Matrix.001 file - promoters70/1035172
tcttttctctatataa

SEQ ID NO: 38648 - DNA, 8 bp, Unknown
  misc_feature (1)..( 8): Matrix.001 file - promoters70/1035172
taaatatt

SEQ ID NO: 38649 - DNA, 7 bp, Unknown
  misc_feature (1)..( 7): Matrix.001 file - promoters70/1035267
ccacaga

SEQ ID NO: 38650 - DNA, 8 bp, Unknown
  misc_feature (1)..( 8): Matrix.001 file - promoters70/1035312
atcaaaac

SEQ ID NO: 38651 - DNA, 9 bp, Unknown
  misc_feature (1)..( 9): Matrix.001 file - promoters70/1035312
aaaccaaaa

SEQ ID NO: 38652 - DNA, 8 bp, Unknown
  misc_feature (1)..( 8): Matrix.001 file - promoters70/1035312
caatcgaa

SEQ ID NO: 38653 - DNA, 10 bp, Unknown
  misc_feature (1)..( 10): Matrix.001 file - promoters70/1035312
cgatttcaca

SEQ ID NO: 38654 - DNA, 10 bp, Unknown
  misc_feature (1)..( 10): Matrix.001 file - promoters70/1035312
attgggccca

SEQ ID NO: 38655 - DNA, 12 bp, Unknown
  misc_feature (1)..( 12): Matrix.001 file - promoters70/1035632
ttacaaaagtat

SEQ ID NO: 38656 - DNA, 10 bp, Unknown
  misc_feature (1)..( 10): Matrix.001 file - promoters70/1035632
acaaaaaata

SEQ ID NO: 38657 - DNA, 8 bp, Unknown
  misc_feature (1)..( 8): Matrix.001 file - promoters70/1035632
aataaaaa

SEQ ID NO: 38658 - DNA, 10 bp, Unknown
  misc_feature (1)..( 10): Matrix.001 file - promoters70/1375217
ttaaaaaaag

SEQ ID NO: 38659 - DNA, 8 bp, Unknown
  misc_feature (1)..( 8): Matrix.001 file - promoters70/1375217
aagaaaaa

SEQ ID NO: 38660 - DNA, 13 bp, Unknown
  misc_feature (1)..( 13): Matrix.001 file - promoters70/1375217
tgtttgtttcaca

SEQ ID NO: 38661 - DNA, 8 bp, Unknown
  misc_feature (1)..( 8): Matrix.001 file - promoters70/1375217
aatcaaga

SEQ ID NO: 38662 - DNA, 9 bp, Unknown
  misc_feature (1)..( 9): Matrix.001 file - promoters70/1375217
gttccttct

SEQ ID NO: 38663 - DNA, 8 bp, Unknown
  misc_feature (1)..( 8): Matrix.001 file - promoters70/1375471
aaaataat

SEQ ID NO: 38664 - DNA, 8 bp, Unknown
  misc_feature (1)..( 8): Matrix.001 file - promoters70/1375615
atcatatt

SEQ ID NO: 38665 - DNA, 9 bp, Unknown
  misc_feature (1)..( 9): Matrix.001 file - promoters70/1375615
tttgtagtg

SEQ ID NO: 38666 - DNA, 8 bp, Unknown
  misc_feature (1)..( 8): Matrix.001 file - promoters70/1375615
tgatttgt

SEQ ID NO: 38667 - DNA, 7 bp, Unknown
  misc_feature (1)..( 7): Matrix.001 file - promoters70/1375615
gtttgtt

SEQ ID NO: 38668 - DNA, 8 bp, Unknown
  misc_feature (1)..( 8): Matrix.001 file - promoters70/1375615
gatttgtt

SEQ ID NO: 38669 - DNA, 9 bp, Unknown
  misc_feature (1)..( 9): Matrix.001 file - promoters70/1375634
tgtatgcat

SEQ ID NO: 38670 - DNA, 10 bp, Unknown
  misc_feature (1)..( 10): Matrix.001 file - promoters70/1375634
tcaattttat

SEQ ID NO: 38671 - DNA, 10 bp, Unknown
  misc_feature (1)..( 10): Matrix.001 file - promoters70/1375634
tcaattttat

SEQ ID NO: 38672 - DNA, 7 bp, Unknown
  misc_feature (1)..( 7): Matrix.001 file - promoters70/1376361
aatttag

SEQ ID NO: 38673 - DNA, 8 bp, Unknown
  misc_feature (1)..( 8): Matrix.001 file - promoters70/1376650
gaaatcaa

SEQ ID NO: 38674 - DNA, 8 bp, Unknown
  misc_feature (1)..( 8): Matrix.001 file - promoters70/1376650
gaactcag

SEQ ID NO: 38675 - DNA, 9 bp, Unknown
  misc_feature (1)..( 9): Matrix.001 file - promoters70/1376650
aagaaaaaa

SEQ ID NO: 38676 - DNA, 6 bp, Unknown
  misc_feature (1)..( 6): Matrix.001 file - promoters70/1376881
agtaaa

SEQ ID NO: 38677 - DNA, 10 bp, Unknown
  misc_feature (1)..( 10): Matrix.001 file - promoters70/1376881
gaaacaaaaa

SEQ ID NO: 38678 - DNA, 8 bp, Unknown
  misc_feature (1)..( 8): Matrix.001 file - promoters70/1377139
tttgagag

SEQ ID NO: 38679 - DNA, 7 bp, Unknown
  misc_feature (1)..( 7): Matrix.001 file - promoters70/1377412
ttgtgaa

SEQ ID NO: 38680 - DNA, 11 bp, Unknown
  misc_feature (1)..( 11): Matrix.001 file - promoters70/1377412
aaatcaaagat

SEQ ID NO: 38681 - DNA, 8 bp, Unknown
  misc_feature (1)..( 8): Matrix.001 file - promoters70/1377412
ttcttcaa

SEQ ID NO: 38682 - DNA, 7 bp, Unknown
  misc_feature (1)..( 7): Matrix.001 file - promoters70/1377472
aaaacaa

SEQ ID NO: 38683 - DNA, 8 bp, Unknown
  misc_feature (1)..( 8): Matrix.001 file - promoters70/1377472
catcgttt

SEQ ID NO: 38684 - DNA, 8 bp, Unknown
  misc_feature (1)..( 8): Matrix.001 file - promoters70/1377472
gattcttt

SEQ ID NO: 38685 - DNA, 7 bp, Unknown
  misc_feature (1)..( 7): Matrix.001 file - promoters70/1377564
attttac

SEQ ID NO: 38686 - DNA, 7 bp, Unknown
  misc_feature (1)..( 7): Matrix.001 file - promoters70/1377564
caaaatc

SEQ ID NO: 38687 - DNA, 10 bp, Unknown
  misc_feature (1)..( 10): Matrix.001 file - promoters70/1377642
taaaaaggaa

SEQ ID NO: 38688 - DNA, 7 bp, Unknown
  misc_feature (1)..( 7): Matrix.001 file - promoters70/1377642
atataat

SEQ ID NO: 38689 - DNA, 8 bp, Unknown
  misc_feature (1)..( 8): Matrix.001 file - promoters70/1377642
taaatata

SEQ ID NO: 38690 - DNA, 11 bp, Unknown
  misc_feature (1)..( 11): Matrix.001 file - promoters70/1377642
ataaaattaat

SEQ ID NO: 38691 - DNA, 12 bp, Unknown
  misc_feature (1)..( 12): Matrix.001 file - promoters70/1377642
ttttgtaaacaa

SEQ ID NO: 38692 - DNA, 8 bp, Unknown
  misc_feature (1)..( 8): Matrix.001 file - promoters70/1377642
aaatttat

SEQ ID NO: 38693 - DNA, 8 bp, Unknown
  misc_feature (1)..( 8): Matrix.001 file - promoters70/1377642
aatcaaaa

SEQ ID NO: 38694 - DNA, 11 bp, Unknown
  misc_feature (1)..( 11): Matrix.001 file - promoters70/1377642
aaaaacacgaa

SEQ ID NO: 38695 - DNA, 8 bp, Unknown
  misc_feature (1)..( 8): Matrix.001 file - promoters70/1377642
atataata

SEQ ID NO: 38696 - DNA, 11 bp, Unknown
  misc_feature (1)..( 11): Matrix.001 file - promoters70/1377680
tgtttgaacat

SEQ ID NO: 38697 - DNA, 8 bp, Unknown
  misc_feature (1)..( 8): Matrix.001 file - promoters70/1377680
caacgaaa

SEQ ID NO: 38698 - DNA, 10 bp, Unknown
  misc_feature (1)..( 10): Matrix.001 file - promoters70/1377680
aaatcatatt

SEQ ID NO: 38699 - DNA, 9 bp, Unknown
  misc_feature (1)..( 9): Matrix.001 file - promoters70/1377680
ataagaaaa

SEQ ID NO: 38700 - DNA, 9 bp, Unknown
  misc_feature (1)..( 9): Matrix.001 file - promoters70/1377680
tcaatcata

SEQ ID NO: 38701 - DNA, 8 bp, Unknown
  misc_feature (1)..( 8): Matrix.001 file - promoters70/1377680
taatttca

SEQ ID NO: 38702 - DNA, 9 bp, Unknown
  misc_feature (1)..( 9): Matrix.001 file - promoters70/1377680
ataataaaa

SEQ ID NO: 38703 - DNA, 8 bp, Unknown
  misc_feature (1)..( 8): Matrix.001 file - promoters70/1377680
aaatatct

SEQ ID NO: 38704 - DNA, 7 bp, Unknown
  misc_feature (1)..( 7): Matrix.001 file - promoters70/1377680
tatcata

SEQ ID NO: 38705 - DNA, 8 bp, Unknown
  misc_feature (1)..( 8): Matrix.001 file - promoters70/1377680
taataaag

SEQ ID NO: 38706 - DNA, 12 bp, Unknown
  misc_feature (1)..( 12): Matrix.001 file - promoters70/1377680
ataaattaatgt

SEQ ID NO: 38707 - DNA, 10 bp, Unknown
  misc_feature (1)..( 10): Matrix.001 file - promoters70/1377718
taaatttgct

SEQ ID NO: 38708 - DNA, 6 bp, Unknown
  misc_feature (1)..( 6): Matrix.001 file - promoters70/1377847
accaaa

SEQ ID NO: 38709 - DNA, 9 bp, Unknown
  misc_feature (1)..( 9): Matrix.001 file - promoters70/1377847
tgtttcttt

SEQ ID NO: 38710 - DNA, 8 bp, Unknown
  misc_feature (1)..( 8): Matrix.001 file - promoters70/1377847
aatcaaga

SEQ ID NO: 38711 - DNA, 9 bp, Unknown
  misc_feature (1)..( 9): Matrix.001 file - promoters70/1377847
gttccttct

SEQ ID NO: 38712 - DNA, 13 bp, Unknown
  misc_feature (1)..( 13): Matrix.001 file - promoters70/1377847
ctatttttctctt

SEQ ID NO: 38713 - DNA, 14 bp, Unknown
  misc_feature (1)..( 14): Matrix.001 file - promoters70/1378049
aaaaattaaccacg

SEQ ID NO: 38714 - DNA, 7 bp, Unknown
  misc_feature (1)..( 7): Matrix.001 file - promoters70/1378049
aaacaaa

SEQ ID NO: 38715 - DNA, 11 bp, Unknown
  misc_feature (1)..( 11): Matrix.001 file - promoters70/1378049
tttatttcaca

SEQ ID NO: 38716 - DNA, 8 bp, Unknown
  misc_feature (1)..( 8): Matrix.001 file - promoters70/1378049
caataaaa

SEQ ID NO: 38717 - DNA, 11 bp, Unknown
  misc_feature (1)..( 11): Matrix.001 file - promoters70/1378088
aattattttat

SEQ ID NO: 38718 - DNA, 7 bp, Unknown
  misc_feature (1)..( 7): Matrix.001 file - promoters70/1378088
tagattt

SEQ ID NO: 38719 - DNA, 8 bp, Unknown
  misc_feature (1)..( 8): Matrix.001 file - promoters70/1378088
aaattatt

SEQ ID NO: 38720 - DNA, 12 bp, Unknown
  misc_feature (1)..( 12): Matrix.001 file - promoters70/1378088
aattagattcga

SEQ ID NO: 38721 - DNA, 9 bp, Unknown
  misc_feature (1)..( 9): Matrix.001 file - promoters70/1378088
aaaaacatt

SEQ ID NO: 38722 - DNA, 9 bp, Unknown
  misc_feature (1)..( 9): Matrix.001 file - promoters70/1378088
aaaaaatta

SEQ ID NO: 38723 - DNA, 11 bp, Unknown
  misc_feature (1)..( 11): Matrix.001 file - promoters70/1378088
ttaatttttta

SEQ ID NO: 38724 - DNA, 10 bp, Unknown
  misc_feature (1)..( 10): Matrix.001 file - promoters70/1378088
attttaaaat

SEQ ID NO: 38725 - DNA, 13 bp, Unknown
  misc_feature (1)..( 13): Matrix.001 file - promoters70/1378088
ttataaaaagata

SEQ ID NO: 38726 - DNA, 8 bp, Unknown
  misc_feature (1)..( 8): Matrix.001 file - promoters70/1378088
gttataaa

SEQ ID NO: 38727 - DNA, 13 bp, Unknown
  misc_feature (1)..( 13): Matrix.001 file - promoters70/1378088
taaaaagagaaaa

SEQ ID NO: 38728 - DNA, 7 bp, Unknown
  misc_feature (1)..( 7): Matrix.001 file - promoters70/1378333
gctgaaa

SEQ ID NO: 38729 - DNA, 13 bp, Unknown
  misc_feature (1)..( 13): Matrix.001 file - promoters70/1378393
ggtttgtttaact

SEQ ID NO: 38730 - DNA, 7 bp, Unknown
  misc_feature (1)..( 7): Matrix.001 file - promoters70/1380389
tttggtt

SEQ ID NO: 38731 - DNA, 8 bp, Unknown
  misc_feature (1)..( 8): Matrix.001 file - promoters70/1380519
gagcaaaa

SEQ ID NO: 38732 - DNA, 11 bp, Unknown
  misc_feature (1)..( 11): Matrix.001 file - promoters70/1380708
taaaatttttt

SEQ ID NO: 38733 - DNA, 9 bp, Unknown
  misc_feature (1)..( 9): Matrix.001 file - promoters70/1380708
tttattcag

SEQ ID NO: 38734 - DNA, 16 bp, Unknown
  misc_feature (1)..( 16): Matrix.001 file - promoters70/1381002
tataaaactttcataa

SEQ ID NO: 38735 - DNA, 7 bp, Unknown
  misc_feature (1)..( 7): Matrix.001 file - promoters70/1381002
ttaaaat

SEQ ID NO: 38736 - DNA, 7 bp, Unknown
  misc_feature (1)..( 7): Matrix.001 file - promoters70/1381002
tcaccta

SEQ ID NO: 38737 - DNA, 8 bp, Unknown
  misc_feature (1)..( 8): Matrix.001 file - promoters70/1381002
tataattt

SEQ ID NO: 38738 - DNA, 9 bp, Unknown
  misc_feature (1)..( 9): Matrix.001 file - promoters70/1381002
tatcaaatt

SEQ ID NO: 38739 - DNA, 8 bp, Unknown
  misc_feature (1)..( 8): Matrix.001 file - promoters70/1381002
caaacact

SEQ ID NO: 38740 - DNA, 8 bp, Unknown
  misc_feature (1)..( 8): Matrix.001 file - promoters70/1381457
ttttgatt

SEQ ID NO: 38741 - DNA, 10 bp, Unknown
  misc_feature (1)..( 10): Matrix.001 file - promoters70/1381563
ggtacacgtg

SEQ ID NO: 38742 - DNA, 9 bp, Unknown
  misc_feature (1)..( 9): Matrix.001 file - promoters70/1381704
gtttccttt

SEQ ID NO: 38743 - DNA, 8 bp, Unknown
  misc_feature (1)..( 8): Matrix.001 file - promoters70/1381818
aaataaaa

SEQ ID NO: 38744 - DNA, 9 bp, Unknown
  misc_feature (1)..( 9): Matrix.001 file - promoters70/1381818
aatgaaaaa

SEQ ID NO: 38745 - DNA, 7 bp, Unknown
  misc_feature (1)..( 7): Matrix.001 file - promoters70/1381818
aaaaaca

SEQ ID NO: 38746 - DNA, 11 bp, Unknown
  misc_feature (1)..( 11): Matrix.001 file - promoters70/1381818
aagaaaaaata

SEQ ID NO: 38747 - DNA, 8 bp, Unknown
  misc_feature (1)..( 8): Matrix.001 file - promoters70/1381818
atataatt

SEQ ID NO: 38748 - DNA, 11 bp, Unknown
  misc_feature (1)..( 11): Matrix.001 file - promoters70/1381818
agttaaattta

SEQ ID NO: 38749 - DNA, 11 bp, Unknown
  misc_feature (1)..( 11): Matrix.001 file - promoters70/1381818
aattaactttg

SEQ ID NO: 38750 - DNA, 10 bp, Unknown
  misc_feature (1)..( 10): Matrix.001 file - promoters70/1381926
gaaatagatt

SEQ ID NO: 38751 - DNA, 7 bp, Unknown
  misc_feature (1)..( 7): Matrix.001 file - promoters70/1382713
attgtgt

SEQ ID NO: 38752 - DNA, 8 bp, Unknown
  misc_feature (1)..( 8): Matrix.001 file - promoters70/1382713
attattct

SEQ ID NO: 38753 - DNA, 13 bp, Unknown
  misc_feature (1)..( 13): Matrix.001 file - promoters70/1383341
cttcctatatagt

SEQ ID NO: 38754 - DNA, 11 bp, Unknown
  misc_feature (1)..( 11): Matrix.001 file - promoters70/1383341
aaagaaataaa

SEQ ID NO: 38755 - DNA, 11 bp, Unknown
  misc_feature (1)..( 11): Matrix.001 file - promoters70/1383485
ccataattaag

SEQ ID NO: 38756 - DNA, 9 bp, Unknown
  misc_feature (1)..( 9): Matrix.001 file - promoters70/1383552
ttaaaaatt

SEQ ID NO: 38757 - DNA, 9 bp, Unknown
  misc_feature (1)..( 9): Matrix.001 file - promoters70/1383552
aaatgtctt

SEQ ID NO: 38758 - DNA, 14 bp, Unknown
  misc_feature (1)..( 14): Matrix.001 file - promoters70/1383552
aaaaatttataatc

SEQ ID NO: 38759 - DNA, 15 bp, Unknown
  misc_feature (1)..( 15): Matrix.001 file - promoters70/1384016
aaaaaatatttttga

SEQ ID NO: 38760 - DNA, 9 bp, Unknown
  misc_feature (1)..( 9): Matrix.001 file - promoters70/1384016
ttacaaaaa

SEQ ID NO: 38761 - DNA, 9 bp, Unknown
  misc_feature (1)..( 9): Matrix.001 file - promoters70/1385376
taaaagatt

SEQ ID NO: 38762 - DNA, 7 bp, Unknown
  misc_feature (1)..( 7): Matrix.001 file - promoters70/1385376
ttggttt

SEQ ID NO: 38763 - DNA, 9 bp, Unknown
  misc_feature (1)..( 9): Matrix.001 file - promoters70/1385376
tttggtttt

SEQ ID NO: 38764 - DNA, 9 bp, Unknown
  misc_feature (1)..( 9): Matrix.001 file - promoters70/1387072
aaagaaaaa

SEQ ID NO: 38765 - DNA, 11 bp, Unknown
  misc_feature (1)..( 11): Matrix.001 file - promoters70/1387123
tgtttgaacat

SEQ ID NO: 38766 - DNA, 8 bp, Unknown
  misc_feature (1)..( 8): Matrix.001 file - promoters70/1387123
caacgaaa

SEQ ID NO: 38767 - DNA, 13 bp, Unknown
  misc_feature (1)..( 13): Matrix.001 file - promoters70/1387349
aaacaaaccaaat

SEQ ID NO: 38768 - DNA, 10 bp, Unknown
  misc_feature (1)..( 10): Matrix.001 file - promoters70/1387349
acacaaaaac

SEQ ID NO: 38769 - DNA, 9 bp, Unknown
  misc_feature (1)..( 9): Matrix.001 file - promoters70/1387349
tcaaagatt

SEQ ID NO: 38770 - DNA, 12 bp, Unknown
  misc_feature (1)..( 12): Matrix.001 file - promoters70/1387349
aagaaaatgaac

SEQ ID NO: 38771 - DNA, 6 bp, Unknown
  misc_feature (1)..( 6): Matrix.001 file - promoters70/1387356
ttaaaa

SEQ ID NO: 38772 - DNA, 11 bp, Unknown
  misc_feature (1)..( 11): Matrix.001 file - promoters70/1387356
aaagtaaaaat

SEQ ID NO: 38773 - DNA, 8 bp, Unknown
  misc_feature (1)..( 8): Matrix.001 file - promoters70/1387417
attttctg

SEQ ID NO: 38774 - DNA, 9 bp, Unknown
  misc_feature (1)..( 9): Matrix.001 file - promoters70/1387417
aatgatttc

SEQ ID NO: 38775 - DNA, 11 bp, Unknown
  misc_feature (1)..( 11): Matrix.001 file - promoters70/1387449
caaattttcac

SEQ ID NO: 38776 - DNA, 8 bp, Unknown
  misc_feature (1)..( 8): Matrix.001 file - promoters70/1387449
aattatat

SEQ ID NO: 38777 - DNA, 7 bp, Unknown
  misc_feature (1)..( 7): Matrix.001 file - promoters70/1387449
tggtttt

SEQ ID NO: 38778 - DNA, 9 bp, Unknown
  misc_feature (1)..( 9): Matrix.001 file - promoters70/1387616
aataaaatt

SEQ ID NO: 38779 - DNA, 10 bp, Unknown
  misc_feature (1)..( 10): Matrix.001 file - promoters70/1387616
taaataaata

SEQ ID NO: 38780 - DNA, 8 bp, Unknown
  misc_feature (1)..( 8): Matrix.001 file - promoters70/1387616
tttcttta

SEQ ID NO: 38781 - DNA, 9 bp, Unknown
  misc_feature (1)..( 9): Matrix.001 file - promoters70/1387671
ttctgtttg

SEQ ID NO: 38782 - DNA, 11 bp, Unknown
  misc_feature (1)..( 11): Matrix.001 file - promoters70/1387671
atcaatactta

SEQ ID NO: 38783 - DNA, 8 bp, Unknown
  misc_feature (1)..( 8): Matrix.001 file - promoters70/1387671
actcttat

SEQ ID NO: 38784 - DNA, 11 bp, Unknown
  misc_feature (1)..( 11): Matrix.001 file - promoters70/1387671
ataaaaaaata

SEQ ID NO: 38785 - DNA, 13 bp, Unknown
  misc_feature (1)..( 13): Matrix.001 file - promoters70/1387671
ccaataaaaaata

SEQ ID NO: 38786 - DNA, 10 bp, Unknown
  misc_feature (1)..( 10): Matrix.001 file - promoters70/1387906
tttgaaggtt

SEQ ID NO: 38787 - DNA, 7 bp, Unknown
  misc_feature (1)..( 7): Matrix.001 file - promoters70/1387906
gaaaata

SEQ ID NO: 38788 - DNA, 11 bp, Unknown
  misc_feature (1)..( 11): Matrix.001 file - promoters70/1387906
ttttaataaca

SEQ ID NO: 38789 - DNA, 10 bp, Unknown
  misc_feature (1)..( 10): Matrix.001 file - promoters70/1387906
aaaatctgtt

SEQ ID NO: 38790 - DNA, 10 bp, Unknown
  misc_feature (1)..( 10): Matrix.001 file - promoters70/1387906
actttataat

SEQ ID NO: 38791 - DNA, 11 bp, Unknown
  misc_feature (1)..( 11): Matrix.001 file - promoters70/1388009
tattaaaatat

SEQ ID NO: 38792 - DNA, 7 bp, Unknown
  misc_feature (1)..( 7): Matrix.001 file - promoters70/1388009
atatttt

SEQ ID NO: 38793 - DNA, 7 bp, Unknown
  misc_feature (1)..( 7): Matrix.001 file - promoters70/1388009
attttac

SEQ ID NO: 38794 - DNA, 10 bp, Unknown
  misc_feature (1)..( 10): Matrix.001 file - promoters70/1388009
cgaaatcata

SEQ ID NO: 38795 - DNA, 7 bp, Unknown
  misc_feature (1)..( 7): Matrix.001 file - promoters70/1388009
ctatatg

SEQ ID NO: 38796 - DNA, 9 bp, Unknown
  misc_feature (1)..( 9): Matrix.001 file - promoters70/1388009
aaattataa

SEQ ID NO: 38797 - DNA, 7 bp, Unknown
  misc_feature (1)..( 7): Matrix.001 file - promoters70/1389279
caatgtt

SEQ ID NO: 38798 - DNA, 8 bp, Unknown
  misc_feature (1)..( 8): Matrix.001 file - promoters70/1389279
agaaaaaa

SEQ ID NO: 38799 - DNA, 7 bp, Unknown
  misc_feature (1)..( 7): Matrix.001 file - promoters70/1389279
acaaaaa

SEQ ID NO: 38800 - DNA, 8 bp, Unknown
  misc_feature (1)..( 8): Matrix.001 file - promoters70/1389279
tatatata

SEQ ID NO: 38801 - DNA, 9 bp, Unknown
  misc_feature (1)..( 9): Matrix.001 file - promoters70/1389279
aaaacaagt

SEQ ID NO: 38802 - DNA, 9 bp, Unknown
  misc_feature (1)..( 9): Matrix.001 file - promoters70/1390146
aatttgaac

SEQ ID NO: 38803 - DNA, 10 bp, Unknown
  misc_feature (1)..( 10): Matrix.001 file - promoters70/1390240
aaatcatttt

SEQ ID NO: 38804 - DNA, 7 bp, Unknown
  misc_feature (1)..( 7): Matrix.001 file - promoters70/1391420
agatttt

SEQ ID NO: 38805 - DNA, 7 bp, Unknown
  misc_feature (1)..( 7): Matrix.001 file - promoters70/1393104
atgtgga

SEQ ID NO: 38806 - DNA, 8 bp, Unknown
  misc_feature (1)..( 8): Matrix.001 file - promoters70/1393139
tagatttg

SEQ ID NO: 38807 - DNA, 7 bp, Unknown
  misc_feature (1)..( 7): Matrix.001 file - promoters70/1393139
cttcatt

SEQ ID NO: 38808 - DNA, 13 bp, Unknown
  misc_feature (1)..( 13): Matrix.001 file - promoters70/1393139
tcaacttttgaga

SEQ ID NO: 38809 - DNA, 10 bp, Unknown
  misc_feature (1)..( 10): Matrix.001 file - promoters70/1393139
aataaaagac

SEQ ID NO: 38810 - DNA, 11 bp, Unknown
  misc_feature (1)..( 11): Matrix.001 file - promoters70/1393139
taccaaaagta

SEQ ID NO: 38811 - DNA, 11 bp, Unknown
  misc_feature (1)..( 11): Matrix.001 file - promoters70/1393139
acgagtctaga

SEQ ID NO: 38812 - DNA, 7 bp, Unknown
  misc_feature (1)..( 7): Matrix.001 file - promoters70/1393139
acgaaaa

SEQ ID NO: 38813 - DNA, 9 bp, Unknown
  misc_feature (1)..( 9): Matrix.001 file - promoters70/1393326
atttgtttg

SEQ ID NO: 38814 - DNA, 10 bp, Unknown
  misc_feature (1)..( 10): Matrix.001 file - promoters70/1393326
aaataaagtt

SEQ ID NO: 38815 - DNA, 7 bp, Unknown
  misc_feature (1)..( 7): Matrix.001 file - promoters70/1393326
aagaaaa

SEQ ID NO: 38816 - DNA, 11 bp, Unknown
  misc_feature (1)..( 11): Matrix.001 file - promoters70/1393492
tttaataacct

SEQ ID NO: 38817 - DNA, 13 bp, Unknown
  misc_feature (1)..( 13): Matrix.001 file - promoters70/1393787
gattaaggtctct

SEQ ID NO: 38818 - DNA, 9 bp, Unknown
  misc_feature (1)..( 9): Matrix.001 file - promoters70/1393787
ataaaaaat

SEQ ID NO: 38819 - DNA, 13 bp, Unknown
  misc_feature (1)..( 13): Matrix.001 file - promoters70/1393787
aaagaaattcgtt

SEQ ID NO: 38820 - DNA, 10 bp, Unknown
  misc_feature (1)..( 10): Matrix.001 file - promoters70/1393787
ctatgttttg

SEQ ID NO: 38821 - DNA, 9 bp, Unknown
  misc_feature (1)..( 9): Matrix.001 file - promoters70/1393787
cattttcaa

SEQ ID NO: 38822 - DNA, 11 bp, Unknown
  misc_feature (1)..( 11): Matrix.001 file - promoters70/1393787
taaccattttc

SEQ ID NO: 38823 - DNA, 14 bp, Unknown
  misc_feature (1)..( 14): Matrix.001 file - promoters70/1393805
ataattaaagtcta

SEQ ID NO: 38824 - DNA, 9 bp, Unknown
  misc_feature (1)..( 9): Matrix.001 file - promoters70/1393805
ttacttcac

SEQ ID NO: 38825 - DNA, 9 bp, Unknown
  misc_feature (1)..( 9): Matrix.001 file - promoters70/1394480
aaaatttct

SEQ ID NO: 38826 - DNA, 8 bp, Unknown
  misc_feature (1)..( 8): Matrix.001 file - promoters70/1394480
tgtgaaac

SEQ ID NO: 38827 - DNA, 9 bp, Unknown
  misc_feature (1)..( 9): Matrix.001 file - promoters70/1394480
aaaatttct

SEQ ID NO: 38828 - DNA, 9 bp, Unknown
  misc_feature (1)..( 9): Matrix.001 file - promoters70/1394480
tttcaaaat

SEQ ID NO: 38829 - DNA, 11 bp, Unknown
  misc_feature (1)..( 11): Matrix.001 file - promoters70/1394510
taaaatttttt

SEQ ID NO: 38830 - DNA, 9 bp, Unknown
  misc_feature (1)..( 9): Matrix.001 file - promoters70/1394510
tttattcag

SEQ ID NO: 38831 - DNA, 9 bp, Unknown
  misc_feature (1)..( 9): Matrix.001 file - promoters70/1394592
ataattata

SEQ ID NO: 38832 - DNA, 9 bp, Unknown
  misc_feature (1)..( 9): Matrix.001 file - promoters70/1395095
aaaataatc

SEQ ID NO: 38833 - DNA, 7 bp, Unknown
  misc_feature (1)..( 7): Matrix.001 file - promoters70/1395095
aatagat

SEQ ID NO: 38834 - DNA, 8 bp, Unknown
  misc_feature (1)..( 8): Matrix.001 file - promoters70/1395095
tttatttc

SEQ ID NO: 38835 - DNA, 7 bp, Unknown
  misc_feature (1)..( 7): Matrix.001 file - promoters70/1395095
aaaaaaa

SEQ ID NO: 38836 - DNA, 11 bp, Unknown
  misc_feature (1)..( 11): Matrix.001 file - promoters70/1395095
caaattttttt

SEQ ID NO: 38837 - DNA, 8 bp, Unknown
  misc_feature (1)..( 8): Matrix.001 file - promoters70/1395095
aaagtctt

SEQ ID NO: 38838 - DNA, 8 bp, Unknown
  misc_feature (1)..( 8): Matrix.001 file - promoters70/1395095
catttttt

SEQ ID NO: 38839 - DNA, 8 bp, Unknown
  misc_feature (1)..( 8): Matrix.001 file - promoters70/1395095
aaaattct

SEQ ID NO: 38840 - DNA, 8 bp, Unknown
  misc_feature (1)..( 8): Matrix.001 file - promoters70/1395095
tataaaaa

SEQ ID NO: 38841 - DNA, 7 bp, Unknown
  misc_feature (1)..( 7): Matrix.001 file - promoters70/1395636
caatatt

SEQ ID NO: 38842 - DNA, 7 bp, Unknown
  misc_feature (1)..( 7): Matrix.001 file - promoters70/1395636
tttttac

SEQ ID NO: 38843 - DNA, 12 bp, Unknown
  misc_feature (1)..( 12): Matrix.001 file - promoters70/1395636
aaaggaaaaaat

SEQ ID NO: 38844 - DNA, 9 bp, Unknown
  misc_feature (1)..( 9): Matrix.001 file - promoters70/1395636
tataaattg

SEQ ID NO: 38845 - DNA, 7 bp, Unknown
  misc_feature (1)..( 7): Matrix.001 file - promoters70/1395636
tttgttt

SEQ ID NO: 38846 - DNA, 10 bp, Unknown
  misc_feature (1)..( 10): Matrix.001 file - promoters70/1395824
ttcaaatata

SEQ ID NO: 38847 - DNA, 10 bp, Unknown
  misc_feature (1)..( 10): Matrix.001 file - promoters70/1396085
tttttattct

SEQ ID NO: 38848 - DNA, 8 bp, Unknown
  misc_feature (1)..( 8): Matrix.001 file - promoters70/1396085
ataaaatt

SEQ ID NO: 38849 - DNA, 8 bp, Unknown
  misc_feature (1)..( 8): Matrix.001 file - promoters70/1396085
aaaataaa

SEQ ID NO: 38850 - DNA, 9 bp, Unknown
  misc_feature (1)..( 9): Matrix.001 file - promoters70/1396182
aagaataag

SEQ ID NO: 38851 - DNA, 7 bp, Unknown
  misc_feature (1)..( 7): Matrix.001 file - promoters70/1396182
aaaacaa

SEQ ID NO: 38852 - DNA, 11 bp, Unknown
  misc_feature (1)..( 11): Matrix.001 file - promoters70/1396182
ggaaatgaaat

SEQ ID NO: 38853 - DNA, 7 bp, Unknown
  misc_feature (1)..( 7): Matrix.001 file - promoters70/1396182
gtatata

SEQ ID NO: 38854 - DNA, 7 bp, Unknown
  misc_feature (1)..( 7): Matrix.001 file - promoters70/1396238
taaaggg

SEQ ID NO: 38855 - DNA, 10 bp, Unknown
  misc_feature (1)..( 10): Matrix.001 file - promoters70/1396308
taaaaaggaa

SEQ ID NO: 38856 - DNA, 7 bp, Unknown
  misc_feature (1)..( 7): Matrix.001 file - promoters70/1396308
atataat

SEQ ID NO: 38857 - DNA, 8 bp, Unknown
  misc_feature (1)..( 8): Matrix.001 file - promoters70/1396308
taaatata

SEQ ID NO: 38858 - DNA, 11 bp, Unknown
  misc_feature (1)..( 11): Matrix.001 file - promoters70/1396308
ataaaattaat

SEQ ID NO: 38859 - DNA, 12 bp, Unknown
  misc_feature (1)..( 12): Matrix.001 file - promoters70/1396308
ttttgtaaacaa

SEQ ID NO: 38860 - DNA, 8 bp, Unknown
  misc_feature (1)..( 8): Matrix.001 file - promoters70/1396308
aaatttat

SEQ ID NO: 38861 - DNA, 8 bp, Unknown
  misc_feature (1)..( 8): Matrix.001 file - promoters70/1396308
aatcaaaa

SEQ ID NO: 38862 - DNA, 11 bp, Unknown
  misc_feature (1)..( 11): Matrix.001 file - promoters70/1396308
aaaaacacgaa

SEQ ID NO: 38863 - DNA, 8 bp, Unknown
  misc_feature (1)..( 8): Matrix.001 file - promoters70/1396308
atataata

SEQ ID NO: 38864 - DNA, 6 bp, Unknown
  misc_feature (1)..( 6): Matrix.001 file - promoters70/1396354
tacatt

SEQ ID NO: 38865 - DNA, 7 bp, Unknown
  misc_feature (1)..( 7): Matrix.001 file - promoters70/1396354
tttgatt

SEQ ID NO: 38866 - DNA, 9 bp, Unknown
  misc_feature (1)..( 9): Matrix.001 file - promoters70/1396469
cattcttat

SEQ ID NO: 38867 - DNA, 9 bp, Unknown
  misc_feature (1)..( 9): Matrix.001 file - promoters70/1396469
acttacaaa

SEQ ID NO: 38868 - DNA, 9 bp, Unknown
  misc_feature (1)..( 9): Matrix.001 file - promoters70/1396469
atataaaca

SEQ ID NO: 38869 - DNA, 6 bp, Unknown
  misc_feature (1)..( 6): Matrix.001 file - promoters70/1396469
aagaaa

SEQ ID NO: 38870 - DNA, 14 bp, Unknown
  misc_feature (1)..( 14): Matrix.001 file - promoters70/1396469
ttagctataaatta

SEQ ID NO: 38871 - DNA, 7 bp, Unknown
  misc_feature (1)..( 7): Matrix.001 file - promoters70/1396469
caacaaa

SEQ ID NO: 38872 - DNA, 9 bp, Unknown
  misc_feature (1)..( 9): Matrix.001 file - promoters70/1396482
aaaaaaagt

SEQ ID NO: 38873 - DNA, 9 bp, Unknown
  misc_feature (1)..( 9): Matrix.001 file - promoters70/1397080
aaatcaaat

SEQ ID NO: 38874 - DNA, 10 bp, Unknown
  misc_feature (1)..( 10): Matrix.001 file - promoters70/1397080
ctaaacaaaa

SEQ ID NO: 38875 - DNA, 8 bp, Unknown
  misc_feature (1)..( 8): Matrix.001 file - promoters70/1397125
tcccaaaa

SEQ ID NO: 38876 - DNA, 8 bp, Unknown
  misc_feature (1)..( 8): Matrix.001 file - promoters70/1397125
taaaattt

SEQ ID NO: 38877 - DNA, 8 bp, Unknown
  misc_feature (1)..( 8): Matrix.001 file - promoters70/1397203
ttattcta

SEQ ID NO: 38878 - DNA, 9 bp, Unknown
  misc_feature (1)..( 9): Matrix.001 file - promoters70/1397203
aaaaaacaa

SEQ ID NO: 38879 - DNA, 10 bp, Unknown
  misc_feature (1)..( 10): Matrix.001 file - promoters70/1397203
aaattataaa

SEQ ID NO: 38880 - DNA, 8 bp, Unknown
  misc_feature (1)..( 8): Matrix.001 file - promoters70/1397231
tatgttaa

SEQ ID NO: 38881 - DNA, 12 bp, Unknown
  misc_feature (1)..( 12): Matrix.001 file - promoters70/1397231
attattttccta

SEQ ID NO: 38882 - DNA, 6 bp, Unknown
  misc_feature (1)..( 6): Matrix.001 file - promoters70/1397231
attatt

SEQ ID NO: 38883 - DNA, 16 bp, Unknown
  misc_feature (1)..( 16): Matrix.001 file - promoters70/1397231
agataagtattaaaaa

SEQ ID NO: 38884 - DNA, 8 bp, Unknown
  misc_feature (1)..( 8): Matrix.001 file - promoters70/1397231
ataaaaaa

SEQ ID NO: 38885 - DNA, 10 bp, Unknown
  misc_feature (1)..( 10): Matrix.001 file - promoters70/1397231
ttatatatat

SEQ ID NO: 38886 - DNA, 10 bp, Unknown
  misc_feature (1)..( 10): Matrix.001 file - promoters70/1397263
atatatcaaa

SEQ ID NO: 38887 - DNA, 9 bp, Unknown
  misc_feature (1)..( 9): Matrix.001 file - promoters70/1397263
ataaaaata

SEQ ID NO: 38888 - DNA, 17 bp, Unknown
  misc_feature (1)..( 17): Matrix.001 file - promoters70/1397263
ggaatttattttaaaac

SEQ ID NO: 38889 - DNA, 10 bp, Unknown
  misc_feature (1)..( 10): Matrix.001 file - promoters70/1397263
ttaaaaaaat

SEQ ID NO: 38890 - DNA, 10 bp, Unknown
  misc_feature (1)..( 10): Matrix.001 file - promoters70/1397263
ggcccaataa

SEQ ID NO: 38891 - DNA, 12 bp, Unknown
  misc_feature (1)..( 12): Matrix.001 file - promoters70/1397263
ggcaaactaaaa

SEQ ID NO: 38892 - DNA, 13 bp, Unknown
  misc_feature (1)..( 13): Matrix.001 file - promoters70/1397350
gtctcatggattc

SEQ ID NO: 38893 - DNA, 11 bp, Unknown
  misc_feature (1)..( 11): Matrix.001 file - promoters70/1397461
aatacaaaatg

SEQ ID NO: 38894 - DNA, 7 bp, Unknown
  misc_feature (1)..( 7): Matrix.001 file - promoters70/1397461
ctttttg

SEQ ID NO: 38895 - DNA, 9 bp, Unknown
  misc_feature (1)..( 9): Matrix.001 file - promoters70/1397461
tcaaaaaat

SEQ ID NO: 38896 - DNA, 8 bp, Unknown
  misc_feature (1)..( 8): Matrix.001 file - promoters70/1397500
aatcatat

SEQ ID NO: 38897 - DNA, 8 bp, Unknown
  misc_feature (1)..( 8): Matrix.001 file - promoters70/1397500
aaatggag

SEQ ID NO: 38898 - DNA, 10 bp, Unknown
  misc_feature (1)..( 10): Matrix.001 file - promoters70/1397500
aaattgaatc

SEQ ID NO: 38899 - DNA, 9 bp, Unknown
  misc_feature (1)..( 9): Matrix.001 file - promoters70/1397500
ttataataa

SEQ ID NO: 38900 - DNA, 9 bp, Unknown
  misc_feature (1)..( 9): Matrix.001 file - promoters70/1397500
agtgccaat

SEQ ID NO: 38901 - DNA, 10 bp, Unknown
  misc_feature (1)..( 10): Matrix.001 file - promoters70/1397500
tcattattat

SEQ ID NO: 38902 - DNA, 9 bp, Unknown
  misc_feature (1)..( 9): Matrix.001 file - promoters70/1397500
ataattatt

SEQ ID NO: 38903 - DNA, 10 bp, Unknown
  misc_feature (1)..( 10): Matrix.001 file - promoters70/1397500
taaatcataa

SEQ ID NO: 38904 - DNA, 7 bp, Unknown
  misc_feature (1)..( 7): Matrix.001 file - promoters70/1397500
atttttt

SEQ ID NO: 38905 - DNA, 9 bp, Unknown
  misc_feature (1)..( 9): Matrix.001 file - promoters70/1397500
ttcaacaat

SEQ ID NO: 38906 - DNA, 8 bp, Unknown
  misc_feature (1)..( 8): Matrix.001 file - promoters70/1397500
caaccaaa

SEQ ID NO: 38907 - DNA, 8 bp, Unknown
  misc_feature (1)..( 8): Matrix.001 file - promoters70/1397500
aaacaatt

SEQ ID NO: 38908 - DNA, 10 bp, Unknown
  misc_feature (1)..( 10): Matrix.001 file - promoters70/1397500
tttttgtgac

SEQ ID NO: 38909 - DNA, 9 bp, Unknown
  misc_feature (1)..( 9): Matrix.001 file - promoters70/1397500
acatattaa

SEQ ID NO: 38910 - DNA, 7 bp, Unknown
  misc_feature (1)..( 7): Matrix.001 file - promoters70/1397700
gtgtttg

SEQ ID NO: 38911 - DNA, 8 bp, Unknown
  misc_feature (1)..( 8): Matrix.001 file - promoters70/1397700
atttcaaa

SEQ ID NO: 38912 - DNA, 11 bp, Unknown
  misc_feature (1)..( 11): Matrix.001 file - promoters70/1397700
taaagtcaaaa

SEQ ID NO: 38913 - DNA, 10 bp, Unknown
  misc_feature (1)..( 10): Matrix.001 file - promoters70/1397700
aaagtcaaaa

SEQ ID NO: 38914 - DNA, 12 bp, Unknown
  misc_feature (1)..( 12): Matrix.001 file - promoters70/1397753
ttctaaaataat

SEQ ID NO: 38915 - DNA, 10 bp, Unknown
  misc_feature (1)..( 10): Matrix.001 file - promoters70/1397821
gaattgatta

SEQ ID NO: 38916 - DNA, 10 bp, Unknown
  misc_feature (1)..( 10): Matrix.001 file - promoters70/1397821
gtcttttcaa

SEQ ID NO: 38917 - DNA, 7 bp, Unknown
  misc_feature (1)..( 7): Matrix.001 file - promoters70/1398124
aatattg

SEQ ID NO: 38918 - DNA, 8 bp, Unknown
  misc_feature (1)..( 8): Matrix.001 file - promoters70/1398124
ttaagtag

SEQ ID NO: 38919 - DNA, 11 bp, Unknown
  misc_feature (1)..( 11): Matrix.001 file - promoters70/1398337
gaaacaaaaac

SEQ ID NO: 38920 - DNA, 10 bp, Unknown
  misc_feature (1)..( 10): Matrix.001 file - promoters70/1398545
tataataaaa

SEQ ID NO: 38921 - DNA, 13 bp, Unknown
  misc_feature (1)..( 13): Matrix.001 file - promoters70/1398545
aactctttttaaa

SEQ ID NO: 38922 - DNA, 9 bp, Unknown
  misc_feature (1)..( 9): Matrix.001 file - promoters70/1398545
ttcaaaaaa

SEQ ID NO: 38923 - DNA, 12 bp, Unknown
  misc_feature (1)..( 12): Matrix.001 file - promoters70/1398545
aaggcccaataa

SEQ ID NO: 38924 - DNA, 11 bp, Unknown
  misc_feature (1)..( 11): Matrix.001 file - promoters70/1398545
acacacaacta

SEQ ID NO: 38925 - DNA, 9 bp, Unknown
  misc_feature (1)..( 9): Matrix.001 file - promoters70/1398573
atttagaaa

SEQ ID NO: 38926 - DNA, 8 bp, Unknown
  misc_feature (1)..( 8): Matrix.001 file - promoters70/1398573
aacaacat

SEQ ID NO: 38927 - DNA, 11 bp, Unknown
  misc_feature (1)..( 11): Matrix.001 file - promoters70/1399325
aaagtaattta

SEQ ID NO: 38928 - DNA, 10 bp, Unknown
  misc_feature (1)..( 10): Matrix.001 file - promoters70/1399325
taaatatgat

SEQ ID NO: 38929 - DNA, 11 bp, Unknown
  misc_feature (1)..( 11): Matrix.001 file - promoters70/1399325
ataattaaatc

SEQ ID NO: 38930 - DNA, 12 bp, Unknown
  misc_feature (1)..( 12): Matrix.001 file - promoters70/1399345
aataaagttttt

SEQ ID NO: 38931 - DNA, 11 bp, Unknown
  misc_feature (1)..( 11): Matrix.001 file - promoters70/1399726
ccaattaattt

SEQ ID NO: 38932 - DNA, 8 bp, Unknown
  misc_feature (1)..( 8): Matrix.001 file - promoters70/1399726
agtgataa

SEQ ID NO: 38933 - DNA, 8 bp, Unknown
  misc_feature (1)..( 8): Matrix.001 file - promoters70/1399726
caaattct

SEQ ID NO: 38934 - DNA, 12 bp, Unknown
  misc_feature (1)..( 12): Matrix.001 file - promoters70/1399726
gtttaacacaaa

SEQ ID NO: 38935 - DNA, 8 bp, Unknown
  misc_feature (1)..( 8): Matrix.001 file - promoters70/1399726
aagcaaaa

SEQ ID NO: 38936 - DNA, 11 bp, Unknown
  misc_feature (1)..( 11): Matrix.001 file - promoters70/1399726
aaaatgaaaaa

SEQ ID NO: 38937 - DNA, 8 bp, Unknown
  misc_feature (1)..( 8): Matrix.001 file - promoters70/1399726
caaaatac

SEQ ID NO: 38938 - DNA, 8 bp, Unknown
  misc_feature (1)..( 8): Matrix.001 file - promoters70/1399726
aaaacaaa

SEQ ID NO: 38939 - DNA, 11 bp, Unknown
  misc_feature (1)..( 11): Matrix.001 file - promoters70/1399726
aaaaaagaaaa

SEQ ID NO: 38940 - DNA, 7 bp, Unknown
  misc_feature (1)..( 7): Matrix.001 file - promoters70/1411616
aaaatca

SEQ ID NO: 38941 - DNA, 6 bp, Unknown
  misc_feature (1)..( 6): Matrix.001 file - promoters70/1413191
ctttct

SEQ ID NO: 38942 - DNA, 14 bp, Unknown
  misc_feature (1)..( 14): Matrix.001 file - promoters70/1413191
caatcaaaagaaac

SEQ ID NO: 38943 - DNA, 10 bp, Unknown
  misc_feature (1)..( 10): Matrix.001 file - promoters70/1413191
tttatgttga

SEQ ID NO: 38944 - DNA, 7 bp, Unknown
  misc_feature (1)..( 7): Matrix.001 file - promoters70/1413191
atataaa

SEQ ID NO: 38945 - DNA, 13 bp, Unknown
  misc_feature (1)..( 13): Matrix.001 file - promoters70/1441044
acaaacttttttt

SEQ ID NO: 38946 - DNA, 9 bp, Unknown
  misc_feature (1)..( 9): Matrix.001 file - promoters70/1441044
aactaaacc

SEQ ID NO: 38947 - DNA, 7 bp, Unknown
  misc_feature (1)..( 7): Matrix.001 file - promoters70/1441044
aaacaat

SEQ ID NO: 38948 - DNA, 17 bp, Unknown
  misc_feature (1)..( 17): Matrix.001 file - promoters70/1441184
tataaataaacccttaa

SEQ ID NO: 38949 - DNA, 10 bp, Unknown
  misc_feature (1)..( 10): Matrix.001 file - promoters70/1441184
ctataaaaaa

SEQ ID NO: 38950 - DNA, 11 bp, Unknown
  misc_feature (1)..( 11): Matrix.001 file - promoters70/1441657
aacttctattt

SEQ ID NO: 38951 - DNA, 7 bp, Unknown
  misc_feature (1)..( 7): Matrix.001 file - promoters70/1441657
ccaaacc

SEQ ID NO: 38952 - DNA, 9 bp, Unknown
  misc_feature (1)..( 9): Matrix.001 file - promoters70/1441657
aaattttca

SEQ ID NO: 38953 - DNA, 7 bp, Unknown
  misc_feature (1)..( 7): Matrix.001 file - promoters70/1441657
caatatt

SEQ ID NO: 38954 - DNA, 13 bp, Unknown
  misc_feature (1)..( 13): Matrix.001 file - promoters70/1441665
gagacaaaaccaa

SEQ ID NO: 38955 - DNA, 9 bp, Unknown
  misc_feature (1)..( 9): Matrix.001 file - promoters70/1441665
acaaaaaac

SEQ ID NO: 38956 - DNA, 13 bp, Unknown
  misc_feature (1)..( 13): Matrix.001 file - promoters70/1441665
tcaaaaacaaaaa

SEQ ID NO: 38957 - DNA, 10 bp, Unknown
  misc_feature (1)..( 10): Matrix.001 file - promoters70/1441665
actatttaaa

SEQ ID NO: 38958 - DNA, 12 bp, Unknown
  misc_feature (1)..( 12): Matrix.001 file - promoters70/1441665
ttcttataattc

SEQ ID NO: 38959 - DNA, 8 bp, Unknown
  misc_feature (1)..( 8): Matrix.001 file - promoters70/1441665
tatgggcc

SEQ ID NO: 38960 - DNA, 9 bp, Unknown
  misc_feature (1)..( 9): Matrix.001 file - promoters70/1441665
caaacaaaa

SEQ ID NO: 38961 - DNA, 11 bp, Unknown
  misc_feature (1)..( 11): Matrix.001 file - promoters70/1441814
taaaaatttat

SEQ ID NO: 38962 - DNA, 8 bp, Unknown
  misc_feature (1)..( 8): Matrix.001 file - promoters70/1441814
ataactat

SEQ ID NO: 38963 - DNA, 12 bp, Unknown
  misc_feature (1)..( 12): Matrix.001 file - promoters70/1441814
tacacaagtttt

SEQ ID NO: 38964 - DNA, 11 bp, Unknown
  misc_feature (1)..( 11): Matrix.001 file - promoters70/1441814
ttttacttttt

SEQ ID NO: 38965 - DNA, 7 bp, Unknown
  misc_feature (1)..( 7): Matrix.001 file - promoters70/1441835
agcaaaa

SEQ ID NO: 38966 - DNA, 10 bp, Unknown
  misc_feature (1)..( 10): Matrix.001 file - promoters70/1441835
aagtcaaaac

SEQ ID NO: 38967 - DNA, 9 bp, Unknown
  misc_feature (1)..( 9): Matrix.001 file - promoters70/1441859
ataaaaata

SEQ ID NO: 38968 - DNA, 8 bp, Unknown
  misc_feature (1)..( 8): Matrix.001 file - promoters70/1441859
atatttta

SEQ ID NO: 38969 - DNA, 10 bp, Unknown
  misc_feature (1)..( 10): Matrix.001 file - promoters70/1441912
gtttggtttt

SEQ ID NO: 38970 - DNA, 6 bp, Unknown
  misc_feature (1)..( 6): Matrix.001 file - promoters70/1441912
tatata

SEQ ID NO: 38971 - DNA, 10 bp, Unknown
  misc_feature (1)..( 10): Matrix.001 file - promoters70/1441912
aacaaaagtt

SEQ ID NO: 38972 - DNA, 7 bp, Unknown
  misc_feature (1)..( 7): Matrix.001 file - promoters70/1442156
attttag

SEQ ID NO: 38973 - DNA, 9 bp, Unknown
  misc_feature (1)..( 9): Matrix.001 file - promoters70/1442156
aaataatta

SEQ ID NO: 38974 - DNA, 7 bp, Unknown
  misc_feature (1)..( 7): Matrix.001 file - promoters70/1442156
aatatac

SEQ ID NO: 38975 - DNA, 7 bp, Unknown
  misc_feature (1)..( 7): Matrix.001 file - promoters70/1442156
aaaaaaa

SEQ ID NO: 38976 - DNA, 7 bp, Unknown
  misc_feature (1)..( 7): Matrix.001 file - promoters70/1442156
tttattt

SEQ ID NO: 38977 - DNA, 10 bp, Unknown
  misc_feature (1)..( 10): Matrix.001 file - promoters70/1442156
aaaatcaaaa

SEQ ID NO: 38978 - DNA, 7 bp, Unknown
  misc_feature (1)..( 7): Matrix.001 file - promoters70/1442156
aaaataa

SEQ ID NO: 38979 - DNA, 8 bp, Unknown
  misc_feature (1)..( 8): Matrix.001 file - promoters70/1442156
cttcttct

SEQ ID NO: 38980 - DNA, 6 bp, Unknown
  misc_feature (1)..( 6): Matrix.001 file - promoters70/1442156
cacgtg

SEQ ID NO: 38981 - DNA, 9 bp, Unknown
  misc_feature (1)..( 9): Matrix.001 file - promoters70/1442156
attaattta

SEQ ID NO: 38982 - DNA, 7 bp, Unknown
  misc_feature (1)..( 7): Matrix.001 file - promoters70/1442156
aaattac

SEQ ID NO: 38983 - DNA, 7 bp, Unknown
  misc_feature (1)..( 7): Matrix.001 file - promoters70/1442408
cttcttt

SEQ ID NO: 38984 - DNA, 10 bp, Unknown
  misc_feature (1)..( 10): Matrix.001 file - promoters70/1442427
taaatttgct

SEQ ID NO: 38985 - DNA, 11 bp, Unknown
  misc_feature (1)..( 11): Matrix.001 file - promoters70/1442476
cccgtagaatt

SEQ ID NO: 38986 - DNA, 9 bp, Unknown
  misc_feature (1)..( 9): Matrix.001 file - promoters70/1442476
aaacaaaaa

SEQ ID NO: 38987 - DNA, 9 bp, Unknown
  misc_feature (1)..( 9): Matrix.001 file - promoters70/1442504
attatatct

SEQ ID NO: 38988 - DNA, 9 bp, Unknown
  misc_feature (1)..( 9): Matrix.001 file - promoters70/1442649
aaaatagtt

SEQ ID NO: 38989 - DNA, 7 bp, Unknown
  misc_feature (1)..( 7): Matrix.001 file - promoters70/1442649
atatcat

SEQ ID NO: 38990 - DNA, 6 bp, Unknown
  misc_feature (1)..( 6): Matrix.001 file - promoters70/1442649
tattta

SEQ ID NO: 38991 - DNA, 9 bp, Unknown
  misc_feature (1)..( 9): Matrix.001 file - promoters70/1442880
acctctttt

SEQ ID NO: 38992 - DNA, 7 bp, Unknown
  misc_feature (1)..( 7): Matrix.001 file - promoters70/1442880
aatttac

SEQ ID NO: 38993 - DNA, 10 bp, Unknown
  misc_feature (1)..( 10): Matrix.001 file - promoters70/1442880
aaaaaattgt

SEQ ID NO: 38994 - DNA, 8 bp, Unknown
  misc_feature (1)..( 8): Matrix.001 file - promoters70/1442880
aagctata

SEQ ID NO: 38995 - DNA, 11 bp, Unknown
  misc_feature (1)..( 11): Matrix.001 file - promoters70/1442880
ttacttaaatt

SEQ ID NO: 38996 - DNA, 9 bp, Unknown
  misc_feature (1)..( 9): Matrix.001 file - promoters70/1442880
aaagaattg

SEQ ID NO: 38997 - DNA, 13 bp, Unknown
  misc_feature (1)..( 13): Matrix.001 file - promoters70/1442880
aatatcaacgacg

SEQ ID NO: 38998 - DNA, 8 bp, Unknown
  misc_feature (1)..( 8): Matrix.001 file - promoters70/1442880
aaataata

SEQ ID NO: 38999 - DNA, 12 bp, Unknown
  misc_feature (1)..( 12): Matrix.001 file - promoters70/1442975
ctttttgtatat

SEQ ID NO: 39000 - DNA, 8 bp, Unknown
  misc_feature (1)..( 8): Matrix.001 file - promoters70/1442975
tctgaatt

SEQ ID NO: 39001 - DNA, 12 bp, Unknown
  misc_feature (1)..( 12): Matrix.001 file - promoters70/1442993
aaataattgtat

SEQ ID NO: 39002 - DNA, 10 bp, Unknown
  misc_feature (1)..( 10): Matrix.001 file - promoters70/1442993
gaaatagatt

SEQ ID NO: 39003 - DNA, 11 bp, Unknown
  misc_feature (1)..( 11): Matrix.001 file - promoters70/1442993
ttacttaaatt

SEQ ID NO: 39004 - DNA, 12 bp, Unknown
  misc_feature (1)..( 12): Matrix.001 file - promoters70/1443021
tcaaaatttatc

SEQ ID NO: 39005 - DNA, 15 bp, Unknown
  misc_feature (1)..( 15): Matrix.001 file - promoters70/1443192
aaaaattattaaatt

SEQ ID NO: 39006 - DNA, 9 bp, Unknown
  misc_feature (1)..( 9): Matrix.001 file - promoters70/1443192
ttaataata

SEQ ID NO: 39007 - DNA, 8 bp, Unknown
  misc_feature (1)..( 8): Matrix.001 file - promoters70/1443192
ataatttt

SEQ ID NO: 39008 - DNA, 10 bp, Unknown
  misc_feature (1)..( 10): Matrix.001 file - promoters70/1443192
ctatatatat

SEQ ID NO: 39009 - DNA, 8 bp, Unknown
  misc_feature (1)..( 8): Matrix.001 file - promoters70/1443192
taattgaa

SEQ ID NO: 39010 - DNA, 8 bp, Unknown
  misc_feature (1)..( 8): Matrix.001 file - promoters70/1443306
tttgtaat

SEQ ID NO: 39011 - DNA, 12 bp, Unknown
  misc_feature (1)..( 12): Matrix.001 file - promoters70/1443306
taaaatattttt

SEQ ID NO: 39012 - DNA, 7 bp, Unknown
  misc_feature (1)..( 7): Matrix.001 file - promoters70/1443306
tttattt

SEQ ID NO: 39013 - DNA, 7 bp, Unknown
  misc_feature (1)..( 7): Matrix.001 file - promoters70/1443306
cataaac

SEQ ID NO: 39014 - DNA, 11 bp, Unknown
  misc_feature (1)..( 11): Matrix.001 file - promoters70/1443306
tatatataaat

SEQ ID NO: 39015 - DNA, 10 bp, Unknown
  misc_feature (1)..( 10): Matrix.001 file - promoters70/1443306
ttaattttac

SEQ ID NO: 39016 - DNA, 9 bp, Unknown
  misc_feature (1)..( 9): Matrix.001 file - promoters70/1443338
tcttataat

SEQ ID NO: 39017 - DNA, 8 bp, Unknown
  misc_feature (1)..( 8): Matrix.001 file - promoters70/1443338
tcttataa

SEQ ID NO: 39018 - DNA, 11 bp, Unknown
  misc_feature (1)..( 11): Matrix.001 file - promoters70/1443349
ttttgaagaat

SEQ ID NO: 39019 - DNA, 16 bp, Unknown
  misc_feature (1)..( 16): Matrix.001 file - promoters70/1443349
atagattttaaaaaaa

SEQ ID NO: 39020 - DNA, 8 bp, Unknown
  misc_feature (1)..( 8): Matrix.001 file - promoters70/1443349
aattaaag

SEQ ID NO: 39021 - DNA, 11 bp, Unknown
  misc_feature (1)..( 11): Matrix.001 file - promoters70/1443349
tatatataaaa

SEQ ID NO: 39022 - DNA, 11 bp, Unknown
  misc_feature (1)..( 11): Matrix.001 file - promoters70/1443349
attataaataa

SEQ ID NO: 39023 - DNA, 8 bp, Unknown
  misc_feature (1)..( 8): Matrix.001 file - promoters70/1443349
cttcataa

SEQ ID NO: 39024 - DNA, 14 bp, Unknown
  misc_feature (1)..( 14): Matrix.001 file - promoters70/1443349
atagattgtaaaaa

SEQ ID NO: 39025 - DNA, 13 bp, Unknown
  misc_feature (1)..( 13): Matrix.001 file - promoters70/1443349
atttataagtatg

SEQ ID NO: 39026 - DNA, 11 bp, Unknown
  misc_feature (1)..( 11): Matrix.001 file - promoters70/1443349
ctttataaaaa

SEQ ID NO: 39027 - DNA, 9 bp, Unknown
  misc_feature (1)..( 9): Matrix.001 file - promoters70/1443356
tacaaattt

SEQ ID NO: 39028 - DNA, 8 bp, Unknown
  misc_feature (1)..( 8): Matrix.001 file - promoters70/1443356
tttatttg

SEQ ID NO: 39029 - DNA, 7 bp, Unknown
  misc_feature (1)..( 7): Matrix.001 file - promoters70/1443356
tacaata

SEQ ID NO: 39030 - DNA, 8 bp, Unknown
  misc_feature (1)..( 8): Matrix.001 file - promoters70/1443418
aattttta

SEQ ID NO: 39031 - DNA, 8 bp, Unknown
  misc_feature (1)..( 8): Matrix.001 file - promoters70/1443418
ttttatta

SEQ ID NO: 39032 - DNA, 9 bp, Unknown
  misc_feature (1)..( 9): Matrix.001 file - promoters70/1443418
tgtttaaaa

SEQ ID NO: 39033 - DNA, 9 bp, Unknown
  misc_feature (1)..( 9): Matrix.001 file - promoters70/1443418
tatatataa

SEQ ID NO: 39034 - DNA, 9 bp, Unknown
  misc_feature (1)..( 9): Matrix.001 file - promoters70/1443633
agaatacat

SEQ ID NO: 39035 - DNA, 8 bp, Unknown
  misc_feature (1)..( 8): Matrix.001 file - promoters70/1443633
acgaaatt

SEQ ID NO: 39036 - DNA, 15 bp, Unknown
  misc_feature (1)..( 15): Matrix.001 file - promoters70/1443683
tatgagcttcaaaca

SEQ ID NO: 39037 - DNA, 12 bp, Unknown
  misc_feature (1)..( 12): Matrix.001 file - promoters70/1444131
gacattataaaa

SEQ ID NO: 39038 - DNA, 12 bp, Unknown
  misc_feature (1)..( 12): Matrix.001 file - promoters70/1444131
caaacaaataaa

SEQ ID NO: 39039 - DNA, 11 bp, Unknown
  misc_feature (1)..( 11): Matrix.001 file - promoters70/1444441
aactcttttta

SEQ ID NO: 39040 - DNA, 9 bp, Unknown
  misc_feature (1)..( 9): Matrix.001 file - promoters70/1444460
tgaaacaca

SEQ ID NO: 39041 - DNA, 7 bp, Unknown
  misc_feature (1)..( 7): Matrix.001 file - promoters70/1444460
tttcttc

SEQ ID NO: 39042 - DNA, 15 bp, Unknown
  misc_feature (1)..( 15): Matrix.001 file - promoters70/1444479
aaaaattattaaatt

SEQ ID NO: 39043 - DNA, 10 bp, Unknown
  misc_feature (1)..( 10): Matrix.001 file - promoters70/1444479
tttactaaaa

SEQ ID NO: 39044 - DNA, 8 bp, Unknown
  misc_feature (1)..( 8): Matrix.001 file - promoters70/1444479
ataatttt

SEQ ID NO: 39045 - DNA, 7 bp, Unknown
  misc_feature (1)..( 7): Matrix.001 file - promoters70/1444479
tatttta

SEQ ID NO: 39046 - DNA, 10 bp, Unknown
  misc_feature (1)..( 10): Matrix.001 file - promoters70/1444479
ctatatatat

SEQ ID NO: 39047 - DNA, 9 bp, Unknown
  misc_feature (1)..( 9): Matrix.001 file - promoters70/1444479
ctaatttta

SEQ ID NO: 39048 - DNA, 8 bp, Unknown
  misc_feature (1)..( 8): Matrix.001 file - promoters70/1444479
ttttgtta

SEQ ID NO: 39049 - DNA, 8 bp, Unknown
  misc_feature (1)..( 8): Matrix.001 file - promoters70/1444479
acaaaaaa

SEQ ID NO: 39050 - DNA, 10 bp, Unknown
  misc_feature (1)..( 10): Matrix.001 file - promoters70/1444479
aaaaaataat

SEQ ID NO: 39051 - DNA, 8 bp, Unknown
  misc_feature (1)..( 8): Matrix.001 file - promoters70/1444479
taattgaa

SEQ ID NO: 39052 - DNA, 9 bp, Unknown
  misc_feature (1)..( 9): Matrix.001 file - promoters70/1444479
aaaatattt

SEQ ID NO: 39053 - DNA, 7 bp, Unknown
  misc_feature (1)..( 7): Matrix.001 file - promoters70/1444479
attttgt

SEQ ID NO: 39054 - DNA, 8 bp, Unknown
  misc_feature (1)..( 8): Matrix.001 file - promoters70/1444479
aaaaaaat

SEQ ID NO: 39055 - DNA, 15 bp, Unknown
  misc_feature (1)..( 15): Matrix.001 file - promoters70/1444506
aaaaattattaaatt

SEQ ID NO: 39056 - DNA, 10 bp, Unknown
  misc_feature (1)..( 10): Matrix.001 file - promoters70/1444506
tttactaaaa

SEQ ID NO: 39057 - DNA, 8 bp, Unknown
  misc_feature (1)..( 8): Matrix.001 file - promoters70/1444506
ataatttt

SEQ ID NO: 39058 - DNA, 7 bp, Unknown
  misc_feature (1)..( 7): Matrix.001 file - promoters70/1444506
tatttta

SEQ ID NO: 39059 - DNA, 10 bp, Unknown
  misc_feature (1)..( 10): Matrix.001 file - promoters70/1444506
ctatatatat

SEQ ID NO: 39060 - DNA, 9 bp, Unknown
  misc_feature (1)..( 9): Matrix.001 file - promoters70/1444506
ctaatttta

SEQ ID NO: 39061 - DNA, 8 bp, Unknown
  misc_feature (1)..( 8): Matrix.001 file - promoters70/1444506
ttttgtta

SEQ ID NO: 39062 - DNA, 8 bp, Unknown
  misc_feature (1)..( 8): Matrix.001 file - promoters70/1444506
acaaaaaa

SEQ ID NO: 39063 - DNA, 10 bp, Unknown
  misc_feature (1)..( 10): Matrix.001 file - promoters70/1444506
aaaaaataat

SEQ ID NO: 39064 - DNA, 8 bp, Unknown
  misc_feature (1)..( 8): Matrix.001 file - promoters70/1444506
taattgaa

SEQ ID NO: 39065 - DNA, 9 bp, Unknown
  misc_feature (1)..( 9): Matrix.001 file - promoters70/1444506
aaaatattt

SEQ ID NO: 39066 - DNA, 7 bp, Unknown
  misc_feature (1)..( 7): Matrix.001 file - promoters70/1444506
attttgt

SEQ ID NO: 39067 - DNA, 8 bp, Unknown
  misc_feature (1)..( 8): Matrix.001 file - promoters70/1444506
aaaaaaat

SEQ ID NO: 39068 - DNA, 15 bp, Unknown
  misc_feature (1)..( 15): Matrix.001 file - promoters70/1444514
aaaaattattaaatt

SEQ ID NO: 39069 - DNA, 9 bp, Unknown
  misc_feature (1)..( 9): Matrix.001 file - promoters70/1444514
ttaataata

SEQ ID NO: 39070 - DNA, 8 bp, Unknown
  misc_feature (1)..( 8): Matrix.001 file - promoters70/1444514
ataatttt

SEQ ID NO: 39071 - DNA, 10 bp, Unknown
  misc_feature (1)..( 10): Matrix.001 file - promoters70/1444514
ctatatatat

SEQ ID NO: 39072 - DNA, 8 bp, Unknown
  misc_feature (1)..( 8): Matrix.001 file - promoters70/1444514
taattgaa

SEQ ID NO: 39073 - DNA, 9 bp, Unknown
  misc_feature (1)..( 9): Matrix.001 file - promoters70/1446636
gaggttaaa

SEQ ID NO: 39074 - DNA, 7 bp, Unknown
  misc_feature (1)..( 7): Matrix.001 file - promoters70/1446636
aaaggat

SEQ ID NO: 39075 - DNA, 10 bp, Unknown
  misc_feature (1)..( 10): Matrix.001 file - promoters70/1447425
aatttgatag

SEQ ID NO: 39076 - DNA, 10 bp, Unknown
  misc_feature (1)..( 10): Matrix.001 file - promoters70/1447646
ggaagtagag

SEQ ID NO: 39077 - DNA, 10 bp, Unknown
  misc_feature (1)..( 10): Matrix.001 file - promoters70/1447646
gaagaaagga

SEQ ID NO: 39078 - DNA, 9 bp, Unknown
  misc_feature (1)..( 9): Matrix.001 file - promoters70/1447646
aagatgatg

SEQ ID NO: 39079 - DNA, 8 bp, Unknown
  misc_feature (1)..( 8): Matrix.001 file - promoters70/1447646
gataaaga

SEQ ID NO: 39080 - DNA, 8 bp, Unknown
  misc_feature (1)..( 8): Matrix.001 file - promoters70/1447646
agtggaaa

SEQ ID NO: 39081 - DNA, 8 bp, Unknown
  misc_feature (1)..( 8): Matrix.001 file - promoters70/1447646
gaagttga

SEQ ID NO: 39082 - DNA, 5 bp, Unknown
  misc_feature (1)..( 5): Matrix.001 file - promoters70/1447953
ttata

SEQ ID NO: 39083 - DNA, 7 bp, Unknown
  misc_feature (1)..( 7): Matrix.001 file - promoters70/1448231
cttaacc

SEQ ID NO: 39084 - DNA, 8 bp, Unknown
  misc_feature (1)..( 8): Matrix.001 file - promoters70/1450625
aattttaa

SEQ ID NO: 39085 - DNA, 6 bp, Unknown
  misc_feature (1)..( 6): Matrix.001 file - promoters70/1450625
ttattc

SEQ ID NO: 39086 - DNA, 9 bp, Unknown
  misc_feature (1)..( 9): Matrix.001 file - promoters70/1450696
aaaaccaaa

SEQ ID NO: 39087 - DNA, 8 bp, Unknown
  misc_feature (1)..( 8): Matrix.001 file - promoters70/1450696
aatatata

SEQ ID NO: 39088 - DNA, 8 bp, Unknown
  misc_feature (1)..( 8): Matrix.001 file - promoters70/1450696
ttttttta

SEQ ID NO: 39089 - DNA, 9 bp, Unknown
  misc_feature (1)..( 9): Matrix.001 file - promoters70/1450811
agatactta

SEQ ID NO: 39090 - DNA, 11 bp, Unknown
  misc_feature (1)..( 11): Matrix.001 file - promoters70/1455944
aaataaaattg

SEQ ID NO: 39091 - DNA, 11 bp, Unknown
  misc_feature (1)..( 11): Matrix.001 file - promoters70/1455944
aaaaaaagaat

SEQ ID NO: 39092 - DNA, 11 bp, Unknown
  misc_feature (1)..( 11): Matrix.001 file - promoters70/1455944
aaacaaagaaa

SEQ ID NO: 39093 - DNA, 7 bp, Unknown
  misc_feature (1)..( 7): Matrix.001 file - promoters70/1455944
aaattaa

SEQ ID NO: 39094 - DNA, 8 bp, Unknown
  misc_feature (1)..( 8): Matrix.001 file - promoters70/1455944
tgaacaaa

SEQ ID NO: 39095 - DNA, 11 bp, Unknown
  misc_feature (1)..( 11): Matrix.001 file - promoters70/1455944
caatcactctc

SEQ ID NO: 39096 - DNA, 10 bp, Unknown
  misc_feature (1)..( 10): Matrix.001 file - promoters70/1455944
tatataaaac

SEQ ID NO: 39097 - DNA, 9 bp, Unknown
  misc_feature (1)..( 9): Matrix.001 file - promoters70/1455944
ttgaccaaa

SEQ ID NO: 39098 - DNA, 9 bp, Unknown
  misc_feature (1)..( 9): Matrix.001 file - promoters70/1455956
tgttaattt

SEQ ID NO: 39099 - DNA, 8 bp, Unknown
  misc_feature (1)..( 8): Matrix.001 file - promoters70/1455956
ttgatttg

SEQ ID NO: 39100 - DNA, 8 bp, Unknown
  misc_feature (1)..( 8): Matrix.001 file - promoters70/1455956
taacttcc

SEQ ID NO: 39101 - DNA, 7 bp, Unknown
  misc_feature (1)..( 7): Matrix.001 file - promoters70/1455956
ttaattt

SEQ ID NO: 39102 - DNA, 10 bp, Unknown
  misc_feature (1)..( 10): Matrix.001 file - promoters70/1455972
ttcaaatata

SEQ ID NO: 39103 - DNA, 9 bp, Unknown
  misc_feature (1)..( 9): Matrix.001 file - promoters70/1459039
atataaagg

SEQ ID NO: 39104 - DNA, 8 bp, Unknown
  misc_feature (1)..( 8): Matrix.001 file - promoters70/1459223
aaaaaaat

SEQ ID NO: 39105 - DNA, 10 bp, Unknown
  misc_feature (1)..( 10): Matrix.001 file - promoters70/1459223
tttataaata

SEQ ID NO: 39106 - DNA, 6 bp, Unknown
  misc_feature (1)..( 6): Matrix.001 file - promoters70/1459223
caaaca

SEQ ID NO: 39107 - DNA, 11 bp, Unknown
  misc_feature (1)..( 11): Matrix.001 file - promoters70/1461780
tttactcaatt

SEQ ID NO: 39108 - DNA, 11 bp, Unknown
  misc_feature (1)..( 11): Matrix.001 file - promoters70/1461791
gaagttgtgtt

SEQ ID NO: 39109 - DNA, 6 bp, Unknown
  misc_feature (1)..( 6): Matrix.001 file - promoters70/1461791
caattt

SEQ ID NO: 39110 - DNA, 8 bp, Unknown
  misc_feature (1)..( 8): Matrix.001 file - promoters70/1461791
actataaa

SEQ ID NO: 39111 - DNA, 7 bp, Unknown
  misc_feature (1)..( 7): Matrix.001 file - promoters70/1461791
gttgaac

SEQ ID NO: 39112 - DNA, 8 bp, Unknown
  misc_feature (1)..( 8): Matrix.001 file - promoters70/1461791
tgaaacaa

SEQ ID NO: 39113 - DNA, 7 bp, Unknown
  misc_feature (1)..( 7): Matrix.001 file - promoters70/1461791
gaaatcg

SEQ ID NO: 39114 - DNA, 15 bp, Unknown
  misc_feature (1)..( 15): Matrix.001 file - promoters70/1461803
actacatttaattat

SEQ ID NO: 39115 - DNA, 8 bp, Unknown
  misc_feature (1)..( 8): Matrix.001 file - promoters70/1461803
caacatga

SEQ ID NO: 39116 - DNA, 12 bp, Unknown
  misc_feature (1)..( 12): Matrix.001 file - promoters70/1461803
accaataaaaga

SEQ ID NO: 39117 - DNA, 11 bp, Unknown
  misc_feature (1)..( 11): Matrix.001 file - promoters70/1461803
agaagataagt

SEQ ID NO: 39118 - DNA, 11 bp, Unknown
  misc_feature (1)..( 11): Matrix.001 file - promoters70/1461803
agacgatgagt

SEQ ID NO: 39119 - DNA, 8 bp, Unknown
  misc_feature (1)..( 8): Matrix.001 file - promoters70/1461803
aattttca

SEQ ID NO: 39120 - DNA, 8 bp, Unknown
  misc_feature (1)..( 8): Matrix.001 file - promoters70/1461803
aataatta

SEQ ID NO: 39121 - DNA, 10 bp, Unknown
  misc_feature (1)..( 10): Matrix.001 file - promoters70/1461803
accaataaaa

SEQ ID NO: 39122 - DNA, 11 bp, Unknown
  misc_feature (1)..( 11): Matrix.001 file - promoters70/1461803
gtcaatataaa

SEQ ID NO: 39123 - DNA, 9 bp, Unknown
  misc_feature (1)..( 9): Matrix.001 file - promoters70/1461803
aagcaaaac

SEQ ID NO: 39124 - DNA, 14 bp, Unknown
  misc_feature (1)..( 14): Matrix.001 file - promoters70/1461839
aaaaagaaaaagaa

SEQ ID NO: 39125 - DNA, 11 bp, Unknown
  misc_feature (1)..( 11): Matrix.001 file - promoters70/1461839
aaaaaaagaaa

SEQ ID NO: 39126 - DNA, 8 bp, Unknown
  misc_feature (1)..( 8): Matrix.001 file - promoters70/1461839
caatctaa

SEQ ID NO: 39127 - DNA, 9 bp, Unknown
  misc_feature (1)..( 9): Matrix.001 file - promoters70/1461839
aaaaggaga

SEQ ID NO: 39128 - DNA, 8 bp, Unknown
  misc_feature (1)..( 8): Matrix.001 file - promoters70/1470993
aaagattg

SEQ ID NO: 39129 - DNA, 7 bp, Unknown
  misc_feature (1)..( 7): Matrix.001 file - promoters70/1470993
ccattaa

SEQ ID NO: 39130 - DNA, 9 bp, Unknown
  misc_feature (1)..( 9): Matrix.001 file - promoters70/1470993
actaaatta

SEQ ID NO: 39131 - DNA, 8 bp, Unknown
  misc_feature (1)..( 8): Matrix.001 file - promoters70/1470993
tagttttg

SEQ ID NO: 39132 - DNA, 6 bp, Unknown
  misc_feature (1)..( 6): Matrix.001 file - promoters70/1471041
aataaa

SEQ ID NO: 39133 - DNA, 7 bp, Unknown
  misc_feature (1)..( 7): Matrix.001 file - promoters70/1471041
aaaaatg

SEQ ID NO: 39134 - DNA, 13 bp, Unknown
  misc_feature (1)..( 13): Matrix.001 file - promoters70/1472778
gtataaaacgaag

SEQ ID NO: 39135 - DNA, 11 bp, Unknown
  misc_feature (1)..( 11): Matrix.001 file - promoters70/1472778
tatataacaca

SEQ ID NO: 39136 - DNA, 9 bp, Unknown
  misc_feature (1)..( 9): Matrix.001 file - promoters70/1472778
ttaattttc

SEQ ID NO: 39137 - DNA, 10 bp, Unknown
  misc_feature (1)..( 10): Matrix.001 file - promoters70/1472778
ttttattttc

SEQ ID NO: 39138 - DNA, 10 bp, Unknown
  misc_feature (1)..( 10): Matrix.001 file - promoters70/1472778
gatacagtta

SEQ ID NO: 39139 - DNA, 8 bp, Unknown
  misc_feature (1)..( 8): Matrix.001 file - promoters70/1472799
atcatatt

SEQ ID NO: 39140 - DNA, 9 bp, Unknown
  misc_feature (1)..( 9): Matrix.001 file - promoters70/1472799
tttgtagtg

SEQ ID NO: 39141 - DNA, 8 bp, Unknown
  misc_feature (1)..( 8): Matrix.001 file - promoters70/1472799
tgatttgt

SEQ ID NO: 39142 - DNA, 7 bp, Unknown
  misc_feature (1)..( 7): Matrix.001 file - promoters70/1472799
gtttgtt

SEQ ID NO: 39143 - DNA, 8 bp, Unknown
  misc_feature (1)..( 8): Matrix.001 file - promoters70/1472799
gatttgtt

SEQ ID NO: 39144 - DNA, 7 bp, Unknown
  misc_feature (1)..( 7): Matrix.001 file - promoters70/1481696
tttactt

SEQ ID NO: 39145 - DNA, 10 bp, Unknown
  misc_feature (1)..( 10): Matrix.001 file - promoters70/1481696
aaaaagaaac

SEQ ID NO: 39146 - DNA, 12 bp, Unknown
  misc_feature (1)..( 12): Matrix.001 file - promoters70/1481696
tatattcaattc

SEQ ID NO: 39147 - DNA, 9 bp, Unknown
  misc_feature (1)..( 9): Matrix.001 file - promoters70/1481696
ttttattat

SEQ ID NO: 39148 - DNA, 13 bp, Unknown
  misc_feature (1)..( 13): Matrix.001 file - promoters70/1481696
tgcttatgttaga

SEQ ID NO: 39149 - DNA, 8 bp, Unknown
  misc_feature (1)..( 8): Matrix.001 file - promoters70/1482448
actatata

SEQ ID NO: 39150 - DNA, 8 bp, Unknown
  misc_feature (1)..( 8): Matrix.001 file - promoters70/1482448
catttttt

SEQ ID NO: 39151 - DNA, 8 bp, Unknown
  misc_feature (1)..( 8): Matrix.001 file - promoters70/1482448
attttaaa

SEQ ID NO: 39152 - DNA, 9 bp, Unknown
  misc_feature (1)..( 9): Matrix.001 file - promoters70/1532660
taaaatttg

SEQ ID NO: 39153 - DNA, 10 bp, Unknown
  misc_feature (1)..( 10): Matrix.001 file - promoters70/1532660
aaaaaatctt

SEQ ID NO: 39154 - DNA, 7 bp, Unknown
  misc_feature (1)..( 7): Matrix.001 file - promoters70/1532937
ttttgtt

SEQ ID NO: 39155 - DNA, 10 bp, Unknown
  misc_feature (1)..( 10): Matrix.001 file - promoters70/1532937
tattaataaa

SEQ ID NO: 39156 - DNA, 8 bp, Unknown
  misc_feature (1)..( 8): Matrix.001 file - promoters70/1532937
cttgtttt

SEQ ID NO: 39157 - DNA, 14 bp, Unknown
  misc_feature (1)..( 14): Matrix.001 file - promoters70/1532937
tattaataaaattt

SEQ ID NO: 39158 - DNA, 10 bp, Unknown
  misc_feature (1)..( 10): Matrix.001 file - promoters70/1532937
tgtttttgtt

SEQ ID NO: 39159 - DNA, 8 bp, Unknown
  misc_feature (1)..( 8): Matrix.001 file - promoters70/1532948
attccatt

SEQ ID NO: 39160 - DNA, 8 bp, Unknown
  misc_feature (1)..( 8): Matrix.001 file - promoters70/1532948
tttgtaat

SEQ ID NO: 39161 - DNA, 12 bp, Unknown
  misc_feature (1)..( 12): Matrix.001 file - promoters70/1532948
aaaagaaattaa

SEQ ID NO: 39162 - DNA, 12 bp, Unknown
  misc_feature (1)..( 12): Matrix.001 file - promoters70/1532948
ttgagacaaaaa

SEQ ID NO: 39163 - DNA, 7 bp, Unknown
  misc_feature (1)..( 7): Matrix.001 file - promoters70/1532948
ggagaaa

SEQ ID NO: 39164 - DNA, 8 bp, Unknown
  misc_feature (1)..( 8): Matrix.001 file - promoters70/1532948
cccactaa

SEQ ID NO: 39165 - DNA, 9 bp, Unknown
  misc_feature (1)..( 9): Matrix.001 file - promoters70/1532948
taacaagta

SEQ ID NO: 39166 - DNA, 9 bp, Unknown
  misc_feature (1)..( 9): Matrix.001 file - promoters70/1534378
gaaattctt

SEQ ID NO: 39167 - DNA, 7 bp, Unknown
  misc_feature (1)..( 7): Matrix.001 file - promoters70/1534378
aatggat

SEQ ID NO: 39168 - DNA, 7 bp, Unknown
  misc_feature (1)..( 7): Matrix.001 file - promoters70/1534378
gaccaac

SEQ ID NO: 39169 - DNA, 7 bp, Unknown
  misc_feature (1)..( 7): Matrix.001 file - promoters70/1534528
gtatata

SEQ ID NO: 39170 - DNA, 8 bp, Unknown
  misc_feature (1)..( 8): Matrix.001 file - promoters70/1537456
ctttcttt

SEQ ID NO: 39171 - DNA, 9 bp, Unknown
  misc_feature (1)..( 9): Matrix.001 file - promoters70/1537617
tgtatgcat

SEQ ID NO: 39172 - DNA, 10 bp, Unknown
  misc_feature (1)..( 10): Matrix.001 file - promoters70/1537617
tcaattttat

SEQ ID NO: 39173 - DNA, 10 bp, Unknown
  misc_feature (1)..( 10): Matrix.001 file - promoters70/1537617
tcaattttat

SEQ ID NO: 39174 - DNA, 9 bp, Unknown
  misc_feature (1)..( 9): Matrix.001 file - promoters70/1557606
ttggcgaga

SEQ ID NO: 39175 - DNA, 11 bp, Unknown
  misc_feature (1)..( 11): Matrix.001 file - promoters70/1557769
atttttgtttt

SEQ ID NO: 39176 - DNA, 14 bp, Unknown
  misc_feature (1)..( 14): Matrix.001 file - promoters70/1557769
gatattaataatag

SEQ ID NO: 39177 - DNA, 9 bp, Unknown
  misc_feature (1)..( 9): Matrix.001 file - promoters70/1557769
aatttttct

SEQ ID NO: 39178 - DNA, 8 bp, Unknown
  misc_feature (1)..( 8): Matrix.001 file - promoters70/1557769
gatattaa

SEQ ID NO: 39179 - DNA, 13 bp, Unknown
  misc_feature (1)..( 13): Matrix.001 file - promoters70/1557769
taacaaaaaaact

SEQ ID NO: 39180 - DNA, 10 bp, Unknown
  misc_feature (1)..( 10): Matrix.001 file - promoters70/1557769
acaataaaaa

SEQ ID NO: 39181 - DNA, 8 bp, Unknown
  misc_feature (1)..( 8): Matrix.001 file - promoters70/1567007
ctaaaaaa

SEQ ID NO: 39182 - DNA, 8 bp, Unknown
  misc_feature (1)..( 8): Matrix.001 file - promoters70/1567007
taaaaaaa

SEQ ID NO: 39183 - DNA, 12 bp, Unknown
  misc_feature (1)..( 12): Matrix.001 file - promoters70/1567092
caacaatttaca

SEQ ID NO: 39184 - DNA, 10 bp, Unknown
  misc_feature (1)..( 10): Matrix.001 file - promoters70/1567092
tttgtttata

SEQ ID NO: 39185 - DNA, 9 bp, Unknown
  misc_feature (1)..( 9): Matrix.001 file - promoters70/1567535
gtttcttct

SEQ ID NO: 39186 - DNA, 11 bp, Unknown
  misc_feature (1)..( 11): Matrix.001 file - promoters70/1567547
aaacacaaaaa

SEQ ID NO: 39187 - DNA, 10 bp, Unknown
  misc_feature (1)..( 10): Matrix.001 file - promoters70/1568230
ttaatataaa

SEQ ID NO: 39188 - DNA, 9 bp, Unknown
  misc_feature (1)..( 9): Matrix.001 file - promoters70/1568508
tcttataat

SEQ ID NO: 39189 - DNA, 8 bp, Unknown
  misc_feature (1)..( 8): Matrix.001 file - promoters70/1568508
tcttataa

SEQ ID NO: 39190 - DNA, 8 bp, Unknown
  misc_feature (1)..( 8): Matrix.001 file - promoters70/1569568
aaaataaa

SEQ ID NO: 39191 - DNA, 8 bp, Unknown
  misc_feature (1)..( 8): Matrix.001 file - promoters70/1569568
taaaataa

SEQ ID NO: 39192 - DNA, 7 bp, Unknown
  misc_feature (1)..( 7): Matrix.001 file - promoters70/1569568
aaataaa

SEQ ID NO: 39193 - DNA, 10 bp, Unknown
  misc_feature (1)..( 10): Matrix.001 file - promoters70/1569568
tttatttaat

SEQ ID NO: 39194 - DNA, 9 bp, Unknown
  misc_feature (1)..( 9): Matrix.001 file - promoters70/1569568
aaaattaaa

SEQ ID NO: 39195 - DNA, 15 bp, Unknown
  misc_feature (1)..( 15): Matrix.001 file - promoters70/1569568
ttttactaaaaaaga

SEQ ID NO: 39196 - DNA, 11 bp, Unknown
  misc_feature (1)..( 11): Matrix.001 file - promoters70/1569568
taatatctcat

SEQ ID NO: 39197 - DNA, 12 bp, Unknown
  misc_feature (1)..( 12): Matrix.001 file - promoters70/1569568
aattttatttat

SEQ ID NO: 39198 - DNA, 9 bp, Unknown
  misc_feature (1)..( 9): Matrix.001 file - promoters70/1569721
tagagaaga

SEQ ID NO: 39199 - DNA, 10 bp, Unknown
  misc_feature (1)..( 10): Matrix.001 file - promoters70/1570606
ttttaataaa

SEQ ID NO: 39200 - DNA, 14 bp, Unknown
  misc_feature (1)..( 14): Matrix.001 file - promoters70/1570606
actttaattaaaat

SEQ ID NO: 39201 - DNA, 8 bp, Unknown
  misc_feature (1)..( 8): Matrix.001 file - promoters70/1570606
tattaata

SEQ ID NO: 39202 - DNA, 12 bp, Unknown
  misc_feature (1)..( 12): Matrix.001 file - promoters70/1570606
agaaaaaaatta

SEQ ID NO: 39203 - DNA, 9 bp, Unknown
  misc_feature (1)..( 9): Matrix.001 file - promoters70/1570622
tcgtttcaa

SEQ ID NO: 39204 - DNA, 8 bp, Unknown
  misc_feature (1)..( 8): Matrix.001 file - promoters70/1570622
aaacataa

SEQ ID NO: 39205 - DNA, 19 bp, Unknown
  misc_feature (1)..( 19): Matrix.001 file - promoters70/1570622
taaaacaaaaaaaagaaaa

SEQ ID NO: 39206 - DNA, 9 bp, Unknown
  misc_feature (1)..( 9): Matrix.001 file - promoters70/1570622
tactctttt

SEQ ID NO: 39207 - DNA, 9 bp, Unknown
  misc_feature (1)..( 9): Matrix.001 file - promoters70/1570622
tatgattaa

SEQ ID NO: 39208 - DNA, 9 bp, Unknown
  misc_feature (1)..( 9): Matrix.001 file - promoters70/1570622
tcttcttat

SEQ ID NO: 39209 - DNA, 9 bp, Unknown
  misc_feature (1)..( 9): Matrix.001 file - promoters70/1570622
tttaacaat

SEQ ID NO: 39210 - DNA, 12 bp, Unknown
  misc_feature (1)..( 12): Matrix.001 file - promoters70/1570860
gagaaataatac

SEQ ID NO: 39211 - DNA, 11 bp, Unknown
  misc_feature (1)..( 11): Matrix.001 file - promoters70/1570869
ttttgaagaat

SEQ ID NO: 39212 - DNA, 16 bp, Unknown
  misc_feature (1)..( 16): Matrix.001 file - promoters70/1570869
atataaatgttaaaaa

SEQ ID NO: 39213 - DNA, 11 bp, Unknown
  misc_feature (1)..( 11): Matrix.001 file - promoters70/1570869
tatatataaaa

SEQ ID NO: 39214 - DNA, 10 bp, Unknown
  misc_feature (1)..( 10): Matrix.001 file - promoters70/1570869
tataaaaaac

SEQ ID NO: 39215 - DNA, 10 bp, Unknown
  misc_feature (1)..( 10): Matrix.001 file - promoters70/1570869
atatctttat

SEQ ID NO: 39216 - DNA, 14 bp, Unknown
  misc_feature (1)..( 14): Matrix.001 file - promoters70/1570869
atagattgtaaaaa

SEQ ID NO: 39217 - DNA, 13 bp, Unknown
  misc_feature (1)..( 13): Matrix.001 file - promoters70/1570869
atttataagtaaa

SEQ ID NO: 39218 - DNA, 14 bp, Unknown
  misc_feature (1)..( 14): Matrix.001 file - promoters70/1570869
ataactttataaaa

SEQ ID NO: 39219 - DNA, 11 bp, Unknown
  misc_feature (1)..( 11): Matrix.001 file - promoters70/1570869
ttaatttaaca

SEQ ID NO: 39220 - DNA, 11 bp, Unknown
  misc_feature (1)..( 11): Matrix.001 file - promoters70/1570966
gataaatttca

SEQ ID NO: 39221 - DNA, 12 bp, Unknown
  misc_feature (1)..( 12): Matrix.001 file - promoters70/1570966
aaataaaataaa

SEQ ID NO: 39222 - DNA, 8 bp, Unknown
  misc_feature (1)..( 8): Matrix.001 file - promoters70/1570966
atatatat

SEQ ID NO: 39223 - DNA, 6 bp, Unknown
  misc_feature (1)..( 6): Matrix.001 file - promoters70/1570966
tttatt

SEQ ID NO: 39224 - DNA, 8 bp, Unknown
  misc_feature (1)..( 8): Matrix.001 file - promoters70/1570966
aattttta

SEQ ID NO: 39225 - DNA, 10 bp, Unknown
  misc_feature (1)..( 10): Matrix.001 file - promoters70/1570966
gaaaaaagaa

SEQ ID NO: 39226 - DNA, 12 bp, Unknown
  misc_feature (1)..( 12): Matrix.001 file - promoters70/1571014
gtttctttatct

SEQ ID NO: 39227 - DNA, 7 bp, Unknown
  misc_feature (1)..( 7): Matrix.001 file - promoters70/1571014
tttaaca

SEQ ID NO: 39228 - DNA, 9 bp, Unknown
  misc_feature (1)..( 9): Matrix.001 file - promoters70/1571014
aatttacaa

SEQ ID NO: 39229 - DNA, 7 bp, Unknown
  misc_feature (1)..( 7): Matrix.001 file - promoters70/1571014
tccaata

SEQ ID NO: 39230 - DNA, 10 bp, Unknown
  misc_feature (1)..( 10): Matrix.001 file - promoters70/1571014
tttaacaaga

SEQ ID NO: 39231 - DNA, 9 bp, Unknown
  misc_feature (1)..( 9): Matrix.001 file - promoters70/1571014
tgattcttt

SEQ ID NO: 39232 - DNA, 7 bp, Unknown
  misc_feature (1)..( 7): Matrix.001 file - promoters70/1573945
cagaaga

SEQ ID NO: 39233 - DNA, 10 bp, Unknown
  misc_feature (1)..( 10): Matrix.001 file - promoters70/1573945
tttaaaattt

SEQ ID NO: 39234 - DNA, 9 bp, Unknown
  misc_feature (1)..( 9): Matrix.001 file - promoters70/1573980
agtaagata

SEQ ID NO: 39235 - DNA, 9 bp, Unknown
  misc_feature (1)..( 9): Matrix.001 file - promoters70/1573980
taagagtta

SEQ ID NO: 39236 - DNA, 10 bp, Unknown
  misc_feature (1)..( 10): Matrix.001 file - promoters70/1573980
tataaatact

SEQ ID NO: 39237 - DNA, 10 bp, Unknown
  misc_feature (1)..( 10): Matrix.001 file - promoters70/1573980
gtatataaat

SEQ ID NO: 39238 - DNA, 8 bp, Unknown
  misc_feature (1)..( 8): Matrix.001 file - promoters70/1573980
ttacaata

SEQ ID NO: 39239 - DNA, 7 bp, Unknown
  misc_feature (1)..( 7): Matrix.001 file - promoters70/1574029
atgtgga

SEQ ID NO: 39240 - DNA, 8 bp, Unknown
  misc_feature (1)..( 8): Matrix.001 file - promoters70/1580500
catataaa

SEQ ID NO: 39241 - DNA, 9 bp, Unknown
  misc_feature (1)..( 9): Matrix.001 file - promoters70/1580500
taaataaaa

SEQ ID NO: 39242 - DNA, 9 bp, Unknown
  misc_feature (1)..( 9): Matrix.001 file - promoters70/1580500
taataaata

SEQ ID NO: 39243 - DNA, 13 bp, Unknown
  misc_feature (1)..( 13): Matrix.001 file - promoters70/1580932
cagattcggattc

SEQ ID NO: 39244 - DNA, 8 bp, Unknown
  misc_feature (1)..( 8): Matrix.001 file - promoters70/1580932
gaaaagga

SEQ ID NO: 39245 - DNA, 8 bp, Unknown
  misc_feature (1)..( 8): Matrix.001 file - promoters70/1580932
accacaaa

SEQ ID NO: 39246 - DNA, 9 bp, Unknown
  misc_feature (1)..( 9): Matrix.001 file - promoters70/1580932
aaaaaaaaa

SEQ ID NO: 39247 - DNA, 8 bp, Unknown
  misc_feature (1)..( 8): Matrix.001 file - promoters70/1580932
tcatttaa

SEQ ID NO: 39248 - DNA, 7 bp, Unknown
  misc_feature (1)..( 7): Matrix.001 file - promoters70/1580932
aaaaacc

SEQ ID NO: 39249 - DNA, 8 bp, Unknown
  misc_feature (1)..( 8): Matrix.001 file - promoters70/1580932
tttcaata

SEQ ID NO: 39250 - DNA, 10 bp, Unknown
  misc_feature (1)..( 10): Matrix.001 file - promoters70/1580932
aaatttatta

SEQ ID NO: 39251 - DNA, 7 bp, Unknown
  misc_feature (1)..( 7): Matrix.001 file - promoters70/1581987
gataatg

SEQ ID NO: 39252 - DNA, 8 bp, Unknown
  misc_feature (1)..( 8): Matrix.001 file - promoters70/1582576
taaaataa

SEQ ID NO: 39253 - DNA, 7 bp, Unknown
  misc_feature (1)..( 7): Matrix.001 file - promoters70/1582576
aataaaa

SEQ ID NO: 39254 - DNA, 11 bp, Unknown
  misc_feature (1)..( 11): Matrix.001 file - promoters70/1595707
aataccaatca

SEQ ID NO: 39255 - DNA, 7 bp, Unknown
  misc_feature (1)..( 7): Matrix.001 file - promoters70/1595707
gacaaaa

SEQ ID NO: 39256 - DNA, 9 bp, Unknown
  misc_feature (1)..( 9): Matrix.001 file - promoters70/1595707
acaaaaaaa

SEQ ID NO: 39257 - DNA, 13 bp, Unknown
  misc_feature (1)..( 13): Matrix.001 file - promoters70/1595741
cttagaaatcctt

SEQ ID NO: 39258 - DNA, 7 bp, Unknown
  misc_feature (1)..( 7): Matrix.001 file - promoters70/1595772
atttaaa

SEQ ID NO: 39259 - DNA, 7 bp, Unknown
  misc_feature (1)..( 7): Matrix.001 file - promoters70/1595772
aaaacaa

SEQ ID NO: 39260 - DNA, 9 bp, Unknown
  misc_feature (1)..( 9): Matrix.001 file - promoters70/1595772
atataaata

SEQ ID NO: 39261 - DNA, 9 bp, Unknown
  misc_feature (1)..( 9): Matrix.001 file - promoters70/1595794
taaaaaatt

SEQ ID NO: 39262 - DNA, 10 bp, Unknown
  misc_feature (1)..( 10): Matrix.001 file - promoters70/1662827
ttttcataat

SEQ ID NO: 39263 - DNA, 10 bp, Unknown
  misc_feature (1)..( 10): Matrix.001 file - promoters70/1662827
agttaataaa

SEQ ID NO: 39264 - DNA, 6 bp, Unknown
  misc_feature (1)..( 6): Matrix.001 file - promoters70/1662827
tacatt

SEQ ID NO: 39265 - DNA, 7 bp, Unknown
  misc_feature (1)..( 7): Matrix.001 file - promoters70/1662827
tttttac

SEQ ID NO: 39266 - DNA, 8 bp, Unknown
  misc_feature (1)..( 8): Matrix.001 file - promoters70/1662827
agacaaaa

SEQ ID NO: 39267 - DNA, 9 bp, Unknown
  misc_feature (1)..( 9): Matrix.001 file - promoters70/1662917
tagagaaat

SEQ ID NO: 39268 - DNA, 8 bp, Unknown
  misc_feature (1)..( 8): Matrix.001 file - promoters70/1662917
atttgtta

SEQ ID NO: 39269 - DNA, 8 bp, Unknown
  misc_feature (1)..( 8): Matrix.001 file - promoters70/1662917
attttaaa

SEQ ID NO: 39270 - DNA, 9 bp, Unknown
  misc_feature (1)..( 9): Matrix.001 file - promoters70/1662917
ttttgatga

SEQ ID NO: 39271 - DNA, 11 bp, Unknown
  misc_feature (1)..( 11): Matrix.001 file - promoters70/1662917
attttcataaa

SEQ ID NO: 39272 - DNA, 17 bp, Unknown
  misc_feature (1)..( 17): Matrix.001 file - promoters70/1662917
taaatgttaaaattatt

SEQ ID NO: 39273 - DNA, 13 bp, Unknown
  misc_feature (1)..( 13): Matrix.001 file - promoters70/1662917
taatccaacggca

SEQ ID NO: 39274 - DNA, 6 bp, Unknown
  misc_feature (1)..( 6): Matrix.001 file - promoters70/1662917
tatata

SEQ ID NO: 39275 - DNA, 10 bp, Unknown
  misc_feature (1)..( 10): Matrix.001 file - promoters70/1662917
tataaacaaa

SEQ ID NO: 39276 - DNA, 8 bp, Unknown
  misc_feature (1)..( 8): Matrix.001 file - promoters70/1662917
aaattctc

SEQ ID NO: 39277 - DNA, 11 bp, Unknown
  misc_feature (1)..( 11): Matrix.001 file - promoters70/1662917
tttataagtat

SEQ ID NO: 39278 - DNA, 8 bp, Unknown
  misc_feature (1)..( 8): Matrix.001 file - promoters70/1662917
tgaatgta

SEQ ID NO: 39279 - DNA, 10 bp, Unknown
  misc_feature (1)..( 10): Matrix.001 file - promoters70/1662917
atttaaattg

SEQ ID NO: 39280 - DNA, 9 bp, Unknown
  misc_feature (1)..( 9): Matrix.001 file - promoters70/1663278
gttcttttt

SEQ ID NO: 39281 - DNA, 6 bp, Unknown
  misc_feature (1)..( 6): Matrix.001 file - promoters70/1663278
tagctt

SEQ ID NO: 39282 - DNA, 7 bp, Unknown
  misc_feature (1)..( 7): Matrix.001 file - promoters70/1663353
aaaacaa

SEQ ID NO: 39283 - DNA, 8 bp, Unknown
  misc_feature (1)..( 8): Matrix.001 file - promoters70/1663353
catcgttt

SEQ ID NO: 39284 - DNA, 8 bp, Unknown
  misc_feature (1)..( 8): Matrix.001 file - promoters70/1663353
gattcttt

SEQ ID NO: 39285 - DNA, 9 bp, Unknown
  misc_feature (1)..( 9): Matrix.001 file - promoters70/1673798
aaactaaaa

SEQ ID NO: 39286 - DNA, 10 bp, Unknown
  misc_feature (1)..( 10): Matrix.001 file - promoters70/1673798
taaaataaaa

SEQ ID NO: 39287 - DNA, 7 bp, Unknown
  misc_feature (1)..( 7): Matrix.001 file - promoters70/1711228
aagattt

SEQ ID NO: 39288 - DNA, 12 bp, Unknown
  misc_feature (1)..( 12): Matrix.001 file - promoters70/1711228
tgtattttatgt

SEQ ID NO: 39289 - DNA, 7 bp, Unknown
  misc_feature (1)..( 7): Matrix.001 file - promoters70/1711228
tagtatt

SEQ ID NO: 39290 - DNA, 8 bp, Unknown
  misc_feature (1)..( 8): Matrix.001 file - promoters70/1711228
caataatg

SEQ ID NO: 39291 - DNA, 7 bp, Unknown
  misc_feature (1)..( 7): Matrix.001 file - promoters70/1711228
tgtattt

SEQ ID NO: 39292 - DNA, 10 bp, Unknown
  misc_feature (1)..( 10): Matrix.001 file - promoters70/1711228
acacaaaaaa

SEQ ID NO: 39293 - DNA, 9 bp, Unknown
  misc_feature (1)..( 9): Matrix.001 file - promoters70/1711318
attaatttc

SEQ ID NO: 39294 - DNA, 12 bp, Unknown
  misc_feature (1)..( 12): Matrix.001 file - promoters70/1711318
aaaggcccatat

SEQ ID NO: 39295 - DNA, 9 bp, Unknown
  misc_feature (1)..( 9): Matrix.001 file - promoters70/1711318
aaattgaga

SEQ ID NO: 39296 - DNA, 9 bp, Unknown
  misc_feature (1)..( 9): Matrix.001 file - promoters70/1711318
gaaaacaaa

SEQ ID NO: 39297 - DNA, 12 bp, Unknown
  misc_feature (1)..( 12): Matrix.001 file - promoters70/1711318
atttttaggccc

SEQ ID NO: 39298 - DNA, 9 bp, Unknown
  misc_feature (1)..( 9): Matrix.001 file - promoters70/1711318
gattggaaa

SEQ ID NO: 39299 - DNA, 12 bp, Unknown
  misc_feature (1)..( 12): Matrix.001 file - promoters70/1711318
atttataggccc

SEQ ID NO: 39300 - DNA, 7 bp, Unknown
  misc_feature (1)..( 7): Matrix.001 file - promoters70/1713842
tatttat

SEQ ID NO: 39301 - DNA, 8 bp, Unknown
  misc_feature (1)..( 8): Matrix.001 file - promoters70/1713842
caaacctg

SEQ ID NO: 39302 - DNA, 8 bp, Unknown
  misc_feature (1)..( 8): Matrix.001 file - promoters70/1713842
agatacag

SEQ ID NO: 39303 - DNA, 9 bp, Unknown
  misc_feature (1)..( 9): Matrix.001 file - promoters70/1713842
tttcaagtt

SEQ ID NO: 39304 - DNA, 8 bp, Unknown
  misc_feature (1)..( 8): Matrix.001 file - promoters70/1714694
ttgtatat

SEQ ID NO: 39305 - DNA, 7 bp, Unknown
  misc_feature (1)..( 7): Matrix.001 file - promoters70/1714694
tttgctt

SEQ ID NO: 39306 - DNA, 8 bp, Unknown
  misc_feature (1)..( 8): Matrix.001 file - promoters70/1714831
aaaatgca

SEQ ID NO: 39307 - DNA, 10 bp, Unknown
  misc_feature (1)..( 10): Matrix.001 file - promoters70/1714831
aagccgaatt

SEQ ID NO: 39308 - DNA, 10 bp, Unknown
  misc_feature (1)..( 10): Matrix.001 file - promoters70/1714831
catttgattt

SEQ ID NO: 39309 - DNA, 8 bp, Unknown
  misc_feature (1)..( 8): Matrix.001 file - promoters70/1714831
caaacctg

SEQ ID NO: 39310 - DNA, 8 bp, Unknown
  misc_feature (1)..( 8): Matrix.001 file - promoters70/1714831
agatacag

SEQ ID NO: 39311 - DNA, 9 bp, Unknown
  misc_feature (1)..( 9): Matrix.001 file - promoters70/1714831
tttcaagtt

SEQ ID NO: 39312 - DNA, 9 bp, Unknown
  misc_feature (1)..( 9): Matrix.001 file - promoters70/1714989
taaaaatat

SEQ ID NO: 39313 - DNA, 10 bp, Unknown
  misc_feature (1)..( 10): Matrix.001 file - promoters70/1714989
taaaaaaaat

SEQ ID NO: 39314 - DNA, 10 bp, Unknown
  misc_feature (1)..( 10): Matrix.001 file - promoters70/1714989
caaaccaaaa

SEQ ID NO: 39315 - DNA, 12 bp, Unknown
  misc_feature (1)..( 12): Matrix.001 file - promoters70/1714989
tttacaaaaaaa

SEQ ID NO: 39316 - DNA, 10 bp, Unknown
  misc_feature (1)..( 10): Matrix.001 file - promoters70/1714989
aaacaataaa

SEQ ID NO: 39317 - DNA, 12 bp, Unknown
  misc_feature (1)..( 12): Matrix.001 file - promoters70/1714989
aaaaatattatt

SEQ ID NO: 39318 - DNA, 5 bp, Unknown
  misc_feature (1)..( 5): Matrix.001 file - promoters70/1714989
tttta

SEQ ID NO: 39319 - DNA, 9 bp, Unknown
  misc_feature (1)..( 9): Matrix.001 file - promoters70/1714989
aaaaatatg

SEQ ID NO: 39320 - DNA, 5 bp, Unknown
  misc_feature (1)..( 5): Matrix.001 file - promoters70/1714989
caaaa

SEQ ID NO: 39321 - DNA, 5 bp, Unknown
  misc_feature (1)..( 5): Matrix.001 file - promoters70/1714989
taaaa

SEQ ID NO: 39322 - DNA, 11 bp, Unknown
  misc_feature (1)..( 11): Matrix.001 file - promoters70/1714989
tagttaataaa

SEQ ID NO: 39323 - DNA, 11 bp, Unknown
  misc_feature (1)..( 11): Matrix.001 file - promoters70/1715347
atttagtttcc

SEQ ID NO: 39324 - DNA, 12 bp, Unknown
  misc_feature (1)..( 12): Matrix.001 file - promoters70/1715347
tctttaattaat

SEQ ID NO: 39325 - DNA, 8 bp, Unknown
  misc_feature (1)..( 8): Matrix.001 file - promoters70/1715347
aaaatatc

SEQ ID NO: 39326 - DNA, 13 bp, Unknown
  misc_feature (1)..( 13): Matrix.001 file - promoters70/1715347
aacatcttaaatc

SEQ ID NO: 39327 - DNA, 10 bp, Unknown
  misc_feature (1)..( 10): Matrix.001 file - promoters70/1715347
tctattattt

SEQ ID NO: 39328 - DNA, 8 bp, Unknown
  misc_feature (1)..( 8): Matrix.001 file - promoters70/1715482
aattcaaa

SEQ ID NO: 39329 - DNA, 9 bp, Unknown
  misc_feature (1)..( 9): Matrix.001 file - promoters70/1715482
aaaacaact

SEQ ID NO: 39330 - DNA, 11 bp, Unknown
  misc_feature (1)..( 11): Matrix.001 file - promoters70/1715535
caaattttcac

SEQ ID NO: 39331 - DNA, 11 bp, Unknown
  misc_feature (1)..( 11): Matrix.001 file - promoters70/1715535
ctctgaacaat

SEQ ID NO: 39332 - DNA, 9 bp, Unknown
  misc_feature (1)..( 9): Matrix.001 file - promoters70/1807771
caaaatatt

SEQ ID NO: 39333 - DNA, 9 bp, Unknown
  misc_feature (1)..( 9): Matrix.001 file - promoters70/1807771
gtcatttaa

SEQ ID NO: 39334 - DNA, 10 bp, Unknown
  misc_feature (1)..( 10): Matrix.001 file - promoters70/1807771
aaacttatac

SEQ ID NO: 39335 - DNA, 9 bp, Unknown
  misc_feature (1)..( 9): Matrix.001 file - promoters70/1807771
atttaattc

SEQ ID NO: 39336 - DNA, 10 bp, Unknown
  misc_feature (1)..( 10): Matrix.001 file - promoters70/1807771
tccaagtaaa

SEQ ID NO: 39337 - DNA, 12 bp, Unknown
  misc_feature (1)..( 12): Matrix.001 file - promoters70/1807771
tttgtttttttt

SEQ ID NO: 39338 - DNA, 7 bp, Unknown
  misc_feature (1)..( 7): Matrix.001 file - promoters70/1807774
aaatttt

SEQ ID NO: 39339 - DNA, 8 bp, Unknown
  misc_feature (1)..( 8): Matrix.001 file - promoters70/1807774
ataccaac

SEQ ID NO: 39340 - DNA, 10 bp, Unknown
  misc_feature (1)..( 10): Matrix.001 file - promoters70/1807774
ttttggaaat

SEQ ID NO: 39341 - DNA, 10 bp, Unknown
  misc_feature (1)..( 10): Matrix.001 file - promoters70/1807774
taaaaatttt

SEQ ID NO: 39342 - DNA, 10 bp, Unknown
  misc_feature (1)..( 10): Matrix.001 file - promoters70/1808137
ggtttatttt

SEQ ID NO: 39343 - DNA, 12 bp, Unknown
  misc_feature (1)..( 12): Matrix.001 file - promoters70/1808156
gtttctttatct

SEQ ID NO: 39344 - DNA, 10 bp, Unknown
  misc_feature (1)..( 10): Matrix.001 file - promoters70/1808156
ggtataaaaa

SEQ ID NO: 39345 - DNA, 7 bp, Unknown
  misc_feature (1)..( 7): Matrix.001 file - promoters70/1808156
tttaaca

SEQ ID NO: 39346 - DNA, 10 bp, Unknown
  misc_feature (1)..( 10): Matrix.001 file - promoters70/1808156
agattttttg

SEQ ID NO: 39347 - DNA, 8 bp, Unknown
  misc_feature (1)..( 8): Matrix.001 file - promoters70/1808156
aatatgaa

SEQ ID NO: 39348 - DNA, 12 bp, Unknown
  misc_feature (1)..( 12): Matrix.001 file - promoters70/1808172
aattaaccatga

SEQ ID NO: 39349 - DNA, 7 bp, Unknown
  misc_feature (1)..( 7): Matrix.001 file - promoters70/1808172
tctttct

SEQ ID NO: 39350 - DNA, 8 bp, Unknown
  misc_feature (1)..( 8): Matrix.001 file - promoters70/1808172
acaaaaca

SEQ ID NO: 39351 - DNA, 8 bp, Unknown
  misc_feature (1)..( 8): Matrix.001 file - promoters70/1808172
caattata

SEQ ID NO: 39352 - DNA, 7 bp, Unknown
  misc_feature (1)..( 7): Matrix.001 file - promoters70/1808172
ctctttc

SEQ ID NO: 39353 - DNA, 8 bp, Unknown
  misc_feature (1)..( 8): Matrix.001 file - promoters70/1808172
tatatata

SEQ ID NO: 39354 - DNA, 9 bp, Unknown
  misc_feature (1)..( 9): Matrix.001 file - promoters70/1808172
aaattttga

SEQ ID NO: 39355 - DNA, 9 bp, Unknown
  misc_feature (1)..( 9): Matrix.001 file - promoters70/1808172
tatgagaaa

SEQ ID NO: 39356 - DNA, 7 bp, Unknown
  misc_feature (1)..( 7): Matrix.001 file - promoters70/1808172
ttgtttt

SEQ ID NO: 39357 - DNA, 7 bp, Unknown
  misc_feature (1)..( 7): Matrix.001 file - promoters70/1808172
attttta

SEQ ID NO: 39358 - DNA, 9 bp, Unknown
  misc_feature (1)..( 9): Matrix.001 file - promoters70/1808172
agttaactt

SEQ ID NO: 39359 - DNA, 9 bp, Unknown
  misc_feature (1)..( 9): Matrix.001 file - promoters70/1808184
tctttataa

SEQ ID NO: 39360 - DNA, 10 bp, Unknown
  misc_feature (1)..( 10): Matrix.001 file - promoters70/1808184
tttaacaaga

SEQ ID NO: 39361 - DNA, 8 bp, Unknown
  misc_feature (1)..( 8): Matrix.001 file - promoters70/1808184
atttacaa

SEQ ID NO: 39362 - DNA, 10 bp, Unknown
  misc_feature (1)..( 10): Matrix.001 file - promoters70/1808184
agataattaa

SEQ ID NO: 39363 - DNA, 10 bp, Unknown
  misc_feature (1)..( 10): Matrix.001 file - promoters70/1809222
attaatttat

SEQ ID NO: 39364 - DNA, 8 bp, Unknown
  misc_feature (1)..( 8): Matrix.001 file - promoters70/1957018
ctttttaa

SEQ ID NO: 39365 - DNA, 9 bp, Unknown
  misc_feature (1)..( 9): Matrix.001 file - promoters70/1957018
gttcttttt

SEQ ID NO: 39366 - DNA, 9 bp, Unknown
  misc_feature (1)..( 9): Matrix.001 file - promoters70/1957018
aaagatttt

SEQ ID NO: 39367 - DNA, 9 bp, Unknown
  misc_feature (1)..( 9): Matrix.001 file - promoters70/1957018
cagtagaga

SEQ ID NO: 39368 - DNA, 10 bp, Unknown
  misc_feature (1)..( 10): Matrix.001 file - promoters70/1957018
tatggataga

SEQ ID NO: 39369 - DNA, 9 bp, Unknown
  misc_feature (1)..( 9): Matrix.001 file - promoters70/1957212
gattcttac

SEQ ID NO: 39370 - DNA, 9 bp, Unknown
  misc_feature (1)..( 9): Matrix.001 file - promoters70/1957212
tatttaaac

SEQ ID NO: 39371 - DNA, 8 bp, Unknown
  misc_feature (1)..( 8): Matrix.001 file - promoters70/1957212
agagaaac

SEQ ID NO: 39372 - DNA, 9 bp, Unknown
  misc_feature (1)..( 9): Matrix.001 file - promoters70/1975923
aaaatatca

SEQ ID NO: 39373 - DNA, 10 bp, Unknown
  misc_feature (1)..( 10): Matrix.001 file - promoters70/1975923
ttaataaaat

SEQ ID NO: 39374 - DNA, 11 bp, Unknown
  misc_feature (1)..( 11): Matrix.001 file - promoters70/1975923
aaaataaacta

SEQ ID NO: 39375 - DNA, 9 bp, Unknown
  misc_feature (1)..( 9): Matrix.001 file - promoters70/1976000
aaaacaatt

SEQ ID NO: 39376 - DNA, 11 bp, Unknown
  misc_feature (1)..( 11): Matrix.001 file - promoters70/1976019
aatcactcctt

SEQ ID NO: 39377 - DNA, 7 bp, Unknown
  misc_feature (1)..( 7): Matrix.001 file - promoters70/1976019
ataaaaa

SEQ ID NO: 39378 - DNA, 9 bp, Unknown
  misc_feature (1)..( 9): Matrix.001 file - promoters70/1976019
taaaaaaaa

SEQ ID NO: 39379 - DNA, 10 bp, Unknown
  misc_feature (1)..( 10): Matrix.001 file - promoters70/1976078
ccagatacag

SEQ ID NO: 39380 - DNA, 12 bp, Unknown
  misc_feature (1)..( 12): Matrix.001 file - promoters70/1976078
aaatccaaaccc

SEQ ID NO: 39381 - DNA, 9 bp, Unknown
  misc_feature (1)..( 9): Matrix.001 file - promoters70/1976078
acttttttt

SEQ ID NO: 39382 - DNA, 4 bp, Unknown
  misc_feature (1)..( 4): Matrix.001 file - promoters70/1976078
attg

SEQ ID NO: 39383 - DNA, 9 bp, Unknown
  misc_feature (1)..( 9): Matrix.001 file - promoters70/1976078
tttcaagtt

SEQ ID NO: 39384 - DNA, 18 bp, Unknown
  misc_feature (1)..( 18): Matrix.001 file - promoters70/1976333
gataaagactcaatattt

SEQ ID NO: 39385 - DNA, 15 bp, Unknown
  misc_feature (1)..( 15): Matrix.001 file - promoters70/1976387
ctaaaggcccaataa

SEQ ID NO: 39386 - DNA, 7 bp, Unknown
  misc_feature (1)..( 7): Matrix.001 file - promoters70/1976387
tatcaaa

SEQ ID NO: 39387 - DNA, 12 bp, Unknown
  misc_feature (1)..( 12): Matrix.001 file - promoters70/1976387
tgaatttgagat

SEQ ID NO: 39388 - DNA, 8 bp, Unknown
  misc_feature (1)..( 8): Matrix.001 file - promoters70/1976457
tatataat

SEQ ID NO: 39389 - DNA, 13 bp, Unknown
  misc_feature (1)..( 13): Matrix.001 file - promoters70/1976457
agaaaaaaaaatg

SEQ ID NO: 39390 - DNA, 11 bp, Unknown
  misc_feature (1)..( 11): Matrix.001 file - promoters70/1976496
tcctatgattt

SEQ ID NO: 39391 - DNA, 12 bp, Unknown
  misc_feature (1)..( 12): Matrix.001 file - promoters70/1976496
taaatcttttga

SEQ ID NO: 39392 - DNA, 8 bp, Unknown
  misc_feature (1)..( 8): Matrix.001 file - promoters70/2026771
aaataaaa

SEQ ID NO: 39393 - DNA, 9 bp, Unknown
  misc_feature (1)..( 9): Matrix.001 file - promoters70/2029031
ttaataaaa

SEQ ID NO: 39394 - DNA, 14 bp, Unknown
  misc_feature (1)..( 14): Matrix.001 file - promoters70/2029031
tactattaataaaa

SEQ ID NO: 39395 - DNA, 12 bp, Unknown
  misc_feature (1)..( 12): Matrix.001 file - promoters70/2029033
atttatttcctt

SEQ ID NO: 39396 - DNA, 8 bp, Unknown
  misc_feature (1)..( 8): Matrix.001 file - promoters70/2029033
tattctat

SEQ ID NO: 39397 - DNA, 7 bp, Unknown
  misc_feature (1)..( 7): Matrix.001 file - promoters70/2029033
tttctat

SEQ ID NO: 39398 - DNA, 11 bp, Unknown
  misc_feature (1)..( 11): Matrix.001 file - promoters70/2029079
tcataattaat

SEQ ID NO: 39399 - DNA, 8 bp, Unknown
  misc_feature (1)..( 8): Matrix.001 file - promoters70/2029079
ccaatttt

SEQ ID NO: 39400 - DNA, 8 bp, Unknown
  misc_feature (1)..( 8): Matrix.001 file - promoters70/2104991
aaatttca

SEQ ID NO: 39401 - DNA, 8 bp, Unknown
  misc_feature (1)..( 8): Matrix.001 file - promoters70/2104991
taaatcag

SEQ ID NO: 39402 - DNA, 14 bp, Unknown
  misc_feature (1)..( 14): Matrix.001 file - promoters70/2104991
taaaagtttgatat

SEQ ID NO: 39403 - DNA, 14 bp, Unknown
  misc_feature (1)..( 14): Matrix.001 file - promoters70/2104991
taaaagtttgatat

SEQ ID NO: 39404 - DNA, 10 bp, Unknown
  misc_feature (1)..( 10): Matrix.001 file - promoters70/2105398
aaatacattt

SEQ ID NO: 39405 - DNA, 8 bp, Unknown
  misc_feature (1)..( 8): Matrix.001 file - promoters70/2105514
actcttat

SEQ ID NO: 39406 - DNA, 10 bp, Unknown
  misc_feature (1)..( 10): Matrix.001 file - promoters70/2105514
aaaagttttg

SEQ ID NO: 39407 - DNA, 13 bp, Unknown
  misc_feature (1)..( 13): Matrix.001 file - promoters70/2105514
tatataaatacgc

SEQ ID NO: 39408 - DNA, 11 bp, Unknown
  misc_feature (1)..( 11): Matrix.001 file - promoters70/2105535
tatcaaagaaa

SEQ ID NO: 39409 - DNA, 9 bp, Unknown
  misc_feature (1)..( 9): Matrix.001 file - promoters70/2105535
caaacaaaa

SEQ ID NO: 39410 - DNA, 11 bp, Unknown
  misc_feature (1)..( 11): Matrix.001 file - promoters70/2105535
ctaatatgtac

SEQ ID NO: 39411 - DNA, 7 bp, Unknown
  misc_feature (1)..( 7): Matrix.001 file - promoters70/2106017
caactaa

SEQ ID NO: 39412 - DNA, 8 bp, Unknown
  misc_feature (1)..( 8): Matrix.001 file - promoters70/2106017
aaaacttt

SEQ ID NO: 39413 - DNA, 10 bp, Unknown
  misc_feature (1)..( 10): Matrix.001 file - promoters70/2113502
ctataaaaat

SEQ ID NO: 39414 - DNA, 10 bp, Unknown
  misc_feature (1)..( 10): Matrix.001 file - promoters70/2113502
tattaaaaaa

SEQ ID NO: 39415 - DNA, 11 bp, Unknown
  misc_feature (1)..( 11): Matrix.001 file - promoters70/2113502
aaaaagcccaa

SEQ ID NO: 39416 - DNA, 11 bp, Unknown
  misc_feature (1)..( 11): Matrix.001 file - promoters70/2113502
ggcctatatac

SEQ ID NO: 39417 - DNA, 12 bp, Unknown
  misc_feature (1)..( 12): Matrix.001 file - promoters70/2113502
atttaaatcttt

SEQ ID NO: 39418 - DNA, 8 bp, Unknown
  misc_feature (1)..( 8): Matrix.001 file - promoters70/2113620
gaaggaag

SEQ ID NO: 39419 - DNA, 9 bp, Unknown
  misc_feature (1)..( 9): Matrix.001 file - promoters70/2113734
aattaaaga

SEQ ID NO: 39420 - DNA, 11 bp, Unknown
  misc_feature (1)..( 11): Matrix.001 file - promoters70/2113734
aattaaaataa

SEQ ID NO: 39421 - DNA, 8 bp, Unknown
  misc_feature (1)..( 8): Matrix.001 file - promoters70/2113846
tataattt

SEQ ID NO: 39422 - DNA, 9 bp, Unknown
  misc_feature (1)..( 9): Matrix.001 file - promoters70/2113846
aatttaacg

SEQ ID NO: 39423 - DNA, 13 bp, Unknown
  misc_feature (1)..( 13): Matrix.001 file - promoters70/2113889
aaaatttagaaat

SEQ ID NO: 39424 - DNA, 10 bp, Unknown
  misc_feature (1)..( 10): Matrix.001 file - promoters70/2113889
attaactttg

SEQ ID NO: 39425 - DNA, 7 bp, Unknown
  misc_feature (1)..( 7): Matrix.001 file - promoters70/2113889
aaaaata

SEQ ID NO: 39426 - DNA, 11 bp, Unknown
  misc_feature (1)..( 11): Matrix.001 file - promoters70/2113889
aaaatgaaaaa

SEQ ID NO: 39427 - DNA, 10 bp, Unknown
  misc_feature (1)..( 10): Matrix.001 file - promoters70/2113889
tatatataaa

SEQ ID NO: 39428 - DNA, 7 bp, Unknown
  misc_feature (1)..( 7): Matrix.001 file - promoters70/2113889
caataaa

SEQ ID NO: 39429 - DNA, 7 bp, Unknown
  misc_feature (1)..( 7): Matrix.001 file - promoters70/2113889
attaatg

SEQ ID NO: 39430 - DNA, 7 bp, Unknown
  misc_feature (1)..( 7): Matrix.001 file - promoters70/2114095
aatcttt

SEQ ID NO: 39431 - DNA, 9 bp, Unknown
  misc_feature (1)..( 9): Matrix.001 file - promoters70/2114095
aaaaaatct

SEQ ID NO: 39432 - DNA, 8 bp, Unknown
  misc_feature (1)..( 8): Matrix.001 file - promoters70/2114200
catcaatc

SEQ ID NO: 39433 - DNA, 9 bp, Unknown
  misc_feature (1)..( 9): Matrix.001 file - promoters70/2114200
tgctatata

SEQ ID NO: 39434 - DNA, 11 bp, Unknown
  misc_feature (1)..( 11): Matrix.001 file - promoters70/2187156
ccataattaag

SEQ ID NO: 39435 - DNA, 16 bp, Unknown
  misc_feature (1)..( 16): Matrix.001 file - promoters70/2217732
tccaatataaagataa

SEQ ID NO: 39436 - DNA, 7 bp, Unknown
  misc_feature (1)..( 7): Matrix.001 file - promoters70/2217817
atagatt

SEQ ID NO: 39437 - DNA, 8 bp, Unknown
  misc_feature (1)..( 8): Matrix.001 file - promoters70/2217996
caaacctg

SEQ ID NO: 39438 - DNA, 8 bp, Unknown
  misc_feature (1)..( 8): Matrix.001 file - promoters70/2217996
agatacag

SEQ ID NO: 39439 - DNA, 9 bp, Unknown
  misc_feature (1)..( 9): Matrix.001 file - promoters70/2217996
tttcaagtt

SEQ ID NO: 39440 - DNA, 8 bp, Unknown
  misc_feature (1)..( 8): Matrix.001 file - promoters70/2218260
acaaaatt

SEQ ID NO: 39441 - DNA, 10 bp, Unknown
  misc_feature (1)..( 10): Matrix.001 file - promoters70/2218260
ctatatataa

SEQ ID NO: 39442 - DNA, 14 bp, Unknown
  misc_feature (1)..( 14): Matrix.001 file - promoters70/2218260
aaaaaaaaaaagtt

SEQ ID NO: 39443 - DNA, 7 bp, Unknown
  misc_feature (1)..( 7): Matrix.001 file - promoters70/2218260
aaattat

SEQ ID NO: 39444 - DNA, 10 bp, Unknown
  misc_feature (1)..( 10): Matrix.001 file - promoters70/2218271
catatataaa

SEQ ID NO: 39445 - DNA, 13 bp, Unknown
  misc_feature (1)..( 13): Matrix.001 file - promoters70/2218271
taaagttataaat

SEQ ID NO: 39446 - DNA, 10 bp, Unknown
  misc_feature (1)..( 10): Matrix.001 file - promoters70/2218271
ataaaaataa

SEQ ID NO: 39447 - DNA, 8 bp, Unknown
  misc_feature (1)..( 8): Matrix.001 file - promoters70/2218271
aggcccaa

SEQ ID NO: 39448 - DNA, 10 bp, Unknown
  misc_feature (1)..( 10): Matrix.001 file - promoters70/2685931
taaatgataa

SEQ ID NO: 39449 - DNA, 8 bp, Unknown
  misc_feature (1)..( 8): Matrix.001 file - promoters70/2685931
tctttgaa

SEQ ID NO: 39450 - DNA, 8 bp, Unknown
  misc_feature (1)..( 8): Matrix.001 file - promoters70/2685931
acattaaa

SEQ ID NO: 39451 - DNA, 7 bp, Unknown
  misc_feature (1)..( 7): Matrix.001 file - promoters70/2685951
aaataag

SEQ ID NO: 39452 - DNA, 7 bp, Unknown
  misc_feature (1)..( 7): Matrix.001 file - promoters70/2724699
cattatc

SEQ ID NO: 39453 - DNA, 9 bp, Unknown
  misc_feature (1)..( 9): Matrix.001 file - promoters70/2724699
aaatgtttt

SEQ ID NO: 39454 - DNA, 9 bp, Unknown
  misc_feature (1)..( 9): Matrix.001 file - promoters70/2918658
acattatca

SEQ ID NO: 39455 - DNA, 9 bp, Unknown
  misc_feature (1)..( 9): Matrix.001 file - promoters70/2918680
caaaaaaaa

SEQ ID NO: 39456 - DNA, 10 bp, Unknown
  misc_feature (1)..( 10): Matrix.001 file - promoters70/2990263
tcgaagaaag

SEQ ID NO: 39457 - DNA, 9 bp, Unknown
  misc_feature (1)..( 9): Matrix.001 file - promoters70/2990263
aaagaagaa

SEQ ID NO: 39458 - DNA, 7 bp, Unknown
  misc_feature (1)..( 7): Matrix.001 file - promoters70/2990611
tttgttt

SEQ ID NO: 39459 - DNA, 13 bp, Unknown
  misc_feature (1)..( 13): Matrix.001 file - promoters70/2990611
ccataaaggaaaa

SEQ ID NO: 39460 - DNA, 8 bp, Unknown
  misc_feature (1)..( 8): Matrix.001 file - promoters70/2990611
tttcttta

SEQ ID NO: 39461 - DNA, 8 bp, Unknown
  misc_feature (1)..( 8): Matrix.001 file - promoters70/2990611
tttatttt

SEQ ID NO: 39462 - DNA, 9 bp, Unknown
  misc_feature (1)..( 9): Matrix.001 file - promoters70/2990611
ataataagt

SEQ ID NO: 39463 - DNA, 9 bp, Unknown
  misc_feature (1)..( 9): Matrix.001 file - promoters70/2990611
aataagttt

SEQ ID NO: 39464 - DNA, 10 bp, Unknown
  misc_feature (1)..( 10): Matrix.001 file - promoters70/2991239
tcaataaatg

SEQ ID NO: 39465 - DNA, 10 bp, Unknown
  misc_feature (1)..( 10): Matrix.001 file - promoters70/2991239
ttaaaaaaaa

SEQ ID NO: 39466 - DNA, 33 bp, Unknown; identical to SEQ ID NO: 37194
  misc_feature (1)..( 33): Matrix.001 file - promoters70/2991239

SEQ ID NO: 39467 - DNA, 32 bp, Unknown; identical to SEQ ID NO: 37195
  misc_feature (1)..( 32): Matrix.001 file - promoters70/2991239

SEQ ID NO: 39468 - DNA, 15 bp, Unknown
  misc_feature (1)..( 15): Matrix.001 file - promoters70/2991239
attgaagacttttca

SEQ ID NO: 39469 - DNA, 14 bp, Unknown
  misc_feature (1)..( 14): Matrix.001 file - promoters70/2991239
ctataagcatttaa

SEQ ID NO: 39470 - DNA, 25 bp, Unknown
  misc_feature (1)..( 25): Matrix.001 file - promoters70/2991239
agcatttaagtctatcgctagactg

SEQ ID NO: 39471 - DNA, 13 bp, Unknown
  misc_feature (1)..( 13): Matrix.001 file - promoters70/2991489
caaaaaggcccaa

SEQ ID NO: 39472 - DNA, 8 bp, Unknown
  misc_feature (1)..( 8): Matrix.001 file - promoters70/2992101
tttcttat

SEQ ID NO: 39473 - DNA, 8 bp, Unknown
  misc_feature (1)..( 8): Matrix.001 file - promoters70/2992101
tcttttct

SEQ ID NO: 39474 - DNA, 9 bp, Unknown
  misc_feature (1)..( 9): Matrix.001 file - promoters70/2992247
cttagatat

SEQ ID NO: 39475 - DNA, 6 bp, Unknown
  misc_feature (1)..( 6): Matrix.001 file - promoters70/2992247
atcttc

SEQ ID NO: 39476 - DNA, 9 bp, Unknown
  misc_feature (1)..( 9): Matrix.001 file - promoters70/2992247
tgagttttt

SEQ ID NO: 39477 - DNA, 6 bp, Unknown
  misc_feature (1)..( 6): Matrix.001 file - promoters70/2992247
aaaatc

SEQ ID NO: 39478 - DNA, 9 bp, Unknown
  misc_feature (1)..( 9): Matrix.001 file - promoters70/2992247
aatttttgg

SEQ ID NO: 39479 - DNA, 9 bp, Unknown
  misc_feature (1)..( 9): Matrix.001 file - promoters70/2992247
aattggtta

SEQ ID NO: 39480 - DNA, 11 bp, Unknown
  misc_feature (1)..( 11): Matrix.001 file - promoters70/2992281
aaatcattaat

SEQ ID NO: 39481 - DNA, 11 bp, Unknown
  misc_feature (1)..( 11): Matrix.001 file - promoters70/2992281
tttaattttaa

SEQ ID NO: 39482 - DNA, 7 bp, Unknown
  misc_feature (1)..( 7): Matrix.001 file - promoters70/2992722
aatttac

SEQ ID NO: 39483 - DNA, 11 bp, Unknown
  misc_feature (1)..( 11): Matrix.001 file - promoters70/2992722
ataattgtata

SEQ ID NO: 39484 - DNA, 10 bp, Unknown
  misc_feature (1)..( 10): Matrix.001 file - promoters70/2992722
gaaatagatt

SEQ ID NO: 39485 - DNA, 8 bp, Unknown
  misc_feature (1)..( 8): Matrix.001 file - promoters70/2992722
aagctata

SEQ ID NO: 39486 - DNA, 9 bp, Unknown
  misc_feature (1)..( 9): Matrix.001 file - promoters70/2992722
ttattaatt

SEQ ID NO: 39487 - DNA, 7 bp, Unknown
  misc_feature (1)..( 7): Matrix.001 file - promoters70/2993642
ctttttc

SEQ ID NO: 39488 - DNA, 7 bp, Unknown
  misc_feature (1)..( 7): Matrix.001 file - promoters70/2993642
tatttat

SEQ ID NO: 39489 - DNA, 8 bp, Unknown
  misc_feature (1)..( 8): Matrix.001 file - promoters70/2993642
ccacgtgg

SEQ ID NO: 39490 - DNA, 14 bp, Unknown
  misc_feature (1)..( 14): Matrix.001 file - promoters70/2993642
tttatatattttta

SEQ ID NO: 39491 - DNA, 8 bp, Unknown
  misc_feature (1)..( 8): Matrix.001 file - promoters70/2993642
aaatgttt

SEQ ID NO: 39492 - DNA, 15 bp, Unknown
  misc_feature (1)..( 15): Matrix.001 file - promoters70/2996222
aaaaattattaaatt

SEQ ID NO: 39493 - DNA, 10 bp, Unknown
  misc_feature (1)..( 10): Matrix.001 file - promoters70/2996222
tttactaaaa

SEQ ID NO: 39494 - DNA, 8 bp, Unknown
  misc_feature (1)..( 8): Matrix.001 file - promoters70/2996222
ataatttt

SEQ ID NO: 39495 - DNA, 7 bp, Unknown
  misc_feature (1)..( 7): Matrix.001 file - promoters70/2996222
tatttta

SEQ ID NO: 39496 - DNA, 10 bp, Unknown
  misc_feature (1)..( 10): Matrix.001 file - promoters70/2996222
ctatatatat

SEQ ID NO: 39497 - DNA, 9 bp, Unknown
  misc_feature (1)..( 9): Matrix.001 file - promoters70/2996222
ctaatttta

SEQ ID NO: 39498 - DNA, 8 bp, Unknown
  misc_feature (1)..( 8): Matrix.001 file - promoters70/2996222
ttttgtta

SEQ ID NO: 39499 - DNA, 8 bp, Unknown
  misc_feature (1)..( 8): Matrix.001 file - promoters70/2996222
acaaaaaa

SEQ ID NO: 39500 - DNA, 10 bp, Unknown
  misc_feature (1)..( 10): Matrix.001 file - promoters70/2996222
aaaaaataat

SEQ ID NO: 39501 - DNA, 8 bp, Unknown
  misc_feature (1)..( 8): Matrix.001 file - promoters70/2996222
taattgaa

SEQ ID NO: 39502 - DNA, 9 bp, Unknown
  misc_feature (1)..( 9): Matrix.001 file - promoters70/2996222
aaaatattt

SEQ ID NO: 39503 - DNA, 7 bp, Unknown
  misc_feature (1)..( 7): Matrix.001 file - promoters70/2996222
attttgt

SEQ ID NO: 39504 - DNA, 8 bp, Unknown
  misc_feature (1)..( 8): Matrix.001 file - promoters70/2996222
aaaaaaat

SEQ ID NO: 39505 - DNA, 7 bp, Unknown
  misc_feature (1)..( 7): Matrix.001 file - promoters70/3003010
caatatt

SEQ ID NO: 39506 - DNA, 12 bp, Unknown
  misc_feature (1)..( 12): Matrix.001 file - promoters70/3043962
atttgaaatttt

SEQ ID NO: 39507 - DNA, 9 bp, Unknown
  misc_feature (1)..( 9): Matrix.001 file - promoters70/3043962
actatttaa

SEQ ID NO: 39508 - DNA, 8 bp, Unknown
  misc_feature (1)..( 8): Matrix.001 file - promoters70/3043962
ttataaaa

SEQ ID NO: 39509 - DNA, 8 bp, Unknown
  misc_feature (1)..( 8): Matrix.001 file - promoters70/3408983
aaatatga

SEQ ID NO: 39510 - DNA, 7 bp, Unknown
  misc_feature (1)..( 7): Matrix.001 file - promoters70/3409165
ttcataa

SEQ ID NO: 39511 - DNA, 7 bp, Unknown
  misc_feature (1)..( 7): Matrix.001 file - promoters70/3409489
cgaagaa

SEQ ID NO: 39512 - DNA, 8 bp, Unknown
  misc_feature (1)..( 8): Matrix.001 file - promoters70/3409489
acttcctt

SEQ ID NO: 39513 - DNA, 9 bp, Unknown
  misc_feature (1)..( 9): Matrix.001 file - promoters70/3409489
aaatgatta

SEQ ID NO: 39514 - DNA, 12 bp, Unknown
  misc_feature (1)..( 12): Matrix.001 file - promoters70/3433799
gattgataacag

SEQ ID NO: 39515 - DNA, 7 bp, Unknown
  misc_feature (1)..( 7): Matrix.001 file - promoters70/3433799
tggaaaa

SEQ ID NO: 39516 - DNA, 9 bp, Unknown
  misc_feature (1)..( 9): Matrix.001 file - promoters70/3433799
aaaccattt

SEQ ID NO: 39517 - DNA, 10 bp, Unknown
  misc_feature (1)..( 10): Matrix.001 file - promoters70/3433799
actttataat

SEQ ID NO: 39518 - DNA, 10 bp, Unknown
  misc_feature (1)..( 10): Matrix.001 file - promoters70/3433904
acattctaca

SEQ ID NO: 39519 - DNA, 8 bp, Unknown
  misc_feature (1)..( 8): Matrix.001 file - promoters70/3433904
tataaaag

SEQ ID NO: 39520 - DNA, 10 bp, Unknown
  misc_feature (1)..( 10): Matrix.001 file - promoters70/3433944
aaacttaaga

SEQ ID NO: 39521 - DNA, 8 bp, Unknown
  misc_feature (1)..( 8): Matrix.001 file - promoters70/3433944
attttttt

SEQ ID NO: 39522 - DNA, 9 bp, Unknown
  misc_feature (1)..( 9): Matrix.001 file - promoters70/3433944
agatattaa

SEQ ID NO: 39523 - DNA, 11 bp, Unknown
  misc_feature (1)..( 11): Matrix.001 file - promoters70/3433944
ttcaaaatttc

SEQ ID NO: 39524 - DNA, 7 bp, Unknown
  misc_feature (1)..( 7): Matrix.001 file - promoters70/3433944
aaaagaa

SEQ ID NO: 39525 - DNA, 12 bp, Unknown
  misc_feature (1)..( 12): Matrix.001 file - promoters70/3434108
ataatttacttt

SEQ ID NO: 39526 - DNA, 7 bp, Unknown
  misc_feature (1)..( 7): Matrix.001 file - promoters70/3434108
acctaaa

SEQ ID NO: 39527 - DNA, 12 bp, Unknown
  misc_feature (1)..( 12): Matrix.001 file - promoters70/3434108
tattaaaaaaat

SEQ ID NO: 39528 - DNA, 10 bp, Unknown
  misc_feature (1)..( 10): Matrix.001 file - promoters70/3434233
aaagcacata

SEQ ID NO: 39529 - DNA, 8 bp, Unknown
  misc_feature (1)..( 8): Matrix.001 file - promoters70/3434233
atatagat

SEQ ID NO: 39530 - DNA, 10 bp, Unknown
  misc_feature (1)..( 10): Matrix.001 file - promoters70/3434279
aaatataaaa

SEQ ID NO: 39531 - DNA, 13 bp, Unknown
  misc_feature (1)..( 13): Matrix.001 file - promoters70/3434279
agagaaaaaatat

SEQ ID NO: 39532 - DNA, 7 bp, Unknown
  misc_feature (1)..( 7): Matrix.001 file - promoters70/3434311
catcaga

SEQ ID NO: 39533 - DNA, 9 bp, Unknown
  misc_feature (1)..( 9): Matrix.001 file - promoters70/3434311
taatgttac

SEQ ID NO: 39534 - DNA, 11 bp, Unknown
  misc_feature (1)..( 11): Matrix.001 file - promoters70/3434311
atactttaagt

SEQ ID NO: 39535 - DNA, 11 bp, Unknown
  misc_feature (1)..( 11): Matrix.001 file - promoters70/3434400
aaaatctgttc

SEQ ID NO: 39536 - DNA, 9 bp, Unknown
  misc_feature (1)..( 9): Matrix.001 file - promoters70/3434400
aaagaacat

SEQ ID NO: 39537 - DNA, 10 bp, Unknown
  misc_feature (1)..( 10): Matrix.001 file - promoters70/3434400
actttataat

SEQ ID NO: 39538 - DNA, 12 bp, Unknown
  misc_feature (1)..( 12): Matrix.001 file - promoters70/3434563
tctttctgttca

SEQ ID NO: 39539 - DNA, 10 bp, Unknown
  misc_feature (1)..( 10): Matrix.001 file - promoters70/3434563
aaaaaagaaa

SEQ ID NO: 39540 - DNA, 9 bp, Unknown
  misc_feature (1)..( 9): Matrix.001 file - promoters70/3434563
cattttgta

SEQ ID NO: 39541 - DNA, 7 bp, Unknown
  misc_feature (1)..( 7): Matrix.001 file - promoters70/3435133
atagatt

SEQ ID NO: 39542 - DNA, 9 bp, Unknown
  misc_feature (1)..( 9): Matrix.001 file - promoters70/3435452
agaaatata

SEQ ID NO: 39543 - DNA, 7 bp, Unknown
  misc_feature (1)..( 7): Matrix.001 file - promoters70/3435452
ctaaaat

SEQ ID NO: 39544 - DNA, 9 bp, Unknown
  misc_feature (1)..( 9): Matrix.001 file - promoters70/3435452
agaaattat

SEQ ID NO: 39545 - DNA, 9 bp, Unknown
  misc_feature (1)..( 9): Matrix.001 file - promoters70/3435452
tatgctaaa

SEQ ID NO: 39546 - DNA, 12 bp, Unknown
  misc_feature (1)..( 12): Matrix.001 file - promoters70/3435452
ttaacttcatca

SEQ ID NO: 39547 - DNA, 10 bp, Unknown
  misc_feature (1)..( 10): Matrix.001 file - promoters70/3435469
ttttgaaaaa

SEQ ID NO: 39548 - DNA, 7 bp, Unknown
  misc_feature (1)..( 7): Matrix.001 file - promoters70/3435469
aacaaaa

SEQ ID NO: 39549 - DNA, 10 bp, Unknown
  misc_feature (1)..( 10): Matrix.001 file - promoters70/3435469
ttttgaccta

SEQ ID NO: 39550 - DNA, 7 bp, Unknown
  misc_feature (1)..( 7): Matrix.001 file - promoters70/3435469
tctttag

SEQ ID NO: 39551 - DNA, 11 bp, Unknown
  misc_feature (1)..( 11): Matrix.001 file - promoters70/3435469
cttatctcgtg

SEQ ID NO: 39552 - DNA, 8 bp, Unknown
  misc_feature (1)..( 8): Matrix.001 file - promoters70/3435469
aatttata

SEQ ID NO: 39553 - DNA, 11 bp, Unknown
  misc_feature (1)..( 11): Matrix.001 file - promoters70/3435534
aaacagagtaa

SEQ ID NO: 39554 - DNA, 11 bp, Unknown
  misc_feature (1)..( 11): Matrix.001 file - promoters70/3435534
gtctatgtgaa

SEQ ID NO: 39555 - DNA, 9 bp, Unknown
  misc_feature (1)..( 9): Matrix.001 file - promoters70/3435632
ttttctttg

SEQ ID NO: 39556 - DNA, 7 bp, Unknown
  misc_feature (1)..( 7): Matrix.001 file - promoters70/3435632
cttttta

SEQ ID NO: 39557 - DNA, 9 bp, Unknown
  misc_feature (1)..( 9): Matrix.001 file - promoters70/3435632
cttaagtca

SEQ ID NO: 39558 - DNA, 8 bp, Unknown
  misc_feature (1)..( 8): Matrix.001 file - promoters70/3435632
aaaaaatt

SEQ ID NO: 39559 - DNA, 8 bp, Unknown
  misc_feature (1)..( 8): Matrix.001 file - promoters70/3435632
aaataatt

SEQ ID NO: 39560 - DNA, 7 bp, Unknown
  misc_feature (1)..( 7): Matrix.001 file - promoters70/3435761
aaaaaaa

SEQ ID NO: 39561 - DNA, 8 bp, Unknown
  misc_feature (1)..( 8): Matrix.001 file - promoters70/3435829
ctaaaata

SEQ ID NO: 39562 - DNA, 8 bp, Unknown
  misc_feature (1)..( 8): Matrix.001 file - promoters70/3435829
attaacta

SEQ ID NO: 39563 - DNA, 8 bp, Unknown
  misc_feature (1)..( 8): Matrix.001 file - promoters70/3436196
aaatcttt

SEQ ID NO: 39564 - DNA, 7 bp, Unknown
  misc_feature (1)..( 7): Matrix.001 file - promoters70/3436196
actaaaa

SEQ ID NO: 39565 - DNA, 10 bp, Unknown
  misc_feature (1)..( 10): Matrix.001 file - promoters70/3436196
atcataaaat

SEQ ID NO: 39566 - DNA, 10 bp, Unknown
  misc_feature (1)..( 10): Matrix.001 file - promoters70/3437193
attgatgaga

SEQ ID NO: 39567 - DNA, 8 bp, Unknown
  misc_feature (1)..( 8): Matrix.001 file - promoters70/3437244
gaatcaac

SEQ ID NO: 39568 - DNA, 10 bp, Unknown
  misc_feature (1)..( 10): Matrix.001 file - promoters70/3437244
attttagttt

SEQ ID NO: 39569 - DNA, 10 bp, Unknown
  misc_feature (1)..( 10): Matrix.001 file - promoters70/3437331
cattttgttt

SEQ ID NO: 39570 - DNA, 8 bp, Unknown
  misc_feature (1)..( 8): Matrix.001 file - promoters70/3437710
tatccaag

SEQ ID NO: 39571 - DNA, 7 bp, Unknown
  misc_feature (1)..( 7): Matrix.001 file - promoters70/3438069
agaaagt

SEQ ID NO: 39572 - DNA, 8 bp, Unknown
  misc_feature (1)..( 8): Matrix.001 file - promoters70/3438069
tcaaaatc

SEQ ID NO: 39573 - DNA, 8 bp, Unknown
  misc_feature (1)..( 8): Matrix.001 file - promoters70/3438069
gttaattg

SEQ ID NO: 39574 - DNA, 9 bp, Unknown
  misc_feature (1)..( 9): Matrix.001 file - promoters70/3438171
agaatgtat

SEQ ID NO: 39575 - DNA, 8 bp, Unknown
  misc_feature (1)..( 8): Matrix.001 file - promoters70/3438171
atatatca

SEQ ID NO: 39576 - DNA, 8 bp, Unknown
  misc_feature (1)..( 8): Matrix.001 file - promoters70/3438171
taatattt

SEQ ID NO: 39577 - DNA, 6 bp, Unknown
  misc_feature (1)..( 6): Matrix.001 file - promoters70/3438171
aaatat

SEQ ID NO: 39578 - DNA, 9 bp, Unknown
  misc_feature (1)..( 9): Matrix.001 file - promoters70/3438171
taaaaaata

SEQ ID NO: 39579 - DNA, 8 bp, Unknown
  misc_feature (1)..( 8): Matrix.001 file - promoters70/3438171
tttttatt

SEQ ID NO: 39580 - DNA, 7 bp, Unknown
  misc_feature (1)..( 7): Matrix.001 file - promoters70/3438171
atattta

SEQ ID NO: 39581 - DNA, 19 bp, Unknown
  misc_feature (1)..( 19): Matrix.001 file - promoters70/3438171
aaattattcacacaagttg

SEQ ID NO: 39582 - DNA, 11 bp, Unknown
  misc_feature (1)..( 11): Matrix.001 file - promoters70/3438171
gtttaaaaatt

SEQ ID NO: 39583 - DNA, 8 bp, Unknown
  misc_feature (1)..( 8): Matrix.001 file - promoters70/3438171
ataatttc

SEQ ID NO: 39584 - DNA, 9 bp, Unknown
  misc_feature (1)..( 9): Matrix.001 file - promoters70/3438171
aataaaaaa

SEQ ID NO: 39585 - DNA, 11 bp, Unknown
  misc_feature (1)..( 11): Matrix.001 file - promoters70/3438171
atttaaataaa

SEQ ID NO: 39586 - DNA, 7 bp, Unknown
  misc_feature (1)..( 7): Matrix.001 file - promoters70/3438171
aaaacaa

SEQ ID NO: 39587 - DNA, 9 bp, Unknown
  misc_feature (1)..( 9): Matrix.001 file - promoters70/3438171
atataaata

SEQ ID NO: 39588 - DNA, 9 bp, Unknown
  misc_feature (1)..( 9): Matrix.001 file - promoters70/3438194
gaaacagag

SEQ ID NO: 39589 - DNA, 8 bp, Unknown
  misc_feature (1)..( 8): Matrix.001 file - promoters70/3438236
taattgat

SEQ ID NO: 39590 - DNA, 7 bp, Unknown
  misc_feature (1)..( 7): Matrix.001 file - promoters70/3438236
taaaccc

SEQ ID NO: 39591 - DNA, 13 bp, Unknown
  misc_feature (1)..( 13): Matrix.001 file - promoters70/3438236
gcgctttttgatt

SEQ ID NO: 39592 - DNA, 12 bp, Unknown
  misc_feature (1)..( 12): Matrix.001 file - promoters70/3438512
tttgtttataat

SEQ ID NO: 39593 - DNA, 8 bp, Unknown
  misc_feature (1)..( 8): Matrix.001 file - promoters70/3438512
caaaaaaa

SEQ ID NO: 39594 - DNA, 10 bp, Unknown
  misc_feature (1)..( 10): Matrix.001 file - promoters70/3438512
aatgtttgag

SEQ ID NO: 39595 - DNA, 11 bp, Unknown
  misc_feature (1)..( 11): Matrix.001 file - promoters70/3438512
agaagaaaaaa

SEQ ID NO: 39596 - DNA, 12 bp, Unknown
  misc_feature (1)..( 12): Matrix.001 file - promoters70/3438632
aaaggcccatat

SEQ ID NO: 39597 - DNA, 11 bp, Unknown
  misc_feature (1)..( 11): Matrix.001 file - promoters70/3438632
ctttattatca

SEQ ID NO: 39598 - DNA, 9 bp, Unknown
  misc_feature (1)..( 9): Matrix.001 file - promoters70/3438648
aaaaaattc

SEQ ID NO: 39599 - DNA, 9 bp, Unknown
  misc_feature (1)..( 9): Matrix.001 file - promoters70/3438648
aatatgagt

SEQ ID NO: 39600 - DNA, 8 bp, Unknown
  misc_feature (1)..( 8): Matrix.001 file - promoters70/3438648
aaaattac

SEQ ID NO: 39601 - DNA, 7 bp, Unknown
  misc_feature (1)..( 7): Matrix.001 file - promoters70/3438648
aaaaaaa

SEQ ID NO: 39602 - DNA, 9 bp, Unknown
  misc_feature (1)..( 9): Matrix.001 file - promoters70/3438648
gaaaaaaaa

SEQ ID NO: 39603 - DNA, 11 bp, Unknown
  misc_feature (1)..( 11): Matrix.001 file - promoters70/3438648
ttgaaaatata

SEQ ID NO: 39604 - DNA, 10 bp, Unknown
  misc_feature (1)..( 10): Matrix.001 file - promoters70/3438648
aaataaaaac

SEQ ID NO: 39605 - DNA, 8 bp, Unknown
  misc_feature (1)..( 8): Matrix.001 file - promoters70/3438734
gtttgatc

SEQ ID NO: 39606 - DNA, 10 bp, Unknown
  misc_feature (1)..( 10): Matrix.001 file - promoters70/3438946
actttataat

SEQ ID NO: 39607 - DNA, 13 bp, Unknown
  misc_feature (1)..( 13): Matrix.001 file - promoters70/3439364
atatttttaaaaa

SEQ ID NO: 39608 - DNA, 7 bp, Unknown
  misc_feature (1)..( 7): Matrix.001 file - promoters70/3439364
ttaaatt

SEQ ID NO: 39609 - DNA, 13 bp, Unknown
  misc_feature (1)..( 13): Matrix.001 file - promoters70/3439364
ttttgtatttatt

SEQ ID NO: 39610 - DNA, 12 bp, Unknown
  misc_feature (1)..( 12): Matrix.001 file - promoters70/3439364
acacatatattt

SEQ ID NO: 39611 - DNA, 11 bp, Unknown
  misc_feature (1)..( 11): Matrix.001 file - promoters70/3439364
tatatataact

SEQ ID NO: 39612 - DNA, 9 bp, Unknown
  misc_feature (1)..( 9): Matrix.001 file - promoters70/3439364
atatttaaa

SEQ ID NO: 39613 - DNA, 8 bp, Unknown
  misc_feature (1)..( 8): Matrix.001 file - promoters70/3439364
aacagttt

SEQ ID NO: 39614 - DNA, 11 bp, Unknown
  misc_feature (1)..( 11): Matrix.001 file - promoters70/3439364
aaaaaaagaat

SEQ ID NO: 39615 - DNA, 13 bp, Unknown
  misc_feature (1)..( 13): Matrix.001 file - promoters70/3439364
acacagatattat

SEQ ID NO: 39616 - DNA, 8 bp, Unknown
  misc_feature (1)..( 8): Matrix.001 file - promoters70/3439364
aataaaaa

SEQ ID NO: 39617 - DNA, 14 bp, Unknown
  misc_feature (1)..( 14): Matrix.001 file - promoters70/3439416
aagtagaaagaaag

SEQ ID NO: 39618 - DNA, 11 bp, Unknown
  misc_feature (1)..( 11): Matrix.001 file - promoters70/3439472
attaataaatc

SEQ ID NO: 39619 - DNA, 15 bp, Unknown
  misc_feature (1)..( 15): Matrix.001 file - promoters70/3439472
acaaaattttattat

SEQ ID NO: 39620 - DNA, 12 bp, Unknown
  misc_feature (1)..( 12): Matrix.001 file - promoters70/3439472
agaaaaaaacaa

SEQ ID NO: 39621 - DNA, 10 bp, Unknown
  misc_feature (1)..( 10): Matrix.001 file - promoters70/3439472
actttaattt

SEQ ID NO: 39622 - DNA, 12 bp, Unknown
  misc_feature (1)..( 12): Matrix.001 file - promoters70/3439641
gaaatacgtttt

SEQ ID NO: 39623 - DNA, 10 bp, Unknown
  misc_feature (1)..( 10): Matrix.001 file - promoters70/3439641
aaagacaaag

SEQ ID NO: 39624 - DNA, 9 bp, Unknown
  misc_feature (1)..( 9): Matrix.001 file - promoters70/3439641
gtccaaatt

SEQ ID NO: 39625 - DNA, 10 bp, Unknown
  misc_feature (1)..( 10): Matrix.001 file - promoters70/3439641
gcccataaag

SEQ ID NO: 39626 - DNA, 11 bp, Unknown
  misc_feature (1)..( 11): Matrix.001 file - promoters70/3439641
ttttgattcgt

SEQ ID NO: 39627 - DNA, 8 bp, Unknown
  misc_feature (1)..( 8): Matrix.001 file - promoters70/3439641
tatttcat

SEQ ID NO: 39628 - DNA, 8 bp, Unknown
  misc_feature (1)..( 8): Matrix.001 file - promoters70/3439641
taattttt

SEQ ID NO: 39629 - DNA, 11 bp, Unknown
  misc_feature (1)..( 11): Matrix.001 file - promoters70/3593205
aaatattttat

SEQ ID NO: 39630 - DNA, 8 bp, Unknown
  misc_feature (1)..( 8): Matrix.001 file - promoters70/3593205
tatgaaac

SEQ ID NO: 39631 - DNA, 8 bp, Unknown
  misc_feature (1)..( 8): Matrix.001 file - promoters70/3593205
caaaaatt

SEQ ID NO: 39632 - DNA, 7 bp, Unknown
  misc_feature (1)..( 7): Matrix.001 file - promoters70/3593205
aaaattg

SEQ ID NO: 39633 - DNA, 7 bp, Unknown
  misc_feature (1)..( 7): Matrix.001 file - promoters70/3593205
aaacttc

SEQ ID NO: 39634 - DNA, 13 bp, Unknown
  misc_feature (1)..( 13): Matrix.001 file - promoters70/3593205
aattagatctttt

SEQ ID NO: 39635 - DNA, 8 bp, Unknown
  misc_feature (1)..( 8): Matrix.001 file - promoters70/3593205
ttatcctt

SEQ ID NO: 39636 - DNA, 10 bp, Unknown
  misc_feature (1)..( 10): Matrix.001 file - promoters70/3593205
ttactttttt

SEQ ID NO: 39637 - DNA, 8 bp, Unknown
  misc_feature (1)..( 8): Matrix.001 file - promoters70/3593205
tttataat

SEQ ID NO: 39638 - DNA, 8 bp, Unknown
  misc_feature (1)..( 8): Matrix.001 file - promoters70/3593205
gttaaaaa

SEQ ID NO: 39639 - DNA, 7 bp, Unknown
  misc_feature (1)..( 7): Matrix.001 file - promoters70/3593205
taaaaat

SEQ ID NO: 39640 - DNA, 6 bp, Unknown
  misc_feature (1)..( 6): Matrix.001 file - promoters70/3593230
cacatt

SEQ ID NO: 39641 - DNA, 8 bp, Unknown
  misc_feature (1)..( 8): Matrix.001 file - promoters70/3593230
tcttcttg

SEQ ID NO: 39642 - DNA, 7 bp, Unknown
  misc_feature (1)..( 7): Matrix.001 file - promoters70/3593230
gatcaca

SEQ ID NO: 39643 - DNA, 8 bp, Unknown
  misc_feature (1)..( 8): Matrix.001 file - promoters70/3597145
gaagaaga

SEQ ID NO: 39644 - DNA, 7 bp, Unknown
  misc_feature (1)..( 7): Matrix.001 file - promoters70/3597145
aaatgaa

SEQ ID NO: 39645 - DNA, 8 bp, Unknown
  misc_feature (1)..( 8): Matrix.001 file - promoters70/3597175
gctctata

SEQ ID NO: 39646 - DNA, 8 bp, Unknown
  misc_feature (1)..( 8): Matrix.001 file - promoters70/4254434
tttagatt

SEQ ID NO: 39647 - DNA, 5 bp, Unknown
  misc_feature (1)..( 5): Matrix.001 file - promoters70/4254434
agatt

SEQ ID NO: 39648 - DNA, 10 bp, Unknown
  misc_feature (1)..( 10): Matrix.001 file - promoters70/4262420
cctattggtt

SEQ ID NO: 39649 - DNA, 6 bp, Unknown
  misc_feature (1)..( 6): Matrix.001 file - promoters70/4262420
tgggat

SEQ ID NO: 39650 - DNA, 9 bp, Unknown
  misc_feature (1)..( 9): Matrix.001 file - promoters70/4262422
ttgtaattt

SEQ ID NO: 39651 - DNA, 7 bp, Unknown
  misc_feature (1)..( 7): Matrix.001 file - promoters70/4262422
accaaag

SEQ ID NO: 39652 - DNA, 8 bp, Unknown
  misc_feature (1)..( 8): Matrix.001 file - promoters70/4262422
tagtgtta

SEQ ID NO: 39653 - DNA, 7 bp, Unknown
  misc_feature (1)..( 7): Matrix.001 file - promoters70/4262422
gataaga

SEQ ID NO: 39654 - DNA, 12 bp, Unknown
  misc_feature (1)..( 12): Matrix.001 file - promoters70/4262422
taatttaatttg

SEQ ID NO: 39655 - DNA, 8 bp, Unknown
  misc_feature (1)..( 8): Matrix.001 file - promoters70/4262428
atgttaac

SEQ ID NO: 39656 - DNA, 7 bp, Unknown
  misc_feature (1)..( 7): Matrix.001 file - promoters70/4262428
attaaat

SEQ ID NO: 39657 - DNA, 9 bp, Unknown
  misc_feature (1)..( 9): Matrix.001 file - promoters70/4262428
ccattaaag

SEQ ID NO: 39658 - DNA, 9 bp, Unknown
  misc_feature (1)..( 9): Matrix.001 file - promoters70/4262428
ttctttctt

SEQ ID NO: 39659 - DNA, 7 bp, Unknown
  misc_feature (1)..( 7): Matrix.001 file - promoters70/4262428
tatataa

SEQ ID NO: 39660 - DNA, 7 bp, Unknown
  misc_feature (1)..( 7): Matrix.001 file - promoters70/4262428
tataaat

SEQ ID NO: 39661 - DNA, 8 bp, Unknown
  misc_feature (1)..( 8): Matrix.001 file - promoters70/4267125
ttatttgt

SEQ ID NO: 39662 - DNA, 8 bp, Unknown
  misc_feature (1)..( 8): Matrix.001 file - promoters70/4270131
ttaataac

SEQ ID NO: 39663 - DNA, 10 bp, Unknown
  misc_feature (1)..( 10): Matrix.001 file - promoters70/4281662
actttataaa

SEQ ID NO: 39664 - DNA, 8 bp, Unknown
  misc_feature (1)..( 8): Matrix.001 file - promoters70/4281662
aagatagt

SEQ ID NO: 39665 - DNA, 8 bp, Unknown
  misc_feature (1)..( 8): Matrix.001 file - promoters70/4281662
attatgtc

SEQ ID NO: 39666 - DNA, 9 bp, Unknown
  misc_feature (1)..( 9): Matrix.001 file - promoters70/4281662
ctttaaaat

SEQ ID NO: 39667 - DNA, 7 bp, Unknown
  misc_feature (1)..( 7): Matrix.001 file - promoters70/4281662
tccattt

SEQ ID NO: 39668 - DNA, 7 bp, Unknown
  misc_feature (1)..( 7): Matrix.001 file - promoters70/4281711
gaataaa

SEQ ID NO: 39669 - DNA, 7 bp, Unknown
  misc_feature (1)..( 7): Matrix.001 file - promoters70/4281744
aatttac

SEQ ID NO: 39670 - DNA, 11 bp, Unknown
  misc_feature (1)..( 11): Matrix.001 file - promoters70/4281744
ataattgtata

SEQ ID NO: 39671 - DNA, 10 bp, Unknown
  misc_feature (1)..( 10): Matrix.001 file - promoters70/4281744
gaaatagatt

SEQ ID NO: 39672 - DNA, 8 bp, Unknown
  misc_feature (1)..( 8): Matrix.001 file - promoters70/4281744
aagctata

SEQ ID NO: 39673 - DNA, 9 bp, Unknown
  misc_feature (1)..( 9): Matrix.001 file - promoters70/4281744
ttattaatt

SEQ ID NO: 39674 - DNA, 9 bp, Unknown
  misc_feature (1)..( 9): Matrix.001 file - promoters70/4281773
aagaattgc

SEQ ID NO: 39675 - DNA, 11 bp, Unknown
  misc_feature (1)..( 11): Matrix.001 file - promoters70/4281925
aaaataaaaca

SEQ ID NO: 39676 - DNA, 8 bp, Unknown
  misc_feature (1)..( 8): Matrix.001 file - promoters70/4281925
taaatttt

SEQ ID NO: 39677 - DNA, 14 bp, Unknown
  misc_feature (1)..( 14): Matrix.001 file - promoters70/4281925
aatttacatatcta

SEQ ID NO: 39678 - DNA, 6 bp, Unknown
  misc_feature (1)..( 6): Matrix.001 file - promoters70/4281997
attatc

SEQ ID NO: 39679 - DNA, 7 bp, Unknown
  misc_feature (1)..( 7): Matrix.001 file - promoters70/4282316
cattatc

SEQ ID NO: 39680 - DNA, 9 bp, Unknown
  misc_feature (1)..( 9): Matrix.001 file - promoters70/4282316
aaatgtttt

SEQ ID NO: 39681 - DNA, 9 bp, Unknown
  misc_feature (1)..( 9): Matrix.001 file - promoters70/4282418
aaaataaaa

SEQ ID NO: 39682 - DNA, 7 bp, Unknown
  misc_feature (1)..( 7): Matrix.001 file - promoters70/4282503
taaaatc

SEQ ID NO: 39683 - DNA, 10 bp, Unknown
  misc_feature (1)..( 10): Matrix.001 file - promoters70/4282503
ttttaataac

SEQ ID NO: 39684 - DNA, 11 bp, Unknown
  misc_feature (1)..( 11): Matrix.001 file - promoters70/4282503
tttattaaatg

SEQ ID NO: 39685 - DNA, 8 bp, Unknown
  misc_feature (1)..( 8): Matrix.001 file - promoters70/4282667
aatgggcc

SEQ ID NO: 39686 - DNA, 8 bp, Unknown
  misc_feature (1)..( 8): Matrix.001 file - promoters70/4282667
attgttac

SEQ ID NO: 39687 - DNA, 10 bp, Unknown
  misc_feature (1)..( 10): Matrix.001 file - promoters70/4282667
attcaaaaaa

SEQ ID NO: 39688 - DNA, 8 bp, Unknown
  misc_feature (1)..( 8): Matrix.001 file - promoters70/4282788
tttgattt

SEQ ID NO: 39689 - DNA, 11 bp, Unknown
  misc_feature (1)..( 11): Matrix.001 file - promoters70/4283003
aataatttgta

SEQ ID NO: 39690 - DNA, 8 bp, Unknown
  misc_feature (1)..( 8): Matrix.001 file - promoters70/4283240
tcaagatt

SEQ ID NO: 39691 - DNA, 10 bp, Unknown
  misc_feature (1)..( 10): Matrix.001 file - promoters70/4283240
aaattgatat

SEQ ID NO: 39692 - DNA, 8 bp, Unknown
  misc_feature (1)..( 8): Matrix.001 file - promoters70/4283293
tttatttc

SEQ ID NO: 39693 - DNA, 7 bp, Unknown
  misc_feature (1)..( 7): Matrix.001 file - promoters70/4283293
tatttaa

SEQ ID NO: 39694 - DNA, 8 bp, Unknown
  misc_feature (1)..( 8): Matrix.001 file - promoters70/4283297
aataaaaa

SEQ ID NO: 39695 - DNA, 7 bp, Unknown
  misc_feature (1)..( 7): Matrix.001 file - promoters70/4283338
aaagcca

SEQ ID NO: 39696 - DNA, 8 bp, Unknown
  misc_feature (1)..( 8): Matrix.001 file - promoters70/4283355
aaatcaaa

SEQ ID NO: 39697 - DNA, 8 bp, Unknown
  misc_feature (1)..( 8): Matrix.001 file - promoters70/4283378
tatataaa

SEQ ID NO: 39698 - DNA, 10 bp, Unknown
  misc_feature (1)..( 10): Matrix.001 file - promoters70/4283378
tgaatgtaaa

SEQ ID NO: 39699 - DNA, 14 bp, Unknown
  misc_feature (1)..( 14): Matrix.001 file - promoters70/4283378
ataactttataaaa

SEQ ID NO: 39700 - DNA, 6 bp, Unknown
  misc_feature (1)..( 6): Matrix.001 file - promoters70/4283378
aaatat

SEQ ID NO: 39701 - DNA, 12 bp, Unknown
  misc_feature (1)..( 12): Matrix.001 file - promoters70/4283378
tataatatatac

SEQ ID NO: 39702 - DNA, 11 bp, Unknown
  misc_feature (1)..( 11): Matrix.001 file - promoters70/4283378
ttaatttaaca

SEQ ID NO: 39703 - DNA, 8 bp, Unknown
  misc_feature (1)..( 8): Matrix.001 file - promoters70/4283378
aaattttt

SEQ ID NO: 39704 - DNA, 8 bp, Unknown
  misc_feature (1)..( 8): Matrix.001 file - promoters70/4283386
gttttatt

SEQ ID NO: 39705 - DNA, 9 bp, Unknown
  misc_feature (1)..( 9): Matrix.001 file - promoters70/4283386
tttctttta

SEQ ID NO: 39706 - DNA, 11 bp, Unknown
  misc_feature (1)..( 11): Matrix.001 file - promoters70/4577400
ccataattaag

SEQ ID NO: 39707 - DNA, 10 bp, Unknown
  misc_feature (1)..( 10): Matrix.001 file - promoters70/4608096
tataaaaata

SEQ ID NO: 39708 - DNA, 9 bp, Unknown
  misc_feature (1)..( 9): Matrix.001 file - promoters70/4608104
tctaataga

SEQ ID NO: 39709 - DNA, 12 bp, Unknown
  misc_feature (1)..( 12): Matrix.001 file - promoters70/4608965
ttttataaatcc

SEQ ID NO: 39710 - DNA, 8 bp, Unknown
  misc_feature (1)..( 8): Matrix.001 file - promoters70/4608985
tacaaaaa

SEQ ID NO: 39711 - DNA, 7 bp, Unknown
  misc_feature (1)..( 7): Matrix.001 file - promoters70/4608985
aaacaat

SEQ ID NO: 39712 - DNA, 10 bp, Unknown
  misc_feature (1)..( 10): Matrix.001 file - promoters70/4608985
attaatatag

SEQ ID NO: 39713 - DNA, 12 bp, Unknown
  misc_feature (1)..( 12): Matrix.001 file - promoters70/4608985
taaaaaaactaa

SEQ ID NO: 39714 - DNA, 6 bp, Unknown
  misc_feature (1)..( 6): Matrix.001 file - promoters70/4608985
taaaat

SEQ ID NO: 39715 - DNA, 5 bp, Unknown
  misc_feature (1)..( 5): Matrix.001 file - promoters70/4608985
caaaa

SEQ ID NO: 39716 - DNA, 13 bp, Unknown
  misc_feature (1)..( 13): Matrix.001 file - promoters70/4608985
taacaaatttctt

SEQ ID NO: 39717 - DNA, 10 bp, Unknown
  misc_feature (1)..( 10): Matrix.001 file - promoters70/4608985
agttaataaa

SEQ ID NO: 39718 - DNA, 11 bp, Unknown
  misc_feature (1)..( 11): Matrix.001 file - promoters70/4610551
aagaaaatata

SEQ ID NO: 39719 - DNA, 12 bp, Unknown
  misc_feature (1)..( 12): Matrix.001 file - promoters70/4701809
ataatgtttttt

SEQ ID NO: 39720 - DNA, 7 bp, Unknown
  misc_feature (1)..( 7): Matrix.001 file - promoters70/4701809
aaagtca

SEQ ID NO: 39721 - DNA, 8 bp, Unknown
  misc_feature (1)..( 8): Matrix.001 file - promoters70/4701809
atttttct

SEQ ID NO: 39722 - DNA, 10 bp, Unknown
  misc_feature (1)..( 10): Matrix.001 file - promoters70/4701809
tacaaaattg

SEQ ID NO: 39723 - DNA, 8 bp, Unknown
  misc_feature (1)..( 8): Matrix.001 file - promoters70/4701809
ttataaaa

SEQ ID NO: 39724 - DNA, 9 bp, Unknown
  misc_feature (1)..( 9): Matrix.001 file - promoters70/4701809
atttttttt

SEQ ID NO: 39725 - DNA, 9 bp, Unknown
  misc_feature (1)..( 9): Matrix.001 file - promoters70/4701809
taaattaat

SEQ ID NO: 39726 - DNA, 12 bp, Unknown
  misc_feature (1)..( 12): Matrix.001 file - promoters70/4701809
tcgttttgtttt

SEQ ID NO: 39727 - DNA, 13 bp, Unknown
  misc_feature (1)..( 13): Matrix.001 file - promoters70/4701809
ttagattcatatt

SEQ ID NO: 39728 - DNA, 7 bp, Unknown
  misc_feature (1)..( 7): Matrix.001 file - promoters70/4701809
aaattaa

SEQ ID NO: 39729 - DNA, 10 bp, Unknown
  misc_feature (1)..( 10): Matrix.001 file - promoters70/4701809
tttgtttttg

SEQ ID NO: 39730 - DNA, 7 bp, Unknown
  misc_feature (1)..( 7): Matrix.001 file - promoters70/4701809
ataaaaa

SEQ ID NO: 39731 - DNA, 8 bp, Unknown
  misc_feature (1)..( 8): Matrix.001 file - promoters70/4766447
tcaaacaa

SEQ ID NO: 39732 - DNA, 7 bp, Unknown
  misc_feature (1)..( 7): Matrix.001 file - promoters70/4766447
tttattt

SEQ ID NO: 39733 - DNA, 11 bp, Unknown
  misc_feature (1)..( 11): Matrix.001 file - promoters70/4766447
aatccaatttt

SEQ ID NO: 39734 - DNA, 8 bp, Unknown
  misc_feature (1)..( 8): Matrix.001 file - promoters70/4766490
gaaaaaaa

SEQ ID NO: 39735 - DNA, 12 bp, Unknown
  misc_feature (1)..( 12): Matrix.001 file - promoters70/4766490
aaaaaagaagaa

SEQ ID NO: 39736 - DNA, 8 bp, Unknown
  misc_feature (1)..( 8): Matrix.001 file - promoters70/4766602
actatata

SEQ ID NO: 39737 - DNA, 8 bp, Unknown
  misc_feature (1)..( 8): Matrix.001 file - promoters70/4766602
catttttt

SEQ ID NO: 39738 - DNA, 8 bp, Unknown
  misc_feature (1)..( 8): Matrix.001 file - promoters70/4766602
attttaaa

SEQ ID NO: 39739 - DNA, 9 bp, Unknown
  misc_feature (1)..( 9): Matrix.001 file - promoters70/4766712
ttataaata

SEQ ID NO: 39740 - DNA, 11 bp, Unknown
  misc_feature (1)..( 11): Matrix.001 file - promoters70/4766712
aagacccgttg

SEQ ID NO: 39741 - DNA, 6 bp, Unknown
  misc_feature (1)..( 6): Matrix.001 file - promoters70/4766712
attaaa

SEQ ID NO: 39742 - DNA, 9 bp, Unknown
  misc_feature (1)..( 9): Matrix.001 file - promoters70/4766712
gaaatgaga

SEQ ID NO: 39743 - DNA, 8 bp, Unknown
  misc_feature (1)..( 8): Matrix.001 file - promoters70/4766866
attccatt

SEQ ID NO: 39744 - DNA, 8 bp, Unknown
  misc_feature (1)..( 8): Matrix.001 file - promoters70/4766866
tttgtaat

SEQ ID NO: 39745 - DNA, 12 bp, Unknown
  misc_feature (1)..( 12): Matrix.001 file - promoters70/4766866
aaaagaaattaa

SEQ ID NO: 39746 - DNA, 12 bp, Unknown
  misc_feature (1)..( 12): Matrix.001 file - promoters70/4766866
ttgagacaaaaa

SEQ ID NO: 39747 - DNA, 7 bp, Unknown
  misc_feature (1)..( 7): Matrix.001 file - promoters70/4766866
ggagaaa

SEQ ID NO: 39748 - DNA, 8 bp, Unknown
  misc_feature (1)..( 8): Matrix.001 file - promoters70/4766866
cccactaa

SEQ ID NO: 39749 - DNA, 9 bp, Unknown
  misc_feature (1)..( 9): Matrix.001 file - promoters70/4766866
taacaagta

SEQ ID NO: 39750 - DNA, 8 bp, Unknown
  misc_feature (1)..( 8): Matrix.001 file - promoters70/4766936
tttatttg

SEQ ID NO: 39751 - DNA, 8 bp, Unknown
  misc_feature (1)..( 8): Matrix.001 file - promoters70/4766936
aattgtta

SEQ ID NO: 39752 - DNA, 15 bp, Unknown
  misc_feature (1)..( 15): Matrix.001 file - promoters70/4766936
tttttaccacacaag

SEQ ID NO: 39753 - DNA, 10 bp, Unknown
  misc_feature (1)..( 10): Matrix.001 file - promoters70/4766936
atctttataa

SEQ ID NO: 39754 - DNA, 10 bp, Unknown
  misc_feature (1)..( 10): Matrix.001 file - promoters70/4766936
ttgccacgtg

SEQ ID NO: 39755 - DNA, 8 bp, Unknown
  misc_feature (1)..( 8): Matrix.001 file - promoters70/4766936
aatgtttt

SEQ ID NO: 39756 - DNA, 9 bp, Unknown
  misc_feature (1)..( 9): Matrix.001 file - promoters70/4766936
attttttgt

SEQ ID NO: 39757 - DNA, 9 bp, Unknown
  misc_feature (1)..( 9): Matrix.001 file - promoters70/4766936
ttatcaaat

SEQ ID NO: 39758 - DNA, 10 bp, Unknown
  misc_feature (1)..( 10): Matrix.001 file - promoters70/4766977
ctataaatag

SEQ ID NO: 39759 - DNA, 7 bp, Unknown
  misc_feature (1)..( 7): Matrix.001 file - promoters70/4767298
tatttca

SEQ ID NO: 39760 - DNA, 7 bp, Unknown
  misc_feature (1)..( 7): Matrix.001 file - promoters70/4767298
ttcattt

SEQ ID NO: 39761 - DNA, 9 bp, Unknown
  misc_feature (1)..( 9): Matrix.001 file - promoters70/4767298
aaatatgat

SEQ ID NO: 39762 - DNA, 9 bp, Unknown
  misc_feature (1)..( 9): Matrix.001 file - promoters70/4767379
taaaaattc

SEQ ID NO: 39763 - DNA, 9 bp, Unknown
  misc_feature (1)..( 9): Matrix.001 file - promoters70/4767379
aaaaataaa

SEQ ID NO: 39764 - DNA, 10 bp, Unknown
  misc_feature (1)..( 10): Matrix.001 file - promoters70/4767379
aaataaaatt

SEQ ID NO: 39765 - DNA, 7 bp, Unknown
  misc_feature (1)..( 7): Matrix.001 file - promoters70/4767379
aaacaaa

SEQ ID NO: 39766 - DNA, 10 bp, Unknown
  misc_feature (1)..( 10): Matrix.001 file - promoters70/4767379
aatgatatac

SEQ ID NO: 39767 - DNA, 11 bp, Unknown
  misc_feature (1)..( 11): Matrix.001 file - promoters70/4767379
aagaaaaaata

SEQ ID NO: 39768 - DNA, 10 bp, Unknown
  misc_feature (1)..( 10): Matrix.001 file - promoters70/4767487
tatttaaaaa

SEQ ID NO: 39769 - DNA, 8 bp, Unknown
  misc_feature (1)..( 8): Matrix.001 file - promoters70/4767487
tttgattt

SEQ ID NO: 39770 - DNA, 10 bp, Unknown
  misc_feature (1)..( 10): Matrix.001 file - promoters70/4767487
taattttctc

SEQ ID NO: 39771 - DNA, 10 bp, Unknown
  misc_feature (1)..( 10): Matrix.001 file - promoters70/4767487
ttatgaataa

SEQ ID NO: 39772 - DNA, 10 bp, Unknown
  misc_feature (1)..( 10): Matrix.001 file - promoters70/4767515
aacaaaacaa

SEQ ID NO: 39773 - DNA, 9 bp, Unknown
  misc_feature (1)..( 9): Matrix.001 file - promoters70/4767701
aattttgag

SEQ ID NO: 39774 - DNA, 12 bp, Unknown
  misc_feature (1)..( 12): Matrix.001 file - promoters70/4767701
aatcaatttaaa

SEQ ID NO: 39775 - DNA, 10 bp, Unknown
  misc_feature (1)..( 10): Matrix.001 file - promoters70/4767701
cttatatata

SEQ ID NO: 39776 - DNA, 11 bp, Unknown
  misc_feature (1)..( 11): Matrix.001 file - promoters70/4767701
aatcaaattgt

SEQ ID NO: 39777 - DNA, 8 bp, Unknown
  misc_feature (1)..( 8): Matrix.001 file - promoters70/4767952
aaaattaa

SEQ ID NO: 39778 - DNA, 8 bp, Unknown
  misc_feature (1)..( 8): Matrix.001 file - promoters70/4767952
attaaatt

SEQ ID NO: 39779 - DNA, 8 bp, Unknown
  misc_feature (1)..( 8): Matrix.001 file - promoters70/4767952
attaaatt

SEQ ID NO: 39780 - DNA, 7 bp, Unknown
  misc_feature (1)..( 7): Matrix.001 file - promoters70/4767952
gtataca

SEQ ID NO: 39781 - DNA, 7 bp, Unknown
  misc_feature (1)..( 7): Matrix.001 file - promoters70/4767952
agatcaa

SEQ ID NO: 39782 - DNA, 7 bp, Unknown
  misc_feature (1)..( 7): Matrix.001 file - promoters70/4767976
gtatata

SEQ ID NO: 39783 - DNA, 10 bp, Unknown
  misc_feature (1)..( 10): Matrix.001 file - promoters70/4767982
ttaaacttgt

SEQ ID NO: 39784 - DNA, 7 bp, Unknown
  misc_feature (1)..( 7): Matrix.001 file - promoters70/4767982
attttaa

SEQ ID NO: 39785 - DNA, 6 bp, Unknown
  misc_feature (1)..( 6): Matrix.001 file - promoters70/4767994
aaatga

SEQ ID NO: 39786 - DNA, 7 bp, Unknown
  misc_feature (1)..( 7): Matrix.001 file - promoters70/4767994
tggccct

SEQ ID NO: 39787 - DNA, 10 bp, Unknown
  misc_feature (1)..( 10): Matrix.001 file - promoters70/4767994
atttgtttat

SEQ ID NO: 39788 - DNA, 9 bp, Unknown
  misc_feature (1)..( 9): Matrix.001 file - promoters70/4767994
taaccaata

SEQ ID NO: 39789 - DNA, 10 bp, Unknown
  misc_feature (1)..( 10): Matrix.001 file - promoters70/4767994
aatacaaatc

SEQ ID NO: 39790 - DNA, 7 bp, Unknown
  misc_feature (1)..( 7): Matrix.001 file - promoters70/4767994
taaggca

SEQ ID NO: 39791 - DNA, 11 bp, Unknown
  misc_feature (1)..( 11): Matrix.001 file - promoters70/4767994
aaagaaacaaa

SEQ ID NO: 39792 - DNA, 10 bp, Unknown
  misc_feature (1)..( 10): Matrix.001 file - promoters70/4767994
caccattgtc

SEQ ID NO: 39793 - DNA, 15 bp, Unknown
  misc_feature (1)..( 15): Matrix.001 file - promoters70/4768007
aaagaatataataaa

SEQ ID NO: 39794 - DNA, 9 bp, Unknown
  misc_feature (1)..( 9): Matrix.001 file - promoters70/4768007
tatatatag

SEQ ID NO: 39795 - DNA, 11 bp, Unknown
  misc_feature (1)..( 11): Matrix.001 file - promoters70/4768007
ttgattttaaa

SEQ ID NO: 39796 - DNA, 10 bp, Unknown
  misc_feature (1)..( 10): Matrix.001 file - promoters70/4768007
ccaaataaaa

SEQ ID NO: 39797 - DNA, 9 bp, Unknown
  misc_feature (1)..( 9): Matrix.001 file - promoters70/4768039
atttctaaa

SEQ ID NO: 39798 - DNA, 8 bp, Unknown
  misc_feature (1)..( 8): Matrix.001 file - promoters70/4768039
tataatat

SEQ ID NO: 39799 - DNA, 11 bp, Unknown
  misc_feature (1)..( 11): Matrix.001 file - promoters70/4768039
caaaaaaaaag

SEQ ID NO: 39800 - DNA, 6 bp, Unknown
  misc_feature (1)..( 6): Matrix.001 file - promoters70/4768066
gtatat

SEQ ID NO: 39801 - DNA, 13 bp, Unknown
  misc_feature (1)..( 13): Matrix.001 file - promoters70/4768147
caataatttttcc

SEQ ID NO: 39802 - DNA, 7 bp, Unknown
  misc_feature (1)..( 7): Matrix.001 file - promoters70/4768147
tattata

SEQ ID NO: 39803 - DNA, 10 bp, Unknown
  misc_feature (1)..( 10): Matrix.001 file - promoters70/4768147
aaaacaataa

SEQ ID NO: 39804 - DNA, 13 bp, Unknown
  misc_feature (1)..( 13): Matrix.001 file - promoters70/4768217
taagataaggaaa

SEQ ID NO: 39805 - DNA, 9 bp, Unknown
  misc_feature (1)..( 9): Matrix.001 file - promoters70/4768236
aaagaaatt

SEQ ID NO: 39806 - DNA, 9 bp, Unknown
  misc_feature (1)..( 9): Matrix.001 file - promoters70/4768236
aagtcaaaa

SEQ ID NO: 39807 - DNA, 7 bp, Unknown
  misc_feature (1)..( 7): Matrix.001 file - promoters70/4768236
aaaaaaa

SEQ ID NO: 39808 - DNA, 7 bp, Unknown
  misc_feature (1)..( 7): Matrix.001 file - promoters70/4768236
aaaataa

SEQ ID NO: 39809 - DNA, 9 bp, Unknown
  misc_feature (1)..( 9): Matrix.001 file - promoters70/4768250
aacaatatt

SEQ ID NO: 39810 - DNA, 7 bp, Unknown
  misc_feature (1)..( 7): Matrix.001 file - promoters70/4768250
caatatt

SEQ ID NO: 39811 - DNA, 10 bp, Unknown
  misc_feature (1)..( 10): Matrix.001 file - promoters70/4768250
agaaaaaaat

SEQ ID NO: 39812 - DNA, 6 bp, Unknown
  misc_feature (1)..( 6): Matrix.001 file - promoters70/4768250
aataaa

SEQ ID NO: 39813 - DNA, 10 bp, Unknown
  misc_feature (1)..( 10): Matrix.001 file - promoters70/4768250
cttttagtta

SEQ ID NO: 39814 - DNA, 8 bp, Unknown
  misc_feature (1)..( 8): Matrix.001 file - promoters70/4768250
aaataata

SEQ ID NO: 39815 - DNA, 13 bp, Unknown
  misc_feature (1)..( 13): Matrix.001 file - promoters70/4768250
agtaatttttggt

SEQ ID NO: 39816 - DNA, 8 bp, Unknown
  misc_feature (1)..( 8): Matrix.001 file - promoters70/4768250
taatttta

SEQ ID NO: 39817 - DNA, 8 bp, Unknown
  misc_feature (1)..( 8): Matrix.001 file - promoters70/4768265
aaaacatt

SEQ ID NO: 39818 - DNA, 7 bp, Unknown
  misc_feature (1)..( 7): Matrix.001 file - promoters70/4768285
tttgatt

SEQ ID NO: 39819 - DNA, 9 bp, Unknown
  misc_feature (1)..( 9): Matrix.001 file - promoters70/4768289
gtttattaa

SEQ ID NO: 39820 - DNA, 13 bp, Unknown
  misc_feature (1)..( 13): Matrix.001 file - promoters70/4768319
catcttcctttgt

SEQ ID NO: 39821 - DNA, 11 bp, Unknown
  misc_feature (1)..( 11): Matrix.001 file - promoters70/4768319
tagataattgt

SEQ ID NO: 39822 - DNA, 11 bp, Unknown
  misc_feature (1)..( 11): Matrix.001 file - promoters70/4768354
taaaatttttt

SEQ ID NO: 39823 - DNA, 9 bp, Unknown
  misc_feature (1)..( 9): Matrix.001 file - promoters70/4768354
tttattcag

SEQ ID NO: 39824 - DNA, 9 bp, Unknown
  misc_feature (1)..( 9): Matrix.001 file - promoters70/4768528
aaaatttct

SEQ ID NO: 39825 - DNA, 8 bp, Unknown
  misc_feature (1)..( 8): Matrix.001 file - promoters70/4768528
tgtgaaac

SEQ ID NO: 39826 - DNA, 9 bp, Unknown
  misc_feature (1)..( 9): Matrix.001 file - promoters70/4768528
aaaatttct

SEQ ID NO: 39827 - DNA, 9 bp, Unknown
  misc_feature (1)..( 9): Matrix.001 file - promoters70/4768528
tttcaaaat

SEQ ID NO: 39828 - DNA, 8 bp, Unknown
  misc_feature (1)..( 8): Matrix.001 file - promoters70/4768532
atttttgt

SEQ ID NO: 39829 - DNA, 9 bp, Unknown
  misc_feature (1)..( 9): Matrix.001 file - promoters70/4768532
tgtcctaat

SEQ ID NO: 39830 - DNA, 9 bp, Unknown
  misc_feature (1)..( 9): Matrix.001 file - promoters70/4768615
taaaaaata

SEQ ID NO: 39831 - DNA, 9 bp, Unknown
  misc_feature (1)..( 9): Matrix.001 file - promoters70/4768615
aaaaaaaat

SEQ ID NO: 39832 - DNA, 10 bp, Unknown
  misc_feature (1)..( 10): Matrix.001 file - promoters70/4768615
aattacaaaa

SEQ ID NO: 39833 - DNA, 12 bp, Unknown
  misc_feature (1)..( 12): Matrix.001 file - promoters70/4768615
agaaaataaaat

SEQ ID NO: 39834 - DNA, 13 bp, Unknown
  misc_feature (1)..( 13): Matrix.001 file - promoters70/4768615
gataaaaaaccaa

SEQ ID NO: 39835 - DNA, 6 bp, Unknown
  misc_feature (1)..( 6): Matrix.001 file - promoters70/4768615
aaaaat

SEQ ID NO: 39836 - DNA, 10 bp, Unknown
  misc_feature (1)..( 10): Matrix.001 file - promoters70/4768635
aaacaaaaac

SEQ ID NO: 39837 - DNA, 8 bp, Unknown
  misc_feature (1)..( 8): Matrix.001 file - promoters70/4768698
attagtta

SEQ ID NO: 39838 - DNA, 13 bp, Unknown
  misc_feature (1)..( 13): Matrix.001 file - promoters70/4768698
attcgaaattttc

SEQ ID NO: 39839 - DNA, 16 bp, Unknown
  misc_feature (1)..( 16): Matrix.001 file - promoters70/4768698
attcgaaaatttcaaa

SEQ ID NO: 39840 - DNA, 11 bp, Unknown
  misc_feature (1)..( 11): Matrix.001 file - promoters70/4768698
gtgttaaatat

SEQ ID NO: 39841 - DNA, 8 bp, Unknown
  misc_feature (1)..( 8): Matrix.001 file - promoters70/4768698
tatataaa

SEQ ID NO: 39842 - DNA, 7 bp, Unknown
  misc_feature (1)..( 7): Matrix.001 file - promoters70/4768698
gaaaatt

SEQ ID NO: 39843 - DNA, 11 bp, Unknown
  misc_feature (1)..( 11): Matrix.001 file - promoters70/4768698
gttataagtta

SEQ ID NO: 39844 - DNA, 10 bp, Unknown
  misc_feature (1)..( 10): Matrix.001 file - promoters70/4768698
ataactttat

SEQ ID NO: 39845 - DNA, 16 bp, Unknown
  misc_feature (1)..( 16): Matrix.001 file - promoters70/4768698
attgtgaaataatttt

SEQ ID NO: 39846 - DNA, 8 bp, Unknown
  misc_feature (1)..( 8): Matrix.001 file - promoters70/4768829
caaattat

SEQ ID NO: 39847 - DNA, 7 bp, Unknown
  misc_feature (1)..( 7): Matrix.001 file - promoters70/4768829
tatgtct

SEQ ID NO: 39848 - DNA, 7 bp, Unknown
  misc_feature (1)..( 7): Matrix.001 file - promoters70/4768829
tttattt

SEQ ID NO: 39849 - DNA, 9 bp, Unknown
  misc_feature (1)..( 9): Matrix.001 file - promoters70/4768829
taaaaaaaa

SEQ ID NO: 39850 - DNA, 7 bp, Unknown
  misc_feature (1)..( 7): Matrix.001 file - promoters70/4768829
gaatcaa

SEQ ID NO: 39851 - DNA, 9 bp, Unknown
  misc_feature (1)..( 9): Matrix.001 file - promoters70/4768848
tactccatt

SEQ ID NO: 39852 - DNA, 8 bp, Unknown
  misc_feature (1)..( 8): Matrix.001 file - promoters70/4768848
attaaaat

SEQ ID NO: 39853 - DNA, 12 bp, Unknown
  misc_feature (1)..( 12): Matrix.001 file - promoters70/4769059
ttatatctttat

SEQ ID NO: 39854 - DNA, 9 bp, Unknown
  misc_feature (1)..( 9): Matrix.001 file - promoters70/4769137
tttgtcttt

SEQ ID NO: 39855 - DNA, 8 bp, Unknown
  misc_feature (1)..( 8): Matrix.001 file - promoters70/4769137
taacaaaa

SEQ ID NO: 39856 - DNA, 8 bp, Unknown
  misc_feature (1)..( 8): Matrix.001 file - promoters70/4769137
ttttggtg

SEQ ID NO: 39857 - DNA, 6 bp, Unknown
  misc_feature (1)..( 6): Matrix.001 file - promoters70/4769137
tataaa

SEQ ID NO: 39858 - DNA, 8 bp, Unknown
  misc_feature (1)..( 8): Matrix.001 file - promoters70/4769137
tttattag

SEQ ID NO: 39859 - DNA, 9 bp, Unknown
  misc_feature (1)..( 9): Matrix.001 file - promoters70/4769137
tttactttg

SEQ ID NO: 39860 - DNA, 9 bp, Unknown
  misc_feature (1)..( 9): Matrix.001 file - promoters70/4769137
ccactagtt

SEQ ID NO: 39861 - DNA, 11 bp, Unknown
  misc_feature (1)..( 11): Matrix.001 file - promoters70/4769153
acattataaaa

SEQ ID NO: 39862 - DNA, 10 bp, Unknown
  misc_feature (1)..( 10): Matrix.001 file - promoters70/4769153
aaattgttta

SEQ ID NO: 39863 - DNA, 8 bp, Unknown
  misc_feature (1)..( 8): Matrix.001 file - promoters70/4769180
aaaaaaat

SEQ ID NO: 39864 - DNA, 10 bp, Unknown
  misc_feature (1)..( 10): Matrix.001 file - promoters70/4769180
aaaaaaaaag

SEQ ID NO: 39865 - DNA, 9 bp, Unknown
  misc_feature (1)..( 9): Matrix.001 file - promoters70/4769180
tagttacag

SEQ ID NO: 39866 - DNA, 7 bp, Unknown
  misc_feature (1)..( 7): Matrix.001 file - promoters70/4769180
agaaaag

SEQ ID NO: 39867 - DNA, 8 bp, Unknown
  misc_feature (1)..( 8): Matrix.001 file - promoters70/4769180
aagaaaaa

SEQ ID NO: 39868 - DNA, 8 bp, Unknown
  misc_feature (1)..( 8): Matrix.001 file - promoters70/4769180
ttcttctt

SEQ ID NO: 39869 - DNA, 9 bp, Unknown
  misc_feature (1)..( 9): Matrix.001 file - promoters70/4769180
ataataaat

SEQ ID NO: 39870 - DNA, 7 bp, Unknown
  misc_feature (1)..( 7): Matrix.001 file - promoters70/4769180
ctataat

SEQ ID NO: 39871 - DNA, 9 bp, Unknown
  misc_feature (1)..( 9): Matrix.001 file - promoters70/4769180
aaattaatc

SEQ ID NO: 39872 - DNA, 11 bp, Unknown
  misc_feature (1)..( 11): Matrix.001 file - promoters70/4769180
gaataaccaaa

SEQ ID NO: 39873 - DNA, 8 bp, Unknown
  misc_feature (1)..( 8): Matrix.001 file - promoters70/4769180
aaaatatt

SEQ ID NO: 39874 - DNA, 14 bp, Unknown
  misc_feature (1)..( 14): Matrix.001 file - promoters70/4769301
agaaatacaatttt

SEQ ID NO: 39875 - DNA, 8 bp, Unknown
  misc_feature (1)..( 8): Matrix.001 file - promoters70/4769301
ctaaaaaa

SEQ ID NO: 39876 - DNA, 7 bp, Unknown
  misc_feature (1)..( 7): Matrix.001 file - promoters70/4769301
tttttgg

SEQ ID NO: 39877 - DNA, 10 bp, Unknown
  misc_feature (1)..( 10): Matrix.001 file - promoters70/4769301
tttcaaaaaa

SEQ ID NO: 39878 - DNA, 11 bp, Unknown
  misc_feature (1)..( 11): Matrix.001 file - promoters70/4769312
aaataaaattg

SEQ ID NO: 39879 - DNA, 11 bp, Unknown
  misc_feature (1)..( 11): Matrix.001 file - promoters70/4769312
aaaaaaagaat

SEQ ID NO: 39880 - DNA, 11 bp, Unknown
  misc_feature (1)..( 11): Matrix.001 file - promoters70/4769312
aaacaaagaaa

SEQ ID NO: 39881 - DNA, 7 bp, Unknown
  misc_feature (1)..( 7): Matrix.001 file - promoters70/4769312
aaattaa

SEQ ID NO: 39882 - DNA, 8 bp, Unknown
  misc_feature (1)..( 8): Matrix.001 file - promoters70/4769312
tgaacaaa

SEQ ID NO: 39883 - DNA, 11 bp, Unknown
  misc_feature (1)..( 11): Matrix.001 file - promoters70/4769312
caatcactctc

SEQ ID NO: 39884 - DNA, 10 bp, Unknown
  misc_feature (1)..( 10): Matrix.001 file - promoters70/4769312
tatataaaac

SEQ ID NO: 39885 - DNA, 9 bp, Unknown
  misc_feature (1)..( 9): Matrix.001 file - promoters70/4769312
ttgaccaaa

SEQ ID NO: 39886 - DNA, 11 bp, Unknown
  misc_feature (1)..( 11): Matrix.001 file - promoters70/4769328
aagaaatttgt

SEQ ID NO: 39887 - DNA, 7 bp, Unknown
  misc_feature (1)..( 7): Matrix.001 file - promoters70/4769328
atcttcg

SEQ ID NO: 39888 - DNA, 8 bp, Unknown
  misc_feature (1)..( 8): Matrix.001 file - promoters70/4770260
attcatat

SEQ ID NO: 39889 - DNA, 8 bp, Unknown
  misc_feature (1)..( 8): Matrix.001 file - promoters70/4770260
ttccattt

SEQ ID NO: 39890 - DNA, 8 bp, Unknown
  misc_feature (1)..( 8): Matrix.001 file - promoters70/4770260
tttcaaat

SEQ ID NO: 39891 - DNA, 8 bp, Unknown
  misc_feature (1)..( 8): Matrix.001 file - promoters70/4770278
caaaaatc

SEQ ID NO: 39892 - DNA, 6 bp, Unknown
  misc_feature (1)..( 6): Matrix.001 file - promoters70/4770278
tttgtc

SEQ ID NO: 39893 - DNA, 8 bp, Unknown
  misc_feature (1)..( 8): Matrix.001 file - promoters70/4770278
aaagaaaa

SEQ ID NO: 39894 - DNA, 8 bp, Unknown
  misc_feature (1)..( 8): Matrix.001 file - promoters70/4770305
tgtttaga

SEQ ID NO: 39895 - DNA, 6 bp, Unknown
  misc_feature (1)..( 6): Matrix.001 file - promoters70/4770379
aagaaa

SEQ ID NO: 39896 - DNA, 7 bp, Unknown
  misc_feature (1)..( 7): Matrix.001 file - promoters70/4770379
ttttttt

SEQ ID NO: 39897 - DNA, 9 bp, Unknown
  misc_feature (1)..( 9): Matrix.001 file - promoters70/4770379
ctataaatt

SEQ ID NO: 39898 - DNA, 9 bp, Unknown
  misc_feature (1)..( 9): Matrix.001 file - promoters70/4770379
atataaaca

SEQ ID NO: 39899 - DNA, 7 bp, Unknown
  misc_feature (1)..( 7): Matrix.001 file - promoters70/4770379
tactaaa

SEQ ID NO: 39900 - DNA, 9 bp, Unknown
  misc_feature (1)..( 9): Matrix.001 file - promoters70/4770379
cgaactaaa

SEQ ID NO: 39901 - DNA, 7 bp, Unknown
  misc_feature (1)..( 7): Matrix.001 file - promoters70/4770379
gttttct

SEQ ID NO: 39902 - DNA, 12 bp, Unknown
  misc_feature (1)..( 12): Matrix.001 file - promoters70/4770443
attaattttact

SEQ ID NO: 39903 - DNA, 11 bp, Unknown
  misc_feature (1)..( 11): Matrix.001 file - promoters70/4770443
tgataaaaaat

SEQ ID NO: 39904 - DNA, 8 bp, Unknown
  misc_feature (1)..( 8): Matrix.001 file - promoters70/4770443
ctttgatt

SEQ ID NO: 39905 - DNA, 11 bp, Unknown
  misc_feature (1)..( 11): Matrix.001 file - promoters70/4770443
acaaaaatgat

SEQ ID NO: 39906 - DNA, 13 bp, Unknown
  misc_feature (1)..( 13): Matrix.001 file - promoters70/4770443
taatttttttcta

SEQ ID NO: 39907 - DNA, 17 bp, Unknown
  misc_feature (1)..( 17): Matrix.001 file - promoters70/4770443
tttttttatattaaaaa

SEQ ID NO: 39908 - DNA, 13 bp, Unknown
  misc_feature (1)..( 13): Matrix.001 file - promoters70/4770443
aaaatattttttt

SEQ ID NO: 39909 - DNA, 11 bp, Unknown
  misc_feature (1)..( 11): Matrix.001 file - promoters70/4770477
tatacttcagt

SEQ ID NO: 39910 - DNA, 8 bp, Unknown
  misc_feature (1)..( 8): Matrix.001 file - promoters70/4770594
ttaatata

SEQ ID NO: 39911 - DNA, 10 bp, Unknown
  misc_feature (1)..( 10): Matrix.001 file - promoters70/4770594
cttcccttta

SEQ ID NO: 39912 - DNA, 9 bp, Unknown
  misc_feature (1)..( 9): Matrix.001 file - promoters70/4770594
tttttatat

SEQ ID NO: 39913 - DNA, 13 bp, Unknown
  misc_feature (1)..( 13): Matrix.001 file - promoters70/4770594
aaatcattaaaat

SEQ ID NO: 39914 - DNA, 13 bp, Unknown
  misc_feature (1)..( 13): Matrix.001 file - promoters70/4770594
aaaacattaaaat

SEQ ID NO: 39915 - DNA, 9 bp, Unknown
  misc_feature (1)..( 9): Matrix.001 file - promoters70/4771239
ttggcgaga

SEQ ID NO: 39916 - DNA, 7 bp, Unknown
  misc_feature (1)..( 7): Matrix.001 file - promoters70/4771271
ttttgct

SEQ ID NO: 39917 - DNA, 9 bp, Unknown
  misc_feature (1)..( 9): Matrix.001 file - promoters70/4771271
aaattaaac

SEQ ID NO: 39918 - DNA, 8 bp, Unknown
  misc_feature (1)..( 8): Matrix.001 file - promoters70/4771271
tatgatta

SEQ ID NO: 39919 - DNA, 10 bp, Unknown
  misc_feature (1)..( 10): Matrix.001 file - promoters70/4771271
aacaaaattg

SEQ ID NO: 39920 - DNA, 13 bp, Unknown
  misc_feature (1)..( 13): Matrix.001 file - promoters70/4771271
gtttttcatagaa

SEQ ID NO: 39921 - DNA, 8 bp, Unknown
  misc_feature (1)..( 8): Matrix.001 file - promoters70/4771271
gttaaata

SEQ ID NO: 39922 - DNA, 12 bp, Unknown
  misc_feature (1)..( 12): Matrix.001 file - promoters70/4771271
tgataaaaaaaa

SEQ ID NO: 39923 - DNA, 9 bp, Unknown
  misc_feature (1)..( 9): Matrix.001 file - promoters70/4771271
taaacaaaa

SEQ ID NO: 39924 - DNA, 9 bp, Unknown
  misc_feature (1)..( 9): Matrix.001 file - promoters70/4771271
aatattttg

SEQ ID NO: 39925 - DNA, 10 bp, Unknown
  misc_feature (1)..( 10): Matrix.001 file - promoters70/4771271
ttaggttttt

SEQ ID NO: 39926 - DNA, 8 bp, Unknown
  misc_feature (1)..( 8): Matrix.001 file - promoters70/4771271
attatttt

SEQ ID NO: 39927 - DNA, 9 bp, Unknown
  misc_feature (1)..( 9): Matrix.001 file - promoters70/4771321
gaaataaga

SEQ ID NO: 39928 - DNA, 9 bp, Unknown
  misc_feature (1)..( 9): Matrix.001 file - promoters70/4771334
agtttttgt

SEQ ID NO: 39929 - DNA, 8 bp, Unknown
  misc_feature (1)..( 8): Matrix.001 file - promoters70/4771348
tgtcttta

SEQ ID NO: 39930 - DNA, 8 bp, Unknown
  misc_feature (1)..( 8): Matrix.001 file - promoters70/4771348
cattagta

SEQ ID NO: 39931 - DNA, 12 bp, Unknown
  misc_feature (1)..( 12): Matrix.001 file - promoters70/4771360
agaaaaatagat

SEQ ID NO: 39932 - DNA, 10 bp, Unknown
  misc_feature (1)..( 10): Matrix.001 file - promoters70/4771360
ttgcatttta

SEQ ID NO: 39933 - DNA, 8 bp, Unknown
  misc_feature (1)..( 8): Matrix.001 file - promoters70/4771360
aaatgtta

SEQ ID NO: 39934 - DNA, 7 bp, Unknown
  misc_feature (1)..( 7): Matrix.001 file - promoters70/4771360
aaaaatt

SEQ ID NO: 39935 - DNA, 9 bp, Unknown
  misc_feature (1)..( 9): Matrix.001 file - promoters70/4771360
gaaaatgtt

SEQ ID NO: 39936 - DNA, 10 bp, Unknown
  misc_feature (1)..( 10): Matrix.001 file - promoters70/4771360
taaaaatgat

SEQ ID NO: 39937 - DNA, 10 bp, Unknown
  misc_feature (1)..( 10): Matrix.001 file - promoters70/4771360
taattagagt

SEQ ID NO: 39938 - DNA, 7 bp, Unknown
  misc_feature (1)..( 7): Matrix.001 file - promoters70/4771360
gaaaatt

SEQ ID NO: 39939 - DNA, 8 bp, Unknown
  misc_feature (1)..( 8): Matrix.001 file - promoters70/4771407
cagattat

SEQ ID NO: 39940 - DNA, 12 bp, Unknown
  misc_feature (1)..( 12): Matrix.001 file - promoters70/4771407
aaatgtcatttt

SEQ ID NO: 39941 - DNA, 7 bp, Unknown
  misc_feature (1)..( 7): Matrix.001 file - promoters70/4771407
attttgt

SEQ ID NO: 39942 - DNA, 9 bp, Unknown
  misc_feature (1)..( 9): Matrix.001 file - promoters70/4771407
aatggaaga

SEQ ID NO: 39943 - DNA, 11 bp, Unknown
  misc_feature (1)..( 11): Matrix.001 file - promoters70/4771407
gatttttgtta

SEQ ID NO: 39944 - DNA, 11 bp, Unknown
  misc_feature (1)..( 11): Matrix.001 file - promoters70/4771414
aaaaattgttc

SEQ ID NO: 39945 - DNA, 7 bp, Unknown
  misc_feature (1)..( 7): Matrix.001 file - promoters70/4771478
ttgcaaa

SEQ ID NO: 39946 - DNA, 9 bp, Unknown
  misc_feature (1)..( 9): Matrix.001 file - promoters70/4771478
taattaaaa

SEQ ID NO: 39947 - DNA, 9 bp, Unknown
  misc_feature (1)..( 9): Matrix.001 file - promoters70/4771478
ttaaaagaa

SEQ ID NO: 39948 - DNA, 15 bp, Unknown
  misc_feature (1)..( 15): Matrix.001 file - promoters70/4771495
aaactattaaaaaaa

SEQ ID NO: 39949 - DNA, 9 bp, Unknown
  misc_feature (1)..( 9): Matrix.001 file - promoters70/4771523
attcatgaa

SEQ ID NO: 39950 - DNA, 9 bp, Unknown
  misc_feature (1)..( 9): Matrix.001 file - promoters70/4771674
ctctccttt

SEQ ID NO: 39951 - DNA, 16 bp, Unknown
  misc_feature (1)..( 16): Matrix.001 file - promoters70/4771674
attctatccaatcttg

SEQ ID NO: 39952 - DNA, 9 bp, Unknown
  misc_feature (1)..( 9): Matrix.001 file - promoters70/4771677
aatgaaaaa

SEQ ID NO: 39953 - DNA, 10 bp, Unknown
  misc_feature (1)..( 10): Matrix.001 file - promoters70/4771677
tataaaaaaa

SEQ ID NO: 39954 - DNA, 11 bp, Unknown
  misc_feature (1)..( 11): Matrix.001 file - promoters70/4771677
aataaaaaata

SEQ ID NO: 39955 - DNA, 9 bp, Unknown
  misc_feature (1)..( 9): Matrix.001 file - promoters70/4771677
aaaatgtca

SEQ ID NO: 39956 - DNA, 11 bp, Unknown
  misc_feature (1)..( 11): Matrix.001 file - promoters70/4771725
taacagaataa

SEQ ID NO: 39957 - DNA, 5 bp, Unknown
  misc_feature (1)..( 5): Matrix.001 file - promoters70/4771725
aaata

SEQ ID NO: 39958 - DNA, 8 bp, Unknown
  misc_feature (1)..( 8): Matrix.001 file - promoters70/4771725
aataaaat

SEQ ID NO: 39959 - DNA, 9 bp, Unknown
  misc_feature (1)..( 9): Matrix.001 file - promoters70/4771853
gtttccttt

SEQ ID NO: 39960 - DNA, 14 bp, Unknown
  misc_feature (1)..( 14): Matrix.001 file - promoters70/4771928
agaaatacaatttt

SEQ ID NO: 39961 - DNA, 8 bp, Unknown
  misc_feature (1)..( 8): Matrix.001 file - promoters70/4771928
ctaaaaaa

SEQ ID NO: 39962 - DNA, 7 bp, Unknown
  misc_feature (1)..( 7): Matrix.001 file - promoters70/4771928
tttttgg

SEQ ID NO: 39963 - DNA, 10 bp, Unknown
  misc_feature (1)..( 10): Matrix.001 file - promoters70/4771928
tttcaaaaaa

SEQ ID NO: 39964 - DNA, 11 bp, Unknown
  misc_feature (1)..( 11): Matrix.001 file - promoters70/4772130
cgattgcacaa

SEQ ID NO: 39965 - DNA, 7 bp, Unknown
  misc_feature (1)..( 7): Matrix.001 file - promoters70/4772130
attcttc

SEQ ID NO: 39966 - DNA, 12 bp, Unknown
  misc_feature (1)..( 12): Matrix.001 file - promoters70/4772130
gaccttgtgaaa

SEQ ID NO: 39967 - DNA, 7 bp, Unknown
  misc_feature (1)..( 7): Matrix.001 file - promoters70/4772130
gatcatt

SEQ ID NO: 39968 - DNA, 8 bp, Unknown
  misc_feature (1)..( 8): Matrix.001 file - promoters70/4772130
ataaattc

SEQ ID NO: 39969 - DNA, 10 bp, Unknown
  misc_feature (1)..( 10): Matrix.001 file - promoters70/4772336
gcctatatat

SEQ ID NO: 39970 - DNA, 16 bp, Unknown
  misc_feature (1)..( 16): Matrix.001 file - promoters70/4772336
tgttttcataacaaaa

SEQ ID NO: 39971 - DNA, 8 bp, Unknown
  misc_feature (1)..( 8): Matrix.001 file - promoters70/4772346
agatacag

SEQ ID NO: 39972 - DNA, 7 bp, Unknown
  misc_feature (1)..( 7): Matrix.001 file - promoters70/4772346
tttcaag

SEQ ID NO: 39973 - DNA, 8 bp, Unknown
  misc_feature (1)..( 8): Matrix.001 file - promoters70/4772346
caaacctg

SEQ ID NO: 39974 - DNA, 15 bp, Unknown
  misc_feature (1)..( 15): Matrix.001 file - promoters70/4772398
ttcataaatttaata

SEQ ID NO: 39975 - DNA, 10 bp, Unknown
  misc_feature (1)..( 10): Matrix.001 file - promoters70/4772398
atctcttttg

SEQ ID NO: 39976 - DNA, 11 bp, Unknown
  misc_feature (1)..( 11): Matrix.001 file - promoters70/4772398
attgttactta

SEQ ID NO: 39977 - DNA, 6 bp, Unknown
  misc_feature (1)..( 6): Matrix.001 file - promoters70/4772398
tttcat

SEQ ID NO: 39978 - DNA, 8 bp, Unknown
  misc_feature (1)..( 8): Matrix.001 file - promoters70/4772398
ttatgaaa

SEQ ID NO: 39979 - DNA, 12 bp, Unknown
  misc_feature (1)..( 12): Matrix.001 file - promoters70/4772402
agaacattggat

SEQ ID NO: 39980 - DNA, 10 bp, Unknown
  misc_feature (1)..( 10): Matrix.001 file - promoters70/4772402
ctaataaaac

SEQ ID NO: 39981 - DNA, 8 bp, Unknown
  misc_feature (1)..( 8): Matrix.001 file - promoters70/4772402
caagttta

SEQ ID NO: 39982 - DNA, 7 bp, Unknown
  misc_feature (1)..( 7): Matrix.001 file - promoters70/4772402
taaaatt

SEQ ID NO: 39983 - DNA, 9 bp, Unknown
  misc_feature (1)..( 9): Matrix.001 file - promoters70/4772402
aaaccctaa

SEQ ID NO: 39984 - DNA, 7 bp, Unknown
  misc_feature (1)..( 7): Matrix.001 file - promoters70/4772402
tttttga

SEQ ID NO: 39985 - DNA, 7 bp, Unknown
  misc_feature (1)..( 7): Matrix.001 file - promoters70/4772724
atgtgga

SEQ ID NO: 39986 - DNA, 7 bp, Unknown
  misc_feature (1)..( 7): Matrix.001 file - promoters70/4772772
aaacaaa

SEQ ID NO: 39987 - DNA, 8 bp, Unknown
  misc_feature (1)..( 8): Matrix.001 file - promoters70/4772772
cctatata

SEQ ID NO: 39988 - DNA, 8 bp, Unknown
  misc_feature (1)..( 8): Matrix.001 file - promoters70/4772772
taaaattt

SEQ ID NO: 39989 - DNA, 8 bp, Unknown
  misc_feature (1)..( 8): Matrix.001 file - promoters70/4772772
aaaatctc

SEQ ID NO: 39990 - DNA, 9 bp, Unknown
  misc_feature (1)..( 9): Matrix.001 file - promoters70/4772776
atttaaacg

SEQ ID NO: 39991 - DNA, 8 bp, Unknown
  misc_feature (1)..( 8): Matrix.001 file - promoters70/4772776
aaatctcg

SEQ ID NO: 39992 - DNA, 11 bp, Unknown
  misc_feature (1)..( 11): Matrix.001 file - promoters70/4772776
ttgttaatgat

SEQ ID NO: 39993 - DNA, 9 bp, Unknown
  misc_feature (1)..( 9): Matrix.001 file - promoters70/4772776
tttatcata

SEQ ID NO: 39994 - DNA, 13 bp, Unknown
  misc_feature (1)..( 13): Matrix.001 file - promoters70/4772776
tcattgatctcaa

SEQ ID NO: 39995 - DNA, 8 bp, Unknown
  misc_feature (1)..( 8): Matrix.001 file - promoters70/4772776
aattgaaa

SEQ ID NO: 39996 - DNA, 10 bp, Unknown
  misc_feature (1)..( 10): Matrix.001 file - promoters70/4772776
attgataaaa

SEQ ID NO: 39997 - DNA, 12 bp, Unknown
  misc_feature (1)..( 12): Matrix.001 file - promoters70/4772776
aacttaaaaaca

SEQ ID NO: 39998 - DNA, 9 bp, Unknown
  misc_feature (1)..( 9): Matrix.001 file - promoters70/4772776
taaaatgca

SEQ ID NO: 39999 - DNA, 11 bp, Unknown
  misc_feature (1)..( 11): Matrix.001 file - promoters70/4772776
tttgatctcaa

SEQ ID NO: 40000 - DNA, 7 bp, Unknown
  misc_feature (1)..( 7): Matrix.001 file - promoters70/4772776
atataaa

SEQ ID NO: 40001 - DNA, 11 bp, Unknown
  misc_feature (1)..( 11): Matrix.001 file - promoters70/4772776
cttcttgttac

SEQ ID NO: 40002 - DNA, 11 bp, Unknown
  misc_feature (1)..( 11): Matrix.001 file - promoters70/4772776
aagtgtctttt

SEQ ID NO: 40003 - DNA, 8 bp, Unknown
  misc_feature (1)..( 8): Matrix.001 file - promoters70/4772776
aatcaaaa

SEQ ID NO: 40004 - DNA, 10 bp, Unknown
  misc_feature (1)..( 10): Matrix.001 file - promoters70/4772879
taaaaaggaa

SEQ ID NO: 40005 - DNA, 7 bp, Unknown
  misc_feature (1)..( 7): Matrix.001 file - promoters70/4772879
atataat

SEQ ID NO: 40006 - DNA, 8 bp, Unknown
  misc_feature (1)..( 8): Matrix.001 file - promoters70/4772879
taaatata

SEQ ID NO: 40007 - DNA, 11 bp, Unknown
  misc_feature (1)..( 11): Matrix.001 file - promoters70/4772879
ataaaattaat

SEQ ID NO: 40008 - DNA, 12 bp, Unknown
  misc_feature (1)..( 12): Matrix.001 file - promoters70/4772879
ttttgtaaacaa

SEQ ID NO: 40009 - DNA, 8 bp, Unknown
  misc_feature (1)..( 8): Matrix.001 file - promoters70/4772879
aaatttat

SEQ ID NO: 40010 - DNA, 8 bp, Unknown
  misc_feature (1)..( 8): Matrix.001 file - promoters70/4772879
aatcaaaa

SEQ ID NO: 40011 - DNA, 11 bp, Unknown
  misc_feature (1)..( 11): Matrix.001 file - promoters70/4772879
aaaaacacgaa

SEQ ID NO: 40012 - DNA, 8 bp, Unknown
  misc_feature (1)..( 8): Matrix.001 file - promoters70/4772879
atataata

SEQ ID NO: 40013 - DNA, 13 bp, Unknown
  misc_feature (1)..( 13): Matrix.001 file - promoters70/4773035
aatatttttaata

SEQ ID NO: 40014 - DNA, 9 bp, Unknown
  misc_feature (1)..( 9): Matrix.001 file - promoters70/4773035
aaatatttt

SEQ ID NO: 40015 - DNA, 7 bp, Unknown
  misc_feature (1)..( 7): Matrix.001 file - promoters70/4773035
tttttaa

SEQ ID NO: 40016 - DNA, 9 bp, Unknown
  misc_feature (1)..( 9): Matrix.001 file - promoters70/4773035
atatgagtc

SEQ ID NO: 40017 - DNA, 8 bp, Unknown
  misc_feature (1)..( 8): Matrix.001 file - promoters70/4773035
tattttca

SEQ ID NO: 40018 - DNA, 7 bp, Unknown
  misc_feature (1)..( 7): Matrix.001 file - promoters70/4773035
cggttag

SEQ ID NO: 40019 - DNA, 12 bp, Unknown
  misc_feature (1)..( 12): Matrix.001 file - promoters70/4773035
aaccaaaacaat

SEQ ID NO: 40020 - DNA, 10 bp, Unknown
  misc_feature (1)..( 10): Matrix.001 file - promoters70/4773068
tacgtgtcaa

SEQ ID NO: 40021 - DNA, 20 bp, Unknown
  misc_feature (1)..( 20): Matrix.001 file - promoters70/4773068
ttggctattgcttcaccgcc

SEQ ID NO: 40022 - DNA, 16 bp, Unknown
  misc_feature (1)..( 16): Matrix.001 file - promoters70/4773068
gaccgagtcgtcctcg

SEQ ID NO: 40023 - DNA, 19 bp, Unknown
  misc_feature (1)..( 19): Matrix.001 file - promoters70/4773068
ttcttcttctataaatcaa

SEQ ID NO: 40024 - DNA, 15 bp, Unknown
  misc_feature (1)..( 15): Matrix.001 file - promoters70/4773068
cgccttagctttctc

SEQ ID NO: 40025 - DNA, 13 bp, Unknown
  misc_feature (1)..( 13): Matrix.001 file - promoters70/4773074
atataaaacccct

SEQ ID NO: 40026 - DNA, 10 bp, Unknown
  misc_feature (1)..( 10): Matrix.001 file - promoters70/4773182
ttgtaagttt

SEQ ID NO: 40027 - DNA, 11 bp, Unknown
  misc_feature (1)..( 11): Matrix.001 file - promoters70/4773355
ttacttttaac

SEQ ID NO: 40028 - DNA, 9 bp, Unknown
  misc_feature (1)..( 9): Matrix.001 file - promoters70/4773355
ttaacaaaa

SEQ ID NO: 40029 - DNA, 8 bp, Unknown
  misc_feature (1)..( 8): Matrix.001 file - promoters70/4773355
aaacaatt

SEQ ID NO: 40030 - DNA, 9 bp, Unknown
  misc_feature (1)..( 9): Matrix.001 file - promoters70/4773823
agaaaattc

SEQ ID NO: 40031 - DNA, 9 bp, Unknown
  misc_feature (1)..( 9): Matrix.001 file - promoters70/4803329
aaaattgaa

SEQ ID NO: 40032 - DNA, 7 bp, Unknown
  misc_feature (1)..( 7): Matrix.001 file - promoters70/4806023
gaccgtt

SEQ ID NO: 40033 - DNA, 10 bp, Unknown
  misc_feature (1)..( 10): Matrix.001 file - promoters70/4806023
atcttgattt

SEQ ID NO: 40034 - DNA, 14 bp, Unknown
  misc_feature (1)..( 14): Matrix.001 file - promoters70/4807026
tatattaactttaa

SEQ ID NO: 40035 - DNA, 9 bp, Unknown
  misc_feature (1)..( 9): Matrix.001 file - promoters70/4807026
cttagaaac

SEQ ID NO: 40036 - DNA, 9 bp, Unknown
  misc_feature (1)..( 9): Matrix.001 file - promoters70/4807026
ttgatttgg

SEQ ID NO: 40037 - DNA, 10 bp, Unknown
  misc_feature (1)..( 10): Matrix.001 file - promoters70/4807026
aaaatcccta

SEQ ID NO: 40038 - DNA, 9 bp, Unknown
  misc_feature (1)..( 9): Matrix.001 file - promoters70/4807026
aaacatata

SEQ ID NO: 40039 - DNA, 12 bp, Unknown
  misc_feature (1)..( 12): Matrix.001 file - promoters70/4807236
tttagcaataag

SEQ ID NO: 40040 - DNA, 7 bp, Unknown
  misc_feature (1)..( 7): Matrix.001 file - promoters70/4808052
aaaccat

SEQ ID NO: 40041 - DNA, 10 bp, Unknown
  misc_feature (1)..( 10): Matrix.001 file - promoters70/4808052
ggacaaaaac

SEQ ID NO: 40042 - DNA, 7 bp, Unknown
  misc_feature (1)..( 7): Matrix.001 file - promoters70/4808052
ttaaaaa

SEQ ID NO: 40043 - DNA, 7 bp, Unknown
  misc_feature (1)..( 7): Matrix.001 file - promoters70/4808052
aaaatta

SEQ ID NO: 40044 - DNA, 7 bp, Unknown
  misc_feature (1)..( 7): Matrix.001 file - promoters70/4808052
agatcaa

SEQ ID NO: 40045 - DNA, 9 bp, Unknown
  misc_feature (1)..( 9): Matrix.001 file - promoters70/4811047
aaaaataaa

SEQ ID NO: 40046 - DNA, 9 bp, Unknown
  misc_feature (1)..( 9): Matrix.001 file - promoters70/4811047
taaataaaa

SEQ ID NO: 40047 - DNA, 9 bp, Unknown
  misc_feature (1)..( 9): Matrix.001 file - promoters70/4811047
atatattaa

SEQ ID NO: 40048 - DNA, 11 bp, Unknown
  misc_feature (1)..( 11): Matrix.001 file - promoters70/4811047
taattattatg

SEQ ID NO: 40049 - DNA, 8 bp, Unknown
  misc_feature (1)..( 8): Matrix.001 file - promoters70/4811047
gtcatata

SEQ ID NO: 40050 - DNA, 9 bp, Unknown
  misc_feature (1)..( 9): Matrix.001 file - promoters70/4899830
tatataaaa

SEQ ID NO: 40051 - DNA, 13 bp, Unknown
  misc_feature (1)..( 13): Matrix.001 file - promoters70/4899830
aaacgtttgataa

SEQ ID NO: 40052 - DNA, 11 bp, Unknown
  misc_feature (1)..( 11): Matrix.001 file - promoters70/4899873
catatatatta

SEQ ID NO: 40053 - DNA, 6 bp, Unknown
  misc_feature (1)..( 6): Matrix.001 file - promoters70/4899873
aaataa

SEQ ID NO: 40054 - DNA, 11 bp, Unknown
  misc_feature (1)..( 11): Matrix.001 file - promoters70/4900353
taatataaatt

SEQ ID NO: 40055 - DNA, 8 bp, Unknown
  misc_feature (1)..( 8): Matrix.001 file - promoters70/4900353
gggcctaa

SEQ ID NO: 40056 - DNA, 9 bp, Unknown
  misc_feature (1)..( 9): Matrix.001 file - promoters70/4901133
atgaaaatt

SEQ ID NO: 40057 - DNA, 8 bp, Unknown
  misc_feature (1)..( 8): Matrix.001 file - promoters70/4901133
acaaataa

SEQ ID NO: 40058 - DNA, 12 bp, Unknown
  misc_feature (1)..( 12): Matrix.001 file - promoters70/4901171
agtaactaaaaa

SEQ ID NO: 40059 - DNA, 5 bp, Unknown
  misc_feature (1)..( 5): Matrix.001 file - promoters70/4901171
actaa

SEQ ID NO: 40060 - DNA, 7 bp, Unknown
  misc_feature (1)..( 7): Matrix.001 file - promoters70/4901783
ccacaga

SEQ ID NO: 40061 - DNA, 10 bp, Unknown
  misc_feature (1)..( 10): Matrix.001 file - promoters70/4901839
ttaaacttgt

SEQ ID NO: 40062 - DNA, 7 bp, Unknown
  misc_feature (1)..( 7): Matrix.001 file - promoters70/4901839
attttaa

SEQ ID NO: 40063 - DNA, 5 bp, Unknown
  misc_feature (1)..( 5): Matrix.001 file - promoters70/4902387
tgata

SEQ ID NO: 40064 - DNA, 9 bp, Unknown
  misc_feature (1)..( 9): Matrix.001 file - promoters70/4902387
ccgaataaa

SEQ ID NO: 40065 - DNA, 10 bp, Unknown
  misc_feature (1)..( 10): Matrix.001 file - promoters70/4903614
ttaatataaa

SEQ ID NO: 40066 - DNA, 11 bp, Unknown
  misc_feature (1)..( 11): Matrix.001 file - promoters70/4909449
ttcaaaaaata

SEQ ID NO: 40067 - DNA, 15 bp, Unknown
  misc_feature (1)..( 15): Matrix.001 file - promoters70/4911380
cattcttgtattaac

SEQ ID NO: 40068 - DNA, 11 bp, Unknown
  misc_feature (1)..( 11): Matrix.001 file - promoters70/4911380
acaaaaatttt

SEQ ID NO: 40069 - DNA, 8 bp, Unknown
  misc_feature (1)..( 8): Matrix.001 file - promoters70/4911485
aatgtttg

SEQ ID NO: 40070 - DNA, 11 bp, Unknown
  misc_feature (1)..( 11): Matrix.001 file - promoters70/4911485
tgagtaaattt

SEQ ID NO: 40071 - DNA, 8 bp, Unknown
  misc_feature (1)..( 8): Matrix.001 file - promoters70/4911485
agttggat

SEQ ID NO: 40072 - DNA, 10 bp, Unknown
  misc_feature (1)..( 10): Matrix.001 file - promoters70/4911485
tataaattta

SEQ ID NO: 40073 - DNA, 10 bp, Unknown
  misc_feature (1)..( 10): Matrix.001 file - promoters70/4911485
ttattgttag

SEQ ID NO: 40074 - DNA, 8 bp, Unknown
  misc_feature (1)..( 8): Matrix.001 file - promoters70/4911485
aattttta

SEQ ID NO: 40075 - DNA, 15 bp, Unknown
  misc_feature (1)..( 15): Matrix.001 file - promoters70/4911485
atataaatttatata

SEQ ID NO: 40076 - DNA, 11 bp, Unknown
  misc_feature (1)..( 11): Matrix.001 file - promoters70/4911485
aatataaattt

SEQ ID NO: 40077 - DNA, 9 bp, Unknown
  misc_feature (1)..( 9): Matrix.001 file - promoters70/4911485
tatcaaaaa

SEQ ID NO: 40078 - DNA, 8 bp, Unknown
  misc_feature (1)..( 8): Matrix.001 file - promoters70/4911485
agaattta

SEQ ID NO: 40079 - DNA, 10 bp, Unknown
  misc_feature (1)..( 10): Matrix.001 file - promoters70/4911492
aataaaatta

SEQ ID NO: 40080 - DNA, 8 bp, Unknown
  misc_feature (1)..( 8): Matrix.001 file - promoters70/4911492
aagaaata

SEQ ID NO: 40081 - DNA, 9 bp, Unknown
  misc_feature (1)..( 9): Matrix.001 file - promoters70/4911492
tatatatat

SEQ ID NO: 40082 - DNA, 9 bp, Unknown
  misc_feature (1)..( 9): Matrix.001 file - promoters70/4911492
taaccaaaa

SEQ ID NO: 40083 - DNA, 12 bp, Unknown
  misc_feature (1)..( 12): Matrix.001 file - promoters70/4911492
aaaataaaaata

SEQ ID NO: 40084 - DNA, 8 bp, Unknown
  misc_feature (1)..( 8): Matrix.001 file - promoters70/4911492
aataaata

SEQ ID NO: 40085 - DNA, 10 bp, Unknown
  misc_feature (1)..( 10): Matrix.001 file - promoters70/4911492
tggaaagttt

SEQ ID NO: 40086 - DNA, 8 bp, Unknown
  misc_feature (1)..( 8): Matrix.001 file - promoters70/4914438
tttgccag

SEQ ID NO: 40087 - DNA, 10 bp, Unknown
  misc_feature (1)..( 10): Matrix.001 file - promoters70/4914438
tataaaaaat

SEQ ID NO: 40088 - DNA, 7 bp, Unknown
  misc_feature (1)..( 7): Matrix.001 file - promoters70/4914438
tataaaa

SEQ ID NO: 40089 - DNA, 10 bp, Unknown
  misc_feature (1)..( 10): Matrix.001 file - promoters70/4915384
ggtttatttt

SEQ ID NO: 40090 - DNA, 9 bp, Unknown
  misc_feature (1)..( 9): Matrix.001 file - promoters70/4915420
aggaatatt

SEQ ID NO: 40091 - DNA, 10 bp, Unknown
  misc_feature (1)..( 10): Matrix.001 file - promoters70/4915420
taatatgagt

SEQ ID NO: 40092 - DNA, 9 bp, Unknown
  misc_feature (1)..( 9): Matrix.001 file - promoters70/4915420
tatatatga

SEQ ID NO: 40093 - DNA, 7 bp, Unknown
  misc_feature (1)..( 7): Matrix.001 file - promoters70/4915420
aaacaaa

SEQ ID NO: 40094 - DNA, 8 bp, Unknown
  misc_feature (1)..( 8): Matrix.001 file - promoters70/4915420
ggttttaa

SEQ ID NO: 40095 - DNA, 12 bp, Unknown
  misc_feature (1)..( 12): Matrix.001 file - promoters70/4915420
agaaatataaat

SEQ ID NO: 40096 - DNA, 12 bp, Unknown
  misc_feature (1)..( 12): Matrix.001 file - promoters70/4915606
aaaaaagtttat

SEQ ID NO: 40097 - DNA, 15 bp, Unknown
  misc_feature (1)..( 15): Matrix.001 file - promoters70/4915606
gttaaatttttaatt

SEQ ID NO: 40098 - DNA, 9 bp, Unknown
  misc_feature (1)..( 9): Matrix.001 file - promoters70/4915606
aaagaattt

SEQ ID NO: 40099 - DNA, 9 bp, Unknown
  misc_feature (1)..( 9): Matrix.001 file - promoters70/4921433
cgagtggct

SEQ ID NO: 40100 - DNA, 8 bp, Unknown
  misc_feature (1)..( 8): Matrix.001 file - promoters70/4921433
gaatgaag

SEQ ID NO: 40101 - DNA, 12 bp, Unknown
  misc_feature (1)..( 12): Matrix.001 file - promoters70/4934904
tctgggaaatcg

SEQ ID NO: 40102 - DNA, 6 bp, Unknown
  misc_feature (1)..( 6): Matrix.001 file - promoters70/4934904
tttcaa

SEQ ID NO: 40103 - DNA, 6 bp, Unknown
  misc_feature (1)..( 6): Matrix.001 file - promoters70/4934904
ggaaat

SEQ ID NO: 40104 - DNA, 10 bp, Unknown
  misc_feature (1)..( 10): Matrix.001 file - promoters70/4949707
aaataattga

SEQ ID NO: 40105 - DNA, 7 bp, Unknown
  misc_feature (1)..( 7): Matrix.001 file - promoters70/4949707
atattta

SEQ ID NO: 40106 - DNA, 9 bp, Unknown
  misc_feature (1)..( 9): Matrix.001 file - promoters70/4978201
tatatattc

SEQ ID NO: 40107 - DNA, 10 bp, Unknown
  misc_feature (1)..( 10): Matrix.001 file - promoters70/4992383
ttttgatttg

SEQ ID NO: 40108 - DNA, 12 bp, Unknown
  misc_feature (1)..( 12): Matrix.001 file - promoters70/4992383
aacttttaagta

SEQ ID NO: 40109 - DNA, 7 bp, Unknown
  misc_feature (1)..( 7): Matrix.001 file - promoters70/5662743
atttgat

SEQ ID NO: 40110 - DNA, 10 bp, Unknown
  misc_feature (1)..( 10): Matrix.001 file - promoters70/5662799
aggcccaatt

SEQ ID NO: 40111 - DNA, 8 bp, Unknown
  misc_feature (1)..( 8): Matrix.001 file - promoters70/5662799
aatttgat

SEQ ID NO: 40112 - DNA, 8 bp, Unknown
  misc_feature (1)..( 8): Matrix.001 file - promoters70/5662799
tttgacca

SEQ ID NO: 40113 - DNA, 7 bp, Unknown
  misc_feature (1)..( 7): Matrix.001 file - promoters70/5662893
aaacaaa

SEQ ID NO: 40114 - DNA, 11 bp, Unknown
  misc_feature (1)..( 11): Matrix.001 file - promoters70/5662893
acttgacaaaa

SEQ ID NO: 40115 - DNA, 11 bp, Unknown
  misc_feature (1)..( 11): Matrix.001 file - promoters70/5662893
ctagagacaaa

SEQ ID NO: 40116 - DNA, 11 bp, Unknown
  misc_feature (1)..( 11): Matrix.001 file - promoters70/5662902
taagataataa

SEQ ID NO: 40117 - DNA, 10 bp, Unknown
  misc_feature (1)..( 10): Matrix.001 file - promoters70/5662914
ggaagtagag

SEQ ID NO: 40118 - DNA, 9 bp, Unknown
  misc_feature (1)..( 9): Matrix.001 file - promoters70/5662914
aagatgatg

SEQ ID NO: 40119 - DNA, 9 bp, Unknown
  misc_feature (1)..( 9): Matrix.001 file - promoters70/5662921
taatttcaa

SEQ ID NO: 40120 - DNA, 8 bp, Unknown
  misc_feature (1)..( 8): Matrix.001 file - promoters70/5662921
aaatttta

SEQ ID NO: 40121 - DNA, 8 bp, Unknown
  misc_feature (1)..( 8): Matrix.001 file - promoters70/5662967
tatattat

SEQ ID NO: 40122 - DNA, 7 bp, Unknown
  misc_feature (1)..( 7): Matrix.001 file - promoters70/5662977
gttcctt

SEQ ID NO: 40123 - DNA, 8 bp, Unknown
  misc_feature (1)..( 8): Matrix.001 file - promoters70/5662977
aaatgtta

SEQ ID NO: 40124 - DNA, 7 bp, Unknown
  misc_feature (1)..( 7): Matrix.001 file - promoters70/5662977
gttgatt

SEQ ID NO: 40125 - DNA, 8 bp, Unknown
  misc_feature (1)..( 8): Matrix.001 file - promoters70/5662977
cgacatgt

SEQ ID NO: 40126 - DNA, 6 bp, Unknown
  misc_feature (1)..( 6): Matrix.001 file - promoters70/5662977
acatgt

SEQ ID NO: 40127 - DNA, 12 bp, Unknown
  misc_feature (1)..( 12): Matrix.001 file - promoters70/5663003
aaataattgtat

SEQ ID NO: 40128 - DNA, 10 bp, Unknown
  misc_feature (1)..( 10): Matrix.001 file - promoters70/5663003
gaaatagatt

SEQ ID NO: 40129 - DNA, 11 bp, Unknown
  misc_feature (1)..( 11): Matrix.001 file - promoters70/5663003
ttacttaaatt

SEQ ID NO: 40130 - DNA, 10 bp, Unknown
  misc_feature (1)..( 10): Matrix.001 file - promoters70/5663116
cattaatttc

SEQ ID NO: 40131 - DNA, 10 bp, Unknown
  misc_feature (1)..( 10): Matrix.001 file - promoters70/5663116
aattaattaa

SEQ ID NO: 40132 - DNA, 8 bp, Unknown
  misc_feature (1)..( 8): Matrix.001 file - promoters70/5663116
acgaaatt

SEQ ID NO: 40133 - DNA, 11 bp, Unknown
  misc_feature (1)..( 11): Matrix.001 file - promoters70/5663116
attaaatcaat

SEQ ID NO: 40134 - DNA, 9 bp, Unknown
  misc_feature (1)..( 9): Matrix.001 file - promoters70/5663138
taataacat

SEQ ID NO: 40135 - DNA, 9 bp, Unknown
  misc_feature (1)..( 9): Matrix.001 file - promoters70/5663142
aatgaatat

SEQ ID NO: 40136 - DNA, 8 bp, Unknown
  misc_feature (1)..( 8): Matrix.001 file - promoters70/5663142
aataatga

SEQ ID NO: 40137 - DNA, 8 bp, Unknown
  misc_feature (1)..( 8): Matrix.001 file - promoters70/5663142
tattaatt

SEQ ID NO: 40138 - DNA, 6 bp, Unknown
  misc_feature (1)..( 6): Matrix.001 file - promoters70/5663142
ataata

SEQ ID NO: 40139 - DNA, 14 bp, Unknown
  misc_feature (1)..( 14): Matrix.001 file - promoters70/5663142
acatataataaata

SEQ ID NO: 40140 - DNA, 8 bp, Unknown
  misc_feature (1)..( 8): Matrix.001 file - promoters70/5663142
aaatatat

SEQ ID NO: 40141 - DNA, 9 bp, Unknown
  misc_feature (1)..( 9): Matrix.001 file - promoters70/5663142
aaattaata

SEQ ID NO: 40142 - DNA, 6 bp, Unknown
  misc_feature (1)..( 6): Matrix.001 file - promoters70/5663142
aaatat

SEQ ID NO: 40143 - DNA, 12 bp, Unknown
  misc_feature (1)..( 12): Matrix.001 file - promoters70/5663142
agacataataaa

SEQ ID NO: 40144 - DNA, 8 bp, Unknown
  misc_feature (1)..( 8): Matrix.001 file - promoters70/5663142
agtgaaaa

SEQ ID NO: 40145 - DNA, 8 bp, Unknown
  misc_feature (1)..( 8): Matrix.001 file - promoters70/5663142
tcatataa

SEQ ID NO: 40146 - DNA, 8 bp, Unknown
  misc_feature (1)..( 8): Matrix.001 file - promoters70/5663142
aaatcttg

SEQ ID NO: 40147 - DNA, 10 bp, Unknown
  misc_feature (1)..( 10): Matrix.001 file - promoters70/5663151
aagaaatgat

SEQ ID NO: 40148 - DNA, 9 bp, Unknown
  misc_feature (1)..( 9): Matrix.001 file - promoters70/5663151
caaacccaa

SEQ ID NO: 40149 - DNA, 11 bp, Unknown
  misc_feature (1)..( 11): Matrix.001 file - promoters70/5663224
cttttaaaata

SEQ ID NO: 40150 - DNA, 7 bp, Unknown
  misc_feature (1)..( 7): Matrix.001 file - promoters70/5663224
gaattat

SEQ ID NO: 40151 - DNA, 13 bp, Unknown
  misc_feature (1)..( 13): Matrix.001 file - promoters70/5663374
aaataaaataaat

SEQ ID NO: 40152 - DNA, 9 bp, Unknown
  misc_feature (1)..( 9): Matrix.001 file - promoters70/5663374
ttcccacta

SEQ ID NO: 40153 - DNA, 9 bp, Unknown
  misc_feature (1)..( 9): Matrix.001 file - promoters70/5663625
aagtcacta

SEQ ID NO: 40154 - DNA, 7 bp, Unknown
  misc_feature (1)..( 7): Matrix.001 file - promoters70/5663625
aagaaag

SEQ ID NO: 40155 - DNA, 11 bp, Unknown
  misc_feature (1)..( 11): Matrix.001 file - promoters70/5663625
ttataataatt

SEQ ID NO: 40156 - DNA, 9 bp, Unknown
  misc_feature (1)..( 9): Matrix.001 file - promoters70/5663625
tagtaatat

SEQ ID NO: 40157 - DNA, 9 bp, Unknown
  misc_feature (1)..( 9): Matrix.001 file - promoters70/5663625
ttgaaaatt

SEQ ID NO: 40158 - DNA, 7 bp, Unknown
  misc_feature (1)..( 7): Matrix.001 file - promoters70/5663625
tcagtct

SEQ ID NO: 40159 - DNA, 7 bp, Unknown
  misc_feature (1)..( 7): Matrix.001 file - promoters70/5663625
atatgat

SEQ ID NO: 40160 - DNA, 8 bp, Unknown
  misc_feature (1)..( 8): Matrix.001 file - promoters70/5663625
atatgagt

SEQ ID NO: 40161 - DNA, 7 bp, Unknown
  misc_feature (1)..( 7): Matrix.001 file - promoters70/5663625
aaattta

SEQ ID NO: 40162 - DNA, 9 bp, Unknown
  misc_feature (1)..( 9): Matrix.001 file - promoters70/5663805
ttactttac

SEQ ID NO: 40163 - DNA, 6 bp, Unknown
  misc_feature (1)..( 6): Matrix.001 file - promoters70/5663805
atataa

SEQ ID NO: 40164 - DNA, 8 bp, Unknown
  misc_feature (1)..( 8): Matrix.001 file - promoters70/5663805
atccaaac

SEQ ID NO: 40165 - DNA, 7 bp, Unknown
  misc_feature (1)..( 7): Matrix.001 file - promoters70/5663805
gtaagaa

SEQ ID NO: 40166 - DNA, 10 bp, Unknown
  misc_feature (1)..( 10): Matrix.001 file - promoters70/5663805
ctttattgat

SEQ ID NO: 40167 - DNA, 8 bp, Unknown
  misc_feature (1)..( 8): Matrix.001 file - promoters70/5663805
ataataaa

SEQ ID NO: 40168 - DNA, 9 bp, Unknown
  misc_feature (1)..( 9): Matrix.001 file - promoters70/5663805
aatttattt

SEQ ID NO: 40169 - DNA, 13 bp, Unknown
  misc_feature (1)..( 13): Matrix.001 file - promoters70/5663805
acttataataaaa

SEQ ID NO: 40170 - DNA, 10 bp, Unknown
  misc_feature (1)..( 10): Matrix.001 file - promoters70/5663805
aaaaagacac

SEQ ID NO: 40171 - DNA, 7 bp, Unknown
  misc_feature (1)..( 7): Matrix.001 file - promoters70/5663805
aaataaa

SEQ ID NO: 40172 - DNA, 8 bp, Unknown
  misc_feature (1)..( 8): Matrix.001 file - promoters70/5663805
aatatgaa

SEQ ID NO: 40173 - DNA, 8 bp, Unknown
  misc_feature (1)..( 8): Matrix.001 file - promoters70/5663805
tttaaaat

SEQ ID NO: 40174 - DNA, 8 bp, Unknown
  misc_feature (1)..( 8): Matrix.001 file - promoters70/5663805
tttatttc

SEQ ID NO: 40175 - DNA, 8 bp, Unknown
  misc_feature (1)..( 8): Matrix.001 file - promoters70/5663862
tgtcattt

SEQ ID NO: 40176 - DNA, 8 bp, Unknown
  misc_feature (1)..( 8): Matrix.001 file - promoters70/5663907
taatcaat

SEQ ID NO: 40177 - DNA, 9 bp, Unknown
  misc_feature (1)..( 9): Matrix.001 file - promoters70/5663907
ttatttgga

SEQ ID NO: 40178 - DNA, 7 bp, Unknown
  misc_feature (1)..( 7): Matrix.001 file - promoters70/5663907
tataaat

SEQ ID NO: 40179 - DNA, 8 bp, Unknown
  misc_feature (1)..( 8): Matrix.001 file - promoters70/5663907
attgttga

SEQ ID NO: 40180 - DNA, 6 bp, Unknown
  misc_feature (1)..( 6): Matrix.001 file - promoters70/5663907
agcaat

SEQ ID NO: 40181 - DNA, 11 bp, Unknown
  misc_feature (1)..( 11): Matrix.001 file - promoters70/5663934
atactacaaat

SEQ ID NO: 40182 - DNA, 13 bp, Unknown
  misc_feature (1)..( 13): Matrix.001 file - promoters70/5663934
aaaacgaatgact

SEQ ID NO: 40183 - DNA, 12 bp, Unknown
  misc_feature (1)..( 12): Matrix.001 file - promoters70/5663934
gaacaaagaaaa

SEQ ID NO: 40184 - DNA, 13 bp, Unknown
  misc_feature (1)..( 13): Matrix.001 file - promoters70/5663934
tactaaaaataac

SEQ ID NO: 40185 - DNA, 11 bp, Unknown
  misc_feature (1)..( 11): Matrix.001 file - promoters70/5663934
aaaagaaatga

SEQ ID NO: 40186 - DNA, 5 bp, Unknown
  misc_feature (1)..( 5): Matrix.001 file - promoters70/5663934
caaat

SEQ ID NO: 40187 - DNA, 7 bp, Unknown
  misc_feature (1)..( 7): Matrix.001 file - promoters70/5663950
ggatttt

SEQ ID NO: 40188 - DNA, 9 bp, Unknown
  misc_feature (1)..( 9): Matrix.001 file - promoters70/5663950
ggatttatt

SEQ ID NO: 40189 - DNA, 8 bp, Unknown
  misc_feature (1)..( 8): Matrix.001 file - promoters70/5663950
ctcatata

SEQ ID NO: 40190 - DNA, 8 bp, Unknown
  misc_feature (1)..( 8): Matrix.001 file - promoters70/5663950
aaagattt

SEQ ID NO: 40191 - DNA, 9 bp, Unknown
  misc_feature (1)..( 9): Matrix.001 file - promoters70/5663970
gagtttctt

SEQ ID NO: 40192 - DNA, 10 bp, Unknown
  misc_feature (1)..( 10): Matrix.001 file - promoters70/5663996
tggaataatc

SEQ ID NO: 40193 - DNA, 13 bp, Unknown
  misc_feature (1)..( 13): Matrix.001 file - promoters70/5663996
atcaaatacacaa

SEQ ID NO: 40194 - DNA, 9 bp, Unknown
  misc_feature (1)..( 9): Matrix.001 file - promoters70/5663996
aacaatttt

SEQ ID NO: 40195 - DNA, 9 bp, Unknown
  misc_feature (1)..( 9): Matrix.001 file - promoters70/5663996
ttggattta

SEQ ID NO: 40196 - DNA, 7 bp, Unknown
  misc_feature (1)..( 7): Matrix.001 file - promoters70/5663996
gagagta

SEQ ID NO: 40197 - DNA, 8 bp, Unknown
  misc_feature (1)..( 8): Matrix.001 file - promoters70/5663996
ctttgacc

SEQ ID NO: 40198 - DNA, 13 bp, Unknown
  misc_feature (1)..( 13): Matrix.001 file - promoters70/5663996
ttgaatcaaaatt

SEQ ID NO: 40199 - DNA, 10 bp, Unknown
  misc_feature (1)..( 10): Matrix.001 file - promoters70/5663996
agctcgctct

SEQ ID NO: 40200 - DNA, 9 bp, Unknown
  misc_feature (1)..( 9): Matrix.001 file - promoters70/5664060
acaaataat

SEQ ID NO: 40201 - DNA, 8 bp, Unknown
  misc_feature (1)..( 8): Matrix.001 file - promoters70/5664060
attggatt

SEQ ID NO: 40202 - DNA, 9 bp, Unknown
  misc_feature (1)..( 9): Matrix.001 file - promoters70/5664060
atttgtcta

SEQ ID NO: 40203 - DNA, 7 bp, Unknown
  misc_feature (1)..( 7): Matrix.001 file - promoters70/5664060
tgaaaac

SEQ ID NO: 40204 - DNA, 7 bp, Unknown
  misc_feature (1)..( 7): Matrix.001 file - promoters70/5664141
atttatg

SEQ ID NO: 40205 - DNA, 9 bp, Unknown
  misc_feature (1)..( 9): Matrix.001 file - promoters70/5664141
atttttttt

SEQ ID NO: 40206 - DNA, 7 bp, Unknown
  misc_feature (1)..( 7): Matrix.001 file - promoters70/5664170
cataatt

SEQ ID NO: 40207 - DNA, 8 bp, Unknown
  misc_feature (1)..( 8): Matrix.001 file - promoters70/5664182
tacaaatt

SEQ ID NO: 40208 - DNA, 11 bp, Unknown
  misc_feature (1)..( 11): Matrix.001 file - promoters70/5664182
gcttaagttta

SEQ ID NO: 40209 - DNA, 8 bp, Unknown
  misc_feature (1)..( 8): Matrix.001 file - promoters70/5664182
gttaaagt

SEQ ID NO: 40210 - DNA, 8 bp, Unknown
  misc_feature (1)..( 8): Matrix.001 file - promoters70/5664294
aaaatcga

SEQ ID NO: 40211 - DNA, 8 bp, Unknown
  misc_feature (1)..( 8): Matrix.001 file - promoters70/5664294
gataaaaa

SEQ ID NO: 40212 - DNA, 10 bp, Unknown
  misc_feature (1)..( 10): Matrix.001 file - promoters70/5664294
actttataat

SEQ ID NO: 40213 - DNA, 10 bp, Unknown
  misc_feature (1)..( 10): Matrix.001 file - promoters70/5664298
catgagctta

SEQ ID NO: 40214 - DNA, 11 bp, Unknown
  misc_feature (1)..( 11): Matrix.001 file - promoters70/5664311
cattgtaaact

SEQ ID NO: 40215 - DNA, 11 bp, Unknown
  misc_feature (1)..( 11): Matrix.001 file - promoters70/5664311
aaaaaaataaa

SEQ ID NO: 40216 - DNA, 9 bp, Unknown
  misc_feature (1)..( 9): Matrix.001 file - promoters70/5664311
aaagttttc

SEQ ID NO: 40217 - DNA, 9 bp, Unknown
  misc_feature (1)..( 9): Matrix.001 file - promoters70/5664457
tctttctat

SEQ ID NO: 40218 - DNA, 7 bp, Unknown
  misc_feature (1)..( 7): Matrix.001 file - promoters70/5664457
tcaaacc

SEQ ID NO: 40219 - DNA, 7 bp, Unknown
  misc_feature (1)..( 7): Matrix.001 file - promoters70/5664465
ttcacaa

SEQ ID NO: 40220 - DNA, 12 bp, Unknown
  misc_feature (1)..( 12): Matrix.001 file - promoters70/5664703
ctttttgtatat

SEQ ID NO: 40221 - DNA, 8 bp, Unknown
  misc_feature (1)..( 8): Matrix.001 file - promoters70/5664703
tctgaatt

SEQ ID NO: 40222 - DNA, 7 bp, Unknown
  misc_feature (1)..( 7): Matrix.001 file - promoters70/5664873
aaataaa

SEQ ID NO: 40223 - DNA, 8 bp, Unknown
  misc_feature (1)..( 8): Matrix.001 file - promoters70/5664873
taaaattt

SEQ ID NO: 40224 - DNA, 7 bp, Unknown
  misc_feature (1)..( 7): Matrix.001 file - promoters70/5664873
aaataaa

SEQ ID NO: 40225 - DNA, 7 bp, Unknown
  misc_feature (1)..( 7): Matrix.001 file - promoters70/5664873
aaattta

SEQ ID NO: 40226 - DNA, 9 bp, Unknown
  misc_feature (1)..( 9): Matrix.001 file - promoters70/5664873
aaacttaat

SEQ ID NO: 40227 - DNA, 11 bp, Unknown
  misc_feature (1)..( 11): Matrix.001 file - promoters70/5664873
tttttgacttt

SEQ ID NO: 40228 - DNA, 13 bp, Unknown
  misc_feature (1)..( 13): Matrix.001 file - promoters70/5664873
ttttactaaaaaa

SEQ ID NO: 40229 - DNA, 10 bp, Unknown
  misc_feature (1)..( 10): Matrix.001 file - promoters70/5664873
taatgtctcg

SEQ ID NO: 40230 - DNA, 9 bp, Unknown
  misc_feature (1)..( 9): Matrix.001 file - promoters70/5664873
aaattttat

SEQ ID NO: 40231 - DNA, 10 bp, Unknown
  misc_feature (1)..( 10): Matrix.001 file - promoters70/5664885
ataaaaatta

SEQ ID NO: 40232 - DNA, 7 bp, Unknown
  misc_feature (1)..( 7): Matrix.001 file - promoters70/5665140
aaaacaa

SEQ ID NO: 40233 - DNA, 8 bp, Unknown
  misc_feature (1)..( 8): Matrix.001 file - promoters70/5665140
catcgttt

SEQ ID NO: 40234 - DNA, 8 bp, Unknown
  misc_feature (1)..( 8): Matrix.001 file - promoters70/5665140
gattcttt

SEQ ID NO: 40235 - DNA, 11 bp, Unknown
  misc_feature (1)..( 11): Matrix.001 file - promoters70/5665347
aattatgaatt

SEQ ID NO: 40236 - DNA, 7 bp, Unknown
  misc_feature (1)..( 7): Matrix.001 file - promoters70/5665351
gcatttc

SEQ ID NO: 40237 - DNA, 8 bp, Unknown
  misc_feature (1)..( 8): Matrix.001 file - promoters70/5665351
caaatgga

SEQ ID NO: 40238 - DNA, 9 bp, Unknown
  misc_feature (1)..( 9): Matrix.001 file - promoters70/5665351
cttcttctc

SEQ ID NO: 40239 - DNA, 7 bp, Unknown
  misc_feature (1)..( 7): Matrix.001 file - promoters70/5665359
aaaaatt

SEQ ID NO: 40240 - DNA, 5 bp, Unknown
  misc_feature (1)..( 5): Matrix.001 file - promoters70/5665359
gttta

SEQ ID NO: 40241 - DNA, 6 bp, Unknown
  misc_feature (1)..( 6): Matrix.001 file - promoters70/5665359
tattgt

SEQ ID NO: 40242 - DNA, 9 bp, Unknown
  misc_feature (1)..( 9): Matrix.001 file - promoters70/5665359
attgttttg

SEQ ID NO: 40243 - DNA, 9 bp, Unknown
  misc_feature (1)..( 9): Matrix.001 file - promoters70/5665404
ttcgtcctt

SEQ ID NO: 40244 - DNA, 7 bp, Unknown
  misc_feature (1)..( 7): Matrix.001 file - promoters70/5665404
ttgcttt

SEQ ID NO: 40245 - DNA, 10 bp, Unknown
  misc_feature (1)..( 10): Matrix.001 file - promoters70/5665404
aaataaaata

SEQ ID NO: 40246 - DNA, 10 bp, Unknown
  misc_feature (1)..( 10): Matrix.001 file - promoters70/5665507
atttttcttt

SEQ ID NO: 40247 - DNA, 7 bp, Unknown
  misc_feature (1)..( 7): Matrix.001 file - promoters70/5665507
atgtttg

SEQ ID NO: 40248 - DNA, 7 bp, Unknown
  misc_feature (1)..( 7): Matrix.001 file - promoters70/5665507
aaaaaat

SEQ ID NO: 40249 - DNA, 7 bp, Unknown
  misc_feature (1)..( 7): Matrix.001 file - promoters70/5665507
tattttc

SEQ ID NO: 40250 - DNA, 8 bp, Unknown
  misc_feature (1)..( 8): Matrix.001 file - promoters70/5665507
ttttgtac

SEQ ID NO: 40251 - DNA, 7 bp, Unknown
  misc_feature (1)..( 7): Matrix.001 file - promoters70/5665507
aaatatc

SEQ ID NO: 40252 - DNA, 8 bp, Unknown
  misc_feature (1)..( 8): Matrix.001 file - promoters70/5665507
aatatctt

SEQ ID NO: 40253 - DNA, 10 bp, Unknown
  misc_feature (1)..( 10): Matrix.001 file - promoters70/5665796
agcatccaca

SEQ ID NO: 40254 - DNA, 10 bp, Unknown
  misc_feature (1)..( 10): Matrix.001 file - promoters70/5665796
aaaatgtgaa

SEQ ID NO: 40255 - DNA, 7 bp, Unknown
  misc_feature (1)..( 7): Matrix.001 file - promoters70/5667720
aatgata

SEQ ID NO: 40256 - DNA, 7 bp, Unknown
  misc_feature (1)..( 7): Matrix.001 file - promoters70/5667720
aaaaatt

SEQ ID NO: 40257 - DNA, 9 bp, Unknown
  misc_feature (1)..( 9): Matrix.001 file - promoters70/5667720
aaagaaata

SEQ ID NO: 40258 - DNA, 9 bp, Unknown
  misc_feature (1)..( 9): Matrix.001 file - promoters70/5667720
aaaacaaat

SEQ ID NO: 40259 - DNA, 9 bp, Unknown
  misc_feature (1)..( 9): Matrix.001 file - promoters70/5667720
taaccaaaa

SEQ ID NO: 40260 - DNA, 12 bp, Unknown
  misc_feature (1)..( 12): Matrix.001 file - promoters70/5667720
aaaataaaaata

SEQ ID NO: 40261 - DNA, 8 bp, Unknown
  misc_feature (1)..( 8): Matrix.001 file - promoters70/5667737
ctacaaag

SEQ ID NO: 40262 - DNA, 14 bp, Unknown
  misc_feature (1)..( 14): Matrix.001 file - promoters70/5667737
ctacaaagaccaaa

SEQ ID NO: 40263 - DNA, 13 bp, Unknown
  misc_feature (1)..( 13): Matrix.001 file - promoters70/5667812
gaaagtttttttt

SEQ ID NO: 40264 - DNA, 10 bp, Unknown
  misc_feature (1)..( 10): Matrix.001 file - promoters70/5667812
aaagaaattc

SEQ ID NO: 40265 - DNA, 9 bp, Unknown
  misc_feature (1)..( 9): Matrix.001 file - promoters70/5667812
gaaacaaaa

SEQ ID NO: 40266 - DNA, 13 bp, Unknown
  misc_feature (1)..( 13): Matrix.001 file - promoters70/5667812
acaagaattaaaa

SEQ ID NO: 40267 - DNA, 8 bp, Unknown
  misc_feature (1)..( 8): Matrix.001 file - promoters70/5667822
tttgccag

SEQ ID NO: 40268 - DNA, 10 bp, Unknown
  misc_feature (1)..( 10): Matrix.001 file - promoters70/5667822
tataaaaaat

SEQ ID NO: 40269 - DNA, 7 bp, Unknown
  misc_feature (1)..( 7): Matrix.001 file - promoters70/5667822
tataaaa

SEQ ID NO: 40270 - DNA, 9 bp, Unknown
  misc_feature (1)..( 9): Matrix.001 file - promoters70/5667849
gtgaatgat

SEQ ID NO: 40271 - DNA, 8 bp, Unknown
  misc_feature (1)..( 8): Matrix.001 file - promoters70/5667849
cattttgt

SEQ ID NO: 40272 - DNA, 8 bp, Unknown
  misc_feature (1)..( 8): Matrix.001 file - promoters70/5668294
attaattt

SEQ ID NO: 40273 - DNA, 8 bp, Unknown
  misc_feature (1)..( 8): Matrix.001 file - promoters70/5668359
atggattt

SEQ ID NO: 40274 - DNA, 13 bp, Unknown
  misc_feature (1)..( 13): Matrix.001 file - promoters70/5668435
agatacaaaacat

SEQ ID NO: 40275 - DNA, 9 bp, Unknown
  misc_feature (1)..( 9): Matrix.001 file - promoters70/5668435
ttttgttat

SEQ ID NO: 40276 - DNA, 11 bp, Unknown
  misc_feature (1)..( 11): Matrix.001 file - promoters70/5668435
atataaaaaaa

SEQ ID NO: 40277 - DNA, 12 bp, Unknown
  misc_feature (1)..( 12): Matrix.001 file - promoters70/5668435
tactatttaaac

SEQ ID NO: 40278 - DNA, 9 bp, Unknown
  misc_feature (1)..( 9): Matrix.001 file - promoters70/5668454
tcttaattt

SEQ ID NO: 40279 - DNA, 6 bp, Unknown
  misc_feature (1)..( 6): Matrix.001 file - promoters70/5668454
tctaaa

SEQ ID NO: 40280 - DNA, 8 bp, Unknown
  misc_feature (1)..( 8): Matrix.001 file - promoters70/5668454
aaaaataa

SEQ ID NO: 40281 - DNA, 8 bp, Unknown
  misc_feature (1)..( 8): Matrix.001 file - promoters70/5668469
ataaaata

SEQ ID NO: 40282 - DNA, 7 bp, Unknown
  misc_feature (1)..( 7): Matrix.001 file - promoters70/5668469
tttatta

SEQ ID NO: 40283 - DNA, 9 bp, Unknown
  misc_feature (1)..( 9): Matrix.001 file - promoters70/5668493
aataaatgt

SEQ ID NO: 40284 - DNA, 9 bp, Unknown
  misc_feature (1)..( 9): Matrix.001 file - promoters70/5668493
gtttattta

SEQ ID NO: 40285 - DNA, 9 bp, Unknown
  misc_feature (1)..( 9): Matrix.001 file - promoters70/5668493
tacaatatt

SEQ ID NO: 40286 - DNA, 8 bp, Unknown
  misc_feature (1)..( 8): Matrix.001 file - promoters70/5668509
ttaagaaa

SEQ ID NO: 40287 - DNA, 8 bp, Unknown
  misc_feature (1)..( 8): Matrix.001 file - promoters70/5668509
ccaaaaaa

SEQ ID NO: 40288 - DNA, 7 bp, Unknown
  misc_feature (1)..( 7): Matrix.001 file - promoters70/5668509
agaagaa

SEQ ID NO: 40289 - DNA, 7 bp, Unknown
  misc_feature (1)..( 7): Matrix.001 file - promoters70/5668509
agaggag

SEQ ID NO: 40290 - DNA, 7 bp, Unknown
  misc_feature (1)..( 7): Matrix.001 file - promoters70/5668529
gttgact

SEQ ID NO: 40291 - DNA, 7 bp, Unknown
  misc_feature (1)..( 7): Matrix.001 file - promoters70/5668547
gctgaaa

SEQ ID NO: 40292 - DNA, 11 bp, Unknown
  misc_feature (1)..( 11): Matrix.001 file - promoters70/5668720
aaagaaacaaa

SEQ ID NO: 40293 - DNA, 9 bp, Unknown
  misc_feature (1)..( 9): Matrix.001 file - promoters70/5668720
aaaaaagtt

SEQ ID NO: 40294 - DNA, 13 bp, Unknown
  misc_feature (1)..( 13): Matrix.001 file - promoters70/5668720
acatttgtttttg

SEQ ID NO: 40295 - DNA, 9 bp, Unknown
  misc_feature (1)..( 9): Matrix.001 file - promoters70/5668897
atgtttttt

SEQ ID NO: 40296 - DNA, 8 bp, Unknown
  misc_feature (1)..( 8): Matrix.001 file - promoters70/5668903
agaatttg

SEQ ID NO: 40297 - DNA, 9 bp, Unknown
  misc_feature (1)..( 9): Matrix.001 file - promoters70/5668903
tttaatttg

SEQ ID NO: 40298 - DNA, 8 bp, Unknown
  misc_feature (1)..( 8): Matrix.001 file - promoters70/5668926
catttaaa

SEQ ID NO: 40299 - DNA, 12 bp, Unknown
  misc_feature (1)..( 12): Matrix.001 file - promoters70/5668926
aaaaatgtgaaa

SEQ ID NO: 40300 - DNA, 10 bp, Unknown
  misc_feature (1)..( 10): Matrix.001 file - promoters70/5668926
ccaattttaa

SEQ ID NO: 40301 - DNA, 9 bp, Unknown
  misc_feature (1)..( 9): Matrix.001 file - promoters70/5668974
aaaaactaa

SEQ ID NO: 40302 - DNA, 10 bp, Unknown
  misc_feature (1)..( 10): Matrix.001 file - promoters70/5668974
caatattttt

SEQ ID NO: 40303 - DNA, 9 bp, Unknown
  misc_feature (1)..( 9): Matrix.001 file - promoters70/5668974
aatatttta

SEQ ID NO: 40304 - DNA, 11 bp, Unknown
  misc_feature (1)..( 11): Matrix.001 file - promoters70/5668974
cactaaaacag

SEQ ID NO: 40305 - DNA, 8 bp, Unknown
  misc_feature (1)..( 8): Matrix.001 file - promoters70/5668990
cgtagtat

SEQ ID NO: 40306 - DNA, 8 bp, Unknown
  misc_feature (1)..( 8): Matrix.001 file - promoters70/5669025
aaagttta

SEQ ID NO: 40307 - DNA, 9 bp, Unknown
  misc_feature (1)..( 9): Matrix.001 file - promoters70/5669025
ttacaaaaa

SEQ ID NO: 40308 - DNA, 12 bp, Unknown
  misc_feature (1)..( 12): Matrix.001 file - promoters70/5669250
aaataaattact

SEQ ID NO: 40309 - DNA, 11 bp, Unknown
  misc_feature (1)..( 11): Matrix.001 file - promoters70/5669250
aaatatctaga

SEQ ID NO: 40310 - DNA, 9 bp, Unknown
  misc_feature (1)..( 9): Matrix.001 file - promoters70/5669250
aaggcccaa

SEQ ID NO: 40311 - DNA, 7 bp, Unknown
  misc_feature (1)..( 7): Matrix.001 file - promoters70/5669250
actataa

SEQ ID NO: 40312 - DNA, 8 bp, Unknown
  misc_feature (1)..( 8): Matrix.001 file - promoters70/5669508
taaacaaa

SEQ ID NO: 40313 - DNA, 8 bp, Unknown
  misc_feature (1)..( 8): Matrix.001 file - promoters70/5669546
cgacatgt

SEQ ID NO: 40314 - DNA, 10 bp, Unknown
  misc_feature (1)..( 10): Matrix.001 file - promoters70/5670592
aatacaaaac

SEQ ID NO: 40315 - DNA, 6 bp, Unknown
  misc_feature (1)..( 6): Matrix.001 file - promoters70/5670592
agaaat

SEQ ID NO: 40316 - DNA, 10 bp, Unknown
  misc_feature (1)..( 10): Matrix.001 file - promoters70/5670592
agacataaag

SEQ ID NO: 40317 - DNA, 7 bp, Unknown
  misc_feature (1)..( 7): Matrix.001 file - promoters70/5671204
atatata

SEQ ID NO: 40318 - DNA, 10 bp, Unknown
  misc_feature (1)..( 10): Matrix.001 file - promoters70/5671204
aaactaaaaa

SEQ ID NO: 40319 - DNA, 11 bp, Unknown
  misc_feature (1)..( 11): Matrix.001 file - promoters70/5671318
cattaaataaa

SEQ ID NO: 40320 - DNA, 9 bp, Unknown
  misc_feature (1)..( 9): Matrix.001 file - promoters70/5671318
acgaaaaat

SEQ ID NO: 40321 - DNA, 11 bp, Unknown
  misc_feature (1)..( 11): Matrix.001 file - promoters70/5671318
tgattaataat

SEQ ID NO: 40322 - DNA, 10 bp, Unknown
  misc_feature (1)..( 10): Matrix.001 file - promoters70/5671318
ataatttaaa

SEQ ID NO: 40323 - DNA, 10 bp, Unknown
  misc_feature (1)..( 10): Matrix.001 file - promoters70/5672093
tttgcttatt

SEQ ID NO: 40324 - DNA, 12 bp, Unknown
  misc_feature (1)..( 12): Matrix.001 file - promoters70/5672842
aaaaaaaacttt

SEQ ID NO: 40325 - DNA, 11 bp, Unknown
  misc_feature (1)..( 11): Matrix.001 file - promoters70/5672842
tttgccactct

SEQ ID NO: 40326 - DNA, 11 bp, Unknown
  misc_feature (1)..( 11): Matrix.001 file - promoters70/5672842
gcccaatgaat

SEQ ID NO: 40327 - DNA, 10 bp, Unknown
  misc_feature (1)..( 10): Matrix.001 file - promoters70/5673124
ggtttatttt

SEQ ID NO: 40328 - DNA, 12 bp, Unknown
  misc_feature (1)..( 12): Matrix.001 file - promoters70/5674194
taagtttattat

SEQ ID NO: 40329 - DNA, 11 bp, Unknown
  misc_feature (1)..( 11): Matrix.001 file - promoters70/5674194
ctttttgttag

SEQ ID NO: 40330 - DNA, 10 bp, Unknown
  misc_feature (1)..( 10): Matrix.001 file - promoters70/5674194
catatataaa

SEQ ID NO: 40331 - DNA, 8 bp, Unknown
  misc_feature (1)..( 8): Matrix.001 file - promoters70/5674194
taatcttt

SEQ ID NO: 40332 - DNA, 8 bp, Unknown
  misc_feature (1)..( 8): Matrix.001 file - promoters70/5674194
aaatatta

SEQ ID NO: 40333 - DNA, 9 bp, Unknown
  misc_feature (1)..( 9): Matrix.001 file - promoters70/5674194
gtttttgtt

SEQ ID NO: 40334 - DNA, 10 bp, Unknown
  misc_feature (1)..( 10): Matrix.001 file - promoters70/5674194
ctttttgtta

SEQ ID NO: 40335 - DNA, 8 bp, Unknown
  misc_feature (1)..( 8): Matrix.001 file - promoters70/5674634
aagaaaat

SEQ ID NO: 40336 - DNA, 9 bp, Unknown
  misc_feature (1)..( 9): Matrix.001 file - promoters70/5674666
aaaaattat

SEQ ID NO: 40337 - DNA, 9 bp, Unknown
  misc_feature (1)..( 9): Matrix.001 file - promoters70/5674666
attcttaca

SEQ ID NO: 40338 - DNA, 9 bp, Unknown
  misc_feature (1)..( 9): Matrix.001 file - promoters70/5675661
ggttgattt

SEQ ID NO: 40339 - DNA, 8 bp, Unknown
  misc_feature (1)..( 8): Matrix.001 file - promoters70/5675661
caaagttg

SEQ ID NO: 40340 - DNA, 8 bp, Unknown
  misc_feature (1)..( 8): Matrix.001 file - promoters70/5675661
aaaagata

SEQ ID NO: 40341 - DNA, 8 bp, Unknown
  misc_feature (1)..( 8): Matrix.001 file - promoters70/5675661
gagagtaa

SEQ ID NO: 40342 - DNA, 7 bp, Unknown
  misc_feature (1)..( 7): Matrix.001 file - promoters70/5677230
aagtaaa

SEQ ID NO: 40343 - DNA, 7 bp, Unknown
  misc_feature (1)..( 7): Matrix.001 file - promoters70/5677230
aaaatat

SEQ ID NO: 40344 - DNA, 8 bp, Unknown
  misc_feature (1)..( 8): Matrix.001 file - promoters70/5677274
acatttag

SEQ ID NO: 40345 - DNA, 11 bp, Unknown
  misc_feature (1)..( 11): Matrix.001 file - promoters70/5677274
atgataataat

SEQ ID NO: 40346 - DNA, 7 bp, Unknown
  misc_feature (1)..( 7): Matrix.001 file - promoters70/5677298
taagaaa

SEQ ID NO: 40347 - DNA, 8 bp, Unknown
  misc_feature (1)..( 8): Matrix.001 file - promoters70/5677298
cttcaatg

SEQ ID NO: 40348 - DNA, 8 bp, Unknown
  misc_feature (1)..( 8): Matrix.001 file - promoters70/5677298
agaaaaca

SEQ ID NO: 40349 - DNA, 7 bp, Unknown
  misc_feature (1)..( 7): Matrix.001 file - promoters70/5681068
gctgaaa

SEQ ID NO: 40350 - DNA, 10 bp, Unknown
  misc_feature (1)..( 10): Matrix.001 file - promoters70/5681157
accttaaaaa

SEQ ID NO: 40351 - DNA, 7 bp, Unknown
  misc_feature (1)..( 7): Matrix.001 file - promoters70/5681157
aaataaa

SEQ ID NO: 40352 - DNA, 6 bp, Unknown
  misc_feature (1)..( 6): Matrix.001 file - promoters70/5681157
ttaaaa

SEQ ID NO: 40353 - DNA, 8 bp, Unknown
  misc_feature (1)..( 8): Matrix.001 file - promoters70/5681157
taaaccat

SEQ ID NO: 40354 - DNA, 12 bp, Unknown
  misc_feature (1)..( 12): Matrix.001 file - promoters70/5681157
ataaaccaaaaa

SEQ ID NO: 40355 - DNA, 6 bp, Unknown
  misc_feature (1)..( 6): Matrix.001 file - promoters70/5681157
ttaaaa

SEQ ID NO: 40356 - DNA, 9 bp, Unknown
  misc_feature (1)..( 9): Matrix.001 file - promoters70/5681157
aaaataaac

SEQ ID NO: 40357 - DNA, 10 bp, Unknown
  misc_feature (1)..( 10): Matrix.001 file - promoters70/5681157
tttgtaatat

SEQ ID NO: 40358 - DNA, 9 bp, Unknown
  misc_feature (1)..( 9): Matrix.001 file - promoters70/5753942
tacattgtt

SEQ ID NO: 40359 - DNA, 9 bp, Unknown
  misc_feature (1)..( 9): Matrix.001 file - promoters70/5753942
caaacaaaa

SEQ ID NO: 40360 - DNA, 9 bp, Unknown
  misc_feature (1)..( 9): Matrix.001 file - promoters70/5753942
tgttcaaaa

SEQ ID NO: 40361 - DNA, 13 bp, Unknown
  misc_feature (1)..( 13): Matrix.001 file - promoters70/5753942
gcccaaattaaaa

SEQ ID NO: 40362 - DNA, 11 bp, Unknown
  misc_feature (1)..( 11): Matrix.001 file - promoters70/5753942
tttgtgttttt

SEQ ID NO: 40363 - DNA, 7 bp, Unknown
  misc_feature (1)..( 7): Matrix.001 file - promoters70/5753942
catattt

SEQ ID NO: 40364 - DNA, 10 bp, Unknown
  misc_feature (1)..( 10): Matrix.001 file - promoters70/5753942
tttcgtacat

SEQ ID NO: 40365 - DNA, 8 bp, Unknown
  misc_feature (1)..( 8): Matrix.001 file - promoters70/5753942
gggccata

SEQ ID NO: 40366 - DNA, 12 bp, Unknown
  misc_feature (1)..( 12): Matrix.001 file - promoters70/5754134
gaaatctggatg

SEQ ID NO: 40367 - DNA, 8 bp, Unknown
  misc_feature (1)..( 8): Matrix.001 file - promoters70/5756166
ttacaatg

SEQ ID NO: 40368 - DNA, 7 bp, Unknown
  misc_feature (1)..( 7): Matrix.001 file - promoters70/5756166
tcttaaa

SEQ ID NO: 40369 - DNA, 8 bp, Unknown
  misc_feature (1)..( 8): Matrix.001 file - promoters70/5759467
gcaataag

SEQ ID NO: 40370 - DNA, 7 bp, Unknown
  misc_feature (1)..( 7): Matrix.001 file - promoters70/5759467
gatttac

SEQ ID NO: 40371 - DNA, 8 bp, Unknown
  misc_feature (1)..( 8): Matrix.001 file - promoters70/5773091
acaaaata

SEQ ID NO: 40372 - DNA, 8 bp, Unknown
  misc_feature (1)..( 8): Matrix.001 file - promoters70/5776417
agtttttg

SEQ ID NO: 40373 - DNA, 8 bp, Unknown
  misc_feature (1)..( 8): Matrix.001 file - promoters60/1006957
gaaaggag

SEQ ID NO: 40374 - DNA, 7 bp, Unknown
  misc_feature (1)..( 7): Matrix.001 file - promoters60/1006957
gataaat

SEQ ID NO: 40375 - DNA, 6 bp, Unknown
  misc_feature (1)..( 6): Matrix.001 file - promoters60/1006957
atcata

SEQ ID NO: 40376 - DNA, 6 bp, Unknown
  misc_feature (1)..( 6): Matrix.001 file - promoters60/1006957
aaaaat

SEQ ID NO: 40377 - DNA, 7 bp, Unknown
  misc_feature (1)..( 7): Matrix.001 file - promoters60/1006957
attcaaa

SEQ ID NO: 40378 - DNA, 10 bp, Unknown
  misc_feature (1)..( 10): Matrix.001 file - promoters60/1006957
caaactaggc

SEQ ID NO: 40379 - DNA, 10 bp, Unknown
  misc_feature (1)..( 10): Matrix.001 file - promoters60/1006957
tgagggtttt

SEQ ID NO: 40380 - DNA, 7 bp, Unknown
  misc_feature (1)..( 7): Matrix.001 file - promoters60/1006957
tggcttc

SEQ ID NO: 40381 - DNA, 6 bp, Unknown
  misc_feature (1)..( 6): Matrix.001 file - promoters60/1006957
gagtga

SEQ ID NO: 40382 - DNA, 9 bp, Unknown
  misc_feature (1)..( 9): Matrix.001 file - promoters60/1006957
ggagagaaa

SEQ ID NO: 40383 - DNA, 9 bp, Unknown
  misc_feature (1)..( 9): Matrix.001 file - promoters60/1006957
agaaaaagt

SEQ ID NO: 40384 - DNA, 8 bp, Unknown
  misc_feature (1)..( 8): Matrix.001 file - promoters60/1006957
tttagctt

SEQ ID NO: 40385 - DNA, 8 bp, Unknown
  misc_feature (1)..( 8): Matrix.001 file - promoters60/1007030
aaataata

SEQ ID NO: 40386 - DNA, 12 bp, Unknown
  misc_feature (1)..( 12): Matrix.001 file - promoters60/1007030
ataaatagtaat

SEQ ID NO: 40387 - DNA, 8 bp, Unknown
  misc_feature (1)..( 8): Matrix.001 file - promoters60/1007030
aaaacaat

SEQ ID NO: 40388 - DNA, 8 bp, Unknown
  misc_feature (1)..( 8): Matrix.001 file - promoters60/1007030
aaacgaat

SEQ ID NO: 40389 - DNA, 13 bp, Unknown
  misc_feature (1)..( 13): Matrix.001 file - promoters60/1007030
tcgaaaataaaca

SEQ ID NO: 40390 - DNA, 11 bp, Unknown
  misc_feature (1)..( 11): Matrix.001 file - promoters60/1007030
aattaacccaa

SEQ ID NO: 40391 - DNA, 10 bp, Unknown
  misc_feature (1)..( 10): Matrix.001 file - promoters60/1007030
aatctgattc

SEQ ID NO: 40392 - DNA, 7 bp, Unknown
  misc_feature (1)..( 7): Matrix.001 file - promoters60/1007030
aaaataa

SEQ ID NO: 40393 - DNA, 12 bp, Unknown
  misc_feature (1)..( 12): Matrix.001 file - promoters60/1007030
agaagaaaaaga

SEQ ID NO: 40394 - DNA, 7 bp, Unknown
  misc_feature (1)..( 7): Matrix.001 file - promoters60/1007030
taaaaaa

SEQ ID NO: 40395 - DNA, 10 bp, Unknown
  misc_feature (1)..( 10): Matrix.001 file - promoters60/1007030
attgaaatat

SEQ ID NO: 40396 - DNA, 8 bp, Unknown
  misc_feature (1)..( 8): Matrix.001 file - promoters60/1007056
aaggatga

SEQ ID NO: 40397 - DNA, 7 bp, Unknown
  misc_feature (1)..( 7): Matrix.001 file - promoters60/1007056
gttttgg

SEQ ID NO: 40398 - DNA, 6 bp, Unknown
  misc_feature (1)..( 6): Matrix.001 file - promoters60/1007056
ggtgat

SEQ ID NO: 40399 - DNA, 11 bp, Unknown
  misc_feature (1)..( 11): Matrix.001 file - promoters60/1007056
accttctctga

SEQ ID NO: 40400 - DNA, 6 bp, Unknown
  misc_feature (1)..( 6): Matrix.001 file - promoters60/1007056
aaggct

SEQ ID NO: 40401 - DNA, 6 bp, Unknown
  misc_feature (1)..( 6): Matrix.001 file - promoters60/1007056
gatgca

SEQ ID NO: 40402 - DNA, 7 bp, Unknown
  misc_feature (1)..( 7): Matrix.001 file - promoters60/1007056
aacatct

SEQ ID NO: 40403 - DNA, 10 bp, Unknown
  misc_feature (1)..( 10): Matrix.001 file - promoters60/1007056
aagttttcta

SEQ ID NO: 40404 - DNA, 7 bp, Unknown
  misc_feature (1)..( 7): Matrix.001 file - promoters60/1007056
ctaatca

SEQ ID NO: 40405 - DNA, 6 bp, Unknown
  misc_feature (1)..( 6): Matrix.001 file - promoters60/1007056
ggtttt

SEQ ID NO: 40406 - DNA, 6 bp, Unknown
  misc_feature (1)..( 6): Matrix.001 file - promoters60/1007056
ttttgt

SEQ ID NO: 40407 - DNA, 6 bp, Unknown
  misc_feature (1)..( 6): Matrix.001 file - promoters60/1007056
ttgttt

SEQ ID NO: 40408 - DNA, 6 bp, Unknown
  misc_feature (1)..( 6): Matrix.001 file - promoters60/1007056
atccaa

SEQ ID NO: 40409 - DNA, 7 bp, Unknown
  misc_feature (1)..( 7): Matrix.001 file - promoters60/1007056
tgccaag

SEQ ID NO: 40410 - DNA, 7 bp, Unknown
  misc_feature (1)..( 7): Matrix.001 file - promoters60/1007056
tcaagaa

SEQ ID NO: 40411 - DNA, 6 bp, Unknown
  misc_feature (1)..( 6): Matrix.001 file - promoters60/1007056
agtcct

SEQ ID NO: 40412 - DNA, 6 bp, Unknown
  misc_feature (1)..( 6): Matrix.001 file - promoters60/1007056
gaggca

SEQ ID NO: 40413 - DNA, 7 bp, Unknown
  misc_feature (1)..( 7): Matrix.001 file - promoters60/1007056
tcaagaa

SEQ ID NO: 40414 - DNA, 10 bp, Unknown
  misc_feature (1)..( 10): Matrix.001 file - promoters60/1007139
tttcaacaaa

SEQ ID NO: 40415 - DNA, 9 bp, Unknown
  misc_feature (1)..( 9): Matrix.001 file - promoters60/1007139
aaagttcag

SEQ ID NO: 40416 - DNA, 10 bp, Unknown
  misc_feature (1)..( 10): Matrix.001 file - promoters60/1007139
taatatatat

SEQ ID NO: 40417 - DNA, 9 bp, Unknown
  misc_feature (1)..( 9): Matrix.001 file - promoters60/1007187
aatttattt

SEQ ID NO: 40418 - DNA, 9 bp, Unknown
  misc_feature (1)..( 9): Matrix.001 file - promoters60/1007187
aaaatatta

SEQ ID NO: 40419 - DNA, 9 bp, Unknown
  misc_feature (1)..( 9): Matrix.001 file - promoters60/1007187
tgttaatct

SEQ ID NO: 40420 - DNA, 7 bp, Unknown
  misc_feature (1)..( 7): Matrix.001 file - promoters60/1007187
aaaagat

SEQ ID NO: 40421 - DNA, 9 bp, Unknown
  misc_feature (1)..( 9): Matrix.001 file - promoters60/1007187
tttggtttt

SEQ ID NO: 40422 - DNA, 12 bp, Unknown
  misc_feature (1)..( 12): Matrix.001 file - promoters60/1007187
ttttctacaatt

SEQ ID NO: 40423 - DNA, 7 bp, Unknown
  misc_feature (1)..( 7): Matrix.001 file - promoters60/1007187
tttttct

SEQ ID NO: 40424 - DNA, 8 bp, Unknown
  misc_feature (1)..( 8): Matrix.001 file - promoters60/1007187
tgaggaat

SEQ ID NO: 40425 - DNA, 7 bp, Unknown
  misc_feature (1)..( 7): Matrix.001 file - promoters60/1007187
caaacgc

SEQ ID NO: 40426 - DNA, 6 bp, Unknown
  misc_feature (1)..( 6): Matrix.001 file - promoters60/1007187
aatttt

SEQ ID NO: 40427 - DNA, 9 bp, Unknown
  misc_feature (1)..( 9): Matrix.001 file - promoters60/1007187
tatttttaa

SEQ ID NO: 40428 - DNA, 9 bp, Unknown
  misc_feature (1)..( 9): Matrix.001 file - promoters60/1007187
aatattttt

SEQ ID NO: 40429 - DNA, 8 bp, Unknown
  misc_feature (1)..( 8): Matrix.001 file - promoters60/1007187
atttaaaa

SEQ ID NO: 40430 - DNA, 7 bp, Unknown
  misc_feature (1)..( 7): Matrix.001 file - promoters60/1007187
taaataa

SEQ ID NO: 40431 - DNA, 7 bp, Unknown
  misc_feature (1)..( 7): Matrix.001 file - promoters60/1007187
ttgtttt

SEQ ID NO: 40432 - DNA, 8 bp, Unknown
  misc_feature (1)..( 8): Matrix.001 file - promoters60/1007187
attggatg

SEQ ID NO: 40433 - DNA, 6 bp, Unknown
  misc_feature (1)..( 6): Matrix.001 file - promoters60/1007187
tccaaa

SEQ ID NO: 40434 - DNA, 6 bp, Unknown
  misc_feature (1)..( 6): Matrix.001 file - promoters60/1007187
tatttt

SEQ ID NO: 40435 - DNA, 6 bp, Unknown
  misc_feature (1)..( 6): Matrix.001 file - promoters60/1007187
ttaaaa

SEQ ID NO: 40436 - DNA, 9 bp, Unknown
  misc_feature (1)..( 9): Matrix.001 file - promoters60/1007187
ataacaaaa

SEQ ID NO: 40437 - DNA, 7 bp, Unknown
  misc_feature (1)..( 7): Matrix.001 file - promoters60/1007187
taataat

SEQ ID NO: 40438 - DNA, 6 bp, Unknown
  misc_feature (1)..( 6): Matrix.001 file - promoters60/1007187
atattt

SEQ ID NO: 40439 - DNA, 7 bp, Unknown
  misc_feature (1)..( 7): Matrix.001 file - promoters60/1007187
tatacaa

SEQ ID NO: 40440 - DNA, 7 bp, Unknown
  misc_feature (1)..( 7): Matrix.001 file - promoters60/1007187
tataatt

SEQ ID NO: 40441 - DNA, 6 bp, Unknown
  misc_feature (1)..( 6): Matrix.001 file - promoters60/1007187
aaaaaa

SEQ ID NO: 40442 - DNA, 8 bp, Unknown
  misc_feature (1)..( 8): Matrix.001 file - promoters60/1007187
taaatttc

SEQ ID NO: 40443 - DNA, 7 bp, Unknown
  misc_feature (1)..( 7): Matrix.001 file - promoters60/1007187
aagagaa

SEQ ID NO: 40444 - DNA, 8 bp, Unknown
  misc_feature (1)..( 8): Matrix.001 file - promoters60/1007187
atggcttg

SEQ ID NO: 40445 - DNA, 12 bp, Unknown
  misc_feature (1)..( 12): Matrix.001 file - promoters60/1007269
tggaaacgaatt

SEQ ID NO: 40446 - DNA, 10 bp, Unknown
  misc_feature (1)..( 10): Matrix.001 file - promoters60/1007269
tattcgtttt

SEQ ID NO: 40447 - DNA, 8 bp, Unknown
  misc_feature (1)..( 8): Matrix.001 file - promoters60/1007269
taaaaaag

SEQ ID NO: 40448 - DNA, 9 bp, Unknown
  misc_feature (1)..( 9): Matrix.001 file - promoters60/1007269
ataaaacct

SEQ ID NO: 40449 - DNA, 8 bp, Unknown
  misc_feature (1)..( 8): Matrix.001 file - promoters60/1007289
atttctta

SEQ ID NO: 40450 - DNA, 11 bp, Unknown
  misc_feature (1)..( 11): Matrix.001 file - promoters60/1007289
ttcaatgataa

SEQ ID NO: 40451 - DNA, 12 bp, Unknown
  misc_feature (1)..( 12): Matrix.001 file - promoters60/1007289
gaataagaagaa

SEQ ID NO: 40452 - DNA, 7 bp, Unknown
  misc_feature (1)..( 7): Matrix.001 file - promoters60/1007289
aaaaaaa

SEQ ID NO: 40453 - DNA, 7 bp, Unknown
  misc_feature (1)..( 7): Matrix.001 file - promoters60/1007348
tgtaatt

SEQ ID NO: 40454 - DNA, 6 bp, Unknown
  misc_feature (1)..( 6): Matrix.001 file - promoters60/1007348
gatctt

SEQ ID NO: 40455 - DNA, 8 bp, Unknown
  misc_feature (1)..( 8): Matrix.001 file - promoters60/1007348
tatgtttt

SEQ ID NO: 40456 - DNA, 7 bp, Unknown
  misc_feature (1)..( 7): Matrix.001 file - promoters60/1007348
ttaaaac

SEQ ID NO: 40457 - DNA, 7 bp, Unknown
  misc_feature (1)..( 7): Matrix.001 file - promoters60/1007348
attgttt

SEQ ID NO: 40458 - DNA, 7 bp, Unknown
  misc_feature (1)..( 7): Matrix.001 file - promoters60/1007348
atccaca

SEQ ID NO: 40459 - DNA, 8 bp, Unknown
  misc_feature (1)..( 8): Matrix.001 file - promoters60/1007348
tatttttc

SEQ ID NO: 40460 - DNA, 8 bp, Unknown
  misc_feature (1)..( 8): Matrix.001 file - promoters60/1007348
atatgtaa

SEQ ID NO: 40461 - DNA, 6 bp, Unknown
  misc_feature (1)..( 6): Matrix.001 file - promoters60/1007348
gtttaa

SEQ ID NO: 40462 - DNA, 7 bp, Unknown
  misc_feature (1)..( 7): Matrix.001 file - promoters60/1007348
ctctttt

SEQ ID NO: 40463 - DNA, 8 bp, Unknown
  misc_feature (1)..( 8): Matrix.001 file - promoters60/1007348
ataacatc

SEQ ID NO: 40464 - DNA, 8 bp, Unknown
  misc_feature (1)..( 8): Matrix.001 file - promoters60/1007348
cacaaaga

SEQ ID NO: 40465 - DNA, 11 bp, Unknown
  misc_feature (1)..( 11): Matrix.001 file - promoters60/1007348
accaataagaa

SEQ ID NO: 40466 - DNA, 8 bp, Unknown
  misc_feature (1)..( 8): Matrix.001 file - promoters60/1007348
aaaataag

SEQ ID NO: 40467 - DNA, 8 bp, Unknown
  misc_feature (1)..( 8): Matrix.001 file - promoters60/1007348
taaattgt

SEQ ID NO: 40468 - DNA, 6 bp, Unknown
  misc_feature (1)..( 6): Matrix.001 file - promoters60/1007348
atagat

SEQ ID NO: 40469 - DNA, 7 bp, Unknown
  misc_feature (1)..( 7): Matrix.001 file - promoters60/1007348
agagata

SEQ ID NO: 40470 - DNA, 6 bp, Unknown
  misc_feature (1)..( 6): Matrix.001 file - promoters60/1007348
ttttgg

SEQ ID NO: 40471 - DNA, 6 bp, Unknown
  misc_feature (1)..( 6): Matrix.001 file - promoters60/1007348
taagat

SEQ ID NO: 40472 - DNA, 6 bp, Unknown
  misc_feature (1)..( 6): Matrix.001 file - promoters60/1007348
aaagaa

SEQ ID NO: 40473 - DNA, 12 bp, Unknown
  misc_feature (1)..( 12): Matrix.001 file - promoters60/1007348
aaaaacaaaaca

SEQ ID NO: 40474 - DNA, 6 bp, Unknown
  misc_feature (1)..( 6): Matrix.001 file - promoters60/1007348
aaaaat

SEQ ID NO: 40475 - DNA, 6 bp, Unknown
  misc_feature (1)..( 6): Matrix.001 file - promoters60/1007348
taaccc

SEQ ID NO: 40476 - DNA, 13 bp, Unknown
  misc_feature (1)..( 13): Matrix.001 file - promoters60/1007370
caataatttaaaa

SEQ ID NO: 40477 - DNA, 8 bp, Unknown
  misc_feature (1)..( 8): Matrix.001 file - promoters60/1007370
aatttatc

SEQ ID NO: 40478 - DNA, 11 bp, Unknown
  misc_feature (1)..( 11): Matrix.001 file - promoters60/1007370
gaatattttat

SEQ ID NO: 40479 - DNA, 9 bp, Unknown
  misc_feature (1)..( 9): Matrix.001 file - promoters60/1007524
tcttgtaaa

SEQ ID NO: 40480 - DNA, 9 bp, Unknown
  misc_feature (1)..( 9): Matrix.001 file - promoters60/1007554
atttatgta

SEQ ID NO: 40481 - DNA, 8 bp, Unknown
  misc_feature (1)..( 8): Matrix.001 file - promoters60/1007554
aaaaataa

SEQ ID NO: 40482 - DNA, 6 bp, Unknown
  misc_feature (1)..( 6): Matrix.001 file - promoters60/1007554
tttaat

SEQ ID NO: 40483 - DNA, 7 bp, Unknown
  misc_feature (1)..( 7): Matrix.001 file - promoters60/1007576
aaacaaa

SEQ ID NO: 40484 - DNA, 10 bp, Unknown
  misc_feature (1)..( 10): Matrix.001 file - promoters60/1007576
ctggaaaatg

SEQ ID NO: 40485 - DNA, 6 bp, Unknown
  misc_feature (1)..( 6): Matrix.001 file - promoters60/1007576
aatgat

SEQ ID NO: 40486 - DNA, 8 bp, Unknown
  misc_feature (1)..( 8): Matrix.001 file - promoters60/1007576
cttcgata

SEQ ID NO: 40487 - DNA, 7 bp, Unknown
  misc_feature (1)..( 7): Matrix.001 file - promoters60/1007576
tcaggaa

SEQ ID NO: 40488 - DNA, 6 bp, Unknown
  misc_feature (1)..( 6): Matrix.001 file - promoters60/1007576
ttttct

SEQ ID NO: 40489 - DNA, 6 bp, Unknown
  misc_feature (1)..( 6): Matrix.001 file - promoters60/1007576
tgaaat

SEQ ID NO: 40490 - DNA, 8 bp, Unknown
  misc_feature (1)..( 8): Matrix.001 file - promoters60/1007576
gtttctca

SEQ ID NO: 40491 - DNA, 6 bp, Unknown
  misc_feature (1)..( 6): Matrix.001 file - promoters60/1007576
tatatt

SEQ ID NO: 40492 - DNA, 6 bp, Unknown
  misc_feature (1)..( 6): Matrix.001 file - promoters60/1007576
gatggt

SEQ ID NO: 40493 - DNA, 7 bp, Unknown
  misc_feature (1)..( 7): Matrix.001 file - promoters60/1007576
tctcttg

SEQ ID NO: 40494 - DNA, 7 bp, Unknown
  misc_feature (1)..( 7): Matrix.001 file - promoters60/1007576
tttactc

SEQ ID NO: 40495 - DNA, 7 bp, Unknown
  misc_feature (1)..( 7): Matrix.001 file - promoters60/1007576
ctgaaac

SEQ ID NO: 40496 - DNA, 9 bp, Unknown
  misc_feature (1)..( 9): Matrix.001 file - promoters60/1007639
cacaaaaac

SEQ ID NO: 40497 - DNA, 12 bp, Unknown
  misc_feature (1)..( 12): Matrix.001 file - promoters60/1007639
tataaactttta

SEQ ID NO: 40498 - DNA, 16 bp, Unknown
  misc_feature (1)..( 16): Matrix.001 file - promoters60/1007639
tgacaaaaaaaaatat

SEQ ID NO: 40499 - DNA, 9 bp, Unknown
  misc_feature (1)..( 9): Matrix.001 file - promoters60/1007639
aaaaattta

SEQ ID NO: 40500 - DNA, 10 bp, Unknown
  misc_feature (1)..( 10): Matrix.001 file - promoters60/1007639
aaaaacttat

SEQ ID NO: 40501 - DNA, 10 bp, Unknown
  misc_feature (1)..( 10): Matrix.001 file - promoters60/1007639
tttttatata

SEQ ID NO: 40502 - DNA, 8 bp, Unknown
  misc_feature (1)..( 8): Matrix.001 file - promoters60/1007675
ctagaaag

SEQ ID NO: 40503 - DNA, 6 bp, Unknown
  misc_feature (1)..( 6): Matrix.001 file - promoters60/1007675
gagata

SEQ ID NO: 40504 - DNA, 6 bp, Unknown
  misc_feature (1)..( 6): Matrix.001 file - promoters60/1007675
caagac

SEQ ID NO: 40505 - DNA, 7 bp, Unknown
  misc_feature (1)..( 7): Matrix.001 file - promoters60/1007675
taatatt

SEQ ID NO: 40506 - DNA, 7 bp, Unknown
  misc_feature (1)..( 7): Matrix.001 file - promoters60/1007675
aaaggga

SEQ ID NO: 40507 - DNA, 6 bp, Unknown
  misc_feature (1)..( 6): Matrix.001 file - promoters60/1007675
tacaaa

SEQ ID NO: 40508 - DNA, 7 bp, Unknown
  misc_feature (1)..( 7): Matrix.001 file - promoters60/1007675
aaaaaaa

SEQ ID NO: 40509 - DNA, 8 bp, Unknown
  misc_feature (1)..( 8): Matrix.001 file - promoters60/1007675
aaatcaac

SEQ ID NO: 40510 - DNA, 6 bp, Unknown
  misc_feature (1)..( 6): Matrix.001 file - promoters60/1007675
aagtcc

SEQ ID NO: 40511 - DNA, 7 bp, Unknown
  misc_feature (1)..( 7): Matrix.001 file - promoters60/1007675
tcaattg

SEQ ID NO: 40512 - DNA, 7 bp, Unknown
  misc_feature (1)..( 7): Matrix.001 file - promoters60/1007675
tatgatt

SEQ ID NO: 40513 - DNA, 6 bp, Unknown
  misc_feature (1)..( 6): Matrix.001 file - promoters60/1007675
atatat

SEQ ID NO: 40514 - DNA, 6 bp, Unknown
  misc_feature (1)..( 6): Matrix.001 file - promoters60/1007675
gaagac

SEQ ID NO: 40515 - DNA, 10 bp, Unknown
  misc_feature (1)..( 10): Matrix.001 file - promoters60/1007675
tattaatgaa

SEQ ID NO: 40516 - DNA, 7 bp, Unknown
  misc_feature (1)..( 7): Matrix.001 file - promoters60/1007675
tttagaa

SEQ ID NO: 40517 - DNA, 6 bp, Unknown
  misc_feature (1)..( 6): Matrix.001 file - promoters60/1007675
aaataa

SEQ ID NO: 40518 - DNA, 9 bp, Unknown
  misc_feature (1)..( 9): Matrix.001 file - promoters60/1007675
tccaaaagt

SEQ ID NO: 40519 - DNA, 8 bp, Unknown
  misc_feature (1)..( 8): Matrix.001 file - promoters60/1007675
tccaaatg

SEQ ID NO: 40520 - DNA, 7 bp, Unknown
  misc_feature (1)..( 7): Matrix.001 file - promoters60/1007675
aaagaaa

SEQ ID NO: 40521 - DNA, 6 bp, Unknown
  misc_feature (1)..( 6): Matrix.001 file - promoters60/1007675
ggaaat

SEQ ID NO: 40522 - DNA, 7 bp, Unknown
  misc_feature (1)..( 7): Matrix.001 file - promoters60/1007675
ataaaaa

SEQ ID NO: 40523 - DNA, 6 bp, Unknown
  misc_feature (1)..( 6): Matrix.001 file - promoters60/1007731
ttttta

SEQ ID NO: 40524 - DNA, 6 bp, Unknown
  misc_feature (1)..( 6): Matrix.001 file - promoters60/1007731
atttac

SEQ ID NO: 40525 - DNA, 6 bp, Unknown
  misc_feature (1)..( 6): Matrix.001 file - promoters60/1007731
ctgttg

SEQ ID NO: 40526 - DNA, 6 bp, Unknown
  misc_feature (1)..( 6): Matrix.001 file - promoters60/1007731
aaacta

SEQ ID NO: 40527 - DNA, 7 bp, Unknown
  misc_feature (1)..( 7): Matrix.001 file - promoters60/1007731
attcgag

SEQ ID NO: 40528 - DNA, 7 bp, Unknown
  misc_feature (1)..( 7): Matrix.001 file - promoters60/1007731
tttcctt

SEQ ID NO: 40529 - DNA, 6 bp, Unknown
  misc_feature (1)..( 6): Matrix.001 file - promoters60/1007731
tatttt

SEQ ID NO: 40530 - DNA, 6 bp, Unknown
  misc_feature (1)..( 6): Matrix.001 file - promoters60/1007731
ttgaat

SEQ ID NO: 40531 - DNA, 6 bp, Unknown
  misc_feature (1)..( 6): Matrix.001 file - promoters60/1007731
attgaa

SEQ ID NO: 40532 - DNA, 7 bp, Unknown
  misc_feature (1)..( 7): Matrix.001 file - promoters60/1007731
tgacatt

SEQ ID NO: 40533 - DNA, 10 bp, Unknown
  misc_feature (1)..( 10): Matrix.001 file - promoters60/1007731
aaattacttg

SEQ ID NO: 40534 - DNA, 7 bp, Unknown
  misc_feature (1)..( 7): Matrix.001 file - promoters60/1007731
atgtgac

SEQ ID NO: 40535 - DNA, 9 bp, Unknown
  misc_feature (1)..( 9): Matrix.001 file - promoters60/1007731
tgactccat

SEQ ID NO: 40536 - DNA, 7 bp, Unknown
  misc_feature (1)..( 7): Matrix.001 file - promoters60/1007731
acgatta

SEQ ID NO: 40537 - DNA, 8 bp, Unknown
  misc_feature (1)..( 8): Matrix.001 file - promoters60/1007731
agaaaatt

SEQ ID NO: 40538 - DNA, 6 bp, Unknown
  misc_feature (1)..( 6): Matrix.001 file - promoters60/1007731
aaaatt

SEQ ID NO: 40539 - DNA, 7 bp, Unknown
  misc_feature (1)..( 7): Matrix.001 file - promoters60/1007731
caaaatg

SEQ ID NO: 40540 - DNA, 6 bp, Unknown
  misc_feature (1)..( 6): Matrix.001 file - promoters60/1007731
gtttac

SEQ ID NO: 40541 - DNA, 6 bp, Unknown
  misc_feature (1)..( 6): Matrix.001 file - promoters60/1007731
ccaaat

SEQ ID NO: 40542 - DNA, 7 bp, Unknown
  misc_feature (1)..( 7): Matrix.001 file - promoters60/1007756
cttctag

SEQ ID NO: 40543 - DNA, 6 bp, Unknown
  misc_feature (1)..( 6): Matrix.001 file - promoters60/1007756
attcac

SEQ ID NO: 40544 - DNA, 8 bp, Unknown
  misc_feature (1)..( 8): Matrix.001 file - promoters60/1007756
tcacatta

SEQ ID NO: 40545 - DNA, 12 bp, Unknown
  misc_feature (1)..( 12): Matrix.001 file - promoters60/1007756
aacctgtttatt

SEQ ID NO: 40546 - DNA, 6 bp, Unknown
  misc_feature (1)..( 6): Matrix.001 file - promoters60/1007756
tattta

SEQ ID NO: 40547 - DNA, 9 bp, Unknown
  misc_feature (1)..( 9): Matrix.001 file - promoters60/1007756
cggtttata

SEQ ID NO: 40548 - DNA, 6 bp, Unknown
  misc_feature (1)..( 6): Matrix.001 file - promoters60/1007756
gatgat

SEQ ID NO: 40549 - DNA, 6 bp, Unknown
  misc_feature (1)..( 6): Matrix.001 file - promoters60/1007756
acccgg

SEQ ID NO: 40550 - DNA, 8 bp, Unknown
  misc_feature (1)..( 8): Matrix.001 file - promoters60/1007756
aatagtaa

SEQ ID NO: 40551 - DNA, 9 bp, Unknown
  misc_feature (1)..( 9): Matrix.001 file - promoters60/1007756
attctgaaa

SEQ ID NO: 40552 - DNA, 8 bp, Unknown
  misc_feature (1)..( 8): Matrix.001 file - promoters60/1007759
aaacaact

SEQ ID NO: 40553 - DNA, 10 bp, Unknown
  misc_feature (1)..( 10): Matrix.001 file - promoters60/1007795
actttttata

SEQ ID NO: 40554 - DNA, 15 bp, Unknown
  misc_feature (1)..( 15): Matrix.001 file - promoters60/1007795
aattttatattgatt

SEQ ID NO: 40555 - DNA, 10 bp, Unknown
  misc_feature (1)..( 10): Matrix.001 file - promoters60/1007795
aaagtttttg

SEQ ID NO: 40556 - DNA, 9 bp, Unknown
  misc_feature (1)..( 9): Matrix.001 file - promoters60/1007802
agattttct

SEQ ID NO: 40557 - DNA, 6 bp, Unknown
  misc_feature (1)..( 6): Matrix.001 file - promoters60/1007802
aaaaac

SEQ ID NO: 40558 - DNA, 9 bp, Unknown
  misc_feature (1)..( 9): Matrix.001 file - promoters60/1007802
tgaaaaaaa

SEQ ID NO: 40559 - DNA, 11 bp, Unknown
  misc_feature (1)..( 11): Matrix.001 file - promoters60/1007802
atttatttgtg

SEQ ID NO: 40560 - DNA, 8 bp, Unknown
  misc_feature (1)..( 8): Matrix.001 file - promoters60/1007802
atgtacta

SEQ ID NO: 40561 - DNA, 9 bp, Unknown
  misc_feature (1)..( 9): Matrix.001 file - promoters60/1007802
aaaatttgt

SEQ ID NO: 40562 - DNA, 6 bp, Unknown
  misc_feature (1)..( 6): Matrix.001 file - promoters60/1007967
gtttta

SEQ ID NO: 40563 - DNA, 8 bp, Unknown
  misc_feature (1)..( 8): Matrix.001 file - promoters60/1007967
attcttaa

SEQ ID NO: 40564 - DNA, 9 bp, Unknown
  misc_feature (1)..( 9): Matrix.001 file - promoters60/1007967
aatttgaac

SEQ ID NO: 40565 - DNA, 6 bp, Unknown
  misc_feature (1)..( 6): Matrix.001 file - promoters60/1007967
attcat

SEQ ID NO: 40566 - DNA, 6 bp, Unknown
  misc_feature (1)..( 6): Matrix.001 file - promoters60/1007967
ttttaa

SEQ ID NO: 40567 - DNA, 6 bp, Unknown
  misc_feature (1)..( 6): Matrix.001 file - promoters60/1007967
gtgtaa

SEQ ID NO: 40568 - DNA, 9 bp, Unknown
  misc_feature (1)..( 9): Matrix.001 file - promoters60/1007967
cataactgt

SEQ ID NO: 40569 - DNA, 7 bp, Unknown
  misc_feature (1)..( 7): Matrix.001 file - promoters60/1007967
ttactga

SEQ ID NO: 40570 - DNA, 6 bp, Unknown
  misc_feature (1)..( 6): Matrix.001 file - promoters60/1007967
aaccaa

SEQ ID NO: 40571 - DNA, 6 bp, Unknown
  misc_feature (1)..( 6): Matrix.001 file - promoters60/1007967
tttcac

SEQ ID NO: 40572 - DNA, 6 bp, Unknown
  misc_feature (1)..( 6): Matrix.001 file - promoters60/1007967
aaactc

SEQ ID NO: 40573 - DNA, 8 bp, Unknown
  misc_feature (1)..( 8): Matrix.001 file - promoters60/1007967
tcatatgt

SEQ ID NO: 40574 - DNA, 7 bp, Unknown
  misc_feature (1)..( 7): Matrix.001 file - promoters60/1007967
aaacaga

SEQ ID NO: 40575 - DNA, 9 bp, Unknown
  misc_feature (1)..( 9): Matrix.001 file - promoters60/1007967
ataaaataa

SEQ ID NO: 40576 - DNA, 9 bp, Unknown
  misc_feature (1)..( 9): Matrix.001 file - promoters60/1007967
ttatccaac

SEQ ID NO: 40577 - DNA, 8 bp, Unknown
  misc_feature (1)..( 8): Matrix.001 file - promoters60/1008070
aaaaaaaa

SEQ ID NO: 40578 - DNA, 11 bp, Unknown
  misc_feature (1)..( 11): Matrix.001 file - promoters60/1008070
ccactatatat

SEQ ID NO: 40579 - DNA, 8 bp, Unknown
  misc_feature (1)..( 8): Matrix.001 file - promoters60/1008070
tgaaataa

SEQ ID NO: 40580 - DNA, 8 bp, Unknown
  misc_feature (1)..( 8): Matrix.001 file - promoters60/1008070
atttattt

SEQ ID NO: 40581 - DNA, 12 bp, Unknown
  misc_feature (1)..( 12): Matrix.001 file - promoters60/1008148
taaattaatctc

SEQ ID NO: 40582 - DNA, 10 bp, Unknown
  misc_feature (1)..( 10): Matrix.001 file - promoters60/1008218
gattaaaata

SEQ ID NO: 40583 - DNA, 11 bp, Unknown
  misc_feature (1)..( 11): Matrix.001 file - promoters60/1008218
ttctggagaga

SEQ ID NO: 40584 - DNA, 9 bp, Unknown
  misc_feature (1)..( 9): Matrix.001 file - promoters60/1008218
caaacaaag

SEQ ID NO: 40585 - DNA, 9 bp, Unknown
  misc_feature (1)..( 9): Matrix.001 file - promoters60/1008319
ggacaacaa

SEQ ID NO: 40586 - DNA, 14 bp, Unknown
  misc_feature (1)..( 14): Matrix.001 file - promoters60/1008319
tttctttttcgcaa

SEQ ID NO: 40587 - DNA, 10 bp, Unknown
  misc_feature (1)..( 10): Matrix.001 file - promoters60/1008319
aaaaacaaag

SEQ ID NO: 40588 - DNA, 4 bp, Unknown
  misc_feature (1)..( 4): Matrix.001 file - promoters60/1008319
cttt

SEQ ID NO: 40589 - DNA, 12 bp, Unknown
  misc_feature (1)..( 12): Matrix.001 file - promoters60/1008324
gatatgctttgc

SEQ ID NO: 40590 - DNA, 11 bp, Unknown
  misc_feature (1)..( 11): Matrix.001 file - promoters60/1008324
gataatttgtc

SEQ ID NO: 40591 - DNA, 9 bp, Unknown
  misc_feature (1)..( 9): Matrix.001 file - promoters60/1008324
aggcccaat

SEQ ID NO: 40592 - DNA, 10 bp, Unknown
  misc_feature (1)..( 10): Matrix.001 file - promoters60/1008324
acacggtatt

SEQ ID NO: 40593 - DNA, 8 bp, Unknown
  misc_feature (1)..( 8): Matrix.001 file - promoters60/1008400
gaacgtga

SEQ ID NO: 40594 - DNA, 7 bp, Unknown
  misc_feature (1)..( 7): Matrix.001 file - promoters60/1008400
gtaagaa

SEQ ID NO: 40595 - DNA, 8 bp, Unknown
  misc_feature (1)..( 8): Matrix.001 file - promoters60/1008400
aaaaaaat

SEQ ID NO: 40596 - DNA, 6 bp, Unknown
  misc_feature (1)..( 6): Matrix.001 file - promoters60/1008400
ttgatt

SEQ ID NO: 40597 - DNA, 6 bp, Unknown
  misc_feature (1)..( 6): Matrix.001 file - promoters60/1008400
aattgt

SEQ ID NO: 40598 - DNA, 7 bp, Unknown
  misc_feature (1)..( 7): Matrix.001 file - promoters60/1008400
ctttgag

SEQ ID NO: 40599 - DNA, 7 bp, Unknown
  misc_feature (1)..( 7): Matrix.001 file - promoters60/1008400
tatcatt

SEQ ID NO: 40600 - DNA, 7 bp, Unknown
  misc_feature (1)..( 7): Matrix.001 file - promoters60/1008400
gaatttg

SEQ ID NO: 40601 - DNA, 7 bp, Unknown
  misc_feature (1)..( 7): Matrix.001 file - promoters60/1008400
tttgatt

SEQ ID NO: 40602 - DNA, 7 bp, Unknown
  misc_feature (1)..( 7): Matrix.001 file - promoters60/1008400
ttagatc

SEQ ID NO: 40603 - DNA, 6 bp, Unknown
  misc_feature (1)..( 6): Matrix.001 file - promoters60/1008400
catttg

SEQ ID NO: 40604 - DNA, 7 bp, Unknown
  misc_feature (1)..( 7): Matrix.001 file - promoters60/1008425
tttggaa

SEQ ID NO: 40605 - DNA, 6 bp, Unknown
  misc_feature (1)..( 6): Matrix.001 file - promoters60/1008425
agaaaa

SEQ ID NO: 40606 - DNA, 10 bp, Unknown
  misc_feature (1)..( 10): Matrix.001 file - promoters60/1008425
caaatacatt

SEQ ID NO: 40607 - DNA, 8 bp, Unknown
  misc_feature (1)..( 8): Matrix.001 file - promoters60/1008425
tgtaaatt

SEQ ID NO: 40608 - DNA, 7 bp, Unknown
  misc_feature (1)..( 7): Matrix.001 file - promoters60/1008425
caaataa

SEQ ID NO: 40609 - DNA, 7 bp, Unknown
  misc_feature (1)..( 7): Matrix.001 file - promoters60/1008425
ttttttt

SEQ ID NO: 40610 - DNA, 6 bp, Unknown
  misc_feature (1)..( 6): Matrix.001 file - promoters60/1008425
aatatt

SEQ ID NO: 40611 - DNA, 8 bp, Unknown
  misc_feature (1)..( 8): Matrix.001 file - promoters60/1008425
cttttgaa

SEQ ID NO: 40612 - DNA, 6 bp, Unknown
  misc_feature (1)..( 6): Matrix.001 file - promoters60/1008425
tttttt

SEQ ID NO: 40613 - DNA, 9 bp, Unknown
  misc_feature (1)..( 9): Matrix.001 file - promoters60/1008425
aatatatta

SEQ ID NO: 40614 - DNA, 8 bp, Unknown
  misc_feature (1)..( 8): Matrix.001 file - promoters60/1008425
gaaaactt

SEQ ID NO: 40615 - DNA, 8 bp, Unknown
  misc_feature (1)..( 8): Matrix.001 file - promoters60/1008425
acttttat

SEQ ID NO: 40616 - DNA, 7 bp, Unknown
  misc_feature (1)..( 7): Matrix.001 file - promoters60/1008425
tttatta

SEQ ID NO: 40617 - DNA, 8 bp, Unknown
  misc_feature (1)..( 8): Matrix.001 file - promoters60/1008425
tttcaatt

SEQ ID NO: 40618 - DNA, 7 bp, Unknown
  misc_feature (1)..( 7): Matrix.001 file - promoters60/1008425
cataaaa

SEQ ID NO: 40619 - DNA, 7 bp, Unknown
  misc_feature (1)..( 7): Matrix.001 file - promoters60/1008425
aaaatga

SEQ ID NO: 40620 - DNA, 6 bp, Unknown
  misc_feature (1)..( 6): Matrix.001 file - promoters60/1008425
acttgt

SEQ ID NO: 40621 - DNA, 7 bp, Unknown
  misc_feature (1)..( 7): Matrix.001 file - promoters60/1008425
tcaagtt

SEQ ID NO: 40622 - DNA, 6 bp, Unknown
  misc_feature (1)..( 6): Matrix.001 file - promoters60/1008425
attaaa

SEQ ID NO: 40623 - DNA, 6 bp, Unknown
  misc_feature (1)..( 6): Matrix.001 file - promoters60/1008425
tcaaca

SEQ ID NO: 40624 - DNA, 9 bp, Unknown
  misc_feature (1)..( 9): Matrix.001 file - promoters60/1008425
aaccattta

SEQ ID NO: 40625 - DNA, 6 bp, Unknown
  misc_feature (1)..( 6): Matrix.001 file - promoters60/1008432
tataat

SEQ ID NO: 40626 - DNA, 6 bp, Unknown
  misc_feature (1)..( 6): Matrix.001 file - promoters60/1008432
ccacca

SEQ ID NO: 40627 - DNA, 9 bp, Unknown
  misc_feature (1)..( 9): Matrix.001 file - promoters60/1008432
gtagatatt

SEQ ID NO: 40628 - DNA, 6 bp, Unknown
  misc_feature (1)..( 6): Matrix.001 file - promoters60/1008432
aacatt

SEQ ID NO: 40629 - DNA, 7 bp, Unknown
  misc_feature (1)..( 7): Matrix.001 file - promoters60/1008432
ttgatga

SEQ ID NO: 40630 - DNA, 8 bp, Unknown
  misc_feature (1)..( 8): Matrix.001 file - promoters60/1008432
ttaatcaa

SEQ ID NO: 40631 - DNA, 8 bp, Unknown
  misc_feature (1)..( 8): Matrix.001 file - promoters60/1008432
aaatggtt

SEQ ID NO: 40632 - DNA, 7 bp, Unknown
  misc_feature (1)..( 7): Matrix.001 file - promoters60/1008432
aatctct

SEQ ID NO: 40633 - DNA, 6 bp, Unknown
  misc_feature (1)..( 6): Matrix.001 file - promoters60/1008432
caaatt

SEQ ID NO: 40634 - DNA, 9 bp, Unknown
  misc_feature (1)..( 9): Matrix.001 file - promoters60/1008432
aatcaaaaa

SEQ ID NO: 40635 - DNA, 8 bp, Unknown
  misc_feature (1)..( 8): Matrix.001 file - promoters60/1008432
tatagtaa

SEQ ID NO: 40636 - DNA, 8 bp, Unknown
  misc_feature (1)..( 8): Matrix.001 file - promoters60/1008432
attttttt

SEQ ID NO: 40637 - DNA, 6 bp, Unknown
  misc_feature (1)..( 6): Matrix.001 file - promoters60/1008432
tttgtt

SEQ ID NO: 40638 - DNA, 6 bp, Unknown
  misc_feature (1)..( 6): Matrix.001 file - promoters60/1008432
tataac

SEQ ID NO: 40639 - DNA, 8 bp, Unknown
  misc_feature (1)..( 8): Matrix.001 file - promoters60/1008432
gaacaaag

SEQ ID NO: 40640 - DNA, 8 bp, Unknown
  misc_feature (1)..( 8): Matrix.001 file - promoters60/1008432
tttaaatg

SEQ ID NO: 40641 - DNA, 7 bp, Unknown
  misc_feature (1)..( 7): Matrix.001 file - promoters60/1008432
ccaaaca

SEQ ID NO: 40642 - DNA, 8 bp, Unknown
  misc_feature (1)..( 8): Matrix.001 file - promoters60/1008432
tacaaaaa

SEQ ID NO: 40643 - DNA, 8 bp, Unknown
  misc_feature (1)..( 8): Matrix.001 file - promoters60/1008432
aaaaaaag

SEQ ID NO: 40644 - DNA, 8 bp, Unknown
  misc_feature (1)..( 8): Matrix.001 file - promoters60/1008432
aacaacct

SEQ ID NO: 40645 - DNA, 12 bp, Unknown
  misc_feature (1)..( 12): Matrix.001 file - promoters60/1008443
taaataggccca

SEQ ID NO: 40646 - DNA, 12 bp, Unknown
  misc_feature (1)..( 12): Matrix.001 file - promoters60/1008534
cccaatataaaa

SEQ ID NO: 40647 - DNA, 11 bp, Unknown
  misc_feature (1)..( 11): Matrix.001 file - promoters60/1008534
atttctgtcaa

SEQ ID NO: 40648 - DNA, 13 bp, Unknown
  misc_feature (1)..( 13): Matrix.001 file - promoters60/1008534
ctcattatataaa

SEQ ID NO: 40649 - DNA, 10 bp, Unknown
  misc_feature (1)..( 10): Matrix.001 file - promoters60/1008573
aagaaatatt

SEQ ID NO: 40650 - DNA, 10 bp, Unknown
  misc_feature (1)..( 10): Matrix.001 file - promoters60/1008573
tatttttaat

SEQ ID NO: 40651 - DNA, 10 bp, Unknown
  misc_feature (1)..( 10): Matrix.001 file - promoters60/1008573
gaataaaaat

SEQ ID NO: 40652 - DNA, 11 bp, Unknown
  misc_feature (1)..( 11): Matrix.001 file - promoters60/1008573
caataatttaa

SEQ ID NO: 40653 - DNA, 10 bp, Unknown
  misc_feature (1)..( 10): Matrix.001 file - promoters60/1008573
aaaatgtata

SEQ ID NO: 40654 - DNA, 7 bp, Unknown
  misc_feature (1)..( 7): Matrix.001 file - promoters60/1008573
gataaaa

SEQ ID NO: 40655 - DNA, 12 bp, Unknown
  misc_feature (1)..( 12): Matrix.001 file - promoters60/1008573
atattttttatg

SEQ ID NO: 40656 - DNA, 7 bp, Unknown
  misc_feature (1)..( 7): Matrix.001 file - promoters60/1008573
tatttat

SEQ ID NO: 40657 - DNA, 6 bp, Unknown
  misc_feature (1)..( 6): Matrix.001 file - promoters60/1008673
atagat

SEQ ID NO: 40658 - DNA, 9 bp, Unknown
  misc_feature (1)..( 9): Matrix.001 file - promoters60/1008673
tatgtaatt

SEQ ID NO: 40659 - DNA, 7 bp, Unknown
  misc_feature (1)..( 7): Matrix.001 file - promoters60/1008673
attgaaa

SEQ ID NO: 40660 - DNA, 12 bp, Unknown
  misc_feature (1)..( 12): Matrix.001 file - promoters60/1008673
aactcaatagtt

SEQ ID NO: 40661 - DNA, 6 bp, Unknown
  misc_feature (1)..( 6): Matrix.001 file - promoters60/1008673
gtttgt

SEQ ID NO: 40662 - DNA, 7 bp, Unknown
  misc_feature (1)..( 7): Matrix.001 file - promoters60/1008673
attcatt

SEQ ID NO: 40663 - DNA, 6 bp, Unknown
  misc_feature (1)..( 6): Matrix.001 file - promoters60/1008673
tgtttg

SEQ ID NO: 40664 - DNA, 8 bp, Unknown
  misc_feature (1)..( 8): Matrix.001 file - promoters60/1008673
cgttacca

SEQ ID NO: 40665 - DNA, 7 bp, Unknown
  misc_feature (1)..( 7): Matrix.001 file - promoters60/1008673
aaaagaa

SEQ ID NO: 40666 - DNA, 6 bp, Unknown
  misc_feature (1)..( 6): Matrix.001 file - promoters60/1008673
actgaa

SEQ ID NO: 40667 - DNA, 6 bp, Unknown
  misc_feature (1)..( 6): Matrix.001 file - promoters60/1008673
tagata

SEQ ID NO: 40668 - DNA, 8 bp, Unknown
  misc_feature (1)..( 8): Matrix.001 file - promoters60/1008673
atgaaatg

SEQ ID NO: 40669 - DNA, 8 bp, Unknown
  misc_feature (1)..( 8): Matrix.001 file - promoters60/1008673
tttttaat

SEQ ID NO: 40670 - DNA, 7 bp, Unknown
  misc_feature (1)..( 7): Matrix.001 file - promoters60/1008673
aaatctt

SEQ ID NO: 40671 - DNA, 9 bp, Unknown
  misc_feature (1)..( 9): Matrix.001 file - promoters60/1008732
taaatttga

SEQ ID NO: 40672 - DNA, 13 bp, Unknown
  misc_feature (1)..( 13): Matrix.001 file - promoters60/1008732
ttaattgtactaa

SEQ ID NO: 40673 - DNA, 12 bp, Unknown
  misc_feature (1)..( 12): Matrix.001 file - promoters60/1008732
aattttattcta

SEQ ID NO: 40674 - DNA, 11 bp, Unknown
  misc_feature (1)..( 11): Matrix.001 file - promoters60/1008732
attaaaatttt

SEQ ID NO: 40675 - DNA, 7 bp, Unknown
  misc_feature (1)..( 7): Matrix.001 file - promoters60/1008787
taacgtt

SEQ ID NO: 40676 - DNA, 15 bp, Unknown
  misc_feature (1)..( 15): Matrix.001 file - promoters60/1008787
aaaagcatacaaata

SEQ ID NO: 40677 - DNA, 6 bp, Unknown
  misc_feature (1)..( 6): Matrix.001 file - promoters60/1008787
tcaact

SEQ ID NO: 40678 - DNA, 7 bp, Unknown
  misc_feature (1)..( 7): Matrix.001 file - promoters60/1008787
aacgtcg

SEQ ID NO: 40679 - DNA, 7 bp, Unknown
  misc_feature (1)..( 7): Matrix.001 file - promoters60/1008787
ctattat

SEQ ID NO: 40680 - DNA, 8 bp, Unknown
  misc_feature (1)..( 8): Matrix.001 file - promoters60/1008787
attatatt

SEQ ID NO: 40681 - DNA, 9 bp, Unknown
  misc_feature (1)..( 9): Matrix.001 file - promoters60/1008787
aaataacaa

SEQ ID NO: 40682 - DNA, 7 bp, Unknown
  misc_feature (1)..( 7): Matrix.001 file - promoters60/1008787
ttaatca

SEQ ID NO: 40683 - DNA, 6 bp, Unknown
  misc_feature (1)..( 6): Matrix.001 file - promoters60/1008787
tttctt

SEQ ID NO: 40684 - DNA, 6 bp, Unknown
  misc_feature (1)..( 6): Matrix.001 file - promoters60/1008787
caagaa

SEQ ID NO: 40685 - DNA, 8 bp, Unknown
  misc_feature (1)..( 8): Matrix.001 file - promoters60/1008787
tggttatt

SEQ ID NO: 40686 - DNA, 6 bp, Unknown
  misc_feature (1)..( 6): Matrix.001 file - promoters60/1008787
ctttgt

SEQ ID NO: 40687 - DNA, 7 bp, Unknown
  misc_feature (1)..( 7): Matrix.001 file - promoters60/1008787
tttcaac

SEQ ID NO: 40688 - DNA, 6 bp, Unknown
  misc_feature (1)..( 6): Matrix.001 file - promoters60/1008787
attaaa

SEQ ID NO: 40689 - DNA, 7 bp, Unknown
  misc_feature (1)..( 7): Matrix.001 file - promoters60/1008787
tacataa

SEQ ID NO: 40690 - DNA, 6 bp, Unknown
  misc_feature (1)..( 6): Matrix.001 file - promoters60/1008787
gtaaaa

SEQ ID NO: 40691 - DNA, 9 bp, Unknown
  misc_feature (1)..( 9): Matrix.001 file - promoters60/1008787
aaatagtta

SEQ ID NO: 40692 - DNA, 8 bp, Unknown
  misc_feature (1)..( 8): Matrix.001 file - promoters60/1008787
caaaactt

SEQ ID NO: 40693 - DNA, 6 bp, Unknown
  misc_feature (1)..( 6): Matrix.001 file - promoters60/1008787
gttcta

SEQ ID NO: 40694 - DNA, 7 bp, Unknown
  misc_feature (1)..( 7): Matrix.001 file - promoters60/1008787
atacttt

SEQ ID NO: 40695 - DNA, 5 bp, Unknown
  misc_feature (1)..( 5): Matrix.001 file - promoters60/1008808
tactt

SEQ ID NO: 40696 - DNA, 11 bp, Unknown
  misc_feature (1)..( 11): Matrix.001 file - promoters60/1008808
aaaaatgatta

SEQ ID NO: 40697 - DNA, 9 bp, Unknown
  misc_feature (1)..( 9): Matrix.001 file - promoters60/1008808
ataagtttg

SEQ ID NO: 40698 - DNA, 9 bp, Unknown
  misc_feature (1)..( 9): Matrix.001 file - promoters60/1008816
tcataacac

SEQ ID NO: 40699 - DNA, 7 bp, Unknown
  misc_feature (1)..( 7): Matrix.001 file - promoters60/1008816
gataaaa

SEQ ID NO: 40700 - DNA, 6 bp, Unknown
  misc_feature (1)..( 6): Matrix.001 file - promoters60/1008816
ttcaac

SEQ ID NO: 40701 - DNA, 6 bp, Unknown
  misc_feature (1)..( 6): Matrix.001 file - promoters60/1008816
taaaac

SEQ ID NO: 40702 - DNA, 6 bp, Unknown
  misc_feature (1)..( 6): Matrix.001 file - promoters60/1008816
aaagtt

SEQ ID NO: 40703 - DNA, 6 bp, Unknown
  misc_feature (1)..( 6): Matrix.001 file - promoters60/1008816
atattt

SEQ ID NO: 40704 - DNA, 6 bp, Unknown
  misc_feature (1)..( 6): Matrix.001 file - promoters60/1008816
gaaaaa

SEQ ID NO: 40705 - DNA, 8 bp, Unknown
  misc_feature (1)..( 8): Matrix.001 file - promoters60/1008816
aggagaaa

SEQ ID NO: 40706 - DNA, 6 bp, Unknown
  misc_feature (1)..( 6): Matrix.001 file - promoters60/1008816
tctaaa

SEQ ID NO: 40707 - DNA, 9 bp, Unknown
  misc_feature (1)..( 9): Matrix.001 file - promoters60/1008816
atcataact

SEQ ID NO: 40708 - DNA, 6 bp, Unknown
  misc_feature (1)..( 6): Matrix.001 file - promoters60/1008816
ctctac

SEQ ID NO: 40709 - DNA, 8 bp, Unknown
  misc_feature (1)..( 8): Matrix.001 file - promoters60/1008816
taaaccaa

SEQ ID NO: 40710 - DNA, 13 bp, Unknown
  misc_feature (1)..( 13): Matrix.001 file - promoters60/1008816
cgaataaaaaaaa

SEQ ID NO: 40711 - DNA, 6 bp, Unknown
  misc_feature (1)..( 6): Matrix.001 file - promoters60/1008816
agtaaa

SEQ ID NO: 40712 - DNA, 7 bp, Unknown
  misc_feature (1)..( 7): Matrix.001 file - promoters60/1008816
aatcggg

SEQ ID NO: 40713 - DNA, 8 bp, Unknown
  misc_feature (1)..( 8): Matrix.001 file - promoters60/1008816
gaaacaaa

SEQ ID NO: 40714 - DNA, 10 bp, Unknown
  misc_feature (1)..( 10): Matrix.001 file - promoters60/1008816
ggaaaagaaa

SEQ ID NO: 40715 - DNA, 7 bp, Unknown
  misc_feature (1)..( 7): Matrix.001 file - promoters60/1008816
cccacta

SEQ ID NO: 40716 - DNA, 9 bp, Unknown
  misc_feature (1)..( 9): Matrix.001 file - promoters60/1008816
aaagaaaag

SEQ ID NO: 40717 - DNA, 7 bp, Unknown
  misc_feature (1)..( 7): Matrix.001 file - promoters60/1008816
gtatata

SEQ ID NO: 40718 - DNA, 10 bp, Unknown
  misc_feature (1)..( 10): Matrix.001 file - promoters60/1008836
aaattttttt

SEQ ID NO: 40719 - DNA, 10 bp, Unknown
  misc_feature (1)..( 10): Matrix.001 file - promoters60/1008836
atttttatta

SEQ ID NO: 40720 - DNA, 12 bp, Unknown
  misc_feature (1)..( 12): Matrix.001 file - promoters60/1008836
tcaaaaaaaaaa

SEQ ID NO: 40721 - DNA, 7 bp, Unknown
  misc_feature (1)..( 7): Matrix.001 file - promoters60/1008836
taaaacg

SEQ ID NO: 40722 - DNA, 12 bp, Unknown
  misc_feature (1)..( 12): Matrix.001 file - promoters60/1008836
taaaaattaaat

SEQ ID NO: 40723 - DNA, 10 bp, Unknown
  misc_feature (1)..( 10): Matrix.001 file - promoters60/1008836
aaatattatc

SEQ ID NO: 40724 - DNA, 6 bp, Unknown
  misc_feature (1)..( 6): Matrix.001 file - promoters60/1008836
tataaa

SEQ ID NO: 40725 - DNA, 13 bp, Unknown
  misc_feature (1)..( 13): Matrix.001 file - promoters60/1008836
atatttttataaa

SEQ ID NO: 40726 - DNA, 12 bp, Unknown
  misc_feature (1)..( 12): Matrix.001 file - promoters60/1008836
gtttttgatatt

SEQ ID NO: 40727 - DNA, 10 bp, Unknown
  misc_feature (1)..( 10): Matrix.001 file - promoters60/1008836
ttttaaaaaa

SEQ ID NO: 40728 - DNA, 4 bp, Unknown
  misc_feature (1)..( 4): Matrix.001 file - promoters60/1008836
atat

SEQ ID NO: 40729 - DNA, 11 bp, Unknown
  misc_feature (1)..( 11): Matrix.001 file - promoters60/1008836
tagattaaaaa

SEQ ID NO: 40730 - DNA, 8 bp, Unknown
  misc_feature (1)..( 8): Matrix.001 file - promoters60/1008889
attcattg

SEQ ID NO: 40731 - DNA, 8 bp, Unknown
  misc_feature (1)..( 8): Matrix.001 file - promoters60/1008889
ctgatatt

SEQ ID NO: 40732 - DNA, 10 bp, Unknown
  misc_feature (1)..( 10): Matrix.001 file - promoters60/1008889
atttataaat

SEQ ID NO: 40733 - DNA, 7 bp, Unknown
  misc_feature (1)..( 7): Matrix.001 file - promoters60/1008889
gttattt

SEQ ID NO: 40734 - DNA, 8 bp, Unknown
  misc_feature (1)..( 8): Matrix.001 file - promoters60/1008889
taaattat

SEQ ID NO: 40735 - DNA, 8 bp, Unknown
  misc_feature (1)..( 8): Matrix.001 file - promoters60/1008889
gtcaaaaa

SEQ ID NO: 40736 - DNA, 6 bp, Unknown
  misc_feature (1)..( 6): Matrix.001 file - promoters60/1008889
agtttg

SEQ ID NO: 40737 - DNA, 8 bp, Unknown
  misc_feature (1)..( 8): Matrix.001 file - promoters60/1008889
aaagacat

SEQ ID NO: 40738 - DNA, 6 bp, Unknown
  misc_feature (1)..( 6): Matrix.001 file - promoters60/1008889
ctctcc

SEQ ID NO: 40739 - DNA, 7 bp, Unknown
  misc_feature (1)..( 7): Matrix.001 file - promoters60/1008889
caacctt

SEQ ID NO: 40740 - DNA, 8 bp, Unknown
  misc_feature (1)..( 8): Matrix.001 file - promoters60/1008889
aagaagat

SEQ ID NO: 40741 - DNA, 8 bp, Unknown
  misc_feature (1)..( 8): Matrix.001 file - promoters60/1008889
caataaga

SEQ ID NO: 40742 - DNA, 6 bp, Unknown
  misc_feature (1)..( 6): Matrix.001 file - promoters60/1008889
aaaaaa

SEQ ID NO: 40743 - DNA, 13 bp, Unknown
  misc_feature (1)..( 13): Matrix.001 file - promoters60/1008889
aaagaaaaaaatt

SEQ ID NO: 40744 - DNA, 8 bp, Unknown
  misc_feature (1)..( 8): Matrix.001 file - promoters60/1008889
attttttt

SEQ ID NO: 40745 - DNA, 6 bp, Unknown
  misc_feature (1)..( 6): Matrix.001 file - promoters60/1008889
caatat

SEQ ID NO: 40746 - DNA, 6 bp, Unknown
  misc_feature (1)..( 6): Matrix.001 file - promoters60/1008889
aataaa

SEQ ID NO: 40747 - DNA, 7 bp, Unknown
  misc_feature (1)..( 7): Matrix.001 file - promoters60/1008983
ttaattg

SEQ ID NO: 40748 - DNA, 7 bp, Unknown
  misc_feature (1)..( 7): Matrix.001 file - promoters60/1008983
gtccaga

SEQ ID NO: 40749 - DNA, 6 bp, Unknown
  misc_feature (1)..( 6): Matrix.001 file - promoters60/1008983
tgaaaa

SEQ ID NO: 40750 - DNA, 6 bp, Unknown
  misc_feature (1)..( 6): Matrix.001 file - promoters60/1008983
atttgg

SEQ ID NO: 40751 - DNA, 9 bp, Unknown
  misc_feature (1)..( 9): Matrix.001 file - promoters60/1008983
ggtgttggt

SEQ ID NO: 40752 - DNA, 7 bp, Unknown
  misc_feature (1)..( 7): Matrix.001 file - promoters60/1008983
atttttg

SEQ ID NO: 40753 - DNA, 6 bp, Unknown
  misc_feature (1)..( 6): Matrix.001 file - promoters60/1008983
gctttt

SEQ ID NO: 40754 - DNA, 7 bp, Unknown
  misc_feature (1)..( 7): Matrix.001 file - promoters60/1008983
tctggtg

SEQ ID NO: 40755 - DNA, 6 bp, Unknown
  misc_feature (1)..( 6): Matrix.001 file - promoters60/1008983
tcttgt

SEQ ID NO: 40756 - DNA, 6 bp, Unknown
  misc_feature (1)..( 6): Matrix.001 file - promoters60/1008983
tctatc

SEQ ID NO: 40757 - DNA, 7 bp, Unknown
  misc_feature (1)..( 7): Matrix.001 file - promoters60/1008983
aatatct

SEQ ID NO: 40758 - DNA, 7 bp, Unknown
  misc_feature (1)..( 7): Matrix.001 file - promoters60/1008983
ttaaccc

SEQ ID NO: 40759 - DNA, 6 bp, Unknown
  misc_feature (1)..( 6): Matrix.001 file - promoters60/1008983
ttctta

SEQ ID NO: 40760 - DNA, 8 bp, Unknown
  misc_feature (1)..( 8): Matrix.001 file - promoters60/1008983
atgatttc

SEQ ID NO: 40761 - DNA, 7 bp, Unknown
  misc_feature (1)..( 7): Matrix.001 file - promoters60/1008983
atttttc

SEQ ID NO: 40762 - DNA, 8 bp, Unknown
  misc_feature (1)..( 8): Matrix.001 file - promoters60/1008983
agaacagg

SEQ ID NO: 40763 - DNA, 6 bp, Unknown
  misc_feature (1)..( 6): Matrix.001 file - promoters60/1008983
tgatcg

SEQ ID NO: 40764 - DNA, 6 bp, Unknown
  misc_feature (1)..( 6): Matrix.001 file - promoters60/1008983
aatgcc

SEQ ID NO: 40765 - DNA, 6 bp, Unknown
  misc_feature (1)..( 6): Matrix.001 file - promoters60/1008983
tgctga

SEQ ID NO: 40766 - DNA, 7 bp, Unknown
  misc_feature (1)..( 7): Matrix.001 file - promoters60/1008983
ccgagtt

SEQ ID NO: 40767 - DNA, 11 bp, Unknown
  misc_feature (1)..( 11): Matrix.001 file - promoters60/1009030
ataaaacaaaa

SEQ ID NO: 40768 - DNA, 11 bp, Unknown
  misc_feature (1)..( 11): Matrix.001 file - promoters60/1009030
ataataatagc

SEQ ID NO: 40769 - DNA, 9 bp, Unknown
  misc_feature (1)..( 9): Matrix.001 file - promoters60/1009030
acaaaacat

SEQ ID NO: 40770 - DNA, 8 bp, Unknown
  misc_feature (1)..( 8): Matrix.001 file - promoters60/1009053
atactact

SEQ ID NO: 40771 - DNA, 7 bp, Unknown
  misc_feature (1)..( 7): Matrix.001 file - promoters60/1009053
caaatac

SEQ ID NO: 40772 - DNA, 11 bp, Unknown
  misc_feature (1)..( 11): Matrix.001 file - promoters60/1009053
tatattttttt

SEQ ID NO: 40773 - DNA, 6 bp, Unknown
  misc_feature (1)..( 6): Matrix.001 file - promoters60/1009053
tatatg

SEQ ID NO: 40774 - DNA, 6 bp, Unknown
  misc_feature (1)..( 6): Matrix.001 file - promoters60/1009053
ttcaaa

SEQ ID NO: 40775 - DNA, 9 bp, Unknown
  misc_feature (1)..( 9): Matrix.001 file - promoters60/1009053
atactctca

SEQ ID NO: 40776 - DNA, 6 bp, Unknown
  misc_feature (1)..( 6): Matrix.001 file - promoters60/1009053
tcaaac

SEQ ID NO: 40777 - DNA, 6 bp, Unknown
  misc_feature (1)..( 6): Matrix.001 file - promoters60/1009053
ttttct

SEQ ID NO: 40778 - DNA, 7 bp, Unknown
  misc_feature (1)..( 7): Matrix.001 file - promoters60/1009053
gaaatca

SEQ ID NO: 40779 - DNA, 6 bp, Unknown
  misc_feature (1)..( 6): Matrix.001 file - promoters60/1009053
atcttg

SEQ ID NO: 40780 - DNA, 6 bp, Unknown
  misc_feature (1)..( 6): Matrix.001 file - promoters60/1009053
acacaa

SEQ ID NO: 40781 - DNA, 10 bp, Unknown
  misc_feature (1)..( 10): Matrix.001 file - promoters60/1009053
atttttttaa

SEQ ID NO: 40782 - DNA, 7 bp, Unknown
  misc_feature (1)..( 7): Matrix.001 file - promoters60/1009053
actattc

SEQ ID NO: 40783 - DNA, 11 bp, Unknown
  misc_feature (1)..( 11): Matrix.001 file - promoters60/1009053
accggatatta

SEQ ID NO: 40784 - DNA, 6 bp, Unknown
  misc_feature (1)..( 6): Matrix.001 file - promoters60/1009053
tactgt

SEQ ID NO: 40785 - DNA, 9 bp, Unknown
  misc_feature (1)..( 9): Matrix.001 file - promoters60/1009053
tcaaaattt

SEQ ID NO: 40786 - DNA, 6 bp, Unknown
  misc_feature (1)..( 6): Matrix.001 file - promoters60/1009053
ttgaaa

SEQ ID NO: 40787 - DNA, 7 bp, Unknown
  misc_feature (1)..( 7): Matrix.001 file - promoters60/1009053
cttctcc

SEQ ID NO: 40788 - DNA, 7 bp, Unknown
  misc_feature (1)..( 7): Matrix.001 file - promoters60/1009053
ttcatgt

SEQ ID NO: 40789 - DNA, 7 bp, Unknown
  misc_feature (1)..( 7): Matrix.001 file - promoters60/1009053
aagattt

SEQ ID NO: 40790 - DNA, 7 bp, Unknown
  misc_feature (1)..( 7): Matrix.001 file - promoters60/1009053
tacctca

SEQ ID NO: 40791 - DNA, 7 bp, Unknown
  misc_feature (1)..( 7): Matrix.001 file - promoters60/1009053
tttgata

SEQ ID NO: 40792 - DNA, 9 bp, Unknown
  misc_feature (1)..( 9): Matrix.001 file - promoters60/1009053
catcattat

SEQ ID NO: 40793 - DNA, 8 bp, Unknown
  misc_feature (1)..( 8): Matrix.001 file - promoters60/1009086
ataaataa

SEQ ID NO: 40794 - DNA, 6 bp, Unknown
  misc_feature (1)..( 6): Matrix.001 file - promoters60/1009086
aattat

SEQ ID NO: 40795 - DNA, 6 bp, Unknown
  misc_feature (1)..( 6): Matrix.001 file - promoters60/1009086
tttgtt

SEQ ID NO: 40796 - DNA, 6 bp, Unknown
  misc_feature (1)..( 6): Matrix.001 file - promoters60/1009086
aaattg

SEQ ID NO: 40797 - DNA, 7 bp, Unknown
  misc_feature (1)..( 7): Matrix.001 file - promoters60/1009086
aaaaatt

SEQ ID NO: 40798 - DNA, 6 bp, Unknown
  misc_feature (1)..( 6): Matrix.001 file - promoters60/1009086
tttgat

SEQ ID NO: 40799 - DNA, 6 bp, Unknown
  misc_feature (1)..( 6): Matrix.001 file - promoters60/1009086
tcaaat

SEQ ID NO: 40800 - DNA, 9 bp, Unknown
  misc_feature (1)..( 9): Matrix.001 file - promoters60/1009086
taaatatga

SEQ ID NO: 40801 - DNA, 7 bp, Unknown
  misc_feature (1)..( 7): Matrix.001 file - promoters60/1009086
aatactt

SEQ ID NO: 40802 - DNA, 7 bp, Unknown
  misc_feature (1)..( 7): Matrix.001 file - promoters60/1009086
aaactct

SEQ ID NO: 40803 - DNA, 6 bp, Unknown
  misc_feature (1)..( 6): Matrix.001 file - promoters60/1009086
gttttt

SEQ ID NO: 40804 - DNA, 8 bp, Unknown
  misc_feature (1)..( 8): Matrix.001 file - promoters60/1009086
gaaacaga

SEQ ID NO: 40805 - DNA, 7 bp, Unknown
  misc_feature (1)..( 7): Matrix.001 file - promoters60/1009086
aaagctt

SEQ ID NO: 40806 - DNA, 8 bp, Unknown
  misc_feature (1)..( 8): Matrix.001 file - promoters60/1009086
aatatgat

SEQ ID NO: 40807 - DNA, 7 bp, Unknown
  misc_feature (1)..( 7): Matrix.001 file - promoters60/1009086
ctcaaca

SEQ ID NO: 40808 - DNA, 8 bp, Unknown
  misc_feature (1)..( 8): Matrix.001 file - promoters60/1009086
ataaaaca

SEQ ID NO: 40809 - DNA, 8 bp, Unknown
  misc_feature (1)..( 8): Matrix.001 file - promoters60/1009086
tatatttt

SEQ ID NO: 40810 - DNA, 6 bp, Unknown
  misc_feature (1)..( 6): Matrix.001 file - promoters60/1009086
tatttc

SEQ ID NO: 40811 - DNA, 8 bp, Unknown
  misc_feature (1)..( 8): Matrix.001 file - promoters60/1009086
atcaggaa

SEQ ID NO: 40812 - DNA, 8 bp, Unknown
  misc_feature (1)..( 8): Matrix.001 file - promoters60/1009086
tttaaaag

SEQ ID NO: 40813 - DNA, 6 bp, Unknown
  misc_feature (1)..( 6): Matrix.001 file - promoters60/1009086
aggttt

SEQ ID NO: 40814 - DNA, 8 bp, Unknown
  misc_feature (1)..( 8): Matrix.001 file - promoters60/1009136
caaaacaa

SEQ ID NO: 40815 - DNA, 8 bp, Unknown
  misc_feature (1)..( 8): Matrix.001 file - promoters60/1009136
attcaatt

SEQ ID NO: 40816 - DNA, 11 bp, Unknown
  misc_feature (1)..( 11): Matrix.001 file - promoters60/1009136
acagaaataaa

SEQ ID NO: 40817 - DNA, 8 bp, Unknown
  misc_feature (1)..( 8): Matrix.001 file - promoters60/1009146
caaatttt

SEQ ID NO: 40818 - DNA, 7 bp, Unknown
  misc_feature (1)..( 7): Matrix.001 file - promoters60/1009146
agacaag

SEQ ID NO: 40819 - DNA, 8 bp, Unknown
  misc_feature (1)..( 8): Matrix.001 file - promoters60/1009146
aaagcgac

SEQ ID NO: 40820 - DNA, 8 bp, Unknown
  misc_feature (1)..( 8): Matrix.001 file - promoters60/1009146
aggggaat

SEQ ID NO: 40821 - DNA, 7 bp, Unknown
  misc_feature (1)..( 7): Matrix.001 file - promoters60/1009146
gttcttg

SEQ ID NO: 40822 - DNA, 13 bp, Unknown
  misc_feature (1)..( 13): Matrix.001 file - promoters60/1009146
ttgaatcaaaatt

SEQ ID NO: 40823 - DNA, 7 bp, Unknown
  misc_feature (1)..( 7): Matrix.001 file - promoters60/1009146
tggattt

SEQ ID NO: 40824 - DNA, 6 bp, Unknown
  misc_feature (1)..( 6): Matrix.001 file - promoters60/1009146
aagatt

SEQ ID NO: 40825 - DNA, 6 bp, Unknown
  misc_feature (1)..( 6): Matrix.001 file - promoters60/1009146
ttggtt

SEQ ID NO: 40826 - DNA, 6 bp, Unknown
  misc_feature (1)..( 6): Matrix.001 file - promoters60/1009146
ttaacc

SEQ ID NO: 40827 - DNA, 7 bp, Unknown
  misc_feature (1)..( 7): Matrix.001 file - promoters60/1009146
ctcactc

SEQ ID NO: 40828 - DNA, 6 bp, Unknown
  misc_feature (1)..( 6): Matrix.001 file - promoters60/1009146
atttct

SEQ ID NO: 40829 - DNA, 15 bp, Unknown
  misc_feature (1)..( 15): Matrix.001 file - promoters60/1009211
taattgggcttatta

SEQ ID NO: 40830 - DNA, 12 bp, Unknown
  misc_feature (1)..( 12): Matrix.001 file - promoters60/1009234
taaaatgaagag

SEQ ID NO: 40831 - DNA, 7 bp, Unknown
  misc_feature (1)..( 7): Matrix.001 file - promoters60/1009234
caaatag

SEQ ID NO: 40832 - DNA, 9 bp, Unknown
  misc_feature (1)..( 9): Matrix.001 file - promoters60/1009354
attgaaata

SEQ ID NO: 40833 - DNA, 6 bp, Unknown
  misc_feature (1)..( 6): Matrix.001 file - promoters60/1009354
ttattt

SEQ ID NO: 40834 - DNA, 6 bp, Unknown
  misc_feature (1)..( 6): Matrix.001 file - promoters60/1009354
ataatt

SEQ ID NO: 40835 - DNA, 8 bp, Unknown
  misc_feature (1)..( 8): Matrix.001 file - promoters60/1009354
taagaact

SEQ ID NO: 40836 - DNA, 7 bp, Unknown
  misc_feature (1)..( 7): Matrix.001 file - promoters60/1009354
accctct

SEQ ID NO: 40837 - DNA, 6 bp, Unknown
  misc_feature (1)..( 6): Matrix.001 file - promoters60/1009354
ttaaat

SEQ ID NO: 40838 - DNA, 6 bp, Unknown
  misc_feature (1)..( 6): Matrix.001 file - promoters60/1009354
ttttgt

SEQ ID NO: 40839 - DNA, 6 bp, Unknown
  misc_feature (1)..( 6): Matrix.001 file - promoters60/1009354
agtaat

SEQ ID NO: 40840 - DNA, 6 bp, Unknown
  misc_feature (1)..( 6): Matrix.001 file - promoters60/1009354
atagag

SEQ ID NO: 40841 - DNA, 7 bp, Unknown
  misc_feature (1)..( 7): Matrix.001 file - promoters60/1009354
atgtggc

SEQ ID NO: 40842 - DNA, 7 bp, Unknown
  misc_feature (1)..( 7): Matrix.001 file - promoters60/1009354
gattctt

SEQ ID NO: 40843 - DNA, 9 bp, Unknown
  misc_feature (1)..( 9): Matrix.001 file - promoters60/1009354
aatgaagat

SEQ ID NO: 40844 - DNA, 7 bp, Unknown
  misc_feature (1)..( 7): Matrix.001 file - promoters60/1009354
acacgtc

SEQ ID NO: 40845 - DNA, 8 bp, Unknown
  misc_feature (1)..( 8): Matrix.001 file - promoters60/1009354
gtgatcca

SEQ ID NO: 40846 - DNA, 6 bp, Unknown
  misc_feature (1)..( 6): Matrix.001 file - promoters60/1009354
aaactt

SEQ ID NO: 40847 - DNA, 7 bp, Unknown
  misc_feature (1)..( 7): Matrix.001 file - promoters60/1009354
ttcaaaa

SEQ ID NO: 40848 - DNA, 6 bp, Unknown
  misc_feature (1)..( 6): Matrix.001 file - promoters60/1009354
taagaa

SEQ ID NO: 40849 - DNA, 8 bp, Unknown
  misc_feature (1)..( 8): Matrix.001 file - promoters60/1009354
gaaaatct

SEQ ID NO: 40850 - DNA, 6 bp, Unknown
  misc_feature (1)..( 6): Matrix.001 file - promoters60/1009354
ttgtca

SEQ ID NO: 40851 - DNA, 8 bp, Unknown
  misc_feature (1)..( 8): Matrix.001 file - promoters60/1009354
cataagta

SEQ ID NO: 40852 - DNA, 8 bp, Unknown
  misc_feature (1)..( 8): Matrix.001 file - promoters60/1009354
ggtggata

SEQ ID NO: 40853 - DNA, 7 bp, Unknown
  misc_feature (1)..( 7): Matrix.001 file - promoters60/1009354
cacacgt

SEQ ID NO: 40854 - DNA, 13 bp, Unknown
  misc_feature (1)..( 13): Matrix.001 file - promoters60/1009354
taaccaaaaattc

SEQ ID NO: 40855 - DNA, 10 bp, Unknown
  misc_feature (1)..( 10): Matrix.001 file - promoters60/1009430
ctcttaaata

SEQ ID NO: 40856 - DNA, 9 bp, Unknown
  misc_feature (1)..( 9): Matrix.001 file - promoters60/1009430
agaaaattc

SEQ ID NO: 40857 - DNA, 8 bp, Unknown
  misc_feature (1)..( 8): Matrix.001 file - promoters60/1009430
cttcatct

SEQ ID NO: 40858 - DNA, 10 bp, Unknown
  misc_feature (1)..( 10): Matrix.001 file - promoters60/1009616
ctaaacaaaa

SEQ ID NO: 40859 - DNA, 9 bp, Unknown
  misc_feature (1)..( 9): Matrix.001 file - promoters60/1009616
gaatacaaa

SEQ ID NO: 40860 - DNA, 12 bp, Unknown
  misc_feature (1)..( 12): Matrix.001 file - promoters60/1009616
aaaatatacaac

SEQ ID NO: 40861 - DNA, 12 bp, Unknown
  misc_feature (1)..( 12): Matrix.001 file - promoters60/1009616
attataatgcaa

SEQ ID NO: 40862 - DNA, 12 bp, Unknown
  misc_feature (1)..( 12): Matrix.001 file - promoters60/1009616
aaacttaaaaag

SEQ ID NO: 40863 - DNA, 7 bp, Unknown
  misc_feature (1)..( 7): Matrix.001 file - promoters60/1009686
tatgttt

SEQ ID NO: 40864 - DNA, 7 bp, Unknown
  misc_feature (1)..( 7): Matrix.001 file - promoters60/1009686
aaagttg

SEQ ID NO: 40865 - DNA, 7 bp, Unknown
  misc_feature (1)..( 7): Matrix.001 file - promoters60/1009686
ttacata

SEQ ID NO: 40866 - DNA, 7 bp, Unknown
  misc_feature (1)..( 7): Matrix.001 file - promoters60/1009686
tagttaa

SEQ ID NO: 40867 - DNA, 6 bp, Unknown
  misc_feature (1)..( 6): Matrix.001 file - promoters60/1009686
tgaaaa

SEQ ID NO: 40868 - DNA, 6 bp, Unknown
  misc_feature (1)..( 6): Matrix.001 file - promoters60/1009686
taaagt

SEQ ID NO: 40869 - DNA, 6 bp, Unknown
  misc_feature (1)..( 6): Matrix.001 file - promoters60/1009686
taattt

SEQ ID NO: 40870 - DNA, 7 bp, Unknown
  misc_feature (1)..( 7): Matrix.001 file - promoters60/1009686
ttacgaa

SEQ ID NO: 40871 - DNA, 8 bp, Unknown
  misc_feature (1)..( 8): Matrix.001 file - promoters60/1009686
attaagtc

SEQ ID NO: 40872 - DNA, 9 bp, Unknown
  misc_feature (1)..( 9): Matrix.001 file - promoters60/1009686
aatcaaaaa

SEQ ID NO: 40873 - DNA, 9 bp, Unknown
  misc_feature (1)..( 9): Matrix.001 file - promoters60/1009686
aaacaatta

SEQ ID NO: 40874 - DNA, 7 bp, Unknown
  misc_feature (1)..( 7): Matrix.001 file - promoters60/1009686
agtagtt

SEQ ID NO: 40875 - DNA, 7 bp, Unknown
  misc_feature (1)..( 7): Matrix.001 file - promoters60/1009686
cttcctt

SEQ ID NO: 40876 - DNA, 6 bp, Unknown
  misc_feature (1)..( 6): Matrix.001 file - promoters60/1009686
tttaca

SEQ ID NO: 40877 - DNA, 7 bp, Unknown
  misc_feature (1)..( 7): Matrix.001 file - promoters60/1009686
aataagg

SEQ ID NO: 40878 - DNA, 11 bp, Unknown
  misc_feature (1)..( 11): Matrix.001 file - promoters60/1009686
acaaagaaata

SEQ ID NO: 40879 - DNA, 6 bp, Unknown
  misc_feature (1)..( 6): Matrix.001 file - promoters60/1009686
tcaaaa

SEQ ID NO: 40880 - DNA, 8 bp, Unknown
  misc_feature (1)..( 8): Matrix.001 file - promoters60/1009686
aagaagaa

SEQ ID NO: 40881 - DNA, 8 bp, Unknown
  misc_feature (1)..( 8): Matrix.001 file - promoters60/1009686
aagaggag

SEQ ID NO: 40882 - DNA, 8 bp, Unknown
  misc_feature (1)..( 8): Matrix.001 file - promoters60/1009752
atttcaat

SEQ ID NO: 40883 - DNA, 8 bp, Unknown
  misc_feature (1)..( 8): Matrix.001 file - promoters60/1009752
ttatttta

SEQ ID NO: 40884 - DNA, 7 bp, Unknown
  misc_feature (1)..( 7): Matrix.001 file - promoters60/1009752
aaaaaat

SEQ ID NO: 40885 - DNA, 6 bp, Unknown
  misc_feature (1)..( 6): Matrix.001 file - promoters60/1009752
aattag

SEQ ID NO: 40886 - DNA, 8 bp, Unknown
  misc_feature (1)..( 8): Matrix.001 file - promoters60/1009752
aggatgtt

SEQ ID NO: 40887 - DNA, 6 bp, Unknown
  misc_feature (1)..( 6): Matrix.001 file - promoters60/1009752
taaacg

SEQ ID NO: 40888 - DNA, 6 bp, Unknown
  misc_feature (1)..( 6): Matrix.001 file - promoters60/1009752
ttaatt

SEQ ID NO: 40889 - DNA, 7 bp, Unknown
  misc_feature (1)..( 7): Matrix.001 file - promoters60/1009752
taacaat

SEQ ID NO: 40890 - DNA, 6 bp, Unknown
  misc_feature (1)..( 6): Matrix.001 file - promoters60/1009752
aaataa

SEQ ID NO: 40891 - DNA, 7 bp, Unknown
  misc_feature (1)..( 7): Matrix.001 file - promoters60/1009752
tttccct

SEQ ID NO: 40892 - DNA, 6 bp, Unknown
  misc_feature (1)..( 6): Matrix.001 file - promoters60/1009752
tatttt

SEQ ID NO: 40893 - DNA, 6 bp, Unknown
  misc_feature (1)..( 6): Matrix.001 file - promoters60/1009752
atttaa

SEQ ID NO: 40894 - DNA, 6 bp, Unknown
  misc_feature (1)..( 6): Matrix.001 file - promoters60/1009752
taatta

SEQ ID NO: 40895 - DNA, 7 bp, Unknown
  misc_feature (1)..( 7): Matrix.001 file - promoters60/1009752
gataata

SEQ ID NO: 40896 - DNA, 7 bp, Unknown
  misc_feature (1)..( 7): Matrix.001 file - promoters60/1009752
ttaaaaa

SEQ ID NO: 40897 - DNA, 6 bp, Unknown
  misc_feature (1)..( 6): Matrix.001 file - promoters60/1009752
aataaa

SEQ ID NO: 40898 - DNA, 7 bp, Unknown
  misc_feature (1)..( 7): Matrix.001 file - promoters60/1009752
tcctata

SEQ ID NO: 40899 - DNA, 9 bp, Unknown
  misc_feature (1)..( 9): Matrix.001 file - promoters60/1009834
aagaaaaga

SEQ ID NO: 40900 - DNA, 7 bp, Unknown
  misc_feature (1)..( 7): Matrix.001 file - promoters60/1009834
tttattc

SEQ ID NO: 40901 - DNA, 11 bp, Unknown
  misc_feature (1)..( 11): Matrix.001 file - promoters60/1009834
atattttggag

SEQ ID NO: 40902 - DNA, 7 bp, Unknown
  misc_feature (1)..( 7): Matrix.001 file - promoters60/1009834
ttcatta

SEQ ID NO: 40903 - DNA, 7 bp, Unknown
  misc_feature (1)..( 7): Matrix.001 file - promoters60/1009834
aaaaatt

SEQ ID NO: 40904 - DNA, 9 bp, Unknown
  misc_feature (1)..( 9): Matrix.001 file - promoters60/1009834
aaaaaaagt

SEQ ID NO: 40905 - DNA, 7 bp, Unknown
  misc_feature (1)..( 7): Matrix.001 file - promoters60/1009834
gaaacaa

SEQ ID NO: 40906 - DNA, 8 bp, Unknown
  misc_feature (1)..( 8): Matrix.001 file - promoters60/1009834
ttacaata

SEQ ID NO: 40907 - DNA, 9 bp, Unknown
  misc_feature (1)..( 9): Matrix.001 file - promoters60/1009834
attcgtttt

SEQ ID NO: 40908 - DNA, 7 bp, Unknown
  misc_feature (1)..( 7): Matrix.001 file - promoters60/1009834
tcccatt

SEQ ID NO: 40909 - DNA, 7 bp, Unknown
  misc_feature (1)..( 7): Matrix.001 file - promoters60/1009834
attgttt

SEQ ID NO: 40910 - DNA, 6 bp, Unknown
  misc_feature (1)..( 6): Matrix.001 file - promoters60/1009834
tattaa

SEQ ID NO: 40911 - DNA, 6 bp, Unknown
  misc_feature (1)..( 6): Matrix.001 file - promoters60/1009834
taatat

SEQ ID NO: 40912 - DNA, 13 bp, Unknown
  misc_feature (1)..( 13): Matrix.001 file - promoters60/1009854
attcataaaaaaa

SEQ ID NO: 40913 - DNA, 8 bp, Unknown
  misc_feature (1)..( 8): Matrix.001 file - promoters60/1009854
gaaaaaat

SEQ ID NO: 40914 - DNA, 12 bp, Unknown
  misc_feature (1)..( 12): Matrix.001 file - promoters60/1009854
aactaatgcaat

SEQ ID NO: 40915 - DNA, 11 bp, Unknown
  misc_feature (1)..( 11): Matrix.001 file - promoters60/1009854
atttctaaaaa

SEQ ID NO: 40916 - DNA, 10 bp, Unknown
  misc_feature (1)..( 10): Matrix.001 file - promoters60/1009854
aaagaaaaca

SEQ ID NO: 40917 - DNA, 9 bp, Unknown
  misc_feature (1)..( 9): Matrix.001 file - promoters60/1009854
caaaacaaa

SEQ ID NO: 40918 - DNA, 7 bp, Unknown
  misc_feature (1)..( 7): Matrix.001 file - promoters60/1009854
aattttg

SEQ ID NO: 40919 - DNA, 9 bp, Unknown
  misc_feature (1)..( 9): Matrix.001 file - promoters60/1009854
ttttgttta

SEQ ID NO: 40920 - DNA, 8 bp, Unknown
  misc_feature (1)..( 8): Matrix.001 file - promoters60/1009854
ttgagatc

SEQ ID NO: 40921 - DNA, 9 bp, Unknown
  misc_feature (1)..( 9): Matrix.001 file - promoters60/1009854
gaaatgaag

SEQ ID NO: 40922 - DNA, 8 bp, Unknown
  misc_feature (1)..( 8): Matrix.001 file - promoters60/1009854
aaaaatat

SEQ ID NO: 40923 - DNA, 12 bp, Unknown
  misc_feature (1)..( 12): Matrix.001 file - promoters60/1009854
ttttattaaaat

SEQ ID NO: 40924 - DNA, 9 bp, Unknown
  misc_feature (1)..( 9): Matrix.001 file - promoters60/1009854
ctttcacaa

SEQ ID NO: 40925 - DNA, 10 bp, Unknown
  misc_feature (1)..( 10): Matrix.001 file - promoters60/1009854
aaaataaatt

SEQ ID NO: 40926 - DNA, 7 bp, Unknown
  misc_feature (1)..( 7): Matrix.001 file - promoters60/1009854
ctataaa

SEQ ID NO: 40927 - DNA, 6 bp, Unknown
  misc_feature (1)..( 6): Matrix.001 file - promoters60/1009861
aaagaa

SEQ ID NO: 40928 - DNA, 8 bp, Unknown
  misc_feature (1)..( 8): Matrix.001 file - promoters60/1009861
attttaat

SEQ ID NO: 40929 - DNA, 6 bp, Unknown
  misc_feature (1)..( 6): Matrix.001 file - promoters60/1009861
aaccaa

SEQ ID NO: 40930 - DNA, 6 bp, Unknown
  misc_feature (1)..( 6): Matrix.001 file - promoters60/1009861
aaaatt

SEQ ID NO: 40931 - DNA, 9 bp, Unknown
  misc_feature (1)..( 9): Matrix.001 file - promoters60/1009861
ttcaaattc

SEQ ID NO: 40932 - DNA, 8 bp, Unknown
  misc_feature (1)..( 8): Matrix.001 file - promoters60/1009861
ttagctgg

SEQ ID NO: 40933 - DNA, 9 bp, Unknown
  misc_feature (1)..( 9): Matrix.001 file - promoters60/1009861
agtacaatg

SEQ ID NO: 40934 - DNA, 6 bp, Unknown
  misc_feature (1)..( 6): Matrix.001 file - promoters60/1009861
gaacat

SEQ ID NO: 40935 - DNA, 6 bp, Unknown
  misc_feature (1)..( 6): Matrix.001 file - promoters60/1009861
ttattt

SEQ ID NO: 40936 - DNA, 6 bp, Unknown
  misc_feature (1)..( 6): Matrix.001 file - promoters60/1009861
tctttt

SEQ ID NO: 40937 - DNA, 10 bp, Unknown
  misc_feature (1)..( 10): Matrix.001 file - promoters60/1009861
ttttaattaa

SEQ ID NO: 40938 - DNA, 6 bp, Unknown
  misc_feature (1)..( 6): Matrix.001 file - promoters60/1009861
aatttc

SEQ ID NO: 40939 - DNA, 8 bp, Unknown
  misc_feature (1)..( 8): Matrix.001 file - promoters60/1009861
aaaatttc

SEQ ID NO: 40940 - DNA, 7 bp, Unknown
  misc_feature (1)..( 7): Matrix.001 file - promoters60/1009861
tttaata

SEQ ID NO: 40941 - DNA, 7 bp, Unknown
  misc_feature (1)..( 7): Matrix.001 file - promoters60/1009861
caaaaac

SEQ ID NO: 40942 - DNA, 8 bp, Unknown
  misc_feature (1)..( 8): Matrix.001 file - promoters60/1009861
aaaagcgc

SEQ ID NO: 40943 - DNA, 8 bp, Unknown
  misc_feature (1)..( 8): Matrix.001 file - promoters60/1009861
tatacata

SEQ ID NO: 40944 - DNA, 7 bp, Unknown
  misc_feature (1)..( 7): Matrix.001 file - promoters60/1009861
aaccgaa

SEQ ID NO: 40945 - DNA, 6 bp, Unknown
  misc_feature (1)..( 6): Matrix.001 file - promoters60/1009861
aatttt

SEQ ID NO: 40946 - DNA, 7 bp, Unknown
  misc_feature (1)..( 7): Matrix.001 file - promoters60/1009861
cataaac

SEQ ID NO: 40947 - DNA, 6 bp, Unknown
  misc_feature (1)..( 6): Matrix.001 file - promoters60/1009861
ctcctt

SEQ ID NO: 40948 - DNA, 9 bp, Unknown
  misc_feature (1)..( 9): Matrix.001 file - promoters60/1009861
tttcaattt

SEQ ID NO: 40949 - DNA, 7 bp, Unknown
  misc_feature (1)..( 7): Matrix.001 file - promoters60/1009861
tttctct

SEQ ID NO: 40950 - DNA, 6 bp, Unknown
  misc_feature (1)..( 6): Matrix.001 file - promoters60/1009861
taacat

SEQ ID NO: 40951 - DNA, 6 bp, Unknown
  misc_feature (1)..( 6): Matrix.001 file - promoters60/1009861
ttttta

SEQ ID NO: 40952 - DNA, 6 bp, Unknown
  misc_feature (1)..( 6): Matrix.001 file - promoters60/1009861
ataata

SEQ ID NO: 40953 - DNA, 8 bp, Unknown
  misc_feature (1)..( 8): Matrix.001 file - promoters60/1009861
catatata

SEQ ID NO: 40954 - DNA, 9 bp, Unknown
  misc_feature (1)..( 9): Matrix.001 file - promoters60/1009930
tcatatctg

SEQ ID NO: 40955 - DNA, 8 bp, Unknown
  misc_feature (1)..( 8): Matrix.001 file - promoters60/1009930
tttaaatt

SEQ ID NO: 40956 - DNA, 9 bp, Unknown
  misc_feature (1)..( 9): Matrix.001 file - promoters60/1009930
aatttattt

SEQ ID NO: 40957 - DNA, 9 bp, Unknown
  misc_feature (1)..( 9): Matrix.001 file - promoters60/1009930
ttacattag

SEQ ID NO: 40958 - DNA, 8 bp, Unknown
  misc_feature (1)..( 8): Matrix.001 file - promoters60/1009930
ttatgatc

SEQ ID NO: 40959 - DNA, 7 bp, Unknown
  misc_feature (1)..( 7): Matrix.001 file - promoters60/1009930
aaacact

SEQ ID NO: 40960 - DNA, 6 bp, Unknown
  misc_feature (1)..( 6): Matrix.001 file - promoters60/1009930
caaata

SEQ ID NO: 40961 - DNA, 9 bp, Unknown
  misc_feature (1)..( 9): Matrix.001 file - promoters60/1009941
tcttcttta

SEQ ID NO: 40962 - DNA, 13 bp, Unknown
  misc_feature (1)..( 13): Matrix.001 file - promoters60/1009941
caaagtatatata

SEQ ID NO: 40963 - DNA, 8 bp, Unknown
  misc_feature (1)..( 8): Matrix.001 file - promoters60/1009941
tagtatat

SEQ ID NO: 40964 - DNA, 8 bp, Unknown
  misc_feature (1)..( 8): Matrix.001 file - promoters60/1009941
agttttct

SEQ ID NO: 40965 - DNA, 12 bp, Unknown
  misc_feature (1)..( 12): Matrix.001 file - promoters60/1009941
aaaaattaataa

SEQ ID NO: 40966 - DNA, 13 bp, Unknown
  misc_feature (1)..( 13): Matrix.001 file - promoters60/1009941
aaaagattattga

SEQ ID NO: 40967 - DNA, 6 bp, Unknown
  misc_feature (1)..( 6): Matrix.001 file - promoters60/1009999
ttgttt

SEQ ID NO: 40968 - DNA, 6 bp, Unknown
  misc_feature (1)..( 6): Matrix.001 file - promoters60/1009999
tatttt

SEQ ID NO: 40969 - DNA, 7 bp, Unknown
  misc_feature (1)..( 7): Matrix.001 file - promoters60/1009999
tttactt

SEQ ID NO: 40970 - DNA, 6 bp, Unknown
  misc_feature (1)..( 6): Matrix.001 file - promoters60/1009999
aaaaga

SEQ ID NO: 40971 - DNA, 6 bp, Unknown
  misc_feature (1)..( 6): Matrix.001 file - promoters60/1009999
aataaa

SEQ ID NO: 40972 - DNA, 7 bp, Unknown
  misc_feature (1)..( 7): Matrix.001 file - promoters60/1009999
ttcctcc

SEQ ID NO: 40973 - DNA, 10 bp, Unknown
  misc_feature (1)..( 10): Matrix.001 file - promoters60/1009999
gtaaaaattt

SEQ ID NO: 40974 - DNA, 7 bp, Unknown
  misc_feature (1)..( 7): Matrix.001 file - promoters60/1009999
ttgctca

SEQ ID NO: 40975 - DNA, 7 bp, Unknown
  misc_feature (1)..( 7): Matrix.001 file - promoters60/1009999
ccactaa

SEQ ID NO: 40976 - DNA, 6 bp, Unknown
  misc_feature (1)..( 6): Matrix.001 file - promoters60/1009999
ataaaa

SEQ ID NO: 40977 - DNA, 8 bp, Unknown
  misc_feature (1)..( 8): Matrix.001 file - promoters60/1009999
tttatttt

SEQ ID NO: 40978 - DNA, 6 bp, Unknown
  misc_feature (1)..( 6): Matrix.001 file - promoters60/1009999
tttact

SEQ ID NO: 40979 - DNA, 9 bp, Unknown
  misc_feature (1)..( 9): Matrix.001 file - promoters60/1009999
cttagtttt

SEQ ID NO: 40980 - DNA, 8 bp, Unknown
  misc_feature (1)..( 8): Matrix.001 file - promoters60/1009999
tttgtttg

SEQ ID NO: 40981 - DNA, 6 bp, Unknown
  misc_feature (1)..( 6): Matrix.001 file - promoters60/1009999
aagttt

SEQ ID NO: 40982 - DNA, 10 bp, Unknown
  misc_feature (1)..( 10): Matrix.001 file - promoters60/1009999
caaactaatt

SEQ ID NO: 40983 - DNA, 7 bp, Unknown
  misc_feature (1)..( 7): Matrix.001 file - promoters60/1009999
attagaa

SEQ ID NO: 40984 - DNA, 8 bp, Unknown
  misc_feature (1)..( 8): Matrix.001 file - promoters60/1009999
aacaaaat

SEQ ID NO: 40985 - DNA, 7 bp, Unknown
  misc_feature (1)..( 7): Matrix.001 file - promoters60/1010019
caaaaac

SEQ ID NO: 40986 - DNA, 9 bp, Unknown
  misc_feature (1)..( 9): Matrix.001 file - promoters60/1010025
agattttct

SEQ ID NO: 40987 - DNA, 6 bp, Unknown
  misc_feature (1)..( 6): Matrix.001 file - promoters60/1010025
aaaaac

SEQ ID NO: 40988 - DNA, 9 bp, Unknown
  misc_feature (1)..( 9): Matrix.001 file - promoters60/1010025
tgaaaaaaa

SEQ ID NO: 40989 - DNA, 11 bp, Unknown
  misc_feature (1)..( 11): Matrix.001 file - promoters60/1010025
atttatttgtg

SEQ ID NO: 40990 - DNA, 8 bp, Unknown
  misc_feature (1)..( 8): Matrix.001 file - promoters60/1010025
atgtacta

SEQ ID NO: 40991 - DNA, 9 bp, Unknown
  misc_feature (1)..( 9): Matrix.001 file - promoters60/1010025
aaaatttgt

SEQ ID NO: 40992 - DNA, 10 bp, Unknown
  misc_feature (1)..( 10): Matrix.001 file - promoters60/1010055
tgtaaaaaaa

SEQ ID NO: 40993 - DNA, 13 bp, Unknown
  misc_feature (1)..( 13): Matrix.001 file - promoters60/1010055
atataattatttt

SEQ ID NO: 40994 - DNA, 9 bp, Unknown
  misc_feature (1)..( 9): Matrix.001 file - promoters60/1010055
aatgaaaat

SEQ ID NO: 40995 - DNA, 10 bp, Unknown
  misc_feature (1)..( 10): Matrix.001 file - promoters60/1010055
aagaaaaaat

SEQ ID NO: 40996 - DNA, 8 bp, Unknown
  misc_feature (1)..( 8): Matrix.001 file - promoters60/1010055
atttattt

SEQ ID NO: 40997 - DNA, 8 bp, Unknown
  misc_feature (1)..( 8): Matrix.001 file - promoters60/1010065
tatacata

SEQ ID NO: 40998 - DNA, 9 bp, Unknown
  misc_feature (1)..( 9): Matrix.001 file - promoters60/1010065
tcgaaatag

SEQ ID NO: 40999 - DNA, 9 bp, Unknown
  misc_feature (1)..( 9): Matrix.001 file - promoters60/1010065
gcgcaatta

SEQ ID NO: 41000 - DNA, 6 bp, Unknown
  misc_feature (1)..( 6): Matrix.001 file - promoters60/1010065
taaaca

SEQ ID NO: 41001 - DNA, 8 bp, Unknown
  misc_feature (1)..( 8): Matrix.001 file - promoters60/1010065
attattta

SEQ ID NO: 41002 - DNA, 6 bp, Unknown
  misc_feature (1)..( 6): Matrix.001 file - promoters60/1010065
tttctc

SEQ ID NO: 41003 - DNA, 6 bp, Unknown
  misc_feature (1)..( 6): Matrix.001 file - promoters60/1010065
aatttt

SEQ ID NO: 41004 - DNA, 7 bp, Unknown
  misc_feature (1)..( 7): Matrix.001 file - promoters60/1010065
atacata

SEQ ID NO: 41005 - DNA, 8 bp, Unknown
  misc_feature (1)..( 8): Matrix.001 file - promoters60/1010065
acatacat

SEQ ID NO: 41006 - DNA, 7 bp, Unknown
  misc_feature (1)..( 7): Matrix.001 file - promoters60/1010065
atactag

SEQ ID NO: 41007 - DNA, 7 bp, Unknown
  misc_feature (1)..( 7): Matrix.001 file - promoters60/1010065
catctat

SEQ ID NO: 41008 - DNA, 7 bp, Unknown
  misc_feature (1)..( 7): Matrix.001 file - promoters60/1010065
acatttc

SEQ ID NO: 41009 - DNA, 7 bp, Unknown
  misc_feature (1)..( 7): Matrix.001 file - promoters60/1010065
tcacata

SEQ ID NO: 41010 - DNA, 6 bp, Unknown
  misc_feature (1)..( 6): Matrix.001 file - promoters60/1010065
atttat

SEQ ID NO: 41011 - DNA, 6 bp, Unknown
  misc_feature (1)..( 6): Matrix.001 file - promoters60/1010065
taataa

SEQ ID NO: 41012 - DNA, 6 bp, Unknown
  misc_feature (1)..( 6): Matrix.001 file - promoters60/1010065
tcgatc

SEQ ID NO: 41013 - DNA, 6 bp, Unknown
  misc_feature (1)..( 6): Matrix.001 file - promoters60/1010065
tagatt

SEQ ID NO: 41014 - DNA, 6 bp, Unknown
  misc_feature (1)..( 6): Matrix.001 file - promoters60/1010115
ttgttt

SEQ ID NO: 41015 - DNA, 9 bp, Unknown
  misc_feature (1)..( 9): Matrix.001 file - promoters60/1010115
ttgataatt

SEQ ID NO: 41016 - DNA, 6 bp, Unknown
  misc_feature (1)..( 6): Matrix.001 file - promoters60/1010140
atagaa

SEQ ID NO: 41017 - DNA, 7 bp, Unknown
  misc_feature (1)..( 7): Matrix.001 file - promoters60/1010140
aacaaca

SEQ ID NO: 41018 - DNA, 6 bp, Unknown
  misc_feature (1)..( 6): Matrix.001 file - promoters60/1010140
ttgaat

SEQ ID NO: 41019 - DNA, 6 bp, Unknown
  misc_feature (1)..( 6): Matrix.001 file - promoters60/1010140
acaaag

SEQ ID NO: 41020 - DNA, 7 bp, Unknown
  misc_feature (1)..( 7): Matrix.001 file - promoters60/1010140
ctgattc

SEQ ID NO: 41021 - DNA, 9 bp, Unknown
  misc_feature (1)..( 9): Matrix.001 file - promoters60/1010140
ttttttttt

SEQ ID NO: 41022 - DNA, 9 bp, Unknown
  misc_feature (1)..( 9): Matrix.001 file - promoters60/1010140
gaagaaaat

SEQ ID NO: 41023 - DNA, 8 bp, Unknown
  misc_feature (1)..( 8): Matrix.001 file - promoters60/1010140
aaaagttt

SEQ ID NO: 41024 - DNA, 8 bp, Unknown
  misc_feature (1)..( 8): Matrix.001 file - promoters60/1010140
attgaaca

SEQ ID NO: 41025 - DNA, 6 bp, Unknown
  misc_feature (1)..( 6): Matrix.001 file - promoters60/1010140
accaac

SEQ ID NO: 41026 - DNA, 6 bp, Unknown
  misc_feature (1)..( 6): Matrix.001 file - promoters60/1010140
ataatc

SEQ ID NO: 41027 - DNA, 6 bp, Unknown
  misc_feature (1)..( 6): Matrix.001 file - promoters60/1010140
actaac

SEQ ID NO: 41028 - DNA, 8 bp, Unknown
  misc_feature (1)..( 8): Matrix.001 file - promoters60/1010140
ataactct

SEQ ID NO: 41029 - DNA, 7 bp, Unknown
  misc_feature (1)..( 7): Matrix.001 file - promoters60/1010140
aaacaca

SEQ ID NO: 41030 - DNA, 10 bp, Unknown
  misc_feature (1)..( 10): Matrix.001 file - promoters60/1010140
aatgaacata

SEQ ID NO: 41031 - DNA, 6 bp, Unknown
  misc_feature (1)..( 6): Matrix.001 file - promoters60/1010140
atataa

SEQ ID NO: 41032 - DNA, 8 bp, Unknown
  misc_feature (1)..( 8): Matrix.001 file - promoters60/1010140
agtattaa

SEQ ID NO: 41033 - DNA, 6 bp, Unknown
  misc_feature (1)..( 6): Matrix.001 file - promoters60/1010140
tcatta

SEQ ID NO: 41034 - DNA, 8 bp, Unknown
  misc_feature (1)..( 8): Matrix.001 file - promoters60/1010140
tttcaaat

SEQ ID NO: 41035 - DNA, 8 bp, Unknown
  misc_feature (1)..( 8): Matrix.001 file - promoters60/1010140
gttatttt

SEQ ID NO: 41036 - DNA, 7 bp, Unknown
  misc_feature (1)..( 7): Matrix.001 file - promoters60/1010140
actcaat

SEQ ID NO: 41037 - DNA, 8 bp, Unknown
  misc_feature (1)..( 8): Matrix.001 file - promoters60/1010140
tttataaa

SEQ ID NO: 41038 - DNA, 9 bp, Unknown
  misc_feature (1)..( 9): Matrix.001 file - promoters60/1010209
acacacatg

SEQ ID NO: 41039 - DNA, 13 bp, Unknown
  misc_feature (1)..( 13): Matrix.001 file - promoters60/1010209
aaacaaatttatt

SEQ ID NO: 41040 - DNA, 8 bp, Unknown
  misc_feature (1)..( 8): Matrix.001 file - promoters60/1010346
atttttac

SEQ ID NO: 41041 - DNA, 8 bp, Unknown
  misc_feature (1)..( 8): Matrix.001 file - promoters60/1010346
tttgccag

SEQ ID NO: 41042 - DNA, 10 bp, Unknown
  misc_feature (1)..( 10): Matrix.001 file - promoters60/1010346
tataaaaaat

SEQ ID NO: 41043 - DNA, 7 bp, Unknown
  misc_feature (1)..( 7): Matrix.001 file - promoters60/1010346
tataaaa

SEQ ID NO: 41044 - DNA, 7 bp, Unknown
  misc_feature (1)..( 7): Matrix.001 file - promoters60/1010346
ccaaatt

SEQ ID NO: 41045 - DNA, 8 bp, Unknown
  misc_feature (1)..( 8): Matrix.001 file - promoters60/1010346
tattttaa

SEQ ID NO: 41046 - DNA, 9 bp, Unknown
  misc_feature (1)..( 9): Matrix.001 file - promoters60/1010346
attgaattt

SEQ ID NO: 41047 - DNA, 7 bp, Unknown
  misc_feature (1)..( 7): Matrix.001 file - promoters60/1010367
aaaattt

SEQ ID NO: 41048 - DNA, 9 bp, Unknown
  misc_feature (1)..( 9): Matrix.001 file - promoters60/1010367
aaaacaaat

SEQ ID NO: 41049 - DNA, 12 bp, Unknown
  misc_feature (1)..( 12): Matrix.001 file - promoters60/1010367
tatttgaataaa

SEQ ID NO: 41050 - DNA, 11 bp, Unknown
  misc_feature (1)..( 11): Matrix.001 file - promoters60/1010367
aaatacaaaaa

SEQ ID NO: 41051 - DNA, 11 bp, Unknown
  misc_feature (1)..( 11): Matrix.001 file - promoters60/1010367
aaaatgaatta

SEQ ID NO: 41052 - DNA, 8 bp, Unknown
  misc_feature (1)..( 8): Matrix.001 file - promoters60/1010367
tatatata

SEQ ID NO: 41053 - DNA, 10 bp, Unknown
  misc_feature (1)..( 10): Matrix.001 file - promoters60/1010367
ttttattttc

SEQ ID NO: 41054 - DNA, 7 bp, Unknown
  misc_feature (1)..( 7): Matrix.001 file - promoters60/1010367
aaaaatt

SEQ ID NO: 41055 - DNA, 8 bp, Unknown
  misc_feature (1)..( 8): Matrix.001 file - promoters60/1010373
cttttttt

SEQ ID NO: 41056 - DNA, 10 bp, Unknown
  misc_feature (1)..( 10): Matrix.001 file - promoters60/1010373
ataatttaca

SEQ ID NO: 41057 - DNA, 9 bp, Unknown
  misc_feature (1)..( 9): Matrix.001 file - promoters60/1010373
cttctttaa

SEQ ID NO: 41058 - DNA, 9 bp, Unknown
  misc_feature (1)..( 9): Matrix.001 file - promoters60/1010373
attttataa

SEQ ID NO: 41059 - DNA, 9 bp, Unknown
  misc_feature (1)..( 9): Matrix.001 file - promoters60/1010385
ctgaagttt

SEQ ID NO: 41060 - DNA, 16 bp, Unknown
  misc_feature (1)..( 16): Matrix.001 file - promoters60/1010385
aaataggcccattata

SEQ ID NO: 41061 - DNA, 8 bp, Unknown
  misc_feature (1)..( 8): Matrix.001 file - promoters60/1010411
aataattg

SEQ ID NO: 41062 - DNA, 9 bp, Unknown
  misc_feature (1)..( 9): Matrix.001 file - promoters60/1010411
tatgtttgc

SEQ ID NO: 41063 - DNA, 10 bp, Unknown
  misc_feature (1)..( 10): Matrix.001 file - promoters60/1010411
gtaattgatg

SEQ ID NO: 41064 - DNA, 8 bp, Unknown
  misc_feature (1)..( 8): Matrix.001 file - promoters60/1010411
aaagtgaa

SEQ ID NO: 41065 - DNA, 14 bp, Unknown
  misc_feature (1)..( 14): Matrix.001 file - promoters60/1010411
ttaataattttttt

SEQ ID NO: 41066 - DNA, 8 bp, Unknown
  misc_feature (1)..( 8): Matrix.001 file - promoters60/1010411
attactaa

SEQ ID NO: 41067 - DNA, 6 bp, Unknown
  misc_feature (1)..( 6): Matrix.001 file - promoters60/1010411
tatttt

SEQ ID NO: 41068 - DNA, 11 bp, Unknown
  misc_feature (1)..( 11): Matrix.001 file - promoters60/1010418
ccagaagagaa

SEQ ID NO: 41069 - DNA, 8 bp, Unknown
  misc_feature (1)..( 8): Matrix.001 file - promoters60/1010418
ggaaagaa

SEQ ID NO: 41070 - DNA, 7 bp, Unknown
  misc_feature (1)..( 7): Matrix.001 file - promoters60/1010418
tagtgat

SEQ ID NO: 41071 - DNA, 8 bp, Unknown
  misc_feature (1)..( 8): Matrix.001 file - promoters60/1010418
ggcctaat

SEQ ID NO: 41072 - DNA, 6 bp, Unknown
  misc_feature (1)..( 6): Matrix.001 file - promoters60/1010421
tgtggt

SEQ ID NO: 41073 - DNA, 11 bp, Unknown
  misc_feature (1)..( 11): Matrix.001 file - promoters60/1010421
cttaaataaat

SEQ ID NO: 41074 - DNA, 6 bp, Unknown
  misc_feature (1)..( 6): Matrix.001 file - promoters60/1010421
caagat

SEQ ID NO: 41075 - DNA, 7 bp, Unknown
  misc_feature (1)..( 7): Matrix.001 file - promoters60/1010421
aatattt

SEQ ID NO: 41076 - DNA, 9 bp, Unknown
  misc_feature (1)..( 9): Matrix.001 file - promoters60/1010421
ataacaaaa

SEQ ID NO: 41077 - DNA, 7 bp, Unknown
  misc_feature (1)..( 7): Matrix.001 file - promoters60/1010421
ccaaaaa

SEQ ID NO: 41078 - DNA, 13 bp, Unknown
  misc_feature (1)..( 13): Matrix.001 file - promoters60/1010421
aataacgtggtcc

SEQ ID NO: 41079 - DNA, 7 bp, Unknown
  misc_feature (1)..( 7): Matrix.001 file - promoters60/1010421
attcaaa

SEQ ID NO: 41080 - DNA, 8 bp, Unknown
  misc_feature (1)..( 8): Matrix.001 file - promoters60/1010421
tgataatc

SEQ ID NO: 41081 - DNA, 6 bp, Unknown
  misc_feature (1)..( 6): Matrix.001 file - promoters60/1010421
atatat

SEQ ID NO: 41082 - DNA, 7 bp, Unknown
  misc_feature (1)..( 7): Matrix.001 file - promoters60/1010421
ttacttt

SEQ ID NO: 41083 - DNA, 6 bp, Unknown
  misc_feature (1)..( 6): Matrix.001 file - promoters60/1010421
atttta

SEQ ID NO: 41084 - DNA, 7 bp, Unknown
  misc_feature (1)..( 7): Matrix.001 file - promoters60/1010421
atatata

SEQ ID NO: 41085 - DNA, 7 bp, Unknown
  misc_feature (1)..( 7): Matrix.001 file - promoters60/1010421
attattt

SEQ ID NO: 41086 - DNA, 7 bp, Unknown
  misc_feature (1)..( 7): Matrix.001 file - promoters60/1010421
tatgtat

SEQ ID NO: 41087 - DNA, 7 bp, Unknown
  misc_feature (1)..( 7): Matrix.001 file - promoters60/1010421
attaata

SEQ ID NO: 41088 - DNA, 7 bp, Unknown
  misc_feature (1)..( 7): Matrix.001 file - promoters60/1010421
aaggatg

SEQ ID NO: 41089 - DNA, 6 bp, Unknown
  misc_feature (1)..( 6): Matrix.001 file - promoters60/1010421
ccaact

SEQ ID NO: 41090 - DNA, 7 bp, Unknown
  misc_feature (1)..( 7): Matrix.001 file - promoters60/1010421
tataatt

SEQ ID NO: 41091 - DNA, 8 bp, Unknown
  misc_feature (1)..( 8): Matrix.001 file - promoters60/1010425
gaaaaaca

SEQ ID NO: 41092 - DNA, 8 bp, Unknown
  misc_feature (1)..( 8): Matrix.001 file - promoters60/1010425
aaattagg

SEQ ID NO: 41093 - DNA, 8 bp, Unknown
  misc_feature (1)..( 8): Matrix.001 file - promoters60/1010425
aaaaaccc

SEQ ID NO: 41094 - DNA, 10 bp, Unknown
  misc_feature (1)..( 10): Matrix.001 file - promoters60/1010429
gaaaaaataa

SEQ ID NO: 41095 - DNA, 9 bp, Unknown
  misc_feature (1)..( 9): Matrix.001 file - promoters60/1010429
aaataaaaa

SEQ ID NO: 41096 - DNA, 8 bp, Unknown
  misc_feature (1)..( 8): Matrix.001 file - promoters60/1010429
tttgttta

SEQ ID NO: 41097 - DNA, 11 bp, Unknown
  misc_feature (1)..( 11): Matrix.001 file - promoters60/1010429
ccaatatgttc

SEQ ID NO: 41098 - DNA, 11 bp, Unknown
  misc_feature (1)..( 11): Matrix.001 file - promoters60/1010429
aatatgtgttc

SEQ ID NO: 41099 - DNA, 10 bp, Unknown
  misc_feature (1)..( 10): Matrix.001 file - promoters60/1010429
ctatataaat

SEQ ID NO: 41100 - DNA, 9 bp, Unknown
  misc_feature (1)..( 9): Matrix.001 file - promoters60/1010431
gacacgtgg

SEQ ID NO: 41101 - DNA, 8 bp, Unknown
  misc_feature (1)..( 8): Matrix.001 file - promoters60/1010435
tcttcttc

SEQ ID NO: 41102 - DNA, 10 bp, Unknown
  misc_feature (1)..( 10): Matrix.001 file - promoters60/1010435
attatcaaag

SEQ ID NO: 41103 - DNA, 10 bp, Unknown
  misc_feature (1)..( 10): Matrix.001 file - promoters60/1010435
aatctgaatc

SEQ ID NO: 41104 - DNA, 9 bp, Unknown
  misc_feature (1)..( 9): Matrix.001 file - promoters60/1010449
attgtattt

SEQ ID NO: 41105 - DNA, 8 bp, Unknown
  misc_feature (1)..( 8): Matrix.001 file - promoters60/1010449
cacaataa

SEQ ID NO: 41106 - DNA, 11 bp, Unknown
  misc_feature (1)..( 11): Matrix.001 file - promoters60/1010491
tataaagaaaa

SEQ ID NO: 41107 - DNA, 7 bp, Unknown
  misc_feature (1)..( 7): Matrix.001 file - promoters60/1010524
taaaata

SEQ ID NO: 41108 - DNA, 6 bp, Unknown
  misc_feature (1)..( 6): Matrix.001 file - promoters60/1010524
atcaaa

SEQ ID NO: 41109 - DNA, 7 bp, Unknown
  misc_feature (1)..( 7): Matrix.001 file - promoters60/1010524
aacaaat

SEQ ID NO: 41110 - DNA, 10 bp, Unknown
  misc_feature (1)..( 10): Matrix.001 file - promoters60/1010524
tattttgaaa

SEQ ID NO: 41111 - DNA, 10 bp, Unknown
  misc_feature (1)..( 10): Matrix.001 file - promoters60/1010524
gaatattttt

SEQ ID NO: 41112 - DNA, 7 bp, Unknown
  misc_feature (1)..( 7): Matrix.001 file - promoters60/1010524
attattt

SEQ ID NO: 41113 - DNA, 6 bp, Unknown
  misc_feature (1)..( 6): Matrix.001 file - promoters60/1010524
atttgg

SEQ ID NO: 41114 - DNA, 6 bp, Unknown
  misc_feature (1)..( 6): Matrix.001 file - promoters60/1010524
tttggt

SEQ ID NO: 41115 - DNA, 8 bp, Unknown
  misc_feature (1)..( 8): Matrix.001 file - promoters60/1010524
aaaacccc

SEQ ID NO: 41116 - DNA, 6 bp, Unknown
  misc_feature (1)..( 6): Matrix.001 file - promoters60/1010524
actttt

SEQ ID NO: 41117 - DNA, 6 bp, Unknown
  misc_feature (1)..( 6): Matrix.001 file - promoters60/1010524
atcaaa

SEQ ID NO: 41118 - DNA, 9 bp, Unknown
  misc_feature (1)..( 9): Matrix.001 file - promoters60/1010524
acaaacgtt

SEQ ID NO: 41119 - DNA, 8 bp, Unknown
  misc_feature (1)..( 8): Matrix.001 file - promoters60/1010524
cgtagcta

SEQ ID NO: 41120 - DNA, 7 bp, Unknown
  misc_feature (1)..( 7): Matrix.001 file - promoters60/1010524
tccattt

SEQ ID NO: 41121 - DNA, 8 bp, Unknown
  misc_feature (1)..( 8): Matrix.001 file - promoters60/1010524
atattttg

SEQ ID NO: 41122 - DNA, 6 bp, Unknown
  misc_feature (1)..( 6): Matrix.001 file - promoters60/1010524
ttttac

SEQ ID NO: 41123 - DNA, 12 bp, Unknown
  misc_feature (1)..( 12): Matrix.001 file - promoters60/1010524
tacatattatat

SEQ ID NO: 41124 - DNA, 7 bp, Unknown
  misc_feature (1)..( 7): Matrix.001 file - promoters60/1010524
ttcgttt

SEQ ID NO: 41125 - DNA, 6 bp, Unknown
  misc_feature (1)..( 6): Matrix.001 file - promoters60/1010524
tacttg

SEQ ID NO: 41126 - DNA, 6 bp, Unknown
  misc_feature (1)..( 6): Matrix.001 file - promoters60/1010524
gaaaag

SEQ ID NO: 41127 - DNA, 8 bp, Unknown
  misc_feature (1)..( 8): Matrix.001 file - promoters60/1010536
gtgtctga

SEQ ID NO: 41128 - DNA, 7 bp, Unknown
  misc_feature (1)..( 7): Matrix.001 file - promoters60/1010536
tccaaaa

SEQ ID NO: 41129 - DNA, 6 bp, Unknown
  misc_feature (1)..( 6): Matrix.001 file - promoters60/1010536
ctccat

SEQ ID NO: 41130 - DNA, 6 bp, Unknown
  misc_feature (1)..( 6): Matrix.001 file - promoters60/1010536
tagaga

SEQ ID NO: 41131 - DNA, 8 bp, Unknown
  misc_feature (1)..( 8): Matrix.001 file - promoters60/1010536
ggcaaaac

SEQ ID NO: 41132 - DNA, 6 bp, Unknown
  misc_feature (1)..( 6): Matrix.001 file - promoters60/1010536
aatctc

SEQ ID NO: 41133 - DNA, 8 bp, Unknown
  misc_feature (1)..( 8): Matrix.001 file - promoters60/1010536
tttaatta

SEQ ID NO: 41134 - DNA, 7 bp, Unknown
  misc_feature (1)..( 7): Matrix.001 file - promoters60/1010536
taacatt

SEQ ID NO: 41135 - DNA, 6 bp, Unknown
  misc_feature (1)..( 6): Matrix.001 file - promoters60/1010536
aaaata

SEQ ID NO: 41136 - DNA, 7 bp, Unknown
  misc_feature (1)..( 7): Matrix.001 file - promoters60/1010536
caaattt

SEQ ID NO: 41137 - DNA, 6 bp, Unknown
  misc_feature (1)..( 6): Matrix.001 file - promoters60/1010536
aaaata

SEQ ID NO: 41138 - DNA, 7 bp, Unknown
  misc_feature (1)..( 7): Matrix.001 file - promoters60/1010536
tatgtaa

SEQ ID NO: 41139 - DNA, 8 bp, Unknown
  misc_feature (1)..( 8): Matrix.001 file - promoters60/1010536
aataatta

SEQ ID NO: 41140 - DNA, 7 bp, Unknown
  misc_feature (1)..( 7): Matrix.001 file - promoters60/1010536
attcaat

SEQ ID NO: 41141 - DNA, 6 bp, Unknown
  misc_feature (1)..( 6): Matrix.001 file - promoters60/1010536
ttaata

SEQ ID NO: 41142 - DNA, 6 bp, Unknown
  misc_feature (1)..( 6): Matrix.001 file - promoters60/1010536
aaatag

SEQ ID NO: 41143 - DNA, 8 bp, Unknown
  misc_feature (1)..( 8): Matrix.001 file - promoters60/1010536
ttaatttt

SEQ ID NO: 41144 - DNA, 6 bp, Unknown
  misc_feature (1)..( 6): Matrix.001 file - promoters60/1010536
gacaaa

SEQ ID NO: 41145 - DNA, 6 bp, Unknown
  misc_feature (1)..( 6): Matrix.001 file - promoters60/1010536
aaaaaa

SEQ ID NO: 41146 - DNA, 9 bp, Unknown
  misc_feature (1)..( 9): Matrix.001 file - promoters60/1010536
agtactctt

SEQ ID NO: 41147 - DNA, 6 bp, Unknown
  misc_feature (1)..( 6): Matrix.001 file - promoters60/1010536
aaagat

SEQ ID NO: 41148 - DNA, 9 bp, Unknown
  misc_feature (1)..( 9): Matrix.001 file - promoters60/1010536
ttaataatt

SEQ ID NO: 41149 - DNA, 6 bp, Unknown
  misc_feature (1)..( 6): Matrix.001 file - promoters60/1010536
ttttaa

SEQ ID NO: 41150 - DNA, 6 bp, Unknown
  misc_feature (1)..( 6): Matrix.001 file - promoters60/1010536
gaaaat

SEQ ID NO: 41151 - DNA, 7 bp, Unknown
  misc_feature (1)..( 7): Matrix.001 file - promoters60/1010562
aaataaa

SEQ ID NO: 41152 - DNA, 6 bp, Unknown
  misc_feature (1)..( 6): Matrix.001 file - promoters60/1010562
aattag

SEQ ID NO: 41153 - DNA, 8 bp, Unknown
  misc_feature (1)..( 8): Matrix.001 file - promoters60/1010562
tatctttc

SEQ ID NO: 41154 - DNA, 7 bp, Unknown
  misc_feature (1)..( 7): Matrix.001 file - promoters60/1010562
aaagatg

SEQ ID NO: 41155 - DNA, 7 bp, Unknown
  misc_feature (1)..( 7): Matrix.001 file - promoters60/1010562
caagtga

SEQ ID NO: 41156 - DNA, 6 bp, Unknown
  misc_feature (1)..( 6): Matrix.001 file - promoters60/1010562
aatcat

SEQ ID NO: 41157 - DNA, 6 bp, Unknown
  misc_feature (1)..( 6): Matrix.001 file - promoters60/1010562
cattat

SEQ ID NO: 41158 - DNA, 7 bp, Unknown
  misc_feature (1)..( 7): Matrix.001 file - promoters60/1010562
tcagatc

SEQ ID NO: 41159 - DNA, 7 bp, Unknown
  misc_feature (1)..( 7): Matrix.001 file - promoters60/1010562
caaaatc

SEQ ID NO: 41160 - DNA, 9 bp, Unknown
  misc_feature (1)..( 9): Matrix.001 file - promoters60/1010562
ccaagaaat

SEQ ID NO: 41161 - DNA, 8 bp, Unknown
  misc_feature (1)..( 8): Matrix.001 file - promoters60/1010562
tttctttt

SEQ ID NO: 41162 - DNA, 6 bp, Unknown
  misc_feature (1)..( 6): Matrix.001 file - promoters60/1010562
tttgtt

SEQ ID NO: 41163 - DNA, 8 bp, Unknown
  misc_feature (1)..( 8): Matrix.001 file - promoters60/1010562
tattataa

SEQ ID NO: 41164 - DNA, 7 bp, Unknown
  misc_feature (1)..( 7): Matrix.001 file - promoters60/1010562
ctcgcat

SEQ ID NO: 41165 - DNA, 6 bp, Unknown
  misc_feature (1)..( 6): Matrix.001 file - promoters60/1010562
cattct

SEQ ID NO: 41166 - DNA, 7 bp, Unknown
  misc_feature (1)..( 7): Matrix.001 file - promoters60/1010562
tatggat

SEQ ID NO: 41167 - DNA, 9 bp, Unknown
  misc_feature (1)..( 9): Matrix.001 file - promoters60/1010562
ttagtatgg

SEQ ID NO: 41168 - DNA, 7 bp, Unknown
  misc_feature (1)..( 7): Matrix.001 file - promoters60/1010562
tttctac

SEQ ID NO: 41169 - DNA, 8 bp, Unknown
  misc_feature (1)..( 8): Matrix.001 file - promoters60/1010562
ctaaagaa

SEQ ID NO: 41170 - DNA, 6 bp, Unknown
  misc_feature (1)..( 6): Matrix.001 file - promoters60/1010562
cccacc

SEQ ID NO: 41171 - DNA, 11 bp, Unknown
  misc_feature (1)..( 11): Matrix.001 file - promoters60/1010571
ctaaattaata

SEQ ID NO: 41172 - DNA, 8 bp, Unknown
  misc_feature (1)..( 8): Matrix.001 file - promoters60/1010571
aatatata

SEQ ID NO: 41173 - DNA, 8 bp, Unknown
  misc_feature (1)..( 8): Matrix.001 file - promoters60/1010571
tataactt

SEQ ID NO: 41174 - DNA, 10 bp, Unknown
  misc_feature (1)..( 10): Matrix.001 file - promoters60/1010571
ttaccaattg

SEQ ID NO: 41175 - DNA, 6 bp, Unknown
  misc_feature (1)..( 6): Matrix.001 file - promoters60/1010571
aaatat

SEQ ID NO: 41176 - DNA, 6 bp, Unknown
  misc_feature (1)..( 6): Matrix.001 file - promoters60/1010571
ataatt

SEQ ID NO: 41177 - DNA, 15 bp, Unknown
  misc_feature (1)..( 15): Matrix.001 file - promoters60/1010571
aaggatgatggacca

SEQ ID NO: 41178 - DNA, 15 bp, Unknown
  misc_feature (1)..( 15): Matrix.001 file - promoters60/1010571
tacacattaataacg

SEQ ID NO: 41179 - DNA, 29 bp, Unknown
  misc_feature (1)..( 29): Matrix.001 file - promoters60/1010571
tttaccaaataaagaaaatacatttctat

SEQ ID NO: 41180 - DNA, 6 bp, Unknown
  misc_feature (1)..( 6): Matrix.001 file - promoters60/1010571
tggttt

SEQ ID NO: 41181 - DNA, 6 bp, Unknown
  misc_feature (1)..( 6): Matrix.001 file - promoters60/1010571
caaaac

SEQ ID NO: 41182 - DNA, 11 bp, Unknown
  misc_feature (1)..( 11): Matrix.001 file - promoters60/1010571
attctcttatt

SEQ ID NO: 41183 - DNA, 6 bp, Unknown
  misc_feature (1)..( 6): Matrix.001 file - promoters60/1010571
tgtttt

SEQ ID NO: 41184 - DNA, 7 bp, Unknown
  misc_feature (1)..( 7): Matrix.001 file - promoters60/1010571
caaaaaa

SEQ ID NO: 41185 - DNA, 7 bp, Unknown
  misc_feature (1)..( 7): Matrix.001 file - promoters60/1010571
aatgttt

SEQ ID NO: 41186 - DNA, 6 bp, Unknown
  misc_feature (1)..( 6): Matrix.001 file - promoters60/1010571
ttttat

SEQ ID NO: 41187 - DNA, 8 bp, Unknown
  misc_feature (1)..( 8): Matrix.001 file - promoters60/1010636
gcttggat

SEQ ID NO: 41188 - DNA, 8 bp, Unknown
  misc_feature (1)..( 8): Matrix.001 file - promoters60/1010636
cgaaagtt

SEQ ID NO: 41189 - DNA, 10 bp, Unknown
  misc_feature (1)..( 10): Matrix.001 file - promoters60/1010636
tttaaaccct

SEQ ID NO: 41190 - DNA, 8 bp, Unknown
  misc_feature (1)..( 8): Matrix.001 file - promoters60/1010636
gtggcatt

SEQ ID NO: 41191 - DNA, 7 bp, Unknown
  misc_feature (1)..( 7): Matrix.001 file - promoters60/1010636
ttttcta

SEQ ID NO: 41192 - DNA, 6 bp, Unknown
  misc_feature (1)..( 6): Matrix.001 file - promoters60/1010693
taattc

SEQ ID NO: 41193 - DNA, 9 bp, Unknown
  misc_feature (1)..( 9): Matrix.001 file - promoters60/1010693
gaagctttt

SEQ ID NO: 41194 - DNA, 6 bp, Unknown
  misc_feature (1)..( 6): Matrix.001 file - promoters60/1010693
ttttaa

SEQ ID NO: 41195 - DNA, 7 bp, Unknown
  misc_feature (1)..( 7): Matrix.001 file - promoters60/1010693
aatcaat

SEQ ID NO: 41196 - DNA, 8 bp, Unknown
  misc_feature (1)..( 8): Matrix.001 file - promoters60/1010693
ttaaatat

SEQ ID NO: 41197 - DNA, 6 bp, Unknown
  misc_feature (1)..( 6): Matrix.001 file - promoters60/1010693
ataaaa

SEQ ID NO: 41198 - DNA, 7 bp, Unknown
  misc_feature (1)..( 7): Matrix.001 file - promoters60/1010693
tttcatt

SEQ ID NO: 41199 - DNA, 7 bp, Unknown
  misc_feature (1)..( 7): Matrix.001 file - promoters60/1010693
agttggt

SEQ ID NO: 41200 - DNA, 7 bp, Unknown
  misc_feature (1)..( 7): Matrix.001 file - promoters60/1010693
agtaaaa

SEQ ID NO: 41201 - DNA, 8 bp, Unknown
  misc_feature (1)..( 8): Matrix.001 file - promoters60/1010693
ataatata

SEQ ID NO: 41202 - DNA, 6 bp, Unknown
  misc_feature (1)..( 6): Matrix.001 file - promoters60/1010693
aacata

SEQ ID NO: 41203 - DNA, 6 bp, Unknown
  misc_feature (1)..( 6): Matrix.001 file - promoters60/1010693
aaaatt

SEQ ID NO: 41204 - DNA, 7 bp, Unknown
  misc_feature (1)..( 7): Matrix.001 file - promoters60/1010693
tttcatt

SEQ ID NO: 41205 - DNA, 8 bp, Unknown
  misc_feature (1)..( 8): Matrix.001 file - promoters60/1010693
caaagtcg

SEQ ID NO: 41206 - DNA, 8 bp, Unknown
  misc_feature (1)..( 8): Matrix.001 file - promoters60/1010693
aaaacttc

SEQ ID NO: 41207 - DNA, 6 bp, Unknown
  misc_feature (1)..( 6): Matrix.001 file - promoters60/1010693
taataa

SEQ ID NO: 41208 - DNA, 7 bp, Unknown
  misc_feature (1)..( 7): Matrix.001 file - promoters60/1010693
aaaagcg

SEQ ID NO: 41209 - DNA, 9 bp, Unknown
  misc_feature (1)..( 9): Matrix.001 file - promoters60/1010693
tcgtaaata

SEQ ID NO: 41210 - DNA, 7 bp, Unknown
  misc_feature (1)..( 7): Matrix.001 file - promoters60/1010693
caaaaac

SEQ ID NO: 41211 - DNA, 6 bp, Unknown
  misc_feature (1)..( 6): Matrix.001 file - promoters60/1010693
atgtta

SEQ ID NO: 41212 - DNA, 9 bp, Unknown
  misc_feature (1)..( 9): Matrix.001 file - promoters60/1010693
aaactaaaa

SEQ ID NO: 41213 - DNA, 7 bp, Unknown
  misc_feature (1)..( 7): Matrix.001 file - promoters60/1010693
tatacaa

SEQ ID NO: 41214 - DNA, 8 bp, Unknown
  misc_feature (1)..( 8): Matrix.001 file - promoters60/1010693
attgtaat

SEQ ID NO: 41215 - DNA, 6 bp, Unknown
  misc_feature (1)..( 6): Matrix.001 file - promoters60/1010710
cggtaa

SEQ ID NO: 41216 - DNA, 7 bp, Unknown
  misc_feature (1)..( 7): Matrix.001 file - promoters60/1010710
tttcttg

SEQ ID NO: 41217 - DNA, 6 bp, Unknown
  misc_feature (1)..( 6): Matrix.001 file - promoters60/1010710
acatat

SEQ ID NO: 41218 - DNA, 7 bp, Unknown
  misc_feature (1)..( 7): Matrix.001 file - promoters60/1010710
tttgttc

SEQ ID NO: 41219 - DNA, 8 bp, Unknown
  misc_feature (1)..( 8): Matrix.001 file - promoters60/1010710
aatcaaaa

SEQ ID NO: 41220 - DNA, 7 bp, Unknown
  misc_feature (1)..( 7): Matrix.001 file - promoters60/1010710
gataaat

SEQ ID NO: 41221 - DNA, 7 bp, Unknown
  misc_feature (1)..( 7): Matrix.001 file - promoters60/1010710
gaacttt

SEQ ID NO: 41222 - DNA, 6 bp, Unknown
  misc_feature (1)..( 6): Matrix.001 file - promoters60/1010710
agtata

SEQ ID NO: 41223 - DNA, 10 bp, Unknown
  misc_feature (1)..( 10): Matrix.001 file - promoters60/1010710
accggttata

SEQ ID NO: 41224 - DNA, 9 bp, Unknown
  misc_feature (1)..( 9): Matrix.001 file - promoters60/1010710
aattatttt

SEQ ID NO: 41225 - DNA, 7 bp, Unknown
  misc_feature (1)..( 7): Matrix.001 file - promoters60/1010710
tttccgg

SEQ ID NO: 41226 - DNA, 7 bp, Unknown
  misc_feature (1)..( 7): Matrix.001 file - promoters60/1010710
gaacagt

SEQ ID NO: 41227 - DNA, 7 bp, Unknown
  misc_feature (1)..( 7): Matrix.001 file - promoters60/1010710
cgacaca

SEQ ID NO: 41228 - DNA, 7 bp, Unknown
  misc_feature (1)..( 7): Matrix.001 file - promoters60/1010710
tttatat

SEQ ID NO: 41229 - DNA, 7 bp, Unknown
  misc_feature (1)..( 7): Matrix.001 file - promoters60/1010710
gatgtga

SEQ ID NO: 41230 - DNA, 6 bp, Unknown
  misc_feature (1)..( 6): Matrix.001 file - promoters60/1010770
ttttaa

SEQ ID NO: 41231 - DNA, 6 bp, Unknown
  misc_feature (1)..( 6): Matrix.001 file - promoters60/1010770
aaaagc

SEQ ID NO: 41232 - DNA, 7 bp, Unknown
  misc_feature (1)..( 7): Matrix.001 file - promoters60/1010770
attattg

SEQ ID NO: 41233 - DNA, 9 bp, Unknown
  misc_feature (1)..( 9): Matrix.001 file - promoters60/1010770
acaaagaga

SEQ ID NO: 41234 - DNA, 7 bp, Unknown
  misc_feature (1)..( 7): Matrix.001 file - promoters60/1010770
tttggac

SEQ ID NO: 41235 - DNA, 6 bp, Unknown
  misc_feature (1)..( 6): Matrix.001 file - promoters60/1010770
gctttt

SEQ ID NO: 41236 - DNA, 7 bp, Unknown
  misc_feature (1)..( 7): Matrix.001 file - promoters60/1010770
ccaattg

SEQ ID NO: 41237 - DNA, 8 bp, Unknown
  misc_feature (1)..( 8): Matrix.001 file - promoters60/1010770
gattaatt

SEQ ID NO: 41238 - DNA, 6 bp, Unknown
  misc_feature (1)..( 6): Matrix.001 file - promoters60/1010770
taaatt

SEQ ID NO: 41239 - DNA, 8 bp, Unknown
  misc_feature (1)..( 8): Matrix.001 file - promoters60/1010770
aattgcaa

SEQ ID NO: 41240 - DNA, 7 bp, Unknown
  misc_feature (1)..( 7): Matrix.001 file - promoters60/1010770
gttattg

SEQ ID NO: 41241 - DNA, 7 bp, Unknown
  misc_feature (1)..( 7): Matrix.001 file - promoters60/1010770
tttagtt

SEQ ID NO: 41242 - DNA, 9 bp, Unknown
  misc_feature (1)..( 9): Matrix.001 file - promoters60/1010770
aatacaaaa

SEQ ID NO: 41243 - DNA, 7 bp, Unknown
  misc_feature (1)..( 7): Matrix.001 file - promoters60/1010770
caaaaaa

SEQ ID NO: 41244 - DNA, 10 bp, Unknown
  misc_feature (1)..( 10): Matrix.001 file - promoters60/1010770
tttaaacaat

SEQ ID NO: 41245 - DNA, 7 bp, Unknown
  misc_feature (1)..( 7): Matrix.001 file - promoters60/1010770
ttaatgc

SEQ ID NO: 41246 - DNA, 6 bp, Unknown
  misc_feature (1)..( 6): Matrix.001 file - promoters60/1010770
atatac

SEQ ID NO: 41247 - DNA, 8 bp, Unknown
  misc_feature (1)..( 8): Matrix.001 file - promoters60/1010770
cttggttt

SEQ ID NO: 41248 - DNA, 8 bp, Unknown
  misc_feature (1)..( 8): Matrix.001 file - promoters60/1010770
ccatacat

SEQ ID NO: 41249 - DNA, 13 bp, Unknown
  misc_feature (1)..( 13): Matrix.001 file - promoters60/1010815
ctttcaaagaaag

SEQ ID NO: 41250 - DNA, 5 bp, Unknown
  misc_feature (1)..( 5): Matrix.001 file - promoters60/1010815
aaaaa

SEQ ID NO: 41251 - DNA, 9 bp, Unknown
  misc_feature (1)..( 9): Matrix.001 file - promoters60/1010815
aacaaaaaa

SEQ ID NO: 41252 - DNA, 11 bp, Unknown
  misc_feature (1)..( 11): Matrix.001 file - promoters60/1010815
aatatataaat

SEQ ID NO: 41253 - DNA, 12 bp, Unknown
  misc_feature (1)..( 12): Matrix.001 file - promoters60/1010819
tttttctaaaag

SEQ ID NO: 41254 - DNA, 6 bp, Unknown
  misc_feature (1)..( 6): Matrix.001 file - promoters60/1010993
tttttt

SEQ ID NO: 41255 - DNA, 10 bp, Unknown
  misc_feature (1)..( 10): Matrix.001 file - promoters60/1010993
taatataaaa

SEQ ID NO: 41256 - DNA, 9 bp, Unknown
  misc_feature (1)..( 9): Matrix.001 file - promoters60/1010993
aaaataaaa

SEQ ID NO: 41257 - DNA, 11 bp, Unknown
  misc_feature (1)..( 11): Matrix.001 file - promoters60/1010993
taaaaaaacta

SEQ ID NO: 41258 - DNA, 8 bp, Unknown
  misc_feature (1)..( 8): Matrix.001 file - promoters60/1010993
aagagtat

SEQ ID NO: 41259 - DNA, 10 bp, Unknown
  misc_feature (1)..( 10): Matrix.001 file - promoters60/1010993
tatagaattt

SEQ ID NO: 41260 - DNA, 8 bp, Unknown
  misc_feature (1)..( 8): Matrix.001 file - promoters60/1010993
attgaaaa

SEQ ID NO: 41261 - DNA, 8 bp, Unknown
  misc_feature (1)..( 8): Matrix.001 file - promoters60/1011041
cagattga

SEQ ID NO: 41262 - DNA, 8 bp, Unknown
  misc_feature (1)..( 8): Matrix.001 file - promoters60/1011041
aagattga

SEQ ID NO: 41263 - DNA, 10 bp, Unknown
  misc_feature (1)..( 10): Matrix.001 file - promoters60/1011041
agaatttaaa

SEQ ID NO: 41264 - DNA, 6 bp, Unknown
  misc_feature (1)..( 6): Matrix.001 file - promoters60/1011212
tttttg

SEQ ID NO: 41265 - DNA, 7 bp, Unknown
  misc_feature (1)..( 7): Matrix.001 file - promoters60/1011212
gacatgg

SEQ ID NO: 41266 - DNA, 7 bp, Unknown
  misc_feature (1)..( 7): Matrix.001 file - promoters60/1011212
taggagt

SEQ ID NO: 41267 - DNA, 8 bp, Unknown
  misc_feature (1)..( 8): Matrix.001 file - promoters60/1011212
ttaaaaca

SEQ ID NO: 41268 - DNA, 12 bp, Unknown
  misc_feature (1)..( 12): Matrix.001 file - promoters60/1011212
acatttatttta

SEQ ID NO: 41269 - DNA, 7 bp, Unknown
  misc_feature (1)..( 7): Matrix.001 file - promoters60/1011212
taatttt

SEQ ID NO: 41270 - DNA, 6 bp, Unknown
  misc_feature (1)..( 6): Matrix.001 file - promoters60/1011212
atttta

SEQ ID NO: 41271 - DNA, 6 bp, Unknown
  misc_feature (1)..( 6): Matrix.001 file - promoters60/1011212
aattga

SEQ ID NO: 41272 - DNA, 7 bp, Unknown
  misc_feature (1)..( 7): Matrix.001 file - promoters60/1011212
ttaaaac

SEQ ID NO: 41273 - DNA, 7 bp, Unknown
  misc_feature (1)..( 7): Matrix.001 file - promoters60/1011212
gttaaca

SEQ ID NO: 41274 - DNA, 8 bp, Unknown
  misc_feature (1)..( 8): Matrix.001 file - promoters60/1011212
ttaaagaa

SEQ ID NO: 41275 - DNA, 6 bp, Unknown
  misc_feature (1)..( 6): Matrix.001 file - promoters60/1011212
aaaaat

SEQ ID NO: 41276 - DNA, 6 bp, Unknown
  misc_feature (1)..( 6): Matrix.001 file - promoters60/1011212
actaca

SEQ ID NO: 41277 - DNA, 6 bp, Unknown
  misc_feature (1)..( 6): Matrix.001 file - promoters60/1011212
ctaact

SEQ ID NO: 41278 - DNA, 6 bp, Unknown
  misc_feature (1)..( 6): Matrix.001 file - promoters60/1011212
ctattt

SEQ ID NO: 41279 - DNA, 7 bp, Unknown
  misc_feature (1)..( 7): Matrix.001 file - promoters60/1011212
acctgat

SEQ ID NO: 41280 - DNA, 6 bp, Unknown
  misc_feature (1)..( 6): Matrix.001 file - promoters60/1011212
tcttag

SEQ ID NO: 41281 - DNA, 7 bp, Unknown
  misc_feature (1)..( 7): Matrix.001 file - promoters60/1011212
catgagt

SEQ ID NO: 41282 - DNA, 7 bp, Unknown
  misc_feature (1)..( 7): Matrix.001 file - promoters60/1011212
ccacggt

SEQ ID NO: 41283 - DNA, 6 bp, Unknown
  misc_feature (1)..( 6): Matrix.001 file - promoters60/1011258
ttaaaa

SEQ ID NO: 41284 - DNA, 6 bp, Unknown
  misc_feature (1)..( 6): Matrix.001 file - promoters60/1011258
taaaac

SEQ ID NO: 41285 - DNA, 6 bp, Unknown
  misc_feature (1)..( 6): Matrix.001 file - promoters60/1011258
aaactt

SEQ ID NO: 41286 - DNA, 7 bp, Unknown
  misc_feature (1)..( 7): Matrix.001 file - promoters60/1011258
cacaatc

SEQ ID NO: 41287 - DNA, 7 bp, Unknown
  misc_feature (1)..( 7): Matrix.001 file - promoters60/1011258
aaaccaa

SEQ ID NO: 41288 - DNA, 7 bp, Unknown
  misc_feature (1)..( 7): Matrix.001 file - promoters60/1011258
aaaccaa

SEQ ID NO: 41289 - DNA, 6 bp, Unknown
  misc_feature (1)..( 6): Matrix.001 file - promoters60/1011258
aataaa

SEQ ID NO: 41290 - DNA, 7 bp, Unknown
  misc_feature (1)..( 7): Matrix.001 file - promoters60/1011258
aagaaga

SEQ ID NO: 41291 - DNA, 9 bp, Unknown
  misc_feature (1)..( 9): Matrix.001 file - promoters60/1011258
ttacagtta

SEQ ID NO: 41292 - DNA, 6 bp, Unknown
  misc_feature (1)..( 6): Matrix.001 file - promoters60/1011258
cagaaa

SEQ ID NO: 41293 - DNA, 7 bp, Unknown
  misc_feature (1)..( 7): Matrix.001 file - promoters60/1011258
tccacca

SEQ ID NO: 41294 - DNA, 6 bp, Unknown
  misc_feature (1)..( 6): Matrix.001 file - promoters60/1011258
ttttga

SEQ ID NO: 41295 - DNA, 6 bp, Unknown
  misc_feature (1)..( 6): Matrix.001 file - promoters60/1011258
tcttct

SEQ ID NO: 41296 - DNA, 7 bp, Unknown
  misc_feature (1)..( 7): Matrix.001 file - promoters60/1011258
cacacca

SEQ ID NO: 41297 - DNA, 11 bp, Unknown
  misc_feature (1)..( 11): Matrix.001 file - promoters60/1011258
ctttcttcttt

SEQ ID NO: 41298 - DNA, 8 bp, Unknown
  misc_feature (1)..( 8): Matrix.001 file - promoters60/1011258
tttgcttc

SEQ ID NO: 41299 - DNA, 7 bp, Unknown
  misc_feature (1)..( 7): Matrix.001 file - promoters60/1011258
caagttg

SEQ ID NO: 41300 - DNA, 8 bp, Unknown
  misc_feature (1)..( 8): Matrix.001 file - promoters60/1011258
taaaaaaa

SEQ ID NO: 41301 - DNA, 8 bp, Unknown
  misc_feature (1)..( 8): Matrix.001 file - promoters60/1011258
caagaaaa

SEQ ID NO: 41302 - DNA, 8 bp, Unknown
  misc_feature (1)..( 8): Matrix.001 file - promoters60/1011258
aagaatct

SEQ ID NO: 41303 - DNA, 8 bp, Unknown
  misc_feature (1)..( 8): Matrix.001 file - promoters60/1011258
tccaacaa

SEQ ID NO: 41304 - DNA, 6 bp, Unknown
  misc_feature (1)..( 6): Matrix.001 file - promoters60/1011262
atgttt

SEQ ID NO: 41305 - DNA, 9 bp, Unknown
  misc_feature (1)..( 9): Matrix.001 file - promoters60/1011262
taagcatat

SEQ ID NO: 41306 - DNA, 6 bp, Unknown
  misc_feature (1)..( 6): Matrix.001 file - promoters60/1011262
taatat

SEQ ID NO: 41307 - DNA, 10 bp, Unknown
  misc_feature (1)..( 10): Matrix.001 file - promoters60/1011262
atatcataat

SEQ ID NO: 41308 - DNA, 8 bp, Unknown
  misc_feature (1)..( 8): Matrix.001 file - promoters60/1011262
tatacata

SEQ ID NO: 41309 - DNA, 7 bp, Unknown
  misc_feature (1)..( 7): Matrix.001 file - promoters60/1011262
atttaca

SEQ ID NO: 41310 - DNA, 6 bp, Unknown
  misc_feature (1)..( 6): Matrix.001 file - promoters60/1011262
acattt

SEQ ID NO: 41311 - DNA, 6 bp, Unknown
  misc_feature (1)..( 6): Matrix.001 file - promoters60/1011262
atttta

SEQ ID NO: 41312 - DNA, 7 bp, Unknown
  misc_feature (1)..( 7): Matrix.001 file - promoters60/1011262
tatatat

SEQ ID NO: 41313 - DNA, 6 bp, Unknown
  misc_feature (1)..( 6): Matrix.001 file - promoters60/1011262
tatatt

SEQ ID NO: 41314 - DNA, 7 bp, Unknown
  misc_feature (1)..( 7): Matrix.001 file - promoters60/1011262
tttattt

SEQ ID NO: 41315 - DNA, 6 bp, Unknown
  misc_feature (1)..( 6): Matrix.001 file - promoters60/1011262
aaaaaa

SEQ ID NO: 41316 - DNA, 6 bp, Unknown
  misc_feature (1)..( 6): Matrix.001 file - promoters60/1011262
aaattc

SEQ ID NO: 41317 - DNA, 7 bp, Unknown
  misc_feature (1)..( 7): Matrix.001 file - promoters60/1011262
ccatctg

SEQ ID NO: 41318 - DNA, 6 bp, Unknown
  misc_feature (1)..( 6): Matrix.001 file - promoters60/1011262
atacac

SEQ ID NO: 41319 - DNA, 6 bp, Unknown
  misc_feature (1)..( 6): Matrix.001 file - promoters60/1011262
ttgatt

SEQ ID NO: 41320 - DNA, 8 bp, Unknown
  misc_feature (1)..( 8): Matrix.001 file - promoters60/1011262
gctacaga

SEQ ID NO: 41321 - DNA, 7 bp, Unknown
  misc_feature (1)..( 7): Matrix.001 file - promoters60/1011303
tgcataa

SEQ ID NO: 41322 - DNA, 9 bp, Unknown
  misc_feature (1)..( 9): Matrix.001 file - promoters60/1011303
tcaaaaact

SEQ ID NO: 41323 - DNA, 6 bp, Unknown
  misc_feature (1)..( 6): Matrix.001 file - promoters60/1011303
aacaaa

SEQ ID NO: 41324 - DNA, 6 bp, Unknown
  misc_feature (1)..( 6): Matrix.001 file - promoters60/1011303
ttttaa

SEQ ID NO: 41325 - DNA, 8 bp, Unknown
  misc_feature (1)..( 8): Matrix.001 file - promoters60/1011303
tccaattt

SEQ ID NO: 41326 - DNA, 9 bp, Unknown
  misc_feature (1)..( 9): Matrix.001 file - promoters60/1011303
tataatgaa

SEQ ID NO: 41327 - DNA, 7 bp, Unknown
  misc_feature (1)..( 7): Matrix.001 file - promoters60/1011303
gtgatca

SEQ ID NO: 41328 - DNA, 10 bp, Unknown
  misc_feature (1)..( 10): Matrix.001 file - promoters60/1011303
cttacaattt

SEQ ID NO: 41329 - DNA, 8 bp, Unknown
  misc_feature (1)..( 8): Matrix.001 file - promoters60/1011303
tttgtaaa

SEQ ID NO: 41330 - DNA, 9 bp, Unknown
  misc_feature (1)..( 9): Matrix.001 file - promoters60/1011303
aacaatata

SEQ ID NO: 41331 - DNA, 6 bp, Unknown
  misc_feature (1)..( 6): Matrix.001 file - promoters60/1011303
aatggt

SEQ ID NO: 41332 - DNA, 7 bp, Unknown
  misc_feature (1)..( 7): Matrix.001 file - promoters60/1011303
caaaatc

SEQ ID NO: 41333 - DNA, 9 bp, Unknown
  misc_feature (1)..( 9): Matrix.001 file - promoters60/1011303
actacaaac

SEQ ID NO: 41334 - DNA, 6 bp, Unknown
  misc_feature (1)..( 6): Matrix.001 file - promoters60/1011303
aaaact

SEQ ID NO: 41335 - DNA, 8 bp, Unknown
  misc_feature (1)..( 8): Matrix.001 file - promoters60/1011303
aggcaaat

SEQ ID NO: 41336 - DNA, 10 bp, Unknown
  misc_feature (1)..( 10): Matrix.001 file - promoters60/1011303
cagtgtcgga

SEQ ID NO: 41337 - DNA, 9 bp, Unknown
  misc_feature (1)..( 9): Matrix.001 file - promoters60/1011303
ttttgatta

SEQ ID NO: 41338 - DNA, 6 bp, Unknown
  misc_feature (1)..( 6): Matrix.001 file - promoters60/1011303
taacta

SEQ ID NO: 41339 - DNA, 6 bp, Unknown
  misc_feature (1)..( 6): Matrix.001 file - promoters60/1011303
attact

SEQ ID NO: 41340 - DNA, 6 bp, Unknown
  misc_feature (1)..( 6): Matrix.001 file - promoters60/1011303
gtcttt

SEQ ID NO: 41341 - DNA, 7 bp, Unknown
  misc_feature (1)..( 7): Matrix.001 file - promoters60/1011303
aataaaa

SEQ ID NO: 41342 - DNA, 6 bp, Unknown
  misc_feature (1)..( 6): Matrix.001 file - promoters60/1011303
gcaaaa

SEQ ID NO: 41343 - DNA, 6 bp, Unknown
  misc_feature (1)..( 6): Matrix.001 file - promoters60/1011303
aaatta

SEQ ID NO: 41344 - DNA, 8 bp, Unknown
  misc_feature (1)..( 8): Matrix.001 file - promoters60/1011303
tttagtcg

SEQ ID NO: 41345 - DNA, 6 bp, Unknown
  misc_feature (1)..( 6): Matrix.001 file - promoters60/1011303
attttt

SEQ ID NO: 41346 - DNA, 11 bp, Unknown
  misc_feature (1)..( 11): Matrix.001 file - promoters60/1011337
atatttttcgt

SEQ ID NO: 41347 - DNA, 7 bp, Unknown
  misc_feature (1)..( 7): Matrix.001 file - promoters60/1011337
aaaaaaa

SEQ ID NO: 41348 - DNA, 8 bp, Unknown
  misc_feature (1)..( 8): Matrix.001 file - promoters60/1011337
aataaata

SEQ ID NO: 41349 - DNA, 11 bp, Unknown
  misc_feature (1)..( 11): Matrix.001 file - promoters60/1011358
cgatacttgtc

SEQ ID NO: 41350 - DNA, 10 bp, Unknown
  misc_feature (1)..( 10): Matrix.001 file - promoters60/1011358
aagaactcat

SEQ ID NO: 41351 - DNA, 12 bp, Unknown
  misc_feature (1)..( 12): Matrix.001 file - promoters60/1011358
ttaaatgaagat

SEQ ID NO: 41352 - DNA, 7 bp, Unknown
  misc_feature (1)..( 7): Matrix.001 file - promoters60/1011358
acacgtc

SEQ ID NO: 41353 - DNA, 10 bp, Unknown
  misc_feature (1)..( 10): Matrix.001 file - promoters60/1011358
tgtggtccat

SEQ ID NO: 41354 - DNA, 9 bp, Unknown
  misc_feature (1)..( 9): Matrix.001 file - promoters60/1011358
ttatgtgga

SEQ ID NO: 41355 - DNA, 7 bp, Unknown
  misc_feature (1)..( 7): Matrix.001 file - promoters60/1011358
agaagaa

SEQ ID NO: 41356 - DNA, 6 bp, Unknown
  misc_feature (1)..( 6): Matrix.001 file - promoters60/1011358
gtgtaa

SEQ ID NO: 41357 - DNA, 9 bp, Unknown
  misc_feature (1)..( 9): Matrix.001 file - promoters60/1011358
aaacaaaaa

SEQ ID NO: 41358 - DNA, 6 bp, Unknown
  misc_feature (1)..( 6): Matrix.001 file - promoters60/1011358
tataaa

SEQ ID NO: 41359 - DNA, 7 bp, Unknown
  misc_feature (1)..( 7): Matrix.001 file - promoters60/1011358
gacctta

SEQ ID NO: 41360 - DNA, 6 bp, Unknown
  misc_feature (1)..( 6): Matrix.001 file - promoters60/1011358
atgaag

SEQ ID NO: 41361 - DNA, 6 bp, Unknown
  misc_feature (1)..( 6): Matrix.001 file - promoters60/1011358
agtaat

SEQ ID NO: 41362 - DNA, 8 bp, Unknown
  misc_feature (1)..( 8): Matrix.001 file - promoters60/1011358
tcagccag

SEQ ID NO: 41363 - DNA, 6 bp, Unknown
  misc_feature (1)..( 6): Matrix.001 file - promoters60/1011358
cgttga

SEQ ID NO: 41364 - DNA, 7 bp, Unknown
  misc_feature (1)..( 7): Matrix.001 file - promoters60/1011516
tagattt

SEQ ID NO: 41365 - DNA, 8 bp, Unknown
  misc_feature (1)..( 8): Matrix.001 file - promoters60/1011516
caatgaga

SEQ ID NO: 41366 - DNA, 7 bp, Unknown
  misc_feature (1)..( 7): Matrix.001 file - promoters60/1011516
cataatt

SEQ ID NO: 41367 - DNA, 8 bp, Unknown
  misc_feature (1)..( 8): Matrix.001 file - promoters60/1011516
aatcaata

SEQ ID NO: 41368 - DNA, 6 bp, Unknown
  misc_feature (1)..( 6): Matrix.001 file - promoters60/1011516
aagaga

SEQ ID NO: 41369 - DNA, 9 bp, Unknown
  misc_feature (1)..( 9): Matrix.001 file - promoters60/1011516
ataataata

SEQ ID NO: 41370 - DNA, 7 bp, Unknown
  misc_feature (1)..( 7): Matrix.001 file - promoters60/1011516
tttgttc

SEQ ID NO: 41371 - DNA, 8 bp, Unknown
  misc_feature (1)..( 8): Matrix.001 file - promoters60/1011516
ccactcca

SEQ ID NO: 41372 - DNA, 8 bp, Unknown
  misc_feature (1)..( 8): Matrix.001 file - promoters60/1011516
taacacgt

SEQ ID NO: 41373 - DNA, 7 bp, Unknown
  misc_feature (1)..( 7): Matrix.001 file - promoters60/1011516
caaaaat

SEQ ID NO: 41374 - DNA, 7 bp, Unknown
  misc_feature (1)..( 7): Matrix.001 file - promoters60/1011516
aaaagga

SEQ ID NO: 41375 - DNA, 10 bp, Unknown
  misc_feature (1)..( 10): Matrix.001 file - promoters60/1011516
ctatattaat

SEQ ID NO: 41376 - DNA, 6 bp, Unknown
  misc_feature (1)..( 6): Matrix.001 file - promoters60/1011516
gatcat

SEQ ID NO: 41377 - DNA, 7 bp, Unknown
  misc_feature (1)..( 7): Matrix.001 file - promoters60/1011516
tctacat

SEQ ID NO: 41378 - DNA, 7 bp, Unknown
  misc_feature (1)..( 7): Matrix.001 file - promoters60/1011516
ttacaaa

SEQ ID NO: 41379 - DNA, 8 bp, Unknown
  misc_feature (1)..( 8): Matrix.001 file - promoters60/1011516
taaaatta

SEQ ID NO: 41380 - DNA, 8 bp, Unknown
  misc_feature (1)..( 8): Matrix.001 file - promoters60/1011516
aataaata

SEQ ID NO: 41381 - DNA, 9 bp, Unknown
  misc_feature (1)..( 9): Matrix.001 file - promoters60/1011556
gaaaaaaaa

SEQ ID NO: 41382 - DNA, 7 bp, Unknown
  misc_feature (1)..( 7): Matrix.001 file - promoters60/1011556
taaaatt

SEQ ID NO: 41383 - DNA, 8 bp, Unknown
  misc_feature (1)..( 8): Matrix.001 file - promoters60/1011556
tttaattt

SEQ ID NO: 41384 - DNA, 6 bp, Unknown
  misc_feature (1)..( 6): Matrix.001 file - promoters60/1011556
ataaat

SEQ ID NO: 41385 - DNA, 12 bp, Unknown
  misc_feature (1)..( 12): Matrix.001 file - promoters60/1011556
atgttaaataat

SEQ ID NO: 41386 - DNA, 8 bp, Unknown
  misc_feature (1)..( 8): Matrix.001 file - promoters60/1011556
tcactaca

SEQ ID NO: 41387 - DNA, 8 bp, Unknown
  misc_feature (1)..( 8): Matrix.001 file - promoters60/1011616
actagaag

SEQ ID NO: 41388 - DNA, 6 bp, Unknown
  misc_feature (1)..( 6): Matrix.001 file - promoters60/1011616
tataaa

SEQ ID NO: 41389 - DNA, 9 bp, Unknown
  misc_feature (1)..( 9): Matrix.001 file - promoters60/1011616
atgaacaat

SEQ ID NO: 41390 - DNA, 7 bp, Unknown
  misc_feature (1)..( 7): Matrix.001 file - promoters60/1011616
ggacgct

SEQ ID NO: 41391 - DNA, 7 bp, Unknown
  misc_feature (1)..( 7): Matrix.001 file - promoters60/1011616
caaccaa

SEQ ID NO: 41392 - DNA, 6 bp, Unknown
  misc_feature (1)..( 6): Matrix.001 file - promoters60/1011616
aataaa

SEQ ID NO: 41393 - DNA, 6 bp, Unknown
  misc_feature (1)..( 6): Matrix.001 file - promoters60/1011616
aaaaat

SEQ ID NO: 41394 - DNA, 7 bp, Unknown
  misc_feature (1)..( 7): Matrix.001 file - promoters60/1011616
ggtcggt

SEQ ID NO: 41395 - DNA, 6 bp, Unknown
  misc_feature (1)..( 6): Matrix.001 file - promoters60/1011616
taaaaa

SEQ ID NO: 41396 - DNA, 6 bp, Unknown
  misc_feature (1)..( 6): Matrix.001 file - promoters60/1011616
tataaa

SEQ ID NO: 41397 - DNA, 8 bp, Unknown
  misc_feature (1)..( 8): Matrix.001 file - promoters60/1011780
aggcccaa

SEQ ID NO: 41398 - DNA, 6 bp, Unknown
  misc_feature (1)..( 6): Matrix.001 file - promoters60/1011900
aaaaat

SEQ ID NO: 41399 - DNA, 9 bp, Unknown
  misc_feature (1)..( 9): Matrix.001 file - promoters60/1011900
gattattgt

SEQ ID NO: 41400 - DNA, 6 bp, Unknown
  misc_feature (1)..( 6): Matrix.001 file - promoters60/1011900
catatc

SEQ ID NO: 41401 - DNA, 6 bp, Unknown
  misc_feature (1)..( 6): Matrix.001 file - promoters60/1011900
caaggt

SEQ ID NO: 41402 - DNA, 6 bp, Unknown
  misc_feature (1)..( 6): Matrix.001 file - promoters60/1011900
aaatgt

SEQ ID NO: 41403 - DNA, 7 bp, Unknown
  misc_feature (1)..( 7): Matrix.001 file - promoters60/1011900
tcataat

SEQ ID NO: 41404 - DNA, 7 bp, Unknown
  misc_feature (1)..( 7): Matrix.001 file - promoters60/1011900
atttgag

SEQ ID NO: 41405 - DNA, 6 bp, Unknown
  misc_feature (1)..( 6): Matrix.001 file - promoters60/1011900
cttaga

SEQ ID NO: 41406 - DNA, 6 bp, Unknown
  misc_feature (1)..( 6): Matrix.001 file - promoters60/1011900
actttt

SEQ ID NO: 41407 - DNA, 6 bp, Unknown
  misc_feature (1)..( 6): Matrix.001 file - promoters60/1011900
aaattc

SEQ ID NO: 41408 - DNA, 6 bp, Unknown
  misc_feature (1)..( 6): Matrix.001 file - promoters60/1011900
caacca

SEQ ID NO: 41409 - DNA, 7 bp, Unknown
  misc_feature (1)..( 7): Matrix.001 file - promoters60/1011900
agtaatc

SEQ ID NO: 41410 - DNA, 10 bp, Unknown
  misc_feature (1)..( 10): Matrix.001 file - promoters60/1011972
aaactttttt

SEQ ID NO: 41411 - DNA, 10 bp, Unknown
  misc_feature (1)..( 10): Matrix.001 file - promoters60/1011972
ttttaacaaa

SEQ ID NO: 41412 - DNA, 8 bp, Unknown
  misc_feature (1)..( 8): Matrix.001 file - promoters60/1011972
tgcataag

SEQ ID NO: 41413 - DNA, 9 bp, Unknown
  misc_feature (1)..( 9): Matrix.001 file - promoters60/1011972
gaatctctt

SEQ ID NO: 41414 - DNA, 7 bp, Unknown
  misc_feature (1)..( 7): Matrix.001 file - promoters60/1011972
tttaaag

SEQ ID NO: 41415 - DNA, 11 bp, Unknown
  misc_feature (1)..( 11): Matrix.001 file - promoters60/1011972
aatctttttaa

SEQ ID NO: 41416 - DNA, 9 bp, Unknown
  misc_feature (1)..( 9): Matrix.001 file - promoters60/1011972
ttctgctaa

SEQ ID NO: 41417 - DNA, 9 bp, Unknown
  misc_feature (1)..( 9): Matrix.001 file - promoters60/1011972
ctatataaa

SEQ ID NO: 41418 - DNA, 12 bp, Unknown
  misc_feature (1)..( 12): Matrix.001 file - promoters60/1011972
actgtttgatat

SEQ ID NO: 41419 - DNA, 8 bp, Unknown
  misc_feature (1)..( 8): Matrix.001 file - promoters60/1011972
attttcaa

SEQ ID NO: 41420 - DNA, 9 bp, Unknown
  misc_feature (1)..( 9): Matrix.001 file - promoters60/1011972
ctaatcaac

SEQ ID NO: 41421 - DNA, 9 bp, Unknown
  misc_feature (1)..( 9): Matrix.001 file - promoters60/1011972
atctacata

SEQ ID NO: 41422 - DNA, 8 bp, Unknown
  misc_feature (1)..( 8): Matrix.001 file - promoters60/1011972
atcaatat

SEQ ID NO: 41423 - DNA, 7 bp, Unknown
  misc_feature (1)..( 7): Matrix.001 file - promoters60/1011972
tgacatt

SEQ ID NO: 41424 - DNA, 7 bp, Unknown
  misc_feature (1)..( 7): Matrix.001 file - promoters60/1011972
tttcgga

SEQ ID NO: 41425 - DNA, 8 bp, Unknown
  misc_feature (1)..( 8): Matrix.001 file - promoters60/1012017
aatgcaac

SEQ ID NO: 41426 - DNA, 6 bp, Unknown
  misc_feature (1)..( 6): Matrix.001 file - promoters60/1012017
aaattt

SEQ ID NO: 41427 - DNA, 10 bp, Unknown
  misc_feature (1)..( 10): Matrix.001 file - promoters60/1012017
tgttttcact

SEQ ID NO: 41428 - DNA, 7 bp, Unknown
  misc_feature (1)..( 7): Matrix.001 file - promoters60/1012017
gttaata

SEQ ID NO: 41429 - DNA, 10 bp, Unknown
  misc_feature (1)..( 10): Matrix.001 file - promoters60/1012017
aactctttta

SEQ ID NO: 41430 - DNA, 6 bp, Unknown
  misc_feature (1)..( 6): Matrix.001 file - promoters60/1012017
caaaaa

SEQ ID NO: 41431 - DNA, 7 bp, Unknown
  misc_feature (1)..( 7): Matrix.001 file - promoters60/1012017
tttatta

SEQ ID NO: 41432 - DNA, 7 bp, Unknown
  misc_feature (1)..( 7): Matrix.001 file - promoters60/1012017
tgaaatt

SEQ ID NO: 41433 - DNA, 6 bp, Unknown
  misc_feature (1)..( 6): Matrix.001 file - promoters60/1012017
aagttg

SEQ ID NO: 41434 - DNA, 8 bp, Unknown
  misc_feature (1)..( 8): Matrix.001 file - promoters60/1012017
attactat

SEQ ID NO: 41435 - DNA, 6 bp, Unknown
  misc_feature (1)..( 6): Matrix.001 file - promoters60/1012017
taattc

SEQ ID NO: 41436 - DNA, 8 bp, Unknown
  misc_feature (1)..( 8): Matrix.001 file - promoters60/1012017
tgtcaaag

SEQ ID NO: 41437 - DNA, 7 bp, Unknown
  misc_feature (1)..( 7): Matrix.001 file - promoters60/1012017
aaaaaaa

SEQ ID NO: 41438 - DNA, 6 bp, Unknown
  misc_feature (1)..( 6): Matrix.001 file - promoters60/1012017
tgtcga

SEQ ID NO: 41439 - DNA, 7 bp, Unknown
  misc_feature (1)..( 7): Matrix.001 file - promoters60/1012017
tttactt

SEQ ID NO: 41440 - DNA, 6 bp, Unknown
  misc_feature (1)..( 6): Matrix.001 file - promoters60/1012017
ttgtac

SEQ ID NO: 41441 - DNA, 10 bp, Unknown
  misc_feature (1)..( 10): Matrix.001 file - promoters60/1012074
atattttgcg

SEQ ID NO: 41442 - DNA, 9 bp, Unknown
  misc_feature (1)..( 9): Matrix.001 file - promoters60/1012074
tttagttaa

SEQ ID NO: 41443 - DNA, 12 bp, Unknown
  misc_feature (1)..( 12): Matrix.001 file - promoters60/1012074
atttaataacaa

SEQ ID NO: 41444 - DNA, 11 bp, Unknown
  misc_feature (1)..( 11): Matrix.001 file - promoters60/1012074
taattttataa

SEQ ID NO: 41445 - DNA, 6 bp, Unknown
  misc_feature (1)..( 6): Matrix.001 file - promoters60/1012078
agccag

SEQ ID NO: 41446 - DNA, 7 bp, Unknown
  misc_feature (1)..( 7): Matrix.001 file - promoters60/1012078
gaaacca

SEQ ID NO: 41447 - DNA, 7 bp, Unknown
  misc_feature (1)..( 7): Matrix.001 file - promoters60/1012078
ttaggat

SEQ ID NO: 41448 - DNA, 7 bp, Unknown
  misc_feature (1)..( 7): Matrix.001 file - promoters60/1012078
ttcatga

SEQ ID NO: 41449 - DNA, 6 bp, Unknown
  misc_feature (1)..( 6): Matrix.001 file - promoters60/1012078
aagaaa

SEQ ID NO: 41450 - DNA, 7 bp, Unknown
  misc_feature (1)..( 7): Matrix.001 file - promoters60/1012078
ttcctct

SEQ ID NO: 41451 - DNA, 13 bp, Unknown
  misc_feature (1)..( 13): Matrix.001 file - promoters60/1012078
gttataatttttt

SEQ ID NO: 41452 - DNA, 7 bp, Unknown
  misc_feature (1)..( 7): Matrix.001 file - promoters60/1012078
tgaatat

SEQ ID NO: 41453 - DNA, 8 bp, Unknown
  misc_feature (1)..( 8): Matrix.001 file - promoters60/1012078
ttgatata

SEQ ID NO: 41454 - DNA, 8 bp, Unknown
  misc_feature (1)..( 8): Matrix.001 file - promoters60/1012078
gatattgt

SEQ ID NO: 41455 - DNA, 6 bp, Unknown
  misc_feature (1)..( 6): Matrix.001 file - promoters60/1012078
aattca

SEQ ID NO: 41456 - DNA, 8 bp, Unknown
  misc_feature (1)..( 8): Matrix.001 file - promoters60/1012078
aaaaaaat

SEQ ID NO: 41457 - DNA, 8 bp, Unknown
  misc_feature (1)..( 8): Matrix.001 file - promoters60/1012078
ttttcctt

SEQ ID NO: 41458 - DNA, 6 bp, Unknown
  misc_feature (1)..( 6): Matrix.001 file - promoters60/1012078
agtgtt

SEQ ID NO: 41459 - DNA, 8 bp, Unknown
  misc_feature (1)..( 8): Matrix.001 file - promoters60/1012078
tttgtttt

SEQ ID NO: 41460 - DNA, 7 bp, Unknown
  misc_feature (1)..( 7): Matrix.001 file - promoters60/1012078
aaaatat

SEQ ID NO: 41461 - DNA, 10 bp, Unknown
  misc_feature (1)..( 10): Matrix.001 file - promoters60/1012078
aaattaaaaa

SEQ ID NO: 41462 - DNA, 8 bp, Unknown
  misc_feature (1)..( 8): Matrix.001 file - promoters60/1012110
aaatgaaa

SEQ ID NO: 41463 - DNA, 11 bp, Unknown
  misc_feature (1)..( 11): Matrix.001 file - promoters60/1012110
ccataattaag

SEQ ID NO: 41464 - DNA, 9 bp, Unknown
  misc_feature (1)..( 9): Matrix.001 file - promoters60/1012110
ctcaaaaaa

SEQ ID NO: 41465 - DNA, 10 bp, Unknown
  misc_feature (1)..( 10): Matrix.001 file - promoters60/1012110
gtaaaaataa

SEQ ID NO: 41466 - DNA, 15 bp, Unknown
  misc_feature (1)..( 15): Matrix.001 file - promoters60/1012128
taaggcccaatattt

SEQ ID NO: 41467 - DNA, 9 bp, Unknown
  misc_feature (1)..( 9): Matrix.001 file - promoters60/1012128
catatataa

SEQ ID NO: 41468 - DNA, 7 bp, Unknown
  misc_feature (1)..( 7): Matrix.001 file - promoters60/1012128
cacaaaa

SEQ ID NO: 41469 - DNA, 11 bp, Unknown
  misc_feature (1)..( 11): Matrix.001 file - promoters60/1012128
gccttcaaaga

SEQ ID NO: 41470 - DNA, 10 bp, Unknown
  misc_feature (1)..( 10): Matrix.001 file - promoters60/1012128
actaatctga

SEQ ID NO: 41471 - DNA, 13 bp, Unknown
  misc_feature (1)..( 13): Matrix.001 file - promoters60/1012140
ttgagtcaaatca

SEQ ID NO: 41472 - DNA, 6 bp, Unknown
  misc_feature (1)..( 6): Matrix.001 file - promoters60/1012140
aaggtt

SEQ ID NO: 41473 - DNA, 7 bp, Unknown
  misc_feature (1)..( 7): Matrix.001 file - promoters60/1012140
ttgaatt

SEQ ID NO: 41474 - DNA, 9 bp, Unknown
  misc_feature (1)..( 9): Matrix.001 file - promoters60/1012140
tcttgttct

SEQ ID NO: 41475 - DNA, 6 bp, Unknown
  misc_feature (1)..( 6): Matrix.001 file - promoters60/1012140
ttcttt

SEQ ID NO: 41476 - DNA, 6 bp, Unknown
  misc_feature (1)..( 6): Matrix.001 file - promoters60/1012140
tttttg

SEQ ID NO: 41477 - DNA, 8 bp, Unknown
  misc_feature (1)..( 8): Matrix.001 file - promoters60/1012140
gcaaaatt

SEQ ID NO: 41478 - DNA, 7 bp, Unknown
  misc_feature (1)..( 7): Matrix.001 file - promoters60/1012140
acaaaaa

SEQ ID NO: 41479 - DNA, 6 bp, Unknown
  misc_feature (1)..( 6): Matrix.001 file - promoters60/1012140
tcaaac

SEQ ID NO: 41480 - DNA, 6 bp, Unknown
  misc_feature (1)..( 6): Matrix.001 file - promoters60/1012213
ctttct

SEQ ID NO: 41481 - DNA, 8 bp, Unknown
  misc_feature (1)..( 8): Matrix.001 file - promoters60/1012213
aaaataca

SEQ ID NO: 41482 - DNA, 6 bp, Unknown
  misc_feature (1)..( 6): Matrix.001 file - promoters60/1012213
tgtgtt

SEQ ID NO: 41483 - DNA, 7 bp, Unknown
  misc_feature (1)..( 7): Matrix.001 file - promoters60/1012213
tttcatg

SEQ ID NO: 41484 - DNA, 7 bp, Unknown
  misc_feature (1)..( 7): Matrix.001 file - promoters60/1012213
tgtctat

SEQ ID NO: 41485 - DNA, 6 bp, Unknown
  misc_feature (1)..( 6): Matrix.001 file - promoters60/1012213
gatgta

SEQ ID NO: 41486 - DNA, 6 bp, Unknown
  misc_feature (1)..( 6): Matrix.001 file - promoters60/1012213
tttttt

SEQ ID NO: 41487 - DNA, 7 bp, Unknown
  misc_feature (1)..( 7): Matrix.001 file - promoters60/1012213
tatcatg

SEQ ID NO: 41488 - DNA, 7 bp, Unknown
  misc_feature (1)..( 7): Matrix.001 file - promoters60/1012213
tttgtat

SEQ ID NO: 41489 - DNA, 6 bp, Unknown
  misc_feature (1)..( 6): Matrix.001 file - promoters60/1012213
aacaac

SEQ ID NO: 41490 - DNA, 8 bp, Unknown
  misc_feature (1)..( 8): Matrix.001 file - promoters60/1012213
aaaaatct

SEQ ID NO: 41491 - DNA, 7 bp, Unknown
  misc_feature (1)..( 7): Matrix.001 file - promoters60/1012213
tatattt

SEQ ID NO: 41492 - DNA, 7 bp, Unknown
  misc_feature (1)..( 7): Matrix.001 file - promoters60/1012213
tatgatt

SEQ ID NO: 41493 - DNA, 7 bp, Unknown
  misc_feature (1)..( 7): Matrix.001 file - promoters60/1012213
tttctgt

SEQ ID NO: 41494 - DNA, 6 bp, Unknown
  misc_feature (1)..( 6): Matrix.001 file - promoters60/1012213
gctaat

SEQ ID NO: 41495 - DNA, 7 bp, Unknown
  misc_feature (1)..( 7): Matrix.001 file - promoters60/1012245
agcgatt

SEQ ID NO: 41496 - DNA, 7 bp, Unknown
  misc_feature (1)..( 7): Matrix.001 file - promoters60/1012245
ttttggt

SEQ ID NO: 41497 - DNA, 7 bp, Unknown
  misc_feature (1)..( 7): Matrix.001 file - promoters60/1012245
gttcctt

SEQ ID NO: 41498 - DNA, 6 bp, Unknown
  misc_feature (1)..( 6): Matrix.001 file - promoters60/1012245
atttaa

SEQ ID NO: 41499 - DNA, 6 bp, Unknown
  misc_feature (1)..( 6): Matrix.001 file - promoters60/1012245
catttt

SEQ ID NO: 41500 - DNA, 7 bp, Unknown
  misc_feature (1)..( 7): Matrix.001 file - promoters60/1012245
tgaatct

SEQ ID NO: 41501 - DNA, 8 bp, Unknown
  misc_feature (1)..( 8): Matrix.001 file - promoters60/1012245
aagagtaa

SEQ ID NO: 41502 - DNA, 8 bp, Unknown
  misc_feature (1)..( 8): Matrix.001 file - promoters60/1012245
tttactta

SEQ ID NO: 41503 - DNA, 7 bp, Unknown
  misc_feature (1)..( 7): Matrix.001 file - promoters60/1012245
ttttcat

SEQ ID NO: 41504 - DNA, 8 bp, Unknown
  misc_feature (1)..( 8): Matrix.001 file - promoters60/1012245
tctcaaat

SEQ ID NO: 41505 - DNA, 9 bp, Unknown
  misc_feature (1)..( 9): Matrix.001 file - promoters60/1012245
tctcaagtg

SEQ ID NO: 41506 - DNA, 9 bp, Unknown
  misc_feature (1)..( 9): Matrix.001 file - promoters60/1012349
ttttgttta

SEQ ID NO: 41507 - DNA, 12 bp, Unknown
  misc_feature (1)..( 12): Matrix.001 file - promoters60/1012349
ataaaaatacta

SEQ ID NO: 41508 - DNA, 12 bp, Unknown
  misc_feature (1)..( 12): Matrix.001 file - promoters60/1012349
caacaatataca

SEQ ID NO: 41509 - DNA, 10 bp, Unknown
  misc_feature (1)..( 10): Matrix.001 file - promoters60/1012349
gaatttatat

SEQ ID NO: 41510 - DNA, 11 bp, Unknown
  misc_feature (1)..( 11): Matrix.001 file - promoters60/1012388
ataatttgatt

SEQ ID NO: 41511 - DNA, 8 bp, Unknown
  misc_feature (1)..( 8): Matrix.001 file - promoters60/1012388
tatttaat

SEQ ID NO: 41512 - DNA, 10 bp, Unknown
  misc_feature (1)..( 10): Matrix.001 file - promoters60/1012388
taaaaatata

SEQ ID NO: 41513 - DNA, 11 bp, Unknown
  misc_feature (1)..( 11): Matrix.001 file - promoters60/1012388
aaattatgatt

SEQ ID NO: 41514 - DNA, 11 bp, Unknown
  misc_feature (1)..( 11): Matrix.001 file - promoters60/1012388
tttaaaataga

SEQ ID NO: 41515 - DNA, 11 bp, Unknown
  misc_feature (1)..( 11): Matrix.001 file - promoters60/1012397
tcgaatatatg

SEQ ID NO: 41516 - DNA, 13 bp, Unknown
  misc_feature (1)..( 13): Matrix.001 file - promoters60/1012397
aatttctctgctt

SEQ ID NO: 41517 - DNA, 10 bp, Unknown
  misc_feature (1)..( 10): Matrix.001 file - promoters60/1012397
ttaatttatt

SEQ ID NO: 41518 - DNA, 10 bp, Unknown
  misc_feature (1)..( 10): Matrix.001 file - promoters60/1012397
aaaaattgat

SEQ ID NO: 41519 - DNA, 13 bp, Unknown
  misc_feature (1)..( 13): Matrix.001 file - promoters60/1012397
taatttaattcat

SEQ ID NO: 41520 - DNA, 10 bp, Unknown
  misc_feature (1)..( 10): Matrix.001 file - promoters60/1012397
cattctcttc

SEQ ID NO: 41521 - DNA, 8 bp, Unknown
  misc_feature (1)..( 8): Matrix.001 file - promoters60/1012403
ttttttta

SEQ ID NO: 41522 - DNA, 7 bp, Unknown
  misc_feature (1)..( 7): Matrix.001 file - promoters60/1012403
aaaataa

SEQ ID NO: 41523 - DNA, 8 bp, Unknown
  misc_feature (1)..( 8): Matrix.001 file - promoters60/1012403
ttttgtta

SEQ ID NO: 41524 - DNA, 8 bp, Unknown
  misc_feature (1)..( 8): Matrix.001 file - promoters60/1012403
caattttt

SEQ ID NO: 41525 - DNA, 12 bp, Unknown
  misc_feature (1)..( 12): Matrix.001 file - promoters60/1012403
ttttatttaatg

SEQ ID NO: 41526 - DNA, 7 bp, Unknown
  misc_feature (1)..( 7): Matrix.001 file - promoters60/1012403
gttgaat

SEQ ID NO: 41527 - DNA, 9 bp, Unknown
  misc_feature (1)..( 9): Matrix.001 file - promoters60/1012407
aaatttttc

SEQ ID NO: 41528 - DNA, 15 bp, Unknown
  misc_feature (1)..( 15): Matrix.001 file - promoters60/1012407
tctacattgtttgat

SEQ ID NO: 41529 - DNA, 6 bp, Unknown
  misc_feature (1)..( 6): Matrix.001 file - promoters60/1012442
aaataa

SEQ ID NO: 41530 - DNA, 7 bp, Unknown
  misc_feature (1)..( 7): Matrix.001 file - promoters60/1012442
tcagttt

SEQ ID NO: 41531 - DNA, 13 bp, Unknown
  misc_feature (1)..( 13): Matrix.001 file - promoters60/1012442
taagattaacata

SEQ ID NO: 41532 - DNA, 7 bp, Unknown
  misc_feature (1)..( 7): Matrix.001 file - promoters60/1012442
tttttaa

SEQ ID NO: 41533 - DNA, 8 bp, Unknown
  misc_feature (1)..( 8): Matrix.001 file - promoters60/1012442
aagaaatt

SEQ ID NO: 41534 - DNA, 7 bp, Unknown
  misc_feature (1)..( 7): Matrix.001 file - promoters60/1012442
aatattt

SEQ ID NO: 41535 - DNA, 7 bp, Unknown
  misc_feature (1)..( 7): Matrix.001 file - promoters60/1012442
aatatat

SEQ ID NO: 41536 - DNA, 6 bp, Unknown
  misc_feature (1)..( 6): Matrix.001 file - promoters60/1012442
aaaatc

SEQ ID NO: 41537 - DNA, 8 bp, Unknown
  misc_feature (1)..( 8): Matrix.001 file - promoters60/1012442
caaggcat

SEQ ID NO: 41538 - DNA, 7 bp, Unknown
  misc_feature (1)..( 7): Matrix.001 file - promoters60/1012442
aataaat

SEQ ID NO: 41539 - DNA, 7 bp, Unknown
  misc_feature (1)..( 7): Matrix.001 file - promoters60/1012442
ttaaaat

SEQ ID NO: 41540 - DNA, 7 bp, Unknown
  misc_feature (1)..( 7): Matrix.001 file - promoters60/1012442
aatgtta

SEQ ID NO: 41541 - DNA, 6 bp, Unknown
  misc_feature (1)..( 6): Matrix.001 file - promoters60/1012442
agatat

SEQ ID NO: 41542 - DNA, 8 bp, Unknown
  misc_feature (1)..( 8): Matrix.001 file - promoters60/1012442
ccaacaca

SEQ ID NO: 41543 - DNA, 8 bp, Unknown
  misc_feature (1)..( 8): Matrix.001 file - promoters60/1012442
taaattgt

SEQ ID NO: 41544 - DNA, 6 bp, Unknown
  misc_feature (1)..( 6): Matrix.001 file - promoters60/1012442
atagat

SEQ ID NO: 41545 - DNA, 7 bp, Unknown
  misc_feature (1)..( 7): Matrix.001 file - promoters60/1012442
agagata

SEQ ID NO: 41546 - DNA, 6 bp, Unknown
  misc_feature (1)..( 6): Matrix.001 file - promoters60/1012442
ttttgg

SEQ ID NO: 41547 - DNA, 12 bp, Unknown
  misc_feature (1)..( 12): Matrix.001 file - promoters60/1012442
aaaaacaaaaca

SEQ ID NO: 41548 - DNA, 6 bp, Unknown
  misc_feature (1)..( 6): Matrix.001 file - promoters60/1012442
aaaaat

SEQ ID NO: 41549 - DNA, 6 bp, Unknown
  misc_feature (1)..( 6): Matrix.001 file - promoters60/1012442
taaccc

SEQ ID NO: 41550 - DNA, 7 bp, Unknown
  misc_feature (1)..( 7): Matrix.001 file - promoters60/1012561
aaacaaa

SEQ ID NO: 41551 - DNA, 7 bp, Unknown
  misc_feature (1)..( 7): Matrix.001 file - promoters60/1012561
gtatctt

SEQ ID NO: 41552 - DNA, 6 bp, Unknown
  misc_feature (1)..( 6): Matrix.001 file - promoters60/1012561
ttatct

SEQ ID NO: 41553 - DNA, 8 bp, Unknown
  misc_feature (1)..( 8): Matrix.001 file - promoters60/1012561
aacaaatt

SEQ ID NO: 41554 - DNA, 7 bp, Unknown
  misc_feature (1)..( 7): Matrix.001 file - promoters60/1012561
tttgctt

SEQ ID NO: 41555 - DNA, 10 bp, Unknown
  misc_feature (1)..( 10): Matrix.001 file - promoters60/1012561
attattgttt

SEQ ID NO: 41556 - DNA, 6 bp, Unknown
  misc_feature (1)..( 6): Matrix.001 file - promoters60/1012561
tcagat

SEQ ID NO: 41557 - DNA, 7 bp, Unknown
  misc_feature (1)..( 7): Matrix.001 file - promoters60/1012561
taaataa

SEQ ID NO: 41558 - DNA, 6 bp, Unknown
  misc_feature (1)..( 6): Matrix.001 file - promoters60/1012561
ataaat

SEQ ID NO: 41559 - DNA, 7 bp, Unknown
  misc_feature (1)..( 7): Matrix.001 file - promoters60/1012561
tatgttt

SEQ ID NO: 41560 - DNA, 7 bp, Unknown
  misc_feature (1)..( 7): Matrix.001 file - promoters60/1012561
caaaaaa

SEQ ID NO: 41561 - DNA, 6 bp, Unknown
  misc_feature (1)..( 6): Matrix.001 file - promoters60/1012561
taaaca

SEQ ID NO: 41562 - DNA, 7 bp, Unknown
  misc_feature (1)..( 7): Matrix.001 file - promoters60/1012561
ttagatc

SEQ ID NO: 41563 - DNA, 7 bp, Unknown
  misc_feature (1)..( 7): Matrix.001 file - promoters60/1012561
atcattt

SEQ ID NO: 41564 - DNA, 7 bp, Unknown
  misc_feature (1)..( 7): Matrix.001 file - promoters60/1012561
gatctat

SEQ ID NO: 41565 - DNA, 6 bp, Unknown
  misc_feature (1)..( 6): Matrix.001 file - promoters60/1012561
ttttca

SEQ ID NO: 41566 - DNA, 7 bp, Unknown
  misc_feature (1)..( 7): Matrix.001 file - promoters60/1012561
cgaacaa

SEQ ID NO: 41567 - DNA, 6 bp, Unknown
  misc_feature (1)..( 6): Matrix.001 file - promoters60/1012561
tatcta

SEQ ID NO: 41568 - DNA, 9 bp, Unknown
  misc_feature (1)..( 9): Matrix.001 file - promoters60/1012580
tcttataat

SEQ ID NO: 41569 - DNA, 7 bp, Unknown
  misc_feature (1)..( 7): Matrix.001 file - promoters60/1012580
acaccaa

SEQ ID NO: 41570 - DNA, 8 bp, Unknown
  misc_feature (1)..( 8): Matrix.001 file - promoters60/1012580
tcttataa

SEQ ID NO: 41571 - DNA, 8 bp, Unknown
  misc_feature (1)..( 8): Matrix.001 file - promoters60/1012580
aaaacaca

SEQ ID NO: 41572 - DNA, 8 bp, Unknown
  misc_feature (1)..( 8): Matrix.001 file - promoters60/1012580
caaacttt

SEQ ID NO: 41573 - DNA, 6 bp, Unknown
  misc_feature (1)..( 6): Matrix.001 file - promoters60/1012580
aatatt

SEQ ID NO: 41574 - DNA, 6 bp, Unknown
  misc_feature (1)..( 6): Matrix.001 file - promoters60/1012580
atcaaa

SEQ ID NO: 41575 - DNA, 7 bp, Unknown
  misc_feature (1)..( 7): Matrix.001 file - promoters60/1012580
caaatcc

SEQ ID NO: 41576 - DNA, 7 bp, Unknown
  misc_feature (1)..( 7): Matrix.001 file - promoters60/1012580
cacaaga

SEQ ID NO: 41577 - DNA, 8 bp, Unknown
  misc_feature (1)..( 8): Matrix.001 file - promoters60/1012580
ctcgcttc

SEQ ID NO: 41578 - DNA, 8 bp, Unknown
  misc_feature (1)..( 8): Matrix.001 file - promoters60/1012580
cttctcga

SEQ ID NO: 41579 - DNA, 11 bp, Unknown
  misc_feature (1)..( 11): Matrix.001 file - promoters60/1012620
ataatttgagt

SEQ ID NO: 41580 - DNA, 8 bp, Unknown
  misc_feature (1)..( 8): Matrix.001 file - promoters60/1012620
aggaggaa

SEQ ID NO: 41581 - DNA, 8 bp, Unknown
  misc_feature (1)..( 8): Matrix.001 file - promoters60/1012620
gttacaac

SEQ ID NO: 41582 - DNA, 10 bp, Unknown
  misc_feature (1)..( 10): Matrix.001 file - promoters60/1012620
aatttataaa

SEQ ID NO: 41583 - DNA, 10 bp, Unknown
  misc_feature (1)..( 10): Matrix.001 file - promoters60/1012620
agaaaaaaga

SEQ ID NO: 41584 - DNA, 9 bp, Unknown
  misc_feature (1)..( 9): Matrix.001 file - promoters60/1012620
acttataaa

SEQ ID NO: 41585 - DNA, 10 bp, Unknown
  misc_feature (1)..( 10): Matrix.001 file - promoters60/1012673
ctaattaaaa

SEQ ID NO: 41586 - DNA, 11 bp, Unknown
  misc_feature (1)..( 11): Matrix.001 file - promoters60/1012673
caaataatttt

SEQ ID NO: 41587 - DNA, 9 bp, Unknown
  misc_feature (1)..( 9): Matrix.001 file - promoters60/1012673
tatcatttt

SEQ ID NO: 41588 - DNA, 11 bp, Unknown
  misc_feature (1)..( 11): Matrix.001 file - promoters60/1012673
agaatccagct

SEQ ID NO: 41589 - DNA, 10 bp, Unknown
  misc_feature (1)..( 10): Matrix.001 file - promoters60/1012673
tcaaataatt

SEQ ID NO: 41590 - DNA, 11 bp, Unknown
  misc_feature (1)..( 11): Matrix.001 file - promoters60/1012673
tgatttgtttg

SEQ ID NO: 41591 - DNA, 8 bp, Unknown
  misc_feature (1)..( 8): Matrix.001 file - promoters60/1012720
ttaagcta

SEQ ID NO: 41592 - DNA, 14 bp, Unknown
  misc_feature (1)..( 14): Matrix.001 file - promoters60/1012720
tttgattcctttaa

SEQ ID NO: 41593 - DNA, 8 bp, Unknown
  misc_feature (1)..( 8): Matrix.001 file - promoters60/1012720
tgttaaaa

SEQ ID NO: 41594 - DNA, 9 bp, Unknown
  misc_feature (1)..( 9): Matrix.001 file - promoters60/1012720
atgttttgc

SEQ ID NO: 41595 - DNA, 7 bp, Unknown
  misc_feature (1)..( 7): Matrix.001 file - promoters60/1012720
aagaaag

SEQ ID NO: 41596 - DNA, 8 bp, Unknown
  misc_feature (1)..( 8): Matrix.001 file - promoters60/1012720
taacttgt

SEQ ID NO: 41597 - DNA, 9 bp, Unknown
  misc_feature (1)..( 9): Matrix.001 file - promoters60/1012720
tgttataaa

SEQ ID NO: 41598 - DNA, 7 bp, Unknown
  misc_feature (1)..( 7): Matrix.001 file - promoters60/1012757
aaaatat

SEQ ID NO: 41599 - DNA, 9 bp, Unknown
  misc_feature (1)..( 9): Matrix.001 file - promoters60/1012757
aaattaaaa

SEQ ID NO: 41600 - DNA, 7 bp, Unknown
  misc_feature (1)..( 7): Matrix.001 file - promoters60/1012757
tctatgt

SEQ ID NO: 41601 - DNA, 11 bp, Unknown
  misc_feature (1)..( 11): Matrix.001 file - promoters60/1012757
tgtttgaacat

SEQ ID NO: 41602 - DNA, 8 bp, Unknown
  misc_feature (1)..( 8): Matrix.001 file - promoters60/1012757
caacgaaa

SEQ ID NO: 41603 - DNA, 6 bp, Unknown
  misc_feature (1)..( 6): Matrix.001 file - promoters60/1012791
ttgttt

SEQ ID NO: 41604 - DNA, 6 bp, Unknown
  misc_feature (1)..( 6): Matrix.001 file - promoters60/1012791
atatat

SEQ ID NO: 41605 - DNA, 6 bp, Unknown
  misc_feature (1)..( 6): Matrix.001 file - promoters60/1012791
attttt

SEQ ID NO: 41606 - DNA, 8 bp, Unknown
  misc_feature (1)..( 8): Matrix.001 file - promoters60/1012791
aaacaaaa

SEQ ID NO: 41607 - DNA, 7 bp, Unknown
  misc_feature (1)..( 7): Matrix.001 file - promoters60/1012791
aataaac

SEQ ID NO: 41608 - DNA, 6 bp, Unknown
  misc_feature (1)..( 6): Matrix.001 file - promoters60/1012791
tttatt

SEQ ID NO: 41609 - DNA, 6 bp, Unknown
  misc_feature (1)..( 6): Matrix.001 file - promoters60/1012791
attaaa

SEQ ID NO: 41610 - DNA, 6 bp, Unknown
  misc_feature (1)..( 6): Matrix.001 file - promoters60/1012791
attaca

SEQ ID NO: 41611 - DNA, 6 bp, Unknown
  misc_feature (1)..( 6): Matrix.001 file - promoters60/1012791
tatatt

SEQ ID NO: 41612 - DNA, 12 bp, Unknown
  misc_feature (1)..( 12): Matrix.001 file - promoters60/1012791
tatatataatgc

SEQ ID NO: 41613 - DNA, 9 bp, Unknown
  misc_feature (1)..( 9): Matrix.001 file - promoters60/1012791
tttttatat

SEQ ID NO: 41614 - DNA, 7 bp, Unknown
  misc_feature (1)..( 7): Matrix.001 file - promoters60/1012791
aacatta

SEQ ID NO: 41615 - DNA, 10 bp, Unknown
  misc_feature (1)..( 10): Matrix.001 file - promoters60/1012791
aaaaacaaat

SEQ ID NO: 41616 - DNA, 8 bp, Unknown
  misc_feature (1)..( 8): Matrix.001 file - promoters60/1012791
aaaaaaac

SEQ ID NO: 41617 - DNA, 7 bp, Unknown
  misc_feature (1)..( 7): Matrix.001 file - promoters60/1012791
accacag

SEQ ID NO: 41618 - DNA, 8 bp, Unknown
  misc_feature (1)..( 8): Matrix.001 file - promoters60/1012791
aaaaaaaa

SEQ ID NO: 41619 - DNA, 6 bp, Unknown
  misc_feature (1)..( 6): Matrix.001 file - promoters60/1012791
aaaaaa

SEQ ID NO: 41620 - DNA, 7 bp, Unknown
  misc_feature (1)..( 7): Matrix.001 file - promoters60/1012791
aaaaaag

SEQ ID NO: 41621 - DNA, 7 bp, Unknown
  misc_feature (1)..( 7): Matrix.001 file - promoters60/1012791
ttctttt

SEQ ID NO: 41622 - DNA, 6 bp, Unknown
  misc_feature (1)..( 6): Matrix.001 file - promoters60/1012791
ataaag

SEQ ID NO: 41623 - DNA, 8 bp, Unknown
  misc_feature (1)..( 8): Matrix.001 file - promoters60/1012791
cttcgcaa

SEQ ID NO: 41624 - DNA, 8 bp, Unknown
  misc_feature (1)..( 8): Matrix.001 file - promoters60/1012791
tttaaaaa

SEQ ID NO: 41625 - DNA, 6 bp, Unknown
  misc_feature (1)..( 6): Matrix.001 file - promoters60/1012791
tcattt

SEQ ID NO: 41626 - DNA, 8 bp, Unknown
  misc_feature (1)..( 8): Matrix.001 file - promoters60/1012791
ttgtttca

SEQ ID NO: 41627 - DNA, 8 bp, Unknown
  misc_feature (1)..( 8): Matrix.001 file - promoters60/1012791
tctatata

SEQ ID NO: 41628 - DNA, 6 bp, Unknown
  misc_feature (1)..( 6): Matrix.001 file - promoters60/1012791
aagata

SEQ ID NO: 41629 - DNA, 11 bp, Unknown
  misc_feature (1)..( 11): Matrix.001 file - promoters60/1012791
atccaccaccg

SEQ ID NO: 41630 - DNA, 11 bp, Unknown
  misc_feature (1)..( 11): Matrix.001 file - promoters60/1012883
gtagatattta

SEQ ID NO: 41631 - DNA, 8 bp, Unknown
  misc_feature (1)..( 8): Matrix.001 file - promoters60/1012883
tgatgaat

SEQ ID NO: 41632 - DNA, 10 bp, Unknown
  misc_feature (1)..( 10): Matrix.001 file - promoters60/1012883
ttagaaaaaa

SEQ ID NO: 41633 - DNA, 11 bp, Unknown
  misc_feature (1)..( 11): Matrix.001 file - promoters60/1012883
cggtacacgtg

SEQ ID NO: 41634 - DNA, 9 bp, Unknown
  misc_feature (1)..( 9): Matrix.001 file - promoters60/1012883
taaaaattg

SEQ ID NO: 41635 - DNA, 9 bp, Unknown
  misc_feature (1)..( 9): Matrix.001 file - promoters60/1012883
aaccattaa

SEQ ID NO: 41636 - DNA, 8 bp, Unknown
  misc_feature (1)..( 8): Matrix.001 file - promoters60/1012883
tagttttg

SEQ ID NO: 41637 - DNA, 14 bp, Unknown
  misc_feature (1)..( 14): Matrix.001 file - promoters60/1012883
tttaaatttgatga

SEQ ID NO: 41638 - DNA, 10 bp, Unknown
  misc_feature (1)..( 10): Matrix.001 file - promoters60/1012906
tgaagaaaaa

SEQ ID NO: 41639 - DNA, 12 bp, Unknown
  misc_feature (1)..( 12): Matrix.001 file - promoters60/1012906
aaaaaaatgttt

SEQ ID NO: 41640 - DNA, 8 bp, Unknown
  misc_feature (1)..( 8): Matrix.001 file - promoters60/1012906
ttaaaaaa

SEQ ID NO: 41641 - DNA, 15 bp, Unknown
  misc_feature (1)..( 15): Matrix.001 file - promoters60/1012906
agttaaaaaatctta

SEQ ID NO: 41642 - DNA, 9 bp, Unknown
  misc_feature (1)..( 9): Matrix.001 file - promoters60/1012906
ataatatct

SEQ ID NO: 41643 - DNA, 11 bp, Unknown
  misc_feature (1)..( 11): Matrix.001 file - promoters60/1012906
gaattgatata

SEQ ID NO: 41644 - DNA, 9 bp, Unknown
  misc_feature (1)..( 9): Matrix.001 file - promoters60/1012906
aaaatccat

SEQ ID NO: 41645 - DNA, 7 bp, Unknown
  misc_feature (1)..( 7): Matrix.001 file - promoters60/1012906
ctatata

SEQ ID NO: 41646 - DNA, 10 bp, Unknown
  misc_feature (1)..( 10): Matrix.001 file - promoters60/1012906
ttgacatatt

SEQ ID NO: 41647 - DNA, 10 bp, Unknown
  misc_feature (1)..( 10): Matrix.001 file - promoters60/1012906
aaatttataa

SEQ ID NO: 41648 - DNA, 10 bp, Unknown
  misc_feature (1)..( 10): Matrix.001 file - promoters60/1012906
agaatttata

SEQ ID NO: 41649 - DNA, 9 bp, Unknown
  misc_feature (1)..( 9): Matrix.001 file - promoters60/1012906
ccaattatt

SEQ ID NO: 41650 - DNA, 9 bp, Unknown
  misc_feature (1)..( 9): Matrix.001 file - promoters60/1012906
gaattgata

SEQ ID NO: 41651 - DNA, 9 bp, Unknown
  misc_feature (1)..( 9): Matrix.001 file - promoters60/1012906
aaatcatat

SEQ ID NO: 41652 - DNA, 11 bp, Unknown
  misc_feature (1)..( 11): Matrix.001 file - promoters60/1012912
tttgaaaaaaa

SEQ ID NO: 41653 - DNA, 8 bp, Unknown
  misc_feature (1)..( 8): Matrix.001 file - promoters60/1012912
atatctac

SEQ ID NO: 41654 - DNA, 11 bp, Unknown
  misc_feature (1)..( 11): Matrix.001 file - promoters60/1012943
taaaaaaataa

SEQ ID NO: 41655 - DNA, 14 bp, Unknown
  misc_feature (1)..( 14): Matrix.001 file - promoters60/1012943
tcaaaatgaaaaat

SEQ ID NO: 41656 - DNA, 12 bp, Unknown
  misc_feature (1)..( 12): Matrix.001 file - promoters60/1012943
ataaaaaataaa

SEQ ID NO: 41657 - DNA, 11 bp, Unknown
  misc_feature (1)..( 11): Matrix.001 file - promoters60/1012943
gaaaagaaata

SEQ ID NO: 41658 - DNA, 10 bp, Unknown
  misc_feature (1)..( 10): Matrix.001 file - promoters60/1012943
aaaagaaaag

SEQ ID NO: 41659 - DNA, 11 bp, Unknown
  misc_feature (1)..( 11): Matrix.001 file - promoters60/1012943
caccaaaaaaa

SEQ ID NO: 41660 - DNA, 12 bp, Unknown
  misc_feature (1)..( 12): Matrix.001 file - promoters60/1012943
ttaaattatttg

SEQ ID NO: 41661 - DNA, 8 bp, Unknown
  misc_feature (1)..( 8): Matrix.001 file - promoters60/1012984
tttgtgaa

SEQ ID NO: 41662 - DNA, 12 bp, Unknown
  misc_feature (1)..( 12): Matrix.001 file - promoters60/1012984
ggtagagataga

SEQ ID NO: 41663 - DNA, 8 bp, Unknown
  misc_feature (1)..( 8): Matrix.001 file - promoters60/1012984
ttgaaatt

SEQ ID NO: 41664 - DNA, 7 bp, Unknown
  misc_feature (1)..( 7): Matrix.001 file - promoters60/1012984
tggattt

SEQ ID NO: 41665 - DNA, 8 bp, Unknown
  misc_feature (1)..( 8): Matrix.001 file - promoters60/1012984
tgaaattt

SEQ ID NO: 41666 - DNA, 6 bp, Unknown
  misc_feature (1)..( 6): Matrix.001 file - promoters60/1012984
atacag

SEQ ID NO: 41667 - DNA, 7 bp, Unknown
  misc_feature (1)..( 7): Matrix.001 file - promoters60/1012984
cggtttg

SEQ ID NO: 41668 - DNA, 9 bp, Unknown
  misc_feature (1)..( 9): Matrix.001 file - promoters60/1013121
gaaaagaaa

SEQ ID NO: 41669 - DNA, 10 bp, Unknown
  misc_feature (1)..( 10): Matrix.001 file - promoters60/1013121
tcaaatttaa

SEQ ID NO: 41670 - DNA, 10 bp, Unknown
  misc_feature (1)..( 10): Matrix.001 file - promoters60/1013121
gatttaagat

SEQ ID NO: 41671 - DNA, 8 bp, Unknown
  misc_feature (1)..( 8): Matrix.001 file - promoters60/1013128
tatatata

SEQ ID NO: 41672 - DNA, 10 bp, Unknown
  misc_feature (1)..( 10): Matrix.001 file - promoters60/1013128
agaaaaaaaa

SEQ ID NO: 41673 - DNA, 8 bp, Unknown
  misc_feature (1)..( 8): Matrix.001 file - promoters60/1013190
gaattaaa

SEQ ID NO: 41674 - DNA, 8 bp, Unknown
  misc_feature (1)..( 8): Matrix.001 file - promoters60/1013190
aaaaaaaa

SEQ ID NO: 41675 - DNA, 7 bp, Unknown
  misc_feature (1)..( 7): Matrix.001 file - promoters60/1013190
attaaaa

SEQ ID NO: 41676 - DNA, 8 bp, Unknown
  misc_feature (1)..( 8): Matrix.001 file - promoters60/1013190
ccaaagaa

SEQ ID NO: 41677 - DNA, 7 bp, Unknown
  misc_feature (1)..( 7): Matrix.001 file - promoters60/1013190
tttattt

SEQ ID NO: 41678 - DNA, 7 bp, Unknown
  misc_feature (1)..( 7): Matrix.001 file - promoters60/1013190
ggtatta

SEQ ID NO: 41679 - DNA, 6 bp, Unknown
  misc_feature (1)..( 6): Matrix.001 file - promoters60/1013190
taaaag

SEQ ID NO: 41680 - DNA, 6 bp, Unknown
  misc_feature (1)..( 6): Matrix.001 file - promoters60/1013190
aaaatt

SEQ ID NO: 41681 - DNA, 9 bp, Unknown
  misc_feature (1)..( 9): Matrix.001 file - promoters60/1013190
gaatatatt

SEQ ID NO: 41682 - DNA, 6 bp, Unknown
  misc_feature (1)..( 6): Matrix.001 file - promoters60/1013190
tgaaat

SEQ ID NO: 41683 - DNA, 8 bp, Unknown
  misc_feature (1)..( 8): Matrix.001 file - promoters60/1013190
aataatta

SEQ ID NO: 41684 - DNA, 6 bp, Unknown
  misc_feature (1)..( 6): Matrix.001 file - promoters60/1013190
agttct

SEQ ID NO: 41685 - DNA, 7 bp, Unknown
  misc_feature (1)..( 7): Matrix.001 file - promoters60/1013190
tataaac

SEQ ID NO: 41686 - DNA, 6 bp, Unknown
  misc_feature (1)..( 6): Matrix.001 file - promoters60/1013190
aaacat

SEQ ID NO: 41687 - DNA, 8 bp, Unknown
  misc_feature (1)..( 8): Matrix.001 file - promoters60/1013190
tttagctt

SEQ ID NO: 41688 - DNA, 6 bp, Unknown
  misc_feature (1)..( 6): Matrix.001 file - promoters60/1013190
gcggaa

SEQ ID NO: 41689 - DNA, 7 bp, Unknown
  misc_feature (1)..( 7): Matrix.001 file - promoters60/1013190
tatcttc

SEQ ID NO: 41690 - DNA, 6 bp, Unknown
  misc_feature (1)..( 6): Matrix.001 file - promoters60/1013190
tccttg

SEQ ID NO: 41691 - DNA, 7 bp, Unknown
  misc_feature (1)..( 7): Matrix.001 file - promoters60/1013190
gatatat

SEQ ID NO: 41692 - DNA, 10 bp, Unknown
  misc_feature (1)..( 10): Matrix.001 file - promoters60/1013208
atttaaattg

SEQ ID NO: 41693 - DNA, 12 bp, Unknown
  misc_feature (1)..( 12): Matrix.001 file - promoters60/1013208
aaatgaaaatat

SEQ ID NO: 41694 - DNA, 7 bp, Unknown
  misc_feature (1)..( 7): Matrix.001 file - promoters60/1013208
taataaa

SEQ ID NO: 41695 - DNA, 6 bp, Unknown
  misc_feature (1)..( 6): Matrix.001 file - promoters60/1013208
atttta

SEQ ID NO: 41696 - DNA, 8 bp, Unknown
  misc_feature (1)..( 8): Matrix.001 file - promoters60/1013208
ttaaaaat

SEQ ID NO: 41697 - DNA, 7 bp, Unknown
  misc_feature (1)..( 7): Matrix.001 file - promoters60/1013208
aagaaat

SEQ ID NO: 41698 - DNA, 10 bp, Unknown
  misc_feature (1)..( 10): Matrix.001 file - promoters60/1013208
aaatttgttg

SEQ ID NO: 41699 - DNA, 9 bp, Unknown
  misc_feature (1)..( 9): Matrix.001 file - promoters60/1013208
ataattaaa

SEQ ID NO: 41700 - DNA, 8 bp, Unknown
  misc_feature (1)..( 8): Matrix.001 file - promoters60/1013208
taaaaatt

SEQ ID NO: 41701 - DNA, 11 bp, Unknown
  misc_feature (1)..( 11): Matrix.001 file - promoters60/1013208
taaataaataa

SEQ ID NO: 41702 - DNA, 17 bp, Unknown
  misc_feature (1)..( 17): Matrix.001 file - promoters60/1013208
aagaaaaaaatactttt

SEQ ID NO: 41703 - DNA, 8 bp, Unknown
  misc_feature (1)..( 8): Matrix.001 file - promoters60/1013242
ttttacat

SEQ ID NO: 41704 - DNA, 11 bp, Unknown
  misc_feature (1)..( 11): Matrix.001 file - promoters60/1013242
atttttaaatt

SEQ ID NO: 41705 - DNA, 10 bp, Unknown
  misc_feature (1)..( 10): Matrix.001 file - promoters60/1013274
ttataatatt

SEQ ID NO: 41706 - DNA, 8 bp, Unknown
  misc_feature (1)..( 8): Matrix.001 file - promoters60/1013274
aatatata

SEQ ID NO: 41707 - DNA, 9 bp, Unknown
  misc_feature (1)..( 9): Matrix.001 file - promoters60/1013274
aaaagaaaa

SEQ ID NO: 41708 - DNA, 9 bp, Unknown
  misc_feature (1)..( 9): Matrix.001 file - promoters60/1013274
tttttgttc

SEQ ID NO: 41709 - DNA, 11 bp, Unknown
  misc_feature (1)..( 11): Matrix.001 file - promoters60/1013274
catttttcttt

SEQ ID NO: 41710 - DNA, 11 bp, Unknown
  misc_feature (1)..( 11): Matrix.001 file - promoters60/1013274
aactttaaata

SEQ ID NO: 41711 - DNA, 6 bp, Unknown
  misc_feature (1)..( 6): Matrix.001 file - promoters60/1013298
ctttca

SEQ ID NO: 41712 - DNA, 6 bp, Unknown
  misc_feature (1)..( 6): Matrix.001 file - promoters60/1013298
agacta

SEQ ID NO: 41713 - DNA, 7 bp, Unknown
  misc_feature (1)..( 7): Matrix.001 file - promoters60/1013298
aaaatta

SEQ ID NO: 41714 - DNA, 6 bp, Unknown
  misc_feature (1)..( 6): Matrix.001 file - promoters60/1013298
ttgaag

SEQ ID NO: 41715 - DNA, 7 bp, Unknown
  misc_feature (1)..( 7): Matrix.001 file - promoters60/1013298
tttaaat

SEQ ID NO: 41716 - DNA, 7 bp, Unknown
  misc_feature (1)..( 7): Matrix.001 file - promoters60/1013298
ttttgtt

SEQ ID NO: 41717 - DNA, 7 bp, Unknown
  misc_feature (1)..( 7): Matrix.001 file - promoters60/1013298
attttaa

SEQ ID NO: 41718 - DNA, 7 bp, Unknown
  misc_feature (1)..( 7): Matrix.001 file - promoters60/1013298
ttaattt

SEQ ID NO: 41719 - DNA, 8 bp, Unknown
  misc_feature (1)..( 8): Matrix.001 file - promoters60/1013298
gtcatttt

SEQ ID NO: 41720 - DNA, 8 bp, Unknown
  misc_feature (1)..( 8): Matrix.001 file - promoters60/1013298
ttttatgg

SEQ ID NO: 41721 - DNA, 6 bp, Unknown
  misc_feature (1)..( 6): Matrix.001 file - promoters60/1013298
atcaaa

SEQ ID NO: 41722 - DNA, 7 bp, Unknown
  misc_feature (1)..( 7): Matrix.001 file - promoters60/1013298
ttaatat

SEQ ID NO: 41723 - DNA, 8 bp, Unknown
  misc_feature (1)..( 8): Matrix.001 file - promoters60/1013298
ttggattt

SEQ ID NO: 41724 - DNA, 6 bp, Unknown
  misc_feature (1)..( 6): Matrix.001 file - promoters60/1013298
ttccat

SEQ ID NO: 41725 - DNA, 8 bp, Unknown
  misc_feature (1)..( 8): Matrix.001 file - promoters60/1013298
atgctttt

SEQ ID NO: 41726 - DNA, 6 bp, Unknown
  misc_feature (1)..( 6): Matrix.001 file - promoters60/1013298
ttctca

SEQ ID NO: 41727 - DNA, 6 bp, Unknown
  misc_feature (1)..( 6): Matrix.001 file - promoters60/1013298
tgtctc

SEQ ID NO: 41728 - DNA, 6 bp, Unknown
  misc_feature (1)..( 6): Matrix.001 file - promoters60/1013298
tatttt

SEQ ID NO: 41729 - DNA, 8 bp, Unknown
  misc_feature (1)..( 8): Matrix.001 file - promoters60/1013298
caattgat

SEQ ID NO: 41730 - DNA, 7 bp, Unknown
  misc_feature (1)..( 7): Matrix.001 file - promoters60/1013298
gaagttt

SEQ ID NO: 41731 - DNA, 6 bp, Unknown
  misc_feature (1)..( 6): Matrix.001 file - promoters60/1013298
aaagtt

SEQ ID NO: 41732 - DNA, 6 bp, Unknown
  misc_feature (1)..( 6): Matrix.001 file - promoters60/1013298
ttgtca

SEQ ID NO: 41733 - DNA, 12 bp, Unknown
  misc_feature (1)..( 12): Matrix.001 file - promoters60/1013310
tcctcttttata

SEQ ID NO: 41734 - DNA, 8 bp, Unknown
  misc_feature (1)..( 8): Matrix.001 file - promoters60/1013310
aattcaaa

SEQ ID NO: 41735 - DNA, 9 bp, Unknown
  misc_feature (1)..( 9): Matrix.001 file - promoters60/1013310
tccactttg

SEQ ID NO: 41736 - DNA, 7 bp, Unknown
  misc_feature (1)..( 7): Matrix.001 file - promoters60/1013314
taaaata

SEQ ID NO: 41737 - DNA, 11 bp, Unknown
  misc_feature (1)..( 11): Matrix.001 file - promoters60/1013314
aaatattttta

SEQ ID NO: 41738 - DNA, 10 bp, Unknown
  misc_feature (1)..( 10): Matrix.001 file - promoters60/1013314
tatatagaaa

SEQ ID NO: 41739 - DNA, 10 bp, Unknown
  misc_feature (1)..( 10): Matrix.001 file - promoters60/1013314
atttttatta

SEQ ID NO: 41740 - DNA, 12 bp, Unknown
  misc_feature (1)..( 12): Matrix.001 file - promoters60/1013314
tcaaaagaaaaa

SEQ ID NO: 41741 - DNA, 8 bp, Unknown
  misc_feature (1)..( 8): Matrix.001 file - promoters60/1013314
aaaaatta

SEQ ID NO: 41742 - DNA, 10 bp, Unknown
  misc_feature (1)..( 10): Matrix.001 file - promoters60/1013314
aaattaaaag

SEQ ID NO: 41743 - DNA, 9 bp, Unknown
  misc_feature (1)..( 9): Matrix.001 file - promoters60/1013314
ttatataaa

SEQ ID NO: 41744 - DNA, 11 bp, Unknown
  misc_feature (1)..( 11): Matrix.001 file - promoters60/1013314
tcaatattatc

SEQ ID NO: 41745 - DNA, 10 bp, Unknown
  misc_feature (1)..( 10): Matrix.001 file - promoters60/1013314
atatttttat

SEQ ID NO: 41746 - DNA, 9 bp, Unknown
  misc_feature (1)..( 9): Matrix.001 file - promoters60/1013314
ataaattat

SEQ ID NO: 41747 - DNA, 5 bp, Unknown
  misc_feature (1)..( 5): Matrix.001 file - promoters60/1013314
atttt

SEQ ID NO: 41748 - DNA, 9 bp, Unknown
  misc_feature (1)..( 9): Matrix.001 file - promoters60/1013314
aacaaaata

SEQ ID NO: 41749 - DNA, 13 bp, Unknown
  misc_feature (1)..( 13): Matrix.001 file - promoters60/1013314
aataaaagaattt

SEQ ID NO: 41750 - DNA, 11 bp, Unknown
  misc_feature (1)..( 11): Matrix.001 file - promoters60/1013314
tcaaaaaaaaa

SEQ ID NO: 41751 - DNA, 13 bp, Unknown
  misc_feature (1)..( 13): Matrix.001 file - promoters60/1013314
ataaagctttaaa

SEQ ID NO: 41752 - DNA, 11 bp, Unknown
  misc_feature (1)..( 11): Matrix.001 file - promoters60/1013314
attttaaaata

SEQ ID NO: 41753 - DNA, 4 bp, Unknown
  misc_feature (1)..( 4): Matrix.001 file - promoters60/1013314
aaat

SEQ ID NO: 41754 - DNA, 10 bp, Unknown
  misc_feature (1)..( 10): Matrix.001 file - promoters60/1013314
ttttaacaaa

SEQ ID NO: 41755 - DNA, 8 bp, Unknown
  misc_feature (1)..( 8): Matrix.001 file - promoters60/1013384
aaaacaga

SEQ ID NO: 41756 - DNA, 7 bp, Unknown
  misc_feature (1)..( 7): Matrix.001 file - promoters60/1013384
ccaatga

SEQ ID NO: 41757 - DNA, 8 bp, Unknown
  misc_feature (1)..( 8): Matrix.001 file - promoters60/1013384
gagcatga

SEQ ID NO: 41758 - DNA, 8 bp, Unknown
  misc_feature (1)..( 8): Matrix.001 file - promoters60/1013384
tccagaag

SEQ ID NO: 41759 - DNA, 6 bp, Unknown
  misc_feature (1)..( 6): Matrix.001 file - promoters60/1013384
gacttg

SEQ ID NO: 41760 - DNA, 6 bp, Unknown
  misc_feature (1)..( 6): Matrix.001 file - promoters60/1013384
tcttct

SEQ ID NO: 41761 - DNA, 6 bp, Unknown
  misc_feature (1)..( 6): Matrix.001 file - promoters60/1013384
caagaa

SEQ ID NO: 41762 - DNA, 6 bp, Unknown
  misc_feature (1)..( 6): Matrix.001 file - promoters60/1013384
tctaaa

SEQ ID NO: 41763 - DNA, 6 bp, Unknown
  misc_feature (1)..( 6): Matrix.001 file - promoters60/1013384
caaacc

SEQ ID NO: 41764 - DNA, 7 bp, Unknown
  misc_feature (1)..( 7): Matrix.001 file - promoters60/1013384
tttaggt

SEQ ID NO: 41765 - DNA, 6 bp, Unknown
  misc_feature (1)..( 6): Matrix.001 file - promoters60/1013384
ttcagt

SEQ ID NO: 41766 - DNA, 15 bp, Unknown
  misc_feature (1)..( 15): Matrix.001 file - promoters60/1013413
taataacaataagaa

SEQ ID NO: 41767 - DNA, 11 bp, Unknown
  misc_feature (1)..( 11): Matrix.001 file - promoters60/1013413
atttaataaaa

SEQ ID NO: 41768 - DNA, 6 bp, Unknown
  misc_feature (1)..( 6): Matrix.001 file - promoters60/1013427
aattca

SEQ ID NO: 41769 - DNA, 6 bp, Unknown
  misc_feature (1)..( 6): Matrix.001 file - promoters60/1013427
caacgg

SEQ ID NO: 41770 - DNA, 8 bp, Unknown
  misc_feature (1)..( 8): Matrix.001 file - promoters60/1013427
tttctctt

SEQ ID NO: 41771 - DNA, 9 bp, Unknown
  misc_feature (1)..( 9): Matrix.001 file - promoters60/1013427
tttatatta

SEQ ID NO: 41772 - DNA, 7 bp, Unknown
  misc_feature (1)..( 7): Matrix.001 file - promoters60/1013427
ttcaatt

SEQ ID NO: 41773 - DNA, 8 bp, Unknown
  misc_feature (1)..( 8): Matrix.001 file - promoters60/1013427
aataattt

SEQ ID NO: 41774 - DNA, 6 bp, Unknown
  misc_feature (1)..( 6): Matrix.001 file - promoters60/1013427
tctttg

SEQ ID NO: 41775 - DNA, 11 bp, Unknown
  misc_feature (1)..( 11): Matrix.001 file - promoters60/1013427
aataatgattt

SEQ ID NO: 41776 - DNA, 7 bp, Unknown
  misc_feature (1)..( 7): Matrix.001 file - promoters60/1013427
ataatta

SEQ ID NO: 41777 - DNA, 6 bp, Unknown
  misc_feature (1)..( 6): Matrix.001 file - promoters60/1013427
ttacaa

SEQ ID NO: 41778 - DNA, 7 bp, Unknown
  misc_feature (1)..( 7): Matrix.001 file - promoters60/1013427
gaaatca

SEQ ID NO: 41779 - DNA, 7 bp, Unknown
  misc_feature (1)..( 7): Matrix.001 file - promoters60/1013497
aaaggaa

SEQ ID NO: 41780 - DNA, 6 bp, Unknown
  misc_feature (1)..( 6): Matrix.001 file - promoters60/1013497
aataaa

SEQ ID NO: 41781 - DNA, 8 bp, Unknown
  misc_feature (1)..( 8): Matrix.001 file - promoters60/1013497
aaatgtta

SEQ ID NO: 41782 - DNA, 8 bp, Unknown
  misc_feature (1)..( 8): Matrix.001 file - promoters60/1013497
aattatca

SEQ ID NO: 41783 - DNA, 6 bp, Unknown
  misc_feature (1)..( 6): Matrix.001 file - promoters60/1013497
aaaatg

SEQ ID NO: 41784 - DNA, 6 bp, Unknown
  misc_feature (1)..( 6): Matrix.001 file - promoters60/1013497
ataaga

SEQ ID NO: 41785 - DNA, 6 bp, Unknown
  misc_feature (1)..( 6): Matrix.001 file - promoters60/1013497
gttgac

SEQ ID NO: 41786 - DNA, 6 bp, Unknown
  misc_feature (1)..( 6): Matrix.001 file - promoters60/1013497
cactca

SEQ ID NO: 41787 - DNA, 6 bp, Unknown
  misc_feature (1)..( 6): Matrix.001 file - promoters60/1013497
ccacca

SEQ ID NO: 41788 - DNA, 6 bp, Unknown
  misc_feature (1)..( 6): Matrix.001 file - promoters60/1013497
cggtga

SEQ ID NO: 41789 - DNA, 9 bp, Unknown
  misc_feature (1)..( 9): Matrix.001 file - promoters60/1013497
gaagtacta

SEQ ID NO: 41790 - DNA, 6 bp, Unknown
  misc_feature (1)..( 6): Matrix.001 file - promoters60/1013497
ccaagt

SEQ ID NO: 41791 - DNA, 7 bp, Unknown
  misc_feature (1)..( 7): Matrix.001 file - promoters60/1013497
tctaagc

SEQ ID NO: 41792 - DNA, 12 bp, Unknown
  misc_feature (1)..( 12): Matrix.001 file - promoters60/1013540
atcttctatgtt

SEQ ID NO: 41793 - DNA, 7 bp, Unknown
  misc_feature (1)..( 7): Matrix.001 file - promoters60/1013629
ggtttct

SEQ ID NO: 41794 - DNA, 8 bp, Unknown
  misc_feature (1)..( 8): Matrix.001 file - promoters60/1013629
agagaaag

SEQ ID NO: 41795 - DNA, 9 bp, Unknown
  misc_feature (1)..( 9): Matrix.001 file - promoters60/1013629
tttcttaga

SEQ ID NO: 41796 - DNA, 8 bp, Unknown
  misc_feature (1)..( 8): Matrix.001 file - promoters60/1013629
ttttcttt

SEQ ID NO: 41797 - DNA, 9 bp, Unknown
  misc_feature (1)..( 9): Matrix.001 file - promoters60/1013641
tattatcat

SEQ ID NO: 41798 - DNA, 12 bp, Unknown
  misc_feature (1)..( 12): Matrix.001 file - promoters60/1013641
tttgacttttaa

SEQ ID NO: 41799 - DNA, 10 bp, Unknown
  misc_feature (1)..( 10): Matrix.001 file - promoters60/1013641
ggattcaaat

SEQ ID NO: 41800 - DNA, 9 bp, Unknown
  misc_feature (1)..( 9): Matrix.001 file - promoters60/1013641
tttaaaata

SEQ ID NO: 41801 - DNA, 11 bp, Unknown
  misc_feature (1)..( 11): Matrix.001 file - promoters60/1013641
tttctacatag

SEQ ID NO: 41802 - DNA, 10 bp, Unknown
  misc_feature (1)..( 10): Matrix.001 file - promoters60/1013641
tctcccttct

SEQ ID NO: 41803 - DNA, 8 bp, Unknown
  misc_feature (1)..( 8): Matrix.001 file - promoters60/1013645
agctcctc

SEQ ID NO: 41804 - DNA, 7 bp, Unknown
  misc_feature (1)..( 7): Matrix.001 file - promoters60/1013645
ttcgtct

SEQ ID NO: 41805 - DNA, 6 bp, Unknown
  misc_feature (1)..( 6): Matrix.001 file - promoters60/1013645
ataaat

SEQ ID NO: 41806 - DNA, 6 bp, Unknown
  misc_feature (1)..( 6): Matrix.001 file - promoters60/1013645
atgatc

SEQ ID NO: 41807 - DNA, 7 bp, Unknown
  misc_feature (1)..( 7): Matrix.001 file - promoters60/1013645
agaattg

SEQ ID NO: 41808 - DNA, 7 bp, Unknown
  misc_feature (1)..( 7): Matrix.001 file - promoters60/1013645
tgtatat

SEQ ID NO: 41809 - DNA, 8 bp, Unknown
  misc_feature (1)..( 8): Matrix.001 file - promoters60/1013645
tctggttt

SEQ ID NO: 41810 - DNA, 7 bp, Unknown
  misc_feature (1)..( 7): Matrix.001 file - promoters60/1013645
tttactt

SEQ ID NO: 41811 - DNA, 8 bp, Unknown
  misc_feature (1)..( 8): Matrix.001 file - promoters60/1013645
cttgtctc

SEQ ID NO: 41812 - DNA, 7 bp, Unknown
  misc_feature (1)..( 7): Matrix.001 file - promoters60/1013645
ttgaagc

SEQ ID NO: 41813 - DNA, 6 bp, Unknown
  misc_feature (1)..( 6): Matrix.001 file - promoters60/1013645
cctttt

SEQ ID NO: 41814 - DNA, 7 bp, Unknown
  misc_feature (1)..( 7): Matrix.001 file - promoters60/1013645
ttttttt

SEQ ID NO: 41815 - DNA, 7 bp, Unknown
  misc_feature (1)..( 7): Matrix.001 file - promoters60/1013645
ggcctat

SEQ ID NO: 41816 - DNA, 8 bp, Unknown
  misc_feature (1)..( 8): Matrix.001 file - promoters60/1013674
ttttgttt

SEQ ID NO: 41817 - DNA, 8 bp, Unknown
  misc_feature (1)..( 8): Matrix.001 file - promoters60/1013674
attacttt

SEQ ID NO: 41818 - DNA, 6 bp, Unknown
  misc_feature (1)..( 6): Matrix.001 file - promoters60/1013674
aaacat

SEQ ID NO: 41819 - DNA, 8 bp, Unknown
  misc_feature (1)..( 8): Matrix.001 file - promoters60/1013674
tgagtttt

SEQ ID NO: 41820 - DNA, 9 bp, Unknown
  misc_feature (1)..( 9): Matrix.001 file - promoters60/1013674
ataagcttt

SEQ ID NO: 41821 - DNA, 12 bp, Unknown
  misc_feature (1)..( 12): Matrix.001 file - promoters60/1013674
tttttgtttcaa

SEQ ID NO: 41822 - DNA, 6 bp, Unknown
  misc_feature (1)..( 6): Matrix.001 file - promoters60/1013674
atatca

SEQ ID NO: 41823 - DNA, 7 bp, Unknown
  misc_feature (1)..( 7): Matrix.001 file - promoters60/1013674
atagttt

SEQ ID NO: 41824 - DNA, 8 bp, Unknown
  misc_feature (1)..( 8): Matrix.001 file - promoters60/1013674
tagcataa

SEQ ID NO: 41825 - DNA, 8 bp, Unknown
  misc_feature (1)..( 8): Matrix.001 file - promoters60/1013674
ttaaaaat

SEQ ID NO: 41826 - DNA, 6 bp, Unknown
  misc_feature (1)..( 6): Matrix.001 file - promoters60/1013674
acaaaa

SEQ ID NO: 41827 - DNA, 7 bp, Unknown
  misc_feature (1)..( 7): Matrix.001 file - promoters60/1013674
ataattt

SEQ ID NO: 41828 - DNA, 7 bp, Unknown
  misc_feature (1)..( 7): Matrix.001 file - promoters60/1013674
tttaata

SEQ ID NO: 41829 - DNA, 7 bp, Unknown
  misc_feature (1)..( 7): Matrix.001 file - promoters60/1013674
attaaat

SEQ ID NO: 41830 - DNA, 8 bp, Unknown
  misc_feature (1)..( 8): Matrix.001 file - promoters60/1013674
aaaacaat

SEQ ID NO: 41831 - DNA, 7 bp, Unknown
  misc_feature (1)..( 7): Matrix.001 file - promoters60/1013674
ataaaat

SEQ ID NO: 41832 - DNA, 7 bp, Unknown
  misc_feature (1)..( 7): Matrix.001 file - promoters60/1013674
taccttt

SEQ ID NO: 41833 - DNA, 7 bp, Unknown
  misc_feature (1)..( 7): Matrix.001 file - promoters60/1013674
tttacta

SEQ ID NO: 41834 - DNA, 6 bp, Unknown
  misc_feature (1)..( 6): Matrix.001 file - promoters60/1013674
atatat

SEQ ID NO: 41835 - DNA, 7 bp, Unknown
  misc_feature (1)..( 7): Matrix.001 file - promoters60/1013674
ataatat

SEQ ID NO: 41836 - DNA, 8 bp, Unknown
  misc_feature (1)..( 8): Matrix.001 file - promoters60/1013674
cttaaaat

SEQ ID NO: 41837 - DNA, 6 bp, Unknown
  misc_feature (1)..( 6): Matrix.001 file - promoters60/1013674
tttcct

SEQ ID NO: 41838 - DNA, 6 bp, Unknown
  misc_feature (1)..( 6): Matrix.001 file - promoters60/1013674
attttt

SEQ ID NO: 41839 - DNA, 7 bp, Unknown
  misc_feature (1)..( 7): Matrix.001 file - promoters60/1013674
tttgtta

SEQ ID NO: 41840 - DNA, 6 bp, Unknown
  misc_feature (1)..( 6): Matrix.001 file - promoters60/1013674
atttaa

SEQ ID NO: 41841 - DNA, 6 bp, Unknown
  misc_feature (1)..( 6): Matrix.001 file - promoters60/1013674
aataga

SEQ ID NO: 41842 - DNA, 8 bp, Unknown
  misc_feature (1)..( 8): Matrix.001 file - promoters60/1013674
aaacaaag

SEQ ID NO: 41843 - DNA, 7 bp, Unknown
  misc_feature (1)..( 7): Matrix.001 file - promoters60/1013674
aacaaaa

SEQ ID NO: 41844 - DNA, 6 bp, Unknown
  misc_feature (1)..( 6): Matrix.001 file - promoters60/1013674
tgtatt

SEQ ID NO: 41845 - DNA, 7 bp, Unknown
  misc_feature (1)..( 7): Matrix.001 file - promoters60/1013674
tatctgt

SEQ ID NO: 41846 - DNA, 7 bp, Unknown
  misc_feature (1)..( 7): Matrix.001 file - promoters60/1013674
attgtat

SEQ ID NO: 41847 - DNA, 11 bp, Unknown
  misc_feature (1)..( 11): Matrix.001 file - promoters60/1013674
aaataataatt

SEQ ID NO: 41848 - DNA, 7 bp, Unknown
  misc_feature (1)..( 7): Matrix.001 file - promoters60/1013690
tttcaga

SEQ ID NO: 41849 - DNA, 11 bp, Unknown
  misc_feature (1)..( 11): Matrix.001 file - promoters60/1013690
taagaggtata

SEQ ID NO: 41850 - DNA, 6 bp, Unknown
  misc_feature (1)..( 6): Matrix.001 file - promoters60/1013690
tatgtt

SEQ ID NO: 41851 - DNA, 6 bp, Unknown
  misc_feature (1)..( 6): Matrix.001 file - promoters60/1013690
caagaa

SEQ ID NO: 41852 - DNA, 8 bp, Unknown
  misc_feature (1)..( 8): Matrix.001 file - promoters60/1013690
attactga

SEQ ID NO: 41853 - DNA, 7 bp, Unknown
  misc_feature (1)..( 7): Matrix.001 file - promoters60/1013690
tatcata

SEQ ID NO: 41854 - DNA, 6 bp, Unknown
  misc_feature (1)..( 6): Matrix.001 file - promoters60/1013690
aatttg

SEQ ID NO: 41855 - DNA, 6 bp, Unknown
  misc_feature (1)..( 6): Matrix.001 file - promoters60/1013690
tataaa

SEQ ID NO: 41856 - DNA, 6 bp, Unknown
  misc_feature (1)..( 6): Matrix.001 file - promoters60/1013690
tctcaa

SEQ ID NO: 41857 - DNA, 7 bp, Unknown
  misc_feature (1)..( 7): Matrix.001 file - promoters60/1013690
aaccaca

SEQ ID NO: 41858 - DNA, 6 bp, Unknown
  misc_feature (1)..( 6): Matrix.001 file - promoters60/1013690
ggctga

SEQ ID NO: 41859 - DNA, 11 bp, Unknown
  misc_feature (1)..( 11): Matrix.001 file - promoters60/1013690
agggtctcaga

SEQ ID NO: 41860 - DNA, 6 bp, Unknown
  misc_feature (1)..( 6): Matrix.001 file - promoters60/1013690
agattt

SEQ ID NO: 41861 - DNA, 6 bp, Unknown
  misc_feature (1)..( 6): Matrix.001 file - promoters60/1013710
acatgt

SEQ ID NO: 41862 - DNA, 8 bp, Unknown
  misc_feature (1)..( 8): Matrix.001 file - promoters60/1013710
taatgagt

SEQ ID NO: 41863 - DNA, 6 bp, Unknown
  misc_feature (1)..( 6): Matrix.001 file - promoters60/1013710
ttttaa

SEQ ID NO: 41864 - DNA, 6 bp, Unknown
  misc_feature (1)..( 6): Matrix.001 file - promoters60/1013710
aaaata

SEQ ID NO: 41865 - DNA, 8 bp, Unknown
  misc_feature (1)..( 8): Matrix.001 file - promoters60/1013710
aagcattg

SEQ ID NO: 41866 - DNA, 6 bp, Unknown
  misc_feature (1)..( 6): Matrix.001 file - promoters60/1013710
tccaca

SEQ ID NO: 41867 - DNA, 7 bp, Unknown
  misc_feature (1)..( 7): Matrix.001 file - promoters60/1013710
ttgaaat

SEQ ID NO: 41868 - DNA, 6 bp, Unknown
  misc_feature (1)..( 6): Matrix.001 file - promoters60/1013710
aagaag

SEQ ID NO: 41869 - DNA, 6 bp, Unknown
  misc_feature (1)..( 6): Matrix.001 file - promoters60/1013710
aataaa

SEQ ID NO: 41870 - DNA, 8 bp, Unknown
  misc_feature (1)..( 8): Matrix.001 file - promoters60/1013710
aaaacttt

SEQ ID NO: 41871 - DNA, 9 bp, Unknown
  misc_feature (1)..( 9): Matrix.001 file - promoters60/1013710
taaaaagag

SEQ ID NO: 41872 - DNA, 7 bp, Unknown
  misc_feature (1)..( 7): Matrix.001 file - promoters60/1013710
tttcaag

SEQ ID NO: 41873 - DNA, 8 bp, Unknown
  misc_feature (1)..( 8): Matrix.001 file - promoters60/1013710
agccatac

SEQ ID NO: 41874 - DNA, 10 bp, Unknown
  misc_feature (1)..( 10): Matrix.001 file - promoters60/1013710
cttgaataac

SEQ ID NO: 41875 - DNA, 9 bp, Unknown
  misc_feature (1)..( 9): Matrix.001 file - promoters60/1013710
taaacgaaa

SEQ ID NO: 41876 - DNA, 6 bp, Unknown
  misc_feature (1)..( 6): Matrix.001 file - promoters60/1013714
tctttt

SEQ ID NO: 41877 - DNA, 8 bp, Unknown
  misc_feature (1)..( 8): Matrix.001 file - promoters60/1013714
atttaaat

SEQ ID NO: 41878 - DNA, 7 bp, Unknown
  misc_feature (1)..( 7): Matrix.001 file - promoters60/1013714
aaaaact

SEQ ID NO: 41879 - DNA, 10 bp, Unknown
  misc_feature (1)..( 10): Matrix.001 file - promoters60/1013714
aaataattat

SEQ ID NO: 41880 - DNA, 6 bp, Unknown
  misc_feature (1)..( 6): Matrix.001 file - promoters60/1013714
atgatc

SEQ ID NO: 41881 - DNA, 7 bp, Unknown
  misc_feature (1)..( 7): Matrix.001 file - promoters60/1013714
cacgaca

SEQ ID NO: 41882 - DNA, 7 bp, Unknown
  misc_feature (1)..( 7): Matrix.001 file - promoters60/1013714
ttcaaaa

SEQ ID NO: 41883 - DNA, 8 bp, Unknown
  misc_feature (1)..( 8): Matrix.001 file - promoters60/1013714
aaaggaag

SEQ ID NO: 41884 - DNA, 9 bp, Unknown
  misc_feature (1)..( 9): Matrix.001 file - promoters60/1013714
gaaaaaagt

SEQ ID NO: 41885 - DNA, 11 bp, Unknown
  misc_feature (1)..( 11): Matrix.001 file - promoters60/1013714
tatataaaagc

SEQ ID NO: 41886 - DNA, 9 bp, Unknown
  misc_feature (1)..( 9): Matrix.001 file - promoters60/1013714
gccatgaac

SEQ ID NO: 41887 - DNA, 8 bp, Unknown
  misc_feature (1)..( 8): Matrix.001 file - promoters60/1013714
cattatca

SEQ ID NO: 41888 - DNA, 8 bp, Unknown
  misc_feature (1)..( 8): Matrix.001 file - promoters60/1013714
atgaaatt

SEQ ID NO: 41889 - DNA, 8 bp, Unknown
  misc_feature (1)..( 8): Matrix.001 file - promoters60/1013714
ttgtattt

SEQ ID NO: 41890 - DNA, 8 bp, Unknown
  misc_feature (1)..( 8): Matrix.001 file - promoters60/1013714
ttaatttt

SEQ ID NO: 41891 - DNA, 6 bp, Unknown
  misc_feature (1)..( 6): Matrix.001 file - promoters60/1013714
aaattt

SEQ ID NO: 41892 - DNA, 7 bp, Unknown
  misc_feature (1)..( 7): Matrix.001 file - promoters60/1013714
aacctta

SEQ ID NO: 41893 - DNA, 9 bp, Unknown
  misc_feature (1)..( 9): Matrix.001 file - promoters60/1013714
cattctaaa

SEQ ID NO: 41894 - DNA, 6 bp, Unknown
  misc_feature (1)..( 6): Matrix.001 file - promoters60/1013714
aagcat

SEQ ID NO: 41895 - DNA, 7 bp, Unknown
  misc_feature (1)..( 7): Matrix.001 file - promoters60/1013714
atttttt

SEQ ID NO: 41896 - DNA, 8 bp, Unknown
  misc_feature (1)..( 8): Matrix.001 file - promoters60/1013714
aaattgct

SEQ ID NO: 41897 - DNA, 8 bp, Unknown
  misc_feature (1)..( 8): Matrix.001 file - promoters60/1013714
aaaaaatg

SEQ ID NO: 41898 - DNA, 6 bp, Unknown
  misc_feature (1)..( 6): Matrix.001 file - promoters60/1013714
aaatat

SEQ ID NO: 41899 - DNA, 6 bp, Unknown
  misc_feature (1)..( 6): Matrix.001 file - promoters60/1013714
aattta

SEQ ID NO: 41900 - DNA, 8 bp, Unknown
  misc_feature (1)..( 8): Matrix.001 file - promoters60/1013764
tattatgt

SEQ ID NO: 41901 - DNA, 8 bp, Unknown
  misc_feature (1)..( 8): Matrix.001 file - promoters60/1013764
taccaatc

SEQ ID NO: 41902 - DNA, 7 bp, Unknown
  misc_feature (1)..( 7): Matrix.001 file - promoters60/1013764
gtaggtt

SEQ ID NO: 41903 - DNA, 6 bp, Unknown
  misc_feature (1)..( 6): Matrix.001 file - promoters60/1013764
gtttct

SEQ ID NO: 41904 - DNA, 6 bp, Unknown
  misc_feature (1)..( 6): Matrix.001 file - promoters60/1013764
gttttg

SEQ ID NO: 41905 - DNA, 6 bp, Unknown
  misc_feature (1)..( 6): Matrix.001 file - promoters60/1013764
tagtaa

SEQ ID NO: 41906 - DNA, 7 bp, Unknown
  misc_feature (1)..( 7): Matrix.001 file - promoters60/1013764
atatctg

SEQ ID NO: 41907 - DNA, 8 bp, Unknown
  misc_feature (1)..( 8): Matrix.001 file - promoters60/1013764
gctaccat

SEQ ID NO: 41908 - DNA, 6 bp, Unknown
  misc_feature (1)..( 6): Matrix.001 file - promoters60/1013764
ggtgag

SEQ ID NO: 41909 - DNA, 11 bp, Unknown
  misc_feature (1)..( 11): Matrix.001 file - promoters60/1013764
acttgtctcct

SEQ ID NO: 41910 - DNA, 7 bp, Unknown
  misc_feature (1)..( 7): Matrix.001 file - promoters60/1013764
gtgctaa

SEQ ID NO: 41911 - DNA, 7 bp, Unknown
  misc_feature (1)..( 7): Matrix.001 file - promoters60/1013764
gatgaag

SEQ ID NO: 41912 - DNA, 7 bp, Unknown
  misc_feature (1)..( 7): Matrix.001 file - promoters60/1013764
tctacct

SEQ ID NO: 41913 - DNA, 7 bp, Unknown
  misc_feature (1)..( 7): Matrix.001 file - promoters60/1013764
cttattg

SEQ ID NO: 41914 - DNA, 7 bp, Unknown
  misc_feature (1)..( 7): Matrix.001 file - promoters60/1013764
gttcctt

SEQ ID NO: 41915 - DNA, 9 bp, Unknown
  misc_feature (1)..( 9): Matrix.001 file - promoters60/1013805
attcttttc

SEQ ID NO: 41916 - DNA, 7 bp, Unknown
  misc_feature (1)..( 7): Matrix.001 file - promoters60/1013850
attataa

SEQ ID NO: 41917 - DNA, 6 bp, Unknown
  misc_feature (1)..( 6): Matrix.001 file - promoters60/1013850
gttcta

SEQ ID NO: 41918 - DNA, 6 bp, Unknown
  misc_feature (1)..( 6): Matrix.001 file - promoters60/1013850
atttga

SEQ ID NO: 41919 - DNA, 6 bp, Unknown
  misc_feature (1)..( 6): Matrix.001 file - promoters60/1013850
ttaaaa

SEQ ID NO: 41920 - DNA, 8 bp, Unknown
  misc_feature (1)..( 8): Matrix.001 file - promoters60/1013850
attgtgtt

SEQ ID NO: 41921 - DNA, 6 bp, Unknown
  misc_feature (1)..( 6): Matrix.001 file - promoters60/1013850
aaaatt

SEQ ID NO: 41922 - DNA, 6 bp, Unknown
  misc_feature (1)..( 6): Matrix.001 file - promoters60/1013850
tttggt

SEQ ID NO: 41923 - DNA, 6 bp, Unknown
  misc_feature (1)..( 6): Matrix.001 file - promoters60/1013850
aaaaaa

SEQ ID NO: 41924 - DNA, 8 bp, Unknown
  misc_feature (1)..( 8): Matrix.001 file - promoters60/1013850
gagaacca

SEQ ID NO: 41925 - DNA, 7 bp, Unknown
  misc_feature (1)..( 7): Matrix.001 file - promoters60/1013850
tgaaacg

SEQ ID NO: 41926 - DNA, 6 bp, Unknown
  misc_feature (1)..( 6): Matrix.001 file - promoters60/1013850
ccattt

SEQ ID NO: 41927 - DNA, 6 bp, Unknown
  misc_feature (1)..( 6): Matrix.001 file - promoters60/1013850
gttttt

SEQ ID NO: 41928 - DNA, 7 bp, Unknown
  misc_feature (1)..( 7): Matrix.001 file - promoters60/1013850
ggcgtcg

SEQ ID NO: 41929 - DNA, 6 bp, Unknown
  misc_feature (1)..( 6): Matrix.001 file - promoters60/1013850
aagccc

SEQ ID NO: 41930 - DNA, 7 bp, Unknown
  misc_feature (1)..( 7): Matrix.001 file - promoters60/1013850
taagaga

SEQ ID NO: 41931 - DNA, 6 bp, Unknown
  misc_feature (1)..( 6): Matrix.001 file - promoters60/1013870
aattta

SEQ ID NO: 41932 - DNA, 8 bp, Unknown
  misc_feature (1)..( 8): Matrix.001 file - promoters60/1013870
tataatta

SEQ ID NO: 41933 - DNA, 10 bp, Unknown
  misc_feature (1)..( 10): Matrix.001 file - promoters60/1013870
aataaaaata

SEQ ID NO: 41934 - DNA, 7 bp, Unknown
  misc_feature (1)..( 7): Matrix.001 file - promoters60/1013870
tggcttg

SEQ ID NO: 41935 - DNA, 12 bp, Unknown
  misc_feature (1)..( 12): Matrix.001 file - promoters60/1013870
taaatttaataa

SEQ ID NO: 41936 - DNA, 8 bp, Unknown
  misc_feature (1)..( 8): Matrix.001 file - promoters60/1013870
aaatctat

SEQ ID NO: 41937 - DNA, 7 bp, Unknown
  misc_feature (1)..( 7): Matrix.001 file - promoters60/1013870
acaatat

SEQ ID NO: 41938 - DNA, 9 bp, Unknown
  misc_feature (1)..( 9): Matrix.001 file - promoters60/1013870
ttacttata

SEQ ID NO: 41939 - DNA, 6 bp, Unknown
  misc_feature (1)..( 6): Matrix.001 file - promoters60/1013870
tacctt

SEQ ID NO: 41940 - DNA, 7 bp, Unknown
  misc_feature (1)..( 7): Matrix.001 file - promoters60/1013870
aataata

SEQ ID NO: 41941 - DNA, 6 bp, Unknown
  misc_feature (1)..( 6): Matrix.001 file - promoters60/1013870
atattt

SEQ ID NO: 41942 - DNA, 7 bp, Unknown
  misc_feature (1)..( 7): Matrix.001 file - promoters60/1013870
tttattt

SEQ ID NO: 41943 - DNA, 8 bp, Unknown
  misc_feature (1)..( 8): Matrix.001 file - promoters60/1013870
ttttgtca

SEQ ID NO: 41944 - DNA, 8 bp, Unknown
  misc_feature (1)..( 8): Matrix.001 file - promoters60/1013870
aattcatt

SEQ ID NO: 41945 - DNA, 7 bp, Unknown
  misc_feature (1)..( 7): Matrix.001 file - promoters60/1013870
aactaaa

SEQ ID NO: 41946 - DNA, 6 bp, Unknown
  misc_feature (1)..( 6): Matrix.001 file - promoters60/1013870
gattta

SEQ ID NO: 41947 - DNA, 12 bp, Unknown
  misc_feature (1)..( 12): Matrix.001 file - promoters60/1013870
tagaattactaa

SEQ ID NO: 41948 - DNA, 7 bp, Unknown
  misc_feature (1)..( 7): Matrix.001 file - promoters60/1013870
taataat

SEQ ID NO: 41949 - DNA, 9 bp, Unknown
  misc_feature (1)..( 9): Matrix.001 file - promoters60/1013870
aatattttt

SEQ ID NO: 41950 - DNA, 6 bp, Unknown
  misc_feature (1)..( 6): Matrix.001 file - promoters60/1013870
atattt

SEQ ID NO: 41951 - DNA, 7 bp, Unknown
  misc_feature (1)..( 7): Matrix.001 file - promoters60/1013870
tatacaa

SEQ ID NO: 41952 - DNA, 11 bp, Unknown
  misc_feature (1)..( 11): Matrix.001 file - promoters60/1013870
ttttctaaaat

SEQ ID NO: 41953 - DNA, 7 bp, Unknown
  misc_feature (1)..( 7): Matrix.001 file - promoters60/1013870
ttataat

SEQ ID NO: 41954 - DNA, 6 bp, Unknown
  misc_feature (1)..( 6): Matrix.001 file - promoters60/1013870
aaaaaa

SEQ ID NO: 41955 - DNA, 8 bp, Unknown
  misc_feature (1)..( 8): Matrix.001 file - promoters60/1013870
taaatttc

SEQ ID NO: 41956 - DNA, 7 bp, Unknown
  misc_feature (1)..( 7): Matrix.001 file - promoters60/1013870
aagagaa

SEQ ID NO: 41957 - DNA, 8 bp, Unknown
  misc_feature (1)..( 8): Matrix.001 file - promoters60/1013878
ataatatg

SEQ ID NO: 41958 - DNA, 9 bp, Unknown
  misc_feature (1)..( 9): Matrix.001 file - promoters60/1013878
atttataaa

SEQ ID NO: 41959 - DNA, 8 bp, Unknown
  misc_feature (1)..( 8): Matrix.001 file - promoters60/1013878
ttacaaga

SEQ ID NO: 41960 - DNA, 10 bp, Unknown
  misc_feature (1)..( 10): Matrix.001 file - promoters60/1013878
taaattctat

SEQ ID NO: 41961 - DNA, 14 bp, Unknown
  misc_feature (1)..( 14): Matrix.001 file - promoters60/1013878
agaaaaaaaaattg

SEQ ID NO: 41962 - DNA, 9 bp, Unknown
  misc_feature (1)..( 9): Matrix.001 file - promoters60/1013878
aaatataat

SEQ ID NO: 41963 - DNA, 10 bp, Unknown
  misc_feature (1)..( 10): Matrix.001 file - promoters60/1013878
ttacccaaaa

SEQ ID NO: 41964 - DNA, 8 bp, Unknown
  misc_feature (1)..( 8): Matrix.001 file - promoters60/1013881
ggataaaa

SEQ ID NO: 41965 - DNA, 11 bp, Unknown
  misc_feature (1)..( 11): Matrix.001 file - promoters60/1013881
agtttattttt

SEQ ID NO: 41966 - DNA, 8 bp, Unknown
  misc_feature (1)..( 8): Matrix.001 file - promoters60/1013881
attttctt

SEQ ID NO: 41967 - DNA, 9 bp, Unknown
  misc_feature (1)..( 9): Matrix.001 file - promoters60/1013881
ttttcttta

SEQ ID NO: 41968 - DNA, 8 bp, Unknown
  misc_feature (1)..( 8): Matrix.001 file - promoters60/1013881
caattttt

SEQ ID NO: 41969 - DNA, 7 bp, Unknown
  misc_feature (1)..( 7): Matrix.001 file - promoters60/1013881
ttactac

SEQ ID NO: 41970 - DNA, 12 bp, Unknown
  misc_feature (1)..( 12): Matrix.001 file - promoters60/1013893
aaaatacacaaa

SEQ ID NO: 41971 - DNA, 9 bp, Unknown
  misc_feature (1)..( 9): Matrix.001 file - promoters60/1013893
attttgtgt

SEQ ID NO: 41972 - DNA, 7 bp, Unknown
  misc_feature (1)..( 7): Matrix.001 file - promoters60/1013904
atataat

SEQ ID NO: 41973 - DNA, 9 bp, Unknown
  misc_feature (1)..( 9): Matrix.001 file - promoters60/1013904
tatttaatt

SEQ ID NO: 41974 - DNA, 10 bp, Unknown
  misc_feature (1)..( 10): Matrix.001 file - promoters60/1013904
tgataaaatc

SEQ ID NO: 41975 - DNA, 8 bp, Unknown
  misc_feature (1)..( 8): Matrix.001 file - promoters60/1013904
aatctaac

SEQ ID NO: 41976 - DNA, 9 bp, Unknown
  misc_feature (1)..( 9): Matrix.001 file - promoters60/1013904
caaaattag

SEQ ID NO: 41977 - DNA, 9 bp, Unknown
  misc_feature (1)..( 9): Matrix.001 file - promoters60/1013907
tttactttc

SEQ ID NO: 41978 - DNA, 8 bp, Unknown
  misc_feature (1)..( 8): Matrix.001 file - promoters60/1013907
aaagattg

SEQ ID NO: 41979 - DNA, 8 bp, Unknown
  misc_feature (1)..( 8): Matrix.001 file - promoters60/1013907
tagatatt

SEQ ID NO: 41980 - DNA, 7 bp, Unknown
  misc_feature (1)..( 7): Matrix.001 file - promoters60/1013907
ccattaa

SEQ ID NO: 41981 - DNA, 9 bp, Unknown
  misc_feature (1)..( 9): Matrix.001 file - promoters60/1013907
actaaatta

SEQ ID NO: 41982 - DNA, 9 bp, Unknown
  misc_feature (1)..( 9): Matrix.001 file - promoters60/1013907
tttaaaatc

SEQ ID NO: 41983 - DNA, 12 bp, Unknown
  misc_feature (1)..( 12): Matrix.001 file - promoters60/1013923
aaaattttagtt

SEQ ID NO: 41984 - DNA, 12 bp, Unknown
  misc_feature (1)..( 12): Matrix.001 file - promoters60/1013923
aaaattttagtt

SEQ ID NO: 41985 - DNA, 11 bp, Unknown
  misc_feature (1)..( 11): Matrix.001 file - promoters60/1013923
atttaatcaaa

SEQ ID NO: 41986 - DNA, 10 bp, Unknown
  misc_feature (1)..( 10): Matrix.001 file - promoters60/1013923
ttcatttaat

SEQ ID NO: 41987 - DNA, 8 bp, Unknown
  misc_feature (1)..( 8): Matrix.001 file - promoters60/1013923
tttcacag

SEQ ID NO: 41988 - DNA, 8 bp, Unknown
  misc_feature (1)..( 8): Matrix.001 file - promoters60/1013923
gataatat

SEQ ID NO: 41989 - DNA, 9 bp, Unknown
  misc_feature (1)..( 9): Matrix.001 file - promoters60/1013923
agatttttg

SEQ ID NO: 41990 - DNA, 9 bp, Unknown
  misc_feature (1)..( 9): Matrix.001 file - promoters60/1013931
agaagcata

SEQ ID NO: 41991 - DNA, 6 bp, Unknown
  misc_feature (1)..( 6): Matrix.001 file - promoters60/1013931
ttcagg

SEQ ID NO: 41992 - DNA, 6 bp, Unknown
  misc_feature (1)..( 6): Matrix.001 file - promoters60/1013931
attggt

SEQ ID NO: 41993 - DNA, 8 bp, Unknown
  misc_feature (1)..( 8): Matrix.001 file - promoters60/1013931
ttagactt

SEQ ID NO: 41994 - DNA, 8 bp, Unknown
  misc_feature (1)..( 8): Matrix.001 file - promoters60/1013931
ttgtgatt

SEQ ID NO: 41995 - DNA, 10 bp, Unknown
  misc_feature (1)..( 10): Matrix.001 file - promoters60/1013931
ttctcttaga

SEQ ID NO: 41996 - DNA, 8 bp, Unknown
  misc_feature (1)..( 8): Matrix.001 file - promoters60/1013931
aaaaattg

SEQ ID NO: 41997 - DNA, 6 bp, Unknown
  misc_feature (1)..( 6): Matrix.001 file - promoters60/1013931
cccttg

SEQ ID NO: 41998 - DNA, 10 bp, Unknown
  misc_feature (1)..( 10): Matrix.001 file - promoters60/1013931
atctctggtg

SEQ ID NO: 41999 - DNA, 7 bp, Unknown
  misc_feature (1)..( 7): Matrix.001 file - promoters60/1013931
tttgtat

SEQ ID NO: 42000 - DNA, 8 bp, Unknown
  misc_feature (1)..( 8): Matrix.001 file - promoters60/1013931
tttgattt

SEQ ID NO: 42001 - DNA, 9 bp, Unknown
  misc_feature (1)..( 9): Matrix.001 file - promoters60/1013931
agttccata

SEQ ID NO: 42002 - DNA, 7 bp, Unknown
  misc_feature (1)..( 7): Matrix.001 file - promoters60/1013931
tctttta

SEQ ID NO: 42003 - DNA, 13 bp, Unknown
  misc_feature (1)..( 13): Matrix.001 file - promoters60/1014010
gtaataaaagaac

SEQ ID NO: 42004 - DNA, 7 bp, Unknown
  misc_feature (1)..( 7): Matrix.001 file - promoters60/1014010
tataaaa

SEQ ID NO: 42005 - DNA, 10 bp, Unknown
  misc_feature (1)..( 10): Matrix.001 file - promoters60/1014050
gaaaaaaaat

SEQ ID NO: 42006 - DNA, 9 bp, Unknown
  misc_feature (1)..( 9): Matrix.001 file - promoters60/1014125
ctaattatt

SEQ ID NO: 42007 - DNA, 8 bp, Unknown
  misc_feature (1)..( 8): Matrix.001 file - promoters60/1014176
aattctat

SEQ ID NO: 42008 - DNA, 11 bp, Unknown
  misc_feature (1)..( 11): Matrix.001 file - promoters60/1014180
tctttgaacat

SEQ ID NO: 42009 - DNA, 7 bp, Unknown
  misc_feature (1)..( 7): Matrix.001 file - promoters60/1014223
aatctgt

SEQ ID NO: 42010 - DNA, 7 bp, Unknown
  misc_feature (1)..( 7): Matrix.001 file - promoters60/1014223
cctacaa

SEQ ID NO: 42011 - DNA, 6 bp, Unknown
  misc_feature (1)..( 6): Matrix.001 file - promoters60/1014223
aagaga

SEQ ID NO: 42012 - DNA, 8 bp, Unknown
  misc_feature (1)..( 8): Matrix.001 file - promoters60/1014223
ttattttt

SEQ ID NO: 42013 - DNA, 6 bp, Unknown
  misc_feature (1)..( 6): Matrix.001 file - promoters60/1014223
aaaaaa

SEQ ID NO: 42014 - DNA, 9 bp, Unknown
  misc_feature (1)..( 9): Matrix.001 file - promoters60/1014223
ttttggtat

SEQ ID NO: 42015 - DNA, 7 bp, Unknown
  misc_feature (1)..( 7): Matrix.001 file - promoters60/1014223
tttaatg

SEQ ID NO: 42016 - DNA, 9 bp, Unknown
  misc_feature (1)..( 9): Matrix.001 file - promoters60/1014223
gtgtattgg

SEQ ID NO: 42017 - DNA, 7 bp, Unknown
  misc_feature (1)..( 7): Matrix.001 file - promoters60/1014223
tgttgta

SEQ ID NO: 42018 - DNA, 6 bp, Unknown
  misc_feature (1)..( 6): Matrix.001 file - promoters60/1014223
caagag

SEQ ID NO: 42019 - DNA, 7 bp, Unknown
  misc_feature (1)..( 7): Matrix.001 file - promoters60/1014223
gaccata

SEQ ID NO: 42020 - DNA, 8 bp, Unknown
  misc_feature (1)..( 8): Matrix.001 file - promoters60/1014259
gcaacaga

SEQ ID NO: 42021 - DNA, 8 bp, Unknown
  misc_feature (1)..( 8): Matrix.001 file - promoters60/1014259
atatatta

SEQ ID NO: 42022 - DNA, 10 bp, Unknown
  misc_feature (1)..( 10): Matrix.001 file - promoters60/1014259
taatgactaa

SEQ ID NO: 42023 - DNA, 7 bp, Unknown
  misc_feature (1)..( 7): Matrix.001 file - promoters60/1014259
taatctg

SEQ ID NO: 42024 - DNA, 8 bp, Unknown
  misc_feature (1)..( 8): Matrix.001 file - promoters60/1014259
aatatata

SEQ ID NO: 42025 - DNA, 8 bp, Unknown
  misc_feature (1)..( 8): Matrix.001 file - promoters60/1014259
aataacaa

SEQ ID NO: 42026 - DNA, 10 bp, Unknown
  misc_feature (1)..( 10): Matrix.001 file - promoters60/1014259
taaaaactaa

SEQ ID NO: 42027 - DNA, 6 bp, Unknown
  misc_feature (1)..( 6): Matrix.001 file - promoters60/1014259
ataaac

SEQ ID NO: 42028 - DNA, 8 bp, Unknown
  misc_feature (1)..( 8): Matrix.001 file - promoters60/1014259
aaacccta

SEQ ID NO: 42029 - DNA, 7 bp, Unknown
  misc_feature (1)..( 7): Matrix.001 file - promoters60/1014259
gatcatt

SEQ ID NO: 42030 - DNA, 9 bp, Unknown
  misc_feature (1)..( 9): Matrix.001 file - promoters60/1014259
ttcgttttc

SEQ ID NO: 42031 - DNA, 8 bp, Unknown
  misc_feature (1)..( 8): Matrix.001 file - promoters60/1014259
tctattta

SEQ ID NO: 42032 - DNA, 7 bp, Unknown
  misc_feature (1)..( 7): Matrix.001 file - promoters60/1014259
taccaaa

SEQ ID NO: 42033 - DNA, 10 bp, Unknown
  misc_feature (1)..( 10): Matrix.001 file - promoters60/1014259
atgtgcgtct

SEQ ID NO: 42034 - DNA, 6 bp, Unknown
  misc_feature (1)..( 6): Matrix.001 file - promoters60/1014259
tgaaaa

SEQ ID NO: 42035 - DNA, 7 bp, Unknown
  misc_feature (1)..( 7): Matrix.001 file - promoters60/1014259
tatctaa

SEQ ID NO: 42036 - DNA, 6 bp, Unknown
  misc_feature (1)..( 6): Matrix.001 file - promoters60/1014259
caactt

SEQ ID NO: 42037 - DNA, 8 bp, Unknown
  misc_feature (1)..( 8): Matrix.001 file - promoters60/1014259
taataacc

SEQ ID NO: 42038 - DNA, 6 bp, Unknown
  misc_feature (1)..( 6): Matrix.001 file - promoters60/1014259
aatggg

SEQ ID NO: 42039 - DNA, 8 bp, Unknown
  misc_feature (1)..( 8): Matrix.001 file - promoters60/1014333
caatgtgt

SEQ ID NO: 42040 - DNA, 10 bp, Unknown
  misc_feature (1)..( 10): Matrix.001 file - promoters60/1014333
atataatttt

SEQ ID NO: 42041 - DNA, 8 bp, Unknown
  misc_feature (1)..( 8): Matrix.001 file - promoters60/1014333
aaaccaaa

SEQ ID NO: 42042 - DNA, 7 bp, Unknown
  misc_feature (1)..( 7): Matrix.001 file - promoters60/1014333
tcgtcaa

SEQ ID NO: 42043 - DNA, 7 bp, Unknown
  misc_feature (1)..( 7): Matrix.001 file - promoters60/1014333
aaacaaa

SEQ ID NO: 42044 - DNA, 8 bp, Unknown
  misc_feature (1)..( 8): Matrix.001 file - promoters60/1014333
taaatata

SEQ ID NO: 42045 - DNA, 8 bp, Unknown
  misc_feature (1)..( 8): Matrix.001 file - promoters60/1014333
taatatta

SEQ ID NO: 42046 - DNA, 6 bp, Unknown
  misc_feature (1)..( 6): Matrix.001 file - promoters60/1014333
tttaaa

SEQ ID NO: 42047 - DNA, 10 bp, Unknown
  misc_feature (1)..( 10): Matrix.001 file - promoters60/1014333
ttaaaaattc

SEQ ID NO: 42048 - DNA, 7 bp, Unknown
  misc_feature (1)..( 7): Matrix.001 file - promoters60/1014333
gttggtt

SEQ ID NO: 42049 - DNA, 7 bp, Unknown
  misc_feature (1)..( 7): Matrix.001 file - promoters60/1014333
aaccgaa

SEQ ID NO: 42050 - DNA, 11 bp, Unknown
  misc_feature (1)..( 11): Matrix.001 file - promoters60/1014333
aatccaaacac

SEQ ID NO: 42051 - DNA, 9 bp, Unknown
  misc_feature (1)..( 9): Matrix.001 file - promoters60/1014333
tgtcgcata

SEQ ID NO: 42052 - DNA, 7 bp, Unknown
  misc_feature (1)..( 7): Matrix.001 file - promoters60/1014333
tttattg

SEQ ID NO: 42053 - DNA, 10 bp, Unknown
  misc_feature (1)..( 10): Matrix.001 file - promoters60/1014362
ccatgttttt

SEQ ID NO: 42054 - DNA, 6 bp, Unknown
  misc_feature (1)..( 6): Matrix.001 file - promoters60/1014362
tttctg

SEQ ID NO: 42055 - DNA, 9 bp, Unknown
  misc_feature (1)..( 9): Matrix.001 file - promoters60/1014387
cctaaaaat

SEQ ID NO: 42056 - DNA, 7 bp, Unknown
  misc_feature (1)..( 7): Matrix.001 file - promoters60/1014387
taaaaat

SEQ ID NO: 42057 - DNA, 13 bp, Unknown
  misc_feature (1)..( 13): Matrix.001 file - promoters60/1014387
tgggaaaattaaa

SEQ ID NO: 42058 - DNA, 11 bp, Unknown
  misc_feature (1)..( 11): Matrix.001 file - promoters60/1014387
gtttctctctt

SEQ ID NO: 42059 - DNA, 11 bp, Unknown
  misc_feature (1)..( 11): Matrix.001 file - promoters60/1014452
tatttatttga

SEQ ID NO: 42060 - DNA, 8 bp, Unknown
  misc_feature (1)..( 8): Matrix.001 file - promoters60/1014452
tataaata

SEQ ID NO: 42061 - DNA, 9 bp, Unknown
  misc_feature (1)..( 9): Matrix.001 file - promoters60/1014452
tcaatattt

SEQ ID NO: 42062 - DNA, 10 bp, Unknown
  misc_feature (1)..( 10): Matrix.001 file - promoters60/1014452
aaaacttaaa

SEQ ID NO: 42063 - DNA, 18 bp, Unknown
  misc_feature (1)..( 18): Matrix.001 file - promoters60/1014452
ctttatcgtccaaacaat

SEQ ID NO: 42064 - DNA, 8 bp, Unknown
  misc_feature (1)..( 8): Matrix.001 file - promoters60/1014452
aatataaa

SEQ ID NO: 42065 - DNA, 11 bp, Unknown
  misc_feature (1)..( 11): Matrix.001 file - promoters60/1014452
aatttttactt

SEQ ID NO: 42066 - DNA, 9 bp, Unknown
  misc_feature (1)..( 9): Matrix.001 file - promoters60/1014452
taaatatat

SEQ ID NO: 42067 - DNA, 8 bp, Unknown
  misc_feature (1)..( 8): Matrix.001 file - promoters60/1014452
actaatat

SEQ ID NO: 42068 - DNA, 11 bp, Unknown
  misc_feature (1)..( 11): Matrix.001 file - promoters60/1014525
taattaaaaaa

SEQ ID NO: 42069 - DNA, 5 bp, Unknown
  misc_feature (1)..( 5): Matrix.001 file - promoters60/1014525
tatat

SEQ ID NO: 42070 - DNA, 11 bp, Unknown
  misc_feature (1)..( 11): Matrix.001 file - promoters60/1014525
ataacaataac

SEQ ID NO: 42071 - DNA, 3 bp, Unknown
  misc_feature (1)..( 3): Matrix.001 file - promoters60/1014525
aaa

SEQ ID NO: 42072 - DNA, 9 bp, Unknown
  misc_feature (1)..( 9): Matrix.001 file - promoters60/1014525
attatatat

SEQ ID NO: 42073 - DNA, 11 bp, Unknown
  misc_feature (1)..( 11): Matrix.001 file - promoters60/1014525
tttacaaaatt

SEQ ID NO: 42074 - DNA, 6 bp, Unknown
  misc_feature (1)..( 6): Matrix.001 file - promoters60/1014573
tttagg

SEQ ID NO: 42075 - DNA, 6 bp, Unknown
  misc_feature (1)..( 6): Matrix.001 file - promoters60/1014573
tttttt

SEQ ID NO: 42076 - DNA, 7 bp, Unknown
  misc_feature (1)..( 7): Matrix.001 file - promoters60/1014573
ggtttta

SEQ ID NO: 42077 - DNA, 9 bp, Unknown
  misc_feature (1)..( 9): Matrix.001 file - promoters60/1014573
tctatagca

SEQ ID NO: 42078 - DNA, 7 bp, Unknown
  misc_feature (1)..( 7): Matrix.001 file - promoters60/1014573
atagttc

SEQ ID NO: 42079 - DNA, 7 bp, Unknown
  misc_feature (1)..( 7): Matrix.001 file - promoters60/1014573
caacaaa

SEQ ID NO: 42080 - DNA, 8 bp, Unknown
  misc_feature (1)..( 8): Matrix.001 file - promoters60/1014573
tataaaat

SEQ ID NO: 42081 - DNA, 10 bp, Unknown
  misc_feature (1)..( 10): Matrix.001 file - promoters60/1014573
ttaatgattc

SEQ ID NO: 42082 - DNA, 8 bp, Unknown
  misc_feature (1)..( 8): Matrix.001 file - promoters60/1014573
aaacacaa

SEQ ID NO: 42083 - DNA, 8 bp, Unknown
  misc_feature (1)..( 8): Matrix.001 file - promoters60/1014573
aagattta

SEQ ID NO: 42084 - DNA, 7 bp, Unknown
  misc_feature (1)..( 7): Matrix.001 file - promoters60/1014573
tgaatat

SEQ ID NO: 42085 - DNA, 15 bp, Unknown
  misc_feature (1)..( 15): Matrix.001 file - promoters60/1014573
tatcagatatgagat

SEQ ID NO: 42086 - DNA, 6 bp, Unknown
  misc_feature (1)..( 6): Matrix.001 file - promoters60/1014573
tactgt

SEQ ID NO: 42087 - DNA, 9 bp, Unknown
  misc_feature (1)..( 9): Matrix.001 file - promoters60/1014573
tcaaaattt

SEQ ID NO: 42088 - DNA, 6 bp, Unknown
  misc_feature (1)..( 6): Matrix.001 file - promoters60/1014573
ttgaaa

SEQ ID NO: 42089 - DNA, 7 bp, Unknown
  misc_feature (1)..( 7): Matrix.001 file - promoters60/1014573
cttctcc

SEQ ID NO: 42090 - DNA, 7 bp, Unknown
  misc_feature (1)..( 7): Matrix.001 file - promoters60/1014573
ttcatgt

SEQ ID NO: 42091 - DNA, 7 bp, Unknown
  misc_feature (1)..( 7): Matrix.001 file - promoters60/1014573
tacctca

SEQ ID NO: 42092 - DNA, 7 bp, Unknown
  misc_feature (1)..( 7): Matrix.001 file - promoters60/1014573
tttgata

SEQ ID NO: 42093 - DNA, 9 bp, Unknown
  misc_feature (1)..( 9): Matrix.001 file - promoters60/1014573
catcattat

SEQ ID NO: 42094 - DNA, 11 bp, Unknown
  misc_feature (1)..( 11): Matrix.001 file - promoters60/1014649
tgctctatact

SEQ ID NO: 42095 - DNA, 6 bp, Unknown
  misc_feature (1)..( 6): Matrix.001 file - promoters60/1014649
caccac

SEQ ID NO: 42096 - DNA, 9 bp, Unknown
  misc_feature (1)..( 9): Matrix.001 file - promoters60/1014649
attctttac

SEQ ID NO: 42097 - DNA, 9 bp, Unknown
  misc_feature (1)..( 9): Matrix.001 file - promoters60/1014649
tttgatttt

SEQ ID NO: 42098 - DNA, 8 bp, Unknown
  misc_feature (1)..( 8): Matrix.001 file - promoters60/1014649
acatatgt

SEQ ID NO: 42099 - DNA, 7 bp, Unknown
  misc_feature (1)..( 7): Matrix.001 file - promoters60/1014649
ttacatt

SEQ ID NO: 42100 - DNA, 6 bp, Unknown
  misc_feature (1)..( 6): Matrix.001 file - promoters60/1014649
tttata

SEQ ID NO: 42101 - DNA, 6 bp, Unknown
  misc_feature (1)..( 6): Matrix.001 file - promoters60/1014649
tcttcg

SEQ ID NO: 42102 - DNA, 7 bp, Unknown
  misc_feature (1)..( 7): Matrix.001 file - promoters60/1014649
gttatca

SEQ ID NO: 42103 - DNA, 9 bp, Unknown
  misc_feature (1)..( 9): Matrix.001 file - promoters60/1014649
aaaaataaa

SEQ ID NO: 42104 - DNA, 6 bp, Unknown
  misc_feature (1)..( 6): Matrix.001 file - promoters60/1014649
taaaat

SEQ ID NO: 42105 - DNA, 9 bp, Unknown
  misc_feature (1)..( 9): Matrix.001 file - promoters60/1014649
aaaataaat

SEQ ID NO: 42106 - DNA, 9 bp, Unknown
  misc_feature (1)..( 9): Matrix.001 file - promoters60/1014649
atttattta

SEQ ID NO: 42107 - DNA, 8 bp, Unknown
  misc_feature (1)..( 8): Matrix.001 file - promoters60/1014649
tctttttt

SEQ ID NO: 42108 - DNA, 6 bp, Unknown
  misc_feature (1)..( 6): Matrix.001 file - promoters60/1014649
ttttaa

SEQ ID NO: 42109 - DNA, 8 bp, Unknown
  misc_feature (1)..( 8): Matrix.001 file - promoters60/1014649
aagtaata

SEQ ID NO: 42110 - DNA, 8 bp, Unknown
  misc_feature (1)..( 8): Matrix.001 file - promoters60/1014649
caaacaag

SEQ ID NO: 42111 - DNA, 6 bp, Unknown
  misc_feature (1)..( 6): Matrix.001 file - promoters60/1014649
actttt

SEQ ID NO: 42112 - DNA, 6 bp, Unknown
  misc_feature (1)..( 6): Matrix.001 file - promoters60/1014649
atttgt

SEQ ID NO: 42113 - DNA, 7 bp, Unknown
  misc_feature (1)..( 7): Matrix.001 file - promoters60/1014649
ttccttt

SEQ ID NO: 42114 - DNA, 11 bp, Unknown
  misc_feature (1)..( 11): Matrix.001 file - promoters60/1014662
ccaaaaatgat

SEQ ID NO: 42115 - DNA, 13 bp, Unknown
  misc_feature (1)..( 13): Matrix.001 file - promoters60/1014662
acttataataaaa

SEQ ID NO: 42116 - DNA, 7 bp, Unknown
  misc_feature (1)..( 7): Matrix.001 file - promoters60/1014662
atataat

SEQ ID NO: 42117 - DNA, 9 bp, Unknown
  misc_feature (1)..( 9): Matrix.001 file - promoters60/1014662
aaaatatat

SEQ ID NO: 42118 - DNA, 11 bp, Unknown
  misc_feature (1)..( 11): Matrix.001 file - promoters60/1014662
ataaaattaat

SEQ ID NO: 42119 - DNA, 12 bp, Unknown
  misc_feature (1)..( 12): Matrix.001 file - promoters60/1014662
ttttgtaaacaa

SEQ ID NO: 42120 - DNA, 8 bp, Unknown
  misc_feature (1)..( 8): Matrix.001 file - promoters60/1014662
aatcaaaa

SEQ ID NO: 42121 - DNA, 11 bp, Unknown
  misc_feature (1)..( 11): Matrix.001 file - promoters60/1014662
tgaccaaaaat

SEQ ID NO: 42122 - DNA, 11 bp, Unknown
  misc_feature (1)..( 11): Matrix.001 file - promoters60/1014662
tgaccaaaaat

SEQ ID NO: 42123 - DNA, 8 bp, Unknown
  misc_feature (1)..( 8): Matrix.001 file - promoters60/1014662
aagtcatt

SEQ ID NO: 42124 - DNA, 8 bp, Unknown
  misc_feature (1)..( 8): Matrix.001 file - promoters60/1014678
cacatgtc

SEQ ID NO: 42125 - DNA, 6 bp, Unknown
  misc_feature (1)..( 6): Matrix.001 file - promoters60/1014678
ttactc

SEQ ID NO: 42126 - DNA, 7 bp, Unknown
  misc_feature (1)..( 7): Matrix.001 file - promoters60/1014678
cataaga

SEQ ID NO: 42127 - DNA, 10 bp, Unknown
  misc_feature (1)..( 10): Matrix.001 file - promoters60/1014678
aaaacaaatc

SEQ ID NO: 42128 - DNA, 6 bp, Unknown
  misc_feature (1)..( 6): Matrix.001 file - promoters60/1014678
aaaact

SEQ ID NO: 42129 - DNA, 10 bp, Unknown
  misc_feature (1)..( 10): Matrix.001 file - promoters60/1014678
cacaatggaa

SEQ ID NO: 42130 - DNA, 11 bp, Unknown
  misc_feature (1)..( 11): Matrix.001 file - promoters60/1014678
aaaaataaatt

SEQ ID NO: 42131 - DNA, 7 bp, Unknown
  misc_feature (1)..( 7): Matrix.001 file - promoters60/1014678
atattgt

SEQ ID NO: 42132 - DNA, 6 bp, Unknown
  misc_feature (1)..( 6): Matrix.001 file - promoters60/1014678
cagtat

SEQ ID NO: 42133 - DNA, 8 bp, Unknown
  misc_feature (1)..( 8): Matrix.001 file - promoters60/1014678
aaagaaaa

SEQ ID NO: 42134 - DNA, 8 bp, Unknown
  misc_feature (1)..( 8): Matrix.001 file - promoters60/1014678
aaactcga

SEQ ID NO: 42135 - DNA, 6 bp, Unknown
  misc_feature (1)..( 6): Matrix.001 file - promoters60/1014678
gtcttc

SEQ ID NO: 42136 - DNA, 6 bp, Unknown
  misc_feature (1)..( 6): Matrix.001 file - promoters60/1014678
accgtt

SEQ ID NO: 42137 - DNA, 7 bp, Unknown
  misc_feature (1)..( 7): Matrix.001 file - promoters60/1014678
catacaa

SEQ ID NO: 42138 - DNA, 7 bp, Unknown
  misc_feature (1)..( 7): Matrix.001 file - promoters60/1014678
caaaaca

SEQ ID NO: 42139 - DNA, 7 bp, Unknown
  misc_feature (1)..( 7): Matrix.001 file - promoters60/1014678
ttcttct

SEQ ID NO: 42140 - DNA, 12 bp, Unknown
  misc_feature (1)..( 12): Matrix.001 file - promoters60/1014693
ttttttataaag

SEQ ID NO: 42141 - DNA, 11 bp, Unknown
  misc_feature (1)..( 11): Matrix.001 file - promoters60/1014693
tgagtctacta

SEQ ID NO: 42142 - DNA, 6 bp, Unknown
  misc_feature (1)..( 6): Matrix.001 file - promoters60/1014771
taaaaa

SEQ ID NO: 42143 - DNA, 11 bp, Unknown
  misc_feature (1)..( 11): Matrix.001 file - promoters60/1014771
tgaaacaaatt

SEQ ID NO: 42144 - DNA, 8 bp, Unknown
  misc_feature (1)..( 8): Matrix.001 file - promoters60/1014778
aagagaag

SEQ ID NO: 42145 - DNA, 6 bp, Unknown
  misc_feature (1)..( 6): Matrix.001 file - promoters60/1014778
catgaa

SEQ ID NO: 42146 - DNA, 6 bp, Unknown
  misc_feature (1)..( 6): Matrix.001 file - promoters60/1014778
attctt

SEQ ID NO: 42147 - DNA, 6 bp, Unknown
  misc_feature (1)..( 6): Matrix.001 file - promoters60/1014778
taattt

SEQ ID NO: 42148 - DNA, 8 bp, Unknown
  misc_feature (1)..( 8): Matrix.001 file - promoters60/1014778
tagtgtct

SEQ ID NO: 42149 - DNA, 8 bp, Unknown
  misc_feature (1)..( 8): Matrix.001 file - promoters60/1014778
cagaaaaa

SEQ ID NO: 42150 - DNA, 8 bp, Unknown
  misc_feature (1)..( 8): Matrix.001 file - promoters60/1014778
tttcgaag

SEQ ID NO: 42151 - DNA, 9 bp, Unknown
  misc_feature (1)..( 9): Matrix.001 file - promoters60/1014778
ggcttatga

SEQ ID NO: 42152 - DNA, 7 bp, Unknown
  misc_feature (1)..( 7): Matrix.001 file - promoters60/1014778
ccaagaa

SEQ ID NO: 42153 - DNA, 9 bp, Unknown
  misc_feature (1)..( 9): Matrix.001 file - promoters60/1014778
acaatacaa

SEQ ID NO: 42154 - DNA, 11 bp, Unknown
  misc_feature (1)..( 11): Matrix.001 file - promoters60/1014778
gaagaacaatg

SEQ ID NO: 42155 - DNA, 8 bp, Unknown
  misc_feature (1)..( 8): Matrix.001 file - promoters60/1014778
gtttatca

SEQ ID NO: 42156 - DNA, 9 bp, Unknown
  misc_feature (1)..( 9): Matrix.001 file - promoters60/1014778
gagaacctc

SEQ ID NO: 42157 - DNA, 6 bp, Unknown
  misc_feature (1)..( 6): Matrix.001 file - promoters60/1014803
ttgctt

SEQ ID NO: 42158 - DNA, 6 bp, Unknown
  misc_feature (1)..( 6): Matrix.001 file - promoters60/1014803
gcaatg

SEQ ID NO: 42159 - DNA, 7 bp, Unknown
  misc_feature (1)..( 7): Matrix.001 file - promoters60/1014803
aatgcat

SEQ ID NO: 42160 - DNA, 7 bp, Unknown
  misc_feature (1)..( 7): Matrix.001 file - promoters60/1014803
tctctga

SEQ ID NO: 42161 - DNA, 6 bp, Unknown
  misc_feature (1)..( 6): Matrix.001 file - promoters60/1014803
taaagt

SEQ ID NO: 42162 - DNA, 6 bp, Unknown
  misc_feature (1)..( 6): Matrix.001 file - promoters60/1014803
tttcaa

SEQ ID NO: 42163 - DNA, 8 bp, Unknown
  misc_feature (1)..( 8): Matrix.001 file - promoters60/1014803
ttcaatat

SEQ ID NO: 42164 - DNA, 9 bp, Unknown
  misc_feature (1)..( 9): Matrix.001 file - promoters60/1014803
aaattggta

SEQ ID NO: 42165 - DNA, 6 bp, Unknown
  misc_feature (1)..( 6): Matrix.001 file - promoters60/1014803
aatagt

SEQ ID NO: 42166 - DNA, 6 bp, Unknown
  misc_feature (1)..( 6): Matrix.001 file - promoters60/1014803
ctttcg

SEQ ID NO: 42167 - DNA, 11 bp, Unknown
  misc_feature (1)..( 11): Matrix.001 file - promoters60/1014803
ttcctagatac

SEQ ID NO: 42168 - DNA, 6 bp, Unknown
  misc_feature (1)..( 6): Matrix.001 file - promoters60/1014803
ttctga

SEQ ID NO: 42169 - DNA, 8 bp, Unknown
  misc_feature (1)..( 8): Matrix.001 file - promoters60/1014803
ctcttgtt

SEQ ID NO: 42170 - DNA, 6 bp, Unknown
  misc_feature (1)..( 6): Matrix.001 file - promoters60/1014803
gatatt

SEQ ID NO: 42171 - DNA, 6 bp, Unknown
  misc_feature (1)..( 6): Matrix.001 file - promoters60/1014803
gttcac

SEQ ID NO: 42172 - DNA, 10 bp, Unknown
  misc_feature (1)..( 10): Matrix.001 file - promoters60/1014885
gttttcattt

SEQ ID NO: 42173 - DNA, 6 bp, Unknown
  misc_feature (1)..( 6): Matrix.001 file - promoters60/1014885
ttaaaa

SEQ ID NO: 42174 - DNA, 7 bp, Unknown
  misc_feature (1)..( 7): Matrix.001 file - promoters60/1014885
aaaaagt

SEQ ID NO: 42175 - DNA, 8 bp, Unknown
  misc_feature (1)..( 8): Matrix.001 file - promoters60/1014885
taccctct

SEQ ID NO: 42176 - DNA, 9 bp, Unknown
  misc_feature (1)..( 9): Matrix.001 file - promoters60/1014885
aaaaactaa

SEQ ID NO: 42177 - DNA, 11 bp, Unknown
  misc_feature (1)..( 11): Matrix.001 file - promoters60/1014895
aatggatagtg

SEQ ID NO: 42178 - DNA, 7 bp, Unknown
  misc_feature (1)..( 7): Matrix.001 file - promoters60/1014895
gaaaatg

SEQ ID NO: 42179 - DNA, 7 bp, Unknown
  misc_feature (1)..( 7): Matrix.001 file - promoters60/1014895
aaaaagc

SEQ ID NO: 42180 - DNA, 8 bp, Unknown
  misc_feature (1)..( 8): Matrix.001 file - promoters60/1014895
ctagcaca

SEQ ID NO: 42181 - DNA, 7 bp, Unknown
  misc_feature (1)..( 7): Matrix.001 file - promoters60/1014895
aatctct

SEQ ID NO: 42182 - DNA, 6 bp, Unknown
  misc_feature (1)..( 6): Matrix.001 file - promoters60/1014895
tataaa

SEQ ID NO: 42183 - DNA, 6 bp, Unknown
  misc_feature (1)..( 6): Matrix.001 file - promoters60/1014895
cacaca

SEQ ID NO: 42184 - DNA, 6 bp, Unknown
  misc_feature (1)..( 6): Matrix.001 file - promoters60/1014895
aaggta

SEQ ID NO: 42185 - DNA, 7 bp, Unknown
  misc_feature (1)..( 7): Matrix.001 file - promoters60/1014895
tataatt

SEQ ID NO: 42186 - DNA, 6 bp, Unknown
  misc_feature (1)..( 6): Matrix.001 file - promoters60/1014895
tcgtta

SEQ ID NO: 42187 - DNA, 8 bp, Unknown
  misc_feature (1)..( 8): Matrix.001 file - promoters60/1014895
cgggaaaa

SEQ ID NO: 42188 - DNA, 7 bp, Unknown
  misc_feature (1)..( 7): Matrix.001 file - promoters60/1014895
ggaatat

SEQ ID NO: 42189 - DNA, 7 bp, Unknown
  misc_feature (1)..( 7): Matrix.001 file - promoters60/1014895
gaaaaaa

SEQ ID NO: 42190 - DNA, 7 bp, Unknown
  misc_feature (1)..( 7): Matrix.001 file - promoters60/1014895
aaaaaaa

SEQ ID NO: 42191 - DNA, 7 bp, Unknown
  misc_feature (1)..( 7): Matrix.001 file - promoters60/1014895
acaaaat

SEQ ID NO: 42192 - DNA, 6 bp, Unknown
  misc_feature (1)..( 6): Matrix.001 file - promoters60/1014895
aatttt

SEQ ID NO: 42193 - DNA, 8 bp, Unknown
  misc_feature (1)..( 8): Matrix.001 file - promoters60/1014895
gaaattgt

SEQ ID NO: 42194 - DNA, 7 bp, Unknown
  misc_feature (1)..( 7): Matrix.001 file - promoters60/1014895
ggtttgg

SEQ ID NO: 42195 - DNA, 6 bp, Unknown
  misc_feature (1)..( 6): Matrix.001 file - promoters60/1014899
cgagtc

SEQ ID NO: 42196 - DNA, 6 bp, Unknown
  misc_feature (1)..( 6): Matrix.001 file - promoters60/1014899
gaaatt

SEQ ID NO: 42197 - DNA, 7 bp, Unknown
  misc_feature (1)..( 7): Matrix.001 file - promoters60/1014899
gacagaa

SEQ ID NO: 42198 - DNA, 8 bp, Unknown
  misc_feature (1)..( 8): Matrix.001 file - promoters60/1014899
aaagatca

SEQ ID NO: 42199 - DNA, 6 bp, Unknown
  misc_feature (1)..( 6): Matrix.001 file - promoters60/1014899
tagtag

SEQ ID NO: 42200 - DNA, 6 bp, Unknown
  misc_feature (1)..( 6): Matrix.001 file - promoters60/1014899
cctttt

SEQ ID NO: 42201 - DNA, 6 bp, Unknown
  misc_feature (1)..( 6): Matrix.001 file - promoters60/1014899
tttgat

SEQ ID NO: 42202 - DNA, 8 bp, Unknown
  misc_feature (1)..( 8): Matrix.001 file - promoters60/1014899
tttaacta

SEQ ID NO: 42203 - DNA, 8 bp, Unknown
  misc_feature (1)..( 8): Matrix.001 file - promoters60/1014899
ctatcttt

SEQ ID NO: 42204 - DNA, 8 bp, Unknown
  misc_feature (1)..( 8): Matrix.001 file - promoters60/1014899
cactaacc

SEQ ID NO: 42205 - DNA, 7 bp, Unknown
  misc_feature (1)..( 7): Matrix.001 file - promoters60/1014899
aatcggt

SEQ ID NO: 42206 - DNA, 6 bp, Unknown
  misc_feature (1)..( 6): Matrix.001 file - promoters60/1014899
gacctc

SEQ ID NO: 42207 - DNA, 8 bp, Unknown
  misc_feature (1)..( 8): Matrix.001 file - promoters60/1014899
ttttaata

SEQ ID NO: 42208 - DNA, 9 bp, Unknown
  misc_feature (1)..( 9): Matrix.001 file - promoters60/1014899
tcttgttta

SEQ ID NO: 42209 - DNA, 7 bp, Unknown
  misc_feature (1)..( 7): Matrix.001 file - promoters60/1014899
aaacata

SEQ ID NO: 42210 - DNA, 7 bp, Unknown
  misc_feature (1)..( 7): Matrix.001 file - promoters60/1014899
caacata

SEQ ID NO: 42211 - DNA, 7 bp, Unknown
  misc_feature (1)..( 7): Matrix.001 file - promoters60/1014899
ttaaaaa

SEQ ID NO: 42212 - DNA, 8 bp, Unknown
  misc_feature (1)..( 8): Matrix.001 file - promoters60/1014899
gtgaaaaa

SEQ ID NO: 42213 - DNA, 8 bp, Unknown
  misc_feature (1)..( 8): Matrix.001 file - promoters60/1014899
tataaata

SEQ ID NO: 42214 - DNA, 11 bp, Unknown
  misc_feature (1)..( 11): Matrix.001 file - promoters60/1014907
ctacatatcat

SEQ ID NO: 42215 - DNA, 7 bp, Unknown
  misc_feature (1)..( 7): Matrix.001 file - promoters60/1014907
ttttcta

SEQ ID NO: 42216 - DNA, 7 bp, Unknown
  misc_feature (1)..( 7): Matrix.001 file - promoters60/1014907
tatcttt

SEQ ID NO: 42217 - DNA, 9 bp, Unknown
  misc_feature (1)..( 9): Matrix.001 file - promoters60/1014907
atttttaat

SEQ ID NO: 42218 - DNA, 9 bp, Unknown
  misc_feature (1)..( 9): Matrix.001 file - promoters60/1014907
caaaaaaaa

SEQ ID NO: 42219 - DNA, 10 bp, Unknown
  misc_feature (1)..( 10): Matrix.001 file - promoters60/1014907
taaaatgatc

SEQ ID NO: 42220 - DNA, 7 bp, Unknown
  misc_feature (1)..( 7): Matrix.001 file - promoters60/1014907
aaaatct

SEQ ID NO: 42221 - DNA, 6 bp, Unknown
  misc_feature (1)..( 6): Matrix.001 file - promoters60/1014926
aataca

SEQ ID NO: 42222 - DNA, 8 bp, Unknown
  misc_feature (1)..( 8): Matrix.001 file - promoters60/1014926
taacacag

SEQ ID NO: 42223 - DNA, 7 bp, Unknown
  misc_feature (1)..( 7): Matrix.001 file - promoters60/1014926
ctcattc

SEQ ID NO: 42224 - DNA, 7 bp, Unknown
  misc_feature (1)..( 7): Matrix.001 file - promoters60/1014926
ccttcct

SEQ ID NO: 42225 - DNA, 8 bp, Unknown
  misc_feature (1)..( 8): Matrix.001 file - promoters60/1014926
cttattta

SEQ ID NO: 42226 - DNA, 6 bp, Unknown
  misc_feature (1)..( 6): Matrix.001 file - promoters60/1014926
aaaagg

SEQ ID NO: 42227 - DNA, 11 bp, Unknown
  misc_feature (1)..( 11): Matrix.001 file - promoters60/1014926
attgttatagg

SEQ ID NO: 42228 - DNA, 7 bp, Unknown
  misc_feature (1)..( 7): Matrix.001 file - promoters60/1014926
ttacaga

SEQ ID NO: 42229 - DNA, 7 bp, Unknown
  misc_feature (1)..( 7): Matrix.001 file - promoters60/1014926
ttacgtt

SEQ ID NO: 42230 - DNA, 8 bp, Unknown
  misc_feature (1)..( 8): Matrix.001 file - promoters60/1014926
taagaaat

SEQ ID NO: 42231 - DNA, 6 bp, Unknown
  misc_feature (1)..( 6): Matrix.001 file - promoters60/1014926
ggctca

SEQ ID NO: 42232 - DNA, 6 bp, Unknown
  misc_feature (1)..( 6): Matrix.001 file - promoters60/1014926
aagttg

SEQ ID NO: 42233 - DNA, 6 bp, Unknown
  misc_feature (1)..( 6): Matrix.001 file - promoters60/1014926
cattct

SEQ ID NO: 42234 - DNA, 6 bp, Unknown
  misc_feature (1)..( 6): Matrix.001 file - promoters60/1014926
tctgga

SEQ ID NO: 42235 - DNA, 7 bp, Unknown
  misc_feature (1)..( 7): Matrix.001 file - promoters60/1014926
cctaaat

SEQ ID NO: 42236 - DNA, 8 bp, Unknown
  misc_feature (1)..( 8): Matrix.001 file - promoters60/1014989
ttttgaaa

SEQ ID NO: 42237 - DNA, 9 bp, Unknown
  misc_feature (1)..( 9): Matrix.001 file - promoters60/1014989
aacaaatat

SEQ ID NO: 42238 - DNA, 7 bp, Unknown
  misc_feature (1)..( 7): Matrix.001 file - promoters60/1014989
atatatg

SEQ ID NO: 42239 - DNA, 6 bp, Unknown
  misc_feature (1)..( 6): Matrix.001 file - promoters60/1014989
aattgg

SEQ ID NO: 42240 - DNA, 6 bp, Unknown
  misc_feature (1)..( 6): Matrix.001 file - promoters60/1014989
gtaata

SEQ ID NO: 42241 - DNA, 8 bp, Unknown
  misc_feature (1)..( 8): Matrix.001 file - promoters60/1014989
aacttatt

SEQ ID NO: 42242 - DNA, 6 bp, Unknown
  misc_feature (1)..( 6): Matrix.001 file - promoters60/1014989
tatttt

SEQ ID NO: 42243 - DNA, 7 bp, Unknown
  misc_feature (1)..( 7): Matrix.001 file - promoters60/1014989
attatat

SEQ ID NO: 42244 - DNA, 7 bp, Unknown
  misc_feature (1)..( 7): Matrix.001 file - promoters60/1014989
agaatat

SEQ ID NO: 42245 - DNA, 7 bp, Unknown
  misc_feature (1)..( 7): Matrix.001 file - promoters60/1014989
ttaaaac

SEQ ID NO: 42246 - DNA, 7 bp, Unknown
  misc_feature (1)..( 7): Matrix.001 file - promoters60/1014989
tttcaaa

SEQ ID NO: 42247 - DNA, 7 bp, Unknown
  misc_feature (1)..( 7): Matrix.001 file - promoters60/1014989
aaccatt

SEQ ID NO: 42248 - DNA, 7 bp, Unknown
  misc_feature (1)..( 7): Matrix.001 file - promoters60/1014989
atgggag

SEQ ID NO: 42249 - DNA, 8 bp, Unknown
  misc_feature (1)..( 8): Matrix.001 file - promoters60/1014989
caaatcaa

SEQ ID NO: 42250 - DNA, 7 bp, Unknown
  misc_feature (1)..( 7): Matrix.001 file - promoters60/1014989
attcaat

SEQ ID NO: 42251 - DNA, 8 bp, Unknown
  misc_feature (1)..( 8): Matrix.001 file - promoters60/1014989
atagcaat

SEQ ID NO: 42252 - DNA, 6 bp, Unknown
  misc_feature (1)..( 6): Matrix.001 file - promoters60/1014989
ttttat

SEQ ID NO: 42253 - DNA, 6 bp, Unknown
  misc_feature (1)..( 6): Matrix.001 file - promoters60/1014989
atattt

SEQ ID NO: 42254 - DNA, 7 bp, Unknown
  misc_feature (1)..( 7): Matrix.001 file - promoters60/1014989
tttcatg

SEQ ID NO: 42255 - DNA, 6 bp, Unknown
  misc_feature (1)..( 6): Matrix.001 file - promoters60/1014989
gatcat

SEQ ID NO: 42256 - DNA, 6 bp, Unknown
  misc_feature (1)..( 6): Matrix.001 file - promoters60/1014989
aaattt

SEQ ID NO: 42257 - DNA, 6 bp, Unknown
  misc_feature (1)..( 6): Matrix.001 file - promoters60/1014989
tgtttt

SEQ ID NO: 42258 - DNA, 6 bp, Unknown
  misc_feature (1)..( 6): Matrix.001 file - promoters60/1014989
atgcaa

SEQ ID NO: 42259 - DNA, 7 bp, Unknown
  misc_feature (1)..( 7): Matrix.001 file - promoters60/1014989
tacattt

SEQ ID NO: 42260 - DNA, 11 bp, Unknown
  misc_feature (1)..( 11): Matrix.001 file - promoters60/1014991
cttgtcttttt

SEQ ID NO: 42261 - DNA, 10 bp, Unknown
  misc_feature (1)..( 10): Matrix.001 file - promoters60/1015030
ttttgaaaaa

SEQ ID NO: 42262 - DNA, 8 bp, Unknown
  misc_feature (1)..( 8): Matrix.001 file - promoters60/1015030
aaaattta

SEQ ID NO: 42263 - DNA, 6 bp, Unknown
  misc_feature (1)..( 6): Matrix.001 file - promoters60/1015030
acaaaa

SEQ ID NO: 42264 - DNA, 10 bp, Unknown
  misc_feature (1)..( 10): Matrix.001 file - promoters60/1015030
ttttgaccta

SEQ ID NO: 42265 - DNA, 8 bp, Unknown
  misc_feature (1)..( 8): Matrix.001 file - promoters60/1015030
aaaaataa

SEQ ID NO: 42266 - DNA, 7 bp, Unknown
  misc_feature (1)..( 7): Matrix.001 file - promoters60/1015030
tccatta

SEQ ID NO: 42267 - DNA, 7 bp, Unknown
  misc_feature (1)..( 7): Matrix.001 file - promoters60/1015030
tttgttc

SEQ ID NO: 42268 - DNA, 7 bp, Unknown
  misc_feature (1)..( 7): Matrix.001 file - promoters60/1015030
tatatac

SEQ ID NO: 42269 - DNA, 7 bp, Unknown
  misc_feature (1)..( 7): Matrix.001 file - promoters60/1015030
atataaa

SEQ ID NO: 42270 - DNA, 7 bp, Unknown
  misc_feature (1)..( 7): Matrix.001 file - promoters60/1015030
tctttag

SEQ ID NO: 42271 - DNA, 8 bp, Unknown
  misc_feature (1)..( 8): Matrix.001 file - promoters60/1015030
agatgttt

SEQ ID NO: 42272 - DNA, 6 bp, Unknown
  misc_feature (1)..( 6): Matrix.001 file - promoters60/1015030
agtttt

SEQ ID NO: 42273 - DNA, 11 bp, Unknown
  misc_feature (1)..( 11): Matrix.001 file - promoters60/1015030
cttatctcgtg

SEQ ID NO: 42274 - DNA, 8 bp, Unknown
  misc_feature (1)..( 8): Matrix.001 file - promoters60/1015030
aatatata

SEQ ID NO: 42275 - DNA, 7 bp, Unknown
  misc_feature (1)..( 7): Matrix.001 file - promoters60/1015030
actaaat

SEQ ID NO: 42276 - DNA, 6 bp, Unknown
  misc_feature (1)..( 6): Matrix.001 file - promoters60/1015030
gttcaa

SEQ ID NO: 42277 - DNA, 6 bp, Unknown
  misc_feature (1)..( 6): Matrix.001 file - promoters60/1015030
tttttt

SEQ ID NO: 42278 - DNA, 6 bp, Unknown
  misc_feature (1)..( 6): Matrix.001 file - promoters60/1015030
actttt

SEQ ID NO: 42279 - DNA, 7 bp, Unknown
  misc_feature (1)..( 7): Matrix.001 file - promoters60/1015030
ttttctt

SEQ ID NO: 42280 - DNA, 8 bp, Unknown
  misc_feature (1)..( 8): Matrix.001 file - promoters60/1015030
tcctcttt

SEQ ID NO: 42281 - DNA, 6 bp, Unknown
  misc_feature (1)..( 6): Matrix.001 file - promoters60/1015030
tgaaag

SEQ ID NO: 42282 - DNA, 7 bp, Unknown
  misc_feature (1)..( 7): Matrix.001 file - promoters60/1015030
gatatac

SEQ ID NO: 42283 - DNA, 7 bp, Unknown
  misc_feature (1)..( 7): Matrix.001 file - promoters60/1015030
ccaaata

SEQ ID NO: 42284 - DNA, 9 bp, Unknown
  misc_feature (1)..( 9): Matrix.001 file - promoters60/1015064
attttagtt

SEQ ID NO: 42285 - DNA, 8 bp, Unknown
  misc_feature (1)..( 8): Matrix.001 file - promoters60/1015064
tattaatg

SEQ ID NO: 42286 - DNA, 7 bp, Unknown
  misc_feature (1)..( 7): Matrix.001 file - promoters60/1015064
aatattt

SEQ ID NO: 42287 - DNA, 8 bp, Unknown
  misc_feature (1)..( 8): Matrix.001 file - promoters60/1015064
tttagttt

SEQ ID NO: 42288 - DNA, 9 bp, Unknown
  misc_feature (1)..( 9): Matrix.001 file - promoters60/1015064
tgaaaccaa

SEQ ID NO: 42289 - DNA, 7 bp, Unknown
  misc_feature (1)..( 7): Matrix.001 file - promoters60/1015064
ttttgat

SEQ ID NO: 42290 - DNA, 9 bp, Unknown
  misc_feature (1)..( 9): Matrix.001 file - promoters60/1015064
aatttattt

SEQ ID NO: 42291 - DNA, 11 bp, Unknown
  misc_feature (1)..( 11): Matrix.001 file - promoters60/1015064
tacgtaacatg

SEQ ID NO: 42292 - DNA, 7 bp, Unknown
  misc_feature (1)..( 7): Matrix.001 file - promoters60/1015092
gtcgaaa

SEQ ID NO: 42293 - DNA, 7 bp, Unknown
  misc_feature (1)..( 7): Matrix.001 file - promoters60/1015092
aaacatt

SEQ ID NO: 42294 - DNA, 10 bp, Unknown
  misc_feature (1)..( 10): Matrix.001 file - promoters60/1015092
taaatttgct

SEQ ID NO: 42295 - DNA, 9 bp, Unknown
  misc_feature (1)..( 9): Matrix.001 file - promoters60/1015092
tcagtaaga

SEQ ID NO: 42296 - DNA, 7 bp, Unknown
  misc_feature (1)..( 7): Matrix.001 file - promoters60/1015092
tttattg

SEQ ID NO: 42297 - DNA, 7 bp, Unknown
  misc_feature (1)..( 7): Matrix.001 file - promoters60/1015092
tgaaaaa

SEQ ID NO: 42298 - DNA, 6 bp, Unknown
  misc_feature (1)..( 6): Matrix.001 file - promoters60/1015092
aatatt

SEQ ID NO: 42299 - DNA, 12 bp, Unknown
  misc_feature (1)..( 12): Matrix.001 file - promoters60/1015092
ttagtttggtct

SEQ ID NO: 42300 - DNA, 6 bp, Unknown
  misc_feature (1)..( 6): Matrix.001 file - promoters60/1015092
ttttat

SEQ ID NO: 42301 - DNA, 9 bp, Unknown
  misc_feature (1)..( 9): Matrix.001 file - promoters60/1015092
attagaaga

SEQ ID NO: 42302 - DNA, 11 bp, Unknown
  misc_feature (1)..( 11): Matrix.001 file - promoters60/1015179
aaactcttata

SEQ ID NO: 42303 - DNA, 7 bp, Unknown
  misc_feature (1)..( 7): Matrix.001 file - promoters60/1015179
tttgaat

SEQ ID NO: 42304 - DNA, 10 bp, Unknown
  misc_feature (1)..( 10): Matrix.001 file - promoters60/1015179
ttattataca

SEQ ID NO: 42305 - DNA, 8 bp, Unknown
  misc_feature (1)..( 8): Matrix.001 file - promoters60/1015179
ccaaattt

SEQ ID NO: 42306 - DNA, 9 bp, Unknown
  misc_feature (1)..( 9): Matrix.001 file - promoters60/1015179
tttcttctc

SEQ ID NO: 42307 - DNA, 8 bp, Unknown
  misc_feature (1)..( 8): Matrix.001 file - promoters60/1015210
ctttattt

SEQ ID NO: 42308 - DNA, 7 bp, Unknown
  misc_feature (1)..( 7): Matrix.001 file - promoters60/1015210
aaataaa

SEQ ID NO: 42309 - DNA, 7 bp, Unknown
  misc_feature (1)..( 7): Matrix.001 file - promoters60/1015210
atgataa

SEQ ID NO: 42310 - DNA, 6 bp, Unknown
  misc_feature (1)..( 6): Matrix.001 file - promoters60/1015214
aaaaca

SEQ ID NO: 42311 - DNA, 6 bp, Unknown
  misc_feature (1)..( 6): Matrix.001 file - promoters60/1015214
tttgtt

SEQ ID NO: 42312 - DNA, 9 bp, Unknown
  misc_feature (1)..( 9): Matrix.001 file - promoters60/1015214
tatataaac

SEQ ID NO: 42313 - DNA, 6 bp, Unknown
  misc_feature (1)..( 6): Matrix.001 file - promoters60/1015214
atatat

SEQ ID NO: 42314 - DNA, 12 bp, Unknown
  misc_feature (1)..( 12): Matrix.001 file - promoters60/1015214
ttcatttatgtt

SEQ ID NO: 42315 - DNA, 11 bp, Unknown
  misc_feature (1)..( 11): Matrix.001 file - promoters60/1015261
acttgtaaatt

SEQ ID NO: 42316 - DNA, 9 bp, Unknown
  misc_feature (1)..( 9): Matrix.001 file - promoters60/1015261
atatataaa

SEQ ID NO: 42317 - DNA, 10 bp, Unknown
  misc_feature (1)..( 10): Matrix.001 file - promoters60/1015261
acttgtaagc

SEQ ID NO: 42318 - DNA, 12 bp, Unknown
  misc_feature (1)..( 12): Matrix.001 file - promoters60/1015261
attagagaaaca

SEQ ID NO: 42319 - DNA, 6 bp, Unknown
  misc_feature (1)..( 6): Matrix.001 file - promoters60/1015261
atttat

SEQ ID NO: 42320 - DNA, 10 bp, Unknown
  misc_feature (1)..( 10): Matrix.001 file - promoters60/1015261
acaattttta

SEQ ID NO: 42321 - DNA, 8 bp, Unknown
  misc_feature (1)..( 8): Matrix.001 file - promoters60/1015264
attttttt

SEQ ID NO: 42322 - DNA, 6 bp, Unknown
  misc_feature (1)..( 6): Matrix.001 file - promoters60/1015264
ataata

SEQ ID NO: 42323 - DNA, 8 bp, Unknown
  misc_feature (1)..( 8): Matrix.001 file - promoters60/1015264
tgtacgaa

SEQ ID NO: 42324 - DNA, 8 bp, Unknown
  misc_feature (1)..( 8): Matrix.001 file - promoters60/1015264
aattaaaa

SEQ ID NO: 42325 - DNA, 7 bp, Unknown
  misc_feature (1)..( 7): Matrix.001 file - promoters60/1015264
aaaatta

SEQ ID NO: 42326 - DNA, 6 bp, Unknown
  misc_feature (1)..( 6): Matrix.001 file - promoters60/1015264
caaggt

SEQ ID NO: 42327 - DNA, 6 bp, Unknown
  misc_feature (1)..( 6): Matrix.001 file - promoters60/1015264
taatta

SEQ ID NO: 42328 - DNA, 8 bp, Unknown
  misc_feature (1)..( 8): Matrix.001 file - promoters60/1015264
tcagatta

SEQ ID NO: 42329 - DNA, 7 bp, Unknown
  misc_feature (1)..( 7): Matrix.001 file - promoters60/1015264
tcgattt

SEQ ID NO: 42330 - DNA, 6 bp, Unknown
  misc_feature (1)..( 6): Matrix.001 file - promoters60/1015264
attagt

SEQ ID NO: 42331 - DNA, 8 bp, Unknown
  misc_feature (1)..( 8): Matrix.001 file - promoters60/1015264
agaaaaaa

SEQ ID NO: 42332 - DNA, 8 bp, Unknown
  misc_feature (1)..( 8): Matrix.001 file - promoters60/1015264
aaatataa

SEQ ID NO: 42333 - DNA, 6 bp, Unknown
  misc_feature (1)..( 6): Matrix.001 file - promoters60/1015264
tctgta

SEQ ID NO: 42334 - DNA, 7 bp, Unknown
  misc_feature (1)..( 7): Matrix.001 file - promoters60/1015264
tcatttg

SEQ ID NO: 42335 - DNA, 7 bp, Unknown
  misc_feature (1)..( 7): Matrix.001 file - promoters60/1015264
tttgaag

SEQ ID NO: 42336 - DNA, 7 bp, Unknown
  misc_feature (1)..( 7): Matrix.001 file - promoters60/1015264
ttaacca

SEQ ID NO: 42337 - DNA, 6 bp, Unknown
  misc_feature (1)..( 6): Matrix.001 file - promoters60/1015264
tgacat

SEQ ID NO: 42338 - DNA, 7 bp, Unknown
  misc_feature (1)..( 7): Matrix.001 file - promoters60/1015264
tatcatt

SEQ ID NO: 42339 - DNA, 7 bp, Unknown
  misc_feature (1)..( 7): Matrix.001 file - promoters60/1015264
gaatttg

SEQ ID NO: 42340 - DNA, 7 bp, Unknown
  misc_feature (1)..( 7): Matrix.001 file - promoters60/1015264
tttgatt

SEQ ID NO: 42341 - DNA, 7 bp, Unknown
  misc_feature (1)..( 7): Matrix.001 file - promoters60/1015264
ttagatc

SEQ ID NO: 42342 - DNA, 7 bp, Unknown
  misc_feature (1)..( 7): Matrix.001 file - promoters60/1015337
aaacaaa

SEQ ID NO: 42343 - DNA, 7 bp, Unknown
  misc_feature (1)..( 7): Matrix.001 file - promoters60/1015360
gttatat

SEQ ID NO: 42344 - DNA, 7 bp, Unknown
  misc_feature (1)..( 7): Matrix.001 file - promoters60/1015360
ctaataa

SEQ ID NO: 42345 - DNA, 8 bp, Unknown
  misc_feature (1)..( 8): Matrix.001 file - promoters60/1015360
atttcatt

SEQ ID NO: 42346 - DNA, 13 bp, Unknown
  misc_feature (1)..( 13): Matrix.001 file - promoters60/1015360
accaaaaaagaaa

SEQ ID NO: 42347 - DNA, 7 bp, Unknown
  misc_feature (1)..( 7): Matrix.001 file - promoters60/1015360
aaaaaaa

SEQ ID NO: 42348 - DNA, 10 bp, Unknown
  misc_feature (1)..( 10): Matrix.001 file - promoters60/1015360
gaaaaataaa

SEQ ID NO: 42349 - DNA, 9 bp, Unknown
  misc_feature (1)..( 9): Matrix.001 file - promoters60/1015475
gtttccttt

SEQ ID NO: 42350 - DNA, 8 bp, Unknown
  misc_feature (1)..( 8): Matrix.001 file - promoters60/1015475
aaccaata

SEQ ID NO: 42351 - DNA, 9 bp, Unknown
  misc_feature (1)..( 9): Matrix.001 file - promoters60/1015475
tttccttat

SEQ ID NO: 42352 - DNA, 12 bp, Unknown
  misc_feature (1)..( 12): Matrix.001 file - promoters60/1015524
acttgaatatta

SEQ ID NO: 42353 - DNA, 7 bp, Unknown
  misc_feature (1)..( 7): Matrix.001 file - promoters60/1015524
agatata

SEQ ID NO: 42354 - DNA, 9 bp, Unknown
  misc_feature (1)..( 9): Matrix.001 file - promoters60/1015524
atttttttc

SEQ ID NO: 42355 - DNA, 12 bp, Unknown
  misc_feature (1)..( 12): Matrix.001 file - promoters60/1015537
aaaaaatttaag

SEQ ID NO: 42356 - DNA, 7 bp, Unknown
  misc_feature (1)..( 7): Matrix.001 file - promoters60/1015537
aatcaat

SEQ ID NO: 42357 - DNA, 7 bp, Unknown
  misc_feature (1)..( 7): Matrix.001 file - promoters60/1015537
aatcaaa

SEQ ID NO: 42358 - DNA, 9 bp, Unknown
  misc_feature (1)..( 9): Matrix.001 file - promoters60/1015537
ctaatttaa

SEQ ID NO: 42359 - DNA, 8 bp, Unknown
  misc_feature (1)..( 8): Matrix.001 file - promoters60/1015537
atataaat

SEQ ID NO: 42360 - DNA, 11 bp, Unknown
  misc_feature (1)..( 11): Matrix.001 file - promoters60/1015537
ttagtttccta

SEQ ID NO: 42361 - DNA, 9 bp, Unknown
  misc_feature (1)..( 9): Matrix.001 file - promoters60/1015597
gagtttgtt

SEQ ID NO: 42362 - DNA, 7 bp, Unknown
  misc_feature (1)..( 7): Matrix.001 file - promoters60/1015661
attaata

SEQ ID NO: 42363 - DNA, 8 bp, Unknown
  misc_feature (1)..( 8): Matrix.001 file - promoters60/1015661
tttataat

SEQ ID NO: 42364 - DNA, 9 bp, Unknown
  misc_feature (1)..( 9): Matrix.001 file - promoters60/1015661
tatataaaa

SEQ ID NO: 42365 - DNA, 6 bp, Unknown
  misc_feature (1)..( 6): Matrix.001 file - promoters60/1015661
ttaatg

SEQ ID NO: 42366 - DNA, 7 bp, Unknown
  misc_feature (1)..( 7): Matrix.001 file - promoters60/1015661
gaaatat

SEQ ID NO: 42367 - DNA, 6 bp, Unknown
  misc_feature (1)..( 6): Matrix.001 file - promoters60/1015661
aaatgt

SEQ ID NO: 42368 - DNA, 7 bp, Unknown
  misc_feature (1)..( 7): Matrix.001 file - promoters60/1015661
tgtacac

SEQ ID NO: 42369 - DNA, 9 bp, Unknown
  misc_feature (1)..( 9): Matrix.001 file - promoters60/1015661
aaagcaatg

SEQ ID NO: 42370 - DNA, 6 bp, Unknown
  misc_feature (1)..( 6): Matrix.001 file - promoters60/1015661
aaacaa

SEQ ID NO: 42371 - DNA, 8 bp, Unknown
  misc_feature (1)..( 8): Matrix.001 file - promoters60/1015661
aaccaaaa

SEQ ID NO: 42372 - DNA, 6 bp, Unknown
  misc_feature (1)..( 6): Matrix.001 file - promoters60/1015661
caaaga

SEQ ID NO: 42373 - DNA, 6 bp, Unknown
  misc_feature (1)..( 6): Matrix.001 file - promoters60/1015661
attatt

SEQ ID NO: 42374 - DNA, 7 bp, Unknown
  misc_feature (1)..( 7): Matrix.001 file - promoters60/1015661
tttgtga

SEQ ID NO: 42375 - DNA, 6 bp, Unknown
  misc_feature (1)..( 6): Matrix.001 file - promoters60/1015661
taaaaa

SEQ ID NO: 42376 - DNA, 6 bp, Unknown
  misc_feature (1)..( 6): Matrix.001 file - promoters60/1015661
atattt

SEQ ID NO: 42377 - DNA, 9 bp, Unknown
  misc_feature (1)..( 9): Matrix.001 file - promoters60/1015661
tagtgtaaa

SEQ ID NO: 42378 - DNA, 6 bp, Unknown
  misc_feature (1)..( 6): Matrix.001 file - promoters60/1015661
ctaatt

SEQ ID NO: 42379 - DNA, 8 bp, Unknown
  misc_feature (1)..( 8): Matrix.001 file - promoters60/1015676
ttttgaaa

SEQ ID NO: 42380 - DNA, 8 bp, Unknown
  misc_feature (1)..( 8): Matrix.001 file - promoters60/1015676
aatatttt

SEQ ID NO: 42381 - DNA, 13 bp, Unknown
  misc_feature (1)..( 13): Matrix.001 file - promoters60/1015676
attatatcaacat

SEQ ID NO: 42382 - DNA, 8 bp, Unknown
  misc_feature (1)..( 8): Matrix.001 file - promoters60/1015676
ttaaaaca

SEQ ID NO: 42383 - DNA, 8 bp, Unknown
  misc_feature (1)..( 8): Matrix.001 file - promoters60/1015676
gtttcaaa

SEQ ID NO: 42384 - DNA, 8 bp, Unknown
  misc_feature (1)..( 8): Matrix.001 file - promoters60/1015748
gttttaat

SEQ ID NO: 42385 - DNA, 10 bp, Unknown
  misc_feature (1)..( 10): Matrix.001 file - promoters60/1015748
caattttgtt

SEQ ID NO: 42386 - DNA, 8 bp, Unknown
  misc_feature (1)..( 8): Matrix.001 file - promoters60/1015748
ttaaaaaa

SEQ ID NO: 42387 - DNA, 8 bp, Unknown
  misc_feature (1)..( 8): Matrix.001 file - promoters60/1015778
attatccc

SEQ ID NO: 42388 - DNA, 11 bp, Unknown
  misc_feature (1)..( 11): Matrix.001 file - promoters60/1015778
taaaataaatt

SEQ ID NO: 42389 - DNA, 12 bp, Unknown
  misc_feature (1)..( 12): Matrix.001 file - promoters60/1015778
aacaaaaaaaaa

SEQ ID NO: 42390 - DNA, 7 bp, Unknown
  misc_feature (1)..( 7): Matrix.001 file - promoters60/1015778
aaaagat

SEQ ID NO: 42391 - DNA, 9 bp, Unknown
  misc_feature (1)..( 9): Matrix.001 file - promoters60/1015778
actctaaaa

SEQ ID NO: 42392 - DNA, 8 bp, Unknown
  misc_feature (1)..( 8): Matrix.001 file - promoters60/1015778
tttgggcc

SEQ ID NO: 42393 - DNA, 12 bp, Unknown
  misc_feature (1)..( 12): Matrix.001 file - promoters60/1015778
aataaaatacta

SEQ ID NO: 42394 - DNA, 9 bp, Unknown
  misc_feature (1)..( 9): Matrix.001 file - promoters60/1015848
gtttccttt

SEQ ID NO: 42395 - DNA, 8 bp, Unknown
  misc_feature (1)..( 8): Matrix.001 file - promoters60/1015848
aaccaata

SEQ ID NO: 42396 - DNA, 9 bp, Unknown
  misc_feature (1)..( 9): Matrix.001 file - promoters60/1015848
tttccttat

SEQ ID NO: 42397 - DNA, 7 bp, Unknown
  misc_feature (1)..( 7): Matrix.001 file - promoters60/1016056
tgtattg

SEQ ID NO: 42398 - DNA, 6 bp, Unknown
  misc_feature (1)..( 6): Matrix.001 file - promoters60/1016056
attaaa

SEQ ID NO: 42399 - DNA, 8 bp, Unknown
  misc_feature (1)..( 8): Matrix.001 file - promoters60/1016056
cagtaact

SEQ ID NO: 42400 - DNA, 8 bp, Unknown
  misc_feature (1)..( 8): Matrix.001 file - promoters60/1016056
ataaaagt

SEQ ID NO: 42401 - DNA, 11 bp, Unknown
  misc_feature (1)..( 11): Matrix.001 file - promoters60/1016056
aataaaataaa

SEQ ID NO: 42402 - DNA, 6 bp, Unknown
  misc_feature (1)..( 6): Matrix.001 file - promoters60/1016056
tttatt

SEQ ID NO: 42403 - DNA, 11 bp, Unknown
  misc_feature (1)..( 11): Matrix.001 file - promoters60/1016056
aataaaaactt

SEQ ID NO: 42404 - DNA, 7 bp, Unknown
  misc_feature (1)..( 7): Matrix.001 file - promoters60/1016056
ttgagaa

SEQ ID NO: 42405 - DNA, 6 bp, Unknown
  misc_feature (1)..( 6): Matrix.001 file - promoters60/1016056
taaaaa

SEQ ID NO: 42406 - DNA, 6 bp, Unknown
  misc_feature (1)..( 6): Matrix.001 file - promoters60/1016056
tgttat

SEQ ID NO: 42407 - DNA, 6 bp, Unknown
  misc_feature (1)..( 6): Matrix.001 file - promoters60/1016056
agtaaa

SEQ ID NO: 42408 - DNA, 7 bp, Unknown
  misc_feature (1)..( 7): Matrix.001 file - promoters60/1016056
aatcggg

SEQ ID NO: 42409 - DNA, 8 bp, Unknown
  misc_feature (1)..( 8): Matrix.001 file - promoters60/1016056
gaaacaaa

SEQ ID NO: 42410 - DNA, 7 bp, Unknown
  misc_feature (1)..( 7): Matrix.001 file - promoters60/1016056
cccacta

SEQ ID NO: 42411 - DNA, 9 bp, Unknown
  misc_feature (1)..( 9): Matrix.001 file - promoters60/1016056
aaagaaaag

SEQ ID NO: 42412 - DNA, 7 bp, Unknown
  misc_feature (1)..( 7): Matrix.001 file - promoters60/1016056
gtatata

SEQ ID NO: 42413 - DNA, 14 bp, Unknown
  misc_feature (1)..( 14): Matrix.001 file - promoters60/1016094
cactgtgattgaat

SEQ ID NO: 42414 - DNA, 9 bp, Unknown
  misc_feature (1)..( 9): Matrix.001 file - promoters60/1016094
gaaaaaaaa

SEQ ID NO: 42415 - DNA, 7 bp, Unknown
  misc_feature (1)..( 7): Matrix.001 file - promoters60/1016133
aaaaaat

SEQ ID NO: 42416 - DNA, 7 bp, Unknown
  misc_feature (1)..( 7): Matrix.001 file - promoters60/1016133
atacaaa

SEQ ID NO: 42417 - DNA, 7 bp, Unknown
  misc_feature (1)..( 7): Matrix.001 file - promoters60/1016133
aaatttt

SEQ ID NO: 42418 - DNA, 6 bp, Unknown
  misc_feature (1)..( 6): Matrix.001 file - promoters60/1016133
ttttat

SEQ ID NO: 42419 - DNA, 8 bp, Unknown
  misc_feature (1)..( 8): Matrix.001 file - promoters60/1016133
ataacatt

SEQ ID NO: 42420 - DNA, 6 bp, Unknown
  misc_feature (1)..( 6): Matrix.001 file - promoters60/1016133
ttaatt

SEQ ID NO: 42421 - DNA, 10 bp, Unknown
  misc_feature (1)..( 10): Matrix.001 file - promoters60/1016133
gtatatcaaa

SEQ ID NO: 42422 - DNA, 6 bp, Unknown
  misc_feature (1)..( 6): Matrix.001 file - promoters60/1016133
tttgaa

SEQ ID NO: 42423 - DNA, 8 bp, Unknown
  misc_feature (1)..( 8): Matrix.001 file - promoters60/1016133
aacattca

SEQ ID NO: 42424 - DNA, 6 bp, Unknown
  misc_feature (1)..( 6): Matrix.001 file - promoters60/1016133
ctctat

SEQ ID NO: 42425 - DNA, 8 bp, Unknown
  misc_feature (1)..( 8): Matrix.001 file - promoters60/1016133
atttgatg

SEQ ID NO: 42426 - DNA, 7 bp, Unknown
  misc_feature (1)..( 7): Matrix.001 file - promoters60/1016133
gatatat

SEQ ID NO: 42427 - DNA, 7 bp, Unknown
  misc_feature (1)..( 7): Matrix.001 file - promoters60/1016133
tatttag

SEQ ID NO: 42428 - DNA, 7 bp, Unknown
  misc_feature (1)..( 7): Matrix.001 file - promoters60/1016133
atcgttt

SEQ ID NO: 42429 - DNA, 6 bp, Unknown
  misc_feature (1)..( 6): Matrix.001 file - promoters60/1016133
atttta

SEQ ID NO: 42430 - DNA, 6 bp, Unknown
  misc_feature (1)..( 6): Matrix.001 file - promoters60/1016133
aataat

SEQ ID NO: 42431 - DNA, 8 bp, Unknown
  misc_feature (1)..( 8): Matrix.001 file - promoters60/1016133
atcaaata

SEQ ID NO: 42432 - DNA, 6 bp, Unknown
  misc_feature (1)..( 6): Matrix.001 file - promoters60/1016133
aattaa

SEQ ID NO: 42433 - DNA, 6 bp, Unknown
  misc_feature (1)..( 6): Matrix.001 file - promoters60/1016133
aataat

SEQ ID NO: 42434 - DNA, 9 bp, Unknown
  misc_feature (1)..( 9): Matrix.001 file - promoters60/1016133
tagataatt

SEQ ID NO: 42435 - DNA, 7 bp, Unknown
  misc_feature (1)..( 7): Matrix.001 file - promoters60/1016133
aatatta

SEQ ID NO: 42436 - DNA, 6 bp, Unknown
  misc_feature (1)..( 6): Matrix.001 file - promoters60/1016133
attcta

SEQ ID NO: 42437 - DNA, 6 bp, Unknown
  misc_feature (1)..( 6): Matrix.001 file - promoters60/1016133
atatat

SEQ ID NO: 42438 - DNA, 7 bp, Unknown
  misc_feature (1)..( 7): Matrix.001 file - promoters60/1016133
tatcata

SEQ ID NO: 42439 - DNA, 6 bp, Unknown
  misc_feature (1)..( 6): Matrix.001 file - promoters60/1016133
aaagat

SEQ ID NO: 42440 - DNA, 6 bp, Unknown
  misc_feature (1)..( 6): Matrix.001 file - promoters60/1016133
actata

SEQ ID NO: 42441 - DNA, 11 bp, Unknown
  misc_feature (1)..( 11): Matrix.001 file - promoters60/1016133
tatactttact

SEQ ID NO: 42442 - DNA, 7 bp, Unknown
  misc_feature (1)..( 7): Matrix.001 file - promoters60/1016133
attcaaa

SEQ ID NO: 42443 - DNA, 7 bp, Unknown
  misc_feature (1)..( 7): Matrix.001 file - promoters60/1016133
aaaatta

SEQ ID NO: 42444 - DNA, 7 bp, Unknown
  misc_feature (1)..( 7): Matrix.001 file - promoters60/1016133
ctacaaa

SEQ ID NO: 42445 - DNA, 6 bp, Unknown
  misc_feature (1)..( 6): Matrix.001 file - promoters60/1016165
tattat

SEQ ID NO: 42446 - DNA, 10 bp, Unknown
  misc_feature (1)..( 10): Matrix.001 file - promoters60/1016165
gattatggat

SEQ ID NO: 42447 - DNA, 7 bp, Unknown
  misc_feature (1)..( 7): Matrix.001 file - promoters60/1016165
tgtattt

SEQ ID NO: 42448 - DNA, 8 bp, Unknown
  misc_feature (1)..( 8): Matrix.001 file - promoters60/1016165
aaaatgtg

SEQ ID NO: 42449 - DNA, 10 bp, Unknown
  misc_feature (1)..( 10): Matrix.001 file - promoters60/1016165
tattttaatg

SEQ ID NO: 42450 - DNA, 10 bp, Unknown
  misc_feature (1)..( 10): Matrix.001 file - promoters60/1016165
ttaataattt

SEQ ID NO: 42451 - DNA, 8 bp, Unknown
  misc_feature (1)..( 8): Matrix.001 file - promoters60/1016165
aataaaag

SEQ ID NO: 42452 - DNA, 6 bp, Unknown
  misc_feature (1)..( 6): Matrix.001 file - promoters60/1016165
aaaatt

SEQ ID NO: 42453 - DNA, 7 bp, Unknown
  misc_feature (1)..( 7): Matrix.001 file - promoters60/1016165
aatcaaa

SEQ ID NO: 42454 - DNA, 6 bp, Unknown
  misc_feature (1)..( 6): Matrix.001 file - promoters60/1016165
ggccca

SEQ ID NO: 42455 - DNA, 8 bp, Unknown
  misc_feature (1)..( 8): Matrix.001 file - promoters60/1016165
agacaagt

SEQ ID NO: 42456 - DNA, 7 bp, Unknown
  misc_feature (1)..( 7): Matrix.001 file - promoters60/1016165
aagatca

SEQ ID NO: 42457 - DNA, 7 bp, Unknown
  misc_feature (1)..( 7): Matrix.001 file - promoters60/1016165
taacaaa

SEQ ID NO: 42458 - DNA, 7 bp, Unknown
  misc_feature (1)..( 7): Matrix.001 file - promoters60/1016165
taatcac

SEQ ID NO: 42459 - DNA, 7 bp, Unknown
  misc_feature (1)..( 7): Matrix.001 file - promoters60/1016165
agtgaat

SEQ ID NO: 42460 - DNA, 7 bp, Unknown
  misc_feature (1)..( 7): Matrix.001 file - promoters60/1016165
cccattt

SEQ ID NO: 42461 - DNA, 6 bp, Unknown
  misc_feature (1)..( 6): Matrix.001 file - promoters60/1016165
aaccaa

SEQ ID NO: 42462 - DNA, 7 bp, Unknown
  misc_feature (1)..( 7): Matrix.001 file - promoters60/1016165
agggata

SEQ ID NO: 42463 - DNA, 7 bp, Unknown
  misc_feature (1)..( 7): Matrix.001 file - promoters60/1016165
tgatcat

SEQ ID NO: 42464 - DNA, 6 bp, Unknown
  misc_feature (1)..( 6): Matrix.001 file - promoters60/1016165
taattt

SEQ ID NO: 42465 - DNA, 7 bp, Unknown
  misc_feature (1)..( 7): Matrix.001 file - promoters60/1016165
ttccatt

SEQ ID NO: 42466 - DNA, 8 bp, Unknown
  misc_feature (1)..( 8): Matrix.001 file - promoters60/1016165
ttaacaat

SEQ ID NO: 42467 - DNA, 9 bp, Unknown
  misc_feature (1)..( 9): Matrix.001 file - promoters60/1016176
taaaataaa

SEQ ID NO: 42468 - DNA, 11 bp, Unknown
  misc_feature (1)..( 11): Matrix.001 file - promoters60/1016176
acaaatcataa

SEQ ID NO: 42469 - DNA, 6 bp, Unknown
  misc_feature (1)..( 6): Matrix.001 file - promoters60/1016176
gaaaga

SEQ ID NO: 42470 - DNA, 8 bp, Unknown
  misc_feature (1)..( 8): Matrix.001 file - promoters60/1016223
aaaacaac

SEQ ID NO: 42471 - DNA, 6 bp, Unknown
  misc_feature (1)..( 6): Matrix.001 file - promoters60/1016223
atggca

SEQ ID NO: 42472 - DNA, 7 bp, Unknown
  misc_feature (1)..( 7): Matrix.001 file - promoters60/1016223
cgtgaaa

SEQ ID NO: 42473 - DNA, 8 bp, Unknown
  misc_feature (1)..( 8): Matrix.001 file - promoters60/1016223
agaaattg

SEQ ID NO: 42474 - DNA, 8 bp, Unknown
  misc_feature (1)..( 8): Matrix.001 file - promoters60/1016223
aaaacaat

SEQ ID NO: 42475 - DNA, 8 bp, Unknown
  misc_feature (1)..( 8): Matrix.001 file - promoters60/1016223
gaaataaa

SEQ ID NO: 42476 - DNA, 7 bp, Unknown
  misc_feature (1)..( 7): Matrix.001 file - promoters60/1016223
caaattt

SEQ ID NO: 42477 - DNA, 6 bp, Unknown
  misc_feature (1)..( 6): Matrix.001 file - promoters60/1016223
ttaaaa

SEQ ID NO: 42478 - DNA, 6 bp, Unknown
  misc_feature (1)..( 6): Matrix.001 file - promoters60/1016223
gtaacg

SEQ ID NO: 42479 - DNA, 7 bp, Unknown
  misc_feature (1)..( 7): Matrix.001 file - promoters60/1016223
gtggtta

SEQ ID NO: 42480 - DNA, 8 bp, Unknown
  misc_feature (1)..( 8): Matrix.001 file - promoters60/1016223
acgtgtca

SEQ ID NO: 42481 - DNA, 15 bp, Unknown
  misc_feature (1)..( 15): Matrix.001 file - promoters60/1016223
tattgcttcaccgcc

SEQ ID NO: 42482 - DNA, 6 bp, Unknown
  misc_feature (1)..( 6): Matrix.001 file - promoters60/1016223
ctcgtc

SEQ ID NO: 42483 - DNA, 15 bp, Unknown
  misc_feature (1)..( 15): Matrix.001 file - promoters60/1016223
ttcttcttctataaa

SEQ ID NO: 42484 - DNA, 10 bp, Unknown
  misc_feature (1)..( 10): Matrix.001 file - promoters60/1016250
atcaaccaaa

SEQ ID NO: 42485 - DNA, 11 bp, Unknown
  misc_feature (1)..( 11): Matrix.001 file - promoters60/1016250
ccacctatata

SEQ ID NO: 42486 - DNA, 10 bp, Unknown
  misc_feature (1)..( 10): Matrix.001 file - promoters60/1016250
aaagaaaaaa

SEQ ID NO: 42487 - DNA, 7 bp, Unknown
  misc_feature (1)..( 7): Matrix.001 file - promoters60/1016250
aaatgaa

SEQ ID NO: 42488 - DNA, 6 bp, Unknown
  misc_feature (1)..( 6): Matrix.001 file - promoters60/1016278
aaaaag

SEQ ID NO: 42489 - DNA, 9 bp, Unknown
  misc_feature (1)..( 9): Matrix.001 file - promoters60/1016278
gggattttt

SEQ ID NO: 42490 - DNA, 8 bp, Unknown
  misc_feature (1)..( 8): Matrix.001 file - promoters60/1016278
tgtatcta

SEQ ID NO: 42491 - DNA, 7 bp, Unknown
  misc_feature (1)..( 7): Matrix.001 file - promoters60/1016278
taattat

SEQ ID NO: 42492 - DNA, 7 bp, Unknown
  misc_feature (1)..( 7): Matrix.001 file - promoters60/1016278
ttatata

SEQ ID NO: 42493 - DNA, 8 bp, Unknown
  misc_feature (1)..( 8): Matrix.001 file - promoters60/1016278
aacgcaag

SEQ ID NO: 42494 - DNA, 6 bp, Unknown
  misc_feature (1)..( 6): Matrix.001 file - promoters60/1016278
attttt

SEQ ID NO: 42495 - DNA, 6 bp, Unknown
  misc_feature (1)..( 6): Matrix.001 file - promoters60/1016278
atcaac

SEQ ID NO: 42496 - DNA, 11 bp, Unknown
  misc_feature (1)..( 11): Matrix.001 file - promoters60/1016278
tataatataat

SEQ ID NO: 42497 - DNA, 6 bp, Unknown
  misc_feature (1)..( 6): Matrix.001 file - promoters60/1016278
aaataa

SEQ ID NO: 42498 - DNA, 10 bp, Unknown
  misc_feature (1)..( 10): Matrix.001 file - promoters60/1016278
aaatagataa

SEQ ID NO: 42499 - DNA, 6 bp, Unknown
  misc_feature (1)..( 6): Matrix.001 file - promoters60/1016278
aattgt

SEQ ID NO: 42500 - DNA, 6 bp, Unknown
  misc_feature (1)..( 6): Matrix.001 file - promoters60/1016278
gctacc

SEQ ID NO: 42501 - DNA, 6 bp, Unknown
  misc_feature (1)..( 6): Matrix.001 file - promoters60/1016278
tctctc

SEQ ID NO: 42502 - DNA, 7 bp, Unknown
  misc_feature (1)..( 7): Matrix.001 file - promoters60/1016278
tttattt

SEQ ID NO: 42503 - DNA, 8 bp, Unknown
  misc_feature (1)..( 8): Matrix.001 file - promoters60/1016278
ttactgat

SEQ ID NO: 42504 - DNA, 6 bp, Unknown
  misc_feature (1)..( 6): Matrix.001 file - promoters60/1016278
atttat

SEQ ID NO: 42505 - DNA, 7 bp, Unknown
  misc_feature (1)..( 7): Matrix.001 file - promoters60/1016278
tttattt

SEQ ID NO: 42506 - DNA, 6 bp, Unknown
  misc_feature (1)..( 6): Matrix.001 file - promoters60/1016278
tatctc

SEQ ID NO: 42507 - DNA, 8 bp, Unknown
  misc_feature (1)..( 8): Matrix.001 file - promoters60/1016278
atccaaac

SEQ ID NO: 42508 - DNA, 7 bp, Unknown
  misc_feature (1)..( 7): Matrix.001 file - promoters60/1016278
ataaaaa

SEQ ID NO: 42509 - DNA, 7 bp, Unknown
  misc_feature (1)..( 7): Matrix.001 file - promoters60/1016278
gaaaacg

SEQ ID NO: 42510 - DNA, 6 bp, Unknown
  misc_feature (1)..( 6): Matrix.001 file - promoters60/1016343
tttccg

SEQ ID NO: 42511 - DNA, 6 bp, Unknown
  misc_feature (1)..( 6): Matrix.001 file - promoters60/1016343
ttttat

SEQ ID NO: 42512 - DNA, 7 bp, Unknown
  misc_feature (1)..( 7): Matrix.001 file - promoters60/1016343
attaata

SEQ ID NO: 42513 - DNA, 6 bp, Unknown
  misc_feature (1)..( 6): Matrix.001 file - promoters60/1016343
taaatt

SEQ ID NO: 42514 - DNA, 9 bp, Unknown
  misc_feature (1)..( 9): Matrix.001 file - promoters60/1016343
atatttttt

SEQ ID NO: 42515 - DNA, 6 bp, Unknown
  misc_feature (1)..( 6): Matrix.001 file - promoters60/1016343
caatat

SEQ ID NO: 42516 - DNA, 9 bp, Unknown
  misc_feature (1)..( 9): Matrix.001 file - promoters60/1016343
atatcatat

SEQ ID NO: 42517 - DNA, 8 bp, Unknown
  misc_feature (1)..( 8): Matrix.001 file - promoters60/1016343
aaaaaaaa

SEQ ID NO: 42518 - DNA, 6 bp, Unknown
  misc_feature (1)..( 6): Matrix.001 file - promoters60/1016343
aatttt

SEQ ID NO: 42519 - DNA, 6 bp, Unknown
  misc_feature (1)..( 6): Matrix.001 file - promoters60/1016343
attttg

SEQ ID NO: 42520 - DNA, 6 bp, Unknown
  misc_feature (1)..( 6): Matrix.001 file - promoters60/1016343
aatttt

SEQ ID NO: 42521 - DNA, 7 bp, Unknown
  misc_feature (1)..( 7): Matrix.001 file - promoters60/1016343
tttcata

SEQ ID NO: 42522 - DNA, 7 bp, Unknown
  misc_feature (1)..( 7): Matrix.001 file - promoters60/1016343
tcacatt

SEQ ID NO: 42523 - DNA, 6 bp, Unknown
  misc_feature (1)..( 6): Matrix.001 file - promoters60/1016343
tgctca

SEQ ID NO: 42524 - DNA, 7 bp, Unknown
  misc_feature (1)..( 7): Matrix.001 file - promoters60/1016343
tgtgttc

SEQ ID NO: 42525 - DNA, 6 bp, Unknown
  misc_feature (1)..( 6): Matrix.001 file - promoters60/1016343
ttcaat

SEQ ID NO: 42526 - DNA, 7 bp, Unknown
  misc_feature (1)..( 7): Matrix.001 file - promoters60/1016382
ctgattc

SEQ ID NO: 42527 - DNA, 6 bp, Unknown
  misc_feature (1)..( 6): Matrix.001 file - promoters60/1016382
taggag

SEQ ID NO: 42528 - DNA, 6 bp, Unknown
  misc_feature (1)..( 6): Matrix.001 file - promoters60/1016382
gaaaga

SEQ ID NO: 42529 - DNA, 6 bp, Unknown
  misc_feature (1)..( 6): Matrix.001 file - promoters60/1016382
cttttg

SEQ ID NO: 42530 - DNA, 6 bp, Unknown
  misc_feature (1)..( 6): Matrix.001 file - promoters60/1016382
tttacc

SEQ ID NO: 42531 - DNA, 11 bp, Unknown
  misc_feature (1)..( 11): Matrix.001 file - promoters60/1016382
ttttaatatat

SEQ ID NO: 42532 - DNA, 6 bp, Unknown
  misc_feature (1)..( 6): Matrix.001 file - promoters60/1016382
gttagt

SEQ ID NO: 42533 - DNA, 6 bp, Unknown
  misc_feature (1)..( 6): Matrix.001 file - promoters60/1016382
taaaaa

SEQ ID NO: 42534 - DNA, 6 bp, Unknown
  misc_feature (1)..( 6): Matrix.001 file - promoters60/1016382
gagtgt

SEQ ID NO: 42535 - DNA, 7 bp, Unknown
  misc_feature (1)..( 7): Matrix.001 file - promoters60/1016382
tctctaa

SEQ ID NO: 42536 - DNA, 6 bp, Unknown
  misc_feature (1)..( 6): Matrix.001 file - promoters60/1016382
ttcaaa

SEQ ID NO: 42537 - DNA, 6 bp, Unknown
  misc_feature (1)..( 6): Matrix.001 file - promoters60/1016382
gtttaa

SEQ ID NO: 42538 - DNA, 6 bp, Unknown
  misc_feature (1)..( 6): Matrix.001 file - promoters60/1016382
tactgt

SEQ ID NO: 42539 - DNA, 9 bp, Unknown
  misc_feature (1)..( 9): Matrix.001 file - promoters60/1016382
tcaaaattt

SEQ ID NO: 42540 - DNA, 6 bp, Unknown
  misc_feature (1)..( 6): Matrix.001 file - promoters60/1016382
ttgaaa

SEQ ID NO: 42541 - DNA, 7 bp, Unknown
  misc_feature (1)..( 7): Matrix.001 file - promoters60/1016382
cttctcc

SEQ ID NO: 42542 - DNA, 7 bp, Unknown
  misc_feature (1)..( 7): Matrix.001 file - promoters60/1016382
ttcatgt

SEQ ID NO: 42543 - DNA, 7 bp, Unknown
  misc_feature (1)..( 7): Matrix.001 file - promoters60/1016382
aagattt

SEQ ID NO: 42544 - DNA, 10 bp, Unknown
  misc_feature (1)..( 10): Matrix.001 file - promoters60/1016382
atattttttt

SEQ ID NO: 42545 - DNA, 7 bp, Unknown
  misc_feature (1)..( 7): Matrix.001 file - promoters60/1016382
tacctca

SEQ ID NO: 42546 - DNA, 7 bp, Unknown
  misc_feature (1)..( 7): Matrix.001 file - promoters60/1016382
tttgata

SEQ ID NO: 42547 - DNA, 9 bp, Unknown
  misc_feature (1)..( 9): Matrix.001 file - promoters60/1016382
catcattat

SEQ ID NO: 42548 - DNA, 8 bp, Unknown
  misc_feature (1)..( 8): Matrix.001 file - promoters60/1016418
taatcaat

SEQ ID NO: 42549 - DNA, 9 bp, Unknown
  misc_feature (1)..( 9): Matrix.001 file - promoters60/1016418
ttatttgga

SEQ ID NO: 42550 - DNA, 7 bp, Unknown
  misc_feature (1)..( 7): Matrix.001 file - promoters60/1016418
tataaat

SEQ ID NO: 42551 - DNA, 8 bp, Unknown
  misc_feature (1)..( 8): Matrix.001 file - promoters60/1016418
attgttga

SEQ ID NO: 42552 - DNA, 6 bp, Unknown
  misc_feature (1)..( 6): Matrix.001 file - promoters60/1016418
agcaat

SEQ ID NO: 42553 - DNA, 7 bp, Unknown
  misc_feature (1)..( 7): Matrix.001 file - promoters60/1016426
aatagga

SEQ ID NO: 42554 - DNA, 9 bp, Unknown
  misc_feature (1)..( 9): Matrix.001 file - promoters60/1016426
tagaaatac

SEQ ID NO: 42555 - DNA, 9 bp, Unknown
  misc_feature (1)..( 9): Matrix.001 file - promoters60/1016426
gaaagttaa

SEQ ID NO: 42556 - DNA, 6 bp, Unknown
  misc_feature (1)..( 6): Matrix.001 file - promoters60/1016426
aatttt

SEQ ID NO: 42557 - DNA, 8 bp, Unknown
  misc_feature (1)..( 8): Matrix.001 file - promoters60/1016426
tttaaatt

SEQ ID NO: 42558 - DNA, 6 bp, Unknown
  misc_feature (1)..( 6): Matrix.001 file - promoters60/1016426
cctaaa

SEQ ID NO: 42559 - DNA, 11 bp, Unknown
  misc_feature (1)..( 11): Matrix.001 file - promoters60/1016426
taaaatattga

SEQ ID NO: 42560 - DNA, 12 bp, Unknown
  misc_feature (1)..( 12): Matrix.001 file - promoters60/1016426
gaaaagcaaaac

SEQ ID NO: 42561 - DNA, 9 bp, Unknown
  misc_feature (1)..( 9): Matrix.001 file - promoters60/1016426
ttaaatttt

SEQ ID NO: 42562 - DNA, 7 bp, Unknown
  misc_feature (1)..( 7): Matrix.001 file - promoters60/1016426
caagtgt

SEQ ID NO: 42563 - DNA, 7 bp, Unknown
  misc_feature (1)..( 7): Matrix.001 file - promoters60/1016426
ctgattt

SEQ ID NO: 42564 - DNA, 6 bp, Unknown
  misc_feature (1)..( 6): Matrix.001 file - promoters60/1016426
tcttcc

SEQ ID NO: 42565 - DNA, 8 bp, Unknown
  misc_feature (1)..( 8): Matrix.001 file - promoters60/1016426
ctctctcg

SEQ ID NO: 42566 - DNA, 9 bp, Unknown
  misc_feature (1)..( 9): Matrix.001 file - promoters60/1016468
ataaaacaa

SEQ ID NO: 42567 - DNA, 11 bp, Unknown
  misc_feature (1)..( 11): Matrix.001 file - promoters60/1016468
caactatataa

SEQ ID NO: 42568 - DNA, 11 bp, Unknown
  misc_feature (1)..( 11): Matrix.001 file - promoters60/1016468
taattatttta

SEQ ID NO: 42569 - DNA, 4 bp, Unknown
  misc_feature (1)..( 4): Matrix.001 file - promoters60/1016468
tatt

SEQ ID NO: 42570 - DNA, 10 bp, Unknown
  misc_feature (1)..( 10): Matrix.001 file - promoters60/1016468
tgttgacttt

SEQ ID NO: 42571 - DNA, 12 bp, Unknown
  misc_feature (1)..( 12): Matrix.001 file - promoters60/1016468
tataattatttt

SEQ ID NO: 42572 - DNA, 9 bp, Unknown
  misc_feature (1)..( 9): Matrix.001 file - promoters60/1016468
aatgaaaat

SEQ ID NO: 42573 - DNA, 13 bp, Unknown
  misc_feature (1)..( 13): Matrix.001 file - promoters60/1016468
agttaaattttta

SEQ ID NO: 42574 - DNA, 9 bp, Unknown
  misc_feature (1)..( 9): Matrix.001 file - promoters60/1016514
taagaaaat

SEQ ID NO: 42575 - DNA, 10 bp, Unknown
  misc_feature (1)..( 10): Matrix.001 file - promoters60/1016514
gtagcaaata

SEQ ID NO: 42576 - DNA, 7 bp, Unknown
  misc_feature (1)..( 7): Matrix.001 file - promoters60/1016514
tttctgt

SEQ ID NO: 42577 - DNA, 9 bp, Unknown
  misc_feature (1)..( 9): Matrix.001 file - promoters60/1016514
atggtgaca

SEQ ID NO: 42578 - DNA, 8 bp, Unknown
  misc_feature (1)..( 8): Matrix.001 file - promoters60/1016514
atacaaca

SEQ ID NO: 42579 - DNA, 8 bp, Unknown
  misc_feature (1)..( 8): Matrix.001 file - promoters60/1016514
aaaattct

SEQ ID NO: 42580 - DNA, 8 bp, Unknown
  misc_feature (1)..( 8): Matrix.001 file - promoters60/1016514
taatatta

SEQ ID NO: 42581 - DNA, 6 bp, Unknown
  misc_feature (1)..( 6): Matrix.001 file - promoters60/1016514
atacca

SEQ ID NO: 42582 - DNA, 8 bp, Unknown
  misc_feature (1)..( 8): Matrix.001 file - promoters60/1016514
ttaatttt

SEQ ID NO: 42583 - DNA, 16 bp, Unknown
  misc_feature (1)..( 16): Matrix.001 file - promoters60/1016514
ttttctgaaatagtta

SEQ ID NO: 42584 - DNA, 7 bp, Unknown
  misc_feature (1)..( 7): Matrix.001 file - promoters60/1016514
attgtat

SEQ ID NO: 42585 - DNA, 6 bp, Unknown
  misc_feature (1)..( 6): Matrix.001 file - promoters60/1016514
tatata

SEQ ID NO: 42586 - DNA, 6 bp, Unknown
  misc_feature (1)..( 6): Matrix.001 file - promoters60/1016514
atatat

SEQ ID NO: 42587 - DNA, 7 bp, Unknown
  misc_feature (1)..( 7): Matrix.001 file - promoters60/1016514
atctttt

SEQ ID NO: 42588 - DNA, 9 bp, Unknown
  misc_feature (1)..( 9): Matrix.001 file - promoters60/1016514
tttaaggtt

SEQ ID NO: 42589 - DNA, 7 bp, Unknown
  misc_feature (1)..( 7): Matrix.001 file - promoters60/1016514
tatatgt

SEQ ID NO: 42590 - DNA, 7 bp, Unknown
  misc_feature (1)..( 7): Matrix.001 file - promoters60/1016514
taaaatt

SEQ ID NO: 42591 - DNA, 8 bp, Unknown
  misc_feature (1)..( 8): Matrix.001 file - promoters60/1016514
ttagttta

SEQ ID NO: 42592 - DNA, 6 bp, Unknown
  misc_feature (1)..( 6): Matrix.001 file - promoters60/1016514
ttaatg

SEQ ID NO: 42593 - DNA, 11 bp, Unknown
  misc_feature (1)..( 11): Matrix.001 file - promoters60/1016514
atagaaatatc

SEQ ID NO: 42594 - DNA, 6 bp, Unknown
  misc_feature (1)..( 6): Matrix.001 file - promoters60/1016514
tatttg

SEQ ID NO: 42595 - DNA, 6 bp, Unknown
  misc_feature (1)..( 6): Matrix.001 file - promoters60/1016514
tttcaa

SEQ ID NO: 42596 - DNA, 6 bp, Unknown
  misc_feature (1)..( 6): Matrix.001 file - promoters60/1016514
aacatt

SEQ ID NO: 42597 - DNA, 6 bp, Unknown
  misc_feature (1)..( 6): Matrix.001 file - promoters60/1016514
taaaaa

SEQ ID NO: 42598 - DNA, 10 bp, Unknown
  misc_feature (1)..( 10): Matrix.001 file - promoters60/1016514
aaaatcatat

SEQ ID NO: 42599 - DNA, 6 bp, Unknown
  misc_feature (1)..( 6): Matrix.001 file - promoters60/1016514
ggaaaa

SEQ ID NO: 42600 - DNA, 6 bp, Unknown
  misc_feature (1)..( 6): Matrix.001 file - promoters60/1016514
aatttt

SEQ ID NO: 42601 - DNA, 6 bp, Unknown
  misc_feature (1)..( 6): Matrix.001 file - promoters60/1016514
ataatt

SEQ ID NO: 42602 - DNA, 7 bp, Unknown
  misc_feature (1)..( 7): Matrix.001 file - promoters60/1016514
ctacaaa

SEQ ID NO: 42603 - DNA, 7 bp, Unknown
  misc_feature (1)..( 7): Matrix.001 file - promoters60/1016525
cttttta

SEQ ID NO: 42604 - DNA, 12 bp, Unknown
  misc_feature (1)..( 12): Matrix.001 file - promoters60/1016525
ttgaaaatataa

SEQ ID NO: 42605 - DNA, 11 bp, Unknown
  misc_feature (1)..( 11): Matrix.001 file - promoters60/1016525
taaaaactaga

SEQ ID NO: 42606 - DNA, 7 bp, Unknown
  misc_feature (1)..( 7): Matrix.001 file - promoters60/1016525
caataaa

SEQ ID NO: 42607 - DNA, 6 bp, Unknown
  misc_feature (1)..( 6): Matrix.001 file - promoters60/1016525
aagata

SEQ ID NO: 42608 - DNA, 7 bp, Unknown
  misc_feature (1)..( 7): Matrix.001 file - promoters60/1016525
tttaaaa

SEQ ID NO: 42609 - DNA, 7 bp, Unknown
  misc_feature (1)..( 7): Matrix.001 file - promoters60/1016525
aataaac

SEQ ID NO: 42610 - DNA, 8 bp, Unknown
  misc_feature (1)..( 8): Matrix.001 file - promoters60/1016525
agaaaaat

SEQ ID NO: 42611 - DNA, 8 bp, Unknown
  misc_feature (1)..( 8): Matrix.001 file - promoters60/1016525
attttaaa

SEQ ID NO: 42612 - DNA, 11 bp, Unknown
  misc_feature (1)..( 11): Matrix.001 file - promoters60/1016525
ataaaaacttt

SEQ ID NO: 42613 - DNA, 8 bp, Unknown
  misc_feature (1)..( 8): Matrix.001 file - promoters60/1016525
tatataaa

SEQ ID NO: 42614 - DNA, 10 bp, Unknown
  misc_feature (1)..( 10): Matrix.001 file - promoters60/1016525
ttaaaaatat

SEQ ID NO: 42615 - DNA, 6 bp, Unknown
  misc_feature (1)..( 6): Matrix.001 file - promoters60/1016525
tttgaa

SEQ ID NO: 42616 - DNA, 7 bp, Unknown
  misc_feature (1)..( 7): Matrix.001 file - promoters60/1016624
ttgtttc

SEQ ID NO: 42617 - DNA, 8 bp, Unknown
  misc_feature (1)..( 8): Matrix.001 file - promoters60/1016624
gatctact

SEQ ID NO: 42618 - DNA, 8 bp, Unknown
  misc_feature (1)..( 8): Matrix.001 file - promoters60/1016624
ttcaactt

SEQ ID NO: 42619 - DNA, 7 bp, Unknown
  misc_feature (1)..( 7): Matrix.001 file - promoters60/1016624
aaatgaa

SEQ ID NO: 42620 - DNA, 8 bp, Unknown
  misc_feature (1)..( 8): Matrix.001 file - promoters60/1016624
tgaacatt

SEQ ID NO: 42621 - DNA, 8 bp, Unknown
  misc_feature (1)..( 8): Matrix.001 file - promoters60/1016624
cttctcaa

SEQ ID NO: 42622 - DNA, 7 bp, Unknown
  misc_feature (1)..( 7): Matrix.001 file - promoters60/1016624
cttcttc

SEQ ID NO: 42623 - DNA, 10 bp, Unknown
  misc_feature (1)..( 10): Matrix.001 file - promoters60/1016665
aatatatcat

SEQ ID NO: 42624 - DNA, 7 bp, Unknown
  misc_feature (1)..( 7): Matrix.001 file - promoters60/1016665
ttttgaa

SEQ ID NO: 42625 - DNA, 7 bp, Unknown
  misc_feature (1)..( 7): Matrix.001 file - promoters60/1016665
aacatat

SEQ ID NO: 42626 - DNA, 6 bp, Unknown
  misc_feature (1)..( 6): Matrix.001 file - promoters60/1016665
tttatt

SEQ ID NO: 42627 - DNA, 9 bp, Unknown
  misc_feature (1)..( 9): Matrix.001 file - promoters60/1016665
acaaccaca

SEQ ID NO: 42628 - DNA, 7 bp, Unknown
  misc_feature (1)..( 7): Matrix.001 file - promoters60/1016665
tatatgt

SEQ ID NO: 42629 - DNA, 6 bp, Unknown
  misc_feature (1)..( 6): Matrix.001 file - promoters60/1016665
cagaat

SEQ ID NO: 42630 - DNA, 6 bp, Unknown
  misc_feature (1)..( 6): Matrix.001 file - promoters60/1016665
aatttc

SEQ ID NO: 42631 - DNA, 6 bp, Unknown
  misc_feature (1)..( 6): Matrix.001 file - promoters60/1016665
ttttga

SEQ ID NO: 42632 - DNA, 6 bp, Unknown
  misc_feature (1)..( 6): Matrix.001 file - promoters60/1016665
aattaa

SEQ ID NO: 42633 - DNA, 6 bp, Unknown
  misc_feature (1)..( 6): Matrix.001 file - promoters60/1016665
ttgcta

SEQ ID NO: 42634 - DNA, 10 bp, Unknown
  misc_feature (1)..( 10): Matrix.001 file - promoters60/1016665
tcttttactt

SEQ ID NO: 42635 - DNA, 7 bp, Unknown
  misc_feature (1)..( 7): Matrix.001 file - promoters60/1016665
tttagtg

SEQ ID NO: 42636 - DNA, 7 bp, Unknown
  misc_feature (1)..( 7): Matrix.001 file - promoters60/1016665
tgtgttc

SEQ ID NO: 42637 - DNA, 6 bp, Unknown
  misc_feature (1)..( 6): Matrix.001 file - promoters60/1016665
atgttc

SEQ ID NO: 42638 - DNA, 11 bp, Unknown
  misc_feature (1)..( 11): Matrix.001 file - promoters60/1016665
gttttaattta

SEQ ID NO: 42639 - DNA, 6 bp, Unknown
  misc_feature (1)..( 6): Matrix.001 file - promoters60/1016665
aaaaat

SEQ ID NO: 42640 - DNA, 11 bp, Unknown
  misc_feature (1)..( 11): Matrix.001 file - promoters60/1016692
aaagaaaccaa

SEQ ID NO: 42641 - DNA, 9 bp, Unknown
  misc_feature (1)..( 9): Matrix.001 file - promoters60/1016692
ctaattatg

SEQ ID NO: 42642 - DNA, 8 bp, Unknown
  misc_feature (1)..( 8): Matrix.001 file - promoters60/1016692
gaaagtta

SEQ ID NO: 42643 - DNA, 9 bp, Unknown
  misc_feature (1)..( 9): Matrix.001 file - promoters60/1016692
aaaataaga

SEQ ID NO: 42644 - DNA, 6 bp, Unknown
  misc_feature (1)..( 6): Matrix.001 file - promoters60/1016729
agattc

SEQ ID NO: 42645 - DNA, 6 bp, Unknown
  misc_feature (1)..( 6): Matrix.001 file - promoters60/1016729
ttcata

SEQ ID NO: 42646 - DNA, 6 bp, Unknown
  misc_feature (1)..( 6): Matrix.001 file - promoters60/1016729
agcaac

SEQ ID NO: 42647 - DNA, 7 bp, Unknown
  misc_feature (1)..( 7): Matrix.001 file - promoters60/1016729
caaaaat

SEQ ID NO: 42648 - DNA, 6 bp, Unknown
  misc_feature (1)..( 6): Matrix.001 file - promoters60/1016729
attgtg

SEQ ID NO: 42649 - DNA, 11 bp, Unknown
  misc_feature (1)..( 11): Matrix.001 file - promoters60/1016729
gaaaccaacat

SEQ ID NO: 42650 - DNA, 6 bp, Unknown
  misc_feature (1)..( 6): Matrix.001 file - promoters60/1016729
gttttt

SEQ ID NO: 42651 - DNA, 7 bp, Unknown
  misc_feature (1)..( 7): Matrix.001 file - promoters60/1016729
cttattg

SEQ ID NO: 42652 - DNA, 8 bp, Unknown
  misc_feature (1)..( 8): Matrix.001 file - promoters60/1016729
gatgcaaa

SEQ ID NO: 42653 - DNA, 8 bp, Unknown
  misc_feature (1)..( 8): Matrix.001 file - promoters60/1016729
tgtggaaa

SEQ ID NO: 42654 - DNA, 7 bp, Unknown
  misc_feature (1)..( 7): Matrix.001 file - promoters60/1016729
ggcgtgt

SEQ ID NO: 42655 - DNA, 6 bp, Unknown
  misc_feature (1)..( 6): Matrix.001 file - promoters60/1016729
tctatt

SEQ ID NO: 42656 - DNA, 8 bp, Unknown
  misc_feature (1)..( 8): Matrix.001 file - promoters60/1016729
taccagat

SEQ ID NO: 42657 - DNA, 6 bp, Unknown
  misc_feature (1)..( 6): Matrix.001 file - promoters60/1016729
agatta

SEQ ID NO: 42658 - DNA, 10 bp, Unknown
  misc_feature (1)..( 10): Matrix.001 file - promoters60/1016771
gaaatcatta

SEQ ID NO: 42659 - DNA, 13 bp, Unknown
  misc_feature (1)..( 13): Matrix.001 file - promoters60/1016771
aaaatcaatgctt

SEQ ID NO: 42660 - DNA, 14 bp, Unknown
  misc_feature (1)..( 14): Matrix.001 file - promoters60/1016814
atctaaaaaatatt

SEQ ID NO: 42661 - DNA, 12 bp, Unknown
  misc_feature (1)..( 12): Matrix.001 file - promoters60/1016814
aattcaatcatc

SEQ ID NO: 42662 - DNA, 12 bp, Unknown
  misc_feature (1)..( 12): Matrix.001 file - promoters60/1016814
atacaaaaaaca

SEQ ID NO: 42663 - DNA, 9 bp, Unknown
  misc_feature (1)..( 9): Matrix.001 file - promoters60/1016886
agtttttct

SEQ ID NO: 42664 - DNA, 8 bp, Unknown
  misc_feature (1)..( 8): Matrix.001 file - promoters60/1016915
aaaataag

SEQ ID NO: 42665 - DNA, 12 bp, Unknown
  misc_feature (1)..( 12): Matrix.001 file - promoters60/1016915
ataagttaatca

SEQ ID NO: 42666 - DNA, 6 bp, Unknown
  misc_feature (1)..( 6): Matrix.001 file - promoters60/1016915
acgaat

SEQ ID NO: 42667 - DNA, 6 bp, Unknown
  misc_feature (1)..( 6): Matrix.001 file - promoters60/1016915
gtacga

SEQ ID NO: 42668 - DNA, 7 bp, Unknown
  misc_feature (1)..( 7): Matrix.001 file - promoters60/1016915
atgaaaa

SEQ ID NO: 42669 - DNA, 8 bp, Unknown
  misc_feature (1)..( 8): Matrix.001 file - promoters60/1016915
agatatat

SEQ ID NO: 42670 - DNA, 7 bp, Unknown
  misc_feature (1)..( 7): Matrix.001 file - promoters60/1016915
atgtttt

SEQ ID NO: 42671 - DNA, 7 bp, Unknown
  misc_feature (1)..( 7): Matrix.001 file - promoters60/1016915
attaaat

SEQ ID NO: 42672 - DNA, 8 bp, Unknown
  misc_feature (1)..( 8): Matrix.001 file - promoters60/1016915
caaataat

SEQ ID NO: 42673 - DNA, 6 bp, Unknown
  misc_feature (1)..( 6): Matrix.001 file - promoters60/1016915
aaatca

SEQ ID NO: 42674 - DNA, 7 bp, Unknown
  misc_feature (1)..( 7): Matrix.001 file - promoters60/1016915
caaatgt

SEQ ID NO: 42675 - DNA, 6 bp, Unknown
  misc_feature (1)..( 6): Matrix.001 file - promoters60/1016915
aagatt

SEQ ID NO: 42676 - DNA, 6 bp, Unknown
  misc_feature (1)..( 6): Matrix.001 file - promoters60/1016915
aagaaa

SEQ ID NO: 42677 - DNA, 6 bp, Unknown
  misc_feature (1)..( 6): Matrix.001 file - promoters60/1016915
aaaaag

SEQ ID NO: 42678 - DNA, 8 bp, Unknown
  misc_feature (1)..( 8): Matrix.001 file - promoters60/1016915
caatcaaa

SEQ ID NO: 42679 - DNA, 7 bp, Unknown
  misc_feature (1)..( 7): Matrix.001 file - promoters60/1016915
ttcgaaa

SEQ ID NO: 42680 - DNA, 8 bp, Unknown
  misc_feature (1)..( 8): Matrix.001 file - promoters60/1016915
aaatctcg

SEQ ID NO: 42681 - DNA, 6 bp, Unknown
  misc_feature (1)..( 6): Matrix.001 file - promoters60/1016915
tataaa

SEQ ID NO: 42682 - DNA, 8 bp, Unknown
  misc_feature (1)..( 8): Matrix.001 file - promoters60/1016915
taaattgt

SEQ ID NO: 42683 - DNA, 6 bp, Unknown
  misc_feature (1)..( 6): Matrix.001 file - promoters60/1016915
atagat

SEQ ID NO: 42684 - DNA, 6 bp, Unknown
  misc_feature (1)..( 6): Matrix.001 file - promoters60/1016915
ttttgg

SEQ ID NO: 42685 - DNA, 6 bp, Unknown
  misc_feature (1)..( 6): Matrix.001 file - promoters60/1016915
taagat

SEQ ID NO: 42686 - DNA, 6 bp, Unknown
  misc_feature (1)..( 6): Matrix.001 file - promoters60/1016915
aaagaa

SEQ ID NO: 42687 - DNA, 12 bp, Unknown
  misc_feature (1)..( 12): Matrix.001 file - promoters60/1016915
aaaaacaaaaca

SEQ ID NO: 42688 - DNA, 6 bp, Unknown
  misc_feature (1)..( 6): Matrix.001 file - promoters60/1016915
taaccc

SEQ ID NO: 42689 - DNA, 7 bp, Unknown
  misc_feature (1)..( 7): Matrix.001 file - promoters60/1016931
aaacaaa

SEQ ID NO: 42690 - DNA, 7 bp, Unknown
  misc_feature (1)..( 7): Matrix.001 file - promoters60/1016931
gtatctt

SEQ ID NO: 42691 - DNA, 6 bp, Unknown
  misc_feature (1)..( 6): Matrix.001 file - promoters60/1016931
ttatct

SEQ ID NO: 42692 - DNA, 8 bp, Unknown
  misc_feature (1)..( 8): Matrix.001 file - promoters60/1016931
aacaaatt

SEQ ID NO: 42693 - DNA, 7 bp, Unknown
  misc_feature (1)..( 7): Matrix.001 file - promoters60/1016931
tttgctt

SEQ ID NO: 42694 - DNA, 10 bp, Unknown
  misc_feature (1)..( 10): Matrix.001 file - promoters60/1016931
attattgttt

SEQ ID NO: 42695 - DNA, 6 bp, Unknown
  misc_feature (1)..( 6): Matrix.001 file - promoters60/1016931
tcagat

SEQ ID NO: 42696 - DNA, 7 bp, Unknown
  misc_feature (1)..( 7): Matrix.001 file - promoters60/1016931
taaataa

SEQ ID NO: 42697 - DNA, 6 bp, Unknown
  misc_feature (1)..( 6): Matrix.001 file - promoters60/1016931
ataaat

SEQ ID NO: 42698 - DNA, 7 bp, Unknown
  misc_feature (1)..( 7): Matrix.001 file - promoters60/1016931
tatgttt

SEQ ID NO: 42699 - DNA, 7 bp, Unknown
  misc_feature (1)..( 7): Matrix.001 file - promoters60/1016931
caaaaaa

SEQ ID NO: 42700 - DNA, 6 bp, Unknown
  misc_feature (1)..( 6): Matrix.001 file - promoters60/1016931
taaaca

SEQ ID NO: 42701 - DNA, 7 bp, Unknown
  misc_feature (1)..( 7): Matrix.001 file - promoters60/1016931
ttagatc

SEQ ID NO: 42702 - DNA, 7 bp, Unknown
  misc_feature (1)..( 7): Matrix.001 file - promoters60/1016931
atcattt

SEQ ID NO: 42703 - DNA, 7 bp, Unknown
  misc_feature (1)..( 7): Matrix.001 file - promoters60/1016931
gatctat

SEQ ID NO: 42704 - DNA, 6 bp, Unknown
  misc_feature (1)..( 6): Matrix.001 file - promoters60/1016931
ttttca

SEQ ID NO: 42705 - DNA, 7 bp, Unknown
  misc_feature (1)..( 7): Matrix.001 file - promoters60/1016931
cgaacaa

SEQ ID NO: 42706 - DNA, 6 bp, Unknown
  misc_feature (1)..( 6): Matrix.001 file - promoters60/1016931
tatcta

SEQ ID NO: 42707 - DNA, 7 bp, Unknown
  misc_feature (1)..( 7): Matrix.001 file - promoters60/1016951
agatttt

SEQ ID NO: 42708 - DNA, 7 bp, Unknown
  misc_feature (1)..( 7): Matrix.001 file - promoters60/1016951
caaacac

SEQ ID NO: 42709 - DNA, 7 bp, Unknown
  misc_feature (1)..( 7): Matrix.001 file - promoters60/1016951
ttaaata

SEQ ID NO: 42710 - DNA, 7 bp, Unknown
  misc_feature (1)..( 7): Matrix.001 file - promoters60/1016951
atatata

SEQ ID NO: 42711 - DNA, 7 bp, Unknown
  misc_feature (1)..( 7): Matrix.001 file - promoters60/1016951
aattttt

SEQ ID NO: 42712 - DNA, 7 bp, Unknown
  misc_feature (1)..( 7): Matrix.001 file - promoters60/1016951
aacataa

SEQ ID NO: 42713 - DNA, 8 bp, Unknown
  misc_feature (1)..( 8): Matrix.001 file - promoters60/1016951
atacataa

SEQ ID NO: 42714 - DNA, 8 bp, Unknown
  misc_feature (1)..( 8): Matrix.001 file - promoters60/1017020
aaaaacat

SEQ ID NO: 42715 - DNA, 8 bp, Unknown
  misc_feature (1)..( 8): Matrix.001 file - promoters60/1017020
ttaatagc

SEQ ID NO: 42716 - DNA, 14 bp, Unknown
  misc_feature (1)..( 14): Matrix.001 file - promoters60/1017020
ttgaatcaaaattc

SEQ ID NO: 42717 - DNA, 10 bp, Unknown
  misc_feature (1)..( 10): Matrix.001 file - promoters60/1017020
ctatactttg

SEQ ID NO: 42718 - DNA, 8 bp, Unknown
  misc_feature (1)..( 8): Matrix.001 file - promoters60/1017041
caagtttc

SEQ ID NO: 42719 - DNA, 6 bp, Unknown
  misc_feature (1)..( 6): Matrix.001 file - promoters60/1017041
attatg

SEQ ID NO: 42720 - DNA, 7 bp, Unknown
  misc_feature (1)..( 7): Matrix.001 file - promoters60/1017041
attcggc

SEQ ID NO: 42721 - DNA, 9 bp, Unknown
  misc_feature (1)..( 9): Matrix.001 file - promoters60/1017041
ttccatgga

SEQ ID NO: 42722 - DNA, 6 bp, Unknown
  misc_feature (1)..( 6): Matrix.001 file - promoters60/1017041
aacagt

SEQ ID NO: 42723 - DNA, 8 bp, Unknown
  misc_feature (1)..( 8): Matrix.001 file - promoters60/1017041
cagagatg

SEQ ID NO: 42724 - DNA, 6 bp, Unknown
  misc_feature (1)..( 6): Matrix.001 file - promoters60/1017041
attaga

SEQ ID NO: 42725 - DNA, 6 bp, Unknown
  misc_feature (1)..( 6): Matrix.001 file - promoters60/1017041
gaatca

SEQ ID NO: 42726 - DNA, 7 bp, Unknown
  misc_feature (1)..( 7): Matrix.001 file - promoters60/1017041
tccagtt

SEQ ID NO: 42727 - DNA, 6 bp, Unknown
  misc_feature (1)..( 6): Matrix.001 file - promoters60/1017041
tttccg

SEQ ID NO: 42728 - DNA, 6 bp, Unknown
  misc_feature (1)..( 6): Matrix.001 file - promoters60/1017041
ataaat

SEQ ID NO: 42729 - DNA, 6 bp, Unknown
  misc_feature (1)..( 6): Matrix.001 file - promoters60/1017041
aaccct

SEQ ID NO: 42730 - DNA, 8 bp, Unknown
  misc_feature (1)..( 8): Matrix.001 file - promoters60/1017046
taatattt

SEQ ID NO: 42731 - DNA, 8 bp, Unknown
  misc_feature (1)..( 8): Matrix.001 file - promoters60/1017046
aatacttt

SEQ ID NO: 42732 - DNA, 7 bp, Unknown
  misc_feature (1)..( 7): Matrix.001 file - promoters60/1017046
cttgaat

SEQ ID NO: 42733 - DNA, 7 bp, Unknown
  misc_feature (1)..( 7): Matrix.001 file - promoters60/1017046
tttattc

SEQ ID NO: 42734 - DNA, 6 bp, Unknown
  misc_feature (1)..( 6): Matrix.001 file - promoters60/1017046
ggtttt

SEQ ID NO: 42735 - DNA, 9 bp, Unknown
  misc_feature (1)..( 9): Matrix.001 file - promoters60/1017046
cctttttta

SEQ ID NO: 42736 - DNA, 6 bp, Unknown
  misc_feature (1)..( 6): Matrix.001 file - promoters60/1017046
ttttaa

SEQ ID NO: 42737 - DNA, 7 bp, Unknown
  misc_feature (1)..( 7): Matrix.001 file - promoters60/1017046
aaaaagt

SEQ ID NO: 42738 - DNA, 8 bp, Unknown
  misc_feature (1)..( 8): Matrix.001 file - promoters60/1017046
taaatttc

SEQ ID NO: 42739 - DNA, 7 bp, Unknown
  misc_feature (1)..( 7): Matrix.001 file - promoters60/1017046
agcaaca

SEQ ID NO: 42740 - DNA, 14 bp, Unknown
  misc_feature (1)..( 14): Matrix.001 file - promoters60/1017046
ttaacaatttattt

SEQ ID NO: 42741 - DNA, 7 bp, Unknown
  misc_feature (1)..( 7): Matrix.001 file - promoters60/1017046
ataattt

SEQ ID NO: 42742 - DNA, 7 bp, Unknown
  misc_feature (1)..( 7): Matrix.001 file - promoters60/1017046
tttactt

SEQ ID NO: 42743 - DNA, 7 bp, Unknown
  misc_feature (1)..( 7): Matrix.001 file - promoters60/1017046
aatattt

SEQ ID NO: 42744 - DNA, 7 bp, Unknown
  misc_feature (1)..( 7): Matrix.001 file - promoters60/1017046
tttattt

SEQ ID NO: 42745 - DNA, 6 bp, Unknown
  misc_feature (1)..( 6): Matrix.001 file - promoters60/1017046
attttt

SEQ ID NO: 42746 - DNA, 8 bp, Unknown
  misc_feature (1)..( 8): Matrix.001 file - promoters60/1017046
catctttt

SEQ ID NO: 42747 - DNA, 10 bp, Unknown
  misc_feature (1)..( 10): Matrix.001 file - promoters60/1017046
atgggttgga

SEQ ID NO: 42748 - DNA, 10 bp, Unknown
  misc_feature (1)..( 10): Matrix.001 file - promoters60/1017046
aaacaaagga

SEQ ID NO: 42749 - DNA, 12 bp, Unknown
  misc_feature (1)..( 12): Matrix.001 file - promoters60/1017046
tagaattactaa

SEQ ID NO: 42750 - DNA, 7 bp, Unknown
  misc_feature (1)..( 7): Matrix.001 file - promoters60/1017046
taataat

SEQ ID NO: 42751 - DNA, 6 bp, Unknown
  misc_feature (1)..( 6): Matrix.001 file - promoters60/1017046
atattt

SEQ ID NO: 42752 - DNA, 7 bp, Unknown
  misc_feature (1)..( 7): Matrix.001 file - promoters60/1017046
tatacaa

SEQ ID NO: 42753 - DNA, 7 bp, Unknown
  misc_feature (1)..( 7): Matrix.001 file - promoters60/1017046
tataatt

SEQ ID NO: 42754 - DNA, 6 bp, Unknown
  misc_feature (1)..( 6): Matrix.001 file - promoters60/1017046
aaaaaa

SEQ ID NO: 42755 - DNA, 7 bp, Unknown
  misc_feature (1)..( 7): Matrix.001 file - promoters60/1017046
aagagaa

SEQ ID NO: 42756 - DNA, 7 bp, Unknown
  misc_feature (1)..( 7): Matrix.001 file - promoters60/1017050
atattgt

SEQ ID NO: 42757 - DNA, 7 bp, Unknown
  misc_feature (1)..( 7): Matrix.001 file - promoters60/1017050
agaatcg

SEQ ID NO: 42758 - DNA, 7 bp, Unknown
  misc_feature (1)..( 7): Matrix.001 file - promoters60/1017050
tctaatg

SEQ ID NO: 42759 - DNA, 12 bp, Unknown
  misc_feature (1)..( 12): Matrix.001 file - promoters60/1017050
ttgattaaatga

SEQ ID NO: 42760 - DNA, 6 bp, Unknown
  misc_feature (1)..( 6): Matrix.001 file - promoters60/1017050
tacaca

SEQ ID NO: 42761 - DNA, 7 bp, Unknown
  misc_feature (1)..( 7): Matrix.001 file - promoters60/1017050
ttgaaat

SEQ ID NO: 42762 - DNA, 6 bp, Unknown
  misc_feature (1)..( 6): Matrix.001 file - promoters60/1017050
tgattt

SEQ ID NO: 42763 - DNA, 6 bp, Unknown
  misc_feature (1)..( 6): Matrix.001 file - promoters60/1017050
acttct

SEQ ID NO: 42764 - DNA, 7 bp, Unknown
  misc_feature (1)..( 7): Matrix.001 file - promoters60/1017050
tttaggg

SEQ ID NO: 42765 - DNA, 6 bp, Unknown
  misc_feature (1)..( 6): Matrix.001 file - promoters60/1017050
tacata

SEQ ID NO: 42766 - DNA, 7 bp, Unknown
  misc_feature (1)..( 7): Matrix.001 file - promoters60/1017050
ttgatat

SEQ ID NO: 42767 - DNA, 6 bp, Unknown
  misc_feature (1)..( 6): Matrix.001 file - promoters60/1017050
catctg

SEQ ID NO: 42768 - DNA, 9 bp, Unknown
  misc_feature (1)..( 9): Matrix.001 file - promoters60/1017050
ttgatgtag

SEQ ID NO: 42769 - DNA, 8 bp, Unknown
  misc_feature (1)..( 8): Matrix.001 file - promoters60/1017050
ttgagttt

SEQ ID NO: 42770 - DNA, 7 bp, Unknown
  misc_feature (1)..( 7): Matrix.001 file - promoters60/1017050
gttctgt

SEQ ID NO: 42771 - DNA, 7 bp, Unknown
  misc_feature (1)..( 7): Matrix.001 file - promoters60/1017094
cgatatt

SEQ ID NO: 42772 - DNA, 8 bp, Unknown
  misc_feature (1)..( 8): Matrix.001 file - promoters60/1017094
aaaattat

SEQ ID NO: 42773 - DNA, 8 bp, Unknown
  misc_feature (1)..( 8): Matrix.001 file - promoters60/1017094
aattatat

SEQ ID NO: 42774 - DNA, 11 bp, Unknown
  misc_feature (1)..( 11): Matrix.001 file - promoters60/1017094
ttcctagatac

SEQ ID NO: 42775 - DNA, 10 bp, Unknown
  misc_feature (1)..( 10): Matrix.001 file - promoters60/1017131
attaataaaa

SEQ ID NO: 42776 - DNA, 12 bp, Unknown
  misc_feature (1)..( 12): Matrix.001 file - promoters60/1017131
tttggataaaac

SEQ ID NO: 42777 - DNA, 10 bp, Unknown
  misc_feature (1)..( 10): Matrix.001 file - promoters60/1017131
ttggataaaa

SEQ ID NO: 42778 - DNA, 10 bp, Unknown
  misc_feature (1)..( 10): Matrix.001 file - promoters60/1017282
aaatcgatag

SEQ ID NO: 42779 - DNA, 10 bp, Unknown
  misc_feature (1)..( 10): Matrix.001 file - promoters60/1017282
aaatagataa

SEQ ID NO: 42780 - DNA, 10 bp, Unknown
  misc_feature (1)..( 10): Matrix.001 file - promoters60/1017286
aaaaaaatca

SEQ ID NO: 42781 - DNA, 8 bp, Unknown
  misc_feature (1)..( 8): Matrix.001 file - promoters60/1017286
caatatgt

SEQ ID NO: 42782 - DNA, 12 bp, Unknown
  misc_feature (1)..( 12): Matrix.001 file - promoters60/1017286
ttctaaaaaaat

SEQ ID NO: 42783 - DNA, 10 bp, Unknown
  misc_feature (1)..( 10): Matrix.001 file - promoters60/1017286
tcaatatttg

SEQ ID NO: 42784 - DNA, 11 bp, Unknown
  misc_feature (1)..( 11): Matrix.001 file - promoters60/1017286
gaacttttctc

SEQ ID NO: 42785 - DNA, 9 bp, Unknown
  misc_feature (1)..( 9): Matrix.001 file - promoters60/1017286
cttgtctcc

SEQ ID NO: 42786 - DNA, 9 bp, Unknown
  misc_feature (1)..( 9): Matrix.001 file - promoters60/1017316
aaaatttga

SEQ ID NO: 42787 - DNA, 10 bp, Unknown
  misc_feature (1)..( 10): Matrix.001 file - promoters60/1017316
agaaaatcat

SEQ ID NO: 42788 - DNA, 8 bp, Unknown
  misc_feature (1)..( 8): Matrix.001 file - promoters60/1017316
tttgtctg

SEQ ID NO: 42789 - DNA, 9 bp, Unknown
  misc_feature (1)..( 9): Matrix.001 file - promoters60/1017316
aaattaatt

SEQ ID NO: 42790 - DNA, 11 bp, Unknown
  misc_feature (1)..( 11): Matrix.001 file - promoters60/1017316
atgggcctata

SEQ ID NO: 42791 - DNA, 9 bp, Unknown
  misc_feature (1)..( 9): Matrix.001 file - promoters60/1017316
tttttactt

SEQ ID NO: 42792 - DNA, 7 bp, Unknown
  misc_feature (1)..( 7): Matrix.001 file - promoters60/1017316
ttacttt

SEQ ID NO: 42793 - DNA, 9 bp, Unknown
  misc_feature (1)..( 9): Matrix.001 file - promoters60/1017316
atgtttcaa

SEQ ID NO: 42794 - DNA, 10 bp, Unknown
  misc_feature (1)..( 10): Matrix.001 file - promoters60/1017358
ccttatatat

SEQ ID NO: 42795 - DNA, 11 bp, Unknown
  misc_feature (1)..( 11): Matrix.001 file - promoters60/1017434
aaaaaataccc

SEQ ID NO: 42796 - DNA, 10 bp, Unknown
  misc_feature (1)..( 10): Matrix.001 file - promoters60/1017434
tttaataaaa

SEQ ID NO: 42797 - DNA, 7 bp, Unknown
  misc_feature (1)..( 7): Matrix.001 file - promoters60/1017476
ttaaata

SEQ ID NO: 42798 - DNA, 12 bp, Unknown
  misc_feature (1)..( 12): Matrix.001 file - promoters60/1017476
aagaatttgttt

SEQ ID NO: 42799 - DNA, 8 bp, Unknown
  misc_feature (1)..( 8): Matrix.001 file - promoters60/1017476
aaagaacc

SEQ ID NO: 42800 - DNA, 7 bp, Unknown
  misc_feature (1)..( 7): Matrix.001 file - promoters60/1017476
tttgtga

SEQ ID NO: 42801 - DNA, 6 bp, Unknown
  misc_feature (1)..( 6): Matrix.001 file - promoters60/1017476
gtttgg

SEQ ID NO: 42802 - DNA, 8 bp, Unknown
  misc_feature (1)..( 8): Matrix.001 file - promoters60/1017476
aaggtttt

SEQ ID NO: 42803 - DNA, 9 bp, Unknown
  misc_feature (1)..( 9): Matrix.001 file - promoters60/1017476
ttttatttt

SEQ ID NO: 42804 - DNA, 8 bp, Unknown
  misc_feature (1)..( 8): Matrix.001 file - promoters60/1017476
tgaaatta

SEQ ID NO: 42805 - DNA, 6 bp, Unknown
  misc_feature (1)..( 6): Matrix.001 file - promoters60/1017476
gaaggt

SEQ ID NO: 42806 - DNA, 8 bp, Unknown
  misc_feature (1)..( 8): Matrix.001 file - promoters60/1017476
aaaaaaaa

SEQ ID NO: 42807 - DNA, 7 bp, Unknown
  misc_feature (1)..( 7): Matrix.001 file - promoters60/1017476
ttaatct

SEQ ID NO: 42808 - DNA, 6 bp, Unknown
  misc_feature (1)..( 6): Matrix.001 file - promoters60/1017476
atcaga

SEQ ID NO: 42809 - DNA, 6 bp, Unknown
  misc_feature (1)..( 6): Matrix.001 file - promoters60/1017476
acgaat

SEQ ID NO: 42810 - DNA, 7 bp, Unknown
  misc_feature (1)..( 7): Matrix.001 file - promoters60/1017476
gacatcg

SEQ ID NO: 42811 - DNA, 6 bp, Unknown
  misc_feature (1)..( 6): Matrix.001 file - promoters60/1017476
gaccat

SEQ ID NO: 42812 - DNA, 7 bp, Unknown
  misc_feature (1)..( 7): Matrix.001 file - promoters60/1017476
ttcgaga

SEQ ID NO: 42813 - DNA, 10 bp, Unknown
  misc_feature (1)..( 10): Matrix.001 file - promoters60/1017552
agaattataa

SEQ ID NO: 42814 - DNA, 6 bp, Unknown
  misc_feature (1)..( 6): Matrix.001 file - promoters60/1017552
ggaaaa

SEQ ID NO: 42815 - DNA, 7 bp, Unknown
  misc_feature (1)..( 7): Matrix.001 file - promoters60/1017552
ttagaac

SEQ ID NO: 42816 - DNA, 7 bp, Unknown
  misc_feature (1)..( 7): Matrix.001 file - promoters60/1017552
gacaaag

SEQ ID NO: 42817 - DNA, 6 bp, Unknown
  misc_feature (1)..( 6): Matrix.001 file - promoters60/1017562
ttacta

SEQ ID NO: 42818 - DNA, 7 bp, Unknown
  misc_feature (1)..( 7): Matrix.001 file - promoters60/1017562
atatata

SEQ ID NO: 42819 - DNA, 9 bp, Unknown
  misc_feature (1)..( 9): Matrix.001 file - promoters60/1017562
ataatatat

SEQ ID NO: 42820 - DNA, 7 bp, Unknown
  misc_feature (1)..( 7): Matrix.001 file - promoters60/1017562
tagactt

SEQ ID NO: 42821 - DNA, 7 bp, Unknown
  misc_feature (1)..( 7): Matrix.001 file - promoters60/1017562
tgggtgg

SEQ ID NO: 42822 - DNA, 9 bp, Unknown
  misc_feature (1)..( 9): Matrix.001 file - promoters60/1017562
aatcaaaca

SEQ ID NO: 42823 - DNA, 6 bp, Unknown
  misc_feature (1)..( 6): Matrix.001 file - promoters60/1017562
ccaaaa

SEQ ID NO: 42824 - DNA, 8 bp, Unknown
  misc_feature (1)..( 8): Matrix.001 file - promoters60/1017562
cttagata

SEQ ID NO: 42825 - DNA, 6 bp, Unknown
  misc_feature (1)..( 6): Matrix.001 file - promoters60/1017562
atataa

SEQ ID NO: 42826 - DNA, 9 bp, Unknown
  misc_feature (1)..( 9): Matrix.001 file - promoters60/1017562
ccattaaac

SEQ ID NO: 42827 - DNA, 8 bp, Unknown
  misc_feature (1)..( 8): Matrix.001 file - promoters60/1017562
caaagttt

SEQ ID NO: 42828 - DNA, 6 bp, Unknown
  misc_feature (1)..( 6): Matrix.001 file - promoters60/1017562
ttgttt

SEQ ID NO: 42829 - DNA, 9 bp, Unknown
  misc_feature (1)..( 9): Matrix.001 file - promoters60/1017562
aaaaactgt

SEQ ID NO: 42830 - DNA, 6 bp, Unknown
  misc_feature (1)..( 6): Matrix.001 file - promoters60/1017562
taacac

SEQ ID NO: 42831 - DNA, 6 bp, Unknown
  misc_feature (1)..( 6): Matrix.001 file - promoters60/1017562
caaaaa

SEQ ID NO: 42832 - DNA, 8 bp, Unknown
  misc_feature (1)..( 8): Matrix.001 file - promoters60/1017562
ataaatat

SEQ ID NO: 42833 - DNA, 7 bp, Unknown
  misc_feature (1)..( 7): Matrix.001 file - promoters60/1017562
aaaccag

SEQ ID NO: 42834 - DNA, 7 bp, Unknown
  misc_feature (1)..( 7): Matrix.001 file - promoters60/1017562
gaaaaaa

SEQ ID NO: 42835 - DNA, 7 bp, Unknown
  misc_feature (1)..( 7): Matrix.001 file - promoters60/1017562
accacat

SEQ ID NO: 42836 - DNA, 7 bp, Unknown
  misc_feature (1)..( 7): Matrix.001 file - promoters60/1017562
aaaagat

SEQ ID NO: 42837 - DNA, 6 bp, Unknown
  misc_feature (1)..( 6): Matrix.001 file - promoters60/1017618
atatca

SEQ ID NO: 42838 - DNA, 13 bp, Unknown
  misc_feature (1)..( 13): Matrix.001 file - promoters60/1017618
tcctataaaaaag

SEQ ID NO: 42839 - DNA, 8 bp, Unknown
  misc_feature (1)..( 8): Matrix.001 file - promoters60/1017618
ctatgaaa

SEQ ID NO: 42840 - DNA, 10 bp, Unknown
  misc_feature (1)..( 10): Matrix.001 file - promoters60/1017618
taatatctca

SEQ ID NO: 42841 - DNA, 10 bp, Unknown
  misc_feature (1)..( 10): Matrix.001 file - promoters60/1017626
tcagtaaaaa

SEQ ID NO: 42842 - DNA, 6 bp, Unknown
  misc_feature (1)..( 6): Matrix.001 file - promoters60/1017626
aaaaaa

SEQ ID NO: 42843 - DNA, 6 bp, Unknown
  misc_feature (1)..( 6): Matrix.001 file - promoters60/1017626
aattta

SEQ ID NO: 42844 - DNA, 6 bp, Unknown
  misc_feature (1)..( 6): Matrix.001 file - promoters60/1017626
tttaat

SEQ ID NO: 42845 - DNA, 9 bp, Unknown
  misc_feature (1)..( 9): Matrix.001 file - promoters60/1017626
ttttataat

SEQ ID NO: 42846 - DNA, 9 bp, Unknown
  misc_feature (1)..( 9): Matrix.001 file - promoters60/1017626
tatccggtt

SEQ ID NO: 42847 - DNA, 6 bp, Unknown
  misc_feature (1)..( 6): Matrix.001 file - promoters60/1017626
ataagt

SEQ ID NO: 42848 - DNA, 7 bp, Unknown
  misc_feature (1)..( 7): Matrix.001 file - promoters60/1017626
tctctct

SEQ ID NO: 42849 - DNA, 9 bp, Unknown
  misc_feature (1)..( 9): Matrix.001 file - promoters60/1017626
tcttcatct

SEQ ID NO: 42850 - DNA, 7 bp, Unknown
  misc_feature (1)..( 7): Matrix.001 file - promoters60/1017626
aaattgg

SEQ ID NO: 42851 - DNA, 7 bp, Unknown
  misc_feature (1)..( 7): Matrix.001 file - promoters60/1017626
gaacaaa

SEQ ID NO: 42852 - DNA, 7 bp, Unknown
  misc_feature (1)..( 7): Matrix.001 file - promoters60/1017626
atgaaat

SEQ ID NO: 42853 - DNA, 8 bp, Unknown
  misc_feature (1)..( 8): Matrix.001 file - promoters60/1017626
cttgaaat

SEQ ID NO: 42854 - DNA, 6 bp, Unknown
  misc_feature (1)..( 6): Matrix.001 file - promoters60/1017626
aattag

SEQ ID NO: 42855 - DNA, 7 bp, Unknown
  misc_feature (1)..( 7): Matrix.001 file - promoters60/1017626
tttgatc

SEQ ID NO: 42856 - DNA, 6 bp, Unknown
  misc_feature (1)..( 6): Matrix.001 file - promoters60/1017626
aaatta

SEQ ID NO: 42857 - DNA, 7 bp, Unknown
  misc_feature (1)..( 7): Matrix.001 file - promoters60/1017626
ccatcta

SEQ ID NO: 42858 - DNA, 7 bp, Unknown
  misc_feature (1)..( 7): Matrix.001 file - promoters60/1017626
aaaccaa

SEQ ID NO: 42859 - DNA, 6 bp, Unknown
  misc_feature (1)..( 6): Matrix.001 file - promoters60/1017626
taataa

SEQ ID NO: 42860 - DNA, 6 bp, Unknown
  misc_feature (1)..( 6): Matrix.001 file - promoters60/1017626
agttct

SEQ ID NO: 42861 - DNA, 7 bp, Unknown
  misc_feature (1)..( 7): Matrix.001 file - promoters60/1017626
gaaaact

SEQ ID NO: 42862 - DNA, 6 bp, Unknown
  misc_feature (1)..( 6): Matrix.001 file - promoters60/1017626
actcat

SEQ ID NO: 42863 - DNA, 7 bp, Unknown
  misc_feature (1)..( 7): Matrix.001 file - promoters60/1017626
gcctata

SEQ ID NO: 42864 - DNA, 7 bp, Unknown
  misc_feature (1)..( 7): Matrix.001 file - promoters60/1017626
tataaat

SEQ ID NO: 42865 - DNA, 6 bp, Unknown
  misc_feature (1)..( 6): Matrix.001 file - promoters60/1017649
caaaca

SEQ ID NO: 42866 - DNA, 8 bp, Unknown
  misc_feature (1)..( 8): Matrix.001 file - promoters60/1017649
caaataaa

SEQ ID NO: 42867 - DNA, 8 bp, Unknown
  misc_feature (1)..( 8): Matrix.001 file - promoters60/1017649
actactga

SEQ ID NO: 42868 - DNA, 7 bp, Unknown
  misc_feature (1)..( 7): Matrix.001 file - promoters60/1017649
ctttgaa

SEQ ID NO: 42869 - DNA, 9 bp, Unknown
  misc_feature (1)..( 9): Matrix.001 file - promoters60/1017649
taaactcta

SEQ ID NO: 42870 - DNA, 8 bp, Unknown
  misc_feature (1)..( 8): Matrix.001 file - promoters60/1017649
aattttat

SEQ ID NO: 42871 - DNA, 7 bp, Unknown
  misc_feature (1)..( 7): Matrix.001 file - promoters60/1017649
attatag

SEQ ID NO: 42872 - DNA, 7 bp, Unknown
  misc_feature (1)..( 7): Matrix.001 file - promoters60/1017649
ataaaaa

SEQ ID NO: 42873 - DNA, 6 bp, Unknown
  misc_feature (1)..( 6): Matrix.001 file - promoters60/1017649
aaataa

SEQ ID NO: 42874 - DNA, 7 bp, Unknown
  misc_feature (1)..( 7): Matrix.001 file - promoters60/1017649
aacattt

SEQ ID NO: 42875 - DNA, 6 bp, Unknown
  misc_feature (1)..( 6): Matrix.001 file - promoters60/1017649
tttgat

SEQ ID NO: 42876 - DNA, 7 bp, Unknown
  misc_feature (1)..( 7): Matrix.001 file - promoters60/1017649
aaactca

SEQ ID NO: 42877 - DNA, 8 bp, Unknown
  misc_feature (1)..( 8): Matrix.001 file - promoters60/1017649
aatttgat

SEQ ID NO: 42878 - DNA, 7 bp, Unknown
  misc_feature (1)..( 7): Matrix.001 file - promoters60/1017649
ataagac

SEQ ID NO: 42879 - DNA, 7 bp, Unknown
  misc_feature (1)..( 7): Matrix.001 file - promoters60/1017649
caaaaag

SEQ ID NO: 42880 - DNA, 6 bp, Unknown
  misc_feature (1)..( 6): Matrix.001 file - promoters60/1017649
ttgatg

SEQ ID NO: 42881 - DNA, 6 bp, Unknown
  misc_feature (1)..( 6): Matrix.001 file - promoters60/1017649
cacatc

SEQ ID NO: 42882 - DNA, 8 bp, Unknown
  misc_feature (1)..( 8): Matrix.001 file - promoters60/1017693
aataaagt

SEQ ID NO: 42883 - DNA, 7 bp, Unknown
  misc_feature (1)..( 7): Matrix.001 file - promoters60/1017693
attggta

SEQ ID NO: 42884 - DNA, 9 bp, Unknown
  misc_feature (1)..( 9): Matrix.001 file - promoters60/1017693
atgtctttg

SEQ ID NO: 42885 - DNA, 6 bp, Unknown
  misc_feature (1)..( 6): Matrix.001 file - promoters60/1017693
aaaaac

SEQ ID NO: 42886 - DNA, 6 bp, Unknown
  misc_feature (1)..( 6): Matrix.001 file - promoters60/1017693
tccaaa

SEQ ID NO: 42887 - DNA, 7 bp, Unknown
  misc_feature (1)..( 7): Matrix.001 file - promoters60/1017693
aatctat

SEQ ID NO: 42888 - DNA, 6 bp, Unknown
  misc_feature (1)..( 6): Matrix.001 file - promoters60/1017693
tgtgtt

SEQ ID NO: 42889 - DNA, 10 bp, Unknown
  misc_feature (1)..( 10): Matrix.001 file - promoters60/1017693
ttttcttctc

SEQ ID NO: 42890 - DNA, 6 bp, Unknown
  misc_feature (1)..( 6): Matrix.001 file - promoters60/1017693
tggtca

SEQ ID NO: 42891 - DNA, 6 bp, Unknown
  misc_feature (1)..( 6): Matrix.001 file - promoters60/1017693
tggaaa

SEQ ID NO: 42892 - DNA, 7 bp, Unknown
  misc_feature (1)..( 7): Matrix.001 file - promoters60/1017693
aaccata

SEQ ID NO: 42893 - DNA, 8 bp, Unknown
  misc_feature (1)..( 8): Matrix.001 file - promoters60/1017693
aagccttt

SEQ ID NO: 42894 - DNA, 7 bp, Unknown
  misc_feature (1)..( 7): Matrix.001 file - promoters60/1017693
caaagag

SEQ ID NO: 42895 - DNA, 10 bp, Unknown
  misc_feature (1)..( 10): Matrix.001 file - promoters60/1017693
ttttctgttg

SEQ ID NO: 42896 - DNA, 10 bp, Unknown
  misc_feature (1)..( 10): Matrix.001 file - promoters60/1017770
tacttcctta

SEQ ID NO: 42897 - DNA, 10 bp, Unknown
  misc_feature (1)..( 10): Matrix.001 file - promoters60/1017770
aaaaatgatt

SEQ ID NO: 42898 - DNA, 9 bp, Unknown
  misc_feature (1)..( 9): Matrix.001 file - promoters60/1017770
catatgtat

SEQ ID NO: 42899 - DNA, 13 bp, Unknown
  misc_feature (1)..( 13): Matrix.001 file - promoters60/1017777
aaagtgtatccaa

SEQ ID NO: 42900 - DNA, 6 bp, Unknown
  misc_feature (1)..( 6): Matrix.001 file - promoters60/1017802
atattg

SEQ ID NO: 42901 - DNA, 10 bp, Unknown
  misc_feature (1)..( 10): Matrix.001 file - promoters60/1017802
attacaatat

SEQ ID NO: 42902 - DNA, 20 bp, Unknown
  misc_feature (1)..( 20): Matrix.001 file - promoters60/1017802
aaagttgctacaaattatag

SEQ ID NO: 42903 - DNA, 22 bp, Unknown
  misc_feature (1)..( 22): Matrix.001 file - promoters60/1017802
tcttttctgattttgtttctca

SEQ ID NO: 42904 - DNA, 7 bp, Unknown
  misc_feature (1)..( 7): Matrix.001 file - promoters60/1017802
taccaaa

SEQ ID NO: 42905 - DNA, 8 bp, Unknown
  misc_feature (1)..( 8): Matrix.001 file - promoters60/1017802
caatatga

SEQ ID NO: 42906 - DNA, 7 bp, Unknown
  misc_feature (1)..( 7): Matrix.001 file - promoters60/1017802
ctcaaat

SEQ ID NO: 42907 - DNA, 7 bp, Unknown
  misc_feature (1)..( 7): Matrix.001 file - promoters60/1017802
aaatata

SEQ ID NO: 42908 - DNA, 7 bp, Unknown
  misc_feature (1)..( 7): Matrix.001 file - promoters60/1017802
ttcaatg

SEQ ID NO: 42909 - DNA, 7 bp, Unknown
  misc_feature (1)..( 7): Matrix.001 file - promoters60/1017802
caaatct

SEQ ID NO: 42910 - DNA, 7 bp, Unknown
  misc_feature (1)..( 7): Matrix.001 file - promoters60/1017802
aattctt

SEQ ID NO: 42911 - DNA, 8 bp, Unknown
  misc_feature (1)..( 8): Matrix.001 file - promoters60/1017802
tcttttct

SEQ ID NO: 42912 - DNA, 8 bp, Unknown
  misc_feature (1)..( 8): Matrix.001 file - promoters60/1017802
gataaaat

SEQ ID NO: 42913 - DNA, 6 bp, Unknown
  misc_feature (1)..( 6): Matrix.001 file - promoters60/1017802
atagga

SEQ ID NO: 42914 - DNA, 6 bp, Unknown
  misc_feature (1)..( 6): Matrix.001 file - promoters60/1017802
atagga

SEQ ID NO: 42915 - DNA, 8 bp, Unknown
  misc_feature (1)..( 8): Matrix.001 file - promoters60/1017802
ataaaatt

SEQ ID NO: 42916 - DNA, 6 bp, Unknown
  misc_feature (1)..( 6): Matrix.001 file - promoters60/1017802
aaaaaa

SEQ ID NO: 42917 - DNA, 12 bp, Unknown
  misc_feature (1)..( 12): Matrix.001 file - promoters60/1017802
aaaaaataaaaa

SEQ ID NO: 42918 - DNA, 7 bp, Unknown
  misc_feature (1)..( 7): Matrix.001 file - promoters60/1017802
gcacaaa

SEQ ID NO: 42919 - DNA, 6 bp, Unknown
  misc_feature (1)..( 6): Matrix.001 file - promoters60/1017802
ttgata

SEQ ID NO: 42920 - DNA, 7 bp, Unknown
  misc_feature (1)..( 7): Matrix.001 file - promoters60/1017802
tttccta

SEQ ID NO: 42921 - DNA, 9 bp, Unknown
  misc_feature (1)..( 9): Matrix.001 file - promoters60/1017802
aaaaataaa

SEQ ID NO: 42922 - DNA, 9 bp, Unknown
  misc_feature (1)..( 9): Matrix.001 file - promoters60/1017802
aaacaaaaa

SEQ ID NO: 42923 - DNA, 8 bp, Unknown
  misc_feature (1)..( 8): Matrix.001 file - promoters60/1017802
ctaaatat

SEQ ID NO: 42924 - DNA, 6 bp, Unknown
  misc_feature (1)..( 6): Matrix.001 file - promoters60/1017802
aaatta

SEQ ID NO: 42925 - DNA, 8 bp, Unknown
  misc_feature (1)..( 8): Matrix.001 file - promoters60/1017883
caagaaaa

SEQ ID NO: 42926 - DNA, 8 bp, Unknown
  misc_feature (1)..( 8): Matrix.001 file - promoters60/1017883
tataaata

SEQ ID NO: 42927 - DNA, 13 bp, Unknown
  misc_feature (1)..( 13): Matrix.001 file - promoters60/1017883
aacaaacttatat

SEQ ID NO: 42928 - DNA, 10 bp, Unknown
  misc_feature (1)..( 10): Matrix.001 file - promoters60/1017883
ttattatgtg

SEQ ID NO: 42929 - DNA, 10 bp, Unknown
  misc_feature (1)..( 10): Matrix.001 file - promoters60/1017883
caaactgata

SEQ ID NO: 42930 - DNA, 12 bp, Unknown
  misc_feature (1)..( 12): Matrix.001 file - promoters60/1017883
aaacaaatcttt

SEQ ID NO: 42931 - DNA, 9 bp, Unknown
  misc_feature (1)..( 9): Matrix.001 file - promoters60/1017883
gaaaaaaaa

SEQ ID NO: 42932 - DNA, 8 bp, Unknown
  misc_feature (1)..( 8): Matrix.001 file - promoters60/1017883
aaatttga

SEQ ID NO: 42933 - DNA, 6 bp, Unknown
  misc_feature (1)..( 6): Matrix.001 file - promoters60/1017964
aactgt

SEQ ID NO: 42934 - DNA, 9 bp, Unknown
  misc_feature (1)..( 9): Matrix.001 file - promoters60/1017964
tgaaaagaa

SEQ ID NO: 42935 - DNA, 7 bp, Unknown
  misc_feature (1)..( 7): Matrix.001 file - promoters60/1017964
tattgaa

SEQ ID NO: 42936 - DNA, 6 bp, Unknown
  misc_feature (1)..( 6): Matrix.001 file - promoters60/1017964
atattc

SEQ ID NO: 42937 - DNA, 6 bp, Unknown
  misc_feature (1)..( 6): Matrix.001 file - promoters60/1017964
tgatat

SEQ ID NO: 42938 - DNA, 7 bp, Unknown
  misc_feature (1)..( 7): Matrix.001 file - promoters60/1017964
ttgatga

SEQ ID NO: 42939 - DNA, 7 bp, Unknown
  misc_feature (1)..( 7): Matrix.001 file - promoters60/1017964
ggaatga

SEQ ID NO: 42940 - DNA, 8 bp, Unknown
  misc_feature (1)..( 8): Matrix.001 file - promoters60/1017964
agtataaa

SEQ ID NO: 42941 - DNA, 6 bp, Unknown
  misc_feature (1)..( 6): Matrix.001 file - promoters60/1017964
gtcgaa

SEQ ID NO: 42942 - DNA, 6 bp, Unknown
  misc_feature (1)..( 6): Matrix.001 file - promoters60/1017964
aaaata

SEQ ID NO: 42943 - DNA, 6 bp, Unknown
  misc_feature (1)..( 6): Matrix.001 file - promoters60/1017964
ttgtat

SEQ ID NO: 42944 - DNA, 7 bp, Unknown
  misc_feature (1)..( 7): Matrix.001 file - promoters60/1017964
cacggtc

SEQ ID NO: 42945 - DNA, 6 bp, Unknown
  misc_feature (1)..( 6): Matrix.001 file - promoters60/1017964
tctgaa

SEQ ID NO: 42946 - DNA, 6 bp, Unknown
  misc_feature (1)..( 6): Matrix.001 file - promoters60/1017964
ggttta

SEQ ID NO: 42947 - DNA, 6 bp, Unknown
  misc_feature (1)..( 6): Matrix.001 file - promoters60/1017964
ttgact

SEQ ID NO: 42948 - DNA, 6 bp, Unknown
  misc_feature (1)..( 6): Matrix.001 file - promoters60/1017964
ggctgt

SEQ ID NO: 42949 - DNA, 9 bp, Unknown
  misc_feature (1)..( 9): Matrix.001 file - promoters60/1018052
atcagtttt

SEQ ID NO: 42950 - DNA, 8 bp, Unknown
  misc_feature (1)..( 8): Matrix.001 file - promoters60/1018052
attgttgt

SEQ ID NO: 42951 - DNA, 9 bp, Unknown
  misc_feature (1)..( 9): Matrix.001 file - promoters60/1018052
atttccaat

SEQ ID NO: 42952 - DNA, 8 bp, Unknown
  misc_feature (1)..( 8): Matrix.001 file - promoters60/1018052
agtttcat

SEQ ID NO: 42953 - DNA, 6 bp, Unknown
  misc_feature (1)..( 6): Matrix.001 file - promoters60/1018055
tgattg

SEQ ID NO: 42954 - DNA, 7 bp, Unknown
  misc_feature (1)..( 7): Matrix.001 file - promoters60/1018055
ttaattt

SEQ ID NO: 42955 - DNA, 7 bp, Unknown
  misc_feature (1)..( 7): Matrix.001 file - promoters60/1018055
ttttctt

SEQ ID NO: 42956 - DNA, 7 bp, Unknown
  misc_feature (1)..( 7): Matrix.001 file - promoters60/1018055
ttatgtg

SEQ ID NO: 42957 - DNA, 6 bp, Unknown
  misc_feature (1)..( 6): Matrix.001 file - promoters60/1018055
tttctt

SEQ ID NO: 42958 - DNA, 8 bp, Unknown
  misc_feature (1)..( 8): Matrix.001 file - promoters60/1018055
aatcaatt

SEQ ID NO: 42959 - DNA, 6 bp, Unknown
  misc_feature (1)..( 6): Matrix.001 file - promoters60/1018055
ttattt

SEQ ID NO: 42960 - DNA, 11 bp, Unknown
  misc_feature (1)..( 11): Matrix.001 file - promoters60/1018055
aaagacaaaat

SEQ ID NO: 42961 - DNA, 8 bp, Unknown
  misc_feature (1)..( 8): Matrix.001 file - promoters60/1018055
gtagagaa

SEQ ID NO: 42962 - DNA, 6 bp, Unknown
  misc_feature (1)..( 6): Matrix.001 file - promoters60/1018055
agaaga

SEQ ID NO: 42963 - DNA, 6 bp, Unknown
  misc_feature (1)..( 6): Matrix.001 file - promoters60/1018055
gtgatt

SEQ ID NO: 42964 - DNA, 7 bp, Unknown
  misc_feature (1)..( 7): Matrix.001 file - promoters60/1018057
caacgaa

SEQ ID NO: 42965 - DNA, 8 bp, Unknown
  misc_feature (1)..( 8): Matrix.001 file - promoters60/1018057
aaatcgtt

SEQ ID NO: 42966 - DNA, 7 bp, Unknown
  misc_feature (1)..( 7): Matrix.001 file - promoters60/1018057
gataagc

SEQ ID NO: 42967 - DNA, 7 bp, Unknown
  misc_feature (1)..( 7): Matrix.001 file - promoters60/1018057
tggagac

SEQ ID NO: 42968 - DNA, 7 bp, Unknown
  misc_feature (1)..( 7): Matrix.001 file - promoters60/1018057
ggcgaag

SEQ ID NO: 42969 - DNA, 7 bp, Unknown
  misc_feature (1)..( 7): Matrix.001 file - promoters60/1018057
aataagc

SEQ ID NO: 42970 - DNA, 13 bp, Unknown
  misc_feature (1)..( 13): Matrix.001 file - promoters60/1018057
caaacaggagtat

SEQ ID NO: 42971 - DNA, 9 bp, Unknown
  misc_feature (1)..( 9): Matrix.001 file - promoters60/1018057
agtagattt

SEQ ID NO: 42972 - DNA, 7 bp, Unknown
  misc_feature (1)..( 7): Matrix.001 file - promoters60/1018057
atggtat

SEQ ID NO: 42973 - DNA, 6 bp, Unknown
  misc_feature (1)..( 6): Matrix.001 file - promoters60/1018057
taaata

SEQ ID NO: 42974 - DNA, 7 bp, Unknown
  misc_feature (1)..( 7): Matrix.001 file - promoters60/1018057
aacctta

SEQ ID NO: 42975 - DNA, 7 bp, Unknown
  misc_feature (1)..( 7): Matrix.001 file - promoters60/1018057
gaaatac

SEQ ID NO: 42976 - DNA, 6 bp, Unknown
  misc_feature (1)..( 6): Matrix.001 file - promoters60/1018057
aaggag

SEQ ID NO: 42977 - DNA, 6 bp, Unknown
  misc_feature (1)..( 6): Matrix.001 file - promoters60/1018057
gtccca

SEQ ID NO: 42978 - DNA, 7 bp, Unknown
  misc_feature (1)..( 7): Matrix.001 file - promoters60/1018057
tcagttt

SEQ ID NO: 42979 - DNA, 7 bp, Unknown
  misc_feature (1)..( 7): Matrix.001 file - promoters60/1018057
tttatat

SEQ ID NO: 42980 - DNA, 6 bp, Unknown
  misc_feature (1)..( 6): Matrix.001 file - promoters60/1018057
attatt

SEQ ID NO: 42981 - DNA, 9 bp, Unknown
  misc_feature (1)..( 9): Matrix.001 file - promoters60/1018159
agtaagaaa

SEQ ID NO: 42982 - DNA, 6 bp, Unknown
  misc_feature (1)..( 6): Matrix.001 file - promoters60/1018159
gaaatc

SEQ ID NO: 42983 - DNA, 7 bp, Unknown
  misc_feature (1)..( 7): Matrix.001 file - promoters60/1018159
tcagcct

SEQ ID NO: 42984 - DNA, 7 bp, Unknown
  misc_feature (1)..( 7): Matrix.001 file - promoters60/1018159
aatatta

SEQ ID NO: 42985 - DNA, 9 bp, Unknown
  misc_feature (1)..( 9): Matrix.001 file - promoters60/1018159
atttaaacc

SEQ ID NO: 42986 - DNA, 6 bp, Unknown
  misc_feature (1)..( 6): Matrix.001 file - promoters60/1018159
acatga

SEQ ID NO: 42987 - DNA, 9 bp, Unknown
  misc_feature (1)..( 9): Matrix.001 file - promoters60/1018159
ggcaaggaa

SEQ ID NO: 42988 - DNA, 9 bp, Unknown
  misc_feature (1)..( 9): Matrix.001 file - promoters60/1018159
agaaacata

SEQ ID NO: 42989 - DNA, 6 bp, Unknown
  misc_feature (1)..( 6): Matrix.001 file - promoters60/1018159
aggaag

SEQ ID NO: 42990 - DNA, 7 bp, Unknown
  misc_feature (1)..( 7): Matrix.001 file - promoters60/1018159
ataaacc

SEQ ID NO: 42991 - DNA, 8 bp, Unknown
  misc_feature (1)..( 8): Matrix.001 file - promoters60/1018159
taaagatt

SEQ ID NO: 42992 - DNA, 6 bp, Unknown
  misc_feature (1)..( 6): Matrix.001 file - promoters60/1018159
attggg

SEQ ID NO: 42993 - DNA, 6 bp, Unknown
  misc_feature (1)..( 6): Matrix.001 file - promoters60/1018159
ccattt

SEQ ID NO: 42994 - DNA, 7 bp, Unknown
  misc_feature (1)..( 7): Matrix.001 file - promoters60/1018159
aatggcg

SEQ ID NO: 42995 - DNA, 6 bp, Unknown
  misc_feature (1)..( 6): Matrix.001 file - promoters60/1018159
aaatta

SEQ ID NO: 42996 - DNA, 6 bp, Unknown
  misc_feature (1)..( 6): Matrix.001 file - promoters60/1018159
taagag

SEQ ID NO: 42997 - DNA, 7 bp, Unknown
  misc_feature (1)..( 7): Matrix.001 file - promoters60/1018159
taaattc

SEQ ID NO: 42998 - DNA, 9 bp, Unknown
  misc_feature (1)..( 9): Matrix.001 file - promoters60/1018159
cgattaaat

SEQ ID NO: 42999 - DNA, 9 bp, Unknown
  misc_feature (1)..( 9): Matrix.001 file - promoters60/1018159
aatttgcga

SEQ ID NO: 43000 - DNA, 7 bp, Unknown
  misc_feature (1)..( 7): Matrix.001 file - promoters60/1018159
tttagaa

SEQ ID NO: 43001 - DNA, 8 bp, Unknown
  misc_feature (1)..( 8): Matrix.001 file - promoters60/1018159
atttaaat

SEQ ID NO: 43002 - DNA, 12 bp, Unknown
  misc_feature (1)..( 12): Matrix.001 file - promoters60/1018159
tgaaatagttaa

SEQ ID NO: 43003 - DNA, 6 bp, Unknown
  misc_feature (1)..( 6): Matrix.001 file - promoters60/1018159
caactt

SEQ ID NO: 43004 - DNA, 10 bp, Unknown
  misc_feature (1)..( 10): Matrix.001 file - promoters60/1018190
gaatttgttg

SEQ ID NO: 43005 - DNA, 9 bp, Unknown
  misc_feature (1)..( 9): Matrix.001 file - promoters60/1018190
attttttta

SEQ ID NO: 43006 - DNA, 9 bp, Unknown
  misc_feature (1)..( 9): Matrix.001 file - promoters60/1018190
aaaatataa

SEQ ID NO: 43007 - DNA, 9 bp, Unknown
  misc_feature (1)..( 9): Matrix.001 file - promoters60/1018190
tgtttgatt

SEQ ID NO: 43008 - DNA, 10 bp, Unknown
  misc_feature (1)..( 10): Matrix.001 file - promoters60/1018276
aatttgtttg

SEQ ID NO: 43009 - DNA, 10 bp, Unknown
  misc_feature (1)..( 10): Matrix.001 file - promoters60/1018276
gaatttgttt

SEQ ID NO: 43010 - DNA, 12 bp, Unknown
  misc_feature (1)..( 12): Matrix.001 file - promoters60/1018276
aacattttttaa

SEQ ID NO: 43011 - DNA, 10 bp, Unknown
  misc_feature (1)..( 10): Matrix.001 file - promoters60/1018276
tataatgtaa

SEQ ID NO: 43012 - DNA, 7 bp, Unknown
  misc_feature (1)..( 7): Matrix.001 file - promoters60/1018276
atttgta

SEQ ID NO: 43013 - DNA, 13 bp, Unknown
  misc_feature (1)..( 13): Matrix.001 file - promoters60/1018276
aatatgtttgatt

SEQ ID NO: 43014 - DNA, 10 bp, Unknown
  misc_feature (1)..( 10): Matrix.001 file - promoters60/1018276
tcaatatcac

SEQ ID NO: 43015 - DNA, 5 bp, Unknown
  misc_feature (1)..( 5): Matrix.001 file - promoters60/1018391
aaaag

SEQ ID NO: 43016 - DNA, 10 bp, Unknown
  misc_feature (1)..( 10): Matrix.001 file - promoters60/1018454
agaaaatatt

SEQ ID NO: 43017 - DNA, 9 bp, Unknown
  misc_feature (1)..( 9): Matrix.001 file - promoters60/1018499
aataaaaat

SEQ ID NO: 43018 - DNA, 7 bp, Unknown
  misc_feature (1)..( 7): Matrix.001 file - promoters60/1018499
cataaac

SEQ ID NO: 43019 - DNA, 9 bp, Unknown
  misc_feature (1)..( 9): Matrix.001 file - promoters60/1018519
tcacaattg

SEQ ID NO: 43020 - DNA, 7 bp, Unknown
  misc_feature (1)..( 7): Matrix.001 file - promoters60/1018523
aaaatat

SEQ ID NO: 43021 - DNA, 10 bp, Unknown
  misc_feature (1)..( 10): Matrix.001 file - promoters60/1018523
aaaatataag

SEQ ID NO: 43022 - DNA, 9 bp, Unknown
  misc_feature (1)..( 9): Matrix.001 file - promoters60/1018523
aaaaaaaat

SEQ ID NO: 43023 - DNA, 14 bp, Unknown
  misc_feature (1)..( 14): Matrix.001 file - promoters60/1018523
aattacaaaaatac

SEQ ID NO: 43024 - DNA, 8 bp, Unknown
  misc_feature (1)..( 8): Matrix.001 file - promoters60/1018523
ataaaata

SEQ ID NO: 43025 - DNA, 10 bp, Unknown
  misc_feature (1)..( 10): Matrix.001 file - promoters60/1018523
atattattaa

SEQ ID NO: 43026 - DNA, 9 bp, Unknown
  misc_feature (1)..( 9): Matrix.001 file - promoters60/1018523
tcaacaata

SEQ ID NO: 43027 - DNA, 10 bp, Unknown
  misc_feature (1)..( 10): Matrix.001 file - promoters60/1018523
atgaaaaaaa

SEQ ID NO: 43028 - DNA, 11 bp, Unknown
  misc_feature (1)..( 11): Matrix.001 file - promoters60/1018523
taaaaattcaa

SEQ ID NO: 43029 - DNA, 10 bp, Unknown
  misc_feature (1)..( 10): Matrix.001 file - promoters60/1018529
tttttctatc

SEQ ID NO: 43030 - DNA, 5 bp, Unknown
  misc_feature (1)..( 5): Matrix.001 file - promoters60/1018536
taatt

SEQ ID NO: 43031 - DNA, 11 bp, Unknown
  misc_feature (1)..( 11): Matrix.001 file - promoters60/1018536
aaatcttgaaa

SEQ ID NO: 43032 - DNA, 9 bp, Unknown
  misc_feature (1)..( 9): Matrix.001 file - promoters60/1018536
aaaaagcta

SEQ ID NO: 43033 - DNA, 8 bp, Unknown
  misc_feature (1)..( 8): Matrix.001 file - promoters60/1018536
attttaaa

SEQ ID NO: 43034 - DNA, 8 bp, Unknown
  misc_feature (1)..( 8): Matrix.001 file - promoters60/1018536
attttaaa

SEQ ID NO: 43035 - DNA, 17 bp, Unknown
  misc_feature (1)..( 17): Matrix.001 file - promoters60/1018536
taaatgttaaaattatt

SEQ ID NO: 43036 - DNA, 10 bp, Unknown
  misc_feature (1)..( 10): Matrix.001 file - promoters60/1018536
tatataaata

SEQ ID NO: 43037 - DNA, 13 bp, Unknown
  misc_feature (1)..( 13): Matrix.001 file - promoters60/1018536
aactttataagta

SEQ ID NO: 43038 - DNA, 8 bp, Unknown
  misc_feature (1)..( 8): Matrix.001 file - promoters60/1018536
caaaatat

SEQ ID NO: 43039 - DNA, 11 bp, Unknown
  misc_feature (1)..( 11): Matrix.001 file - promoters60/1018536
taatataagta

SEQ ID NO: 43040 - DNA, 9 bp, Unknown
  misc_feature (1)..( 9): Matrix.001 file - promoters60/1018536
attattcat

SEQ ID NO: 43041 - DNA, 9 bp, Unknown
  misc_feature (1)..( 9): Matrix.001 file - promoters60/1018536
tttataagt

SEQ ID NO: 43042 - DNA, 9 bp, Unknown
  misc_feature (1)..( 9): Matrix.001 file - promoters60/1018536
aaaatatat

SEQ ID NO: 43043 - DNA, 13 bp, Unknown
  misc_feature (1)..( 13): Matrix.001 file - promoters60/1018755
aaaatcaatccta

SEQ ID NO: 43044 - DNA, 14 bp, Unknown
  misc_feature (1)..( 14): Matrix.001 file - promoters60/1018755
gaccttttagttta

SEQ ID NO: 43045 - DNA, 13 bp, Unknown
  misc_feature (1)..( 13): Matrix.001 file - promoters60/1018783
tgttaataattat

SEQ ID NO: 43046 - DNA, 9 bp, Unknown
  misc_feature (1)..( 9): Matrix.001 file - promoters60/1018783
ccaattaaa

SEQ ID NO: 43047 - DNA, 10 bp, Unknown
  misc_feature (1)..( 10): Matrix.001 file - promoters60/1018783
attcaacgta

SEQ ID NO: 43048 - DNA, 7 bp, Unknown
  misc_feature (1)..( 7): Matrix.001 file - promoters60/1018798
ctaaaat

SEQ ID NO: 43049 - DNA, 12 bp, Unknown
  misc_feature (1)..( 12): Matrix.001 file - promoters60/1018798
caatatttataa

SEQ ID NO: 43050 - DNA, 6 bp, Unknown
  misc_feature (1)..( 6): Matrix.001 file - promoters60/1018831
agaatc

SEQ ID NO: 43051 - DNA, 8 bp, Unknown
  misc_feature (1)..( 8): Matrix.001 file - promoters60/1018831
tccggagg

SEQ ID NO: 43052 - DNA, 6 bp, Unknown
  misc_feature (1)..( 6): Matrix.001 file - promoters60/1018831
gtactc

SEQ ID NO: 43053 - DNA, 6 bp, Unknown
  misc_feature (1)..( 6): Matrix.001 file - promoters60/1018831
aactct

SEQ ID NO: 43054 - DNA, 9 bp, Unknown
  misc_feature (1)..( 9): Matrix.001 file - promoters60/1018831
gaaaacata

SEQ ID NO: 43055 - DNA, 7 bp, Unknown
  misc_feature (1)..( 7): Matrix.001 file - promoters60/1018831
caaaagg

SEQ ID NO: 43056 - DNA, 6 bp, Unknown
  misc_feature (1)..( 6): Matrix.001 file - promoters60/1018831
aatcat

SEQ ID NO: 43057 - DNA, 10 bp, Unknown
  misc_feature (1)..( 10): Matrix.001 file - promoters60/1018831
ttcacaggtt

SEQ ID NO: 43058 - DNA, 8 bp, Unknown
  misc_feature (1)..( 8): Matrix.001 file - promoters60/1018831
aagcaact

SEQ ID NO: 43059 - DNA, 6 bp, Unknown
  misc_feature (1)..( 6): Matrix.001 file - promoters60/1018831
acaaaa

SEQ ID NO: 43060 - DNA, 7 bp, Unknown
  misc_feature (1)..( 7): Matrix.001 file - promoters60/1018831
aagaaaa

SEQ ID NO: 43061 - DNA, 8 bp, Unknown
  misc_feature (1)..( 8): Matrix.001 file - promoters60/1018831
aaactgtt

SEQ ID NO: 43062 - DNA, 6 bp, Unknown
  misc_feature (1)..( 6): Matrix.001 file - promoters60/1018831
ttggat

SEQ ID NO: 43063 - DNA, 6 bp, Unknown
  misc_feature (1)..( 6): Matrix.001 file - promoters60/1018831
tcaaca

SEQ ID NO: 43064 - DNA, 6 bp, Unknown
  misc_feature (1)..( 6): Matrix.001 file - promoters60/1018831
gtttgt

SEQ ID NO: 43065 - DNA, 6 bp, Unknown
  misc_feature (1)..( 6): Matrix.001 file - promoters60/1018831
cttcac

SEQ ID NO: 43066 - DNA, 7 bp, Unknown
  misc_feature (1)..( 7): Matrix.001 file - promoters60/1018835
cctttta

SEQ ID NO: 43067 - DNA, 8 bp, Unknown
  misc_feature (1)..( 8): Matrix.001 file - promoters60/1018835
gtttcaat

SEQ ID NO: 43068 - DNA, 8 bp, Unknown
  misc_feature (1)..( 8): Matrix.001 file - promoters60/1018835
gaaatgct

SEQ ID NO: 43069 - DNA, 8 bp, Unknown
  misc_feature (1)..( 8): Matrix.001 file - promoters60/1018835
ttgttaat

SEQ ID NO: 43070 - DNA, 10 bp, Unknown
  misc_feature (1)..( 10): Matrix.001 file - promoters60/1018835
aggctggaag

SEQ ID NO: 43071 - DNA, 7 bp, Unknown
  misc_feature (1)..( 7): Matrix.001 file - promoters60/1018835
gaagcga

SEQ ID NO: 43072 - DNA, 7 bp, Unknown
  misc_feature (1)..( 7): Matrix.001 file - promoters60/1018956
aatcaca

SEQ ID NO: 43073 - DNA, 10 bp, Unknown
  misc_feature (1)..( 10): Matrix.001 file - promoters60/1018956
ggaaaagaaa

SEQ ID NO: 43074 - DNA, 7 bp, Unknown
  misc_feature (1)..( 7): Matrix.001 file - promoters60/1018956
aaaagaa

SEQ ID NO: 43075 - DNA, 6 bp, Unknown
  misc_feature (1)..( 6): Matrix.001 file - promoters60/1018956
aatcaa

SEQ ID NO: 43076 - DNA, 6 bp, Unknown
  misc_feature (1)..( 6): Matrix.001 file - promoters60/1018956
aactca

SEQ ID NO: 43077 - DNA, 8 bp, Unknown
  misc_feature (1)..( 8): Matrix.001 file - promoters60/1018956
aatagcaa

SEQ ID NO: 43078 - DNA, 6 bp, Unknown
  misc_feature (1)..( 6): Matrix.001 file - promoters60/1018956
agagag

SEQ ID NO: 43079 - DNA, 6 bp, Unknown
  misc_feature (1)..( 6): Matrix.001 file - promoters60/1018956
taaaaa

SEQ ID NO: 43080 - DNA, 7 bp, Unknown
  misc_feature (1)..( 7): Matrix.001 file - promoters60/1018956
attatca

SEQ ID NO: 43081 - DNA, 6 bp, Unknown
  misc_feature (1)..( 6): Matrix.001 file - promoters60/1018956
agtaaa

SEQ ID NO: 43082 - DNA, 7 bp, Unknown
  misc_feature (1)..( 7): Matrix.001 file - promoters60/1018956
aatcggg

SEQ ID NO: 43083 - DNA, 8 bp, Unknown
  misc_feature (1)..( 8): Matrix.001 file - promoters60/1018956
gaaacaaa

SEQ ID NO: 43084 - DNA, 7 bp, Unknown
  misc_feature (1)..( 7): Matrix.001 file - promoters60/1018956
cccacta

SEQ ID NO: 43085 - DNA, 9 bp, Unknown
  misc_feature (1)..( 9): Matrix.001 file - promoters60/1018956
aaagaaaag

SEQ ID NO: 43086 - DNA, 7 bp, Unknown
  misc_feature (1)..( 7): Matrix.001 file - promoters60/1018956
gtatata

SEQ ID NO: 43087 - DNA, 13 bp, Unknown
  misc_feature (1)..( 13): Matrix.001 file - promoters60/1018973
caatctttgtatt

SEQ ID NO: 43088 - DNA, 9 bp, Unknown
  misc_feature (1)..( 9): Matrix.001 file - promoters60/1018973
tattttaga

SEQ ID NO: 43089 - DNA, 9 bp, Unknown
  misc_feature (1)..( 9): Matrix.001 file - promoters60/1018973
attctacat

SEQ ID NO: 43090 - DNA, 8 bp, Unknown
  misc_feature (1)..( 8): Matrix.001 file - promoters60/1018973
aaaaagct

SEQ ID NO: 43091 - DNA, 8 bp, Unknown
  misc_feature (1)..( 8): Matrix.001 file - promoters60/1018973
ttcccttc

SEQ ID NO: 43092 - DNA, 5 bp, Unknown
  misc_feature (1)..( 5): Matrix.001 file - promoters60/1018973
ttata

SEQ ID NO: 43093 - DNA, 10 bp, Unknown
  misc_feature (1)..( 10): Matrix.001 file - promoters60/1018973
tataaaaacc

SEQ ID NO: 43094 - DNA, 9 bp, Unknown
  misc_feature (1)..( 9): Matrix.001 file - promoters60/1018973
atataattt

SEQ ID NO: 43095 - DNA, 8 bp, Unknown
  misc_feature (1)..( 8): Matrix.001 file - promoters60/1019024
actaattt

SEQ ID NO: 43096 - DNA, 11 bp, Unknown
  misc_feature (1)..( 11): Matrix.001 file - promoters60/1019024
atttaattaac

SEQ ID NO: 43097 - DNA, 9 bp, Unknown
  misc_feature (1)..( 9): Matrix.001 file - promoters60/1019024
gaaacaata

SEQ ID NO: 43098 - DNA, 12 bp, Unknown
  misc_feature (1)..( 12): Matrix.001 file - promoters60/1019024
ccaattttttta

SEQ ID NO: 43099 - DNA, 8 bp, Unknown
  misc_feature (1)..( 8): Matrix.001 file - promoters60/1019024
aataaata

SEQ ID NO: 43100 - DNA, 8 bp, Unknown
  misc_feature (1)..( 8): Matrix.001 file - promoters60/1019030
attttgaa

SEQ ID NO: 43101 - DNA, 6 bp, Unknown
  misc_feature (1)..( 6): Matrix.001 file - promoters60/1019030
tatttt

SEQ ID NO: 43102 - DNA, 10 bp, Unknown
  misc_feature (1)..( 10): Matrix.001 file - promoters60/1019030
ttacaaaata

SEQ ID NO: 43103 - DNA, 6 bp, Unknown
  misc_feature (1)..( 6): Matrix.001 file - promoters60/1019030
gaaaaa

SEQ ID NO: 43104 - DNA, 7 bp, Unknown
  misc_feature (1)..( 7): Matrix.001 file - promoters60/1019030
attttag

SEQ ID NO: 43105 - DNA, 7 bp, Unknown
  misc_feature (1)..( 7): Matrix.001 file - promoters60/1019030
tttctta

SEQ ID NO: 43106 - DNA, 7 bp, Unknown
  misc_feature (1)..( 7): Matrix.001 file - promoters60/1019030
ataaaaa

SEQ ID NO: 43107 - DNA, 9 bp, Unknown
  misc_feature (1)..( 9): Matrix.001 file - promoters60/1019030
aaaacaaaa

SEQ ID NO: 43108 - DNA, 6 bp, Unknown
  misc_feature (1)..( 6): Matrix.001 file - promoters60/1019030
tatttt

SEQ ID NO: 43109 - DNA, 6 bp, Unknown
  misc_feature (1)..( 6): Matrix.001 file - promoters60/1019030
taaaaa

SEQ ID NO: 43110 - DNA, 8 bp, Unknown
  misc_feature (1)..( 8): Matrix.001 file - promoters60/1019030
aaaacatg

SEQ ID NO: 43111 - DNA, 6 bp, Unknown
  misc_feature (1)..( 6): Matrix.001 file - promoters60/1019030
tgtcaa

SEQ ID NO: 43112 - DNA, 7 bp, Unknown
  misc_feature (1)..( 7): Matrix.001 file - promoters60/1019030
cataaaa

SEQ ID NO: 43113 - DNA, 8 bp, Unknown
  misc_feature (1)..( 8): Matrix.001 file - promoters60/1019030
aaagaatt

SEQ ID NO: 43114 - DNA, 6 bp, Unknown
  misc_feature (1)..( 6): Matrix.001 file - promoters60/1019030
attttt

SEQ ID NO: 43115 - DNA, 6 bp, Unknown
  misc_feature (1)..( 6): Matrix.001 file - promoters60/1019030
ataaaa

SEQ ID NO: 43116 - DNA, 7 bp, Unknown
  misc_feature (1)..( 7): Matrix.001 file - promoters60/1019030
tgtataa

SEQ ID NO: 43117 - DNA, 8 bp, Unknown
  misc_feature (1)..( 8): Matrix.001 file - promoters60/1019030
ctttaatt

SEQ ID NO: 43118 - DNA, 6 bp, Unknown
  misc_feature (1)..( 6): Matrix.001 file - promoters60/1019030
aaaata

SEQ ID NO: 43119 - DNA, 7 bp, Unknown
  misc_feature (1)..( 7): Matrix.001 file - promoters60/1019030
ttcaagc

SEQ ID NO: 43120 - DNA, 7 bp, Unknown
  misc_feature (1)..( 7): Matrix.001 file - promoters60/1019030
tctcttc

SEQ ID NO: 43121 - DNA, 11 bp, Unknown
  misc_feature (1)..( 11): Matrix.001 file - promoters60/1019105
gctacgaaaaa

SEQ ID NO: 43122 - DNA, 7 bp, Unknown
  misc_feature (1)..( 7): Matrix.001 file - promoters60/1019111
tatgttc

SEQ ID NO: 43123 - DNA, 7 bp, Unknown
  misc_feature (1)..( 7): Matrix.001 file - promoters60/1019111
gttctag

SEQ ID NO: 43124 - DNA, 8 bp, Unknown
  misc_feature (1)..( 8): Matrix.001 file - promoters60/1019111
ataagata

SEQ ID NO: 43125 - DNA, 6 bp, Unknown
  misc_feature (1)..( 6): Matrix.001 file - promoters60/1019111
ttttaa

SEQ ID NO: 43126 - DNA, 8 bp, Unknown
  misc_feature (1)..( 8): Matrix.001 file - promoters60/1019111
aaaaaatg

SEQ ID NO: 43127 - DNA, 6 bp, Unknown
  misc_feature (1)..( 6): Matrix.001 file - promoters60/1019111
agaaat

SEQ ID NO: 43128 - DNA, 7 bp, Unknown
  misc_feature (1)..( 7): Matrix.001 file - promoters60/1019111
ataagat

SEQ ID NO: 43129 - DNA, 9 bp, Unknown
  misc_feature (1)..( 9): Matrix.001 file - promoters60/1019111
caagacaat

SEQ ID NO: 43130 - DNA, 6 bp, Unknown
  misc_feature (1)..( 6): Matrix.001 file - promoters60/1019111
atagta

SEQ ID NO: 43131 - DNA, 6 bp, Unknown
  misc_feature (1)..( 6): Matrix.001 file - promoters60/1019111
gaaaaa

SEQ ID NO: 43132 - DNA, 8 bp, Unknown
  misc_feature (1)..( 8): Matrix.001 file - promoters60/1019111
tgaaggtg

SEQ ID NO: 43133 - DNA, 8 bp, Unknown
  misc_feature (1)..( 8): Matrix.001 file - promoters60/1019111
aaatattt

SEQ ID NO: 43134 - DNA, 9 bp, Unknown
  misc_feature (1)..( 9): Matrix.001 file - promoters60/1019111
caagctcta

SEQ ID NO: 43135 - DNA, 8 bp, Unknown
  misc_feature (1)..( 8): Matrix.001 file - promoters60/1019111
attttcat

SEQ ID NO: 43136 - DNA, 8 bp, Unknown
  misc_feature (1)..( 8): Matrix.001 file - promoters60/1019111
attttttt

SEQ ID NO: 43137 - DNA, 6 bp, Unknown
  misc_feature (1)..( 6): Matrix.001 file - promoters60/1019111
tcatat

SEQ ID NO: 43138 - DNA, 6 bp, Unknown
  misc_feature (1)..( 6): Matrix.001 file - promoters60/1019111
agaaaa

SEQ ID NO: 43139 - DNA, 6 bp, Unknown
  misc_feature (1)..( 6): Matrix.001 file - promoters60/1019111
tttcaa

SEQ ID NO: 43140 - DNA, 8 bp, Unknown
  misc_feature (1)..( 8): Matrix.001 file - promoters60/1019111
atcaaaat

SEQ ID NO: 43141 - DNA, 8 bp, Unknown
  misc_feature (1)..( 8): Matrix.001 file - promoters60/1019257
ggaataga

SEQ ID NO: 43142 - DNA, 7 bp, Unknown
  misc_feature (1)..( 7): Matrix.001 file - promoters60/1019257
aaaaaag

SEQ ID NO: 43143 - DNA, 7 bp, Unknown
  misc_feature (1)..( 7): Matrix.001 file - promoters60/1019257
ttataaa

SEQ ID NO: 43144 - DNA, 11 bp, Unknown
  misc_feature (1)..( 11): Matrix.001 file - promoters60/1019257
atttgaattaa

SEQ ID NO: 43145 - DNA, 10 bp, Unknown
  misc_feature (1)..( 10): Matrix.001 file - promoters60/1019260
gttatgcttt

SEQ ID NO: 43146 - DNA, 8 bp, Unknown
  misc_feature (1)..( 8): Matrix.001 file - promoters60/1019260
aaaacctg

SEQ ID NO: 43147 - DNA, 7 bp, Unknown
  misc_feature (1)..( 7): Matrix.001 file - promoters60/1019278
gttcaga

SEQ ID NO: 43148 - DNA, 8 bp, Unknown
  misc_feature (1)..( 8): Matrix.001 file - promoters60/1019278
ttttattg

SEQ ID NO: 43149 - DNA, 6 bp, Unknown
  misc_feature (1)..( 6): Matrix.001 file - promoters60/1019278
ttactt

SEQ ID NO: 43150 - DNA, 11 bp, Unknown
  misc_feature (1)..( 11): Matrix.001 file - promoters60/1019278
aagacagaaca

SEQ ID NO: 43151 - DNA, 7 bp, Unknown
  misc_feature (1)..( 7): Matrix.001 file - promoters60/1019278
acaaaaa

SEQ ID NO: 43152 - DNA, 9 bp, Unknown
  misc_feature (1)..( 9): Matrix.001 file - promoters60/1019278
aagaagaca

SEQ ID NO: 43153 - DNA, 7 bp, Unknown
  misc_feature (1)..( 7): Matrix.001 file - promoters60/1019278
atttata

SEQ ID NO: 43154 - DNA, 10 bp, Unknown
  misc_feature (1)..( 10): Matrix.001 file - promoters60/1019278
aagctctgaa

SEQ ID NO: 43155 - DNA, 7 bp, Unknown
  misc_feature (1)..( 7): Matrix.001 file - promoters60/1019278
tttggat

SEQ ID NO: 43156 - DNA, 9 bp, Unknown
  misc_feature (1)..( 9): Matrix.001 file - promoters60/1019278
agacaaaac

SEQ ID NO: 43157 - DNA, 6 bp, Unknown
  misc_feature (1)..( 6): Matrix.001 file - promoters60/1019278
aaaaag

SEQ ID NO: 43158 - DNA, 7 bp, Unknown
  misc_feature (1)..( 7): Matrix.001 file - promoters60/1019278
tgaagaa

SEQ ID NO: 43159 - DNA, 7 bp, Unknown
  misc_feature (1)..( 7): Matrix.001 file - promoters60/1019278
aactatc

SEQ ID NO: 43160 - DNA, 8 bp, Unknown
  misc_feature (1)..( 8): Matrix.001 file - promoters60/1019278
agacatga

SEQ ID NO: 43161 - DNA, 6 bp, Unknown
  misc_feature (1)..( 6): Matrix.001 file - promoters60/1019278
actttt

SEQ ID NO: 43162 - DNA, 7 bp, Unknown
  misc_feature (1)..( 7): Matrix.001 file - promoters60/1019278
tttgatt

SEQ ID NO: 43163 - DNA, 6 bp, Unknown
  misc_feature (1)..( 6): Matrix.001 file - promoters60/1019278
acaaaa

SEQ ID NO: 43164 - DNA, 10 bp, Unknown
  misc_feature (1)..( 10): Matrix.001 file - promoters60/1019498
gcggtaacta

SEQ ID NO: 43165 - DNA, 15 bp, Unknown
  misc_feature (1)..( 15): Matrix.001 file - promoters60/1019498
caaagtataataaac

SEQ ID NO: 43166 - DNA, 9 bp, Unknown
  misc_feature (1)..( 9): Matrix.001 file - promoters60/1019498
cttatttaa

SEQ ID NO: 43167 - DNA, 8 bp, Unknown
  misc_feature (1)..( 8): Matrix.001 file - promoters60/1019498
atatatgt

SEQ ID NO: 43168 - DNA, 10 bp, Unknown
  misc_feature (1)..( 10): Matrix.001 file - promoters60/1019498
aatcatgtat

SEQ ID NO: 43169 - DNA, 12 bp, Unknown
  misc_feature (1)..( 12): Matrix.001 file - promoters60/1019498
agtataataaac

SEQ ID NO: 43170 - DNA, 8 bp, Unknown
  misc_feature (1)..( 8): Matrix.001 file - promoters60/1019498
ctttttca

SEQ ID NO: 43171 - DNA, 11 bp, Unknown
  misc_feature (1)..( 11): Matrix.001 file - promoters60/1019508
tcattatgtct

SEQ ID NO: 43172 - DNA, 6 bp, Unknown
  misc_feature (1)..( 6): Matrix.001 file - promoters60/1019508
ttgtta

SEQ ID NO: 43173 - DNA, 7 bp, Unknown
  misc_feature (1)..( 7): Matrix.001 file - promoters60/1019508
gatcgat

SEQ ID NO: 43174 - DNA, 9 bp, Unknown
  misc_feature (1)..( 9): Matrix.001 file - promoters60/1019524
gaattgaaa

SEQ ID NO: 43175 - DNA, 12 bp, Unknown
  misc_feature (1)..( 12): Matrix.001 file - promoters60/1019524
gagaatgaatag

SEQ ID NO: 43176 - DNA, 8 bp, Unknown
  misc_feature (1)..( 8): Matrix.001 file - promoters60/1019537
atttttgt

SEQ ID NO: 43177 - DNA, 7 bp, Unknown
  misc_feature (1)..( 7): Matrix.001 file - promoters60/1019537
atatatg

SEQ ID NO: 43178 - DNA, 10 bp, Unknown
  misc_feature (1)..( 10): Matrix.001 file - promoters60/1019559
aattttgaaa

SEQ ID NO: 43179 - DNA, 11 bp, Unknown
  misc_feature (1)..( 11): Matrix.001 file - promoters60/1019559
aaaagttgcag

SEQ ID NO: 43180 - DNA, 10 bp, Unknown
  misc_feature (1)..( 10): Matrix.001 file - promoters60/1019559
taaagtaaag

SEQ ID NO: 43181 - DNA, 9 bp, Unknown
  misc_feature (1)..( 9): Matrix.001 file - promoters60/1019559
ttcttagct

SEQ ID NO: 43182 - DNA, 9 bp, Unknown
  misc_feature (1)..( 9): Matrix.001 file - promoters60/1019559
agaaagcaa

SEQ ID NO: 43183 - DNA, 8 bp, Unknown
  misc_feature (1)..( 8): Matrix.001 file - promoters60/1019559
gaaagatt

SEQ ID NO: 43184 - DNA, 8 bp, Unknown
  misc_feature (1)..( 8): Matrix.001 file - promoters60/1019604
taaatcca

SEQ ID NO: 43185 - DNA, 7 bp, Unknown
  misc_feature (1)..( 7): Matrix.001 file - promoters60/1019604
gaaggca

SEQ ID NO: 43186 - DNA, 8 bp, Unknown
  misc_feature (1)..( 8): Matrix.001 file - promoters60/1019604
agggtata

SEQ ID NO: 43187 - DNA, 8 bp, Unknown
  misc_feature (1)..( 8): Matrix.001 file - promoters60/1019604
attttata

SEQ ID NO: 43188 - DNA, 12 bp, Unknown
  misc_feature (1)..( 12): Matrix.001 file - promoters60/1019604
aaagatagaaat

SEQ ID NO: 43189 - DNA, 6 bp, Unknown
  misc_feature (1)..( 6): Matrix.001 file - promoters60/1019604
taataa

SEQ ID NO: 43190 - DNA, 10 bp, Unknown
  misc_feature (1)..( 10): Matrix.001 file - promoters60/1019604
tgtctaaaaa

SEQ ID NO: 43191 - DNA, 6 bp, Unknown
  misc_feature (1)..( 6): Matrix.001 file - promoters60/1019604
actaaa

SEQ ID NO: 43192 - DNA, 6 bp, Unknown
  misc_feature (1)..( 6): Matrix.001 file - promoters60/1019604
atataa

SEQ ID NO: 43193 - DNA, 10 bp, Unknown
  misc_feature (1)..( 10): Matrix.001 file - promoters60/1019604
ttgaattttt

SEQ ID NO: 43194 - DNA, 9 bp, Unknown
  misc_feature (1)..( 9): Matrix.001 file - promoters60/1019604
tcaagattt

SEQ ID NO: 43195 - DNA, 8 bp, Unknown
  misc_feature (1)..( 8): Matrix.001 file - promoters60/1019604
ttgatttt

SEQ ID NO: 43196 - DNA, 8 bp, Unknown
  misc_feature (1)..( 8): Matrix.001 file - promoters60/1019604
aggaactt

SEQ ID NO: 43197 - DNA, 6 bp, Unknown
  misc_feature (1)..( 6): Matrix.001 file - promoters60/1019604
tattta

SEQ ID NO: 43198 - DNA, 7 bp, Unknown
  misc_feature (1)..( 7): Matrix.001 file - promoters60/1019604
caaaaca

SEQ ID NO: 43199 - DNA, 22 bp, Unknown
  misc_feature (1)..( 22): Matrix.001 file - promoters60/1019604
aaatataaccaaatttgaaatc

SEQ ID NO: 43200 - DNA, 6 bp, Unknown
  misc_feature (1)..( 6): Matrix.001 file - promoters60/1019604
atgaaa

SEQ ID NO: 43201 - DNA, 7 bp, Unknown
  misc_feature (1)..( 7): Matrix.001 file - promoters60/1019604
tatatat

SEQ ID NO: 43202 - DNA, 21 bp, Unknown
  misc_feature (1)..( 21): Matrix.001 file - promoters60/1019604
aaaaacaacattcatttacta

SEQ ID NO: 43203 - DNA, 6 bp, Unknown
  misc_feature (1)..( 6): Matrix.001 file - promoters60/1019604
atcatc

SEQ ID NO: 43204 - DNA, 6 bp, Unknown
  misc_feature (1)..( 6): Matrix.001 file - promoters60/1019604
atcatc

SEQ ID NO: 43205 - DNA, 9 bp, Unknown
  misc_feature (1)..( 9): Matrix.001 file - promoters60/1019648
agaaaagat

SEQ ID NO: 43206 - DNA, 6 bp, Unknown
  misc_feature (1)..( 6): Matrix.001 file - promoters60/1019695
gagctg

SEQ ID NO: 43207 - DNA, 6 bp, Unknown
  misc_feature (1)..( 6): Matrix.001 file - promoters60/1019695
gaaatc

SEQ ID NO: 43208 - DNA, 10 bp, Unknown
  misc_feature (1)..( 10): Matrix.001 file - promoters60/1019695
aaacgattcc

SEQ ID NO: 43209 - DNA, 7 bp, Unknown
  misc_feature (1)..( 7): Matrix.001 file - promoters60/1019695
attgtgt

SEQ ID NO: 43210 - DNA, 6 bp, Unknown
  misc_feature (1)..( 6): Matrix.001 file - promoters60/1019695
taaacc

SEQ ID NO: 43211 - DNA, 8 bp, Unknown
  misc_feature (1)..( 8): Matrix.001 file - promoters60/1019695
atttgtta

SEQ ID NO: 43212 - DNA, 6 bp, Unknown
  misc_feature (1)..( 6): Matrix.001 file - promoters60/1019695
aagacg

SEQ ID NO: 43213 - DNA, 6 bp, Unknown
  misc_feature (1)..( 6): Matrix.001 file - promoters60/1019695
agaaat

SEQ ID NO: 43214 - DNA, 6 bp, Unknown
  misc_feature (1)..( 6): Matrix.001 file - promoters60/1019695
cggttc

SEQ ID NO: 43215 - DNA, 7 bp, Unknown
  misc_feature (1)..( 7): Matrix.001 file - promoters60/1019695
tagggtt

SEQ ID NO: 43216 - DNA, 9 bp, Unknown
  misc_feature (1)..( 9): Matrix.001 file - promoters60/1019695
tttaattaa

SEQ ID NO: 43217 - DNA, 6 bp, Unknown
  misc_feature (1)..( 6): Matrix.001 file - promoters60/1019695
gaaccc

SEQ ID NO: 43218 - DNA, 7 bp, Unknown
  misc_feature (1)..( 7): Matrix.001 file - promoters60/1019695
attaata

SEQ ID NO: 43219 - DNA, 8 bp, Unknown
  misc_feature (1)..( 8): Matrix.001 file - promoters60/1019734
attgattt

SEQ ID NO: 43220 - DNA, 10 bp, Unknown
  misc_feature (1)..( 10): Matrix.001 file - promoters60/1019734
atttgaggat

SEQ ID NO: 43221 - DNA, 9 bp, Unknown
  misc_feature (1)..( 9): Matrix.001 file - promoters60/1019734
tttgaacat

SEQ ID NO: 43222 - DNA, 10 bp, Unknown
  misc_feature (1)..( 10): Matrix.001 file - promoters60/1019734
aaaacacgtg

SEQ ID NO: 43223 - DNA, 7 bp, Unknown
  misc_feature (1)..( 7): Matrix.001 file - promoters60/1019734
tctatat

SEQ ID NO: 43224 - DNA, 11 bp, Unknown
  misc_feature (1)..( 11): Matrix.001 file - promoters60/1019734
ataaattaatg

SEQ ID NO: 43225 - DNA, 9 bp, Unknown
  misc_feature (1)..( 9): Matrix.001 file - promoters60/1019734
tcaatcata

SEQ ID NO: 43226 - DNA, 9 bp, Unknown
  misc_feature (1)..( 9): Matrix.001 file - promoters60/1019734
taatttcat

SEQ ID NO: 43227 - DNA, 7 bp, Unknown
  misc_feature (1)..( 7): Matrix.001 file - promoters60/1019734
taacaaa

SEQ ID NO: 43228 - DNA, 6 bp, Unknown
  misc_feature (1)..( 6): Matrix.001 file - promoters60/1019734
aaactc

SEQ ID NO: 43229 - DNA, 7 bp, Unknown
  misc_feature (1)..( 7): Matrix.001 file - promoters60/1019734
cctttat

SEQ ID NO: 43230 - DNA, 6 bp, Unknown
  misc_feature (1)..( 6): Matrix.001 file - promoters60/1019734
tcattt

SEQ ID NO: 43231 - DNA, 6 bp, Unknown
  misc_feature (1)..( 6): Matrix.001 file - promoters60/1019734
aaacat

SEQ ID NO: 43232 - DNA, 9 bp, Unknown
  misc_feature (1)..( 9): Matrix.001 file - promoters60/1019734
aaaataata

SEQ ID NO: 43233 - DNA, 6 bp, Unknown
  misc_feature (1)..( 6): Matrix.001 file - promoters60/1019734
ataata

SEQ ID NO: 43234 - DNA, 8 bp, Unknown
  misc_feature (1)..( 8): Matrix.001 file - promoters60/1019734
aaaaagaa

SEQ ID NO: 43235 - DNA, 7 bp, Unknown
  misc_feature (1)..( 7): Matrix.001 file - promoters60/1019734
aatatct

SEQ ID NO: 43236 - DNA, 6 bp, Unknown
  misc_feature (1)..( 6): Matrix.001 file - promoters60/1019734
tatttc

SEQ ID NO: 43237 - DNA, 7 bp, Unknown
  misc_feature (1)..( 7): Matrix.001 file - promoters60/1019776
ttcattt

SEQ ID NO: 43238 - DNA, 6 bp, Unknown
  misc_feature (1)..( 6): Matrix.001 file - promoters60/1019776
gtttca

SEQ ID NO: 43239 - DNA, 6 bp, Unknown
  misc_feature (1)..( 6): Matrix.001 file - promoters60/1019776
aaacat

SEQ ID NO: 43240 - DNA, 8 bp, Unknown
  misc_feature (1)..( 8): Matrix.001 file - promoters60/1019776
aataagta

SEQ ID NO: 43241 - DNA, 8 bp, Unknown
  misc_feature (1)..( 8): Matrix.001 file - promoters60/1019776
taagatcc

SEQ ID NO: 43242 - DNA, 11 bp, Unknown
  misc_feature (1)..( 11): Matrix.001 file - promoters60/1019776
ataatttgttt

SEQ ID NO: 43243 - DNA, 6 bp, Unknown
  misc_feature (1)..( 6): Matrix.001 file - promoters60/1019776
aaaacc

SEQ ID NO: 43244 - DNA, 6 bp, Unknown
  misc_feature (1)..( 6): Matrix.001 file - promoters60/1019776
taaaaa

SEQ ID NO: 43245 - DNA, 6 bp, Unknown
  misc_feature (1)..( 6): Matrix.001 file - promoters60/1019776
aaaaag

SEQ ID NO: 43246 - DNA, 9 bp, Unknown
  misc_feature (1)..( 9): Matrix.001 file - promoters60/1019776
gtatataaa

SEQ ID NO: 43247 - DNA, 6 bp, Unknown
  misc_feature (1)..( 6): Matrix.001 file - promoters60/1019776
aacatt

SEQ ID NO: 43248 - DNA, 8 bp, Unknown
  misc_feature (1)..( 8): Matrix.001 file - promoters60/1019776
ccaccaaa

SEQ ID NO: 43249 - DNA, 6 bp, Unknown
  misc_feature (1)..( 6): Matrix.001 file - promoters60/1019776
ataaaa

SEQ ID NO: 43250 - DNA, 9 bp, Unknown
  misc_feature (1)..( 9): Matrix.001 file - promoters60/1019776
aaagtaaag

SEQ ID NO: 43251 - DNA, 6 bp, Unknown
  misc_feature (1)..( 6): Matrix.001 file - promoters60/1019776
agtaaa

SEQ ID NO: 43252 - DNA, 7 bp, Unknown
  misc_feature (1)..( 7): Matrix.001 file - promoters60/1019776
aatcggg

SEQ ID NO: 43253 - DNA, 8 bp, Unknown
  misc_feature (1)..( 8): Matrix.001 file - promoters60/1019776
gaaacaaa

SEQ ID NO: 43254 - DNA, 10 bp, Unknown
  misc_feature (1)..( 10): Matrix.001 file - promoters60/1019776
ggaaaagaaa

SEQ ID NO: 43255 - DNA, 7 bp, Unknown
  misc_feature (1)..( 7): Matrix.001 file - promoters60/1019776
cccacta

SEQ ID NO: 43256 - DNA, 12 bp, Unknown
  misc_feature (1)..( 12): Matrix.001 file - promoters60/1019898
gatatagataca

SEQ ID NO: 43257 - DNA, 9 bp, Unknown
  misc_feature (1)..( 9): Matrix.001 file - promoters60/1019898
aatatagat

SEQ ID NO: 43258 - DNA, 6 bp, Unknown
  misc_feature (1)..( 6): Matrix.001 file - promoters60/1019898
ctttta

SEQ ID NO: 43259 - DNA, 6 bp, Unknown
  misc_feature (1)..( 6): Matrix.001 file - promoters60/1019898
tttttg

SEQ ID NO: 43260 - DNA, 7 bp, Unknown
  misc_feature (1)..( 7): Matrix.001 file - promoters60/1019915
aactaga

SEQ ID NO: 43261 - DNA, 8 bp, Unknown
  misc_feature (1)..( 8): Matrix.001 file - promoters60/1019915
tgtcaaat

SEQ ID NO: 43262 - DNA, 10 bp, Unknown
  misc_feature (1)..( 10): Matrix.001 file - promoters60/1019915
ttaagaaaaa

SEQ ID NO: 43263 - DNA, 8 bp, Unknown
  misc_feature (1)..( 8): Matrix.001 file - promoters60/1019915
ctaaaaac

SEQ ID NO: 43264 - DNA, 8 bp, Unknown
  misc_feature (1)..( 8): Matrix.001 file - promoters60/1019915
aaaataaa

SEQ ID NO: 43265 - DNA, 8 bp, Unknown
  misc_feature (1)..( 8): Matrix.001 file - promoters60/1019915
tttttagt

SEQ ID NO: 43266 - DNA, 12 bp, Unknown
  misc_feature (1)..( 12): Matrix.001 file - promoters60/1019915
ataaaaccatta

SEQ ID NO: 43267 - DNA, 10 bp, Unknown
  misc_feature (1)..( 10): Matrix.001 file - promoters60/1019915
ttatattgat

SEQ ID NO: 43268 - DNA, 8 bp, Unknown
  misc_feature (1)..( 8): Matrix.001 file - promoters60/1019928
attagtta

SEQ ID NO: 43269 - DNA, 9 bp, Unknown
  misc_feature (1)..( 9): Matrix.001 file - promoters60/1019928
gatttgaaa

SEQ ID NO: 43270 - DNA, 16 bp, Unknown
  misc_feature (1)..( 16): Matrix.001 file - promoters60/1019928
attcgaatattttaaa

SEQ ID NO: 43271 - DNA, 9 bp, Unknown
  misc_feature (1)..( 9): Matrix.001 file - promoters60/1019928
tagaaaatt

SEQ ID NO: 43272 - DNA, 10 bp, Unknown
  misc_feature (1)..( 10): Matrix.001 file - promoters60/1019928
tataaaaatc

SEQ ID NO: 43273 - DNA, 13 bp, Unknown
  misc_feature (1)..( 13): Matrix.001 file - promoters60/1019928
atctttataatta

SEQ ID NO: 43274 - DNA, 10 bp, Unknown
  misc_feature (1)..( 10): Matrix.001 file - promoters60/1019928
ttatgtaatt

SEQ ID NO: 43275 - DNA, 5 bp, Unknown
  misc_feature (1)..( 5): Matrix.001 file - promoters60/1020023
aaatt

SEQ ID NO: 43276 - DNA, 12 bp, Unknown
  misc_feature (1)..( 12): Matrix.001 file - promoters60/1020023
tcctataaatat

SEQ ID NO: 43277 - DNA, 8 bp, Unknown
  misc_feature (1)..( 8): Matrix.001 file - promoters60/1020023
ataattaa

SEQ ID NO: 43278 - DNA, 11 bp, Unknown
  misc_feature (1)..( 11): Matrix.001 file - promoters60/1020023
agaaaatattc

SEQ ID NO: 43279 - DNA, 11 bp, Unknown
  misc_feature (1)..( 11): Matrix.001 file - promoters60/1020023
tttttatgtat

SEQ ID NO: 43280 - DNA, 7 bp, Unknown
  misc_feature (1)..( 7): Matrix.001 file - promoters60/1020023
cttaata

SEQ ID NO: 43281 - DNA, 10 bp, Unknown
  misc_feature (1)..( 10): Matrix.001 file - promoters60/1020023
ttaataacct

SEQ ID NO: 43282 - DNA, 8 bp, Unknown
  misc_feature (1)..( 8): Matrix.001 file - promoters60/1020046
atagttat

SEQ ID NO: 43283 - DNA, 7 bp, Unknown
  misc_feature (1)..( 7): Matrix.001 file - promoters60/1020046
ctttttc

SEQ ID NO: 43284 - DNA, 6 bp, Unknown
  misc_feature (1)..( 6): Matrix.001 file - promoters60/1020046
tttaac

SEQ ID NO: 43285 - DNA, 7 bp, Unknown
  misc_feature (1)..( 7): Matrix.001 file - promoters60/1020046
ttaattc

SEQ ID NO: 43286 - DNA, 7 bp, Unknown
  misc_feature (1)..( 7): Matrix.001 file - promoters60/1020046
tataaag

SEQ ID NO: 43287 - DNA, 6 bp, Unknown
  misc_feature (1)..( 6): Matrix.001 file - promoters60/1020046
acataa

SEQ ID NO: 43288 - DNA, 13 bp, Unknown
  misc_feature (1)..( 13): Matrix.001 file - promoters60/1020046
aaaaagtaaagga

SEQ ID NO: 43289 - DNA, 6 bp, Unknown
  misc_feature (1)..( 6): Matrix.001 file - promoters60/1020046
aaaata

SEQ ID NO: 43290 - DNA, 8 bp, Unknown
  misc_feature (1)..( 8): Matrix.001 file - promoters60/1020046
ttctctct

SEQ ID NO: 43291 - DNA, 8 bp, Unknown
  misc_feature (1)..( 8): Matrix.001 file - promoters60/1020046
taaacaca

SEQ ID NO: 43292 - DNA, 6 bp, Unknown
  misc_feature (1)..( 6): Matrix.001 file - promoters60/1020046
ttataa

SEQ ID NO: 43293 - DNA, 8 bp, Unknown
  misc_feature (1)..( 8): Matrix.001 file - promoters60/1020046
aaatatat

SEQ ID NO: 43294 - DNA, 10 bp, Unknown
  misc_feature (1)..( 10): Matrix.001 file - promoters60/1020046
tatctttaat

SEQ ID NO: 43295 - DNA, 19 bp, Unknown
  misc_feature (1)..( 19): Matrix.001 file - promoters60/1020046
taataaaagacatatttct

SEQ ID NO: 43296 - DNA, 9 bp, Unknown
  misc_feature (1)..( 9): Matrix.001 file - promoters60/1020046
aaaattaga

SEQ ID NO: 43297 - DNA, 6 bp, Unknown
  misc_feature (1)..( 6): Matrix.001 file - promoters60/1020046
aaaata

SEQ ID NO: 43298 - DNA, 9 bp, Unknown
  misc_feature (1)..( 9): Matrix.001 file - promoters60/1020046
ttaaaagat

SEQ ID NO: 43299 - DNA, 8 bp, Unknown
  misc_feature (1)..( 8): Matrix.001 file - promoters60/1020046
taaaaaaa

SEQ ID NO: 43300 - DNA, 8 bp, Unknown
  misc_feature (1)..( 8): Matrix.001 file - promoters60/1020046
aaaacttt

SEQ ID NO: 43301 - DNA, 6 bp, Unknown
  misc_feature (1)..( 6): Matrix.001 file - promoters60/1020046
ttctat

SEQ ID NO: 43302 - DNA, 7 bp, Unknown
  misc_feature (1)..( 7): Matrix.001 file - promoters60/1020046
ataaatt

SEQ ID NO: 43303 - DNA, 11 bp, Unknown
  misc_feature (1)..( 11): Matrix.001 file - promoters60/1020046
ttacaaaatta

SEQ ID NO: 43304 - DNA, 8 bp, Unknown
  misc_feature (1)..( 8): Matrix.001 file - promoters60/1020046
aaaaatat

SEQ ID NO: 43305 - DNA, 6 bp, Unknown
  misc_feature (1)..( 6): Matrix.001 file - promoters60/1020046
caactt

SEQ ID NO: 43306 - DNA, 6 bp, Unknown
  misc_feature (1)..( 6): Matrix.001 file - promoters60/1020046
aaataa

SEQ ID NO: 43307 - DNA, 6 bp, Unknown
  misc_feature (1)..( 6): Matrix.001 file - promoters60/1020046
aaaata

SEQ ID NO: 43308 - DNA, 6 bp, Unknown
  misc_feature (1)..( 6): Matrix.001 file - promoters60/1020046
aagatg

SEQ ID NO: 43309 - DNA, 6 bp, Unknown
  misc_feature (1)..( 6): Matrix.001 file - promoters60/1020046
cgcgtt

SEQ ID NO: 43310 - DNA, 9 bp, Unknown
  misc_feature (1)..( 9): Matrix.001 file - promoters60/1020069
aagaagaaa

SEQ ID NO: 43311 - DNA, 11 bp, Unknown
  misc_feature (1)..( 11): Matrix.001 file - promoters60/1020069
gaacttttctc

SEQ ID NO: 43312 - DNA, 9 bp, Unknown
  misc_feature (1)..( 9): Matrix.001 file - promoters60/1020069
cttgtctcc

SEQ ID NO: 43313 - DNA, 8 bp, Unknown
  misc_feature (1)..( 8): Matrix.001 file - promoters60/1020223
atcatatt

SEQ ID NO: 43314 - DNA, 9 bp, Unknown
  misc_feature (1)..( 9): Matrix.001 file - promoters60/1020223
tttgtagtg

SEQ ID NO: 43315 - DNA, 8 bp, Unknown
  misc_feature (1)..( 8): Matrix.001 file - promoters60/1020223
tgatttgt

SEQ ID NO: 43316 - DNA, 6 bp, Unknown
  misc_feature (1)..( 6): Matrix.001 file - promoters60/1020223
atattt

SEQ ID NO: 43317 - DNA, 7 bp, Unknown
  misc_feature (1)..( 7): Matrix.001 file - promoters60/1020223
gtttgtt

SEQ ID NO: 43318 - DNA, 6 bp, Unknown
  misc_feature (1)..( 6): Matrix.001 file - promoters60/1020223
tgatgt

SEQ ID NO: 43319 - DNA, 8 bp, Unknown
  misc_feature (1)..( 8): Matrix.001 file - promoters60/1020223
gatttgtt

SEQ ID NO: 43320 - DNA, 7 bp, Unknown
  misc_feature (1)..( 7): Matrix.001 file - promoters60/1020223
gttttgt

SEQ ID NO: 43321 - DNA, 7 bp, Unknown
  misc_feature (1)..( 7): Matrix.001 file - promoters60/1020223
aagaaca

SEQ ID NO: 43322 - DNA, 6 bp, Unknown
  misc_feature (1)..( 6): Matrix.001 file - promoters60/1020223
tgtgat

SEQ ID NO: 43323 - DNA, 8 bp, Unknown
  misc_feature (1)..( 8): Matrix.001 file - promoters60/1020223
ataatttg

SEQ ID NO: 43324 - DNA, 8 bp, Unknown
  misc_feature (1)..( 8): Matrix.001 file - promoters60/1020223
agtatgtt

SEQ ID NO: 43325 - DNA, 6 bp, Unknown
  misc_feature (1)..( 6): Matrix.001 file - promoters60/1020223
tgtttg

SEQ ID NO: 43326 - DNA, 6 bp, Unknown
  misc_feature (1)..( 6): Matrix.001 file - promoters60/1020223
gagttt

SEQ ID NO: 43327 - DNA, 6 bp, Unknown
  misc_feature (1)..( 6): Matrix.001 file - promoters60/1020223
ctgatt

SEQ ID NO: 43328 - DNA, 6 bp, Unknown
  misc_feature (1)..( 6): Matrix.001 file - promoters60/1020223
ttagtt

SEQ ID NO: 43329 - DNA, 8 bp, Unknown
  misc_feature (1)..( 8): Matrix.001 file - promoters60/1020265
atgactta

SEQ ID NO: 43330 - DNA, 7 bp, Unknown
  misc_feature (1)..( 7): Matrix.001 file - promoters60/1020265
attgtgt

SEQ ID NO: 43331 - DNA, 8 bp, Unknown
  misc_feature (1)..( 8): Matrix.001 file - promoters60/1020265
attattct

SEQ ID NO: 43332 - DNA, 8 bp, Unknown
  misc_feature (1)..( 8): Matrix.001 file - promoters60/1020265
tgaagaaa

SEQ ID NO: 43333 - DNA, 7 bp, Unknown
  misc_feature (1)..( 7): Matrix.001 file - promoters60/1020313
tgtttat

SEQ ID NO: 43334 - DNA, 15 bp, Unknown
  misc_feature (1)..( 15): Matrix.001 file - promoters60/1020364
acttatacaaaaagt

SEQ ID NO: 43335 - DNA, 9 bp, Unknown
  misc_feature (1)..( 9): Matrix.001 file - promoters60/1020430
ctaactaac

SEQ ID NO: 43336 - DNA, 9 bp, Unknown
  misc_feature (1)..( 9): Matrix.001 file - promoters60/1020430
ctaactaac

SEQ ID NO: 43337 - DNA, 9 bp, Unknown
  misc_feature (1)..( 9): Matrix.001 file - promoters60/1020430
atataatta

SEQ ID NO: 43338 - DNA, 6 bp, Unknown
  misc_feature (1)..( 6): Matrix.001 file - promoters60/1020442
taatac

SEQ ID NO: 43339 - DNA, 9 bp, Unknown
  misc_feature (1)..( 9): Matrix.001 file - promoters60/1020442
tttttattt

SEQ ID NO: 43340 - DNA, 6 bp, Unknown
  misc_feature (1)..( 6): Matrix.001 file - promoters60/1020442
tcaagt

SEQ ID NO: 43341 - DNA, 6 bp, Unknown
  misc_feature (1)..( 6): Matrix.001 file - promoters60/1020442
actagt

SEQ ID NO: 43342 - DNA, 7 bp, Unknown
  misc_feature (1)..( 7): Matrix.001 file - promoters60/1020442
attattt

SEQ ID NO: 43343 - DNA, 9 bp, Unknown
  misc_feature (1)..( 9): Matrix.001 file - promoters60/1020442
gataacaat

SEQ ID NO: 43344 - DNA, 8 bp, Unknown
  misc_feature (1)..( 8): Matrix.001 file - promoters60/1020442
gcaacaac

SEQ ID NO: 43345 - DNA, 6 bp, Unknown
  misc_feature (1)..( 6): Matrix.001 file - promoters60/1020442
agcaaa

SEQ ID NO: 43346 - DNA, 6 bp, Unknown
  misc_feature (1)..( 6): Matrix.001 file - promoters60/1020442
tttgaa

SEQ ID NO: 43347 - DNA, 9 bp, Unknown
  misc_feature (1)..( 9): Matrix.001 file - promoters60/1020442
aaaagattt

SEQ ID NO: 43348 - DNA, 7 bp, Unknown
  misc_feature (1)..( 7): Matrix.001 file - promoters60/1020442
gctggct

SEQ ID NO: 43349 - DNA, 9 bp, Unknown
  misc_feature (1)..( 9): Matrix.001 file - promoters60/1020442
aagaagatg

SEQ ID NO: 43350 - DNA, 10 bp, Unknown
  misc_feature (1)..( 10): Matrix.001 file - promoters60/1020442
tgagagattg

SEQ ID NO: 43351 - DNA, 7 bp, Unknown
  misc_feature (1)..( 7): Matrix.001 file - promoters60/1020442
ttgcaat

SEQ ID NO: 43352 - DNA, 8 bp, Unknown
  misc_feature (1)..( 8): Matrix.001 file - promoters60/1020442
tatatata

SEQ ID NO: 43353 - DNA, 8 bp, Unknown
  misc_feature (1)..( 8): Matrix.001 file - promoters60/1020460
gtatatgg

SEQ ID NO: 43354 - DNA, 11 bp, Unknown
  misc_feature (1)..( 11): Matrix.001 file - promoters60/1020460
agtgtatctct

SEQ ID NO: 43355 - DNA, 6 bp, Unknown
  misc_feature (1)..( 6): Matrix.001 file - promoters60/1020460
ttatga

SEQ ID NO: 43356 - DNA, 7 bp, Unknown
  misc_feature (1)..( 7): Matrix.001 file - promoters60/1020460
cttaata

SEQ ID NO: 43357 - DNA, 7 bp, Unknown
  misc_feature (1)..( 7): Matrix.001 file - promoters60/1020460
gtgaaaa

SEQ ID NO: 43358 - DNA, 6 bp, Unknown
  misc_feature (1)..( 6): Matrix.001 file - promoters60/1020460
agacaa

SEQ ID NO: 43359 - DNA, 6 bp, Unknown
  misc_feature (1)..( 6): Matrix.001 file - promoters60/1020460
ttctta

SEQ ID NO: 43360 - DNA, 8 bp, Unknown
  misc_feature (1)..( 8): Matrix.001 file - promoters60/1020460
ataaacaa

SEQ ID NO: 43361 - DNA, 7 bp, Unknown
  misc_feature (1)..( 7): Matrix.001 file - promoters60/1020460
aaatcca

SEQ ID NO: 43362 - DNA, 6 bp, Unknown
  misc_feature (1)..( 6): Matrix.001 file - promoters60/1020460
tcaaac

SEQ ID NO: 43363 - DNA, 7 bp, Unknown
  misc_feature (1)..( 7): Matrix.001 file - promoters60/1020460
attattc

SEQ ID NO: 43364 - DNA, 7 bp, Unknown
  misc_feature (1)..( 7): Matrix.001 file - promoters60/1020460
atgatat

SEQ ID NO: 43365 - DNA, 6 bp, Unknown
  misc_feature (1)..( 6): Matrix.001 file - promoters60/1020460
atctgg

SEQ ID NO: 43366 - DNA, 6 bp, Unknown
  misc_feature (1)..( 6): Matrix.001 file - promoters60/1020460
attatt

SEQ ID NO: 43367 - DNA, 7 bp, Unknown
  misc_feature (1)..( 7): Matrix.001 file - promoters60/1020460
tctaaaa

SEQ ID NO: 43368 - DNA, 7 bp, Unknown
  misc_feature (1)..( 7): Matrix.001 file - promoters60/1020460
tgtgtca

SEQ ID NO: 43369 - DNA, 7 bp, Unknown
  misc_feature (1)..( 7): Matrix.001 file - promoters60/1020508
ttaagaa

SEQ ID NO: 43370 - DNA, 6 bp, Unknown
  misc_feature (1)..( 6): Matrix.001 file - promoters60/1020508
gctaat

SEQ ID NO: 43371 - DNA, 6 bp, Unknown
  misc_feature (1)..( 6): Matrix.001 file - promoters60/1020508
taatga

SEQ ID NO: 43372 - DNA, 9 bp, Unknown
  misc_feature (1)..( 9): Matrix.001 file - promoters60/1020508
acaacatta

SEQ ID NO: 43373 - DNA, 6 bp, Unknown
  misc_feature (1)..( 6): Matrix.001 file - promoters60/1020508
tatatt

SEQ ID NO: 43374 - DNA, 11 bp, Unknown
  misc_feature (1)..( 11): Matrix.001 file - promoters60/1020508
tatttggattt

SEQ ID NO: 43375 - DNA, 6 bp, Unknown
  misc_feature (1)..( 6): Matrix.001 file - promoters60/1020508
ttcttc

SEQ ID NO: 43376 - DNA, 6 bp, Unknown
  misc_feature (1)..( 6): Matrix.001 file - promoters60/1020508
tcattt

SEQ ID NO: 43377 - DNA, 6 bp, Unknown
  misc_feature (1)..( 6): Matrix.001 file - promoters60/1020508
aatgaa

SEQ ID NO: 43378 - DNA, 7 bp, Unknown
  misc_feature (1)..( 7): Matrix.001 file - promoters60/1020508
caaatat

SEQ ID NO: 43379 - DNA, 7 bp, Unknown
  misc_feature (1)..( 7): Matrix.001 file - promoters60/1020508
tgcatac

SEQ ID NO: 43380 - DNA, 6 bp, Unknown
  misc_feature (1)..( 6): Matrix.001 file - promoters60/1020508
cattat

SEQ ID NO: 43381 - DNA, 8 bp, Unknown
  misc_feature (1)..( 8): Matrix.001 file - promoters60/1020508
ttactaca

SEQ ID NO: 43382 - DNA, 8 bp, Unknown
  misc_feature (1)..( 8): Matrix.001 file - promoters60/1020508
atgtcatt

SEQ ID NO: 43383 - DNA, 7 bp, Unknown
  misc_feature (1)..( 7): Matrix.001 file - promoters60/1020508
aaaagtt

SEQ ID NO: 43384 - DNA, 7 bp, Unknown
  misc_feature (1)..( 7): Matrix.001 file - promoters60/1020508
gaccctt

SEQ ID NO: 43385 - DNA, 7 bp, Unknown
  misc_feature (1)..( 7): Matrix.001 file - promoters60/1020508
atcgtaa

SEQ ID NO: 43386 - DNA, 6 bp, Unknown
  misc_feature (1)..( 6): Matrix.001 file - promoters60/1020508
ataaat

SEQ ID NO: 43387 - DNA, 7 bp, Unknown
  misc_feature (1)..( 7): Matrix.001 file - promoters60/1020508
aacataa

SEQ ID NO: 43388 - DNA, 8 bp, Unknown
  misc_feature (1)..( 8): Matrix.001 file - promoters60/1020508
taaaatat

SEQ ID NO: 43389 - DNA, 6 bp, Unknown
  misc_feature (1)..( 6): Matrix.001 file - promoters60/1020512
aacaaa

SEQ ID NO: 43390 - DNA, 9 bp, Unknown
  misc_feature (1)..( 9): Matrix.001 file - promoters60/1020512
aaaagtcta

SEQ ID NO: 43391 - DNA, 10 bp, Unknown
  misc_feature (1)..( 10): Matrix.001 file - promoters60/1020512
tattttccag

SEQ ID NO: 43392 - DNA, 7 bp, Unknown
  misc_feature (1)..( 7): Matrix.001 file - promoters60/1020543
tttgttg

SEQ ID NO: 43393 - DNA, 6 bp, Unknown
  misc_feature (1)..( 6): Matrix.001 file - promoters60/1020543
caaaaa

SEQ ID NO: 43394 - DNA, 8 bp, Unknown
  misc_feature (1)..( 8): Matrix.001 file - promoters60/1020543
gaaaaaaa

SEQ ID NO: 43395 - DNA, 8 bp, Unknown
  misc_feature (1)..( 8): Matrix.001 file - promoters60/1020543
caactatt

SEQ ID NO: 43396 - DNA, 7 bp, Unknown
  misc_feature (1)..( 7): Matrix.001 file - promoters60/1020543
tttcatg

SEQ ID NO: 43397 - DNA, 6 bp, Unknown
  misc_feature (1)..( 6): Matrix.001 file - promoters60/1020543
taaaaa

SEQ ID NO: 43398 - DNA, 8 bp, Unknown
  misc_feature (1)..( 8): Matrix.001 file - promoters60/1020543
tcgacatg

SEQ ID NO: 43399 - DNA, 7 bp, Unknown
  misc_feature (1)..( 7): Matrix.001 file - promoters60/1020543
acgtggt

SEQ ID NO: 43400 - DNA, 6 bp, Unknown
  misc_feature (1)..( 6): Matrix.001 file - promoters60/1020543
ggtgga

SEQ ID NO: 43401 - DNA, 6 bp, Unknown
  misc_feature (1)..( 6): Matrix.001 file - promoters60/1020543
aaagaa

SEQ ID NO: 43402 - DNA, 6 bp, Unknown
  misc_feature (1)..( 6): Matrix.001 file - promoters60/1020543
acaaca

SEQ ID NO: 43403 - DNA, 12 bp, Unknown
  misc_feature (1)..( 12): Matrix.001 file - promoters60/1020543
aaaaaagaagaa

SEQ ID NO: 43404 - DNA, 9 bp, Unknown
  misc_feature (1)..( 9): Matrix.001 file - promoters60/1020543
atgataaga

SEQ ID NO: 43405 - DNA, 6 bp, Unknown
  misc_feature (1)..( 6): Matrix.001 file - promoters60/1020543
aataaa

SEQ ID NO: 43406 - DNA, 6 bp, Unknown
  misc_feature (1)..( 6): Matrix.001 file - promoters60/1020543
aactag

SEQ ID NO: 43407 - DNA, 7 bp, Unknown
  misc_feature (1)..( 7): Matrix.001 file - promoters60/1020543
aatgttg

SEQ ID NO: 43408 - DNA, 8 bp, Unknown
  misc_feature (1)..( 8): Matrix.001 file - promoters60/1020543
tggcaaag

SEQ ID NO: 43409 - DNA, 7 bp, Unknown
  misc_feature (1)..( 7): Matrix.001 file - promoters60/1020543
cgtcttc

SEQ ID NO: 43410 - DNA, 6 bp, Unknown
  misc_feature (1)..( 6): Matrix.001 file - promoters60/1020557
atgaaa

SEQ ID NO: 43411 - DNA, 6 bp, Unknown
  misc_feature (1)..( 6): Matrix.001 file - promoters60/1020557
atttta

SEQ ID NO: 43412 - DNA, 7 bp, Unknown
  misc_feature (1)..( 7): Matrix.001 file - promoters60/1020557
tatatat

SEQ ID NO: 43413 - DNA, 21 bp, Unknown
  misc_feature (1)..( 21): Matrix.001 file - promoters60/1020557
aaaaacaacattcatttacta

SEQ ID NO: 43414 - DNA, 6 bp, Unknown
  misc_feature (1)..( 6): Matrix.001 file - promoters60/1020557
atcatc

SEQ ID NO: 43415 - DNA, 6 bp, Unknown
  misc_feature (1)..( 6): Matrix.001 file - promoters60/1020557
atcatc

SEQ ID NO: 43416 - DNA, 22 bp, Unknown
  misc_feature (1)..( 22): Matrix.001 file - promoters60/1020557
aaatataaccaactttgaaatc

SEQ ID NO: 43417 - DNA, 15 bp, Unknown
  misc_feature (1)..( 15): Matrix.001 file - promoters60/1020557
tctctactatataaa

SEQ ID NO: 43418 - DNA, 7 bp, Unknown
  misc_feature (1)..( 7): Matrix.001 file - promoters60/1020557
agagatc

SEQ ID NO: 43419 - DNA, 7 bp, Unknown
  misc_feature (1)..( 7): Matrix.001 file - promoters60/1020557
atcaaaa

SEQ ID NO: 43420 - DNA, 6 bp, Unknown
  misc_feature (1)..( 6): Matrix.001 file - promoters60/1020557
tagaaa

SEQ ID NO: 43421 - DNA, 6 bp, Unknown
  misc_feature (1)..( 6): Matrix.001 file - promoters60/1020557
attttt

SEQ ID NO: 43422 - DNA, 10 bp, Unknown
  misc_feature (1)..( 10): Matrix.001 file - promoters60/1020596
aatctttcaa

SEQ ID NO: 43423 - DNA, 9 bp, Unknown
  misc_feature (1)..( 9): Matrix.001 file - promoters60/1020596
tatggaaag

SEQ ID NO: 43424 - DNA, 9 bp, Unknown
  misc_feature (1)..( 9): Matrix.001 file - promoters60/1020596
gaagaaatg

SEQ ID NO: 43425 - DNA, 8 bp, Unknown
  misc_feature (1)..( 8): Matrix.001 file - promoters60/1020596
ccgaaaaa

SEQ ID NO: 43426 - DNA, 14 bp, Unknown
  misc_feature (1)..( 14): Matrix.001 file - promoters60/1020619
aaatttaatactct

SEQ ID NO: 43427 - DNA, 13 bp, Unknown
  misc_feature (1)..( 13): Matrix.001 file - promoters60/1020619
ctcctataaatta

SEQ ID NO: 43428 - DNA, 13 bp, Unknown
  misc_feature (1)..( 13): Matrix.001 file - promoters60/1020619
gcaattttattta

SEQ ID NO: 43429 - DNA, 9 bp, Unknown
  misc_feature (1)..( 9): Matrix.001 file - promoters60/1020634
aaaatactc

SEQ ID NO: 43430 - DNA, 9 bp, Unknown
  misc_feature (1)..( 9): Matrix.001 file - promoters60/1020634
tgtcaaatt

SEQ ID NO: 43431 - DNA, 9 bp, Unknown
  misc_feature (1)..( 9): Matrix.001 file - promoters60/1020634
tttttaaaa

SEQ ID NO: 43432 - DNA, 13 bp, Unknown
  misc_feature (1)..( 13): Matrix.001 file - promoters60/1020634
gatttcaaatagt

SEQ ID NO: 43433 - DNA, 7 bp, Unknown
  misc_feature (1)..( 7): Matrix.001 file - promoters60/1020634
taaaaat

SEQ ID NO: 43434 - DNA, 10 bp, Unknown
  misc_feature (1)..( 10): Matrix.001 file - promoters60/1020634
tttaaaattc

SEQ ID NO: 43435 - DNA, 6 bp, Unknown
  misc_feature (1)..( 6): Matrix.001 file - promoters60/1020642
ttttac

SEQ ID NO: 43436 - DNA, 9 bp, Unknown
  misc_feature (1)..( 9): Matrix.001 file - promoters60/1020642
aaacaaata

SEQ ID NO: 43437 - DNA, 8 bp, Unknown
  misc_feature (1)..( 8): Matrix.001 file - promoters60/1020642
agaaaaaa

SEQ ID NO: 43438 - DNA, 8 bp, Unknown
  misc_feature (1)..( 8): Matrix.001 file - promoters60/1020642
aattcttg

SEQ ID NO: 43439 - DNA, 7 bp, Unknown
  misc_feature (1)..( 7): Matrix.001 file - promoters60/1020642
ttgattt

SEQ ID NO: 43440 - DNA, 8 bp, Unknown
  misc_feature (1)..( 8): Matrix.001 file - promoters60/1020642
catcgtct

SEQ ID NO: 43441 - DNA, 6 bp, Unknown
  misc_feature (1)..( 6): Matrix.001 file - promoters60/1020642
tctaac

SEQ ID NO: 43442 - DNA, 9 bp, Unknown
  misc_feature (1)..( 9): Matrix.001 file - promoters60/1020642
ttttcagct

SEQ ID NO: 43443 - DNA, 11 bp, Unknown
  misc_feature (1)..( 11): Matrix.001 file - promoters60/1020646
aataatttgta

SEQ ID NO: 43444 - DNA, 7 bp, Unknown
  misc_feature (1)..( 7): Matrix.001 file - promoters60/1020646
ttgtaac

SEQ ID NO: 43445 - DNA, 7 bp, Unknown
  misc_feature (1)..( 7): Matrix.001 file - promoters60/1020646
atacaaa

SEQ ID NO: 43446 - DNA, 6 bp, Unknown
  misc_feature (1)..( 6): Matrix.001 file - promoters60/1020646
aaaaaa

SEQ ID NO: 43447 - DNA, 9 bp, Unknown
  misc_feature (1)..( 9): Matrix.001 file - promoters60/1020646
atcaatcat

SEQ ID NO: 43448 - DNA, 8 bp, Unknown
  misc_feature (1)..( 8): Matrix.001 file - promoters60/1020646
ttagttta

SEQ ID NO: 43449 - DNA, 7 bp, Unknown
  misc_feature (1)..( 7): Matrix.001 file - promoters60/1020646
aacagaa

SEQ ID NO: 43450 - DNA, 6 bp, Unknown
  misc_feature (1)..( 6): Matrix.001 file - promoters60/1020646
ctctta

SEQ ID NO: 43451 - DNA, 6 bp, Unknown
  misc_feature (1)..( 6): Matrix.001 file - promoters60/1020646
atcatt

SEQ ID NO: 43452 - DNA, 6 bp, Unknown
  misc_feature (1)..( 6): Matrix.001 file - promoters60/1020646
cattat

SEQ ID NO: 43453 - DNA, 7 bp, Unknown
  misc_feature (1)..( 7): Matrix.001 file - promoters60/1020646
gaaaaaa

SEQ ID NO: 43454 - DNA, 8 bp, Unknown
  misc_feature (1)..( 8): Matrix.001 file - promoters60/1020646
aacagtta

SEQ ID NO: 43455 - DNA, 11 bp, Unknown
  misc_feature (1)..( 11): Matrix.001 file - promoters60/1020646
actaaccaaat

SEQ ID NO: 43456 - DNA, 7 bp, Unknown
  misc_feature (1)..( 7): Matrix.001 file - promoters60/1020646
ttagtaa

SEQ ID NO: 43457 - DNA, 6 bp, Unknown
  misc_feature (1)..( 6): Matrix.001 file - promoters60/1020646
tttatt

SEQ ID NO: 43458 - DNA, 7 bp, Unknown
  misc_feature (1)..( 7): Matrix.001 file - promoters60/1020646
aaacaaa

SEQ ID NO: 43459 - DNA, 6 bp, Unknown
  misc_feature (1)..( 6): Matrix.001 file - promoters60/1020646
catgaa

SEQ ID NO: 43460 - DNA, 6 bp, Unknown
  misc_feature (1)..( 6): Matrix.001 file - promoters60/1020646
tcccaa

SEQ ID NO: 43461 - DNA, 6 bp, Unknown
  misc_feature (1)..( 6): Matrix.001 file - promoters60/1020646
agaaaa

SEQ ID NO: 43462 - DNA, 8 bp, Unknown
  misc_feature (1)..( 8): Matrix.001 file - promoters60/1020646
gcatccaa

SEQ ID NO: 43463 - DNA, 10 bp, Unknown
  misc_feature (1)..( 10): Matrix.001 file - promoters60/1020666
agaaatttaa

SEQ ID NO: 43464 - DNA, 12 bp, Unknown
  misc_feature (1)..( 12): Matrix.001 file - promoters60/1020666
tatcaaaaaaga

SEQ ID NO: 43465 - DNA, 9 bp, Unknown
  misc_feature (1)..( 9): Matrix.001 file - promoters60/1020701
gaaaataag

SEQ ID NO: 43466 - DNA, 11 bp, Unknown
  misc_feature (1)..( 11): Matrix.001 file - promoters60/1020701
caagtctctat

SEQ ID NO: 43467 - DNA, 10 bp, Unknown
  misc_feature (1)..( 10): Matrix.001 file - promoters60/1020701
atattaatgt

SEQ ID NO: 43468 - DNA, 10 bp, Unknown
  misc_feature (1)..( 10): Matrix.001 file - promoters60/1020701
aaatcatatt

SEQ ID NO: 43469 - DNA, 8 bp, Unknown
  misc_feature (1)..( 8): Matrix.001 file - promoters60/1020701
taatttca

SEQ ID NO: 43470 - DNA, 7 bp, Unknown
  misc_feature (1)..( 7): Matrix.001 file - promoters60/1020713
tttattt

SEQ ID NO: 43471 - DNA, 7 bp, Unknown
  misc_feature (1)..( 7): Matrix.001 file - promoters60/1020713
ttagtta

SEQ ID NO: 43472 - DNA, 7 bp, Unknown
  misc_feature (1)..( 7): Matrix.001 file - promoters60/1020713
taagtta

SEQ ID NO: 43473 - DNA, 12 bp, Unknown
  misc_feature (1)..( 12): Matrix.001 file - promoters60/1020713
taaatatccgta

SEQ ID NO: 43474 - DNA, 6 bp, Unknown
  misc_feature (1)..( 6): Matrix.001 file - promoters60/1020713
gtttga

SEQ ID NO: 43475 - DNA, 7 bp, Unknown
  misc_feature (1)..( 7): Matrix.001 file - promoters60/1020713
gttgaat

SEQ ID NO: 43476 - DNA, 7 bp, Unknown
  misc_feature (1)..( 7): Matrix.001 file - promoters60/1020713
ttcatac

SEQ ID NO: 43477 - DNA, 7 bp, Unknown
  misc_feature (1)..( 7): Matrix.001 file - promoters60/1020713
taggtta

SEQ ID NO: 43478 - DNA, 7 bp, Unknown
  misc_feature (1)..( 7): Matrix.001 file - promoters60/1020713
ttccata

SEQ ID NO: 43479 - DNA, 7 bp, Unknown
  misc_feature (1)..( 7): Matrix.001 file - promoters60/1020713
atcttct

SEQ ID NO: 43480 - DNA, 8 bp, Unknown
  misc_feature (1)..( 8): Matrix.001 file - promoters60/1020713
caagaaaa

SEQ ID NO: 43481 - DNA, 7 bp, Unknown
  misc_feature (1)..( 7): Matrix.001 file - promoters60/1020713
aaatttc

SEQ ID NO: 43482 - DNA, 6 bp, Unknown
  misc_feature (1)..( 6): Matrix.001 file - promoters60/1020713
aagctt

SEQ ID NO: 43483 - DNA, 6 bp, Unknown
  misc_feature (1)..( 6): Matrix.001 file - promoters60/1020713
tacgtt

SEQ ID NO: 43484 - DNA, 8 bp, Unknown
  misc_feature (1)..( 8): Matrix.001 file - promoters60/1020713
atccaatt

SEQ ID NO: 43485 - DNA, 6 bp, Unknown
  misc_feature (1)..( 6): Matrix.001 file - promoters60/1020713
cgtgag

SEQ ID NO: 43486 - DNA, 7 bp, Unknown
  misc_feature (1)..( 7): Matrix.001 file - promoters60/1020713
atttaaa

SEQ ID NO: 43487 - DNA, 6 bp, Unknown
  misc_feature (1)..( 6): Matrix.001 file - promoters60/1020713
aaaaaa

SEQ ID NO: 43488 - DNA, 6 bp, Unknown
  misc_feature (1)..( 6): Matrix.001 file - promoters60/1020713
gaacac

SEQ ID NO: 43489 - DNA, 7 bp, Unknown
  misc_feature (1)..( 7): Matrix.001 file - promoters60/1020713
ttttaaa

SEQ ID NO: 43490 - DNA, 7 bp, Unknown
  misc_feature (1)..( 7): Matrix.001 file - promoters60/1020713
gaaataa

SEQ ID NO: 43491 - DNA, 11 bp, Unknown
  misc_feature (1)..( 11): Matrix.001 file - promoters60/1020786
caaaaaaaata

SEQ ID NO: 43492 - DNA, 6 bp, Unknown
  misc_feature (1)..( 6): Matrix.001 file - promoters60/1020786
aaatac

SEQ ID NO: 43493 - DNA, 10 bp, Unknown
  misc_feature (1)..( 10): Matrix.001 file - promoters60/1020786
aaattaatat

SEQ ID NO: 43494 - DNA, 13 bp, Unknown
  misc_feature (1)..( 13): Matrix.001 file - promoters60/1020786
aaaacaaaaaaca

SEQ ID NO: 43495 - DNA, 7 bp, Unknown
  misc_feature (1)..( 7): Matrix.001 file - promoters60/1020786
aaaaata

SEQ ID NO: 43496 - DNA, 9 bp, Unknown
  misc_feature (1)..( 9): Matrix.001 file - promoters60/1020786
aattaaaaa

SEQ ID NO: 43497 - DNA, 10 bp, Unknown
  misc_feature (1)..( 10): Matrix.001 file - promoters60/1020786
acaaaaaaat

SEQ ID NO: 43498 - DNA, 10 bp, Unknown
  misc_feature (1)..( 10): Matrix.001 file - promoters60/1020786
aaaataaatt

SEQ ID NO: 43499 - DNA, 14 bp, Unknown
  misc_feature (1)..( 14): Matrix.001 file - promoters60/1020786
taacttttaaacta

SEQ ID NO: 43500 - DNA, 8 bp, Unknown
  misc_feature (1)..( 8): Matrix.001 file - promoters60/1020786
aaaaaatt

SEQ ID NO: 43501 - DNA, 9 bp, Unknown
  misc_feature (1)..( 9): Matrix.001 file - promoters60/1020786
atataaaaa

SEQ ID NO: 43502 - DNA, 9 bp, Unknown
  misc_feature (1)..( 9): Matrix.001 file - promoters60/1020818
aaataattt

SEQ ID NO: 43503 - DNA, 13 bp, Unknown
  misc_feature (1)..( 13): Matrix.001 file - promoters60/1020818
ataatttttcctt

SEQ ID NO: 43504 - DNA, 10 bp, Unknown
  misc_feature (1)..( 10): Matrix.001 file - promoters60/1020818
taaaaaagaa

SEQ ID NO: 43505 - DNA, 9 bp, Unknown
  misc_feature (1)..( 9): Matrix.001 file - promoters60/1020818
gtcaaaaaa

SEQ ID NO: 43506 - DNA, 6 bp, Unknown
  misc_feature (1)..( 6): Matrix.001 file - promoters60/1020826
acatag

SEQ ID NO: 43507 - DNA, 9 bp, Unknown
  misc_feature (1)..( 9): Matrix.001 file - promoters60/1020826
tttttcttc

SEQ ID NO: 43508 - DNA, 6 bp, Unknown
  misc_feature (1)..( 6): Matrix.001 file - promoters60/1020826
tagaat

SEQ ID NO: 43509 - DNA, 6 bp, Unknown
  misc_feature (1)..( 6): Matrix.001 file - promoters60/1020826
attttc

SEQ ID NO: 43510 - DNA, 6 bp, Unknown
  misc_feature (1)..( 6): Matrix.001 file - promoters60/1020826
taaatt

SEQ ID NO: 43511 - DNA, 6 bp, Unknown
  misc_feature (1)..( 6): Matrix.001 file - promoters60/1020826
aatata

SEQ ID NO: 43512 - DNA, 8 bp, Unknown
  misc_feature (1)..( 8): Matrix.001 file - promoters60/1020826
gaccattg

SEQ ID NO: 43513 - DNA, 7 bp, Unknown
  misc_feature (1)..( 7): Matrix.001 file - promoters60/1020826
ctcaaat

SEQ ID NO: 43514 - DNA, 7 bp, Unknown
  misc_feature (1)..( 7): Matrix.001 file - promoters60/1020826
ctacgtc

SEQ ID NO: 43515 - DNA, 7 bp, Unknown
  misc_feature (1)..( 7): Matrix.001 file - promoters60/1020826
gaagaaa

SEQ ID NO: 43516 - DNA, 6 bp, Unknown
  misc_feature (1)..( 6): Matrix.001 file - promoters60/1020826
tttcat

SEQ ID NO: 43517 - DNA, 7 bp, Unknown
  misc_feature (1)..( 7): Matrix.001 file - promoters60/1020826
gtcataa

SEQ ID NO: 43518 - DNA, 11 bp, Unknown
  misc_feature (1)..( 11): Matrix.001 file - promoters60/1020826
attataacctc

SEQ ID NO: 43519 - DNA, 6 bp, Unknown
  misc_feature (1)..( 6): Matrix.001 file - promoters60/1020826
aagtat

SEQ ID NO: 43520 - DNA, 6 bp, Unknown
  misc_feature (1)..( 6): Matrix.001 file - promoters60/1020826
tgagaa

SEQ ID NO: 43521 - DNA, 7 bp, Unknown
  misc_feature (1)..( 7): Matrix.001 file - promoters60/1020826
aagaaaa

SEQ ID NO: 43522 - DNA, 8 bp, Unknown
  misc_feature (1)..( 8): Matrix.001 file - promoters60/1020834
agaatacc

SEQ ID NO: 43523 - DNA, 6 bp, Unknown
  misc_feature (1)..( 6): Matrix.001 file - promoters60/1020834
gcacat

SEQ ID NO: 43524 - DNA, 6 bp, Unknown
  misc_feature (1)..( 6): Matrix.001 file - promoters60/1020834
cagaag

SEQ ID NO: 43525 - DNA, 9 bp, Unknown
  misc_feature (1)..( 9): Matrix.001 file - promoters60/1020834
ttatcaaaa

SEQ ID NO: 43526 - DNA, 6 bp, Unknown
  misc_feature (1)..( 6): Matrix.001 file - promoters60/1020834
tagatt

SEQ ID NO: 43527 - DNA, 7 bp, Unknown
  misc_feature (1)..( 7): Matrix.001 file - promoters60/1020834
ttggact

SEQ ID NO: 43528 - DNA, 6 bp, Unknown
  misc_feature (1)..( 6): Matrix.001 file - promoters60/1020834
cactta

SEQ ID NO: 43529 - DNA, 7 bp, Unknown
  misc_feature (1)..( 7): Matrix.001 file - promoters60/1020834
aaaatca

SEQ ID NO: 43530 - DNA, 6 bp, Unknown
  misc_feature (1)..( 6): Matrix.001 file - promoters60/1020834
tgagat

SEQ ID NO: 43531 - DNA, 8 bp, Unknown
  misc_feature (1)..( 8): Matrix.001 file - promoters60/1020834
agatcttc

SEQ ID NO: 43532 - DNA, 8 bp, Unknown
  misc_feature (1)..( 8): Matrix.001 file - promoters60/1020834
ttcactga

SEQ ID NO: 43533 - DNA, 6 bp, Unknown
  misc_feature (1)..( 6): Matrix.001 file - promoters60/1020838
atagaa

SEQ ID NO: 43534 - DNA, 9 bp, Unknown
  misc_feature (1)..( 9): Matrix.001 file - promoters60/1020838
cattgcaaa

SEQ ID NO: 43535 - DNA, 8 bp, Unknown
  misc_feature (1)..( 8): Matrix.001 file - promoters60/1020838
accaacta

SEQ ID NO: 43536 - DNA, 6 bp, Unknown
  misc_feature (1)..( 6): Matrix.001 file - promoters60/1020838
tatata

SEQ ID NO: 43537 - DNA, 9 bp, Unknown
  misc_feature (1)..( 9): Matrix.001 file - promoters60/1020838
aatgtcttt

SEQ ID NO: 43538 - DNA, 7 bp, Unknown
  misc_feature (1)..( 7): Matrix.001 file - promoters60/1020838
tttcaag

SEQ ID NO: 43539 - DNA, 6 bp, Unknown
  misc_feature (1)..( 6): Matrix.001 file - promoters60/1020838
gaacaa

SEQ ID NO: 43540 - DNA, 8 bp, Unknown
  misc_feature (1)..( 8): Matrix.001 file - promoters60/1020838
attacatg

SEQ ID NO: 43541 - DNA, 6 bp, Unknown
  misc_feature (1)..( 6): Matrix.001 file - promoters60/1020838
tagatg

SEQ ID NO: 43542 - DNA, 8 bp, Unknown
  misc_feature (1)..( 8): Matrix.001 file - promoters60/1020838
aaaacgtt

SEQ ID NO: 43543 - DNA, 7 bp, Unknown
  misc_feature (1)..( 7): Matrix.001 file - promoters60/1020838
caaaaag

SEQ ID NO: 43544 - DNA, 7 bp, Unknown
  misc_feature (1)..( 7): Matrix.001 file - promoters60/1020838
ataaaag

SEQ ID NO: 43545 - DNA, 7 bp, Unknown
  misc_feature (1)..( 7): Matrix.001 file - promoters60/1020838
ttgaagg

SEQ ID NO: 43546 - DNA, 6 bp, Unknown
  misc_feature (1)..( 6): Matrix.001 file - promoters60/1020838
ggagaa

SEQ ID NO: 43547 - DNA, 7 bp, Unknown
  misc_feature (1)..( 7): Matrix.001 file - promoters60/1020838
gaaagaa

SEQ ID NO: 43548 - DNA, 8 bp, Unknown
  misc_feature (1)..( 8): Matrix.001 file - promoters60/1020838
ctttggaa

SEQ ID NO: 43549 - DNA, 6 bp, Unknown
  misc_feature (1)..( 6): Matrix.001 file - promoters60/1020838
aatgaa

SEQ ID NO: 43550 - DNA, 7 bp, Unknown
  misc_feature (1)..( 7): Matrix.001 file - promoters60/1020838
ttcctaa

SEQ ID NO: 43551 - DNA, 7 bp, Unknown
  misc_feature (1)..( 7): Matrix.001 file - promoters60/1020838
aaatcaa

SEQ ID NO: 43552 - DNA, 7 bp, Unknown
  misc_feature (1)..( 7): Matrix.001 file - promoters60/1020838
aaggtaa

SEQ ID NO: 43553 - DNA, 9 bp, Unknown
  misc_feature (1)..( 9): Matrix.001 file - promoters60/1020838
aaaaaaaaa

SEQ ID NO: 43554 - DNA, 6 bp, Unknown
  misc_feature (1)..( 6): Matrix.001 file - promoters60/1020838
acatag

SEQ ID NO: 43555 - DNA, 8 bp, Unknown
  misc_feature (1)..( 8): Matrix.001 file - promoters60/1020838
acactttc

SEQ ID NO: 43556 - DNA, 6 bp, Unknown
  misc_feature (1)..( 6): Matrix.001 file - promoters60/1020838
tcagat

SEQ ID NO: 43557 - DNA, 7 bp, Unknown
  misc_feature (1)..( 7): Matrix.001 file - promoters60/1020838
tttgtaa

SEQ ID NO: 43558 - DNA, 6 bp, Unknown
  misc_feature (1)..( 6): Matrix.001 file - promoters60/1020838
aataaa

SEQ ID NO: 43559 - DNA, 7 bp, Unknown
  misc_feature (1)..( 7): Matrix.001 file - promoters60/1020838
tttatgt

SEQ ID NO: 43560 - DNA, 7 bp, Unknown
  misc_feature (1)..( 7): Matrix.001 file - promoters60/1020838
tatgtat

SEQ ID NO: 43561 - DNA, 8 bp, Unknown
  misc_feature (1)..( 8): Matrix.001 file - promoters60/1020838
taaaaccg

SEQ ID NO: 43562 - DNA, 8 bp, Unknown
  misc_feature (1)..( 8): Matrix.001 file - promoters60/1020848
ttttgaaa

SEQ ID NO: 43563 - DNA, 9 bp, Unknown
  misc_feature (1)..( 9): Matrix.001 file - promoters60/1020848
aacaaatat

SEQ ID NO: 43564 - DNA, 7 bp, Unknown
  misc_feature (1)..( 7): Matrix.001 file - promoters60/1020848
atatatg

SEQ ID NO: 43565 - DNA, 6 bp, Unknown
  misc_feature (1)..( 6): Matrix.001 file - promoters60/1020848
aattgg

SEQ ID NO: 43566 - DNA, 6 bp, Unknown
  misc_feature (1)..( 6): Matrix.001 file - promoters60/1020848
gtaata

SEQ ID NO: 43567 - DNA, 8 bp, Unknown
  misc_feature (1)..( 8): Matrix.001 file - promoters60/1020848
aacttatt

SEQ ID NO: 43568 - DNA, 6 bp, Unknown
  misc_feature (1)..( 6): Matrix.001 file - promoters60/1020848
tatttt

SEQ ID NO: 43569 - DNA, 7 bp, Unknown
  misc_feature (1)..( 7): Matrix.001 file - promoters60/1020848
attatat

SEQ ID NO: 43570 - DNA, 7 bp, Unknown
  misc_feature (1)..( 7): Matrix.001 file - promoters60/1020848
agaatat

SEQ ID NO: 43571 - DNA, 7 bp, Unknown
  misc_feature (1)..( 7): Matrix.001 file - promoters60/1020848
ttaaaac

SEQ ID NO: 43572 - DNA, 7 bp, Unknown
  misc_feature (1)..( 7): Matrix.001 file - promoters60/1020848
tttcaaa

SEQ ID NO: 43573 - DNA, 7 bp, Unknown
  misc_feature (1)..( 7): Matrix.001 file - promoters60/1020848
aaccatt

SEQ ID NO: 43574 - DNA, 7 bp, Unknown
  misc_feature (1)..( 7): Matrix.001 file - promoters60/1020848
atgggag

SEQ ID NO: 43575 - DNA, 8 bp, Unknown
  misc_feature (1)..( 8): Matrix.001 file - promoters60/1020848
caaatcaa

SEQ ID NO: 43576 - DNA, 7 bp, Unknown
  misc_feature (1)..( 7): Matrix.001 file - promoters60/1020848
attcaat

SEQ ID NO: 43577 - DNA, 8 bp, Unknown
  misc_feature (1)..( 8): Matrix.001 file - promoters60/1020848
atagcaat

SEQ ID NO: 43578 - DNA, 6 bp, Unknown
  misc_feature (1)..( 6): Matrix.001 file - promoters60/1020848
ttttat

SEQ ID NO: 43579 - DNA, 6 bp, Unknown
  misc_feature (1)..( 6): Matrix.001 file - promoters60/1020848
atattt

SEQ ID NO: 43580 - DNA, 7 bp, Unknown
  misc_feature (1)..( 7): Matrix.001 file - promoters60/1020848
tttcatg

SEQ ID NO: 43581 - DNA, 6 bp, Unknown
  misc_feature (1)..( 6): Matrix.001 file - promoters60/1020848
gatcat

SEQ ID NO: 43582 - DNA, 6 bp, Unknown
  misc_feature (1)..( 6): Matrix.001 file - promoters60/1020848
aaattt

SEQ ID NO: 43583 - DNA, 6 bp, Unknown
  misc_feature (1)..( 6): Matrix.001 file - promoters60/1020848
tgtttt

SEQ ID NO: 43584 - DNA, 6 bp, Unknown
  misc_feature (1)..( 6): Matrix.001 file - promoters60/1020848
atgcaa

SEQ ID NO: 43585 - DNA, 7 bp, Unknown
  misc_feature (1)..( 7): Matrix.001 file - promoters60/1020848
tacattt

SEQ ID NO: 43586 - DNA, 8 bp, Unknown
  misc_feature (1)..( 8): Matrix.001 file - promoters60/1020863
aaaaaata

SEQ ID NO: 43587 - DNA, 11 bp, Unknown
  misc_feature (1)..( 11): Matrix.001 file - promoters60/1020863
aaaataaaata

SEQ ID NO: 43588 - DNA, 8 bp, Unknown
  misc_feature (1)..( 8): Matrix.001 file - promoters60/1020863
aaaacaaa

SEQ ID NO: 43589 - DNA, 13 bp, Unknown
  misc_feature (1)..( 13): Matrix.001 file - promoters60/1020863
tcatttgcaataa

SEQ ID NO: 43590 - DNA, 9 bp, Unknown
  misc_feature (1)..( 9): Matrix.001 file - promoters60/1020863
ttgaatttt

SEQ ID NO: 43591 - DNA, 11 bp, Unknown
  misc_feature (1)..( 11): Matrix.001 file - promoters60/1020863
tccaaaaataa

SEQ ID NO: 43592 - DNA, 10 bp, Unknown
  misc_feature (1)..( 10): Matrix.001 file - promoters60/1020863
aaataataaa

SEQ ID NO: 43593 - DNA, 6 bp, Unknown
  misc_feature (1)..( 6): Matrix.001 file - promoters60/1020863
atatta

SEQ ID NO: 43594 - DNA, 11 bp, Unknown
  misc_feature (1)..( 11): Matrix.001 file - promoters60/1020863
gaaaaaaatag

SEQ ID NO: 43595 - DNA, 7 bp, Unknown
  misc_feature (1)..( 7): Matrix.001 file - promoters60/1020863
taaaaat

SEQ ID NO: 43596 - DNA, 8 bp, Unknown
  misc_feature (1)..( 8): Matrix.001 file - promoters60/1020863
atttattt

SEQ ID NO: 43597 - DNA, 8 bp, Unknown
  misc_feature (1)..( 8): Matrix.001 file - promoters60/1020892
gttttaca

SEQ ID NO: 43598 - DNA, 12 bp, Unknown
  misc_feature (1)..( 12): Matrix.001 file - promoters60/1020892
ttactgaaaaaa

SEQ ID NO: 43599 - DNA, 8 bp, Unknown
  misc_feature (1)..( 8): Matrix.001 file - promoters60/1020940
taaaatgg

SEQ ID NO: 43600 - DNA, 7 bp, Unknown
  misc_feature (1)..( 7): Matrix.001 file - promoters60/1020940
aaaaaaa

SEQ ID NO: 43601 - DNA, 9 bp, Unknown
  misc_feature (1)..( 9): Matrix.001 file - promoters60/1020940
aaacaaaat

SEQ ID NO: 43602 - DNA, 7 bp, Unknown
  misc_feature (1)..( 7): Matrix.001 file - promoters60/1020940
aaattat

SEQ ID NO: 43603 - DNA, 10 bp, Unknown
  misc_feature (1)..( 10): Matrix.001 file - promoters60/1020940
tatataaacc

SEQ ID NO: 43604 - DNA, 7 bp, Unknown
  misc_feature (1)..( 7): Matrix.001 file - promoters60/1020940
aaaatag

SEQ ID NO: 43605 - DNA, 9 bp, Unknown
  misc_feature (1)..( 9): Matrix.001 file - promoters60/1020940
tgaataatg

SEQ ID NO: 43606 - DNA, 10 bp, Unknown
  misc_feature (1)..( 10): Matrix.001 file - promoters60/1020940
ataataaata

SEQ ID NO: 43607 - DNA, 9 bp, Unknown
  misc_feature (1)..( 9): Matrix.001 file - promoters60/1020968
gtaatttaa

SEQ ID NO: 43608 - DNA, 11 bp, Unknown
  misc_feature (1)..( 11): Matrix.001 file - promoters60/1020968
atacttaagtt

SEQ ID NO: 43609 - DNA, 12 bp, Unknown
  misc_feature (1)..( 12): Matrix.001 file - promoters60/1020968
attaaattttca

SEQ ID NO: 43610 - DNA, 11 bp, Unknown
  misc_feature (1)..( 11): Matrix.001 file - promoters60/1020968
aattttcaaat

SEQ ID NO: 43611 - DNA, 9 bp, Unknown
  misc_feature (1)..( 9): Matrix.001 file - promoters60/1020968
ttaaaatat

SEQ ID NO: 43612 - DNA, 14 bp, Unknown
  misc_feature (1)..( 14): Matrix.001 file - promoters60/1020968
atataattaaacgt

SEQ ID NO: 43613 - DNA, 13 bp, Unknown
  misc_feature (1)..( 13): Matrix.001 file - promoters60/1020968
aatgcttaaattt

SEQ ID NO: 43614 - DNA, 8 bp, Unknown
  misc_feature (1)..( 8): Matrix.001 file - promoters60/1020968
aaaataaa

SEQ ID NO: 43615 - DNA, 11 bp, Unknown
  misc_feature (1)..( 11): Matrix.001 file - promoters60/1021001
aacaaagaaag

SEQ ID NO: 43616 - DNA, 6 bp, Unknown
  misc_feature (1)..( 6): Matrix.001 file - promoters60/1021047
tcaatg

SEQ ID NO: 43617 - DNA, 8 bp, Unknown
  misc_feature (1)..( 8): Matrix.001 file - promoters60/1021047
cacaccct

SEQ ID NO: 43618 - DNA, 9 bp, Unknown
  misc_feature (1)..( 9): Matrix.001 file - promoters60/1021047
tttatttta

SEQ ID NO: 43619 - DNA, 10 bp, Unknown
  misc_feature (1)..( 10): Matrix.001 file - promoters60/1021047
tttaattttg

SEQ ID NO: 43620 - DNA, 7 bp, Unknown
  misc_feature (1)..( 7): Matrix.001 file - promoters60/1021047
ttaagta

SEQ ID NO: 43621 - DNA, 8 bp, Unknown
  misc_feature (1)..( 8): Matrix.001 file - promoters60/1021047
aaatttta

SEQ ID NO: 43622 - DNA, 6 bp, Unknown
  misc_feature (1)..( 6): Matrix.001 file - promoters60/1021047
aaactt

SEQ ID NO: 43623 - DNA, 10 bp, Unknown
  misc_feature (1)..( 10): Matrix.001 file - promoters60/1021047
agatattttg

SEQ ID NO: 43624 - DNA, 7 bp, Unknown
  misc_feature (1)..( 7): Matrix.001 file - promoters60/1021047
tttctta

SEQ ID NO: 43625 - DNA, 6 bp, Unknown
  misc_feature (1)..( 6): Matrix.001 file - promoters60/1021047
atatta

SEQ ID NO: 43626 - DNA, 6 bp, Unknown
  misc_feature (1)..( 6): Matrix.001 file - promoters60/1021047
aatgtt

SEQ ID NO: 43627 - DNA, 8 bp, Unknown
  misc_feature (1)..( 8): Matrix.001 file - promoters60/1021047
tatataaa

SEQ ID NO: 43628 - DNA, 6 bp, Unknown
  misc_feature (1)..( 6): Matrix.001 file - promoters60/1021047
taattt

SEQ ID NO: 43629 - DNA, 7 bp, Unknown
  misc_feature (1)..( 7): Matrix.001 file - promoters60/1021047
tttattt

SEQ ID NO: 43630 - DNA, 6 bp, Unknown
  misc_feature (1)..( 6): Matrix.001 file - promoters60/1021047
tcatcc

SEQ ID NO: 43631 - DNA, 6 bp, Unknown
  misc_feature (1)..( 6): Matrix.001 file - promoters60/1021047
tttttt

SEQ ID NO: 43632 - DNA, 14 bp, Unknown
  misc_feature (1)..( 14): Matrix.001 file - promoters60/1021047
aaaattaagttcaa

SEQ ID NO: 43633 - DNA, 9 bp, Unknown
  misc_feature (1)..( 9): Matrix.001 file - promoters60/1021047
aagaaaaaa

SEQ ID NO: 43634 - DNA, 6 bp, Unknown
  misc_feature (1)..( 6): Matrix.001 file - promoters60/1021047
aaaaca

SEQ ID NO: 43635 - DNA, 6 bp, Unknown
  misc_feature (1)..( 6): Matrix.001 file - promoters60/1021047
ctaaga

SEQ ID NO: 43636 - DNA, 6 bp, Unknown
  misc_feature (1)..( 6): Matrix.001 file - promoters60/1021047
aataat

SEQ ID NO: 43637 - DNA, 9 bp, Unknown
  misc_feature (1)..( 9): Matrix.001 file - promoters60/1021079
gaaaatata

SEQ ID NO: 43638 - DNA, 12 bp, Unknown
  misc_feature (1)..( 12): Matrix.001 file - promoters60/1021079
aaaattttgttt

SEQ ID NO: 43639 - DNA, 12 bp, Unknown
  misc_feature (1)..( 12): Matrix.001 file - promoters60/1021079
ttattaagataa

SEQ ID NO: 43640 - DNA, 15 bp, Unknown
  misc_feature (1)..( 15): Matrix.001 file - promoters60/1021079
atataaataatatta

SEQ ID NO: 43641 - DNA, 9 bp, Unknown
  misc_feature (1)..( 9): Matrix.001 file - promoters60/1021079
taaaaaaca

SEQ ID NO: 43642 - DNA, 9 bp, Unknown
  misc_feature (1)..( 9): Matrix.001 file - promoters60/1021079
ttgaatcac

SEQ ID NO: 43643 - DNA, 10 bp, Unknown
  misc_feature (1)..( 10): Matrix.001 file - promoters60/1021079
taataaaaac

SEQ ID NO: 43644 - DNA, 11 bp, Unknown
  misc_feature (1)..( 11): Matrix.001 file - promoters60/1021079
cctaaaatttt

SEQ ID NO: 43645 - DNA, 11 bp, Unknown
  misc_feature (1)..( 11): Matrix.001 file - promoters60/1021104
gaaattcttct

SEQ ID NO: 43646 - DNA, 6 bp, Unknown
  misc_feature (1)..( 6): Matrix.001 file - promoters60/1021104
agaagt

SEQ ID NO: 43647 - DNA, 13 bp, Unknown
  misc_feature (1)..( 13): Matrix.001 file - promoters60/1021104
agttttgtaataa

SEQ ID NO: 43648 - DNA, 7 bp, Unknown
  misc_feature (1)..( 7): Matrix.001 file - promoters60/1021136
aatgttt

SEQ ID NO: 43649 - DNA, 6 bp, Unknown
  misc_feature (1)..( 6): Matrix.001 file - promoters60/1021136
tttgtt

SEQ ID NO: 43650 - DNA, 6 bp, Unknown
  misc_feature (1)..( 6): Matrix.001 file - promoters60/1021136
ctctca

SEQ ID NO: 43651 - DNA, 6 bp, Unknown
  misc_feature (1)..( 6): Matrix.001 file - promoters60/1021136
ttcaat

SEQ ID NO: 43652 - DNA, 8 bp, Unknown
  misc_feature (1)..( 8): Matrix.001 file - promoters60/1021136
ttgttaaa

SEQ ID NO: 43653 - DNA, 7 bp, Unknown
  misc_feature (1)..( 7): Matrix.001 file - promoters60/1021136
taatatg

SEQ ID NO: 43654 - DNA, 8 bp, Unknown
  misc_feature (1)..( 8): Matrix.001 file - promoters60/1021136
aaagaaaa

SEQ ID NO: 43655 - DNA, 9 bp, Unknown
  misc_feature (1)..( 9): Matrix.001 file - promoters60/1021136
actgtattt

SEQ ID NO: 43656 - DNA, 9 bp, Unknown
  misc_feature (1)..( 9): Matrix.001 file - promoters60/1021136
ttaaaaata

SEQ ID NO: 43657 - DNA, 10 bp, Unknown
  misc_feature (1)..( 10): Matrix.001 file - promoters60/1021136
tatatattct

SEQ ID NO: 43658 - DNA, 8 bp, Unknown
  misc_feature (1)..( 8): Matrix.001 file - promoters60/1021136
aaaaacaa

SEQ ID NO: 43659 - DNA, 7 bp, Unknown
  misc_feature (1)..( 7): Matrix.001 file - promoters60/1021136
aatctaa

SEQ ID NO: 43660 - DNA, 11 bp, Unknown
  misc_feature (1)..( 11): Matrix.001 file - promoters60/1021136
aaatcaatgca

SEQ ID NO: 43661 - DNA, 6 bp, Unknown
  misc_feature (1)..( 6): Matrix.001 file - promoters60/1021136
taaatt

SEQ ID NO: 43662 - DNA, 6 bp, Unknown
  misc_feature (1)..( 6): Matrix.001 file - promoters60/1021136
aaagaa

SEQ ID NO: 43663 - DNA, 7 bp, Unknown
  misc_feature (1)..( 7): Matrix.001 file - promoters60/1021136
aatagaa

SEQ ID NO: 43664 - DNA, 8 bp, Unknown
  misc_feature (1)..( 8): Matrix.001 file - promoters60/1021136
atataaga

SEQ ID NO: 43665 - DNA, 6 bp, Unknown
  misc_feature (1)..( 6): Matrix.001 file - promoters60/1021136
aatctt

SEQ ID NO: 43666 - DNA, 7 bp, Unknown
  misc_feature (1)..( 7): Matrix.001 file - promoters60/1021136
attaatt

SEQ ID NO: 43667 - DNA, 6 bp, Unknown
  misc_feature (1)..( 6): Matrix.001 file - promoters60/1021136
aaaaat

SEQ ID NO: 43668 - DNA, 8 bp, Unknown
  misc_feature (1)..( 8): Matrix.001 file - promoters60/1021136
aaagtaaa

SEQ ID NO: 43669 - DNA, 7 bp, Unknown
  misc_feature (1)..( 7): Matrix.001 file - promoters60/1021136
atcatca

SEQ ID NO: 43670 - DNA, 10 bp, Unknown
  misc_feature (1)..( 10): Matrix.001 file - promoters60/1021148
ttattttacg

SEQ ID NO: 43671 - DNA, 10 bp, Unknown
  misc_feature (1)..( 10): Matrix.001 file - promoters60/1021148
cctaaaaaga

SEQ ID NO: 43672 - DNA, 8 bp, Unknown
  misc_feature (1)..( 8): Matrix.001 file - promoters60/1021218
gaaagaaa

SEQ ID NO: 43673 - DNA, 9 bp, Unknown
  misc_feature (1)..( 9): Matrix.001 file - promoters60/1021239
taccaaaaa

SEQ ID NO: 43674 - DNA, 9 bp, Unknown
  misc_feature (1)..( 9): Matrix.001 file - promoters60/1021239
aagaaaaat

SEQ ID NO: 43675 - DNA, 6 bp, Unknown
  misc_feature (1)..( 6): Matrix.001 file - promoters60/1021239
aaatgt

SEQ ID NO: 43676 - DNA, 7 bp, Unknown
  misc_feature (1)..( 7): Matrix.001 file - promoters60/1021239
tcagttt

SEQ ID NO: 43677 - DNA, 9 bp, Unknown
  misc_feature (1)..( 9): Matrix.001 file - promoters60/1021239
aaaaacaaa

SEQ ID NO: 43678 - DNA, 7 bp, Unknown
  misc_feature (1)..( 7): Matrix.001 file - promoters60/1021239
aaaataa

SEQ ID NO: 43679 - DNA, 7 bp, Unknown
  misc_feature (1)..( 7): Matrix.001 file - promoters60/1021239
gaaagtt

SEQ ID NO: 43680 - DNA, 8 bp, Unknown
  misc_feature (1)..( 8): Matrix.001 file - promoters60/1021239
agagccca

SEQ ID NO: 43681 - DNA, 7 bp, Unknown
  misc_feature (1)..( 7): Matrix.001 file - promoters60/1021239
cacttaa

SEQ ID NO: 43682 - DNA, 9 bp, Unknown
  misc_feature (1)..( 9): Matrix.001 file - promoters60/1021239
ttaaaagaa

SEQ ID NO: 43683 - DNA, 6 bp, Unknown
  misc_feature (1)..( 6): Matrix.001 file - promoters60/1021239
tttttc

SEQ ID NO: 43684 - DNA, 8 bp, Unknown
  misc_feature (1)..( 8): Matrix.001 file - promoters60/1021239
gcaaatgg

SEQ ID NO: 43685 - DNA, 6 bp, Unknown
  misc_feature (1)..( 6): Matrix.001 file - promoters60/1021239
agaaac

SEQ ID NO: 43686 - DNA, 8 bp, Unknown
  misc_feature (1)..( 8): Matrix.001 file - promoters60/1021239
ttacatca

SEQ ID NO: 43687 - DNA, 7 bp, Unknown
  misc_feature (1)..( 7): Matrix.001 file - promoters60/1021239
taaacaa

SEQ ID NO: 43688 - DNA, 7 bp, Unknown
  misc_feature (1)..( 7): Matrix.001 file - promoters60/1021239
tttgtta

SEQ ID NO: 43689 - DNA, 7 bp, Unknown
  misc_feature (1)..( 7): Matrix.001 file - promoters60/1021242
attggtt

SEQ ID NO: 43690 - DNA, 7 bp, Unknown
  misc_feature (1)..( 7): Matrix.001 file - promoters60/1021242
atcgtca

SEQ ID NO: 43691 - DNA, 8 bp, Unknown
  misc_feature (1)..( 8): Matrix.001 file - promoters60/1021242
gattgtcc

SEQ ID NO: 43692 - DNA, 7 bp, Unknown
  misc_feature (1)..( 7): Matrix.001 file - promoters60/1021242
ttaagaa

SEQ ID NO: 43693 - DNA, 6 bp, Unknown
  misc_feature (1)..( 6): Matrix.001 file - promoters60/1021242
tactgt

SEQ ID NO: 43694 - DNA, 6 bp, Unknown
  misc_feature (1)..( 6): Matrix.001 file - promoters60/1021242
cacaga

SEQ ID NO: 43695 - DNA, 7 bp, Unknown
  misc_feature (1)..( 7): Matrix.001 file - promoters60/1021242
taaaaaa

SEQ ID NO: 43696 - DNA, 7 bp, Unknown
  misc_feature (1)..( 7): Matrix.001 file - promoters60/1021242
attatac

SEQ ID NO: 43697 - DNA, 8 bp, Unknown
  misc_feature (1)..( 8): Matrix.001 file - promoters60/1021242
caaaattt

SEQ ID NO: 43698 - DNA, 7 bp, Unknown
  misc_feature (1)..( 7): Matrix.001 file - promoters60/1021242
caaagtc

SEQ ID NO: 43699 - DNA, 7 bp, Unknown
  misc_feature (1)..( 7): Matrix.001 file - promoters60/1021242
tataaaa

SEQ ID NO: 43700 - DNA, 7 bp, Unknown
  misc_feature (1)..( 7): Matrix.001 file - promoters60/1021242
gcccaaa

SEQ ID NO: 43701 - DNA, 6 bp, Unknown
  misc_feature (1)..( 6): Matrix.001 file - promoters60/1021246
ataata

SEQ ID NO: 43702 - DNA, 6 bp, Unknown
  misc_feature (1)..( 6): Matrix.001 file - promoters60/1021246
tttgac

SEQ ID NO: 43703 - DNA, 7 bp, Unknown
  misc_feature (1)..( 7): Matrix.001 file - promoters60/1021246
cgaatgg

SEQ ID NO: 43704 - DNA, 8 bp, Unknown
  misc_feature (1)..( 8): Matrix.001 file - promoters60/1021246
tgccattt

SEQ ID NO: 43705 - DNA, 6 bp, Unknown
  misc_feature (1)..( 6): Matrix.001 file - promoters60/1021246
cggctc

SEQ ID NO: 43706 - DNA, 11 bp, Unknown
  misc_feature (1)..( 11): Matrix.001 file - promoters60/1021246
ttagtttcata

SEQ ID NO: 43707 - DNA, 6 bp, Unknown
  misc_feature (1)..( 6): Matrix.001 file - promoters60/1021246
agtatg

SEQ ID NO: 43708 - DNA, 6 bp, Unknown
  misc_feature (1)..( 6): Matrix.001 file - promoters60/1021246
aaaaga

SEQ ID NO: 43709 - DNA, 6 bp, Unknown
  misc_feature (1)..( 6): Matrix.001 file - promoters60/1021246
agaaaa

SEQ ID NO: 43710 - DNA, 7 bp, Unknown
  misc_feature (1)..( 7): Matrix.001 file - promoters60/1021246
aaaaaag

SEQ ID NO: 43711 - DNA, 6 bp, Unknown
  misc_feature (1)..( 6): Matrix.001 file - promoters60/1021246
actcca

SEQ ID NO: 43712 - DNA, 8 bp, Unknown
  misc_feature (1)..( 8): Matrix.001 file - promoters60/1021246
aagagaag

SEQ ID NO: 43713 - DNA, 7 bp, Unknown
  misc_feature (1)..( 7): Matrix.001 file - promoters60/1021246
tatcatt

SEQ ID NO: 43714 - DNA, 7 bp, Unknown
  misc_feature (1)..( 7): Matrix.001 file - promoters60/1021246
gaatttg

SEQ ID NO: 43715 - DNA, 7 bp, Unknown
  misc_feature (1)..( 7): Matrix.001 file - promoters60/1021246
tttgatt

SEQ ID NO: 43716 - DNA, 7 bp, Unknown
  misc_feature (1)..( 7): Matrix.001 file - promoters60/1021246
ttagatc

SEQ ID NO: 43717 - DNA, 6 bp, Unknown
  misc_feature (1)..( 6): Matrix.001 file - promoters60/1021246
catttg

SEQ ID NO: 43718 - DNA, 6 bp, Unknown
  misc_feature (1)..( 6): Matrix.001 file - promoters60/1021323
taacaa

SEQ ID NO: 43719 - DNA, 6 bp, Unknown
  misc_feature (1)..( 6): Matrix.001 file - promoters60/1021323
tttatt

SEQ ID NO: 43720 - DNA, 7 bp, Unknown
  misc_feature (1)..( 7): Matrix.001 file - promoters60/1021323
attgttt

SEQ ID NO: 43721 - DNA, 9 bp, Unknown
  misc_feature (1)..( 9): Matrix.001 file - promoters60/1021323
tttctaaaa

SEQ ID NO: 43722 - DNA, 6 bp, Unknown
  misc_feature (1)..( 6): Matrix.001 file - promoters60/1021323
tgttgc

SEQ ID NO: 43723 - DNA, 6 bp, Unknown
  misc_feature (1)..( 6): Matrix.001 file - promoters60/1021323
gttaat

SEQ ID NO: 43724 - DNA, 6 bp, Unknown
  misc_feature (1)..( 6): Matrix.001 file - promoters60/1021323
atattt

SEQ ID NO: 43725 - DNA, 8 bp, Unknown
  misc_feature (1)..( 8): Matrix.001 file - promoters60/1021323
atttggtt

SEQ ID NO: 43726 - DNA, 7 bp, Unknown
  misc_feature (1)..( 7): Matrix.001 file - promoters60/1021323
aatcatg

SEQ ID NO: 43727 - DNA, 9 bp, Unknown
  misc_feature (1)..( 9): Matrix.001 file - promoters60/1021323
gaaacctaa

SEQ ID NO: 43728 - DNA, 6 bp, Unknown
  misc_feature (1)..( 6): Matrix.001 file - promoters60/1021323
taaaca

SEQ ID NO: 43729 - DNA, 6 bp, Unknown
  misc_feature (1)..( 6): Matrix.001 file - promoters60/1021323
aagagt

SEQ ID NO: 43730 - DNA, 8 bp, Unknown
  misc_feature (1)..( 8): Matrix.001 file - promoters60/1021323
acacaaag

SEQ ID NO: 43731 - DNA, 7 bp, Unknown
  misc_feature (1)..( 7): Matrix.001 file - promoters60/1021323
agtcttc

SEQ ID NO: 43732 - DNA, 6 bp, Unknown
  misc_feature (1)..( 6): Matrix.001 file - promoters60/1021323
aaaata

SEQ ID NO: 43733 - DNA, 6 bp, Unknown
  misc_feature (1)..( 6): Matrix.001 file - promoters60/1021323
accgtt

SEQ ID NO: 43734 - DNA, 6 bp, Unknown
  misc_feature (1)..( 6): Matrix.001 file - promoters60/1021323
gaatca

SEQ ID NO: 43735 - DNA, 7 bp, Unknown
  misc_feature (1)..( 7): Matrix.001 file - promoters60/1021323
tccagtt

SEQ ID NO: 43736 - DNA, 6 bp, Unknown
  misc_feature (1)..( 6): Matrix.001 file - promoters60/1021323
tttccg

SEQ ID NO: 43737 - DNA, 6 bp, Unknown
  misc_feature (1)..( 6): Matrix.001 file - promoters60/1021323
ataaat

SEQ ID NO: 43738 - DNA, 6 bp, Unknown
  misc_feature (1)..( 6): Matrix.001 file - promoters60/1021323
aaccct

SEQ ID NO: 43739 - DNA, 6 bp, Unknown
  misc_feature (1)..( 6): Matrix.001 file - promoters60/1021326
caaaat

SEQ ID NO: 43740 - DNA, 7 bp, Unknown
  misc_feature (1)..( 7): Matrix.001 file - promoters60/1021326
agaattc

SEQ ID NO: 43741 - DNA, 6 bp, Unknown
  misc_feature (1)..( 6): Matrix.001 file - promoters60/1021326
gtaatc

SEQ ID NO: 43742 - DNA, 6 bp, Unknown
  misc_feature (1)..( 6): Matrix.001 file - promoters60/1021326
acaaaa

SEQ ID NO: 43743 - DNA, 7 bp, Unknown
  misc_feature (1)..( 7): Matrix.001 file - promoters60/1021326
actaaat

SEQ ID NO: 43744 - DNA, 7 bp, Unknown
  misc_feature (1)..( 7): Matrix.001 file - promoters60/1021326
ggtagtt

SEQ ID NO: 43745 - DNA, 7 bp, Unknown
  misc_feature (1)..( 7): Matrix.001 file - promoters60/1021326
gttaatt

SEQ ID NO: 43746 - DNA, 6 bp, Unknown
  misc_feature (1)..( 6): Matrix.001 file - promoters60/1021326
tattta

SEQ ID NO: 43747 - DNA, 10 bp, Unknown
  misc_feature (1)..( 10): Matrix.001 file - promoters60/1021419
attttatata

SEQ ID NO: 43748 - DNA, 11 bp, Unknown
  misc_feature (1)..( 11): Matrix.001 file - promoters60/1021419
atctatgtgat

SEQ ID NO: 43749 - DNA, 9 bp, Unknown
  misc_feature (1)..( 9): Matrix.001 file - promoters60/1021419
ggtaaatca

SEQ ID NO: 43750 - DNA, 11 bp, Unknown
  misc_feature (1)..( 11): Matrix.001 file - promoters60/1021445
atcaaaaaagt

SEQ ID NO: 43751 - DNA, 13 bp, Unknown
  misc_feature (1)..( 13): Matrix.001 file - promoters60/1021445
agtattaaagttt

SEQ ID NO: 43752 - DNA, 13 bp, Unknown
  misc_feature (1)..( 13): Matrix.001 file - promoters60/1021445
ctaataaaacaaa

SEQ ID NO: 43753 - DNA, 8 bp, Unknown
  misc_feature (1)..( 8): Matrix.001 file - promoters60/1021445
tgggccta

SEQ ID NO: 43754 - DNA, 9 bp, Unknown
  misc_feature (1)..( 9): Matrix.001 file - promoters60/1021445
tataaaaac

SEQ ID NO: 43755 - DNA, 12 bp, Unknown
  misc_feature (1)..( 12): Matrix.001 file - promoters60/1021549
gtatatatataa

SEQ ID NO: 43756 - DNA, 10 bp, Unknown
  misc_feature (1)..( 10): Matrix.001 file - promoters60/1021549
aaatcttttg

SEQ ID NO: 43757 - DNA, 7 bp, Unknown
  misc_feature (1)..( 7): Matrix.001 file - promoters60/1021563
ctggata

SEQ ID NO: 43758 - DNA, 9 bp, Unknown
  misc_feature (1)..( 9): Matrix.001 file - promoters60/1021563
catcgtctg

SEQ ID NO: 43759 - DNA, 9 bp, Unknown
  misc_feature (1)..( 9): Matrix.001 file - promoters60/1021563
gtttagcta

SEQ ID NO: 43760 - DNA, 10 bp, Unknown
  misc_feature (1)..( 10): Matrix.001 file - promoters60/1021563
agcggcggag

SEQ ID NO: 43761 - DNA, 11 bp, Unknown
  misc_feature (1)..( 11): Matrix.001 file - promoters60/1021655
ctacgaaaatg

SEQ ID NO: 43762 - DNA, 7 bp, Unknown
  misc_feature (1)..( 7): Matrix.001 file - promoters60/1021764
aaaaaat

SEQ ID NO: 43763 - DNA, 7 bp, Unknown
  misc_feature (1)..( 7): Matrix.001 file - promoters60/1021764
atacaaa

SEQ ID NO: 43764 - DNA, 7 bp, Unknown
  misc_feature (1)..( 7): Matrix.001 file - promoters60/1021764
aaatttt

SEQ ID NO: 43765 - DNA, 6 bp, Unknown
  misc_feature (1)..( 6): Matrix.001 file - promoters60/1021764
ttttat

SEQ ID NO: 43766 - DNA, 8 bp, Unknown
  misc_feature (1)..( 8): Matrix.001 file - promoters60/1021764
ataacatt

SEQ ID NO: 43767 - DNA, 6 bp, Unknown
  misc_feature (1)..( 6): Matrix.001 file - promoters60/1021764
ttaatt

SEQ ID NO: 43768 - DNA, 8 bp, Unknown
  misc_feature (1)..( 8): Matrix.001 file - promoters60/1021764
atatcaaa

SEQ ID NO: 43769 - DNA, 6 bp, Unknown
  misc_feature (1)..( 6): Matrix.001 file - promoters60/1021764
tttgaa

SEQ ID NO: 43770 - DNA, 8 bp, Unknown
  misc_feature (1)..( 8): Matrix.001 file - promoters60/1021764
aacattca

SEQ ID NO: 43771 - DNA, 6 bp, Unknown
  misc_feature (1)..( 6): Matrix.001 file - promoters60/1021764
ctctat

SEQ ID NO: 43772 - DNA, 8 bp, Unknown
  misc_feature (1)..( 8): Matrix.001 file - promoters60/1021764
atttagta

SEQ ID NO: 43773 - DNA, 7 bp, Unknown
  misc_feature (1)..( 7): Matrix.001 file - promoters60/1021764
taaatat

SEQ ID NO: 43774 - DNA, 7 bp, Unknown
  misc_feature (1)..( 7): Matrix.001 file - promoters60/1021764
gtttctt

SEQ ID NO: 43775 - DNA, 8 bp, Unknown
  misc_feature (1)..( 8): Matrix.001 file - promoters60/1021764
caaacaca

SEQ ID NO: 43776 - DNA, 6 bp, Unknown
  misc_feature (1)..( 6): Matrix.001 file - promoters60/1021764
tatttt

SEQ ID NO: 43777 - DNA, 11 bp, Unknown
  misc_feature (1)..( 11): Matrix.001 file - promoters60/1021764
ttttgtatttt

SEQ ID NO: 43778 - DNA, 6 bp, Unknown
  misc_feature (1)..( 6): Matrix.001 file - promoters60/1021764
ttattt

SEQ ID NO: 43779 - DNA, 8 bp, Unknown
  misc_feature (1)..( 8): Matrix.001 file - promoters60/1021764
ctacaaac

SEQ ID NO: 43780 - DNA, 6 bp, Unknown
  misc_feature (1)..( 6): Matrix.001 file - promoters60/1021764
ctaaaa

SEQ ID NO: 43781 - DNA, 10 bp, Unknown
  misc_feature (1)..( 10): Matrix.001 file - promoters60/1021764
aaaatattac

SEQ ID NO: 43782 - DNA, 6 bp, Unknown
  misc_feature (1)..( 6): Matrix.001 file - promoters60/1021764
caataa

SEQ ID NO: 43783 - DNA, 7 bp, Unknown
  misc_feature (1)..( 7): Matrix.001 file - promoters60/1021764
ctattta

SEQ ID NO: 43784 - DNA, 7 bp, Unknown
  misc_feature (1)..( 7): Matrix.001 file - promoters60/1021764
aaagata

SEQ ID NO: 43785 - DNA, 7 bp, Unknown
  misc_feature (1)..( 7): Matrix.001 file - promoters60/1021764
ttaatag

SEQ ID NO: 43786 - DNA, 7 bp, Unknown
  misc_feature (1)..( 7): Matrix.001 file - promoters60/1021764
ttagttt

SEQ ID NO: 43787 - DNA, 7 bp, Unknown
  misc_feature (1)..( 7): Matrix.001 file - promoters60/1021764
agagtct

SEQ ID NO: 43788 - DNA, 6 bp, Unknown
  misc_feature (1)..( 6): Matrix.001 file - promoters60/1021764
acaaat

SEQ ID NO: 43789 - DNA, 7 bp, Unknown
  misc_feature (1)..( 7): Matrix.001 file - promoters60/1021764
cttcttt

SEQ ID NO: 43790 - DNA, 7 bp, Unknown
  misc_feature (1)..( 7): Matrix.001 file - promoters60/1021833
taaatta

SEQ ID NO: 43791 - DNA, 7 bp, Unknown
  misc_feature (1)..( 7): Matrix.001 file - promoters60/1021833
atttttt

SEQ ID NO: 43792 - DNA, 9 bp, Unknown
  misc_feature (1)..( 9): Matrix.001 file - promoters60/1021833
aaaaaaatt

SEQ ID NO: 43793 - DNA, 9 bp, Unknown
  misc_feature (1)..( 9): Matrix.001 file - promoters60/1021833
ttatatatt

SEQ ID NO: 43794 - DNA, 8 bp, Unknown
  misc_feature (1)..( 8): Matrix.001 file - promoters60/1021833
aattttta

SEQ ID NO: 43795 - DNA, 10 bp, Unknown
  misc_feature (1)..( 10): Matrix.001 file - promoters60/1021833
tttttacttt

SEQ ID NO: 43796 - DNA, 12 bp, Unknown
  misc_feature (1)..( 12): Matrix.001 file - promoters60/1021862
ataaaattttaa

SEQ ID NO: 43797 - DNA, 10 bp, Unknown
  misc_feature (1)..( 10): Matrix.001 file - promoters60/1021862
ttttaattta

SEQ ID NO: 43798 - DNA, 14 bp, Unknown
  misc_feature (1)..( 14): Matrix.001 file - promoters60/1021862
aaaaaaaaaaaaaa

SEQ ID NO: 43799 - DNA, 9 bp, Unknown
  misc_feature (1)..( 9): Matrix.001 file - promoters60/1021870
aaaatctgg

SEQ ID NO: 43800 - DNA, 12 bp, Unknown
  misc_feature (1)..( 12): Matrix.001 file - promoters60/1021870
attaccaaaatt

SEQ ID NO: 43801 - DNA, 11 bp, Unknown
  misc_feature (1)..( 11): Matrix.001 file - promoters60/1021987
ttttgctaaaa

SEQ ID NO: 43802 - DNA, 9 bp, Unknown
  misc_feature (1)..( 9): Matrix.001 file - promoters60/1021987
atttgattt

SEQ ID NO: 43803 - DNA, 7 bp, Unknown
  misc_feature (1)..( 7): Matrix.001 file - promoters60/1021987
tattata

SEQ ID NO: 43804 - DNA, 8 bp, Unknown
  misc_feature (1)..( 8): Matrix.001 file - promoters60/1021987
caaacctg

SEQ ID NO: 43805 - DNA, 8 bp, Unknown
  misc_feature (1)..( 8): Matrix.001 file - promoters60/1021987
agatacag

SEQ ID NO: 43806 - DNA, 9 bp, Unknown
  misc_feature (1)..( 9): Matrix.001 file - promoters60/1021987
tttcaagtt

SEQ ID NO: 43807 - DNA, 8 bp, Unknown
  misc_feature (1)..( 8): Matrix.001 file - promoters60/1022111
gcggcaac

SEQ ID NO: 43808 - DNA, 7 bp, Unknown
  misc_feature (1)..( 7): Matrix.001 file - promoters60/1022111
tacattt

SEQ ID NO: 43809 - DNA, 9 bp, Unknown
  misc_feature (1)..( 9): Matrix.001 file - promoters60/1022111
ttattctaa

SEQ ID NO: 43810 - DNA, 8 bp, Unknown
  misc_feature (1)..( 8): Matrix.001 file - promoters60/1022111
caaagtat

SEQ ID NO: 43811 - DNA, 8 bp, Unknown
  misc_feature (1)..( 8): Matrix.001 file - promoters60/1022111
ttatttaa

SEQ ID NO: 43812 - DNA, 7 bp, Unknown
  misc_feature (1)..( 7): Matrix.001 file - promoters60/1022111
agaaatt

SEQ ID NO: 43813 - DNA, 7 bp, Unknown
  misc_feature (1)..( 7): Matrix.001 file - promoters60/1022111
tctaaaa

SEQ ID NO: 43814 - DNA, 6 bp, Unknown
  misc_feature (1)..( 6): Matrix.001 file - promoters60/1022111
ttagta

SEQ ID NO: 43815 - DNA, 9 bp, Unknown
  misc_feature (1)..( 9): Matrix.001 file - promoters60/1022111
atcatatat

SEQ ID NO: 43816 - DNA, 8 bp, Unknown
  misc_feature (1)..( 8): Matrix.001 file - promoters60/1022111
ttaataat

SEQ ID NO: 43817 - DNA, 8 bp, Unknown
  misc_feature (1)..( 8): Matrix.001 file - promoters60/1022111
taacatat

SEQ ID NO: 43818 - DNA, 7 bp, Unknown
  misc_feature (1)..( 7): Matrix.001 file - promoters60/1022111
aataaac

SEQ ID NO: 43819 - DNA, 6 bp, Unknown
  misc_feature (1)..( 6): Matrix.001 file - promoters60/1022111
tatgca

SEQ ID NO: 43820 - DNA, 13 bp, Unknown
  misc_feature (1)..( 13): Matrix.001 file - promoters60/1022131
tatttaaaagaga

SEQ ID NO: 43821 - DNA, 12 bp, Unknown
  misc_feature (1)..( 12): Matrix.001 file - promoters60/1022131
taatattttatt

SEQ ID NO: 43822 - DNA, 9 bp, Unknown
  misc_feature (1)..( 9): Matrix.001 file - promoters60/1022135
ctcttactg

SEQ ID NO: 43823 - DNA, 8 bp, Unknown
  misc_feature (1)..( 8): Matrix.001 file - promoters60/1022135
agagtttc

SEQ ID NO: 43824 - DNA, 7 bp, Unknown
  misc_feature (1)..( 7): Matrix.001 file - promoters60/1022170
tgggcct

SEQ ID NO: 43825 - DNA, 11 bp, Unknown
  misc_feature (1)..( 11): Matrix.001 file - promoters60/1022170
ctagagaaaaa

SEQ ID NO: 43826 - DNA, 8 bp, Unknown
  misc_feature (1)..( 8): Matrix.001 file - promoters60/1022170
gagaaaaa

SEQ ID NO: 43827 - DNA, 8 bp, Unknown
  misc_feature (1)..( 8): Matrix.001 file - promoters60/1022192
aaacgcat

SEQ ID NO: 43828 - DNA, 7 bp, Unknown
  misc_feature (1)..( 7): Matrix.001 file - promoters60/1022192
aaaattg

SEQ ID NO: 43829 - DNA, 7 bp, Unknown
  misc_feature (1)..( 7): Matrix.001 file - promoters60/1022192
aaaacta

SEQ ID NO: 43830 - DNA, 7 bp, Unknown
  misc_feature (1)..( 7): Matrix.001 file - promoters60/1022192
ttgttta

SEQ ID NO: 43831 - DNA, 6 bp, Unknown
  misc_feature (1)..( 6): Matrix.001 file - promoters60/1022192
aaacta

SEQ ID NO: 43832 - DNA, 6 bp, Unknown
  misc_feature (1)..( 6): Matrix.001 file - promoters60/1022192
taaaaa

SEQ ID NO: 43833 - DNA, 7 bp, Unknown
  misc_feature (1)..( 7): Matrix.001 file - promoters60/1022192
tcaaagt

SEQ ID NO: 43834 - DNA, 8 bp, Unknown
  misc_feature (1)..( 8): Matrix.001 file - promoters60/1022192
aaaatgtc

SEQ ID NO: 43835 - DNA, 8 bp, Unknown
  misc_feature (1)..( 8): Matrix.001 file - promoters60/1022192
tttgcttc

SEQ ID NO: 43836 - DNA, 6 bp, Unknown
  misc_feature (1)..( 6): Matrix.001 file - promoters60/1022192
tattta

SEQ ID NO: 43837 - DNA, 6 bp, Unknown
  misc_feature (1)..( 6): Matrix.001 file - promoters60/1022192
aattta

SEQ ID NO: 43838 - DNA, 6 bp, Unknown
  misc_feature (1)..( 6): Matrix.001 file - promoters60/1022192
aactta

SEQ ID NO: 43839 - DNA, 9 bp, Unknown
  misc_feature (1)..( 9): Matrix.001 file - promoters60/1022192
cttttgaaa

SEQ ID NO: 43840 - DNA, 6 bp, Unknown
  misc_feature (1)..( 6): Matrix.001 file - promoters60/1022192
tatatt

SEQ ID NO: 43841 - DNA, 10 bp, Unknown
  misc_feature (1)..( 10): Matrix.001 file - promoters60/1022192
ttctaatcaa

SEQ ID NO: 43842 - DNA, 8 bp, Unknown
  misc_feature (1)..( 8): Matrix.001 file - promoters60/1022192
ctaaaaag

SEQ ID NO: 43843 - DNA, 7 bp, Unknown
  misc_feature (1)..( 7): Matrix.001 file - promoters60/1022245
aaaatca

SEQ ID NO: 43844 - DNA, 7 bp, Unknown
  misc_feature (1)..( 7): Matrix.001 file - promoters60/1022252
ggcactt

SEQ ID NO: 43845 - DNA, 8 bp, Unknown
  misc_feature (1)..( 8): Matrix.001 file - promoters60/1022252
ttatcttt

SEQ ID NO: 43846 - DNA, 7 bp, Unknown
  misc_feature (1)..( 7): Matrix.001 file - promoters60/1022252
tttgaag

SEQ ID NO: 43847 - DNA, 8 bp, Unknown
  misc_feature (1)..( 8): Matrix.001 file - promoters60/1022252
taaaaatt

SEQ ID NO: 43848 - DNA, 6 bp, Unknown
  misc_feature (1)..( 6): Matrix.001 file - promoters60/1022252
tacaaa

SEQ ID NO: 43849 - DNA, 6 bp, Unknown
  misc_feature (1)..( 6): Matrix.001 file - promoters60/1022252
agaaaa

SEQ ID NO: 43850 - DNA, 6 bp, Unknown
  misc_feature (1)..( 6): Matrix.001 file - promoters60/1022252
aaagta

SEQ ID NO: 43851 - DNA, 8 bp, Unknown
  misc_feature (1)..( 8): Matrix.001 file - promoters60/1022252
aaaaaaat

SEQ ID NO: 43852 - DNA, 7 bp, Unknown
  misc_feature (1)..( 7): Matrix.001 file - promoters60/1022252
aaaatta

SEQ ID NO: 43853 - DNA, 10 bp, Unknown
  misc_feature (1)..( 10): Matrix.001 file - promoters60/1022252
taaatctatt

SEQ ID NO: 43854 - DNA, 7 bp, Unknown
  misc_feature (1)..( 7): Matrix.001 file - promoters60/1022252
ataaaag

SEQ ID NO: 43855 - DNA, 6 bp, Unknown
  misc_feature (1)..( 6): Matrix.001 file - promoters60/1022252
aaaaag

SEQ ID NO: 43856 - DNA, 7 bp, Unknown
  misc_feature (1)..( 7): Matrix.001 file - promoters60/1022252
aattatt

SEQ ID NO: 43857 - DNA, 6 bp, Unknown
  misc_feature (1)..( 6): Matrix.001 file - promoters60/1022252
atggaa

SEQ ID NO: 43858 - DNA, 6 bp, Unknown
  misc_feature (1)..( 6): Matrix.001 file - promoters60/1022252
ttattt

SEQ ID NO: 43859 - DNA, 6 bp, Unknown
  misc_feature (1)..( 6): Matrix.001 file - promoters60/1022252
cacaat

SEQ ID NO: 43860 - DNA, 7 bp, Unknown
  misc_feature (1)..( 7): Matrix.001 file - promoters60/1022252
aatcaca

SEQ ID NO: 43861 - DNA, 6 bp, Unknown
  misc_feature (1)..( 6): Matrix.001 file - promoters60/1022252
ttttaa

SEQ ID NO: 43862 - DNA, 7 bp, Unknown
  misc_feature (1)..( 7): Matrix.001 file - promoters60/1022252
aagattt

SEQ ID NO: 43863 - DNA, 8 bp, Unknown
  misc_feature (1)..( 8): Matrix.001 file - promoters60/1022252
aacatttt

SEQ ID NO: 43864 - DNA, 11 bp, Unknown
  misc_feature (1)..( 11): Matrix.001 file - promoters60/1022252
atataaacaaa

SEQ ID NO: 43865 - DNA, 7 bp, Unknown
  misc_feature (1)..( 7): Matrix.001 file - promoters60/1022252
ccaaaaa

SEQ ID NO: 43866 - DNA, 7 bp, Unknown
  misc_feature (1)..( 7): Matrix.001 file - promoters60/1022256
aaaagaa

SEQ ID NO: 43867 - DNA, 11 bp, Unknown
  misc_feature (1)..( 11): Matrix.001 file - promoters60/1022256
aaatattaaat

SEQ ID NO: 43868 - DNA, 10 bp, Unknown
  misc_feature (1)..( 10): Matrix.001 file - promoters60/1022256
agataatgag

SEQ ID NO: 43869 - DNA, 8 bp, Unknown
  misc_feature (1)..( 8): Matrix.001 file - promoters60/1022256
ttttatca

SEQ ID NO: 43870 - DNA, 9 bp, Unknown
  misc_feature (1)..( 9): Matrix.001 file - promoters60/1022256
tatataaat

SEQ ID NO: 43871 - DNA, 7 bp, Unknown
  misc_feature (1)..( 7): Matrix.001 file - promoters60/1022256
aaaacta

SEQ ID NO: 43872 - DNA, 6 bp, Unknown
  misc_feature (1)..( 6): Matrix.001 file - promoters60/1022268
aaacca

SEQ ID NO: 43873 - DNA, 6 bp, Unknown
  misc_feature (1)..( 6): Matrix.001 file - promoters60/1022268
aagatt

SEQ ID NO: 43874 - DNA, 9 bp, Unknown
  misc_feature (1)..( 9): Matrix.001 file - promoters60/1022268
ctccgccga

SEQ ID NO: 43875 - DNA, 6 bp, Unknown
  misc_feature (1)..( 6): Matrix.001 file - promoters60/1022268
tcacca

SEQ ID NO: 43876 - DNA, 6 bp, Unknown
  misc_feature (1)..( 6): Matrix.001 file - promoters60/1022268
aaaccg

SEQ ID NO: 43877 - DNA, 9 bp, Unknown
  misc_feature (1)..( 9): Matrix.001 file - promoters60/1022268
ctaaaccgg

SEQ ID NO: 43878 - DNA, 8 bp, Unknown
  misc_feature (1)..( 8): Matrix.001 file - promoters60/1022268
atcactgg

SEQ ID NO: 43879 - DNA, 6 bp, Unknown
  misc_feature (1)..( 6): Matrix.001 file - promoters60/1022268
tctaca

SEQ ID NO: 43880 - DNA, 6 bp, Unknown
  misc_feature (1)..( 6): Matrix.001 file - promoters60/1022268
tctccg

SEQ ID NO: 43881 - DNA, 7 bp, Unknown
  misc_feature (1)..( 7): Matrix.001 file - promoters60/1022268
gatacca

SEQ ID NO: 43882 - DNA, 7 bp, Unknown
  misc_feature (1)..( 7): Matrix.001 file - promoters60/1022292
aaaaatt

SEQ ID NO: 43883 - DNA, 12 bp, Unknown
  misc_feature (1)..( 12): Matrix.001 file - promoters60/1022292
tttaaaaactac

SEQ ID NO: 43884 - DNA, 9 bp, Unknown
  misc_feature (1)..( 9): Matrix.001 file - promoters60/1022296
cagaaggaa

SEQ ID NO: 43885 - DNA, 11 bp, Unknown
  misc_feature (1)..( 11): Matrix.001 file - promoters60/1022324
caattctcaaa

SEQ ID NO: 43886 - DNA, 6 bp, Unknown
  misc_feature (1)..( 6): Matrix.001 file - promoters60/1022383
attgcc

SEQ ID NO: 43887 - DNA, 6 bp, Unknown
  misc_feature (1)..( 6): Matrix.001 file - promoters60/1022383
tttcaa

SEQ ID NO: 43888 - DNA, 6 bp, Unknown
  misc_feature (1)..( 6): Matrix.001 file - promoters60/1022383
ctcatt

SEQ ID NO: 43889 - DNA, 7 bp, Unknown
  misc_feature (1)..( 7): Matrix.001 file - promoters60/1022383
ctcctcc

SEQ ID NO: 43890 - DNA, 6 bp, Unknown
  misc_feature (1)..( 6): Matrix.001 file - promoters60/1022383
taagtt

SEQ ID NO: 43891 - DNA, 9 bp, Unknown
  misc_feature (1)..( 9): Matrix.001 file - promoters60/1022383
caaaatgaa

SEQ ID NO: 43892 - DNA, 6 bp, Unknown
  misc_feature (1)..( 6): Matrix.001 file - promoters60/1022383
tatcca

SEQ ID NO: 43893 - DNA, 7 bp, Unknown
  misc_feature (1)..( 7): Matrix.001 file - promoters60/1022383
cttgatt

SEQ ID NO: 43894 - DNA, 7 bp, Unknown
  misc_feature (1)..( 7): Matrix.001 file - promoters60/1022383
caccaca

SEQ ID NO: 43895 - DNA, 7 bp, Unknown
  misc_feature (1)..( 7): Matrix.001 file - promoters60/1022383
agatctc

SEQ ID NO: 43896 - DNA, 6 bp, Unknown
  misc_feature (1)..( 6): Matrix.001 file - promoters60/1022383
aattaa

SEQ ID NO: 43897 - DNA, 6 bp, Unknown
  misc_feature (1)..( 6): Matrix.001 file - promoters60/1022383
tactaa

SEQ ID NO: 43898 - DNA, 6 bp, Unknown
  misc_feature (1)..( 6): Matrix.001 file - promoters60/1022383
aaaata

SEQ ID NO: 43899 - DNA, 8 bp, Unknown
  misc_feature (1)..( 8): Matrix.001 file - promoters60/1022383
ttaaattt

SEQ ID NO: 43900 - DNA, 8 bp, Unknown
  misc_feature (1)..( 8): Matrix.001 file - promoters60/1022383
ttcaaaaa

SEQ ID NO: 43901 - DNA, 9 bp, Unknown
  misc_feature (1)..( 9): Matrix.001 file - promoters60/1022401
gtatataaa

SEQ ID NO: 43902 - DNA, 8 bp, Unknown
  misc_feature (1)..( 8): Matrix.001 file - promoters60/1022401
tcataaag

SEQ ID NO: 43903 - DNA, 8 bp, Unknown
  misc_feature (1)..( 8): Matrix.001 file - promoters60/1022401
atttcttt

SEQ ID NO: 43904 - DNA, 17 bp, Unknown
  misc_feature (1)..( 17): Matrix.001 file - promoters60/1022401
taaagcccatttttaag

SEQ ID NO: 43905 - DNA, 7 bp, Unknown
  misc_feature (1)..( 7): Matrix.001 file - promoters60/1022474
gcacagc

SEQ ID NO: 43906 - DNA, 8 bp, Unknown
  misc_feature (1)..( 8): Matrix.001 file - promoters60/1022474
aaatcggg

SEQ ID NO: 43907 - DNA, 7 bp, Unknown
  misc_feature (1)..( 7): Matrix.001 file - promoters60/1022474
ttaaagt

SEQ ID NO: 43908 - DNA, 9 bp, Unknown
  misc_feature (1)..( 9): Matrix.001 file - promoters60/1022474
atggctgaa

SEQ ID NO: 43909 - DNA, 7 bp, Unknown
  misc_feature (1)..( 7): Matrix.001 file - promoters60/1022474
aagaaaa

SEQ ID NO: 43910 - DNA, 6 bp, Unknown
  misc_feature (1)..( 6): Matrix.001 file - promoters60/1022546
actgtt

SEQ ID NO: 43911 - DNA, 8 bp, Unknown
  misc_feature (1)..( 8): Matrix.001 file - promoters60/1022546
aagatttt

SEQ ID NO: 43912 - DNA, 6 bp, Unknown
  misc_feature (1)..( 6): Matrix.001 file - promoters60/1022546
gtttag

SEQ ID NO: 43913 - DNA, 6 bp, Unknown
  misc_feature (1)..( 6): Matrix.001 file - promoters60/1022546
ttattt

SEQ ID NO: 43914 - DNA, 6 bp, Unknown
  misc_feature (1)..( 6): Matrix.001 file - promoters60/1022546
tttgac

SEQ ID NO: 43915 - DNA, 8 bp, Unknown
  misc_feature (1)..( 8): Matrix.001 file - promoters60/1022546
caaccaat

SEQ ID NO: 43916 - DNA, 7 bp, Unknown
  misc_feature (1)..( 7): Matrix.001 file - promoters60/1022546
aatttca

SEQ ID NO: 43917 - DNA, 7 bp, Unknown
  misc_feature (1)..( 7): Matrix.001 file - promoters60/1022546
atctcaa

SEQ ID NO: 43918 - DNA, 6 bp, Unknown
  misc_feature (1)..( 6): Matrix.001 file - promoters60/1022546
ctttat

SEQ ID NO: 43919 - DNA, 7 bp, Unknown
  misc_feature (1)..( 7): Matrix.001 file - promoters60/1022546
ttcacac

SEQ ID NO: 43920 - DNA, 7 bp, Unknown
  misc_feature (1)..( 7): Matrix.001 file - promoters60/1022546
tttccgt

SEQ ID NO: 43921 - DNA, 7 bp, Unknown
  misc_feature (1)..( 7): Matrix.001 file - promoters60/1022546
accaaaa

SEQ ID NO: 43922 - DNA, 9 bp, Unknown
  misc_feature (1)..( 9): Matrix.001 file - promoters60/1022546
atttcacat

SEQ ID NO: 43923 - DNA, 6 bp, Unknown
  misc_feature (1)..( 6): Matrix.001 file - promoters60/1022546
aaccac

SEQ ID NO: 43924 - DNA, 6 bp, Unknown
  misc_feature (1)..( 6): Matrix.001 file - promoters60/1022546
aggctt

SEQ ID NO: 43925 - DNA, 6 bp, Unknown
  misc_feature (1)..( 6): Matrix.001 file - promoters60/1022546
caaaaa

SEQ ID NO: 43926 - DNA, 7 bp, Unknown
  misc_feature (1)..( 7): Matrix.001 file - promoters60/1022546
taaaata

SEQ ID NO: 43927 - DNA, 6 bp, Unknown
  misc_feature (1)..( 6): Matrix.001 file - promoters60/1022546
aaaaaa

SEQ ID NO: 43928 - DNA, 6 bp, Unknown
  misc_feature (1)..( 6): Matrix.001 file - promoters60/1022546
ctctct

SEQ ID NO: 43929 - DNA, 7 bp, Unknown
  misc_feature (1)..( 7): Matrix.001 file - promoters60/1022546
tctattt

SEQ ID NO: 43930 - DNA, 6 bp, Unknown
  misc_feature (1)..( 6): Matrix.001 file - promoters60/1022546
tttaca

SEQ ID NO: 43931 - DNA, 6 bp, Unknown
  misc_feature (1)..( 6): Matrix.001 file - promoters60/1022546
caaact

SEQ ID NO: 43932 - DNA, 6 bp, Unknown
  misc_feature (1)..( 6): Matrix.001 file - promoters60/1022546
ttcaaa

SEQ ID NO: 43933 - DNA, 6 bp, Unknown
  misc_feature (1)..( 6): Matrix.001 file - promoters60/1022586
tttttg

SEQ ID NO: 43934 - DNA, 8 bp, Unknown
  misc_feature (1)..( 8): Matrix.001 file - promoters60/1022586
tttatctt

SEQ ID NO: 43935 - DNA, 6 bp, Unknown
  misc_feature (1)..( 6): Matrix.001 file - promoters60/1022586
ttttat

SEQ ID NO: 43936 - DNA, 6 bp, Unknown
  misc_feature (1)..( 6): Matrix.001 file - promoters60/1022586
atttta

SEQ ID NO: 43937 - DNA, 6 bp, Unknown
  misc_feature (1)..( 6): Matrix.001 file - promoters60/1022586
aaattc

SEQ ID NO: 43938 - DNA, 6 bp, Unknown
  misc_feature (1)..( 6): Matrix.001 file - promoters60/1022586
agagag

SEQ ID NO: 43939 - DNA, 7 bp, Unknown
  misc_feature (1)..( 7): Matrix.001 file - promoters60/1022586
acaattc

SEQ ID NO: 43940 - DNA, 9 bp, Unknown
  misc_feature (1)..( 9): Matrix.001 file - promoters60/1022586
ttgaataat

SEQ ID NO: 43941 - DNA, 8 bp, Unknown
  misc_feature (1)..( 8): Matrix.001 file - promoters60/1022586
aaaaatat

SEQ ID NO: 43942 - DNA, 8 bp, Unknown
  misc_feature (1)..( 8): Matrix.001 file - promoters60/1022586
acgactct

SEQ ID NO: 43943 - DNA, 6 bp, Unknown
  misc_feature (1)..( 6): Matrix.001 file - promoters60/1022586
tataaa

SEQ ID NO: 43944 - DNA, 7 bp, Unknown
  misc_feature (1)..( 7): Matrix.001 file - promoters60/1022586
tttctct

SEQ ID NO: 43945 - DNA, 6 bp, Unknown
  misc_feature (1)..( 6): Matrix.001 file - promoters60/1022586
ttttct

SEQ ID NO: 43946 - DNA, 7 bp, Unknown
  misc_feature (1)..( 7): Matrix.001 file - promoters60/1022586
aaaatcc

SEQ ID NO: 43947 - DNA, 6 bp, Unknown
  misc_feature (1)..( 6): Matrix.001 file - promoters60/1022586
atatct

SEQ ID NO: 43948 - DNA, 7 bp, Unknown
  misc_feature (1)..( 7): Matrix.001 file - promoters60/1022586
ttacttt

SEQ ID NO: 43949 - DNA, 7 bp, Unknown
  misc_feature (1)..( 7): Matrix.001 file - promoters60/1022586
aacccaa

SEQ ID NO: 43950 - DNA, 7 bp, Unknown
  misc_feature (1)..( 7): Matrix.001 file - promoters60/1022586
tttaaag

SEQ ID NO: 43951 - DNA, 7 bp, Unknown
  misc_feature (1)..( 7): Matrix.001 file - promoters60/1022586
aatattt

SEQ ID NO: 43952 - DNA, 6 bp, Unknown
  misc_feature (1)..( 6): Matrix.001 file - promoters60/1022586
aaaaag

SEQ ID NO: 43953 - DNA, 6 bp, Unknown
  misc_feature (1)..( 6): Matrix.001 file - promoters60/1022586
tttgta

SEQ ID NO: 43954 - DNA, 8 bp, Unknown
  misc_feature (1)..( 8): Matrix.001 file - promoters60/1022598
taaatatc

SEQ ID NO: 43955 - DNA, 11 bp, Unknown
  misc_feature (1)..( 11): Matrix.001 file - promoters60/1022598
tatcagtgtct

SEQ ID NO: 43956 - DNA, 8 bp, Unknown
  misc_feature (1)..( 8): Matrix.001 file - promoters60/1022610
taattatt

SEQ ID NO: 43957 - DNA, 13 bp, Unknown
  misc_feature (1)..( 13): Matrix.001 file - promoters60/1022610
aaaaaatttataa

SEQ ID NO: 43958 - DNA, 13 bp, Unknown
  misc_feature (1)..( 13): Matrix.001 file - promoters60/1022662
ttcgttttaattt

SEQ ID NO: 43959 - DNA, 14 bp, Unknown
  misc_feature (1)..( 14): Matrix.001 file - promoters60/1022662
aaaaccatccaatt

SEQ ID NO: 43960 - DNA, 7 bp, Unknown
  misc_feature (1)..( 7): Matrix.001 file - promoters60/1022687
ttagtaa

SEQ ID NO: 43961 - DNA, 11 bp, Unknown
  misc_feature (1)..( 11): Matrix.001 file - promoters60/1022687
aaaattattaa

SEQ ID NO: 43962 - DNA, 11 bp, Unknown
  misc_feature (1)..( 11): Matrix.001 file - promoters60/1022687
gaaatattaga

SEQ ID NO: 43963 - DNA, 8 bp, Unknown
  misc_feature (1)..( 8): Matrix.001 file - promoters60/1022687
caatatta

SEQ ID NO: 43964 - DNA, 6 bp, Unknown
  misc_feature (1)..( 6): Matrix.001 file - promoters60/1022810
ttttaa

SEQ ID NO: 43965 - DNA, 6 bp, Unknown
  misc_feature (1)..( 6): Matrix.001 file - promoters60/1022810
taatat

SEQ ID NO: 43966 - DNA, 8 bp, Unknown
  misc_feature (1)..( 8): Matrix.001 file - promoters60/1022810
aaacacaa

SEQ ID NO: 43967 - DNA, 7 bp, Unknown
  misc_feature (1)..( 7): Matrix.001 file - promoters60/1022810
ataacaa

SEQ ID NO: 43968 - DNA, 7 bp, Unknown
  misc_feature (1)..( 7): Matrix.001 file - promoters60/1022810
tctgcga

SEQ ID NO: 43969 - DNA, 7 bp, Unknown
  misc_feature (1)..( 7): Matrix.001 file - promoters60/1022810
aatcatt

SEQ ID NO: 43970 - DNA, 7 bp, Unknown
  misc_feature (1)..( 7): Matrix.001 file - promoters60/1022810
ttacaat

SEQ ID NO: 43971 - DNA, 7 bp, Unknown
  misc_feature (1)..( 7): Matrix.001 file - promoters60/1022810
aatctgt

SEQ ID NO: 43972 - DNA, 7 bp, Unknown
  misc_feature (1)..( 7): Matrix.001 file - promoters60/1022824
agaagca

SEQ ID NO: 43973 - DNA, 8 bp, Unknown
  misc_feature (1)..( 8): Matrix.001 file - promoters60/1022824
tttgattt

SEQ ID NO: 43974 - DNA, 9 bp, Unknown
  misc_feature (1)..( 9): Matrix.001 file - promoters60/1022824
agttccata

SEQ ID NO: 43975 - DNA, 7 bp, Unknown
  misc_feature (1)..( 7): Matrix.001 file - promoters60/1022824
tctttta

SEQ ID NO: 43976 - DNA, 9 bp, Unknown
  misc_feature (1)..( 9): Matrix.001 file - promoters60/1022824
tctctcgtg

SEQ ID NO: 43977 - DNA, 6 bp, Unknown
  misc_feature (1)..( 6): Matrix.001 file - promoters60/1022824
tagact

SEQ ID NO: 43978 - DNA, 6 bp, Unknown
  misc_feature (1)..( 6): Matrix.001 file - promoters60/1022824
atgttg

SEQ ID NO: 43979 - DNA, 6 bp, Unknown
  misc_feature (1)..( 6): Matrix.001 file - promoters60/1022824
gtggtt

SEQ ID NO: 43980 - DNA, 6 bp, Unknown
  misc_feature (1)..( 6): Matrix.001 file - promoters60/1022824
tacaga

SEQ ID NO: 43981 - DNA, 7 bp, Unknown
  misc_feature (1)..( 7): Matrix.001 file - promoters60/1022824
ataaact

SEQ ID NO: 43982 - DNA, 7 bp, Unknown
  misc_feature (1)..( 7): Matrix.001 file - promoters60/1022824
gagaaga

SEQ ID NO: 43983 - DNA, 7 bp, Unknown
  misc_feature (1)..( 7): Matrix.001 file - promoters60/1022824
aaacagc

SEQ ID NO: 43984 - DNA, 7 bp, Unknown
  misc_feature (1)..( 7): Matrix.001 file - promoters60/1022824
ttctttg

SEQ ID NO: 43985 - DNA, 7 bp, Unknown
  misc_feature (1)..( 7): Matrix.001 file - promoters60/1022824
actaatt

SEQ ID NO: 43986 - DNA, 6 bp, Unknown
  misc_feature (1)..( 6): Matrix.001 file - promoters60/1022824
tcgttt

SEQ ID NO: 43987 - DNA, 10 bp, Unknown
  misc_feature (1)..( 10): Matrix.001 file - promoters60/1022932
catatgtagt

SEQ ID NO: 43988 - DNA, 10 bp, Unknown
  misc_feature (1)..( 10): Matrix.001 file - promoters60/1022932
gatctaatga

SEQ ID NO: 43989 - DNA, 8 bp, Unknown
  misc_feature (1)..( 8): Matrix.001 file - promoters60/1022983
cattaaaa

SEQ ID NO: 43990 - DNA, 8 bp, Unknown
  misc_feature (1)..( 8): Matrix.001 file - promoters60/1022983
tataaaaa

SEQ ID NO: 43991 - DNA, 12 bp, Unknown
  misc_feature (1)..( 12): Matrix.001 file - promoters60/1022983
aataaaaaaaaa

SEQ ID NO: 43992 - DNA, 11 bp, Unknown
  misc_feature (1)..( 11): Matrix.001 file - promoters60/1022983
tataaaaaaat

SEQ ID NO: 43993 - DNA, 10 bp, Unknown
  misc_feature (1)..( 10): Matrix.001 file - promoters60/1022983
atataaaaat

SEQ ID NO: 43994 - DNA, 11 bp, Unknown
  misc_feature (1)..( 11): Matrix.001 file - promoters60/1022983
acaaaaaaaaa

SEQ ID NO: 43995 - DNA, 9 bp, Unknown
  misc_feature (1)..( 9): Matrix.001 file - promoters60/1022987
tttaatgaa

SEQ ID NO: 43996 - DNA, 8 bp, Unknown
  misc_feature (1)..( 8): Matrix.001 file - promoters60/1023029
ctttgtta

SEQ ID NO: 43997 - DNA, 9 bp, Unknown
  misc_feature (1)..( 9): Matrix.001 file - promoters60/1023029
tataccaat

SEQ ID NO: 43998 - DNA, 6 bp, Unknown
  misc_feature (1)..( 6): Matrix.001 file - promoters60/1023029
ttatga

SEQ ID NO: 43999 - DNA, 7 bp, Unknown
  misc_feature (1)..( 7): Matrix.001 file - promoters60/1023029
aataatt

SEQ ID NO: 44000 - DNA, 8 bp, Unknown
  misc_feature (1)..( 8): Matrix.001 file - promoters60/1023029
aatcttaa

SEQ ID NO: 44001 - DNA, 6 bp, Unknown
  misc_feature (1)..( 6): Matrix.001 file - promoters60/1023029
cgtata

SEQ ID NO: 44002 - DNA, 7 bp, Unknown
  misc_feature (1)..( 7): Matrix.001 file - promoters60/1023029
ataggtt

SEQ ID NO: 44003 - DNA, 6 bp, Unknown
  misc_feature (1)..( 6): Matrix.001 file - promoters60/1023029
atttta

SEQ ID NO: 44004 - DNA, 6 bp, Unknown
  misc_feature (1)..( 6): Matrix.001 file - promoters60/1023029
ccaata

SEQ ID NO: 44005 - DNA, 11 bp, Unknown
  misc_feature (1)..( 11): Matrix.001 file - promoters60/1023029
agaagatgagt

SEQ ID NO: 44006 - DNA, 8 bp, Unknown
  misc_feature (1)..( 8): Matrix.001 file - promoters60/1023029
tatatgaa

SEQ ID NO: 44007 - DNA, 8 bp, Unknown
  misc_feature (1)..( 8): Matrix.001 file - promoters60/1023029
attacttc

SEQ ID NO: 44008 - DNA, 9 bp, Unknown
  misc_feature (1)..( 9): Matrix.001 file - promoters60/1023029
caatataaa

SEQ ID NO: 44009 - DNA, 6 bp, Unknown
  misc_feature (1)..( 6): Matrix.001 file - promoters60/1023029
ctcttt

SEQ ID NO: 44010 - DNA, 7 bp, Unknown
  misc_feature (1)..( 7): Matrix.001 file - promoters60/1023029
actccta

SEQ ID NO: 44011 - DNA, 6 bp, Unknown
  misc_feature (1)..( 6): Matrix.001 file - promoters60/1023029
caactt

SEQ ID NO: 44012 - DNA, 7 bp, Unknown
  misc_feature (1)..( 7): Matrix.001 file - promoters60/1023029
gatgctt

SEQ ID NO: 44013 - DNA, 8 bp, Unknown
  misc_feature (1)..( 8): Matrix.001 file - promoters60/1023029
tttaaatt

SEQ ID NO: 44014 - DNA, 7 bp, Unknown
  misc_feature (1)..( 7): Matrix.001 file - promoters60/1023029
tggatca

SEQ ID NO: 44015 - DNA, 8 bp, Unknown
  misc_feature (1)..( 8): Matrix.001 file - promoters60/1023029
aattatta

SEQ ID NO: 44016 - DNA, 9 bp, Unknown
  misc_feature (1)..( 9): Matrix.001 file - promoters60/1023037
aaattcact

SEQ ID NO: 44017 - DNA, 6 bp, Unknown
  misc_feature (1)..( 6): Matrix.001 file - promoters60/1023037
taaaga

SEQ ID NO: 44018 - DNA, 11 bp, Unknown
  misc_feature (1)..( 11): Matrix.001 file - promoters60/1023037
acagtttataa

SEQ ID NO: 44019 - DNA, 7 bp, Unknown
  misc_feature (1)..( 7): Matrix.001 file - promoters60/1023037
gtaacta

SEQ ID NO: 44020 - DNA, 7 bp, Unknown
  misc_feature (1)..( 7): Matrix.001 file - promoters60/1023037
aattttt

SEQ ID NO: 44021 - DNA, 9 bp, Unknown
  misc_feature (1)..( 9): Matrix.001 file - promoters60/1023037
gggtatata

SEQ ID NO: 44022 - DNA, 6 bp, Unknown
  misc_feature (1)..( 6): Matrix.001 file - promoters60/1023037
agtaat

SEQ ID NO: 44023 - DNA, 6 bp, Unknown
  misc_feature (1)..( 6): Matrix.001 file - promoters60/1023037
tttata

SEQ ID NO: 44024 - DNA, 6 bp, Unknown
  misc_feature (1)..( 6): Matrix.001 file - promoters60/1023037
ttaaaa

SEQ ID NO: 44025 - DNA, 8 bp, Unknown
  misc_feature (1)..( 8): Matrix.001 file - promoters60/1023037
ctaattat

SEQ ID NO: 44026 - DNA, 6 bp, Unknown
  misc_feature (1)..( 6): Matrix.001 file - promoters60/1023037
tttact

SEQ ID NO: 44027 - DNA, 9 bp, Unknown
  misc_feature (1)..( 9): Matrix.001 file - promoters60/1023037
gaaaatatc

SEQ ID NO: 44028 - DNA, 6 bp, Unknown
  misc_feature (1)..( 6): Matrix.001 file - promoters60/1023037
acacaa

SEQ ID NO: 44029 - DNA, 6 bp, Unknown
  misc_feature (1)..( 6): Matrix.001 file - promoters60/1023037
gagaga

SEQ ID NO: 44030 - DNA, 8 bp, Unknown
  misc_feature (1)..( 8): Matrix.001 file - promoters60/1023062
taaaaaat

SEQ ID NO: 44031 - DNA, 9 bp, Unknown
  misc_feature (1)..( 9): Matrix.001 file - promoters60/1023062
aattccaaa

SEQ ID NO: 44032 - DNA, 9 bp, Unknown
  misc_feature (1)..( 9): Matrix.001 file - promoters60/1023062
tttatgaca

SEQ ID NO: 44033 - DNA, 10 bp, Unknown
  misc_feature (1)..( 10): Matrix.001 file - promoters60/1023062
tttgaatttt

SEQ ID NO: 44034 - DNA, 8 bp, Unknown
  misc_feature (1)..( 8): Matrix.001 file - promoters60/1023062
aattttat

SEQ ID NO: 44035 - DNA, 13 bp, Unknown
  misc_feature (1)..( 13): Matrix.001 file - promoters60/1023062
taatggatctaca

SEQ ID NO: 44036 - DNA, 10 bp, Unknown
  misc_feature (1)..( 10): Matrix.001 file - promoters60/1023062
acaaaattag

SEQ ID NO: 44037 - DNA, 7 bp, Unknown
  misc_feature (1)..( 7): Matrix.001 file - promoters60/1023079
agtcatt

SEQ ID NO: 44038 - DNA, 6 bp, Unknown
  misc_feature (1)..( 6): Matrix.001 file - promoters60/1023079
tttcct

SEQ ID NO: 44039 - DNA, 6 bp, Unknown
  misc_feature (1)..( 6): Matrix.001 file - promoters60/1023079
agaaaa

SEQ ID NO: 44040 - DNA, 7 bp, Unknown
  misc_feature (1)..( 7): Matrix.001 file - promoters60/1023079
aaagttt

SEQ ID NO: 44041 - DNA, 8 bp, Unknown
  misc_feature (1)..( 8): Matrix.001 file - promoters60/1023079
ccaaactc

SEQ ID NO: 44042 - DNA, 6 bp, Unknown
  misc_feature (1)..( 6): Matrix.001 file - promoters60/1023079
atttta

SEQ ID NO: 44043 - DNA, 7 bp, Unknown
  misc_feature (1)..( 7): Matrix.001 file - promoters60/1023079
caaattt

SEQ ID NO: 44044 - DNA, 8 bp, Unknown
  misc_feature (1)..( 8): Matrix.001 file - promoters60/1023079
tttcttta

SEQ ID NO: 44045 - DNA, 8 bp, Unknown
  misc_feature (1)..( 8): Matrix.001 file - promoters60/1023079
taatacat

SEQ ID NO: 44046 - DNA, 6 bp, Unknown
  misc_feature (1)..( 6): Matrix.001 file - promoters60/1023079
tttaat

SEQ ID NO: 44047 - DNA, 7 bp, Unknown
  misc_feature (1)..( 7): Matrix.001 file - promoters60/1023079
taaatta

SEQ ID NO: 44048 - DNA, 6 bp, Unknown
  misc_feature (1)..( 6): Matrix.001 file - promoters60/1023079
aattag

SEQ ID NO: 44049 - DNA, 9 bp, Unknown
  misc_feature (1)..( 9): Matrix.001 file - promoters60/1023079
ttaaataat

SEQ ID NO: 44050 - DNA, 7 bp, Unknown
  misc_feature (1)..( 7): Matrix.001 file - promoters60/1023079
taaaatt

SEQ ID NO: 44051 - DNA, 7 bp, Unknown
  misc_feature (1)..( 7): Matrix.001 file - promoters60/1023079
ttagaat

SEQ ID NO: 44052 - DNA, 7 bp, Unknown
  misc_feature (1)..( 7): Matrix.001 file - promoters60/1023079
aaacata

SEQ ID NO: 44053 - DNA, 8 bp, Unknown
  misc_feature (1)..( 8): Matrix.001 file - promoters60/1023079
tttattaa

SEQ ID NO: 44054 - DNA, 6 bp, Unknown
  misc_feature (1)..( 6): Matrix.001 file - promoters60/1023079
ttaatt

SEQ ID NO: 44055 - DNA, 7 bp, Unknown
  misc_feature (1)..( 7): Matrix.001 file - promoters60/1023079
aattctt

SEQ ID NO: 44056 - DNA, 6 bp, Unknown
  misc_feature (1)..( 6): Matrix.001 file - promoters60/1023089
ttctag

SEQ ID NO: 44057 - DNA, 6 bp, Unknown
  misc_feature (1)..( 6): Matrix.001 file - promoters60/1023089
ttcaaa

SEQ ID NO: 44058 - DNA, 7 bp, Unknown
  misc_feature (1)..( 7): Matrix.001 file - promoters60/1023089
aaaaaac

SEQ ID NO: 44059 - DNA, 8 bp, Unknown
  misc_feature (1)..( 8): Matrix.001 file - promoters60/1023089
tttctttt

SEQ ID NO: 44060 - DNA, 7 bp, Unknown
  misc_feature (1)..( 7): Matrix.001 file - promoters60/1023089
tttcttt

SEQ ID NO: 44061 - DNA, 11 bp, Unknown
  misc_feature (1)..( 11): Matrix.001 file - promoters60/1023089
gattaatactt

SEQ ID NO: 44062 - DNA, 6 bp, Unknown
  misc_feature (1)..( 6): Matrix.001 file - promoters60/1023089
tatttt

SEQ ID NO: 44063 - DNA, 6 bp, Unknown
  misc_feature (1)..( 6): Matrix.001 file - promoters60/1023089
tttgat

SEQ ID NO: 44064 - DNA, 6 bp, Unknown
  misc_feature (1)..( 6): Matrix.001 file - promoters60/1023089
aaattg

SEQ ID NO: 44065 - DNA, 6 bp, Unknown
  misc_feature (1)..( 6): Matrix.001 file - promoters60/1023089
taatta

SEQ ID NO: 44066 - DNA, 9 bp, Unknown
  misc_feature (1)..( 9): Matrix.001 file - promoters60/1023089
tacaaaaat

SEQ ID NO: 44067 - DNA, 11 bp, Unknown
  misc_feature (1)..( 11): Matrix.001 file - promoters60/1023124
aaattatgatt

SEQ ID NO: 44068 - DNA, 7 bp, Unknown
  misc_feature (1)..( 7): Matrix.001 file - promoters60/1023124
tttttaa

SEQ ID NO: 44069 - DNA, 7 bp, Unknown
  misc_feature (1)..( 7): Matrix.001 file - promoters60/1023124
ttcatac

SEQ ID NO: 44070 - DNA, 6 bp, Unknown
  misc_feature (1)..( 6): Matrix.001 file - promoters60/1023124
catgtt

SEQ ID NO: 44071 - DNA, 8 bp, Unknown
  misc_feature (1)..( 8): Matrix.001 file - promoters60/1023124
taaacaat

SEQ ID NO: 44072 - DNA, 8 bp, Unknown
  misc_feature (1)..( 8): Matrix.001 file - promoters60/1023124
aaataatt

SEQ ID NO: 44073 - DNA, 6 bp, Unknown
  misc_feature (1)..( 6): Matrix.001 file - promoters60/1023124
gtttaa

SEQ ID NO: 44074 - DNA, 6 bp, Unknown
  misc_feature (1)..( 6): Matrix.001 file - promoters60/1023124
tataaa

SEQ ID NO: 44075 - DNA, 6 bp, Unknown
  misc_feature (1)..( 6): Matrix.001 file - promoters60/1023124
aatata

SEQ ID NO: 44076 - DNA, 8 bp, Unknown
  misc_feature (1)..( 8): Matrix.001 file - promoters60/1023124
atgaatat

SEQ ID NO: 44077 - DNA, 6 bp, Unknown
  misc_feature (1)..( 6): Matrix.001 file - promoters60/1023124
ctcgtg

SEQ ID NO: 44078 - DNA, 7 bp, Unknown
  misc_feature (1)..( 7): Matrix.001 file - promoters60/1023124
ttaatat

SEQ ID NO: 44079 - DNA, 8 bp, Unknown
  misc_feature (1)..( 8): Matrix.001 file - promoters60/1023124
tataattt

SEQ ID NO: 44080 - DNA, 8 bp, Unknown
  misc_feature (1)..( 8): Matrix.001 file - promoters60/1023124
gtaaatgt

SEQ ID NO: 44081 - DNA, 6 bp, Unknown
  misc_feature (1)..( 6): Matrix.001 file - promoters60/1023124
ctctaa

SEQ ID NO: 44082 - DNA, 6 bp, Unknown
  misc_feature (1)..( 6): Matrix.001 file - promoters60/1023124
ttaaaa

SEQ ID NO: 44083 - DNA, 9 bp, Unknown
  misc_feature (1)..( 9): Matrix.001 file - promoters60/1023124
atttttttt

SEQ ID NO: 44084 - DNA, 6 bp, Unknown
  misc_feature (1)..( 6): Matrix.001 file - promoters60/1023124
tgttgt

SEQ ID NO: 44085 - DNA, 15 bp, Unknown
  misc_feature (1)..( 15): Matrix.001 file - promoters60/1023124
ttttaaaaaaaaaaa

SEQ ID NO: 44086 - DNA, 8 bp, Unknown
  misc_feature (1)..( 8): Matrix.001 file - promoters60/1023124
taaataat

SEQ ID NO: 44087 - DNA, 7 bp, Unknown
  misc_feature (1)..( 7): Matrix.001 file - promoters60/1023124
atatata

SEQ ID NO: 44088 - DNA, 6 bp, Unknown
  misc_feature (1)..( 6): Matrix.001 file - promoters60/1023124
tatata

SEQ ID NO: 44089 - DNA, 6 bp, Unknown
  misc_feature (1)..( 6): Matrix.001 file - promoters60/1023124
gagaac

SEQ ID NO: 44090 - DNA, 7 bp, Unknown
  misc_feature (1)..( 7): Matrix.001 file - promoters60/1023124
atgctgc

SEQ ID NO: 44091 - DNA, 6 bp, Unknown
  misc_feature (1)..( 6): Matrix.001 file - promoters60/1023124
tttaaa

SEQ ID NO: 44092 - DNA, 14 bp, Unknown
  misc_feature (1)..( 14): Matrix.001 file - promoters60/1023124
tctaaaaaaaaaaa

SEQ ID NO: 44093 - DNA, 7 bp, Unknown
  misc_feature (1)..( 7): Matrix.001 file - promoters60/1023124
caaaatc

SEQ ID NO: 44094 - DNA, 7 bp, Unknown
  misc_feature (1)..( 7): Matrix.001 file - promoters60/1023143
tttgata

SEQ ID NO: 44095 - DNA, 8 bp, Unknown
  misc_feature (1)..( 8): Matrix.001 file - promoters60/1023143
ttgcaaat

SEQ ID NO: 44096 - DNA, 6 bp, Unknown
  misc_feature (1)..( 6): Matrix.001 file - promoters60/1023143
acattg

SEQ ID NO: 44097 - DNA, 8 bp, Unknown
  misc_feature (1)..( 8): Matrix.001 file - promoters60/1023143
tttagtat

SEQ ID NO: 44098 - DNA, 7 bp, Unknown
  misc_feature (1)..( 7): Matrix.001 file - promoters60/1023143
tattatg

SEQ ID NO: 44099 - DNA, 11 bp, Unknown
  misc_feature (1)..( 11): Matrix.001 file - promoters60/1023143
atgaaaactgt

SEQ ID NO: 44100 - DNA, 6 bp, Unknown
  misc_feature (1)..( 6): Matrix.001 file - promoters60/1023143
atacca

SEQ ID NO: 44101 - DNA, 7 bp, Unknown
  misc_feature (1)..( 7): Matrix.001 file - promoters60/1023143
atgactt

SEQ ID NO: 44102 - DNA, 6 bp, Unknown
  misc_feature (1)..( 6): Matrix.001 file - promoters60/1023143
ttcata

SEQ ID NO: 44103 - DNA, 9 bp, Unknown
  misc_feature (1)..( 9): Matrix.001 file - promoters60/1023143
ttttcagta

SEQ ID NO: 44104 - DNA, 6 bp, Unknown
  misc_feature (1)..( 6): Matrix.001 file - promoters60/1023143
tgcaaa

SEQ ID NO: 44105 - DNA, 8 bp, Unknown
  misc_feature (1)..( 8): Matrix.001 file - promoters60/1023143
tatcaaac

SEQ ID NO: 44106 - DNA, 6 bp, Unknown
  misc_feature (1)..( 6): Matrix.001 file - promoters60/1023143
aaaata

SEQ ID NO: 44107 - DNA, 7 bp, Unknown
  misc_feature (1)..( 7): Matrix.001 file - promoters60/1023143
ttaccaa

SEQ ID NO: 44108 - DNA, 9 bp, Unknown
  misc_feature (1)..( 9): Matrix.001 file - promoters60/1023143
tctttttct

SEQ ID NO: 44109 - DNA, 9 bp, Unknown
  misc_feature (1)..( 9): Matrix.001 file - promoters60/1023143
ataatgttt

SEQ ID NO: 44110 - DNA, 7 bp, Unknown
  misc_feature (1)..( 7): Matrix.001 file - promoters60/1023143
atagata

SEQ ID NO: 44111 - DNA, 7 bp, Unknown
  misc_feature (1)..( 7): Matrix.001 file - promoters60/1023143
atggaat

SEQ ID NO: 44112 - DNA, 7 bp, Unknown
  misc_feature (1)..( 7): Matrix.001 file - promoters60/1023143
accaaat

SEQ ID NO: 44113 - DNA, 6 bp, Unknown
  misc_feature (1)..( 6): Matrix.001 file - promoters60/1023143
aaaaaa

SEQ ID NO: 44114 - DNA, 6 bp, Unknown
  misc_feature (1)..( 6): Matrix.001 file - promoters60/1023143
gtcaaa

SEQ ID NO: 44115 - DNA, 6 bp, Unknown
  misc_feature (1)..( 6): Matrix.001 file - promoters60/1023143
ggcgag

SEQ ID NO: 44116 - DNA, 8 bp, Unknown
  misc_feature (1)..( 8): Matrix.001 file - promoters60/1023210
caaaaaaa

SEQ ID NO: 44117 - DNA, 6 bp, Unknown
  misc_feature (1)..( 6): Matrix.001 file - promoters60/1023210
aaaaca

SEQ ID NO: 44118 - DNA, 8 bp, Unknown
  misc_feature (1)..( 8): Matrix.001 file - promoters60/1023210
gaaataaa

SEQ ID NO: 44119 - DNA, 7 bp, Unknown
  misc_feature (1)..( 7): Matrix.001 file - promoters60/1023210
caaattt

SEQ ID NO: 44120 - DNA, 6 bp, Unknown
  misc_feature (1)..( 6): Matrix.001 file - promoters60/1023210
ttaaaa

SEQ ID NO: 44121 - DNA, 6 bp, Unknown
  misc_feature (1)..( 6): Matrix.001 file - promoters60/1023210
gtaacg

SEQ ID NO: 44122 - DNA, 7 bp, Unknown
  misc_feature (1)..( 7): Matrix.001 file - promoters60/1023210
gtggtta

SEQ ID NO: 44123 - DNA, 10 bp, Unknown
  misc_feature (1)..( 10): Matrix.001 file - promoters60/1023210
tacgtgtcaa

SEQ ID NO: 44124 - DNA, 20 bp, Unknown
  misc_feature (1)..( 20): Matrix.001 file - promoters60/1023210
ttggctattgcttcaccgcc

SEQ ID NO: 44125 - DNA, 16 bp, Unknown
  misc_feature (1)..( 16): Matrix.001 file - promoters60/1023210
gaccgagtcgtcctcg

SEQ ID NO: 44126 - DNA, 16 bp, Unknown
  misc_feature (1)..( 16): Matrix.001 file - promoters60/1023210
ttcttcttctataaat

SEQ ID NO: 44127 - DNA, 6 bp, Unknown
  misc_feature (1)..( 6): Matrix.001 file - promoters60/1023210
gcttct

SEQ ID NO: 44128 - DNA, 8 bp, Unknown
  misc_feature (1)..( 8): Matrix.001 file - promoters60/1023210
ttctggcc

SEQ ID NO: 44129 - DNA, 7 bp, Unknown
  misc_feature (1)..( 7): Matrix.001 file - promoters60/1023210
tacatat

SEQ ID NO: 44130 - DNA, 15 bp, Unknown
  misc_feature (1)..( 15): Matrix.001 file - promoters60/1023210
cgccttagctttctc

SEQ ID NO: 44131 - DNA, 6 bp, Unknown
  misc_feature (1)..( 6): Matrix.001 file - promoters60/1023210
tttttt

SEQ ID NO: 44132 - DNA, 9 bp, Unknown
  misc_feature (1)..( 9): Matrix.001 file - promoters60/1023210
acaaaaagg

SEQ ID NO: 44133 - DNA, 7 bp, Unknown
  misc_feature (1)..( 7): Matrix.001 file - promoters60/1023210
acgaaga

SEQ ID NO: 44134 - DNA, 6 bp, Unknown
  misc_feature (1)..( 6): Matrix.001 file - promoters60/1023210
gttcaa

SEQ ID NO: 44135 - DNA, 6 bp, Unknown
  misc_feature (1)..( 6): Matrix.001 file - promoters60/1023210
gtatat

SEQ ID NO: 44136 - DNA, 9 bp, Unknown
  misc_feature (1)..( 9): Matrix.001 file - promoters60/1023210
atctaatga

SEQ ID NO: 44137 - DNA, 6 bp, Unknown
  misc_feature (1)..( 6): Matrix.001 file - promoters60/1023210
tcagta

SEQ ID NO: 44138 - DNA, 10 bp, Unknown
  misc_feature (1)..( 10): Matrix.001 file - promoters60/1023210
tttaacaact

SEQ ID NO: 44139 - DNA, 15 bp, Unknown
  misc_feature (1)..( 15): Matrix.001 file - promoters60/1023210
aaatacttttcctca

SEQ ID NO: 44140 - DNA, 6 bp, Unknown
  misc_feature (1)..( 6): Matrix.001 file - promoters60/1023210
aacaac

SEQ ID NO: 44141 - DNA, 15 bp, Unknown
  misc_feature (1)..( 15): Matrix.001 file - promoters60/1023210
aatacccaaagagct

SEQ ID NO: 44142 - DNA, 15 bp, Unknown
  misc_feature (1)..( 15): Matrix.001 file - promoters60/1023221
aaataaaaactaata

SEQ ID NO: 44143 - DNA, 12 bp, Unknown
  misc_feature (1)..( 12): Matrix.001 file - promoters60/1023221
aaacattcttaa

SEQ ID NO: 44144 - DNA, 10 bp, Unknown
  misc_feature (1)..( 10): Matrix.001 file - promoters60/1023237
tactttttct

SEQ ID NO: 44145 - DNA, 11 bp, Unknown
  misc_feature (1)..( 11): Matrix.001 file - promoters60/1023237
atcttttttaa

SEQ ID NO: 44146 - DNA, 15 bp, Unknown
  misc_feature (1)..( 15): Matrix.001 file - promoters60/1023237
tatagttttgaagga

SEQ ID NO: 44147 - DNA, 12 bp, Unknown
  misc_feature (1)..( 12): Matrix.001 file - promoters60/1023237
ttgtggtttctt

SEQ ID NO: 44148 - DNA, 8 bp, Unknown
  misc_feature (1)..( 8): Matrix.001 file - promoters60/1023278
aaattttt

SEQ ID NO: 44149 - DNA, 14 bp, Unknown
  misc_feature (1)..( 14): Matrix.001 file - promoters60/1023278
aaaaagggcctgta

SEQ ID NO: 44150 - DNA, 8 bp, Unknown
  misc_feature (1)..( 8): Matrix.001 file - promoters60/1023299
gtaaaata

SEQ ID NO: 44151 - DNA, 10 bp, Unknown
  misc_feature (1)..( 10): Matrix.001 file - promoters60/1023299
ttttcatttt

SEQ ID NO: 44152 - DNA, 10 bp, Unknown
  misc_feature (1)..( 10): Matrix.001 file - promoters60/1023299
atttacaata

SEQ ID NO: 44153 - DNA, 9 bp, Unknown
  misc_feature (1)..( 9): Matrix.001 file - promoters60/1023299
cattttata

SEQ ID NO: 44154 - DNA, 11 bp, Unknown
  misc_feature (1)..( 11): Matrix.001 file - promoters60/1023299
ctataaataca

SEQ ID NO: 44155 - DNA, 9 bp, Unknown
  misc_feature (1)..( 9): Matrix.001 file - promoters60/1023299
acaatttta

SEQ ID NO: 44156 - DNA, 8 bp, Unknown
  misc_feature (1)..( 8): Matrix.001 file - promoters60/1023397
gattttcc

SEQ ID NO: 44157 - DNA, 12 bp, Unknown
  misc_feature (1)..( 12): Matrix.001 file - promoters60/1023397
cttttttttggt

SEQ ID NO: 44158 - DNA, 12 bp, Unknown
  misc_feature (1)..( 12): Matrix.001 file - promoters60/1023397
tctgtttatgtt

SEQ ID NO: 44159 - DNA, 15 bp, Unknown
  misc_feature (1)..( 15): Matrix.001 file - promoters60/1023397
tctggagagattttg

SEQ ID NO: 44160 - DNA, 8 bp, Unknown
  misc_feature (1)..( 8): Matrix.001 file - promoters60/1023397
gagttttc

SEQ ID NO: 44161 - DNA, 12 bp, Unknown
  misc_feature (1)..( 12): Matrix.001 file - promoters60/1023397
ctttcttttttt

SEQ ID NO: 44162 - DNA, 7 bp, Unknown
  misc_feature (1)..( 7): Matrix.001 file - promoters60/1023397
ttaaatt

SEQ ID NO: 44163 - DNA, 10 bp, Unknown
  misc_feature (1)..( 10): Matrix.001 file - promoters60/1023407
caaaattttg

SEQ ID NO: 44164 - DNA, 14 bp, Unknown
  misc_feature (1)..( 14): Matrix.001 file - promoters60/1023407
ttctcataatacat

SEQ ID NO: 44165 - DNA, 9 bp, Unknown
  misc_feature (1)..( 9): Matrix.001 file - promoters60/1023528
aaaaacaga

SEQ ID NO: 44166 - DNA, 8 bp, Unknown
  misc_feature (1)..( 8): Matrix.001 file - promoters60/1023528
gattaaag

SEQ ID NO: 44167 - DNA, 7 bp, Unknown
  misc_feature (1)..( 7): Matrix.001 file - promoters60/1023583
aataaga

SEQ ID NO: 44168 - DNA, 9 bp, Unknown
  misc_feature (1)..( 9): Matrix.001 file - promoters60/1023583
gtttataag

SEQ ID NO: 44169 - DNA, 10 bp, Unknown
  misc_feature (1)..( 10): Matrix.001 file - promoters60/1023583
tgaaaagaaa

SEQ ID NO: 44170 - DNA, 10 bp, Unknown
  misc_feature (1)..( 10): Matrix.001 file - promoters60/1023583
tgaaaaatat

SEQ ID NO: 44171 - DNA, 6 bp, Unknown
  misc_feature (1)..( 6): Matrix.001 file - promoters60/1023583
aatatg

SEQ ID NO: 44172 - DNA, 6 bp, Unknown
  misc_feature (1)..( 6): Matrix.001 file - promoters60/1023583
ttttaa

SEQ ID NO: 44173 - DNA, 7 bp, Unknown
  misc_feature (1)..( 7): Matrix.001 file - promoters60/1023583
aaaactg

SEQ ID NO: 44174 - DNA, 8 bp, Unknown
  misc_feature (1)..( 8): Matrix.001 file - promoters60/1023583
gttattat

SEQ ID NO: 44175 - DNA, 6 bp, Unknown
  misc_feature (1)..( 6): Matrix.001 file - promoters60/1023583
cgtctt

SEQ ID NO: 44176 - DNA, 8 bp, Unknown
  misc_feature (1)..( 8): Matrix.001 file - promoters60/1023583
caaatttc

SEQ ID NO: 44177 - DNA, 6 bp, Unknown
  misc_feature (1)..( 6): Matrix.001 file - promoters60/1023583
tggttc

SEQ ID NO: 44178 - DNA, 6 bp, Unknown
  misc_feature (1)..( 6): Matrix.001 file - promoters60/1023583
attata

SEQ ID NO: 44179 - DNA, 8 bp, Unknown
  misc_feature (1)..( 8): Matrix.001 file - promoters60/1023594
caaaaaaa

SEQ ID NO: 44180 - DNA, 11 bp, Unknown
  misc_feature (1)..( 11): Matrix.001 file - promoters60/1023594
caactagtcaa

SEQ ID NO: 44181 - DNA, 9 bp, Unknown
  misc_feature (1)..( 9): Matrix.001 file - promoters60/1023594
tgaaaaatt

SEQ ID NO: 44182 - DNA, 10 bp, Unknown
  misc_feature (1)..( 10): Matrix.001 file - promoters60/1023594
ctataaatat

SEQ ID NO: 44183 - DNA, 9 bp, Unknown
  misc_feature (1)..( 9): Matrix.001 file - promoters60/1023619
aattgattt

SEQ ID NO: 44184 - DNA, 9 bp, Unknown
  misc_feature (1)..( 9): Matrix.001 file - promoters60/1023619
aattgattt

SEQ ID NO: 44185 - DNA, 8 bp, Unknown
  misc_feature (1)..( 8): Matrix.001 file - promoters60/1023619
attgattt

SEQ ID NO: 44186 - DNA, 9 bp, Unknown
  misc_feature (1)..( 9): Matrix.001 file - promoters60/1023634
atttgagag

SEQ ID NO: 44187 - DNA, 6 bp, Unknown
  misc_feature (1)..( 6): Matrix.001 file - promoters60/1023698
tatttt

SEQ ID NO: 44188 - DNA, 6 bp, Unknown
  misc_feature (1)..( 6): Matrix.001 file - promoters60/1023698
ttttta

SEQ ID NO: 44189 - DNA, 7 bp, Unknown
  misc_feature (1)..( 7): Matrix.001 file - promoters60/1023698
taaaatt

SEQ ID NO: 44190 - DNA, 8 bp, Unknown
  misc_feature (1)..( 8): Matrix.001 file - promoters60/1023698
tacagtat

SEQ ID NO: 44191 - DNA, 7 bp, Unknown
  misc_feature (1)..( 7): Matrix.001 file - promoters60/1023698
ttatttt

SEQ ID NO: 44192 - DNA, 9 bp, Unknown
  misc_feature (1)..( 9): Matrix.001 file - promoters60/1023698
aagcaaaaa

SEQ ID NO: 44193 - DNA, 8 bp, Unknown
  misc_feature (1)..( 8): Matrix.001 file - promoters60/1023698
ctttattt

SEQ ID NO: 44194 - DNA, 7 bp, Unknown
  misc_feature (1)..( 7): Matrix.001 file - promoters60/1023698
atttttt

SEQ ID NO: 44195 - DNA, 8 bp, Unknown
  misc_feature (1)..( 8): Matrix.001 file - promoters60/1023698
ataaaaat

SEQ ID NO: 44196 - DNA, 8 bp, Unknown
  misc_feature (1)..( 8): Matrix.001 file - promoters60/1023698
aaaaataa

SEQ ID NO: 44197 - DNA, 8 bp, Unknown
  misc_feature (1)..( 8): Matrix.001 file - promoters60/1023698
tttcaaaa

SEQ ID NO: 44198 - DNA, 9 bp, Unknown
  misc_feature (1)..( 9): Matrix.001 file - promoters60/1023698
tcttaattt

SEQ ID NO: 44199 - DNA, 10 bp, Unknown
  misc_feature (1)..( 10): Matrix.001 file - promoters60/1023698
atatttagtt

SEQ ID NO: 44200 - DNA, 7 bp, Unknown
  misc_feature (1)..( 7): Matrix.001 file - promoters60/1023698
acattat

SEQ ID NO: 44201 - DNA, 8 bp, Unknown
  misc_feature (1)..( 8): Matrix.001 file - promoters60/1023698
taaacaat

SEQ ID NO: 44202 - DNA, 8 bp, Unknown
  misc_feature (1)..( 8): Matrix.001 file - promoters60/1023698
aagattaa

SEQ ID NO: 44203 - DNA, 6 bp, Unknown
  misc_feature (1)..( 6): Matrix.001 file - promoters60/1023698
aaaact

SEQ ID NO: 44204 - DNA, 8 bp, Unknown
  misc_feature (1)..( 8): Matrix.001 file - promoters60/1023698
ctatgtgg

SEQ ID NO: 44205 - DNA, 15 bp, Unknown
  misc_feature (1)..( 15): Matrix.001 file - promoters60/1023698
ggcatgaggtgtaaa

SEQ ID NO: 44206 - DNA, 20 bp, Unknown
  misc_feature (1)..( 20): Matrix.001 file - promoters60/1023698
ttttatatataagcaaaaaa

SEQ ID NO: 44207 - DNA, 8 bp, Unknown
  misc_feature (1)..( 8): Matrix.001 file - promoters60/1023698
atcatcat

SEQ ID NO: 44208 - DNA, 8 bp, Unknown
  misc_feature (1)..( 8): Matrix.001 file - promoters60/1023698
aaactaat

SEQ ID NO: 44209 - DNA, 7 bp, Unknown
  misc_feature (1)..( 7): Matrix.001 file - promoters60/1023698
taatttt

SEQ ID NO: 44210 - DNA, 11 bp, Unknown
  misc_feature (1)..( 11): Matrix.001 file - promoters60/1023698
ttattgtaaac

SEQ ID NO: 44211 - DNA, 15 bp, Unknown
  misc_feature (1)..( 15): Matrix.001 file - promoters60/1023698
tttgcttctactata

SEQ ID NO: 44212 - DNA, 19 bp, Unknown
  misc_feature (1)..( 19): Matrix.001 file - promoters60/1023698
ctcatcttgatcaaatctc

SEQ ID NO: 44213 - DNA, 6 bp, Unknown
  misc_feature (1)..( 6): Matrix.001 file - promoters60/1023698
aatttc

SEQ ID NO: 44214 - DNA, 7 bp, Unknown
  misc_feature (1)..( 7): Matrix.001 file - promoters60/1023698
taattta

SEQ ID NO: 44215 - DNA, 6 bp, Unknown
  misc_feature (1)..( 6): Matrix.001 file - promoters60/1023698
aaatct

SEQ ID NO: 44216 - DNA, 12 bp, Unknown
  misc_feature (1)..( 12): Matrix.001 file - promoters60/1023698
tacactattttt

SEQ ID NO: 44217 - DNA, 11 bp, Unknown
  misc_feature (1)..( 11): Matrix.001 file - promoters60/1023782
aaaataaaata

SEQ ID NO: 44218 - DNA, 7 bp, Unknown
  misc_feature (1)..( 7): Matrix.001 file - promoters60/1023782
gtaaaac

SEQ ID NO: 44219 - DNA, 10 bp, Unknown
  misc_feature (1)..( 10): Matrix.001 file - promoters60/1023782
ggaaatgaaa

SEQ ID NO: 44220 - DNA, 7 bp, Unknown
  misc_feature (1)..( 7): Matrix.001 file - promoters60/1023782
gaaccca

SEQ ID NO: 44221 - DNA, 8 bp, Unknown
  misc_feature (1)..( 8): Matrix.001 file - promoters60/1023782
gataatta

SEQ ID NO: 44222 - DNA, 10 bp, Unknown
  misc_feature (1)..( 10): Matrix.001 file - promoters60/1023782
atatttttta

SEQ ID NO: 44223 - DNA, 6 bp, Unknown
  misc_feature (1)..( 6): Matrix.001 file - promoters60/1023891
ttatat

SEQ ID NO: 44224 - DNA, 7 bp, Unknown
  misc_feature (1)..( 7): Matrix.001 file - promoters60/1023891
tatactc

SEQ ID NO: 44225 - DNA, 9 bp, Unknown
  misc_feature (1)..( 9): Matrix.001 file - promoters60/1023891
taataattt

SEQ ID NO: 44226 - DNA, 8 bp, Unknown
  misc_feature (1)..( 8): Matrix.001 file - promoters60/1023891
aaaagaaa

SEQ ID NO: 44227 - DNA, 12 bp, Unknown
  misc_feature (1)..( 12): Matrix.001 file - promoters60/1023891
agtcaacaaaag

SEQ ID NO: 44228 - DNA, 6 bp, Unknown
  misc_feature (1)..( 6): Matrix.001 file - promoters60/1023891
gtaacg

SEQ ID NO: 44229 - DNA, 9 bp, Unknown
  misc_feature (1)..( 9): Matrix.001 file - promoters60/1023891
ctttatata

SEQ ID NO: 44230 - DNA, 6 bp, Unknown
  misc_feature (1)..( 6): Matrix.001 file - promoters60/1023891
aaaaac

SEQ ID NO: 44231 - DNA, 7 bp, Unknown
  misc_feature (1)..( 7): Matrix.001 file - promoters60/1023891
aaaatca

SEQ ID NO: 44232 - DNA, 8 bp, Unknown
  misc_feature (1)..( 8): Matrix.001 file - promoters60/1023891
cattcaaa

SEQ ID NO: 44233 - DNA, 7 bp, Unknown
  misc_feature (1)..( 7): Matrix.001 file - promoters60/1023891
attcatt

SEQ ID NO: 44234 - DNA, 6 bp, Unknown
  misc_feature (1)..( 6): Matrix.001 file - promoters60/1023891
actaaa

SEQ ID NO: 44235 - DNA, 10 bp, Unknown
  misc_feature (1)..( 10): Matrix.001 file - promoters60/1023891
aaaattttaa

SEQ ID NO: 44236 - DNA, 6 bp, Unknown
  misc_feature (1)..( 6): Matrix.001 file - promoters60/1023891
aatgtc

SEQ ID NO: 44237 - DNA, 6 bp, Unknown
  misc_feature (1)..( 6): Matrix.001 file - promoters60/1023891
tagaat

SEQ ID NO: 44238 - DNA, 11 bp, Unknown
  misc_feature (1)..( 11): Matrix.001 file - promoters60/1023891
ataagagaaga

SEQ ID NO: 44239 - DNA, 6 bp, Unknown
  misc_feature (1)..( 6): Matrix.001 file - promoters60/1023891
aaaaag

SEQ ID NO: 44240 - DNA, 6 bp, Unknown
  misc_feature (1)..( 6): Matrix.001 file - promoters60/1023891
acacaa

SEQ ID NO: 44241 - DNA, 6 bp, Unknown
  misc_feature (1)..( 6): Matrix.001 file - promoters60/1023891
tgtcac

SEQ ID NO: 44242 - DNA, 6 bp, Unknown
  misc_feature (1)..( 6): Matrix.001 file - promoters60/1023891
acattt

SEQ ID NO: 44243 - DNA, 8 bp, Unknown
  misc_feature (1)..( 8): Matrix.001 file - promoters60/1023891
agtaacca

SEQ ID NO: 44244 - DNA, 12 bp, Unknown
  misc_feature (1)..( 12): Matrix.001 file - promoters60/1023963
gaaaacaaataa

SEQ ID NO: 44245 - DNA, 6 bp, Unknown
  misc_feature (1)..( 6): Matrix.001 file - promoters60/1023963
acatta

SEQ ID NO: 44246 - DNA, 6 bp, Unknown
  misc_feature (1)..( 6): Matrix.001 file - promoters60/1024037
ttacaa

SEQ ID NO: 44247 - DNA, 6 bp, Unknown
  misc_feature (1)..( 6): Matrix.001 file - promoters60/1024037
tattat

SEQ ID NO: 44248 - DNA, 8 bp, Unknown
  misc_feature (1)..( 8): Matrix.001 file - promoters60/1024037
aaaatctt

SEQ ID NO: 44249 - DNA, 8 bp, Unknown
  misc_feature (1)..( 8): Matrix.001 file - promoters60/1024037
atactatt

SEQ ID NO: 44250 - DNA, 7 bp, Unknown
  misc_feature (1)..( 7): Matrix.001 file - promoters60/1024037
ttaatac

SEQ ID NO: 44251 - DNA, 7 bp, Unknown
  misc_feature (1)..( 7): Matrix.001 file - promoters60/1024037
attaata

SEQ ID NO: 44252 - DNA, 11 bp, Unknown
  misc_feature (1)..( 11): Matrix.001 file - promoters60/1024037
taagtatatat

SEQ ID NO: 44253 - DNA, 6 bp, Unknown
  misc_feature (1)..( 6): Matrix.001 file - promoters60/1024037
agactt

SEQ ID NO: 44254 - DNA, 6 bp, Unknown
  misc_feature (1)..( 6): Matrix.001 file - promoters60/1024037
aagcca

SEQ ID NO: 44255 - DNA, 7 bp, Unknown
  misc_feature (1)..( 7): Matrix.001 file - promoters60/1024037
acaattt

SEQ ID NO: 44256 - DNA, 7 bp, Unknown
  misc_feature (1)..( 7): Matrix.001 file - promoters60/1024037
atgcatg

SEQ ID NO: 44257 - DNA, 7 bp, Unknown
  misc_feature (1)..( 7): Matrix.001 file - promoters60/1024037
aatttag

SEQ ID NO: 44258 - DNA, 6 bp, Unknown
  misc_feature (1)..( 6): Matrix.001 file - promoters60/1024037
gctgac

SEQ ID NO: 44259 - DNA, 7 bp, Unknown
  misc_feature (1)..( 7): Matrix.001 file - promoters60/1024037
ttcgtca

SEQ ID NO: 44260 - DNA, 6 bp, Unknown
  misc_feature (1)..( 6): Matrix.001 file - promoters60/1024037
ataaca

SEQ ID NO: 44261 - DNA, 6 bp, Unknown
  misc_feature (1)..( 6): Matrix.001 file - promoters60/1024037
tggttg

SEQ ID NO: 44262 - DNA, 4 bp, Unknown
  misc_feature (1)..( 4): Matrix.001 file - promoters60/1024060
aaat

SEQ ID NO: 44263 - DNA, 11 bp, Unknown
  misc_feature (1)..( 11): Matrix.001 file - promoters60/1024083
ttccttttttt

SEQ ID NO: 44264 - DNA, 11 bp, Unknown
  misc_feature (1)..( 11): Matrix.001 file - promoters60/1024083
attagactttt

SEQ ID NO: 44265 - DNA, 9 bp, Unknown
  misc_feature (1)..( 9): Matrix.001 file - promoters60/1024083
tagaataaa

SEQ ID NO: 44266 - DNA, 8 bp, Unknown
  misc_feature (1)..( 8): Matrix.001 file - promoters60/1024083
aaaattaa

SEQ ID NO: 44267 - DNA, 6 bp, Unknown
  misc_feature (1)..( 6): Matrix.001 file - promoters60/1024083
acattt

SEQ ID NO: 44268 - DNA, 7 bp, Unknown
  misc_feature (1)..( 7): Matrix.001 file - promoters60/1024083
atttaca

SEQ ID NO: 44269 - DNA, 7 bp, Unknown
  misc_feature (1)..( 7): Matrix.001 file - promoters60/1024083
tttaaaa

SEQ ID NO: 44270 - DNA, 6 bp, Unknown
  misc_feature (1)..( 6): Matrix.001 file - promoters60/1024083
agtttg

SEQ ID NO: 44271 - DNA, 7 bp, Unknown
  misc_feature (1)..( 7): Matrix.001 file - promoters60/1024083
attaata

SEQ ID NO: 44272 - DNA, 6 bp, Unknown
  misc_feature (1)..( 6): Matrix.001 file - promoters60/1024083
tctttt

SEQ ID NO: 44273 - DNA, 8 bp, Unknown
  misc_feature (1)..( 8): Matrix.001 file - promoters60/1024083
atattttt

SEQ ID NO: 44274 - DNA, 6 bp, Unknown
  misc_feature (1)..( 6): Matrix.001 file - promoters60/1024083
acaaaa

SEQ ID NO: 44275 - DNA, 8 bp, Unknown
  misc_feature (1)..( 8): Matrix.001 file - promoters60/1024083
ttatcctt

SEQ ID NO: 44276 - DNA, 7 bp, Unknown
  misc_feature (1)..( 7): Matrix.001 file - promoters60/1024083
attctat

SEQ ID NO: 44277 - DNA, 7 bp, Unknown
  misc_feature (1)..( 7): Matrix.001 file - promoters60/1024083
aaaacaa

SEQ ID NO: 44278 - DNA, 7 bp, Unknown
  misc_feature (1)..( 7): Matrix.001 file - promoters60/1024083
atagtta

SEQ ID NO: 44279 - DNA, 8 bp, Unknown
  misc_feature (1)..( 8): Matrix.001 file - promoters60/1024083
ttacttat

SEQ ID NO: 44280 - DNA, 7 bp, Unknown
  misc_feature (1)..( 7): Matrix.001 file - promoters60/1024083
attagaa

SEQ ID NO: 44281 - DNA, 6 bp, Unknown
  misc_feature (1)..( 6): Matrix.001 file - promoters60/1024083
tttgat

SEQ ID NO: 44282 - DNA, 6 bp, Unknown
  misc_feature (1)..( 6): Matrix.001 file - promoters60/1024083
attttg

SEQ ID NO: 44283 - DNA, 6 bp, Unknown
  misc_feature (1)..( 6): Matrix.001 file - promoters60/1024083
aaaaat

SEQ ID NO: 44284 - DNA, 6 bp, Unknown
  misc_feature (1)..( 6): Matrix.001 file - promoters60/1024083
ggtctc

SEQ ID NO: 44285 - DNA, 8 bp, Unknown
  misc_feature (1)..( 8): Matrix.001 file - promoters60/1024083
taaaatcc

SEQ ID NO: 44286 - DNA, 9 bp, Unknown
  misc_feature (1)..( 9): Matrix.001 file - promoters60/1024126
ataatcaat

SEQ ID NO: 44287 - DNA, 8 bp, Unknown
  misc_feature (1)..( 8): Matrix.001 file - promoters60/1024126
aaaaaaga

SEQ ID NO: 44288 - DNA, 9 bp, Unknown
  misc_feature (1)..( 9): Matrix.001 file - promoters60/1024126
aaaacacaa

SEQ ID NO: 44289 - DNA, 9 bp, Unknown
  misc_feature (1)..( 9): Matrix.001 file - promoters60/1024145
gagcgatga

SEQ ID NO: 44290 - DNA, 7 bp, Unknown
  misc_feature (1)..( 7): Matrix.001 file - promoters60/1024145
tgaaaga

SEQ ID NO: 44291 - DNA, 8 bp, Unknown
  misc_feature (1)..( 8): Matrix.001 file - promoters60/1024145
aaatctaa

SEQ ID NO: 44292 - DNA, 6 bp, Unknown
  misc_feature (1)..( 6): Matrix.001 file - promoters60/1024145
ccggtt

SEQ ID NO: 44293 - DNA, 11 bp, Unknown
  misc_feature (1)..( 11): Matrix.001 file - promoters60/1024145
tctggtcaaac

SEQ ID NO: 44294 - DNA, 6 bp, Unknown
  misc_feature (1)..( 6): Matrix.001 file - promoters60/1024145
attatt

SEQ ID NO: 44295 - DNA, 8 bp, Unknown
  misc_feature (1)..( 8): Matrix.001 file - promoters60/1024145
gtgacaaa

SEQ ID NO: 44296 - DNA, 7 bp, Unknown
  misc_feature (1)..( 7): Matrix.001 file - promoters60/1024145
attcttt

SEQ ID NO: 44297 - DNA, 8 bp, Unknown
  misc_feature (1)..( 8): Matrix.001 file - promoters60/1024145
gtttccct

SEQ ID NO: 44298 - DNA, 11 bp, Unknown
  misc_feature (1)..( 11): Matrix.001 file - promoters60/1024166
ataacaaaaaa

SEQ ID NO: 44299 - DNA, 10 bp, Unknown
  misc_feature (1)..( 10): Matrix.001 file - promoters60/1024166
atcaataaac

SEQ ID NO: 44300 - DNA, 7 bp, Unknown
  misc_feature (1)..( 7): Matrix.001 file - promoters60/1024166
atttatg

SEQ ID NO: 44301 - DNA, 10 bp, Unknown
  misc_feature (1)..( 10): Matrix.001 file - promoters60/1024189
taaaaaggaa

SEQ ID NO: 44302 - DNA, 7 bp, Unknown
  misc_feature (1)..( 7): Matrix.001 file - promoters60/1024189
atataat

SEQ ID NO: 44303 - DNA, 8 bp, Unknown
  misc_feature (1)..( 8): Matrix.001 file - promoters60/1024189
taaatata

SEQ ID NO: 44304 - DNA, 11 bp, Unknown
  misc_feature (1)..( 11): Matrix.001 file - promoters60/1024189
ataaaattaat

SEQ ID NO: 44305 - DNA, 6 bp, Unknown
  misc_feature (1)..( 6): Matrix.001 file - promoters60/1024189
aaatat

SEQ ID NO: 44306 - DNA, 12 bp, Unknown
  misc_feature (1)..( 12): Matrix.001 file - promoters60/1024189
ttttgtaaacaa

SEQ ID NO: 44307 - DNA, 8 bp, Unknown
  misc_feature (1)..( 8): Matrix.001 file - promoters60/1024189
aaatttat

SEQ ID NO: 44308 - DNA, 8 bp, Unknown
  misc_feature (1)..( 8): Matrix.001 file - promoters60/1024189
aatcaaaa

SEQ ID NO: 44309 - DNA, 11 bp, Unknown
  misc_feature (1)..( 11): Matrix.001 file - promoters60/1024189
aaaaacacgaa

SEQ ID NO: 44310 - DNA, 10 bp, Unknown
  misc_feature (1)..( 10): Matrix.001 file - promoters60/1024189
gaccaaaaat

SEQ ID NO: 44311 - DNA, 8 bp, Unknown
  misc_feature (1)..( 8): Matrix.001 file - promoters60/1024189
atataata

SEQ ID NO: 44312 - DNA, 10 bp, Unknown
  misc_feature (1)..( 10): Matrix.001 file - promoters60/1024199
aaataaaaca

SEQ ID NO: 44313 - DNA, 7 bp, Unknown
  misc_feature (1)..( 7): Matrix.001 file - promoters60/1024203
aggagag

SEQ ID NO: 44314 - DNA, 6 bp, Unknown
  misc_feature (1)..( 6): Matrix.001 file - promoters60/1024203
aagaag

SEQ ID NO: 44315 - DNA, 7 bp, Unknown
  misc_feature (1)..( 7): Matrix.001 file - promoters60/1024203
gtggtca

SEQ ID NO: 44316 - DNA, 9 bp, Unknown
  misc_feature (1)..( 9): Matrix.001 file - promoters60/1024203
agaaaagac

SEQ ID NO: 44317 - DNA, 9 bp, Unknown
  misc_feature (1)..( 9): Matrix.001 file - promoters60/1024203
aacacggga

SEQ ID NO: 44318 - DNA, 6 bp, Unknown
  misc_feature (1)..( 6): Matrix.001 file - promoters60/1024203
gaacac

SEQ ID NO: 44319 - DNA, 7 bp, Unknown
  misc_feature (1)..( 7): Matrix.001 file - promoters60/1024203
gaatgaa

SEQ ID NO: 44320 - DNA, 8 bp, Unknown
  misc_feature (1)..( 8): Matrix.001 file - promoters60/1024203
ccatatac

SEQ ID NO: 44321 - DNA, 8 bp, Unknown
  misc_feature (1)..( 8): Matrix.001 file - promoters60/1024203
ctctctcg

SEQ ID NO: 44322 - DNA, 7 bp, Unknown
  misc_feature (1)..( 7): Matrix.001 file - promoters60/1024203
acaagcg

SEQ ID NO: 44323 - DNA, 7 bp, Unknown
  misc_feature (1)..( 7): Matrix.001 file - promoters60/1024203
tcgatga

SEQ ID NO: 44324 - DNA, 7 bp, Unknown
  misc_feature (1)..( 7): Matrix.001 file - promoters60/1024203
gaagtca

SEQ ID NO: 44325 - DNA, 6 bp, Unknown
  misc_feature (1)..( 6): Matrix.001 file - promoters60/1024203
tgttct

SEQ ID NO: 44326 - DNA, 9 bp, Unknown
  misc_feature (1)..( 9): Matrix.001 file - promoters60/1024214
aattgattt

SEQ ID NO: 44327 - DNA, 9 bp, Unknown
  misc_feature (1)..( 9): Matrix.001 file - promoters60/1024214
aattgattt

SEQ ID NO: 44328 - DNA, 8 bp, Unknown
  misc_feature (1)..( 8): Matrix.001 file - promoters60/1024214
attgattt

SEQ ID NO: 44329 - DNA, 8 bp, Unknown
  misc_feature (1)..( 8): Matrix.001 file - promoters60/1024234
caaaaatt

SEQ ID NO: 44330 - DNA, 19 bp, Unknown
  misc_feature (1)..( 19): Matrix.001 file - promoters60/1024234
atagaacaaaaattataca

SEQ ID NO: 44331 - DNA, 9 bp, Unknown
  misc_feature (1)..( 9): Matrix.001 file - promoters60/1024234
ttagatatg

SEQ ID NO: 44332 - DNA, 16 bp, Unknown
  misc_feature (1)..( 16): Matrix.001 file - promoters60/1024234
caatttgaaagaaaac

SEQ ID NO: 44333 - DNA, 9 bp, Unknown
  misc_feature (1)..( 9): Matrix.001 file - promoters60/1024234
ccggttcga

SEQ ID NO: 44334 - DNA, 9 bp, Unknown
  misc_feature (1)..( 9): Matrix.001 file - promoters60/1024234
tctaacagt

SEQ ID NO: 44335 - DNA, 9 bp, Unknown
  misc_feature (1)..( 9): Matrix.001 file - promoters60/1024257
attctaaat

SEQ ID NO: 44336 - DNA, 9 bp, Unknown
  misc_feature (1)..( 9): Matrix.001 file - promoters60/1024355
ctatactct

SEQ ID NO: 44337 - DNA, 6 bp, Unknown
  misc_feature (1)..( 6): Matrix.001 file - promoters60/1024355
tactcg

SEQ ID NO: 44338 - DNA, 7 bp, Unknown
  misc_feature (1)..( 7): Matrix.001 file - promoters60/1024355
tgagctc

SEQ ID NO: 44339 - DNA, 7 bp, Unknown
  misc_feature (1)..( 7): Matrix.001 file - promoters60/1024355
aaactaa

SEQ ID NO: 44340 - DNA, 6 bp, Unknown
  misc_feature (1)..( 6): Matrix.001 file - promoters60/1024355
ttaatc

SEQ ID NO: 44341 - DNA, 6 bp, Unknown
  misc_feature (1)..( 6): Matrix.001 file - promoters60/1024355
gattta

SEQ ID NO: 44342 - DNA, 6 bp, Unknown
  misc_feature (1)..( 6): Matrix.001 file - promoters60/1024355
atcttt

SEQ ID NO: 44343 - DNA, 8 bp, Unknown
  misc_feature (1)..( 8): Matrix.001 file - promoters60/1024355
atactaaa

SEQ ID NO: 44344 - DNA, 6 bp, Unknown
  misc_feature (1)..( 6): Matrix.001 file - promoters60/1024355
aaagcg

SEQ ID NO: 44345 - DNA, 8 bp, Unknown
  misc_feature (1)..( 8): Matrix.001 file - promoters60/1024355
aagaagct

SEQ ID NO: 44346 - DNA, 6 bp, Unknown
  misc_feature (1)..( 6): Matrix.001 file - promoters60/1024355
acttcc

SEQ ID NO: 44347 - DNA, 7 bp, Unknown
  misc_feature (1)..( 7): Matrix.001 file - promoters60/1024355
caccctc

SEQ ID NO: 44348 - DNA, 6 bp, Unknown
  misc_feature (1)..( 6): Matrix.001 file - promoters60/1024355
gattaa

SEQ ID NO: 44349 - DNA, 6 bp, Unknown
  misc_feature (1)..( 6): Matrix.001 file - promoters60/1024355
tttgat

SEQ ID NO: 44350 - DNA, 8 bp, Unknown
  misc_feature (1)..( 8): Matrix.001 file - promoters60/1024355
cttcatat

SEQ ID NO: 44351 - DNA, 8 bp, Unknown
  misc_feature (1)..( 8): Matrix.001 file - promoters60/1024355
attgttca

SEQ ID NO: 44352 - DNA, 8 bp, Unknown
  misc_feature (1)..( 8): Matrix.001 file - promoters60/1024355
tttaacaa

SEQ ID NO: 44353 - DNA, 11 bp, Unknown
  misc_feature (1)..( 11): Matrix.001 file - promoters60/1024367
taaaataaaag

SEQ ID NO: 44354 - DNA, 12 bp, Unknown
  misc_feature (1)..( 12): Matrix.001 file - promoters60/1024367
ccactatatata

SEQ ID NO: 44355 - DNA, 12 bp, Unknown
  misc_feature (1)..( 12): Matrix.001 file - promoters60/1024367
aaataaaataaa

SEQ ID NO: 44356 - DNA, 10 bp, Unknown
  misc_feature (1)..( 10): Matrix.001 file - promoters60/1024367
ataagtttga

SEQ ID NO: 44357 - DNA, 10 bp, Unknown
  misc_feature (1)..( 10): Matrix.001 file - promoters60/1024367
ataaacaaaa

SEQ ID NO: 44358 - DNA, 8 bp, Unknown
  misc_feature (1)..( 8): Matrix.001 file - promoters60/1024375
atgtaaat

SEQ ID NO: 44359 - DNA, 9 bp, Unknown
  misc_feature (1)..( 9): Matrix.001 file - promoters60/1024375
cagtgaaag

SEQ ID NO: 44360 - DNA, 7 bp, Unknown
  misc_feature (1)..( 7): Matrix.001 file - promoters60/1024375
taaacat

SEQ ID NO: 44361 - DNA, 7 bp, Unknown
  misc_feature (1)..( 7): Matrix.001 file - promoters60/1024375
aaattat

SEQ ID NO: 44362 - DNA, 11 bp, Unknown
  misc_feature (1)..( 11): Matrix.001 file - promoters60/1024375
agtgaaagcaa

SEQ ID NO: 44363 - DNA, 8 bp, Unknown
  misc_feature (1)..( 8): Matrix.001 file - promoters60/1024375
aatttgtt

SEQ ID NO: 44364 - DNA, 9 bp, Unknown
  misc_feature (1)..( 9): Matrix.001 file - promoters60/1024375
atatataaa

SEQ ID NO: 44365 - DNA, 8 bp, Unknown
  misc_feature (1)..( 8): Matrix.001 file - promoters60/1024375
ttgaaaca

SEQ ID NO: 44366 - DNA, 9 bp, Unknown
  misc_feature (1)..( 9): Matrix.001 file - promoters60/1024375
aagaaaaaa

SEQ ID NO: 44367 - DNA, 8 bp, Unknown
  misc_feature (1)..( 8): Matrix.001 file - promoters60/1024392
tttataaa

SEQ ID NO: 44368 - DNA, 6 bp, Unknown
  misc_feature (1)..( 6): Matrix.001 file - promoters60/1024431
ttttta

SEQ ID NO: 44369 - DNA, 6 bp, Unknown
  misc_feature (1)..( 6): Matrix.001 file - promoters60/1024431
ataatt

SEQ ID NO: 44370 - DNA, 7 bp, Unknown
  misc_feature (1)..( 7): Matrix.001 file - promoters60/1024431
tttcctt

SEQ ID NO: 44371 - DNA, 7 bp, Unknown
  misc_feature (1)..( 7): Matrix.001 file - promoters60/1024431
aaaagac

SEQ ID NO: 44372 - DNA, 6 bp, Unknown
  misc_feature (1)..( 6): Matrix.001 file - promoters60/1024431
aaactg

SEQ ID NO: 44373 - DNA, 15 bp, Unknown
  misc_feature (1)..( 15): Matrix.001 file - promoters60/1024431
aatacctcatttata

SEQ ID NO: 44374 - DNA, 8 bp, Unknown
  misc_feature (1)..( 8): Matrix.001 file - promoters60/1024431
ttcaaaac

SEQ ID NO: 44375 - DNA, 11 bp, Unknown
  misc_feature (1)..( 11): Matrix.001 file - promoters60/1024431
aaataaatcac

SEQ ID NO: 44376 - DNA, 6 bp, Unknown
  misc_feature (1)..( 6): Matrix.001 file - promoters60/1024431
tactaa

SEQ ID NO: 44377 - DNA, 7 bp, Unknown
  misc_feature (1)..( 7): Matrix.001 file - promoters60/1024431
aaaacaa

SEQ ID NO: 44378 - DNA, 6 bp, Unknown
  misc_feature (1)..( 6): Matrix.001 file - promoters60/1024431
atattc

SEQ ID NO: 44379 - DNA, 6 bp, Unknown
  misc_feature (1)..( 6): Matrix.001 file - promoters60/1024431
tgtaaa

SEQ ID NO: 44380 - DNA, 6 bp, Unknown
  misc_feature (1)..( 6): Matrix.001 file - promoters60/1024431
attaat

SEQ ID NO: 44381 - DNA, 10 bp, Unknown
  misc_feature (1)..( 10): Matrix.001 file - promoters60/1024431
attaatattg

SEQ ID NO: 44382 - DNA, 8 bp, Unknown
  misc_feature (1)..( 8): Matrix.001 file - promoters60/1024431
taaaaaaa

SEQ ID NO: 44383 - DNA, 7 bp, Unknown
  misc_feature (1)..( 7): Matrix.001 file - promoters60/1024431
acattat

SEQ ID NO: 44384 - DNA, 7 bp, Unknown
  misc_feature (1)..( 7): Matrix.001 file - promoters60/1024431
ttacagt

SEQ ID NO: 44385 - DNA, 11 bp, Unknown
  misc_feature (1)..( 11): Matrix.001 file - promoters60/1024431
gttattaaaaa

SEQ ID NO: 44386 - DNA, 13 bp, Unknown
  misc_feature (1)..( 13): Matrix.001 file - promoters60/1024499
aaaatattttttt

SEQ ID NO: 44387 - DNA, 13 bp, Unknown
  misc_feature (1)..( 13): Matrix.001 file - promoters60/1024499
tatatataaataa

SEQ ID NO: 44388 - DNA, 10 bp, Unknown
  misc_feature (1)..( 10): Matrix.001 file - promoters60/1024499
aacattaata

SEQ ID NO: 44389 - DNA, 10 bp, Unknown
  misc_feature (1)..( 10): Matrix.001 file - promoters60/1024562
aggcccaatt

SEQ ID NO: 44390 - DNA, 10 bp, Unknown
  misc_feature (1)..( 10): Matrix.001 file - promoters60/1024562
taacaacaga

SEQ ID NO: 44391 - DNA, 8 bp, Unknown
  misc_feature (1)..( 8): Matrix.001 file - promoters60/1024562
gaagcttt

SEQ ID NO: 44392 - DNA, 13 bp, Unknown
  misc_feature (1)..( 13): Matrix.001 file - promoters60/1024562
tagaaaaaaacaa

SEQ ID NO: 44393 - DNA, 10 bp, Unknown
  misc_feature (1)..( 10): Matrix.001 file - promoters60/1024611
tcaaaagagc

SEQ ID NO: 44394 - DNA, 6 bp, Unknown
  misc_feature (1)..( 6): Matrix.001 file - promoters60/1024611
atgaaa

SEQ ID NO: 44395 - DNA, 8 bp, Unknown
  misc_feature (1)..( 8): Matrix.001 file - promoters60/1024611
ttgaaaca

SEQ ID NO: 44396 - DNA, 6 bp, Unknown
  misc_feature (1)..( 6): Matrix.001 file - promoters60/1024611
aagact

SEQ ID NO: 44397 - DNA, 7 bp, Unknown
  misc_feature (1)..( 7): Matrix.001 file - promoters60/1024611
agacaaa

SEQ ID NO: 44398 - DNA, 7 bp, Unknown
  misc_feature (1)..( 7): Matrix.001 file - promoters60/1024611
ctaatcc

SEQ ID NO: 44399 - DNA, 6 bp, Unknown
  misc_feature (1)..( 6): Matrix.001 file - promoters60/1024611
gaaagt

SEQ ID NO: 44400 - DNA, 7 bp, Unknown
  misc_feature (1)..( 7): Matrix.001 file - promoters60/1024611
tacctga

SEQ ID NO: 44401 - DNA, 7 bp, Unknown
  misc_feature (1)..( 7): Matrix.001 file - promoters60/1024611
atgctaa

SEQ ID NO: 44402 - DNA, 8 bp, Unknown
  misc_feature (1)..( 8): Matrix.001 file - promoters60/1024611
cggaaatt

SEQ ID NO: 44403 - DNA, 10 bp, Unknown
  misc_feature (1)..( 10): Matrix.001 file - promoters60/1024611
tttgttttgt

SEQ ID NO: 44404 - DNA, 6 bp, Unknown
  misc_feature (1)..( 6): Matrix.001 file - promoters60/1024611
aaagaa

SEQ ID NO: 44405 - DNA, 7 bp, Unknown
  misc_feature (1)..( 7): Matrix.001 file - promoters60/1024611
tagagaa

SEQ ID NO: 44406 - DNA, 7 bp, Unknown
  misc_feature (1)..( 7): Matrix.001 file - promoters60/1024611
aaggaga

SEQ ID NO: 44407 - DNA, 7 bp, Unknown
  misc_feature (1)..( 7): Matrix.001 file - promoters60/1024611
aaagaag

SEQ ID NO: 44408 - DNA, 6 bp, Unknown
  misc_feature (1)..( 6): Matrix.001 file - promoters60/1024611
caacac

SEQ ID NO: 44409 - DNA, 6 bp, Unknown
  misc_feature (1)..( 6): Matrix.001 file - promoters60/1024611
ttgaag

SEQ ID NO: 44410 - DNA, 7 bp, Unknown
  misc_feature (1)..( 7): Matrix.001 file - promoters60/1024611
ctccatt

SEQ ID NO: 44411 - DNA, 7 bp, Unknown
  misc_feature (1)..( 7): Matrix.001 file - promoters60/1024662
ataaaaa

SEQ ID NO: 44412 - DNA, 9 bp, Unknown
  misc_feature (1)..( 9): Matrix.001 file - promoters60/1024713
gaaatttgc

SEQ ID NO: 44413 - DNA, 7 bp, Unknown
  misc_feature (1)..( 7): Matrix.001 file - promoters60/1024713
ttgataa

SEQ ID NO: 44414 - DNA, 6 bp, Unknown
  misc_feature (1)..( 6): Matrix.001 file - promoters60/1024713
gtatat

SEQ ID NO: 44415 - DNA, 8 bp, Unknown
  misc_feature (1)..( 8): Matrix.001 file - promoters60/1024713
acaaaagt

SEQ ID NO: 44416 - DNA, 8 bp, Unknown
  misc_feature (1)..( 8): Matrix.001 file - promoters60/1024713
aaaacgtt

SEQ ID NO: 44417 - DNA, 11 bp, Unknown
  misc_feature (1)..( 11): Matrix.001 file - promoters60/1024713
gaaatttgctt

SEQ ID NO: 44418 - DNA, 10 bp, Unknown
  misc_feature (1)..( 10): Matrix.001 file - promoters60/1024713
aaatttgttt

SEQ ID NO: 44419 - DNA, 6 bp, Unknown
  misc_feature (1)..( 6): Matrix.001 file - promoters60/1024713
accttt

SEQ ID NO: 44420 - DNA, 7 bp, Unknown
  misc_feature (1)..( 7): Matrix.001 file - promoters60/1024713
tggatca

SEQ ID NO: 44421 - DNA, 6 bp, Unknown
  misc_feature (1)..( 6): Matrix.001 file - promoters60/1024713
tatttt

SEQ ID NO: 44422 - DNA, 6 bp, Unknown
  misc_feature (1)..( 6): Matrix.001 file - promoters60/1024713
tttggt

SEQ ID NO: 44423 - DNA, 7 bp, Unknown
  misc_feature (1)..( 7): Matrix.001 file - promoters60/1024713
ctgtatc

SEQ ID NO: 44424 - DNA, 7 bp, Unknown
  misc_feature (1)..( 7): Matrix.001 file - promoters60/1024713
tctctga

SEQ ID NO: 44425 - DNA, 9 bp, Unknown
  misc_feature (1)..( 9): Matrix.001 file - promoters60/1024713
tccataaat

SEQ ID NO: 44426 - DNA, 8 bp, Unknown
  misc_feature (1)..( 8): Matrix.001 file - promoters60/1024713
aatctgat

SEQ ID NO: 44427 - DNA, 6 bp, Unknown
  misc_feature (1)..( 6): Matrix.001 file - promoters60/1024713
gaaaaa

SEQ ID NO: 44428 - DNA, 6 bp, Unknown
  misc_feature (1)..( 6): Matrix.001 file - promoters60/1024713
aacctt

SEQ ID NO: 44429 - DNA, 8 bp, Unknown
  misc_feature (1)..( 8): Matrix.001 file - promoters60/1024713
ggtaggaa

SEQ ID NO: 44430 - DNA, 7 bp, Unknown
  misc_feature (1)..( 7): Matrix.001 file - promoters60/1024737
attaaaa

SEQ ID NO: 44431 - DNA, 6 bp, Unknown
  misc_feature (1)..( 6): Matrix.001 file - promoters60/1024737
tattta

SEQ ID NO: 44432 - DNA, 7 bp, Unknown
  misc_feature (1)..( 7): Matrix.001 file - promoters60/1024737
gatattc

SEQ ID NO: 44433 - DNA, 6 bp, Unknown
  misc_feature (1)..( 6): Matrix.001 file - promoters60/1024737
aaaaca

SEQ ID NO: 44434 - DNA, 10 bp, Unknown
  misc_feature (1)..( 10): Matrix.001 file - promoters60/1024737
agaaaaaaaa

SEQ ID NO: 44435 - DNA, 6 bp, Unknown
  misc_feature (1)..( 6): Matrix.001 file - promoters60/1024737
ataata

SEQ ID NO: 44436 - DNA, 7 bp, Unknown
  misc_feature (1)..( 7): Matrix.001 file - promoters60/1024737
aaacaca

SEQ ID NO: 44437 - DNA, 7 bp, Unknown
  misc_feature (1)..( 7): Matrix.001 file - promoters60/1024737
actatag

SEQ ID NO: 44438 - DNA, 6 bp, Unknown
  misc_feature (1)..( 6): Matrix.001 file - promoters60/1024737
actata

SEQ ID NO: 44439 - DNA, 7 bp, Unknown
  misc_feature (1)..( 7): Matrix.001 file - promoters60/1024737
acagtta

SEQ ID NO: 44440 - DNA, 6 bp, Unknown
  misc_feature (1)..( 6): Matrix.001 file - promoters60/1024737
ttaatc

SEQ ID NO: 44441 - DNA, 8 bp, Unknown
  misc_feature (1)..( 8): Matrix.001 file - promoters60/1024737
tacaaaaa

SEQ ID NO: 44442 - DNA, 6 bp, Unknown
  misc_feature (1)..( 6): Matrix.001 file - promoters60/1024737
aattat

SEQ ID NO: 44443 - DNA, 7 bp, Unknown
  misc_feature (1)..( 7): Matrix.001 file - promoters60/1024737
taaacac

SEQ ID NO: 44444 - DNA, 6 bp, Unknown
  misc_feature (1)..( 6): Matrix.001 file - promoters60/1024737
caaaac

SEQ ID NO: 44445 - DNA, 8 bp, Unknown
  misc_feature (1)..( 8): Matrix.001 file - promoters60/1024737
tacaattt

SEQ ID NO: 44446 - DNA, 9 bp, Unknown
  misc_feature (1)..( 9): Matrix.001 file - promoters60/1024737
cagcttttt

SEQ ID NO: 44447 - DNA, 6 bp, Unknown
  misc_feature (1)..( 6): Matrix.001 file - promoters60/1024737
acaact

SEQ ID NO: 44448 - DNA, 7 bp, Unknown
  misc_feature (1)..( 7): Matrix.001 file - promoters60/1024737
tttctaa

SEQ ID NO: 44449 - DNA, 6 bp, Unknown
  misc_feature (1)..( 6): Matrix.001 file - promoters60/1024737
ctccaa

SEQ ID NO: 44450 - DNA, 7 bp, Unknown
  misc_feature (1)..( 7): Matrix.001 file - promoters60/1024737
tacaatt

SEQ ID NO: 44451 - DNA, 7 bp, Unknown
  misc_feature (1)..( 7): Matrix.001 file - promoters60/1024737
acataaa

SEQ ID NO: 44452 - DNA, 7 bp, Unknown
  misc_feature (1)..( 7): Matrix.001 file - promoters60/1024737
aaacttt

SEQ ID NO: 44453 - DNA, 6 bp, Unknown
  misc_feature (1)..( 6): Matrix.001 file - promoters60/1024737
taaata

SEQ ID NO: 44454 - DNA, 9 bp, Unknown
  misc_feature (1)..( 9): Matrix.001 file - promoters60/1024756
ataattttt

SEQ ID NO: 44455 - DNA, 13 bp, Unknown
  misc_feature (1)..( 13): Matrix.001 file - promoters60/1024756
taaaagtcaaaaa

SEQ ID NO: 44456 - DNA, 9 bp, Unknown
  misc_feature (1)..( 9): Matrix.001 file - promoters60/1024756
ttaccaaag

SEQ ID NO: 44457 - DNA, 8 bp, Unknown
  misc_feature (1)..( 8): Matrix.001 file - promoters60/1024840
gataacat

SEQ ID NO: 44458 - DNA, 7 bp, Unknown
  misc_feature (1)..( 7): Matrix.001 file - promoters60/1024840
acaactt

SEQ ID NO: 44459 - DNA, 8 bp, Unknown
  misc_feature (1)..( 8): Matrix.001 file - promoters60/1024840
ttcctttg

SEQ ID NO: 44460 - DNA, 6 bp, Unknown
  misc_feature (1)..( 6): Matrix.001 file - promoters60/1024840
aaaaca

SEQ ID NO: 44461 - DNA, 7 bp, Unknown
  misc_feature (1)..( 7): Matrix.001 file - promoters60/1024840
cataaga

SEQ ID NO: 44462 - DNA, 8 bp, Unknown
  misc_feature (1)..( 8): Matrix.001 file - promoters60/1024840
gaataaag

SEQ ID NO: 44463 - DNA, 7 bp, Unknown
  misc_feature (1)..( 7): Matrix.001 file - promoters60/1024840
aaaatca

SEQ ID NO: 44464 - DNA, 7 bp, Unknown
  misc_feature (1)..( 7): Matrix.001 file - promoters60/1024840
taataat

SEQ ID NO: 44465 - DNA, 10 bp, Unknown
  misc_feature (1)..( 10): Matrix.001 file - promoters60/1024840
tttatacaaa

SEQ ID NO: 44466 - DNA, 8 bp, Unknown
  misc_feature (1)..( 8): Matrix.001 file - promoters60/1024840
aaaataaa

SEQ ID NO: 44467 - DNA, 7 bp, Unknown
  misc_feature (1)..( 7): Matrix.001 file - promoters60/1024840
aataatg

SEQ ID NO: 44468 - DNA, 7 bp, Unknown
  misc_feature (1)..( 7): Matrix.001 file - promoters60/1024840
taaattg

SEQ ID NO: 44469 - DNA, 7 bp, Unknown
  misc_feature (1)..( 7): Matrix.001 file - promoters60/1024840
ctaaaaa

SEQ ID NO: 44470 - DNA, 6 bp, Unknown
  misc_feature (1)..( 6): Matrix.001 file - promoters60/1024840
aagtaa

SEQ ID NO: 44471 - DNA, 6 bp, Unknown
  misc_feature (1)..( 6): Matrix.001 file - promoters60/1024840
cattta

SEQ ID NO: 44472 - DNA, 8 bp, Unknown
  misc_feature (1)..( 8): Matrix.001 file - promoters60/1024840
aaaaagaa

SEQ ID NO: 44473 - DNA, 9 bp, Unknown
  misc_feature (1)..( 9): Matrix.001 file - promoters60/1024840
acatgaacg

SEQ ID NO: 44474 - DNA, 10 bp, Unknown
  misc_feature (1)..( 10): Matrix.001 file - promoters60/1024889
gttaaagatt

SEQ ID NO: 44475 - DNA, 9 bp, Unknown
  misc_feature (1)..( 9): Matrix.001 file - promoters60/1024889
aaacaaaat

SEQ ID NO: 44476 - DNA, 9 bp, Unknown
  misc_feature (1)..( 9): Matrix.001 file - promoters60/1024889
tttgtttgg

SEQ ID NO: 44477 - DNA, 10 bp, Unknown
  misc_feature (1)..( 10): Matrix.001 file - promoters60/1024889
caagtttaaa

SEQ ID NO: 44478 - DNA, 9 bp, Unknown
  misc_feature (1)..( 9): Matrix.001 file - promoters60/1024889
ccaatattt

SEQ ID NO: 44479 - DNA, 9 bp, Unknown
  misc_feature (1)..( 9): Matrix.001 file - promoters60/1024940
aaagtaaat

SEQ ID NO: 44480 - DNA, 8 bp, Unknown
  misc_feature (1)..( 8): Matrix.001 file - promoters60/1024940
aaatatat

SEQ ID NO: 44481 - DNA, 7 bp, Unknown
  misc_feature (1)..( 7): Matrix.001 file - promoters60/1024961
aaacaat

SEQ ID NO: 44482 - DNA, 7 bp, Unknown
  misc_feature (1)..( 7): Matrix.001 file - promoters60/1024961
ataattg

SEQ ID NO: 44483 - DNA, 14 bp, Unknown
  misc_feature (1)..( 14): Matrix.001 file - promoters60/1024961
cttggttttgcttg

SEQ ID NO: 44484 - DNA, 7 bp, Unknown
  misc_feature (1)..( 7): Matrix.001 file - promoters60/1024961
aaaaaag

SEQ ID NO: 44485 - DNA, 6 bp, Unknown
  misc_feature (1)..( 6): Matrix.001 file - promoters60/1024961
gagttt

SEQ ID NO: 44486 - DNA, 8 bp, Unknown
  misc_feature (1)..( 8): Matrix.001 file - promoters60/1024961
ttctattc

SEQ ID NO: 44487 - DNA, 9 bp, Unknown
  misc_feature (1)..( 9): Matrix.001 file - promoters60/1024961
atctcactt

SEQ ID NO: 44488 - DNA, 11 bp, Unknown
  misc_feature (1)..( 11): Matrix.001 file - promoters60/1024961
agagagcatct

SEQ ID NO: 44489 - DNA, 7 bp, Unknown
  misc_feature (1)..( 7): Matrix.001 file - promoters60/1024961
agagaga

SEQ ID NO: 44490 - DNA, 7 bp, Unknown
  misc_feature (1)..( 7): Matrix.001 file - promoters60/1024961
tgagaaa

SEQ ID NO: 44491 - DNA, 6 bp, Unknown
  misc_feature (1)..( 6): Matrix.001 file - promoters60/1024961
tttcca

SEQ ID NO: 44492 - DNA, 8 bp, Unknown
  misc_feature (1)..( 8): Matrix.001 file - promoters60/1024961
aaataaat

SEQ ID NO: 44493 - DNA, 6 bp, Unknown
  misc_feature (1)..( 6): Matrix.001 file - promoters60/1024961
ttaatt

SEQ ID NO: 44494 - DNA, 6 bp, Unknown
  misc_feature (1)..( 6): Matrix.001 file - promoters60/1024961
aatttt

SEQ ID NO: 44495 - DNA, 6 bp, Unknown
  misc_feature (1)..( 6): Matrix.001 file - promoters60/1024961
ttatat

SEQ ID NO: 44496 - DNA, 7 bp, Unknown
  misc_feature (1)..( 7): Matrix.001 file - promoters60/1024961
aataaaa

SEQ ID NO: 44497 - DNA, 8 bp, Unknown
  misc_feature (1)..( 8): Matrix.001 file - promoters60/1024961
aataaata

SEQ ID NO: 44498 - DNA, 8 bp, Unknown
  misc_feature (1)..( 8): Matrix.001 file - promoters60/1024961
gaaactta

SEQ ID NO: 44499 - DNA, 8 bp, Unknown
  misc_feature (1)..( 8): Matrix.001 file - promoters60/1024961
ctttatat

SEQ ID NO: 44500 - DNA, 7 bp, Unknown
  misc_feature (1)..( 7): Matrix.001 file - promoters60/1024961
ttaaaat

SEQ ID NO: 44501 - DNA, 7 bp, Unknown
  misc_feature (1)..( 7): Matrix.001 file - promoters60/1024961
ttaaaat

SEQ ID NO: 44502 - DNA, 7 bp, Unknown
  misc_feature (1)..( 7): Matrix.001 file - promoters60/1024961
atatagc

SEQ ID NO: 44503 - DNA, 9 bp, Unknown
  misc_feature (1)..( 9): Matrix.001 file - promoters60/1024969
agaaagtag

SEQ ID NO: 44504 - DNA, 7 bp, Unknown
  misc_feature (1)..( 7): Matrix.001 file - promoters60/1024969
aaaatca

SEQ ID NO: 44505 - DNA, 8 bp, Unknown
  misc_feature (1)..( 8): Matrix.001 file - promoters60/1024969
gttactta

SEQ ID NO: 44506 - DNA, 6 bp, Unknown
  misc_feature (1)..( 6): Matrix.001 file - promoters60/1024969
gacttt

SEQ ID NO: 44507 - DNA, 8 bp, Unknown
  misc_feature (1)..( 8): Matrix.001 file - promoters60/1024969
ttaacata

SEQ ID NO: 44508 - DNA, 8 bp, Unknown
  misc_feature (1)..( 8): Matrix.001 file - promoters60/1024969
gttcttaa

SEQ ID NO: 44509 - DNA, 7 bp, Unknown
  misc_feature (1)..( 7): Matrix.001 file - promoters60/1024969
atcttct

SEQ ID NO: 44510 - DNA, 8 bp, Unknown
  misc_feature (1)..( 8): Matrix.001 file - promoters60/1024969
aaaaatat

SEQ ID NO: 44511 - DNA, 6 bp, Unknown
  misc_feature (1)..( 6): Matrix.001 file - promoters60/1024969
ggaaaa

SEQ ID NO: 44512 - DNA, 6 bp, Unknown
  misc_feature (1)..( 6): Matrix.001 file - promoters60/1024969
gatggt

SEQ ID NO: 44513 - DNA, 7 bp, Unknown
  misc_feature (1)..( 7): Matrix.001 file - promoters60/1024969
tctcttg

SEQ ID NO: 44514 - DNA, 7 bp, Unknown
  misc_feature (1)..( 7): Matrix.001 file - promoters60/1024969
tttactc

SEQ ID NO: 44515 - DNA, 7 bp, Unknown
  misc_feature (1)..( 7): Matrix.001 file - promoters60/1024969
ctgaaac

SEQ ID NO: 44516 - DNA, 8 bp, Unknown
  misc_feature (1)..( 8): Matrix.001 file - promoters60/1025087
tttttgaa

SEQ ID NO: 44517 - DNA, 8 bp, Unknown
  misc_feature (1)..( 8): Matrix.001 file - promoters60/1025087
aagttttt

SEQ ID NO: 44518 - DNA, 7 bp, Unknown
  misc_feature (1)..( 7): Matrix.001 file - promoters60/1025087
ttgaaat

SEQ ID NO: 44519 - DNA, 6 bp, Unknown
  misc_feature (1)..( 6): Matrix.001 file - promoters60/1025087
agattt

SEQ ID NO: 44520 - DNA, 9 bp, Unknown
  misc_feature (1)..( 9): Matrix.001 file - promoters60/1025087
ttcgataaa

SEQ ID NO: 44521 - DNA, 7 bp, Unknown
  misc_feature (1)..( 7): Matrix.001 file - promoters60/1025087
cttagtt

SEQ ID NO: 44522 - DNA, 9 bp, Unknown
  misc_feature (1)..( 9): Matrix.001 file - promoters60/1025087
gaaataaaa

SEQ ID NO: 44523 - DNA, 7 bp, Unknown
  misc_feature (1)..( 7): Matrix.001 file - promoters60/1025087
aaataaa

SEQ ID NO: 44524 - DNA, 6 bp, Unknown
  misc_feature (1)..( 6): Matrix.001 file - promoters60/1025087
caattt

SEQ ID NO: 44525 - DNA, 6 bp, Unknown
  misc_feature (1)..( 6): Matrix.001 file - promoters60/1025087
tctttt

SEQ ID NO: 44526 - DNA, 7 bp, Unknown
  misc_feature (1)..( 7): Matrix.001 file - promoters60/1025087
aacaatc

SEQ ID NO: 44527 - DNA, 8 bp, Unknown
  misc_feature (1)..( 8): Matrix.001 file - promoters60/1025087
aataccaa

SEQ ID NO: 44528 - DNA, 6 bp, Unknown
  misc_feature (1)..( 6): Matrix.001 file - promoters60/1025087
tttttt

SEQ ID NO: 44529 - DNA, 6 bp, Unknown
  misc_feature (1)..( 6): Matrix.001 file - promoters60/1025087
atagaa

SEQ ID NO: 44530 - DNA, 6 bp, Unknown
  misc_feature (1)..( 6): Matrix.001 file - promoters60/1025087
taagta

SEQ ID NO: 44531 - DNA, 9 bp, Unknown
  misc_feature (1)..( 9): Matrix.001 file - promoters60/1025087
aaaagaaaa

SEQ ID NO: 44532 - DNA, 6 bp, Unknown
  misc_feature (1)..( 6): Matrix.001 file - promoters60/1025087
aattaa

SEQ ID NO: 44533 - DNA, 7 bp, Unknown
  misc_feature (1)..( 7): Matrix.001 file - promoters60/1025100
caaaaat

SEQ ID NO: 44534 - DNA, 13 bp, Unknown
  misc_feature (1)..( 13): Matrix.001 file - promoters60/1025100
gataaaaaaaata

SEQ ID NO: 44535 - DNA, 7 bp, Unknown
  misc_feature (1)..( 7): Matrix.001 file - promoters60/1025100
ataatta

SEQ ID NO: 44536 - DNA, 9 bp, Unknown
  misc_feature (1)..( 9): Matrix.001 file - promoters60/1025100
aaattgtat

SEQ ID NO: 44537 - DNA, 6 bp, Unknown
  misc_feature (1)..( 6): Matrix.001 file - promoters60/1025100
tagttg

SEQ ID NO: 44538 - DNA, 6 bp, Unknown
  misc_feature (1)..( 6): Matrix.001 file - promoters60/1025100
tcaacc

SEQ ID NO: 44539 - DNA, 6 bp, Unknown
  misc_feature (1)..( 6): Matrix.001 file - promoters60/1025100
aaatca

SEQ ID NO: 44540 - DNA, 9 bp, Unknown
  misc_feature (1)..( 9): Matrix.001 file - promoters60/1025100
tatagatca

SEQ ID NO: 44541 - DNA, 6 bp, Unknown
  misc_feature (1)..( 6): Matrix.001 file - promoters60/1025100
tttgaa

SEQ ID NO: 44542 - DNA, 9 bp, Unknown
  misc_feature (1)..( 9): Matrix.001 file - promoters60/1025100
atagaaata

SEQ ID NO: 44543 - DNA, 6 bp, Unknown
  misc_feature (1)..( 6): Matrix.001 file - promoters60/1025100
aatttt

SEQ ID NO: 44544 - DNA, 8 bp, Unknown
  misc_feature (1)..( 8): Matrix.001 file - promoters60/1025100
acaatttt

SEQ ID NO: 44545 - DNA, 7 bp, Unknown
  misc_feature (1)..( 7): Matrix.001 file - promoters60/1025100
ttataaa

SEQ ID NO: 44546 - DNA, 9 bp, Unknown
  misc_feature (1)..( 9): Matrix.001 file - promoters60/1025100
attaattca

SEQ ID NO: 44547 - DNA, 6 bp, Unknown
  misc_feature (1)..( 6): Matrix.001 file - promoters60/1025100
attcga

SEQ ID NO: 44548 - DNA, 7 bp, Unknown
  misc_feature (1)..( 7): Matrix.001 file - promoters60/1025100
atacaat

SEQ ID NO: 44549 - DNA, 7 bp, Unknown
  misc_feature (1)..( 7): Matrix.001 file - promoters60/1025100
acaaaaa

SEQ ID NO: 44550 - DNA, 8 bp, Unknown
  misc_feature (1)..( 8): Matrix.001 file - promoters60/1025117
ttttttaa

SEQ ID NO: 44551 - DNA, 14 bp, Unknown
  misc_feature (1)..( 14): Matrix.001 file - promoters60/1025117
ttgtttaatgtttt

SEQ ID NO: 44552 - DNA, 9 bp, Unknown
  misc_feature (1)..( 9): Matrix.001 file - promoters60/1025117
atagagttt

SEQ ID NO: 44553 - DNA, 8 bp, Unknown
  misc_feature (1)..( 8): Matrix.001 file - promoters60/1025117
tttggtct

SEQ ID NO: 44554 - DNA, 6 bp, Unknown
  misc_feature (1)..( 6): Matrix.001 file - promoters60/1025117
agaaaa

SEQ ID NO: 44555 - DNA, 10 bp, Unknown
  misc_feature (1)..( 10): Matrix.001 file - promoters60/1025117
tattaaaata

SEQ ID NO: 44556 - DNA, 7 bp, Unknown
  misc_feature (1)..( 7): Matrix.001 file - promoters60/1025117
gttcaat

SEQ ID NO: 44557 - DNA, 9 bp, Unknown
  misc_feature (1)..( 9): Matrix.001 file - promoters60/1025117
cttaattac

SEQ ID NO: 44558 - DNA, 17 bp, Unknown
  misc_feature (1)..( 17): Matrix.001 file - promoters60/1025117
tagttgttcaatatttt

SEQ ID NO: 44559 - DNA, 7 bp, Unknown
  misc_feature (1)..( 7): Matrix.001 file - promoters60/1025117
tttggtg

SEQ ID NO: 44560 - DNA, 6 bp, Unknown
  misc_feature (1)..( 6): Matrix.001 file - promoters60/1025117
tcttta

SEQ ID NO: 44561 - DNA, 6 bp, Unknown
  misc_feature (1)..( 6): Matrix.001 file - promoters60/1025117
atcaag

SEQ ID NO: 44562 - DNA, 6 bp, Unknown
  misc_feature (1)..( 6): Matrix.001 file - promoters60/1025117
atattt

SEQ ID NO: 44563 - DNA, 6 bp, Unknown
  misc_feature (1)..( 6): Matrix.001 file - promoters60/1025117
ttctaa

SEQ ID NO: 44564 - DNA, 7 bp, Unknown
  misc_feature (1)..( 7): Matrix.001 file - promoters60/1025117
cagcaag

SEQ ID NO: 44565 - DNA, 6 bp, Unknown
  misc_feature (1)..( 6): Matrix.001 file - promoters60/1025202
atagat

SEQ ID NO: 44566 - DNA, 6 bp, Unknown
  misc_feature (1)..( 6): Matrix.001 file - promoters60/1025202
taaaga

SEQ ID NO: 44567 - DNA, 7 bp, Unknown
  misc_feature (1)..( 7): Matrix.001 file - promoters60/1025202
ataattt

SEQ ID NO: 44568 - DNA, 7 bp, Unknown
  misc_feature (1)..( 7): Matrix.001 file - promoters60/1025202
tttgctt

SEQ ID NO: 44569 - DNA, 8 bp, Unknown
  misc_feature (1)..( 8): Matrix.001 file - promoters60/1025202
atttctgt

SEQ ID NO: 44570 - DNA, 8 bp, Unknown
  misc_feature (1)..( 8): Matrix.001 file - promoters60/1025202
tttctctc

SEQ ID NO: 44571 - DNA, 6 bp, Unknown
  misc_feature (1)..( 6): Matrix.001 file - promoters60/1025202
agaact

SEQ ID NO: 44572 - DNA, 6 bp, Unknown
  misc_feature (1)..( 6): Matrix.001 file - promoters60/1025202
gctggt

SEQ ID NO: 44573 - DNA, 6 bp, Unknown
  misc_feature (1)..( 6): Matrix.001 file - promoters60/1025202
tctctg

SEQ ID NO: 44574 - DNA, 6 bp, Unknown
  misc_feature (1)..( 6): Matrix.001 file - promoters60/1025202
atatgg

SEQ ID NO: 44575 - DNA, 6 bp, Unknown
  misc_feature (1)..( 6): Matrix.001 file - promoters60/1025202
ttgttg

SEQ ID NO: 44576 - DNA, 7 bp, Unknown
  misc_feature (1)..( 7): Matrix.001 file - promoters60/1025202
ttaatgt

SEQ ID NO: 44577 - DNA, 6 bp, Unknown
  misc_feature (1)..( 6): Matrix.001 file - promoters60/1025202
agtaaa

SEQ ID NO: 44578 - DNA, 7 bp, Unknown
  misc_feature (1)..( 7): Matrix.001 file - promoters60/1025202
aatcggg

SEQ ID NO: 44579 - DNA, 8 bp, Unknown
  misc_feature (1)..( 8): Matrix.001 file - promoters60/1025202
gaaacaaa

SEQ ID NO: 44580 - DNA, 10 bp, Unknown
  misc_feature (1)..( 10): Matrix.001 file - promoters60/1025202
ggaaaagaaa

SEQ ID NO: 44581 - DNA, 7 bp, Unknown
  misc_feature (1)..( 7): Matrix.001 file - promoters60/1025202
cccacta

SEQ ID NO: 44582 - DNA, 9 bp, Unknown
  misc_feature (1)..( 9): Matrix.001 file - promoters60/1025202
aaagaaaag

SEQ ID NO: 44583 - DNA, 7 bp, Unknown
  misc_feature (1)..( 7): Matrix.001 file - promoters60/1025202
gtatata

SEQ ID NO: 44584 - DNA, 8 bp, Unknown
  misc_feature (1)..( 8): Matrix.001 file - promoters60/1025211
aaaaaata

SEQ ID NO: 44585 - DNA, 9 bp, Unknown
  misc_feature (1)..( 9): Matrix.001 file - promoters60/1025211
ataataaaa

SEQ ID NO: 44586 - DNA, 8 bp, Unknown
  misc_feature (1)..( 8): Matrix.001 file - promoters60/1025211
aaaacaaa

SEQ ID NO: 44587 - DNA, 14 bp, Unknown
  misc_feature (1)..( 14): Matrix.001 file - promoters60/1025211
ttcatttgaatgaa

SEQ ID NO: 44588 - DNA, 10 bp, Unknown
  misc_feature (1)..( 10): Matrix.001 file - promoters60/1025211
aaaaaataaa

SEQ ID NO: 44589 - DNA, 9 bp, Unknown
  misc_feature (1)..( 9): Matrix.001 file - promoters60/1025211
gaaaaaaat

SEQ ID NO: 44590 - DNA, 9 bp, Unknown
  misc_feature (1)..( 9): Matrix.001 file - promoters60/1025211
attttataa

SEQ ID NO: 44591 - DNA, 7 bp, Unknown
  misc_feature (1)..( 7): Matrix.001 file - promoters60/1025340
atgagaa

SEQ ID NO: 44592 - DNA, 8 bp, Unknown
  misc_feature (1)..( 8): Matrix.001 file - promoters60/1025340
agaagatg

SEQ ID NO: 44593 - DNA, 9 bp, Unknown
  misc_feature (1)..( 9): Matrix.001 file - promoters60/1025340
acattgttt

SEQ ID NO: 44594 - DNA, 7 bp, Unknown
  misc_feature (1)..( 7): Matrix.001 file - promoters60/1025340
aaactta

SEQ ID NO: 44595 - DNA, 11 bp, Unknown
  misc_feature (1)..( 11): Matrix.001 file - promoters60/1025468
ttttgtagatt

SEQ ID NO: 44596 - DNA, 8 bp, Unknown
  misc_feature (1)..( 8): Matrix.001 file - promoters60/1025468
ttatatat

SEQ ID NO: 44597 - DNA, 10 bp, Unknown
  misc_feature (1)..( 10): Matrix.001 file - promoters60/1025468
gaaaatatat

SEQ ID NO: 44598 - DNA, 9 bp, Unknown
  misc_feature (1)..( 9): Matrix.001 file - promoters60/1025468
aaatatagc

SEQ ID NO: 44599 - DNA, 10 bp, Unknown
  misc_feature (1)..( 10): Matrix.001 file - promoters60/1025468
ttagaaaagt

SEQ ID NO: 44600 - DNA, 11 bp, Unknown
  misc_feature (1)..( 11): Matrix.001 file - promoters60/1025468
ctagattaagt

SEQ ID NO: 44601 - DNA, 8 bp, Unknown
  misc_feature (1)..( 8): Matrix.001 file - promoters60/1025468
gtaaatag

SEQ ID NO: 44602 - DNA, 9 bp, Unknown
  misc_feature (1)..( 9): Matrix.001 file - promoters60/1025468
ataaaaaca

SEQ ID NO: 44603 - DNA, 6 bp, Unknown
  misc_feature (1)..( 6): Matrix.001 file - promoters60/1025468
aaaaca

SEQ ID NO: 44604 - DNA, 9 bp, Unknown
  misc_feature (1)..( 9): Matrix.001 file - promoters60/1025468
taaaagatg

SEQ ID NO: 44605 - DNA, 9 bp, Unknown
  misc_feature (1)..( 9): Matrix.001 file - promoters60/1025468
aaccaaagc

SEQ ID NO: 44606 - DNA, 9 bp, Unknown
  misc_feature (1)..( 9): Matrix.001 file - promoters60/1025471
aacgtatgt

SEQ ID NO: 44607 - DNA, 9 bp, Unknown
  misc_feature (1)..( 9): Matrix.001 file - promoters60/1025471
tgactaaga

SEQ ID NO: 44608 - DNA, 10 bp, Unknown
  misc_feature (1)..( 10): Matrix.001 file - promoters60/1025511
aaaataataa

SEQ ID NO: 44609 - DNA, 10 bp, Unknown
  misc_feature (1)..( 10): Matrix.001 file - promoters60/1025582
gagacaattg

SEQ ID NO: 44610 - DNA, 7 bp, Unknown
  misc_feature (1)..( 7): Matrix.001 file - promoters60/1025582
cagagat

SEQ ID NO: 44611 - DNA, 12 bp, Unknown
  misc_feature (1)..( 12): Matrix.001 file - promoters60/1025642
acataataatta

SEQ ID NO: 44612 - DNA, 11 bp, Unknown
  misc_feature (1)..( 11): Matrix.001 file - promoters60/1025642
ctaattattta

SEQ ID NO: 44613 - DNA, 9 bp, Unknown
  misc_feature (1)..( 9): Matrix.001 file - promoters60/1025642
aaaaatatt

SEQ ID NO: 44614 - DNA, 15 bp, Unknown
  misc_feature (1)..( 15): Matrix.001 file - promoters60/1025642
tttctaaaaaaatat

SEQ ID NO: 44615 - DNA, 8 bp, Unknown
  misc_feature (1)..( 8): Matrix.001 file - promoters60/1025683
cttatata

SEQ ID NO: 44616 - DNA, 12 bp, Unknown
  misc_feature (1)..( 12): Matrix.001 file - promoters60/1025683
ctatttaaaatg

SEQ ID NO: 44617 - DNA, 14 bp, Unknown
  misc_feature (1)..( 14): Matrix.001 file - promoters60/1025683
tataatgaaatttt

SEQ ID NO: 44618 - DNA, 13 bp, Unknown
  misc_feature (1)..( 13): Matrix.001 file - promoters60/1025683
aagaatataaatt

SEQ ID NO: 44619 - DNA, 10 bp, Unknown
  misc_feature (1)..( 10): Matrix.001 file - promoters60/1025707
aatcatacaa

SEQ ID NO: 44620 - DNA, 6 bp, Unknown
  misc_feature (1)..( 6): Matrix.001 file - promoters60/1025707
tcttga

SEQ ID NO: 44621 - DNA, 7 bp, Unknown
  misc_feature (1)..( 7): Matrix.001 file - promoters60/1025707
tagaata

SEQ ID NO: 44622 - DNA, 11 bp, Unknown
  misc_feature (1)..( 11): Matrix.001 file - promoters60/1025707
acacattaagt

SEQ ID NO: 44623 - DNA, 7 bp, Unknown
  misc_feature (1)..( 7): Matrix.001 file - promoters60/1025707
caaataa

SEQ ID NO: 44624 - DNA, 7 bp, Unknown
  misc_feature (1)..( 7): Matrix.001 file - promoters60/1025707
ctaaata

SEQ ID NO: 44625 - DNA, 6 bp, Unknown
  misc_feature (1)..( 6): Matrix.001 file - promoters60/1025707
tataaa

SEQ ID NO: 44626 - DNA, 7 bp, Unknown
  misc_feature (1)..( 7): Matrix.001 file - promoters60/1025707
cacacaa

SEQ ID NO: 44627 - DNA, 7 bp, Unknown
  misc_feature (1)..( 7): Matrix.001 file - promoters60/1025707
aatatca

SEQ ID NO: 44628 - DNA, 8 bp, Unknown
  misc_feature (1)..( 8): Matrix.001 file - promoters60/1025707
atacaaat

SEQ ID NO: 44629 - DNA, 7 bp, Unknown
  misc_feature (1)..( 7): Matrix.001 file - promoters60/1025707
ataaata

SEQ ID NO: 44630 - DNA, 8 bp, Unknown
  misc_feature (1)..( 8): Matrix.001 file - promoters60/1025707
aataataa

SEQ ID NO: 44631 - DNA, 8 bp, Unknown
  misc_feature (1)..( 8): Matrix.001 file - promoters60/1025707
acaaaaag

SEQ ID NO: 44632 - DNA, 6 bp, Unknown
  misc_feature (1)..( 6): Matrix.001 file - promoters60/1025707
ataaac

SEQ ID NO: 44633 - DNA, 7 bp, Unknown
  misc_feature (1)..( 7): Matrix.001 file - promoters60/1025707
tgaacaa

SEQ ID NO: 44634 - DNA, 6 bp, Unknown
  misc_feature (1)..( 6): Matrix.001 file - promoters60/1025707
cgatta

SEQ ID NO: 44635 - DNA, 6 bp, Unknown
  misc_feature (1)..( 6): Matrix.001 file - promoters60/1025707
ttttga

SEQ ID NO: 44636 - DNA, 6 bp, Unknown
  misc_feature (1)..( 6): Matrix.001 file - promoters60/1025707
acagta

SEQ ID NO: 44637 - DNA, 7 bp, Unknown
  misc_feature (1)..( 7): Matrix.001 file - promoters60/1025707
taaaata

SEQ ID NO: 44638 - DNA, 6 bp, Unknown
  misc_feature (1)..( 6): Matrix.001 file - promoters60/1025707
ttgaca

SEQ ID NO: 44639 - DNA, 7 bp, Unknown
  misc_feature (1)..( 7): Matrix.001 file - promoters60/1025707
aaccaag

SEQ ID NO: 44640 - DNA, 8 bp, Unknown
  misc_feature (1)..( 8): Matrix.001 file - promoters60/1025707
acgatgac

SEQ ID NO: 44641 - DNA, 11 bp, Unknown
  misc_feature (1)..( 11): Matrix.001 file - promoters60/1025791
ttaaccttaga

SEQ ID NO: 44642 - DNA, 7 bp, Unknown
  misc_feature (1)..( 7): Matrix.001 file - promoters60/1025791
aattggg

SEQ ID NO: 44643 - DNA, 8 bp, Unknown
  misc_feature (1)..( 8): Matrix.001 file - promoters60/1026014
aatatttt

SEQ ID NO: 44644 - DNA, 11 bp, Unknown
  misc_feature (1)..( 11): Matrix.001 file - promoters60/1026014
tttataacaaa

SEQ ID NO: 44645 - DNA, 9 bp, Unknown
  misc_feature (1)..( 9): Matrix.001 file - promoters60/1026014
taaaaaaaa

SEQ ID NO: 44646 - DNA, 11 bp, Unknown
  misc_feature (1)..( 11): Matrix.001 file - promoters60/1026014
gattttaaaaa

SEQ ID NO: 44647 - DNA, 10 bp, Unknown
  misc_feature (1)..( 10): Matrix.001 file - promoters60/1026014
atttatttga

SEQ ID NO: 44648 - DNA, 14 bp, Unknown
  misc_feature (1)..( 14): Matrix.001 file - promoters60/1026014
aattattttatttt

SEQ ID NO: 44649 - DNA, 9 bp, Unknown
  misc_feature (1)..( 9): Matrix.001 file - promoters60/1026014
acaaaattg

SEQ ID NO: 44650 - DNA, 12 bp, Unknown
  misc_feature (1)..( 12): Matrix.001 file - promoters60/1026014
aaagaaaaaata

SEQ ID NO: 44651 - DNA, 12 bp, Unknown
  misc_feature (1)..( 12): Matrix.001 file - promoters60/1026014
aataattttata

SEQ ID NO: 44652 - DNA, 10 bp, Unknown
  misc_feature (1)..( 10): Matrix.001 file - promoters60/1026014
aaaaaaaatt

SEQ ID NO: 44653 - DNA, 7 bp, Unknown
  misc_feature (1)..( 7): Matrix.001 file - promoters60/1026039
taacgtt

SEQ ID NO: 44654 - DNA, 15 bp, Unknown
  misc_feature (1)..( 15): Matrix.001 file - promoters60/1026039
aaaagcatacaaata

SEQ ID NO: 44655 - DNA, 6 bp, Unknown
  misc_feature (1)..( 6): Matrix.001 file - promoters60/1026039
tcaact

SEQ ID NO: 44656 - DNA, 7 bp, Unknown
  misc_feature (1)..( 7): Matrix.001 file - promoters60/1026039
aacgtcg

SEQ ID NO: 44657 - DNA, 7 bp, Unknown
  misc_feature (1)..( 7): Matrix.001 file - promoters60/1026039
ctattat

SEQ ID NO: 44658 - DNA, 8 bp, Unknown
  misc_feature (1)..( 8): Matrix.001 file - promoters60/1026039
attatatt

SEQ ID NO: 44659 - DNA, 9 bp, Unknown
  misc_feature (1)..( 9): Matrix.001 file - promoters60/1026039
aaataacaa

SEQ ID NO: 44660 - DNA, 7 bp, Unknown
  misc_feature (1)..( 7): Matrix.001 file - promoters60/1026039
ttaatca

SEQ ID NO: 44661 - DNA, 6 bp, Unknown
  misc_feature (1)..( 6): Matrix.001 file - promoters60/1026039
tttctt

SEQ ID NO: 44662 - DNA, 6 bp, Unknown
  misc_feature (1)..( 6): Matrix.001 file - promoters60/1026039
caagaa

SEQ ID NO: 44663 - DNA, 8 bp, Unknown
  misc_feature (1)..( 8): Matrix.001 file - promoters60/1026039
tggttatt

SEQ ID NO: 44664 - DNA, 6 bp, Unknown
  misc_feature (1)..( 6): Matrix.001 file - promoters60/1026039
ctttgt

SEQ ID NO: 44665 - DNA, 7 bp, Unknown
  misc_feature (1)..( 7): Matrix.001 file - promoters60/1026039
tttcaac

SEQ ID NO: 44666 - DNA, 6 bp, Unknown
  misc_feature (1)..( 6): Matrix.001 file - promoters60/1026039
attaaa

SEQ ID NO: 44667 - DNA, 7 bp, Unknown
  misc_feature (1)..( 7): Matrix.001 file - promoters60/1026039
tacataa

SEQ ID NO: 44668 - DNA, 6 bp, Unknown
  misc_feature (1)..( 6): Matrix.001 file - promoters60/1026039
gtaaaa

SEQ ID NO: 44669 - DNA, 9 bp, Unknown
  misc_feature (1)..( 9): Matrix.001 file - promoters60/1026039
aaatagtta

SEQ ID NO: 44670 - DNA, 8 bp, Unknown
  misc_feature (1)..( 8): Matrix.001 file - promoters60/1026039
caaaactt

SEQ ID NO: 44671 - DNA, 6 bp, Unknown
  misc_feature (1)..( 6): Matrix.001 file - promoters60/1026039
gttcta

SEQ ID NO: 44672 - DNA, 7 bp, Unknown
  misc_feature (1)..( 7): Matrix.001 file - promoters60/1026039
atacttt

SEQ ID NO: 44673 - DNA, 5 bp, Unknown
  misc_feature (1)..( 5): Matrix.001 file - promoters60/1026160
aaaaa

SEQ ID NO: 44674 - DNA, 9 bp, Unknown
  misc_feature (1)..( 9): Matrix.001 file - promoters60/1026160
actataaaa

SEQ ID NO: 44675 - DNA, 6 bp, Unknown
  misc_feature (1)..( 6): Matrix.001 file - promoters60/1026353
ttttag

SEQ ID NO: 44676 - DNA, 6 bp, Unknown
  misc_feature (1)..( 6): Matrix.001 file - promoters60/1026353
agtttt

SEQ ID NO: 44677 - DNA, 10 bp, Unknown
  misc_feature (1)..( 10): Matrix.001 file - promoters60/1026353
ttataattta

SEQ ID NO: 44678 - DNA, 10 bp, Unknown
  misc_feature (1)..( 10): Matrix.001 file - promoters60/1026353
atgcattata

SEQ ID NO: 44679 - DNA, 7 bp, Unknown
  misc_feature (1)..( 7): Matrix.001 file - promoters60/1026353
taggatt

SEQ ID NO: 44680 - DNA, 7 bp, Unknown
  misc_feature (1)..( 7): Matrix.001 file - promoters60/1026353
caaatca

SEQ ID NO: 44681 - DNA, 12 bp, Unknown
  misc_feature (1)..( 12): Matrix.001 file - promoters60/1026353
ttccactatgtt

SEQ ID NO: 44682 - DNA, 6 bp, Unknown
  misc_feature (1)..( 6): Matrix.001 file - promoters60/1026353
gataat

SEQ ID NO: 44683 - DNA, 8 bp, Unknown
  misc_feature (1)..( 8): Matrix.001 file - promoters60/1026353
aagagaaa

SEQ ID NO: 44684 - DNA, 8 bp, Unknown
  misc_feature (1)..( 8): Matrix.001 file - promoters60/1026353
tttgttgt

SEQ ID NO: 44685 - DNA, 7 bp, Unknown
  misc_feature (1)..( 7): Matrix.001 file - promoters60/1026353
tagaagc

SEQ ID NO: 44686 - DNA, 8 bp, Unknown
  misc_feature (1)..( 8): Matrix.001 file - promoters60/1026353
gactaaat

SEQ ID NO: 44687 - DNA, 7 bp, Unknown
  misc_feature (1)..( 7): Matrix.001 file - promoters60/1026353
tttaggt

SEQ ID NO: 44688 - DNA, 8 bp, Unknown
  misc_feature (1)..( 8): Matrix.001 file - promoters60/1026353
cctcgttt

SEQ ID NO: 44689 - DNA, 8 bp, Unknown
  misc_feature (1)..( 8): Matrix.001 file - promoters60/1026353
attccgaa

SEQ ID NO: 44690 - DNA, 10 bp, Unknown
  misc_feature (1)..( 10): Matrix.001 file - promoters60/1026412
ttttgttata

SEQ ID NO: 44691 - DNA, 12 bp, Unknown
  misc_feature (1)..( 12): Matrix.001 file - promoters60/1026412
aaatttgttata

SEQ ID NO: 44692 - DNA, 7 bp, Unknown
  misc_feature (1)..( 7): Matrix.001 file - promoters60/1026419
aatcttt

SEQ ID NO: 44693 - DNA, 10 bp, Unknown
  misc_feature (1)..( 10): Matrix.001 file - promoters60/1026419
gaaacaagta

SEQ ID NO: 44694 - DNA, 6 bp, Unknown
  misc_feature (1)..( 6): Matrix.001 file - promoters60/1026419
tttatc

SEQ ID NO: 44695 - DNA, 7 bp, Unknown
  misc_feature (1)..( 7): Matrix.001 file - promoters60/1026419
atcattt

SEQ ID NO: 44696 - DNA, 6 bp, Unknown
  misc_feature (1)..( 6): Matrix.001 file - promoters60/1026419
gcatgg

SEQ ID NO: 44697 - DNA, 6 bp, Unknown
  misc_feature (1)..( 6): Matrix.001 file - promoters60/1026419
aacaaa

SEQ ID NO: 44698 - DNA, 8 bp, Unknown
  misc_feature (1)..( 8): Matrix.001 file - promoters60/1026419
gaagagag

SEQ ID NO: 44699 - DNA, 7 bp, Unknown
  misc_feature (1)..( 7): Matrix.001 file - promoters60/1026419
ggtgaat

SEQ ID NO: 44700 - DNA, 6 bp, Unknown
  misc_feature (1)..( 6): Matrix.001 file - promoters60/1026419
ttgggt

SEQ ID NO: 44701 - DNA, 6 bp, Unknown
  misc_feature (1)..( 6): Matrix.001 file - promoters60/1026419
ataaaa

SEQ ID NO: 44702 - DNA, 6 bp, Unknown
  misc_feature (1)..( 6): Matrix.001 file - promoters60/1026419
aagaaa

SEQ ID NO: 44703 - DNA, 6 bp, Unknown
  misc_feature (1)..( 6): Matrix.001 file - promoters60/1026419
cacatg

SEQ ID NO: 44704 - DNA, 9 bp, Unknown
  misc_feature (1)..( 9): Matrix.001 file - promoters60/1026514
ggttttgct

SEQ ID NO: 44705 - DNA, 7 bp, Unknown
  misc_feature (1)..( 7): Matrix.001 file - promoters60/1026514
aagaagt

SEQ ID NO: 44706 - DNA, 7 bp, Unknown
  misc_feature (1)..( 7): Matrix.001 file - promoters60/1026514
aactttt

SEQ ID NO: 44707 - DNA, 10 bp, Unknown
  misc_feature (1)..( 10): Matrix.001 file - promoters60/1026514
gttaaattgt

SEQ ID NO: 44708 - DNA, 6 bp, Unknown
  misc_feature (1)..( 6): Matrix.001 file - promoters60/1026514
taaaat

SEQ ID NO: 44709 - DNA, 10 bp, Unknown
  misc_feature (1)..( 10): Matrix.001 file - promoters60/1026514
ttaaaaaaaa

SEQ ID NO: 44710 - DNA, 6 bp, Unknown
  misc_feature (1)..( 6): Matrix.001 file - promoters60/1026514
gaaaaa

SEQ ID NO: 44711 - DNA, 6 bp, Unknown
  misc_feature (1)..( 6): Matrix.001 file - promoters60/1026514
aataat

SEQ ID NO: 44712 - DNA, 8 bp, Unknown
  misc_feature (1)..( 8): Matrix.001 file - promoters60/1026514
gccactac

SEQ ID NO: 44713 - DNA, 7 bp, Unknown
  misc_feature (1)..( 7): Matrix.001 file - promoters60/1026514
actgttc

SEQ ID NO: 44714 - DNA, 6 bp, Unknown
  misc_feature (1)..( 6): Matrix.001 file - promoters60/1026514
actcaa

SEQ ID NO: 44715 - DNA, 7 bp, Unknown
  misc_feature (1)..( 7): Matrix.001 file - promoters60/1026514
aaagtaa

SEQ ID NO: 44716 - DNA, 8 bp, Unknown
  misc_feature (1)..( 8): Matrix.001 file - promoters60/1026514
ctcaatta

SEQ ID NO: 44717 - DNA, 7 bp, Unknown
  misc_feature (1)..( 7): Matrix.001 file - promoters60/1026514
tatttgt

SEQ ID NO: 44718 - DNA, 9 bp, Unknown
  misc_feature (1)..( 9): Matrix.001 file - promoters60/1026514
taatctatt

SEQ ID NO: 44719 - DNA, 6 bp, Unknown
  misc_feature (1)..( 6): Matrix.001 file - promoters60/1026514
atgacc

SEQ ID NO: 44720 - DNA, 7 bp, Unknown
  misc_feature (1)..( 7): Matrix.001 file - promoters60/1026514
cataaaa

SEQ ID NO: 44721 - DNA, 11 bp, Unknown
  misc_feature (1)..( 11): Matrix.001 file - promoters60/1026514
tttgaggcctt

SEQ ID NO: 44722 - DNA, 7 bp, Unknown
  misc_feature (1)..( 7): Matrix.001 file - promoters60/1026514
tttgctt

SEQ ID NO: 44723 - DNA, 10 bp, Unknown
  misc_feature (1)..( 10): Matrix.001 file - promoters60/1026551
taaattaata

SEQ ID NO: 44724 - DNA, 10 bp, Unknown
  misc_feature (1)..( 10): Matrix.001 file - promoters60/1026551
tcaatatata

SEQ ID NO: 44725 - DNA, 11 bp, Unknown
  misc_feature (1)..( 11): Matrix.001 file - promoters60/1026551
aagtataaaat

SEQ ID NO: 44726 - DNA, 8 bp, Unknown
  misc_feature (1)..( 8): Matrix.001 file - promoters60/1026551
ttatcaat

SEQ ID NO: 44727 - DNA, 7 bp, Unknown
  misc_feature (1)..( 7): Matrix.001 file - promoters60/1026551
aaatatg

SEQ ID NO: 44728 - DNA, 15 bp, Unknown
  misc_feature (1)..( 15): Matrix.001 file - promoters60/1026551
aaggatgatggacca

SEQ ID NO: 44729 - DNA, 21 bp, Unknown
  misc_feature (1)..( 21): Matrix.001 file - promoters60/1026551
tacacattaataacgtggtcc

SEQ ID NO: 44730 - DNA, 23 bp, Unknown
  misc_feature (1)..( 23): Matrix.001 file - promoters60/1026551
cgtttaccaaaataaagaaaata

SEQ ID NO: 44731 - DNA, 7 bp, Unknown
  misc_feature (1)..( 7): Matrix.001 file - promoters60/1026551
ttaattt

SEQ ID NO: 44732 - DNA, 11 bp, Unknown
  misc_feature (1)..( 11): Matrix.001 file - promoters60/1026551
attattttata

SEQ ID NO: 44733 - DNA, 7 bp, Unknown
  misc_feature (1)..( 7): Matrix.001 file - promoters60/1026551
tttcatg

SEQ ID NO: 44734 - DNA, 9 bp, Unknown
  misc_feature (1)..( 9): Matrix.001 file - promoters60/1026551
tatattaat

SEQ ID NO: 44735 - DNA, 7 bp, Unknown
  misc_feature (1)..( 7): Matrix.001 file - promoters60/1026551
tatatgt

SEQ ID NO: 44736 - DNA, 7 bp, Unknown
  misc_feature (1)..( 7): Matrix.001 file - promoters60/1026562
aataata

SEQ ID NO: 44737 - DNA, 8 bp, Unknown
  misc_feature (1)..( 8): Matrix.001 file - promoters60/1026562
ttgaagat

SEQ ID NO: 44738 - DNA, 6 bp, Unknown
  misc_feature (1)..( 6): Matrix.001 file - promoters60/1026562
agatta

SEQ ID NO: 44739 - DNA, 13 bp, Unknown
  misc_feature (1)..( 13): Matrix.001 file - promoters60/1026562
aacgagtttatcc

SEQ ID NO: 44740 - DNA, 8 bp, Unknown
  misc_feature (1)..( 8): Matrix.001 file - promoters60/1026562
tttcgtat

SEQ ID NO: 44741 - DNA, 7 bp, Unknown
  misc_feature (1)..( 7): Matrix.001 file - promoters60/1026562
caaatgg

SEQ ID NO: 44742 - DNA, 6 bp, Unknown
  misc_feature (1)..( 6): Matrix.001 file - promoters60/1026562
ataatt

SEQ ID NO: 44743 - DNA, 6 bp, Unknown
  misc_feature (1)..( 6): Matrix.001 file - promoters60/1026562
caatct

SEQ ID NO: 44744 - DNA, 7 bp, Unknown
  misc_feature (1)..( 7): Matrix.001 file - promoters60/1026562
aaaatct

SEQ ID NO: 44745 - DNA, 6 bp, Unknown
  misc_feature (1)..( 6): Matrix.001 file - promoters60/1026562
caactg

SEQ ID NO: 44746 - DNA, 7 bp, Unknown
  misc_feature (1)..( 7): Matrix.001 file - promoters60/1026562
aatcaat

SEQ ID NO: 44747 - DNA, 8 bp, Unknown
  misc_feature (1)..( 8): Matrix.001 file - promoters60/1026562
gagaaagt

SEQ ID NO: 44748 - DNA, 7 bp, Unknown
  misc_feature (1)..( 7): Matrix.001 file - promoters60/1026562
ttatcta

SEQ ID NO: 44749 - DNA, 6 bp, Unknown
  misc_feature (1)..( 6): Matrix.001 file - promoters60/1026562
tgtttc

SEQ ID NO: 44750 - DNA, 7 bp, Unknown
  misc_feature (1)..( 7): Matrix.001 file - promoters60/1026565
gttcaga

SEQ ID NO: 44751 - DNA, 8 bp, Unknown
  misc_feature (1)..( 8): Matrix.001 file - promoters60/1026565
ttttattg

SEQ ID NO: 44752 - DNA, 6 bp, Unknown
  misc_feature (1)..( 6): Matrix.001 file - promoters60/1026565
ttactt

SEQ ID NO: 44753 - DNA, 11 bp, Unknown
  misc_feature (1)..( 11): Matrix.001 file - promoters60/1026565
aagacagaaca

SEQ ID NO: 44754 - DNA, 7 bp, Unknown
  misc_feature (1)..( 7): Matrix.001 file - promoters60/1026565
acaaaaa

SEQ ID NO: 44755 - DNA, 9 bp, Unknown
  misc_feature (1)..( 9): Matrix.001 file - promoters60/1026565
aagaagaca

SEQ ID NO: 44756 - DNA, 7 bp, Unknown
  misc_feature (1)..( 7): Matrix.001 file - promoters60/1026565
atttata

SEQ ID NO: 44757 - DNA, 10 bp, Unknown
  misc_feature (1)..( 10): Matrix.001 file - promoters60/1026565
aagctctgaa

SEQ ID NO: 44758 - DNA, 7 bp, Unknown
  misc_feature (1)..( 7): Matrix.001 file - promoters60/1026565
tttggat

SEQ ID NO: 44759 - DNA, 9 bp, Unknown
  misc_feature (1)..( 9): Matrix.001 file - promoters60/1026565
agacaaaac

SEQ ID NO: 44760 - DNA, 6 bp, Unknown
  misc_feature (1)..( 6): Matrix.001 file - promoters60/1026565
aaaaag

SEQ ID NO: 44761 - DNA, 7 bp, Unknown
  misc_feature (1)..( 7): Matrix.001 file - promoters60/1026565
tgaagaa

SEQ ID NO: 44762 - DNA, 7 bp, Unknown
  misc_feature (1)..( 7): Matrix.001 file - promoters60/1026565
aactatc

SEQ ID NO: 44763 - DNA, 8 bp, Unknown
  misc_feature (1)..( 8): Matrix.001 file - promoters60/1026565
agacatga

SEQ ID NO: 44764 - DNA, 6 bp, Unknown
  misc_feature (1)..( 6): Matrix.001 file - promoters60/1026565
actttt

SEQ ID NO: 44765 - DNA, 7 bp, Unknown
  misc_feature (1)..( 7): Matrix.001 file - promoters60/1026565
tttgatt

SEQ ID NO: 44766 - DNA, 6 bp, Unknown
  misc_feature (1)..( 6): Matrix.001 file - promoters60/1026565
acaaaa

SEQ ID NO: 44767 - DNA, 9 bp, Unknown
  misc_feature (1)..( 9): Matrix.001 file - promoters60/1026578
attgttttc

SEQ ID NO: 44768 - DNA, 8 bp, Unknown
  misc_feature (1)..( 8): Matrix.001 file - promoters60/1026578
taaaagat

SEQ ID NO: 44769 - DNA, 7 bp, Unknown
  misc_feature (1)..( 7): Matrix.001 file - promoters60/1026578
taaattt

SEQ ID NO: 44770 - DNA, 10 bp, Unknown
  misc_feature (1)..( 10): Matrix.001 file - promoters60/1026618
aaataaatat

SEQ ID NO: 44771 - DNA, 11 bp, Unknown
  misc_feature (1)..( 11): Matrix.001 file - promoters60/1026618
aaatttaaaaa

SEQ ID NO: 44772 - DNA, 9 bp, Unknown
  misc_feature (1)..( 9): Matrix.001 file - promoters60/1026622
aatccaaag

SEQ ID NO: 44773 - DNA, 11 bp, Unknown
  misc_feature (1)..( 11): Matrix.001 file - promoters60/1026622
tgatataaaaa

SEQ ID NO: 44774 - DNA, 12 bp, Unknown
  misc_feature (1)..( 12): Matrix.001 file - promoters60/1026705
gtcaaaccataa

SEQ ID NO: 44775 - DNA, 9 bp, Unknown
  misc_feature (1)..( 9): Matrix.001 file - promoters60/1026742
ctcttactg

SEQ ID NO: 44776 - DNA, 8 bp, Unknown
  misc_feature (1)..( 8): Matrix.001 file - promoters60/1026742
ccgtcaat

SEQ ID NO: 44777 - DNA, 6 bp, Unknown
  misc_feature (1)..( 6): Matrix.001 file - promoters60/1026754
ttgtta

SEQ ID NO: 44778 - DNA, 6 bp, Unknown
  misc_feature (1)..( 6): Matrix.001 file - promoters60/1026754
tggaaa

SEQ ID NO: 44779 - DNA, 8 bp, Unknown
  misc_feature (1)..( 8): Matrix.001 file - promoters60/1026754
ttcattct

SEQ ID NO: 44780 - DNA, 9 bp, Unknown
  misc_feature (1)..( 9): Matrix.001 file - promoters60/1026754
gtttcttac

SEQ ID NO: 44781 - DNA, 7 bp, Unknown
  misc_feature (1)..( 7): Matrix.001 file - promoters60/1026754
ctttctc

SEQ ID NO: 44782 - DNA, 6 bp, Unknown
  misc_feature (1)..( 6): Matrix.001 file - promoters60/1026754
tacaag

SEQ ID NO: 44783 - DNA, 7 bp, Unknown
  misc_feature (1)..( 7): Matrix.001 file - promoters60/1026754
tttagtt

SEQ ID NO: 44784 - DNA, 7 bp, Unknown
  misc_feature (1)..( 7): Matrix.001 file - promoters60/1026754
tcacatt

SEQ ID NO: 44785 - DNA, 6 bp, Unknown
  misc_feature (1)..( 6): Matrix.001 file - promoters60/1026754
aagaaa

SEQ ID NO: 44786 - DNA, 7 bp, Unknown
  misc_feature (1)..( 7): Matrix.001 file - promoters60/1026754
agaaagt

SEQ ID NO: 44787 - DNA, 6 bp, Unknown
  misc_feature (1)..( 6): Matrix.001 file - promoters60/1026754
aaatgc

SEQ ID NO: 44788 - DNA, 7 bp, Unknown
  misc_feature (1)..( 7): Matrix.001 file - promoters60/1026754
ttaaaat

SEQ ID NO: 44789 - DNA, 9 bp, Unknown
  misc_feature (1)..( 9): Matrix.001 file - promoters60/1026754
tactcaatt

SEQ ID NO: 44790 - DNA, 8 bp, Unknown
  misc_feature (1)..( 8): Matrix.001 file - promoters60/1026822
aaacatat

SEQ ID NO: 44791 - DNA, 8 bp, Unknown
  misc_feature (1)..( 8): Matrix.001 file - promoters60/1026822
aaaaactt

SEQ ID NO: 44792 - DNA, 7 bp, Unknown
  misc_feature (1)..( 7): Matrix.001 file - promoters60/1026822
attttaa

SEQ ID NO: 44793 - DNA, 9 bp, Unknown
  misc_feature (1)..( 9): Matrix.001 file - promoters60/1026822
acaaaatag

SEQ ID NO: 44794 - DNA, 6 bp, Unknown
  misc_feature (1)..( 6): Matrix.001 file - promoters60/1026822
ttaatt

SEQ ID NO: 44795 - DNA, 7 bp, Unknown
  misc_feature (1)..( 7): Matrix.001 file - promoters60/1026822
ttacata

SEQ ID NO: 44796 - DNA, 6 bp, Unknown
  misc_feature (1)..( 6): Matrix.001 file - promoters60/1026822
tgatat

SEQ ID NO: 44797 - DNA, 6 bp, Unknown
  misc_feature (1)..( 6): Matrix.001 file - promoters60/1026822
aagatg

SEQ ID NO: 44798 - DNA, 6 bp, Unknown
  misc_feature (1)..( 6): Matrix.001 file - promoters60/1026822
ttaaac

SEQ ID NO: 44799 - DNA, 8 bp, Unknown
  misc_feature (1)..( 8): Matrix.001 file - promoters60/1026822
taatacat

SEQ ID NO: 44800 - DNA, 6 bp, Unknown
  misc_feature (1)..( 6): Matrix.001 file - promoters60/1026822
atcaag

SEQ ID NO: 44801 - DNA, 6 bp, Unknown
  misc_feature (1)..( 6): Matrix.001 file - promoters60/1026822
aaagtt

SEQ ID NO: 44802 - DNA, 7 bp, Unknown
  misc_feature (1)..( 7): Matrix.001 file - promoters60/1026822
tcattat

SEQ ID NO: 44803 - DNA, 7 bp, Unknown
  misc_feature (1)..( 7): Matrix.001 file - promoters60/1026822
tttaata

SEQ ID NO: 44804 - DNA, 8 bp, Unknown
  misc_feature (1)..( 8): Matrix.001 file - promoters60/1026822
acagaaca

SEQ ID NO: 44805 - DNA, 8 bp, Unknown
  misc_feature (1)..( 8): Matrix.001 file - promoters60/1026822
aagaccat

SEQ ID NO: 44806 - DNA, 12 bp, Unknown
  misc_feature (1)..( 12): Matrix.001 file - promoters60/1026861
acattctcgaat

SEQ ID NO: 44807 - DNA, 8 bp, Unknown
  misc_feature (1)..( 8): Matrix.001 file - promoters60/1026861
atataaaa

SEQ ID NO: 44808 - DNA, 9 bp, Unknown
  misc_feature (1)..( 9): Matrix.001 file - promoters60/1026883
taaaataaa

SEQ ID NO: 44809 - DNA, 10 bp, Unknown
  misc_feature (1)..( 10): Matrix.001 file - promoters60/1026883
aatttgtcta

SEQ ID NO: 44810 - DNA, 7 bp, Unknown
  misc_feature (1)..( 7): Matrix.001 file - promoters60/1026976
aatgtag

SEQ ID NO: 44811 - DNA, 13 bp, Unknown
  misc_feature (1)..( 13): Matrix.001 file - promoters60/1026976
ttgaatcaaaatt

SEQ ID NO: 44812 - DNA, 6 bp, Unknown
  misc_feature (1)..( 6): Matrix.001 file - promoters60/1026976
aagaga

SEQ ID NO: 44813 - DNA, 6 bp, Unknown
  misc_feature (1)..( 6): Matrix.001 file - promoters60/1026976
tttgca

SEQ ID NO: 44814 - DNA, 6 bp, Unknown
  misc_feature (1)..( 6): Matrix.001 file - promoters60/1026976
tgaatc

SEQ ID NO: 44815 - DNA, 7 bp, Unknown
  misc_feature (1)..( 7): Matrix.001 file - promoters60/1026976
ataaata

SEQ ID NO: 44816 - DNA, 8 bp, Unknown
  misc_feature (1)..( 8): Matrix.001 file - promoters60/1026976
atttctgc

SEQ ID NO: 44817 - DNA, 8 bp, Unknown
  misc_feature (1)..( 8): Matrix.001 file - promoters60/1026976
agaacaag

SEQ ID NO: 44818 - DNA, 6 bp, Unknown
  misc_feature (1)..( 6): Matrix.001 file - promoters60/1026976
caagaa

SEQ ID NO: 44819 - DNA, 8 bp, Unknown
  misc_feature (1)..( 8): Matrix.001 file - promoters60/1026976
agaaagag

SEQ ID NO: 44820 - DNA, 9 bp, Unknown
  misc_feature (1)..( 9): Matrix.001 file - promoters60/1026976
ttgagaaag

SEQ ID NO: 44821 - DNA, 6 bp, Unknown
  misc_feature (1)..( 6): Matrix.001 file - promoters60/1026976
gaatgc

SEQ ID NO: 44822 - DNA, 9 bp, Unknown
  misc_feature (1)..( 9): Matrix.001 file - promoters60/1026976
atacttaat

SEQ ID NO: 44823 - DNA, 7 bp, Unknown
  misc_feature (1)..( 7): Matrix.001 file - promoters60/1026976
tggattt

SEQ ID NO: 44824 - DNA, 6 bp, Unknown
  misc_feature (1)..( 6): Matrix.001 file - promoters60/1026976
aagatt

SEQ ID NO: 44825 - DNA, 6 bp, Unknown
  misc_feature (1)..( 6): Matrix.001 file - promoters60/1026976
ttggtt

SEQ ID NO: 44826 - DNA, 6 bp, Unknown
  misc_feature (1)..( 6): Matrix.001 file - promoters60/1026976
ttaacc

SEQ ID NO: 44827 - DNA, 7 bp, Unknown
  misc_feature (1)..( 7): Matrix.001 file - promoters60/1026976
ctcactc

SEQ ID NO: 44828 - DNA, 12 bp, Unknown
  misc_feature (1)..( 12): Matrix.001 file - promoters60/1026983
gtgaaaaaataa

SEQ ID NO: 44829 - DNA, 10 bp, Unknown
  misc_feature (1)..( 10): Matrix.001 file - promoters60/1026987
caacttcctt

SEQ ID NO: 44830 - DNA, 7 bp, Unknown
  misc_feature (1)..( 7): Matrix.001 file - promoters60/1026987
tctataa

SEQ ID NO: 44831 - DNA, 11 bp, Unknown
  misc_feature (1)..( 11): Matrix.001 file - promoters60/1026987
tatttaaaaaa

SEQ ID NO: 44832 - DNA, 10 bp, Unknown
  misc_feature (1)..( 10): Matrix.001 file - promoters60/1026987
ctaaaaaata

SEQ ID NO: 44833 - DNA, 10 bp, Unknown
  misc_feature (1)..( 10): Matrix.001 file - promoters60/1026987
attaaaaaga

SEQ ID NO: 44834 - DNA, 8 bp, Unknown
  misc_feature (1)..( 8): Matrix.001 file - promoters60/1027002
tttgagag

SEQ ID NO: 44835 - DNA, 8 bp, Unknown
  misc_feature (1)..( 8): Matrix.001 file - promoters60/1027002
aaaaaaaa

SEQ ID NO: 44836 - DNA, 8 bp, Unknown
  misc_feature (1)..( 8): Matrix.001 file - promoters60/1027002
agttttta

SEQ ID NO: 44837 - DNA, 8 bp, Unknown
  misc_feature (1)..( 8): Matrix.001 file - promoters60/1027002
aaaaaatg

SEQ ID NO: 44838 - DNA, 7 bp, Unknown
  misc_feature (1)..( 7): Matrix.001 file - promoters60/1027002
tgaaaaa

SEQ ID NO: 44839 - DNA, 11 bp, Unknown
  misc_feature (1)..( 11): Matrix.001 file - promoters60/1027032
ttttaattata

SEQ ID NO: 44840 - DNA, 3 bp, Unknown
  misc_feature (1)..( 3): Matrix.001 file - promoters60/1027125
tta

SEQ ID NO: 44841 - DNA, 10 bp, Unknown
  misc_feature (1)..( 10): Matrix.001 file - promoters60/1027125
aagtttttga

SEQ ID NO: 44842 - DNA, 7 bp, Unknown
  misc_feature (1)..( 7): Matrix.001 file - promoters60/1027125
ttttgta

SEQ ID NO: 44843 - DNA, 7 bp, Unknown
  misc_feature (1)..( 7): Matrix.001 file - promoters60/1027125
tgtaaaa

SEQ ID NO: 44844 - DNA, 9 bp, Unknown
  misc_feature (1)..( 9): Matrix.001 file - promoters60/1027125
acaaaaaga

SEQ ID NO: 44845 - DNA, 9 bp, Unknown
  misc_feature (1)..( 9): Matrix.001 file - promoters60/1027125
ttagctaaa

SEQ ID NO: 44846 - DNA, 12 bp, Unknown
  misc_feature (1)..( 12): Matrix.001 file - promoters60/1027125
aaaaataaaatt

SEQ ID NO: 44847 - DNA, 12 bp, Unknown
  misc_feature (1)..( 12): Matrix.001 file - promoters60/1027125
tgtatcatcatc

SEQ ID NO: 44848 - DNA, 8 bp, Unknown
  misc_feature (1)..( 8): Matrix.001 file - promoters60/1027156
atacaata

SEQ ID NO: 44849 - DNA, 9 bp, Unknown
  misc_feature (1)..( 9): Matrix.001 file - promoters60/1027156
aaagtaaac

SEQ ID NO: 44850 - DNA, 10 bp, Unknown
  misc_feature (1)..( 10): Matrix.001 file - promoters60/1027156
aaaataagtt

SEQ ID NO: 44851 - DNA, 9 bp, Unknown
  misc_feature (1)..( 9): Matrix.001 file - promoters60/1027156
caaaaacta

SEQ ID NO: 44852 - DNA, 8 bp, Unknown
  misc_feature (1)..( 8): Matrix.001 file - promoters60/1027171
ttttctta

SEQ ID NO: 44853 - DNA, 8 bp, Unknown
  misc_feature (1)..( 8): Matrix.001 file - promoters60/1027171
aaaaacaa

SEQ ID NO: 44854 - DNA, 7 bp, Unknown
  misc_feature (1)..( 7): Matrix.001 file - promoters60/1027171
attcaaa

SEQ ID NO: 44855 - DNA, 6 bp, Unknown
  misc_feature (1)..( 6): Matrix.001 file - promoters60/1027171
aaagat

SEQ ID NO: 44856 - DNA, 7 bp, Unknown
  misc_feature (1)..( 7): Matrix.001 file - promoters60/1027171
ttaatca

SEQ ID NO: 44857 - DNA, 7 bp, Unknown
  misc_feature (1)..( 7): Matrix.001 file - promoters60/1027171
ccaaagc

SEQ ID NO: 44858 - DNA, 6 bp, Unknown
  misc_feature (1)..( 6): Matrix.001 file - promoters60/1027171
aaaaca

SEQ ID NO: 44859 - DNA, 7 bp, Unknown
  misc_feature (1)..( 7): Matrix.001 file - promoters60/1027171
agtagga

SEQ ID NO: 44860 - DNA, 10 bp, Unknown
  misc_feature (1)..( 10): Matrix.001 file - promoters60/1027171
tataattcaa

SEQ ID NO: 44861 - DNA, 6 bp, Unknown
  misc_feature (1)..( 6): Matrix.001 file - promoters60/1027171
aaactc

SEQ ID NO: 44862 - DNA, 7 bp, Unknown
  misc_feature (1)..( 7): Matrix.001 file - promoters60/1027171
ttcaaca

SEQ ID NO: 44863 - DNA, 7 bp, Unknown
  misc_feature (1)..( 7): Matrix.001 file - promoters60/1027171
accatca

SEQ ID NO: 44864 - DNA, 6 bp, Unknown
  misc_feature (1)..( 6): Matrix.001 file - promoters60/1027171
ataaag

SEQ ID NO: 44865 - DNA, 10 bp, Unknown
  misc_feature (1)..( 10): Matrix.001 file - promoters60/1027171
caaaaaataa

SEQ ID NO: 44866 - DNA, 7 bp, Unknown
  misc_feature (1)..( 7): Matrix.001 file - promoters60/1027171
aatctag

SEQ ID NO: 44867 - DNA, 7 bp, Unknown
  misc_feature (1)..( 7): Matrix.001 file - promoters60/1027171
agataaa

SEQ ID NO: 44868 - DNA, 7 bp, Unknown
  misc_feature (1)..( 7): Matrix.001 file - promoters60/1027171
aaactta

SEQ ID NO: 44869 - DNA, 10 bp, Unknown
  misc_feature (1)..( 10): Matrix.001 file - promoters60/1027171
acaaacatta

SEQ ID NO: 44870 - DNA, 8 bp, Unknown
  misc_feature (1)..( 8): Matrix.001 file - promoters60/1027171
aaaaaaac

SEQ ID NO: 44871 - DNA, 6 bp, Unknown
  misc_feature (1)..( 6): Matrix.001 file - promoters60/1027171
aaacat

SEQ ID NO: 44872 - DNA, 6 bp, Unknown
  misc_feature (1)..( 6): Matrix.001 file - promoters60/1027171
taatat

SEQ ID NO: 44873 - DNA, 9 bp, Unknown
  misc_feature (1)..( 9): Matrix.001 file - promoters60/1027189
cagaaaaat

SEQ ID NO: 44874 - DNA, 9 bp, Unknown
  misc_feature (1)..( 9): Matrix.001 file - promoters60/1027189
cattgattt

SEQ ID NO: 44875 - DNA, 7 bp, Unknown
  misc_feature (1)..( 7): Matrix.001 file - promoters60/1027189
tattatg

SEQ ID NO: 44876 - DNA, 11 bp, Unknown
  misc_feature (1)..( 11): Matrix.001 file - promoters60/1027189
tatataacaaa

SEQ ID NO: 44877 - DNA, 7 bp, Unknown
  misc_feature (1)..( 7): Matrix.001 file - promoters60/1027189
aaacaaa

SEQ ID NO: 44878 - DNA, 15 bp, Unknown
  misc_feature (1)..( 15): Matrix.001 file - promoters60/1027189
ataattattttatcc

SEQ ID NO: 44879 - DNA, 15 bp, Unknown
  misc_feature (1)..( 15): Matrix.001 file - promoters60/1027201
aaatcatctcaatgc

SEQ ID NO: 44880 - DNA, 7 bp, Unknown
  misc_feature (1)..( 7): Matrix.001 file - promoters60/1027201
cataata

SEQ ID NO: 44881 - DNA, 8 bp, Unknown
  misc_feature (1)..( 8): Matrix.001 file - promoters60/1027201
caagaaca

SEQ ID NO: 44882 - DNA, 6 bp, Unknown
  misc_feature (1)..( 6): Matrix.001 file - promoters60/1027201
aattaa

SEQ ID NO: 44883 - DNA, 6 bp, Unknown
  misc_feature (1)..( 6): Matrix.001 file - promoters60/1027201
gatgaa

SEQ ID NO: 44884 - DNA, 6 bp, Unknown
  misc_feature (1)..( 6): Matrix.001 file - promoters60/1027201
ctctct

SEQ ID NO: 44885 - DNA, 7 bp, Unknown
  misc_feature (1)..( 7): Matrix.001 file - promoters60/1027201
tcgaatt

SEQ ID NO: 44886 - DNA, 9 bp, Unknown
  misc_feature (1)..( 9): Matrix.001 file - promoters60/1027201
aagctcgat

SEQ ID NO: 44887 - DNA, 6 bp, Unknown
  misc_feature (1)..( 6): Matrix.001 file - promoters60/1027201
gaaaaa

SEQ ID NO: 44888 - DNA, 7 bp, Unknown
  misc_feature (1)..( 7): Matrix.001 file - promoters60/1027201
aaaaaat

SEQ ID NO: 44889 - DNA, 7 bp, Unknown
  misc_feature (1)..( 7): Matrix.001 file - promoters60/1027201
attggtt

SEQ ID NO: 44890 - DNA, 6 bp, Unknown
  misc_feature (1)..( 6): Matrix.001 file - promoters60/1027201
aaactt

SEQ ID NO: 44891 - DNA, 8 bp, Unknown
  misc_feature (1)..( 8): Matrix.001 file - promoters60/1027201
aaaattaa

SEQ ID NO: 44892 - DNA, 7 bp, Unknown
  misc_feature (1)..( 7): Matrix.001 file - promoters60/1027201
tactata

SEQ ID NO: 44893 - DNA, 7 bp, Unknown
  misc_feature (1)..( 7): Matrix.001 file - promoters60/1027240
agatttt

SEQ ID NO: 44894 - DNA, 10 bp, Unknown
  misc_feature (1)..( 10): Matrix.001 file - promoters60/1027240
caaaatattt

SEQ ID NO: 44895 - DNA, 10 bp, Unknown
  misc_feature (1)..( 10): Matrix.001 file - promoters60/1027240
ttaaaccgaa

SEQ ID NO: 44896 - DNA, 8 bp, Unknown
  misc_feature (1)..( 8): Matrix.001 file - promoters60/1027240
aatcaaaa

SEQ ID NO: 44897 - DNA, 8 bp, Unknown
  misc_feature (1)..( 8): Matrix.001 file - promoters60/1027240
taacccta

SEQ ID NO: 44898 - DNA, 9 bp, Unknown
  misc_feature (1)..( 9): Matrix.001 file - promoters60/1027240
catggtcca

SEQ ID NO: 44899 - DNA, 12 bp, Unknown
  misc_feature (1)..( 12): Matrix.001 file - promoters60/1027240
atataaaacgaa

SEQ ID NO: 44900 - DNA, 6 bp, Unknown
  misc_feature (1)..( 6): Matrix.001 file - promoters60/1027240
aaaaac

SEQ ID NO: 44901 - DNA, 12 bp, Unknown
  misc_feature (1)..( 12): Matrix.001 file - promoters60/1027240
taagataaacac

SEQ ID NO: 44902 - DNA, 7 bp, Unknown
  misc_feature (1)..( 7): Matrix.001 file - promoters60/1027243
tatatat

SEQ ID NO: 44903 - DNA, 6 bp, Unknown
  misc_feature (1)..( 6): Matrix.001 file - promoters60/1027243
ttttat

SEQ ID NO: 44904 - DNA, 7 bp, Unknown
  misc_feature (1)..( 7): Matrix.001 file - promoters60/1027243
taaactt

SEQ ID NO: 44905 - DNA, 7 bp, Unknown
  misc_feature (1)..( 7): Matrix.001 file - promoters60/1027243
gcaaaat

SEQ ID NO: 44906 - DNA, 7 bp, Unknown
  misc_feature (1)..( 7): Matrix.001 file - promoters60/1027243
agtgttg

SEQ ID NO: 44907 - DNA, 8 bp, Unknown
  misc_feature (1)..( 8): Matrix.001 file - promoters60/1027243
tagaagtt

SEQ ID NO: 44908 - DNA, 7 bp, Unknown
  misc_feature (1)..( 7): Matrix.001 file - promoters60/1027243
agtgaat

SEQ ID NO: 44909 - DNA, 6 bp, Unknown
  misc_feature (1)..( 6): Matrix.001 file - promoters60/1027243
caaaac

SEQ ID NO: 44910 - DNA, 7 bp, Unknown
  misc_feature (1)..( 7): Matrix.001 file - promoters60/1027243
taactct

SEQ ID NO: 44911 - DNA, 7 bp, Unknown
  misc_feature (1)..( 7): Matrix.001 file - promoters60/1027243
attcata

SEQ ID NO: 44912 - DNA, 6 bp, Unknown
  misc_feature (1)..( 6): Matrix.001 file - promoters60/1027243
tattaa

SEQ ID NO: 44913 - DNA, 9 bp, Unknown
  misc_feature (1)..( 9): Matrix.001 file - promoters60/1027243
ataataaca

SEQ ID NO: 44914 - DNA, 7 bp, Unknown
  misc_feature (1)..( 7): Matrix.001 file - promoters60/1027243
atagtat

SEQ ID NO: 44915 - DNA, 6 bp, Unknown
  misc_feature (1)..( 6): Matrix.001 file - promoters60/1027243
aatctt

SEQ ID NO: 44916 - DNA, 6 bp, Unknown
  misc_feature (1)..( 6): Matrix.001 file - promoters60/1027243
tttttt

SEQ ID NO: 44917 - DNA, 11 bp, Unknown
  misc_feature (1)..( 11): Matrix.001 file - promoters60/1027243
cattgatactt

SEQ ID NO: 44918 - DNA, 8 bp, Unknown
  misc_feature (1)..( 8): Matrix.001 file - promoters60/1027243
aaagaaaa

SEQ ID NO: 44919 - DNA, 6 bp, Unknown
  misc_feature (1)..( 6): Matrix.001 file - promoters60/1027243
taataa

SEQ ID NO: 44920 - DNA, 6 bp, Unknown
  misc_feature (1)..( 6): Matrix.001 file - promoters60/1027243
cacaca

SEQ ID NO: 44921 - DNA, 8 bp, Unknown
  misc_feature (1)..( 8): Matrix.001 file - promoters60/1027243
atttactt

SEQ ID NO: 44922 - DNA, 8 bp, Unknown
  misc_feature (1)..( 8): Matrix.001 file - promoters60/1027243
atcaaaac

SEQ ID NO: 44923 - DNA, 8 bp, Unknown
  misc_feature (1)..( 8): Matrix.001 file - promoters60/1027243
cttcttca

SEQ ID NO: 44924 - DNA, 8 bp, Unknown
  misc_feature (1)..( 8): Matrix.001 file - promoters60/1027276
acatatta

SEQ ID NO: 44925 - DNA, 10 bp, Unknown
  misc_feature (1)..( 10): Matrix.001 file - promoters60/1027276
attttattct

SEQ ID NO: 44926 - DNA, 14 bp, Unknown
  misc_feature (1)..( 14): Matrix.001 file - promoters60/1027327
acttgtaaatgtat

SEQ ID NO: 44927 - DNA, 12 bp, Unknown
  misc_feature (1)..( 12): Matrix.001 file - promoters60/1027327
gaaaaaataaat

SEQ ID NO: 44928 - DNA, 11 bp, Unknown
  misc_feature (1)..( 11): Matrix.001 file - promoters60/1027327
aaaaatttata

SEQ ID NO: 44929 - DNA, 15 bp, Unknown
  misc_feature (1)..( 15): Matrix.001 file - promoters60/1027327
aataaaattttaact

SEQ ID NO: 44930 - DNA, 11 bp, Unknown
  misc_feature (1)..( 11): Matrix.001 file - promoters60/1027327
gtaaaaattaa

SEQ ID NO: 44931 - DNA, 11 bp, Unknown
  misc_feature (1)..( 11): Matrix.001 file - promoters60/1027399
tgataaaaata

SEQ ID NO: 44932 - DNA, 10 bp, Unknown
  misc_feature (1)..( 10): Matrix.001 file - promoters60/1027399
caaagtaatg

SEQ ID NO: 44933 - DNA, 12 bp, Unknown
  misc_feature (1)..( 12): Matrix.001 file - promoters60/1027406
aaaaaatatgaa

SEQ ID NO: 44934 - DNA, 10 bp, Unknown
  misc_feature (1)..( 10): Matrix.001 file - promoters60/1027406
acaatttttc

SEQ ID NO: 44935 - DNA, 8 bp, Unknown
  misc_feature (1)..( 8): Matrix.001 file - promoters60/1027406
aattttta

SEQ ID NO: 44936 - DNA, 9 bp, Unknown
  misc_feature (1)..( 9): Matrix.001 file - promoters60/1027406
aatgaatat

SEQ ID NO: 44937 - DNA, 11 bp, Unknown
  misc_feature (1)..( 11): Matrix.001 file - promoters60/1027406
taactttttgt

SEQ ID NO: 44938 - DNA, 12 bp, Unknown
  misc_feature (1)..( 12): Matrix.001 file - promoters60/1027406
taaagatttttc

SEQ ID NO: 44939 - DNA, 16 bp, Unknown
  misc_feature (1)..( 16): Matrix.001 file - promoters60/1027406
attttaaggaaaaatt

SEQ ID NO: 44940 - DNA, 14 bp, Unknown
  misc_feature (1)..( 14): Matrix.001 file - promoters60/1027406
attttaaaaaaaaa

SEQ ID NO: 44941 - DNA, 8 bp, Unknown
  misc_feature (1)..( 8): Matrix.001 file - promoters60/1027406
atgaaatg

SEQ ID NO: 44942 - DNA, 9 bp, Unknown
  misc_feature (1)..( 9): Matrix.001 file - promoters60/1027434
aaattattt

SEQ ID NO: 44943 - DNA, 11 bp, Unknown
  misc_feature (1)..( 11): Matrix.001 file - promoters60/1027452
taatttcgtaa

SEQ ID NO: 44944 - DNA, 9 bp, Unknown
  misc_feature (1)..( 9): Matrix.001 file - promoters60/1027456
actttattt

SEQ ID NO: 44945 - DNA, 8 bp, Unknown
  misc_feature (1)..( 8): Matrix.001 file - promoters60/1027456
tgtatctg

SEQ ID NO: 44946 - DNA, 7 bp, Unknown
  misc_feature (1)..( 7): Matrix.001 file - promoters60/1027456
attatcc

SEQ ID NO: 44947 - DNA, 9 bp, Unknown
  misc_feature (1)..( 9): Matrix.001 file - promoters60/1027456
tattttttt

SEQ ID NO: 44948 - DNA, 9 bp, Unknown
  misc_feature (1)..( 9): Matrix.001 file - promoters60/1027456
tatgagtca

SEQ ID NO: 44949 - DNA, 8 bp, Unknown
  misc_feature (1)..( 8): Matrix.001 file - promoters60/1027456
ataaattc

SEQ ID NO: 44950 - DNA, 15 bp, Unknown
  misc_feature (1)..( 15): Matrix.001 file - promoters60/1027456
tatatataaaaattc

SEQ ID NO: 44951 - DNA, 11 bp, Unknown
  misc_feature (1)..( 11): Matrix.001 file - promoters60/1027456
agaattgtatt

SEQ ID NO: 44952 - DNA, 12 bp, Unknown
  misc_feature (1)..( 12): Matrix.001 file - promoters60/1027456
gaaagaaatata

SEQ ID NO: 44953 - DNA, 10 bp, Unknown
  misc_feature (1)..( 10): Matrix.001 file - promoters60/1027456
attcatttta

SEQ ID NO: 44954 - DNA, 11 bp, Unknown
  misc_feature (1)..( 11): Matrix.001 file - promoters60/1027456
atatcttaaat

SEQ ID NO: 44955 - DNA, 13 bp, Unknown
  misc_feature (1)..( 13): Matrix.001 file - promoters60/1027456
ttattacttacaa

SEQ ID NO: 44956 - DNA, 12 bp, Unknown
  misc_feature (1)..( 12): Matrix.001 file - promoters60/1027456
tacaatatattt

SEQ ID NO: 44957 - DNA, 15 bp, Unknown
  misc_feature (1)..( 15): Matrix.001 file - promoters60/1027456
ttagtaaatcatcgt

SEQ ID NO: 44958 - DNA, 14 bp, Unknown
  misc_feature (1)..( 14): Matrix.001 file - promoters60/1027460
gactttgacacaaa

SEQ ID NO: 44959 - DNA, 7 bp, Unknown
  misc_feature (1)..( 7): Matrix.001 file - promoters60/1027460
aaaaata

SEQ ID NO: 44960 - DNA, 9 bp, Unknown
  misc_feature (1)..( 9): Matrix.001 file - promoters60/1027460
gaaaacata

SEQ ID NO: 44961 - DNA, 8 bp, Unknown
  misc_feature (1)..( 8): Matrix.001 file - promoters60/1027460
aagagaac

SEQ ID NO: 44962 - DNA, 7 bp, Unknown
  misc_feature (1)..( 7): Matrix.001 file - promoters60/1027460
gagtaaa

SEQ ID NO: 44963 - DNA, 13 bp, Unknown
  misc_feature (1)..( 13): Matrix.001 file - promoters60/1027460
agactttgaaaca

SEQ ID NO: 44964 - DNA, 10 bp, Unknown
  misc_feature (1)..( 10): Matrix.001 file - promoters60/1027492
tcagaagttt

SEQ ID NO: 44965 - DNA, 14 bp, Unknown
  misc_feature (1)..( 14): Matrix.001 file - promoters60/1027492
gagaattattgaaa

SEQ ID NO: 44966 - DNA, 10 bp, Unknown
  misc_feature (1)..( 10): Matrix.001 file - promoters60/1027492
aaaataggct

SEQ ID NO: 44967 - DNA, 15 bp, Unknown
  misc_feature (1)..( 15): Matrix.001 file - promoters60/1027590
aacaaagattcttta

SEQ ID NO: 44968 - DNA, 9 bp, Unknown
  misc_feature (1)..( 9): Matrix.001 file - promoters60/1027590
gatttttaa

SEQ ID NO: 44969 - DNA, 11 bp, Unknown
  misc_feature (1)..( 11): Matrix.001 file - promoters60/1027590
gtattttttcc

SEQ ID NO: 44970 - DNA, 12 bp, Unknown
  misc_feature (1)..( 12): Matrix.001 file - promoters60/1027596
tactttctggca

SEQ ID NO: 44971 - DNA, 8 bp, Unknown
  misc_feature (1)..( 8): Matrix.001 file - promoters60/1027596
aaaaagtt

SEQ ID NO: 44972 - DNA, 9 bp, Unknown
  misc_feature (1)..( 9): Matrix.001 file - promoters60/1027596
ctttattaa

SEQ ID NO: 44973 - DNA, 10 bp, Unknown
  misc_feature (1)..( 10): Matrix.001 file - promoters60/1027596
gacgaaatga

SEQ ID NO: 44974 - DNA, 10 bp, Unknown
  misc_feature (1)..( 10): Matrix.001 file - promoters60/1027596
taattttctt

SEQ ID NO: 44975 - DNA, 10 bp, Unknown
  misc_feature (1)..( 10): Matrix.001 file - promoters60/1027596
gttatcattc

SEQ ID NO: 44976 - DNA, 11 bp, Unknown
  misc_feature (1)..( 11): Matrix.001 file - promoters60/1027652
ttagcatttat

SEQ ID NO: 44977 - DNA, 9 bp, Unknown
  misc_feature (1)..( 9): Matrix.001 file - promoters60/1027652
tttatgttt

SEQ ID NO: 44978 - DNA, 10 bp, Unknown
  misc_feature (1)..( 10): Matrix.001 file - promoters60/1027652
atactcaaac

SEQ ID NO: 44979 - DNA, 8 bp, Unknown
  misc_feature (1)..( 8): Matrix.001 file - promoters60/1027652
taaagaaa

SEQ ID NO: 44980 - DNA, 7 bp, Unknown
  misc_feature (1)..( 7): Matrix.001 file - promoters60/1027652
ttttgta

SEQ ID NO: 44981 - DNA, 19 bp, Unknown
  misc_feature (1)..( 19): Matrix.001 file - promoters60/1027652
gaaaaattattaaattata

SEQ ID NO: 44982 - DNA, 10 bp, Unknown
  misc_feature (1)..( 10): Matrix.001 file - promoters60/1027652
gtaaaaaaag

SEQ ID NO: 44983 - DNA, 9 bp, Unknown
  misc_feature (1)..( 9): Matrix.001 file - promoters60/1027652
tatataaat

SEQ ID NO: 44984 - DNA, 8 bp, Unknown
  misc_feature (1)..( 8): Matrix.001 file - promoters60/1027652
aaattcca

SEQ ID NO: 44985 - DNA, 11 bp, Unknown
  misc_feature (1)..( 11): Matrix.001 file - promoters60/1027652
aaaatcaagat

SEQ ID NO: 44986 - DNA, 11 bp, Unknown
  misc_feature (1)..( 11): Matrix.001 file - promoters60/1027652
acaaatttcta

SEQ ID NO: 44987 - DNA, 9 bp, Unknown
  misc_feature (1)..( 9): Matrix.001 file - promoters60/1027652
aataatatt

SEQ ID NO: 44988 - DNA, 10 bp, Unknown
  misc_feature (1)..( 10): Matrix.001 file - promoters60/1027652
aaaaattaag

SEQ ID NO: 44989 - DNA, 6 bp, Unknown
  misc_feature (1)..( 6): Matrix.001 file - promoters60/1027673
atcaca

SEQ ID NO: 44990 - DNA, 7 bp, Unknown
  misc_feature (1)..( 7): Matrix.001 file - promoters60/1027673
tttcgta

SEQ ID NO: 44991 - DNA, 6 bp, Unknown
  misc_feature (1)..( 6): Matrix.001 file - promoters60/1027673
agaaga

SEQ ID NO: 44992 - DNA, 7 bp, Unknown
  misc_feature (1)..( 7): Matrix.001 file - promoters60/1027673
ttggaga

SEQ ID NO: 44993 - DNA, 9 bp, Unknown
  misc_feature (1)..( 9): Matrix.001 file - promoters60/1027673
gagagagag

SEQ ID NO: 44994 - DNA, 7 bp, Unknown
  misc_feature (1)..( 7): Matrix.001 file - promoters60/1027673
caaatta

SEQ ID NO: 44995 - DNA, 8 bp, Unknown
  misc_feature (1)..( 8): Matrix.001 file - promoters60/1027673
aaatacga

SEQ ID NO: 44996 - DNA, 8 bp, Unknown
  misc_feature (1)..( 8): Matrix.001 file - promoters60/1027673
agaagaag

SEQ ID NO: 44997 - DNA, 6 bp, Unknown
  misc_feature (1)..( 6): Matrix.001 file - promoters60/1027673
tgtttc

SEQ ID NO: 44998 - DNA, 9 bp, Unknown
  misc_feature (1)..( 9): Matrix.001 file - promoters60/1027725
cataaaagt

SEQ ID NO: 44999 - DNA, 10 bp, Unknown
  misc_feature (1)..( 10): Matrix.001 file - promoters60/1027725
ttgtatttgt

SEQ ID NO: 45000 - DNA, 12 bp, Unknown
  misc_feature (1)..( 12): Matrix.001 file - promoters60/1027725
ttactttcattg

SEQ ID NO: 45001 - DNA, 11 bp, Unknown
  misc_feature (1)..( 11): Matrix.001 file - promoters60/1027725
aaaagtttatg

SEQ ID NO: 45002 - DNA, 8 bp, Unknown
  misc_feature (1)..( 8): Matrix.001 file - promoters60/1027765
taaaaaaa

SEQ ID NO: 45003 - DNA, 11 bp, Unknown
  misc_feature (1)..( 11): Matrix.001 file - promoters60/1027765
aaaattttata

SEQ ID NO: 45004 - DNA, 7 bp, Unknown
  misc_feature (1)..( 7): Matrix.001 file - promoters60/1027765
ttacaaa

SEQ ID NO: 45005 - DNA, 12 bp, Unknown
  misc_feature (1)..( 12): Matrix.001 file - promoters60/1027765
atatttttttgt

SEQ ID NO: 45006 - DNA, 7 bp, Unknown
  misc_feature (1)..( 7): Matrix.001 file - promoters60/1027765
ttaaaat

SEQ ID NO: 45007 - DNA, 8 bp, Unknown
  misc_feature (1)..( 8): Matrix.001 file - promoters60/1027765
aaaagaac

SEQ ID NO: 45008 - DNA, 11 bp, Unknown
  misc_feature (1)..( 11): Matrix.001 file - promoters60/1027765
tataatttaca

SEQ ID NO: 45009 - DNA, 9 bp, Unknown
  misc_feature (1)..( 9): Matrix.001 file - promoters60/1027765
taaaaattg

SEQ ID NO: 45010 - DNA, 9 bp, Unknown
  misc_feature (1)..( 9): Matrix.001 file - promoters60/1027869
atcgtttac

SEQ ID NO: 45011 - DNA, 6 bp, Unknown
  misc_feature (1)..( 6): Matrix.001 file - promoters60/1027869
gatttg

SEQ ID NO: 45012 - DNA, 10 bp, Unknown
  misc_feature (1)..( 10): Matrix.001 file - promoters60/1027869
aaagatcgaa

SEQ ID NO: 45013 - DNA, 7 bp, Unknown
  misc_feature (1)..( 7): Matrix.001 file - promoters60/1027869
aacaaat

SEQ ID NO: 45014 - DNA, 6 bp, Unknown
  misc_feature (1)..( 6): Matrix.001 file - promoters60/1027869
aattta

SEQ ID NO: 45015 - DNA, 7 bp, Unknown
  misc_feature (1)..( 7): Matrix.001 file - promoters60/1027869
ttacaat

SEQ ID NO: 45016 - DNA, 7 bp, Unknown
  misc_feature (1)..( 7): Matrix.001 file - promoters60/1027869
tttacaa

SEQ ID NO: 45017 - DNA, 7 bp, Unknown
  misc_feature (1)..( 7): Matrix.001 file - promoters60/1027869
agaaaca

SEQ ID NO: 45018 - DNA, 11 bp, Unknown
  misc_feature (1)..( 11): Matrix.001 file - promoters60/1027869
tataaacatct

SEQ ID NO: 45019 - DNA, 7 bp, Unknown
  misc_feature (1)..( 7): Matrix.001 file - promoters60/1027869
atgaaga

SEQ ID NO: 45020 - DNA, 7 bp, Unknown
  misc_feature (1)..( 7): Matrix.001 file - promoters60/1027873
tttattt

SEQ ID NO: 45021 - DNA, 10 bp, Unknown
  misc_feature (1)..( 10): Matrix.001 file - promoters60/1027873
tttttaacaa

SEQ ID NO: 45022 - DNA, 6 bp, Unknown
  misc_feature (1)..( 6): Matrix.001 file - promoters60/1027873
agttaa

SEQ ID NO: 45023 - DNA, 6 bp, Unknown
  misc_feature (1)..( 6): Matrix.001 file - promoters60/1027873
ttttgg

SEQ ID NO: 45024 - DNA, 6 bp, Unknown
  misc_feature (1)..( 6): Matrix.001 file - promoters60/1027873
aataat

SEQ ID NO: 45025 - DNA, 7 bp, Unknown
  misc_feature (1)..( 7): Matrix.001 file - promoters60/1027873
taaatta

SEQ ID NO: 45026 - DNA, 13 bp, Unknown
  misc_feature (1)..( 13): Matrix.001 file - promoters60/1027873
accaaaatcatat

SEQ ID NO: 45027 - DNA, 8 bp, Unknown
  misc_feature (1)..( 8): Matrix.001 file - promoters60/1027873
tttgggta

SEQ ID NO: 45028 - DNA, 6 bp, Unknown
  misc_feature (1)..( 6): Matrix.001 file - promoters60/1027873
atggtt

SEQ ID NO: 45029 - DNA, 9 bp, Unknown
  misc_feature (1)..( 9): Matrix.001 file - promoters60/1027873
atttagcaa

SEQ ID NO: 45030 - DNA, 6 bp, Unknown
  misc_feature (1)..( 6): Matrix.001 file - promoters60/1027873
cgattt

SEQ ID NO: 45031 - DNA, 7 bp, Unknown
  misc_feature (1)..( 7): Matrix.001 file - promoters60/1027873
atgacta

SEQ ID NO: 45032 - DNA, 6 bp, Unknown
  misc_feature (1)..( 6): Matrix.001 file - promoters60/1027873
attttt

SEQ ID NO: 45033 - DNA, 8 bp, Unknown
  misc_feature (1)..( 8): Matrix.001 file - promoters60/1027873
catttttg

SEQ ID NO: 45034 - DNA, 8 bp, Unknown
  misc_feature (1)..( 8): Matrix.001 file - promoters60/1027873
tggggttg

SEQ ID NO: 45035 - DNA, 10 bp, Unknown
  misc_feature (1)..( 10): Matrix.001 file - promoters60/1027873
aaagagctta

SEQ ID NO: 45036 - DNA, 10 bp, Unknown
  misc_feature (1)..( 10): Matrix.001 file - promoters60/1027873
gaccaaacca

SEQ ID NO: 45037 - DNA, 7 bp, Unknown
  misc_feature (1)..( 7): Matrix.001 file - promoters60/1027873
taaaaag

SEQ ID NO: 45038 - DNA, 8 bp, Unknown
  misc_feature (1)..( 8): Matrix.001 file - promoters60/1027877
atcaagaa

SEQ ID NO: 45039 - DNA, 8 bp, Unknown
  misc_feature (1)..( 8): Matrix.001 file - promoters60/1027877
aatcgaaa

SEQ ID NO: 45040 - DNA, 8 bp, Unknown
  misc_feature (1)..( 8): Matrix.001 file - promoters60/1027877
taagaatc

SEQ ID NO: 45041 - DNA, 7 bp, Unknown
  misc_feature (1)..( 7): Matrix.001 file - promoters60/1027877
tttcttt

SEQ ID NO: 45042 - DNA, 8 bp, Unknown
  misc_feature (1)..( 8): Matrix.001 file - promoters60/1027877
ttgtagaa

SEQ ID NO: 45043 - DNA, 7 bp, Unknown
  misc_feature (1)..( 7): Matrix.001 file - promoters60/1027877
acaagta

SEQ ID NO: 45044 - DNA, 6 bp, Unknown
  misc_feature (1)..( 6): Matrix.001 file - promoters60/1027877
caagaa

SEQ ID NO: 45045 - DNA, 6 bp, Unknown
  misc_feature (1)..( 6): Matrix.001 file - promoters60/1027877
atgaca

SEQ ID NO: 45046 - DNA, 6 bp, Unknown
  misc_feature (1)..( 6): Matrix.001 file - promoters60/1027877
actggt

SEQ ID NO: 45047 - DNA, 10 bp, Unknown
  misc_feature (1)..( 10): Matrix.001 file - promoters60/1027877
atcacttgat

SEQ ID NO: 45048 - DNA, 9 bp, Unknown
  misc_feature (1)..( 9): Matrix.001 file - promoters60/1027877
attgaaata

SEQ ID NO: 45049 - DNA, 8 bp, Unknown
  misc_feature (1)..( 8): Matrix.001 file - promoters60/1027914
tctattct

SEQ ID NO: 45050 - DNA, 7 bp, Unknown
  misc_feature (1)..( 7): Matrix.001 file - promoters60/1027914
ttgatta

SEQ ID NO: 45051 - DNA, 11 bp, Unknown
  misc_feature (1)..( 11): Matrix.001 file - promoters60/1027914
tatataataac

SEQ ID NO: 45052 - DNA, 11 bp, Unknown
  misc_feature (1)..( 11): Matrix.001 file - promoters60/1027928
aatttttcaac

SEQ ID NO: 45053 - DNA, 13 bp, Unknown
  misc_feature (1)..( 13): Matrix.001 file - promoters60/1027928
actatttataaat

SEQ ID NO: 45054 - DNA, 10 bp, Unknown
  misc_feature (1)..( 10): Matrix.001 file - promoters60/1027928
agtgtcaaat

SEQ ID NO: 45055 - DNA, 8 bp, Unknown
  misc_feature (1)..( 8): Matrix.001 file - promoters60/1027928
tataaata

SEQ ID NO: 45056 - DNA, 6 bp, Unknown
  misc_feature (1)..( 6): Matrix.001 file - promoters60/1027970
ttttgt

SEQ ID NO: 45057 - DNA, 6 bp, Unknown
  misc_feature (1)..( 6): Matrix.001 file - promoters60/1027970
tatatt

SEQ ID NO: 45058 - DNA, 6 bp, Unknown
  misc_feature (1)..( 6): Matrix.001 file - promoters60/1027970
tattat

SEQ ID NO: 45059 - DNA, 7 bp, Unknown
  misc_feature (1)..( 7): Matrix.001 file - promoters60/1027970
attattc

SEQ ID NO: 45060 - DNA, 6 bp, Unknown
  misc_feature (1)..( 6): Matrix.001 file - promoters60/1027970
taaaga

SEQ ID NO: 45061 - DNA, 6 bp, Unknown
  misc_feature (1)..( 6): Matrix.001 file - promoters60/1027970
agtttt

SEQ ID NO: 45062 - DNA, 7 bp, Unknown
  misc_feature (1)..( 7): Matrix.001 file - promoters60/1027970
tcggtta

SEQ ID NO: 45063 - DNA, 8 bp, Unknown
  misc_feature (1)..( 8): Matrix.001 file - promoters60/1027970
taagattc

SEQ ID NO: 45064 - DNA, 6 bp, Unknown
  misc_feature (1)..( 6): Matrix.001 file - promoters60/1027970
aagtga

SEQ ID NO: 45065 - DNA, 10 bp, Unknown
  misc_feature (1)..( 10): Matrix.001 file - promoters60/1027970
ttaatttctt

SEQ ID NO: 45066 - DNA, 12 bp, Unknown
  misc_feature (1)..( 12): Matrix.001 file - promoters60/1027970
ttggaaaacatg

SEQ ID NO: 45067 - DNA, 7 bp, Unknown
  misc_feature (1)..( 7): Matrix.001 file - promoters60/1027970
cttccgt

SEQ ID NO: 45068 - DNA, 6 bp, Unknown
  misc_feature (1)..( 6): Matrix.001 file - promoters60/1027970
attatt

SEQ ID NO: 45069 - DNA, 7 bp, Unknown
  misc_feature (1)..( 7): Matrix.001 file - promoters60/1027970
gagctaa

SEQ ID NO: 45070 - DNA, 6 bp, Unknown
  misc_feature (1)..( 6): Matrix.001 file - promoters60/1027970
aataaa

SEQ ID NO: 45071 - DNA, 6 bp, Unknown
  misc_feature (1)..( 6): Matrix.001 file - promoters60/1027970
aaaatt

SEQ ID NO: 45072 - DNA, 7 bp, Unknown
  misc_feature (1)..( 7): Matrix.001 file - promoters60/1027990
aaaaccc

SEQ ID NO: 45073 - DNA, 6 bp, Unknown
  misc_feature (1)..( 6): Matrix.001 file - promoters60/1027990
tagaaa

SEQ ID NO: 45074 - DNA, 7 bp, Unknown
  misc_feature (1)..( 7): Matrix.001 file - promoters60/1027990
tgtcgtt

SEQ ID NO: 45075 - DNA, 6 bp, Unknown
  misc_feature (1)..( 6): Matrix.001 file - promoters60/1027990
caggaa

SEQ ID NO: 45076 - DNA, 7 bp, Unknown
  misc_feature (1)..( 7): Matrix.001 file - promoters60/1027990
tttctca

SEQ ID NO: 45077 - DNA, 7 bp, Unknown
  misc_feature (1)..( 7): Matrix.001 file - promoters60/1028013
atcaagc

SEQ ID NO: 45078 - DNA, 6 bp, Unknown
  misc_feature (1)..( 6): Matrix.001 file - promoters60/1028013
ttttct

SEQ ID NO: 45079 - DNA, 8 bp, Unknown
  misc_feature (1)..( 8): Matrix.001 file - promoters60/1028013
agagaaga

SEQ ID NO: 45080 - DNA, 8 bp, Unknown
  misc_feature (1)..( 8): Matrix.001 file - promoters60/1028013
tgggatta

SEQ ID NO: 45081 - DNA, 6 bp, Unknown
  misc_feature (1)..( 6): Matrix.001 file - promoters60/1028013
tttaaa

SEQ ID NO: 45082 - DNA, 7 bp, Unknown
  misc_feature (1)..( 7): Matrix.001 file - promoters60/1028013
aaagcat

SEQ ID NO: 45083 - DNA, 8 bp, Unknown
  misc_feature (1)..( 8): Matrix.001 file - promoters60/1028013
tctcgtct

SEQ ID NO: 45084 - DNA, 7 bp, Unknown
  misc_feature (1)..( 7): Matrix.001 file - promoters60/1028013
agaaaag

SEQ ID NO: 45085 - DNA, 6 bp, Unknown
  misc_feature (1)..( 6): Matrix.001 file - promoters60/1028013
acgtgg

SEQ ID NO: 45086 - DNA, 6 bp, Unknown
  misc_feature (1)..( 6): Matrix.001 file - promoters60/1028013
agatag

SEQ ID NO: 45087 - DNA, 8 bp, Unknown
  misc_feature (1)..( 8): Matrix.001 file - promoters60/1028013
tttatttt

SEQ ID NO: 45088 - DNA, 6 bp, Unknown
  misc_feature (1)..( 6): Matrix.001 file - promoters60/1028013
tgactc

SEQ ID NO: 45089 - DNA, 7 bp, Unknown
  misc_feature (1)..( 7): Matrix.001 file - promoters60/1028013
ttgagtc

SEQ ID NO: 45090 - DNA, 7 bp, Unknown
  misc_feature (1)..( 7): Matrix.001 file - promoters60/1028013
cttgttt

SEQ ID NO: 45091 - DNA, 7 bp, Unknown
  misc_feature (1)..( 7): Matrix.001 file - promoters60/1028013
taaaatt

SEQ ID NO: 45092 - DNA, 6 bp, Unknown
  misc_feature (1)..( 6): Matrix.001 file - promoters60/1028013
ttcaaa

SEQ ID NO: 45093 - DNA, 9 bp, Unknown
  misc_feature (1)..( 9): Matrix.001 file - promoters60/1028013
aaaaaaaac

SEQ ID NO: 45094 - DNA, 7 bp, Unknown
  misc_feature (1)..( 7): Matrix.001 file - promoters60/1028013
ttagtca

SEQ ID NO: 45095 - DNA, 7 bp, Unknown
  misc_feature (1)..( 7): Matrix.001 file - promoters60/1028013
aataaat

SEQ ID NO: 45096 - DNA, 6 bp, Unknown
  misc_feature (1)..( 6): Matrix.001 file - promoters60/1028013
aataat

SEQ ID NO: 45097 - DNA, 6 bp, Unknown
  misc_feature (1)..( 6): Matrix.001 file - promoters60/1028042
ttaaaa

SEQ ID NO: 45098 - DNA, 6 bp, Unknown
  misc_feature (1)..( 6): Matrix.001 file - promoters60/1028042
taaaac

SEQ ID NO: 45099 - DNA, 6 bp, Unknown
  misc_feature (1)..( 6): Matrix.001 file - promoters60/1028042
aaactt

SEQ ID NO: 45100 - DNA, 7 bp, Unknown
  misc_feature (1)..( 7): Matrix.001 file - promoters60/1028042
cacaatc

SEQ ID NO: 45101 - DNA, 7 bp, Unknown
  misc_feature (1)..( 7): Matrix.001 file - promoters60/1028042
aaaccaa

SEQ ID NO: 45102 - DNA, 6 bp, Unknown
  misc_feature (1)..( 6): Matrix.001 file - promoters60/1028042
agttaa

SEQ ID NO: 45103 - DNA, 7 bp, Unknown
  misc_feature (1)..( 7): Matrix.001 file - promoters60/1028042
aagcaat

SEQ ID NO: 45104 - DNA, 7 bp, Unknown
  misc_feature (1)..( 7): Matrix.001 file - promoters60/1028042
acatgtt

SEQ ID NO: 45105 - DNA, 7 bp, Unknown
  misc_feature (1)..( 7): Matrix.001 file - promoters60/1028042
aatgtaa

SEQ ID NO: 45106 - DNA, 13 bp, Unknown
  misc_feature (1)..( 13): Matrix.001 file - promoters60/1028042
cagaaaagaaaaa

SEQ ID NO: 45107 - DNA, 8 bp, Unknown
  misc_feature (1)..( 8): Matrix.001 file - promoters60/1028042
aaaacaaa

SEQ ID NO: 45108 - DNA, 7 bp, Unknown
  misc_feature (1)..( 7): Matrix.001 file - promoters60/1028042
acaaaag

SEQ ID NO: 45109 - DNA, 8 bp, Unknown
  misc_feature (1)..( 8): Matrix.001 file - promoters60/1028042
agacgaaa

SEQ ID NO: 45110 - DNA, 13 bp, Unknown
  misc_feature (1)..( 13): Matrix.001 file - promoters60/1028042
agaacaattaacc

SEQ ID NO: 45111 - DNA, 6 bp, Unknown
  misc_feature (1)..( 6): Matrix.001 file - promoters60/1028042
cctttc

SEQ ID NO: 45112 - DNA, 6 bp, Unknown
  misc_feature (1)..( 6): Matrix.001 file - promoters60/1028042
ctttaa

SEQ ID NO: 45113 - DNA, 9 bp, Unknown
  misc_feature (1)..( 9): Matrix.001 file - promoters60/1028042
aatttaagt

SEQ ID NO: 45114 - DNA, 8 bp, Unknown
  misc_feature (1)..( 8): Matrix.001 file - promoters60/1028042
atagttca

SEQ ID NO: 45115 - DNA, 7 bp, Unknown
  misc_feature (1)..( 7): Matrix.001 file - promoters60/1028042
ttttttt

SEQ ID NO: 45116 - DNA, 7 bp, Unknown
  misc_feature (1)..( 7): Matrix.001 file - promoters60/1028042
tttattt

SEQ ID NO: 45117 - DNA, 7 bp, Unknown
  misc_feature (1)..( 7): Matrix.001 file - promoters60/1028042
aaacttt

SEQ ID NO: 45118 - DNA, 7 bp, Unknown
  misc_feature (1)..( 7): Matrix.001 file - promoters60/1028042
cataata

SEQ ID NO: 45119 - DNA, 7 bp, Unknown
  misc_feature (1)..( 7): Matrix.001 file - promoters60/1028042
aaaagcg

SEQ ID NO: 45120 - DNA, 12 bp, Unknown
  misc_feature (1)..( 12): Matrix.001 file - promoters60/1028084
gaaattttattt

SEQ ID NO: 45121 - DNA, 8 bp, Unknown
  misc_feature (1)..( 8): Matrix.001 file - promoters60/1028084
catccaca

SEQ ID NO: 45122 - DNA, 6 bp, Unknown
  misc_feature (1)..( 6): Matrix.001 file - promoters60/1028084
cacaaa

SEQ ID NO: 45123 - DNA, 10 bp, Unknown
  misc_feature (1)..( 10): Matrix.001 file - promoters60/1028084
ataacaattt

SEQ ID NO: 45124 - DNA, 7 bp, Unknown
  misc_feature (1)..( 7): Matrix.001 file - promoters60/1028084
aaaaaaa

SEQ ID NO: 45125 - DNA, 8 bp, Unknown
  misc_feature (1)..( 8): Matrix.001 file - promoters60/1028084
aaaaagac

SEQ ID NO: 45126 - DNA, 6 bp, Unknown
  misc_feature (1)..( 6): Matrix.001 file - promoters60/1028084
tatata

SEQ ID NO: 45127 - DNA, 6 bp, Unknown
  misc_feature (1)..( 6): Matrix.001 file - promoters60/1028084
tgtatg

SEQ ID NO: 45128 - DNA, 6 bp, Unknown
  misc_feature (1)..( 6): Matrix.001 file - promoters60/1028084
ataata

SEQ ID NO: 45129 - DNA, 6 bp, Unknown
  misc_feature (1)..( 6): Matrix.001 file - promoters60/1028084
attatt

SEQ ID NO: 45130 - DNA, 7 bp, Unknown
  misc_feature (1)..( 7): Matrix.001 file - promoters60/1028084
gttaagt

SEQ ID NO: 45131 - DNA, 6 bp, Unknown
  misc_feature (1)..( 6): Matrix.001 file - promoters60/1028084
tagtgt

SEQ ID NO: 45132 - DNA, 7 bp, Unknown
  misc_feature (1)..( 7): Matrix.001 file - promoters60/1028084
tttgcac

SEQ ID NO: 45133 - DNA, 6 bp, Unknown
  misc_feature (1)..( 6): Matrix.001 file - promoters60/1028084
aagaaa

SEQ ID NO: 45134 - DNA, 6 bp, Unknown
  misc_feature (1)..( 6): Matrix.001 file - promoters60/1028084
aaatca

SEQ ID NO: 45135 - DNA, 7 bp, Unknown
  misc_feature (1)..( 7): Matrix.001 file - promoters60/1028084
aataact

SEQ ID NO: 45136 - DNA, 6 bp, Unknown
  misc_feature (1)..( 6): Matrix.001 file - promoters60/1028095
gattaa

SEQ ID NO: 45137 - DNA, 8 bp, Unknown
  misc_feature (1)..( 8): Matrix.001 file - promoters60/1028095
atatcttt

SEQ ID NO: 45138 - DNA, 9 bp, Unknown
  misc_feature (1)..( 9): Matrix.001 file - promoters60/1028095
aacaacatc

SEQ ID NO: 45139 - DNA, 8 bp, Unknown
  misc_feature (1)..( 8): Matrix.001 file - promoters60/1028095
tagctata

SEQ ID NO: 45140 - DNA, 6 bp, Unknown
  misc_feature (1)..( 6): Matrix.001 file - promoters60/1028095
tttttt

SEQ ID NO: 45141 - DNA, 9 bp, Unknown
  misc_feature (1)..( 9): Matrix.001 file - promoters60/1028095
tttatttta

SEQ ID NO: 45142 - DNA, 7 bp, Unknown
  misc_feature (1)..( 7): Matrix.001 file - promoters60/1028095
tataaaa

SEQ ID NO: 45143 - DNA, 7 bp, Unknown
  misc_feature (1)..( 7): Matrix.001 file - promoters60/1028095
tgaaatt

SEQ ID NO: 45144 - DNA, 7 bp, Unknown
  misc_feature (1)..( 7): Matrix.001 file - promoters60/1028095
cgttttt

SEQ ID NO: 45145 - DNA, 8 bp, Unknown
  misc_feature (1)..( 8): Matrix.001 file - promoters60/1028095
caaagaaa

SEQ ID NO: 45146 - DNA, 7 bp, Unknown
  misc_feature (1)..( 7): Matrix.001 file - promoters60/1028095
ttattat

SEQ ID NO: 45147 - DNA, 10 bp, Unknown
  misc_feature (1)..( 10): Matrix.001 file - promoters60/1028095
aaataaagtt

SEQ ID NO: 45148 - DNA, 6 bp, Unknown
  misc_feature (1)..( 6): Matrix.001 file - promoters60/1028095
aaaacg

SEQ ID NO: 45149 - DNA, 8 bp, Unknown
  misc_feature (1)..( 8): Matrix.001 file - promoters60/1028131
agtatata

SEQ ID NO: 45150 - DNA, 8 bp, Unknown
  misc_feature (1)..( 8): Matrix.001 file - promoters60/1028131
ttcaattt

SEQ ID NO: 45151 - DNA, 14 bp, Unknown
  misc_feature (1)..( 14): Matrix.001 file - promoters60/1028131
ccttcattttttta

SEQ ID NO: 45152 - DNA, 10 bp, Unknown
  misc_feature (1)..( 10): Matrix.001 file - promoters60/1028131
gaagcccaat

SEQ ID NO: 45153 - DNA, 6 bp, Unknown
  misc_feature (1)..( 6): Matrix.001 file - promoters60/1028151
aagatg

SEQ ID NO: 45154 - DNA, 9 bp, Unknown
  misc_feature (1)..( 9): Matrix.001 file - promoters60/1028151
tgattattt

SEQ ID NO: 45155 - DNA, 8 bp, Unknown
  misc_feature (1)..( 8): Matrix.001 file - promoters60/1028151
acagcttt

SEQ ID NO: 45156 - DNA, 6 bp, Unknown
  misc_feature (1)..( 6): Matrix.001 file - promoters60/1028151
tatttt

SEQ ID NO: 45157 - DNA, 7 bp, Unknown
  misc_feature (1)..( 7): Matrix.001 file - promoters60/1028151
agatttt

SEQ ID NO: 45158 - DNA, 7 bp, Unknown
  misc_feature (1)..( 7): Matrix.001 file - promoters60/1028151
aaacact

SEQ ID NO: 45159 - DNA, 6 bp, Unknown
  misc_feature (1)..( 6): Matrix.001 file - promoters60/1028151
tctctc

SEQ ID NO: 45160 - DNA, 7 bp, Unknown
  misc_feature (1)..( 7): Matrix.001 file - promoters60/1028151
atgatga

SEQ ID NO: 45161 - DNA, 8 bp, Unknown
  misc_feature (1)..( 8): Matrix.001 file - promoters60/1028151
attgtttt

SEQ ID NO: 45162 - DNA, 8 bp, Unknown
  misc_feature (1)..( 8): Matrix.001 file - promoters60/1028151
aagaggat

SEQ ID NO: 45163 - DNA, 10 bp, Unknown
  misc_feature (1)..( 10): Matrix.001 file - promoters60/1028151
tttatttata

SEQ ID NO: 45164 - DNA, 7 bp, Unknown
  misc_feature (1)..( 7): Matrix.001 file - promoters60/1028151
tctaaaa

SEQ ID NO: 45165 - DNA, 7 bp, Unknown
  misc_feature (1)..( 7): Matrix.001 file - promoters60/1028177
gatttta

SEQ ID NO: 45166 - DNA, 8 bp, Unknown
  misc_feature (1)..( 8): Matrix.001 file - promoters60/1028177
ttggacaa

SEQ ID NO: 45167 - DNA, 11 bp, Unknown
  misc_feature (1)..( 11): Matrix.001 file - promoters60/1028177
ctatcaatttt

SEQ ID NO: 45168 - DNA, 9 bp, Unknown
  misc_feature (1)..( 9): Matrix.001 file - promoters60/1028177
tgatttctt

SEQ ID NO: 45169 - DNA, 7 bp, Unknown
  misc_feature (1)..( 7): Matrix.001 file - promoters60/1028177
gatatgt

SEQ ID NO: 45170 - DNA, 9 bp, Unknown
  misc_feature (1)..( 9): Matrix.001 file - promoters60/1028177
gttctaact

SEQ ID NO: 45171 - DNA, 7 bp, Unknown
  misc_feature (1)..( 7): Matrix.001 file - promoters60/1028177
ctaagta

SEQ ID NO: 45172 - DNA, 6 bp, Unknown
  misc_feature (1)..( 6): Matrix.001 file - promoters60/1028177
aactct

SEQ ID NO: 45173 - DNA, 8 bp, Unknown
  misc_feature (1)..( 8): Matrix.001 file - promoters60/1028177
gttctact

SEQ ID NO: 45174 - DNA, 8 bp, Unknown
  misc_feature (1)..( 8): Matrix.001 file - promoters60/1028177
tggatttg

SEQ ID NO: 45175 - DNA, 6 bp, Unknown
  misc_feature (1)..( 6): Matrix.001 file - promoters60/1028177
tttttt

SEQ ID NO: 45176 - DNA, 7 bp, Unknown
  misc_feature (1)..( 7): Matrix.001 file - promoters60/1028177
ttagttt

SEQ ID NO: 45177 - DNA, 7 bp, Unknown
  misc_feature (1)..( 7): Matrix.001 file - promoters60/1028177
tctaaaa

SEQ ID NO: 45178 - DNA, 6 bp, Unknown
  misc_feature (1)..( 6): Matrix.001 file - promoters60/1028177
tagaaa

SEQ ID NO: 45179 - DNA, 8 bp, Unknown
  misc_feature (1)..( 8): Matrix.001 file - promoters60/1028177
cctagaat

SEQ ID NO: 45180 - DNA, 6 bp, Unknown
  misc_feature (1)..( 6): Matrix.001 file - promoters60/1028224
taagtt

SEQ ID NO: 45181 - DNA, 7 bp, Unknown
  misc_feature (1)..( 7): Matrix.001 file - promoters60/1028224
tcgtcaa

SEQ ID NO: 45182 - DNA, 6 bp, Unknown
  misc_feature (1)..( 6): Matrix.001 file - promoters60/1028224
caatta

SEQ ID NO: 45183 - DNA, 8 bp, Unknown
  misc_feature (1)..( 8): Matrix.001 file - promoters60/1028224
taatcagt

SEQ ID NO: 45184 - DNA, 6 bp, Unknown
  misc_feature (1)..( 6): Matrix.001 file - promoters60/1028224
acgact

SEQ ID NO: 45185 - DNA, 8 bp, Unknown
  misc_feature (1)..( 8): Matrix.001 file - promoters60/1028224
atgtttat

SEQ ID NO: 45186 - DNA, 6 bp, Unknown
  misc_feature (1)..( 6): Matrix.001 file - promoters60/1028224
ttaaaa

SEQ ID NO: 45187 - DNA, 8 bp, Unknown
  misc_feature (1)..( 8): Matrix.001 file - promoters60/1028224
ttatgttt

SEQ ID NO: 45188 - DNA, 6 bp, Unknown
  misc_feature (1)..( 6): Matrix.001 file - promoters60/1028224
tataaa

SEQ ID NO: 45189 - DNA, 7 bp, Unknown
  misc_feature (1)..( 7): Matrix.001 file - promoters60/1028224
acaattt

SEQ ID NO: 45190 - DNA, 7 bp, Unknown
  misc_feature (1)..( 7): Matrix.001 file - promoters60/1028224
taaaata

SEQ ID NO: 45191 - DNA, 6 bp, Unknown
  misc_feature (1)..( 6): Matrix.001 file - promoters60/1028224
tttcat

SEQ ID NO: 45192 - DNA, 6 bp, Unknown
  misc_feature (1)..( 6): Matrix.001 file - promoters60/1028224
tgaaat

SEQ ID NO: 45193 - DNA, 7 bp, Unknown
  misc_feature (1)..( 7): Matrix.001 file - promoters60/1028224
gttgaaa

SEQ ID NO: 45194 - DNA, 7 bp, Unknown
  misc_feature (1)..( 7): Matrix.001 file - promoters60/1028224
gtttttt

SEQ ID NO: 45195 - DNA, 7 bp, Unknown
  misc_feature (1)..( 7): Matrix.001 file - promoters60/1028224
ggtaaac

SEQ ID NO: 45196 - DNA, 6 bp, Unknown
  misc_feature (1)..( 6): Matrix.001 file - promoters60/1028224
atttga

SEQ ID NO: 45197 - DNA, 6 bp, Unknown
  misc_feature (1)..( 6): Matrix.001 file - promoters60/1028224
taaatt

SEQ ID NO: 45198 - DNA, 6 bp, Unknown
  misc_feature (1)..( 6): Matrix.001 file - promoters60/1028224
taatct

SEQ ID NO: 45199 - DNA, 9 bp, Unknown
  misc_feature (1)..( 9): Matrix.001 file - promoters60/1028224
taaccattt

SEQ ID NO: 45200 - DNA, 7 bp, Unknown
  misc_feature (1)..( 7): Matrix.001 file - promoters60/1028224
tatagtt

SEQ ID NO: 45201 - DNA, 11 bp, Unknown
  misc_feature (1)..( 11): Matrix.001 file - promoters60/1028224
aaacttcatct

SEQ ID NO: 45202 - DNA, 7 bp, Unknown
  misc_feature (1)..( 7): Matrix.001 file - promoters60/1028224
tatatgt

SEQ ID NO: 45203 - DNA, 7 bp, Unknown
  misc_feature (1)..( 7): Matrix.001 file - promoters60/1028224
taagatt

SEQ ID NO: 45204 - DNA, 7 bp, Unknown
  misc_feature (1)..( 7): Matrix.001 file - promoters60/1028224
tggatat

SEQ ID NO: 45205 - DNA, 8 bp, Unknown
  misc_feature (1)..( 8): Matrix.001 file - promoters60/1028243
tatataaa

SEQ ID NO: 45206 - DNA, 11 bp, Unknown
  misc_feature (1)..( 11): Matrix.001 file - promoters60/1028243
acaagttaaaa

SEQ ID NO: 45207 - DNA, 6 bp, Unknown
  misc_feature (1)..( 6): Matrix.001 file - promoters60/1028273
gccaat

SEQ ID NO: 45208 - DNA, 6 bp, Unknown
  misc_feature (1)..( 6): Matrix.001 file - promoters60/1028273
gcagag

SEQ ID NO: 45209 - DNA, 6 bp, Unknown
  misc_feature (1)..( 6): Matrix.001 file - promoters60/1028273
ttaaag

SEQ ID NO: 45210 - DNA, 8 bp, Unknown
  misc_feature (1)..( 8): Matrix.001 file - promoters60/1028273
aattctaa

SEQ ID NO: 45211 - DNA, 7 bp, Unknown
  misc_feature (1)..( 7): Matrix.001 file - promoters60/1028273
aatcgga

SEQ ID NO: 45212 - DNA, 11 bp, Unknown
  misc_feature (1)..( 11): Matrix.001 file - promoters60/1028273
agacagtgaag

SEQ ID NO: 45213 - DNA, 6 bp, Unknown
  misc_feature (1)..( 6): Matrix.001 file - promoters60/1028273
aagtgt

SEQ ID NO: 45214 - DNA, 6 bp, Unknown
  misc_feature (1)..( 6): Matrix.001 file - promoters60/1028273
atatat

SEQ ID NO: 45215 - DNA, 7 bp, Unknown
  misc_feature (1)..( 7): Matrix.001 file - promoters60/1028273
acaatac

SEQ ID NO: 45216 - DNA, 9 bp, Unknown
  misc_feature (1)..( 9): Matrix.001 file - promoters60/1028273
atacaaata

SEQ ID NO: 45217 - DNA, 6 bp, Unknown
  misc_feature (1)..( 6): Matrix.001 file - promoters60/1028273
tcaaat

SEQ ID NO: 45218 - DNA, 6 bp, Unknown
  misc_feature (1)..( 6): Matrix.001 file - promoters60/1028273
gagcag

SEQ ID NO: 45219 - DNA, 7 bp, Unknown
  misc_feature (1)..( 7): Matrix.001 file - promoters60/1028273
gaaataa

SEQ ID NO: 45220 - DNA, 10 bp, Unknown
  misc_feature (1)..( 10): Matrix.001 file - promoters60/1028318
ttcttaaaga

SEQ ID NO: 45221 - DNA, 8 bp, Unknown
  misc_feature (1)..( 8): Matrix.001 file - promoters60/1028318
tattattt

SEQ ID NO: 45222 - DNA, 8 bp, Unknown
  misc_feature (1)..( 8): Matrix.001 file - promoters60/1028318
ataaataa

SEQ ID NO: 45223 - DNA, 8 bp, Unknown
  misc_feature (1)..( 8): Matrix.001 file - promoters60/1028318
catcgttt

SEQ ID NO: 45224 - DNA, 11 bp, Unknown
  misc_feature (1)..( 11): Matrix.001 file - promoters60/1028368
agagaaaataa

SEQ ID NO: 45225 - DNA, 10 bp, Unknown
  misc_feature (1)..( 10): Matrix.001 file - promoters60/1028368
agactaaaaa

SEQ ID NO: 45226 - DNA, 10 bp, Unknown
  misc_feature (1)..( 10): Matrix.001 file - promoters60/1028413
attaaaattg

SEQ ID NO: 45227 - DNA, 8 bp, Unknown
  misc_feature (1)..( 8): Matrix.001 file - promoters60/1028413
ttaaattc

SEQ ID NO: 45228 - DNA, 11 bp, Unknown
  misc_feature (1)..( 11): Matrix.001 file - promoters60/1028470
aataaaattaa

SEQ ID NO: 45229 - DNA, 8 bp, Unknown
  misc_feature (1)..( 8): Matrix.001 file - promoters60/1028470
ttttcttt

SEQ ID NO: 45230 - DNA, 10 bp, Unknown
  misc_feature (1)..( 10): Matrix.001 file - promoters60/1028470
tttcaaatac

SEQ ID NO: 45231 - DNA, 10 bp, Unknown
  misc_feature (1)..( 10): Matrix.001 file - promoters60/1028470
cgataaaaaa

SEQ ID NO: 45232 - DNA, 7 bp, Unknown
  misc_feature (1)..( 7): Matrix.001 file - promoters60/1028508
tcttctt

SEQ ID NO: 45233 - DNA, 7 bp, Unknown
  misc_feature (1)..( 7): Matrix.001 file - promoters60/1028508
caaacaa

SEQ ID NO: 45234 - DNA, 7 bp, Unknown
  misc_feature (1)..( 7): Matrix.001 file - promoters60/1028508
aaaaatc

SEQ ID NO: 45235 - DNA, 11 bp, Unknown
  misc_feature (1)..( 11): Matrix.001 file - promoters60/1028508
tctatataaac

SEQ ID NO: 45236 - DNA, 7 bp, Unknown
  misc_feature (1)..( 7): Matrix.001 file - promoters60/1028508
gtcaagt

SEQ ID NO: 45237 - DNA, 6 bp, Unknown
  misc_feature (1)..( 6): Matrix.001 file - promoters60/1028508
ttggaa

SEQ ID NO: 45238 - DNA, 8 bp, Unknown
  misc_feature (1)..( 8): Matrix.001 file - promoters60/1028508
tcagaaaa

SEQ ID NO: 45239 - DNA, 7 bp, Unknown
  misc_feature (1)..( 7): Matrix.001 file - promoters60/1028508
aaaacaa

SEQ ID NO: 45240 - DNA, 12 bp, Unknown
  misc_feature (1)..( 12): Matrix.001 file - promoters60/1028508
taatagatctac

SEQ ID NO: 45241 - DNA, 6 bp, Unknown
  misc_feature (1)..( 6): Matrix.001 file - promoters60/1028508
aaaaaa

SEQ ID NO: 45242 - DNA, 6 bp, Unknown
  misc_feature (1)..( 6): Matrix.001 file - promoters60/1028508
tttggc

SEQ ID NO: 45243 - DNA, 6 bp, Unknown
  misc_feature (1)..( 6): Matrix.001 file - promoters60/1028508
tatgga

SEQ ID NO: 45244 - DNA, 7 bp, Unknown
  misc_feature (1)..( 7): Matrix.001 file - promoters60/1028508
tggacgt

SEQ ID NO: 45245 - DNA, 6 bp, Unknown
  misc_feature (1)..( 6): Matrix.001 file - promoters60/1028508
tggaat

SEQ ID NO: 45246 - DNA, 7 bp, Unknown
  misc_feature (1)..( 7): Matrix.001 file - promoters60/1028508
ttcaact

SEQ ID NO: 45247 - DNA, 7 bp, Unknown
  misc_feature (1)..( 7): Matrix.001 file - promoters60/1028508
cttgtaa

SEQ ID NO: 45248 - DNA, 9 bp, Unknown
  misc_feature (1)..( 9): Matrix.001 file - promoters60/1028508
ttctcaaaa

SEQ ID NO: 45249 - DNA, 6 bp, Unknown
  misc_feature (1)..( 6): Matrix.001 file - promoters60/1028508
aaattg

SEQ ID NO: 45250 - DNA, 8 bp, Unknown
  misc_feature (1)..( 8): Matrix.001 file - promoters60/1028508
accagcga

SEQ ID NO: 45251 - DNA, 8 bp, Unknown
  misc_feature (1)..( 8): Matrix.001 file - promoters60/1028508
aaaaaaaa

SEQ ID NO: 45252 - DNA, 10 bp, Unknown
  misc_feature (1)..( 10): Matrix.001 file - promoters60/1028545
ttattttaat

SEQ ID NO: 45253 - DNA, 11 bp, Unknown
  misc_feature (1)..( 11): Matrix.001 file - promoters60/1028545
ttaagtagatt

SEQ ID NO: 45254 - DNA, 8 bp, Unknown
  misc_feature (1)..( 8): Matrix.001 file - promoters60/1028545
aaatttta

SEQ ID NO: 45255 - DNA, 8 bp, Unknown
  misc_feature (1)..( 8): Matrix.001 file - promoters60/1028545
gtcttttt

SEQ ID NO: 45256 - DNA, 8 bp, Unknown
  misc_feature (1)..( 8): Matrix.001 file - promoters60/1028545
ctaatttc

SEQ ID NO: 45257 - DNA, 11 bp, Unknown
  misc_feature (1)..( 11): Matrix.001 file - promoters60/1028545
acaagaatata

SEQ ID NO: 45258 - DNA, 7 bp, Unknown
  misc_feature (1)..( 7): Matrix.001 file - promoters60/1028549
tctatat

SEQ ID NO: 45259 - DNA, 7 bp, Unknown
  misc_feature (1)..( 7): Matrix.001 file - promoters60/1028549
aaatcga

SEQ ID NO: 45260 - DNA, 7 bp, Unknown
  misc_feature (1)..( 7): Matrix.001 file - promoters60/1028549
actgttg

SEQ ID NO: 45261 - DNA, 6 bp, Unknown
  misc_feature (1)..( 6): Matrix.001 file - promoters60/1028549
tttaaa

SEQ ID NO: 45262 - DNA, 6 bp, Unknown
  misc_feature (1)..( 6): Matrix.001 file - promoters60/1028549
gtgaaa

SEQ ID NO: 45263 - DNA, 7 bp, Unknown
  misc_feature (1)..( 7): Matrix.001 file - promoters60/1028549
aaaagaa

SEQ ID NO: 45264 - DNA, 7 bp, Unknown
  misc_feature (1)..( 7): Matrix.001 file - promoters60/1028549
aaaccca

SEQ ID NO: 45265 - DNA, 7 bp, Unknown
  misc_feature (1)..( 7): Matrix.001 file - promoters60/1028549
aactgaa

SEQ ID NO: 45266 - DNA, 7 bp, Unknown
  misc_feature (1)..( 7): Matrix.001 file - promoters60/1028549
tttggtg

SEQ ID NO: 45267 - DNA, 7 bp, Unknown
  misc_feature (1)..( 7): Matrix.001 file - promoters60/1028549
gtttatc

SEQ ID NO: 45268 - DNA, 7 bp, Unknown
  misc_feature (1)..( 7): Matrix.001 file - promoters60/1028549
atcgtac

SEQ ID NO: 45269 - DNA, 6 bp, Unknown
  misc_feature (1)..( 6): Matrix.001 file - promoters60/1028549
ataaat

SEQ ID NO: 45270 - DNA, 7 bp, Unknown
  misc_feature (1)..( 7): Matrix.001 file - promoters60/1028549
ggtacaa

SEQ ID NO: 45271 - DNA, 8 bp, Unknown
  misc_feature (1)..( 8): Matrix.001 file - promoters60/1028549
cagtggat

SEQ ID NO: 45272 - DNA, 9 bp, Unknown
  misc_feature (1)..( 9): Matrix.001 file - promoters60/1028590
atgattatc

SEQ ID NO: 45273 - DNA, 8 bp, Unknown
  misc_feature (1)..( 8): Matrix.001 file - promoters60/1028590
aaaaaact

SEQ ID NO: 45274 - DNA, 6 bp, Unknown
  misc_feature (1)..( 6): Matrix.001 file - promoters60/1028590
tttctt

SEQ ID NO: 45275 - DNA, 8 bp, Unknown
  misc_feature (1)..( 8): Matrix.001 file - promoters60/1028590
caaccttg

SEQ ID NO: 45276 - DNA, 6 bp, Unknown
  misc_feature (1)..( 6): Matrix.001 file - promoters60/1028590
atcaag

SEQ ID NO: 45277 - DNA, 9 bp, Unknown
  misc_feature (1)..( 9): Matrix.001 file - promoters60/1028590
aactaaata

SEQ ID NO: 45278 - DNA, 7 bp, Unknown
  misc_feature (1)..( 7): Matrix.001 file - promoters60/1028590
aacaacg

SEQ ID NO: 45279 - DNA, 12 bp, Unknown
  misc_feature (1)..( 12): Matrix.001 file - promoters60/1028590
aaaacaaaaatg

SEQ ID NO: 45280 - DNA, 7 bp, Unknown
  misc_feature (1)..( 7): Matrix.001 file - promoters60/1028590
tacaata

SEQ ID NO: 45281 - DNA, 6 bp, Unknown
  misc_feature (1)..( 6): Matrix.001 file - promoters60/1028590
ccaaac

SEQ ID NO: 45282 - DNA, 8 bp, Unknown
  misc_feature (1)..( 8): Matrix.001 file - promoters60/1028590
aaaagttg

SEQ ID NO: 45283 - DNA, 10 bp, Unknown
  misc_feature (1)..( 10): Matrix.001 file - promoters60/1028590
ggtagaatac

SEQ ID NO: 45284 - DNA, 7 bp, Unknown
  misc_feature (1)..( 7): Matrix.001 file - promoters60/1028590
tataaat

SEQ ID NO: 45285 - DNA, 6 bp, Unknown
  misc_feature (1)..( 6): Matrix.001 file - promoters60/1028590
ttgatg

SEQ ID NO: 45286 - DNA, 7 bp, Unknown
  misc_feature (1)..( 7): Matrix.001 file - promoters60/1028590
tcaatca

SEQ ID NO: 45287 - DNA, 8 bp, Unknown
  misc_feature (1)..( 8): Matrix.001 file - promoters60/1028590
ttcatctt

SEQ ID NO: 45288 - DNA, 8 bp, Unknown
  misc_feature (1)..( 8): Matrix.001 file - promoters60/1028590
tcttctcc

SEQ ID NO: 45289 - DNA, 7 bp, Unknown
  misc_feature (1)..( 7): Matrix.001 file - promoters60/1028590
attatat

SEQ ID NO: 45290 - DNA, 6 bp, Unknown
  misc_feature (1)..( 6): Matrix.001 file - promoters60/1028590
ttctta

SEQ ID NO: 45291 - DNA, 6 bp, Unknown
  misc_feature (1)..( 6): Matrix.001 file - promoters60/1028590
taatta

SEQ ID NO: 45292 - DNA, 7 bp, Unknown
  misc_feature (1)..( 7): Matrix.001 file - promoters60/1028674
ttataat

SEQ ID NO: 45293 - DNA, 10 bp, Unknown
  misc_feature (1)..( 10): Matrix.001 file - promoters60/1028674
ttataacaaa

SEQ ID NO: 45294 - DNA, 9 bp, Unknown
  misc_feature (1)..( 9): Matrix.001 file - promoters60/1028674
aaaatttaa

SEQ ID NO: 45295 - DNA, 9 bp, Unknown
  misc_feature (1)..( 9): Matrix.001 file - promoters60/1028674
tttaaagat

SEQ ID NO: 45296 - DNA, 9 bp, Unknown
  misc_feature (1)..( 9): Matrix.001 file - promoters60/1028674
cattaatta

SEQ ID NO: 45297 - DNA, 8 bp, Unknown
  misc_feature (1)..( 8): Matrix.001 file - promoters60/1028674
atgaaaat

SEQ ID NO: 45298 - DNA, 8 bp, Unknown
  misc_feature (1)..( 8): Matrix.001 file - promoters60/1028674
tttaaaaa

SEQ ID NO: 45299 - DNA, 10 bp, Unknown
  misc_feature (1)..( 10): Matrix.001 file - promoters60/1028682
ttttcaattc

SEQ ID NO: 45300 - DNA, 9 bp, Unknown
  misc_feature (1)..( 9): Matrix.001 file - promoters60/1028682
ctatatata

SEQ ID NO: 45301 - DNA, 9 bp, Unknown
  misc_feature (1)..( 9): Matrix.001 file - promoters60/1028682
aaaaattca

SEQ ID NO: 45302 - DNA, 6 bp, Unknown
  misc_feature (1)..( 6): Matrix.001 file - promoters60/1028735
atatga

SEQ ID NO: 45303 - DNA, 7 bp, Unknown
  misc_feature (1)..( 7): Matrix.001 file - promoters60/1028735
aacacac

SEQ ID NO: 45304 - DNA, 7 bp, Unknown
  misc_feature (1)..( 7): Matrix.001 file - promoters60/1028735
aggatcc

SEQ ID NO: 45305 - DNA, 6 bp, Unknown
  misc_feature (1)..( 6): Matrix.001 file - promoters60/1028735
ttcttc

SEQ ID NO: 45306 - DNA, 11 bp, Unknown
  misc_feature (1)..( 11): Matrix.001 file - promoters60/1028735
gaaacacgcac

SEQ ID NO: 45307 - DNA, 6 bp, Unknown
  misc_feature (1)..( 6): Matrix.001 file - promoters60/1028735
ggaaaa

SEQ ID NO: 45308 - DNA, 7 bp, Unknown
  misc_feature (1)..( 7): Matrix.001 file - promoters60/1028735
aacaact

SEQ ID NO: 45309 - DNA, 6 bp, Unknown
  misc_feature (1)..( 6): Matrix.001 file - promoters60/1028735
aggtat

SEQ ID NO: 45310 - DNA, 9 bp, Unknown
  misc_feature (1)..( 9): Matrix.001 file - promoters60/1028735
cacttttac

SEQ ID NO: 45311 - DNA, 11 bp, Unknown
  misc_feature (1)..( 11): Matrix.001 file - promoters60/1028735
acaattggagg

SEQ ID NO: 45312 - DNA, 7 bp, Unknown
  misc_feature (1)..( 7): Matrix.001 file - promoters60/1028735
tacccac

SEQ ID NO: 45313 - DNA, 6 bp, Unknown
  misc_feature (1)..( 6): Matrix.001 file - promoters60/1028751
cagaaa

SEQ ID NO: 45314 - DNA, 10 bp, Unknown
  misc_feature (1)..( 10): Matrix.001 file - promoters60/1028751
tgcaacaaga

SEQ ID NO: 45315 - DNA, 6 bp, Unknown
  misc_feature (1)..( 6): Matrix.001 file - promoters60/1028751
aaaaaa

SEQ ID NO: 45316 - DNA, 6 bp, Unknown
  misc_feature (1)..( 6): Matrix.001 file - promoters60/1028751
cttttc

SEQ ID NO: 45317 - DNA, 7 bp, Unknown
  misc_feature (1)..( 7): Matrix.001 file - promoters60/1028751
ttcattt

SEQ ID NO: 45318 - DNA, 9 bp, Unknown
  misc_feature (1)..( 9): Matrix.001 file - promoters60/1028751
tttagttta

SEQ ID NO: 45319 - DNA, 6 bp, Unknown
  misc_feature (1)..( 6): Matrix.001 file - promoters60/1028751
taatgt

SEQ ID NO: 45320 - DNA, 10 bp, Unknown
  misc_feature (1)..( 10): Matrix.001 file - promoters60/1028751
gataattgat

SEQ ID NO: 45321 - DNA, 6 bp, Unknown
  misc_feature (1)..( 6): Matrix.001 file - promoters60/1028751
tcaaaa

SEQ ID NO: 45322 - DNA, 6 bp, Unknown
  misc_feature (1)..( 6): Matrix.001 file - promoters60/1028751
tggatt

SEQ ID NO: 45323 - DNA, 6 bp, Unknown
  misc_feature (1)..( 6): Matrix.001 file - promoters60/1028751
ttttgc

SEQ ID NO: 45324 - DNA, 9 bp, Unknown
  misc_feature (1)..( 9): Matrix.001 file - promoters60/1028751
gatataata

SEQ ID NO: 45325 - DNA, 7 bp, Unknown
  misc_feature (1)..( 7): Matrix.001 file - promoters60/1028751
attagag

SEQ ID NO: 45326 - DNA, 6 bp, Unknown
  misc_feature (1)..( 6): Matrix.001 file - promoters60/1028751
catgaa

SEQ ID NO: 45327 - DNA, 7 bp, Unknown
  misc_feature (1)..( 7): Matrix.001 file - promoters60/1028751
aatgctt

SEQ ID NO: 45328 - DNA, 7 bp, Unknown
  misc_feature (1)..( 7): Matrix.001 file - promoters60/1028751
gatacag

SEQ ID NO: 45329 - DNA, 6 bp, Unknown
  misc_feature (1)..( 6): Matrix.001 file - promoters60/1028751
attcca

SEQ ID NO: 45330 - DNA, 7 bp, Unknown
  misc_feature (1)..( 7): Matrix.001 file - promoters60/1028751
aaacctg

SEQ ID NO: 45331 - DNA, 6 bp, Unknown
  misc_feature (1)..( 6): Matrix.001 file - promoters60/1028751
tttgac

SEQ ID NO: 45332 - DNA, 6 bp, Unknown
  misc_feature (1)..( 6): Matrix.001 file - promoters60/1028751
acggta

SEQ ID NO: 45333 - DNA, 7 bp, Unknown
  misc_feature (1)..( 7): Matrix.001 file - promoters60/1028751
tcaagtt

SEQ ID NO: 45334 - DNA, 9 bp, Unknown
  misc_feature (1)..( 9): Matrix.001 file - promoters60/1028751
atttaattt

SEQ ID NO: 45335 - DNA, 13 bp, Unknown
  misc_feature (1)..( 13): Matrix.001 file - promoters60/1028826
atacgtttttttg

SEQ ID NO: 45336 - DNA, 12 bp, Unknown
  misc_feature (1)..( 12): Matrix.001 file - promoters60/1028826
tacatttgtctg

SEQ ID NO: 45337 - DNA, 10 bp, Unknown
  misc_feature (1)..( 10): Matrix.001 file - promoters60/1028859
aaagatatat

SEQ ID NO: 45338 - DNA, 6 bp, Unknown
  misc_feature (1)..( 6): Matrix.001 file - promoters60/1028859
aaaaaa

SEQ ID NO: 45339 - DNA, 7 bp, Unknown
  misc_feature (1)..( 7): Matrix.001 file - promoters60/1028859
atgattg

SEQ ID NO: 45340 - DNA, 14 bp, Unknown
  misc_feature (1)..( 14): Matrix.001 file - promoters60/1028859
attaaagttcaatt

SEQ ID NO: 45341 - DNA, 7 bp, Unknown
  misc_feature (1)..( 7): Matrix.001 file - promoters60/1028859
aagaaat

SEQ ID NO: 45342 - DNA, 8 bp, Unknown
  misc_feature (1)..( 8): Matrix.001 file - promoters60/1028859
aataaaat

SEQ ID NO: 45343 - DNA, 6 bp, Unknown
  misc_feature (1)..( 6): Matrix.001 file - promoters60/1028859
ctcaag

SEQ ID NO: 45344 - DNA, 7 bp, Unknown
  misc_feature (1)..( 7): Matrix.001 file - promoters60/1028859
tcttctt

SEQ ID NO: 45345 - DNA, 9 bp, Unknown
  misc_feature (1)..( 9): Matrix.001 file - promoters60/1028859
tctcttttt

SEQ ID NO: 45346 - DNA, 6 bp, Unknown
  misc_feature (1)..( 6): Matrix.001 file - promoters60/1028859
tgtgtt

SEQ ID NO: 45347 - DNA, 6 bp, Unknown
  misc_feature (1)..( 6): Matrix.001 file - promoters60/1028859
tttttt

SEQ ID NO: 45348 - DNA, 6 bp, Unknown
  misc_feature (1)..( 6): Matrix.001 file - promoters60/1028859
ttttta

SEQ ID NO: 45349 - DNA, 6 bp, Unknown
  misc_feature (1)..( 6): Matrix.001 file - promoters60/1028859
ttgttt

SEQ ID NO: 45350 - DNA, 9 bp, Unknown
  misc_feature (1)..( 9): Matrix.001 file - promoters60/1028863
tttcattaa

SEQ ID NO: 45351 - DNA, 6 bp, Unknown
  misc_feature (1)..( 6): Matrix.001 file - promoters60/1028878
attcga

SEQ ID NO: 45352 - DNA, 9 bp, Unknown
  misc_feature (1)..( 9): Matrix.001 file - promoters60/1028878
cttcaagaa

SEQ ID NO: 45353 - DNA, 6 bp, Unknown
  misc_feature (1)..( 6): Matrix.001 file - promoters60/1028878
tcttct

SEQ ID NO: 45354 - DNA, 6 bp, Unknown
  misc_feature (1)..( 6): Matrix.001 file - promoters60/1028878
tctgta

SEQ ID NO: 45355 - DNA, 6 bp, Unknown
  misc_feature (1)..( 6): Matrix.001 file - promoters60/1028878
gataaa

SEQ ID NO: 45356 - DNA, 6 bp, Unknown
  misc_feature (1)..( 6): Matrix.001 file - promoters60/1028878
cttctt

SEQ ID NO: 45357 - DNA, 6 bp, Unknown
  misc_feature (1)..( 6): Matrix.001 file - promoters60/1028878
catctc

SEQ ID NO: 45358 - DNA, 6 bp, Unknown
  misc_feature (1)..( 6): Matrix.001 file - promoters60/1028878
agtttt

SEQ ID NO: 45359 - DNA, 7 bp, Unknown
  misc_feature (1)..( 7): Matrix.001 file - promoters60/1028878
acaaaaa

SEQ ID NO: 45360 - DNA, 11 bp, Unknown
  misc_feature (1)..( 11): Matrix.001 file - promoters60/1028908
acaaatacgaa

SEQ ID NO: 45361 - DNA, 12 bp, Unknown
  misc_feature (1)..( 12): Matrix.001 file - promoters60/1028908
aatggttaatca

SEQ ID NO: 45362 - DNA, 8 bp, Unknown
  misc_feature (1)..( 8): Matrix.001 file - promoters60/1028908
actttttc

SEQ ID NO: 45363 - DNA, 8 bp, Unknown
  misc_feature (1)..( 8): Matrix.001 file - promoters60/1028908
gaaaaaac

SEQ ID NO: 45364 - DNA, 6 bp, Unknown
  misc_feature (1)..( 6): Matrix.001 file - promoters60/1028908
atctat

SEQ ID NO: 45365 - DNA, 6 bp, Unknown
  misc_feature (1)..( 6): Matrix.001 file - promoters60/1028908
atctct

SEQ ID NO: 45366 - DNA, 7 bp, Unknown
  misc_feature (1)..( 7): Matrix.001 file - promoters60/1028908
ttcaatc

SEQ ID NO: 45367 - DNA, 8 bp, Unknown
  misc_feature (1)..( 8): Matrix.001 file - promoters60/1028908
gcgtcgtc

SEQ ID NO: 45368 - DNA, 6 bp, Unknown
  misc_feature (1)..( 6): Matrix.001 file - promoters60/1028908
tcagat

SEQ ID NO: 45369 - DNA, 7 bp, Unknown
  misc_feature (1)..( 7): Matrix.001 file - promoters60/1028908
acacgca

SEQ ID NO: 45370 - DNA, 6 bp, Unknown
  misc_feature (1)..( 6): Matrix.001 file - promoters60/1028908
ttcctt

SEQ ID NO: 45371 - DNA, 12 bp, Unknown
  misc_feature (1)..( 12): Matrix.001 file - promoters60/1028937
acaataatataa

SEQ ID NO: 45372 - DNA, 12 bp, Unknown
  misc_feature (1)..( 12): Matrix.001 file - promoters60/1028937
attatataaaaa

SEQ ID NO: 45373 - DNA, 7 bp, Unknown
  misc_feature (1)..( 7): Matrix.001 file - promoters60/1028937
aaaacaa

SEQ ID NO: 45374 - DNA, 9 bp, Unknown
  misc_feature (1)..( 9): Matrix.001 file - promoters60/1028937
aaatgaaac

SEQ ID NO: 45375 - DNA, 7 bp, Unknown
  misc_feature (1)..( 7): Matrix.001 file - promoters60/1028937
taatttt

SEQ ID NO: 45376 - DNA, 11 bp, Unknown
  misc_feature (1)..( 11): Matrix.001 file - promoters60/1028937
atatatataat

SEQ ID NO: 45377 - DNA, 11 bp, Unknown
  misc_feature (1)..( 11): Matrix.001 file - promoters60/1028937
agattatcaaa

SEQ ID NO: 45378 - DNA, 8 bp, Unknown
  misc_feature (1)..( 8): Matrix.001 file - promoters60/1028937
attttata

SEQ ID NO: 45379 - DNA, 15 bp, Unknown
  misc_feature (1)..( 15): Matrix.001 file - promoters60/1028937
aaaaacaatttatat

SEQ ID NO: 45380 - DNA, 9 bp, Unknown
  misc_feature (1)..( 9): Matrix.001 file - promoters60/1028937
gtaaaaaaa

SEQ ID NO: 45381 - DNA, 12 bp, Unknown
  misc_feature (1)..( 12): Matrix.001 file - promoters60/1028937
acaaaaatgaat

SEQ ID NO: 45382 - DNA, 8 bp, Unknown
  misc_feature (1)..( 8): Matrix.001 file - promoters60/1028937
aagaaata

SEQ ID NO: 45383 - DNA, 11 bp, Unknown
  misc_feature (1)..( 11): Matrix.001 file - promoters60/1028937
taataaaacaa

SEQ ID NO: 45384 - DNA, 10 bp, Unknown
  misc_feature (1)..( 10): Matrix.001 file - promoters60/1028937
atatatttta

SEQ ID NO: 45385 - DNA, 10 bp, Unknown
  misc_feature (1)..( 10): Matrix.001 file - promoters60/1028955
aaagatagat

SEQ ID NO: 45386 - DNA, 8 bp, Unknown
  misc_feature (1)..( 8): Matrix.001 file - promoters60/1028963
tgttttgc

SEQ ID NO: 45387 - DNA, 6 bp, Unknown
  misc_feature (1)..( 6): Matrix.001 file - promoters60/1028963
tttcaa

SEQ ID NO: 45388 - DNA, 9 bp, Unknown
  misc_feature (1)..( 9): Matrix.001 file - promoters60/1028963
gattaaaca

SEQ ID NO: 45389 - DNA, 10 bp, Unknown
  misc_feature (1)..( 10): Matrix.001 file - promoters60/1028963
aaataaaata

SEQ ID NO: 45390 - DNA, 8 bp, Unknown
  misc_feature (1)..( 8): Matrix.001 file - promoters60/1028963
tatcttct

SEQ ID NO: 45391 - DNA, 6 bp, Unknown
  misc_feature (1)..( 6): Matrix.001 file - promoters60/1028963
aaatcg

SEQ ID NO: 45392 - DNA, 6 bp, Unknown
  misc_feature (1)..( 6): Matrix.001 file - promoters60/1028963
atctga

SEQ ID NO: 45393 - DNA, 7 bp, Unknown
  misc_feature (1)..( 7): Matrix.001 file - promoters60/1028963
tatatat

SEQ ID NO: 45394 - DNA, 7 bp, Unknown
  misc_feature (1)..( 7): Matrix.001 file - promoters60/1028963
gaaaaaa

SEQ ID NO: 45395 - DNA, 6 bp, Unknown
  misc_feature (1)..( 6): Matrix.001 file - promoters60/1028963
agtaaa

SEQ ID NO: 45396 - DNA, 7 bp, Unknown
  misc_feature (1)..( 7): Matrix.001 file - promoters60/1028963
aatcggg

SEQ ID NO: 45397 - DNA, 8 bp, Unknown
  misc_feature (1)..( 8): Matrix.001 file - promoters60/1028963
gaaacaaa

SEQ ID NO: 45398 - DNA, 10 bp, Unknown
  misc_feature (1)..( 10): Matrix.001 file - promoters60/1028963
ggaaaagaaa

SEQ ID NO: 45399 - DNA, 7 bp, Unknown
  misc_feature (1)..( 7): Matrix.001 file - promoters60/1028963
cccacta

SEQ ID NO: 45400 - DNA, 9 bp, Unknown
  misc_feature (1)..( 9): Matrix.001 file - promoters60/1028963
aaagaaaag

SEQ ID NO: 45401 - DNA, 7 bp, Unknown
  misc_feature (1)..( 7): Matrix.001 file - promoters60/1028963
gtatata

SEQ ID NO: 45402 - DNA, 7 bp, Unknown
  misc_feature (1)..( 7): Matrix.001 file - promoters60/1028984
aaaaacc

SEQ ID NO: 45403 - DNA, 7 bp, Unknown
  misc_feature (1)..( 7): Matrix.001 file - promoters60/1028984
taaaatg

SEQ ID NO: 45404 - DNA, 7 bp, Unknown
  misc_feature (1)..( 7): Matrix.001 file - promoters60/1028984
aaaatca

SEQ ID NO: 45405 - DNA, 6 bp, Unknown
  misc_feature (1)..( 6): Matrix.001 file - promoters60/1028984
ggttta

SEQ ID NO: 45406 - DNA, 7 bp, Unknown
  misc_feature (1)..( 7): Matrix.001 file - promoters60/1028984
gattata

SEQ ID NO: 45407 - DNA, 9 bp, Unknown
  misc_feature (1)..( 9): Matrix.001 file - promoters60/1028984
cagtaacaa

SEQ ID NO: 45408 - DNA, 6 bp, Unknown
  misc_feature (1)..( 6): Matrix.001 file - promoters60/1028984
tcaaca

SEQ ID NO: 45409 - DNA, 7 bp, Unknown
  misc_feature (1)..( 7): Matrix.001 file - promoters60/1028984
attacag

SEQ ID NO: 45410 - DNA, 8 bp, Unknown
  misc_feature (1)..( 8): Matrix.001 file - promoters60/1028984
agtagttt

SEQ ID NO: 45411 - DNA, 7 bp, Unknown
  misc_feature (1)..( 7): Matrix.001 file - promoters60/1028984
ttaatcg

SEQ ID NO: 45412 - DNA, 6 bp, Unknown
  misc_feature (1)..( 6): Matrix.001 file - promoters60/1028984
tacgaa

SEQ ID NO: 45413 - DNA, 7 bp, Unknown
  misc_feature (1)..( 7): Matrix.001 file - promoters60/1028984
aaaaatc

SEQ ID NO: 45414 - DNA, 7 bp, Unknown
  misc_feature (1)..( 7): Matrix.001 file - promoters60/1028984
gataaac

SEQ ID NO: 45415 - DNA, 6 bp, Unknown
  misc_feature (1)..( 6): Matrix.001 file - promoters60/1028984
atcgtc

SEQ ID NO: 45416 - DNA, 6 bp, Unknown
  misc_feature (1)..( 6): Matrix.001 file - promoters60/1028984
tttcac

SEQ ID NO: 45417 - DNA, 8 bp, Unknown
  misc_feature (1)..( 8): Matrix.001 file - promoters60/1028984
taacacgt

SEQ ID NO: 45418 - DNA, 7 bp, Unknown
  misc_feature (1)..( 7): Matrix.001 file - promoters60/1029005
attacat

SEQ ID NO: 45419 - DNA, 12 bp, Unknown
  misc_feature (1)..( 12): Matrix.001 file - promoters60/1029005
ttaaaagaaaaa

SEQ ID NO: 45420 - DNA, 9 bp, Unknown
  misc_feature (1)..( 9): Matrix.001 file - promoters60/1029005
aaattatat

SEQ ID NO: 45421 - DNA, 7 bp, Unknown
  misc_feature (1)..( 7): Matrix.001 file - promoters60/1029005
tttttct

SEQ ID NO: 45422 - DNA, 6 bp, Unknown
  misc_feature (1)..( 6): Matrix.001 file - promoters60/1029005
tttttc

SEQ ID NO: 45423 - DNA, 12 bp, Unknown
  misc_feature (1)..( 12): Matrix.001 file - promoters60/1029005
aaaaacaaattt

SEQ ID NO: 45424 - DNA, 9 bp, Unknown
  misc_feature (1)..( 9): Matrix.001 file - promoters60/1029085
gtttaattt

SEQ ID NO: 45425 - DNA, 7 bp, Unknown
  misc_feature (1)..( 7): Matrix.001 file - promoters60/1029085
caaaaag

SEQ ID NO: 45426 - DNA, 8 bp, Unknown
  misc_feature (1)..( 8): Matrix.001 file - promoters60/1029085
taaaaaat

SEQ ID NO: 45427 - DNA, 8 bp, Unknown
  misc_feature (1)..( 8): Matrix.001 file - promoters60/1029085
gattcata

SEQ ID NO: 45428 - DNA, 8 bp, Unknown
  misc_feature (1)..( 8): Matrix.001 file - promoters60/1029242
attccaaa

SEQ ID NO: 45429 - DNA, 7 bp, Unknown
  misc_feature (1)..( 7): Matrix.001 file - promoters60/1029242
ttttgaa

SEQ ID NO: 45430 - DNA, 10 bp, Unknown
  misc_feature (1)..( 10): Matrix.001 file - promoters60/1029242
gagtaaaatt

SEQ ID NO: 45431 - DNA, 8 bp, Unknown
  misc_feature (1)..( 8): Matrix.001 file - promoters60/1029242
aattctta

SEQ ID NO: 45432 - DNA, 7 bp, Unknown
  misc_feature (1)..( 7): Matrix.001 file - promoters60/1029242
ataaaac

SEQ ID NO: 45433 - DNA, 6 bp, Unknown
  misc_feature (1)..( 6): Matrix.001 file - promoters60/1029242
tactta

SEQ ID NO: 45434 - DNA, 7 bp, Unknown
  misc_feature (1)..( 7): Matrix.001 file - promoters60/1029242
aattaaa

SEQ ID NO: 45435 - DNA, 6 bp, Unknown
  misc_feature (1)..( 6): Matrix.001 file - promoters60/1029242
aaaaga

SEQ ID NO: 45436 - DNA, 8 bp, Unknown
  misc_feature (1)..( 8): Matrix.001 file - promoters60/1029242
aaaccaaa

SEQ ID NO: 45437 - DNA, 6 bp, Unknown
  misc_feature (1)..( 6): Matrix.001 file - promoters60/1029242
agagta

SEQ ID NO: 45438 - DNA, 10 bp, Unknown
  misc_feature (1)..( 10): Matrix.001 file - promoters60/1029242
caaatatctt

SEQ ID NO: 45439 - DNA, 7 bp, Unknown
  misc_feature (1)..( 7): Matrix.001 file - promoters60/1029242
tttactt

SEQ ID NO: 45440 - DNA, 6 bp, Unknown
  misc_feature (1)..( 6): Matrix.001 file - promoters60/1029242
aaaaat

SEQ ID NO: 45441 - DNA, 8 bp, Unknown
  misc_feature (1)..( 8): Matrix.001 file - promoters60/1029242
tatataca

SEQ ID NO: 45442 - DNA, 9 bp, Unknown
  misc_feature (1)..( 9): Matrix.001 file - promoters60/1029315
ttttgattt

SEQ ID NO: 45443 - DNA, 7 bp, Unknown
  misc_feature (1)..( 7): Matrix.001 file - promoters60/1029315
caaaatt

SEQ ID NO: 45444 - DNA, 9 bp, Unknown
  misc_feature (1)..( 9): Matrix.001 file - promoters60/1029315
aacaatcac

SEQ ID NO: 45445 - DNA, 7 bp, Unknown
  misc_feature (1)..( 7): Matrix.001 file - promoters60/1029315
atataat

SEQ ID NO: 45446 - DNA, 9 bp, Unknown
  misc_feature (1)..( 9): Matrix.001 file - promoters60/1029315
ttttcatta

SEQ ID NO: 45447 - DNA, 9 bp, Unknown
  misc_feature (1)..( 9): Matrix.001 file - promoters60/1029315
aaactaatt

SEQ ID NO: 45448 - DNA, 9 bp, Unknown
  misc_feature (1)..( 9): Matrix.001 file - promoters60/1029395
aattgatga

SEQ ID NO: 45449 - DNA, 7 bp, Unknown
  misc_feature (1)..( 7): Matrix.001 file - promoters60/1029395
ataaatc

SEQ ID NO: 45450 - DNA, 8 bp, Unknown
  misc_feature (1)..( 8): Matrix.001 file - promoters60/1029395
atgaataa

SEQ ID NO: 45451 - DNA, 7 bp, Unknown
  misc_feature (1)..( 7): Matrix.001 file - promoters60/1029395
ctaattg

SEQ ID NO: 45452 - DNA, 6 bp, Unknown
  misc_feature (1)..( 6): Matrix.001 file - promoters60/1029395
tagcta

SEQ ID NO: 45453 - DNA, 7 bp, Unknown
  misc_feature (1)..( 7): Matrix.001 file - promoters60/1029395
tcaattt

SEQ ID NO: 45454 - DNA, 6 bp, Unknown
  misc_feature (1)..( 6): Matrix.001 file - promoters60/1029395
atctcg

SEQ ID NO: 45455 - DNA, 6 bp, Unknown
  misc_feature (1)..( 6): Matrix.001 file - promoters60/1029395
ctaaat

SEQ ID NO: 45456 - DNA, 9 bp, Unknown
  misc_feature (1)..( 9): Matrix.001 file - promoters60/1029395
aattaaaaa

SEQ ID NO: 45457 - DNA, 9 bp, Unknown
  misc_feature (1)..( 9): Matrix.001 file - promoters60/1029395
cttttgtat

SEQ ID NO: 45458 - DNA, 6 bp, Unknown
  misc_feature (1)..( 6): Matrix.001 file - promoters60/1029395
aaaaga

SEQ ID NO: 45459 - DNA, 6 bp, Unknown
  misc_feature (1)..( 6): Matrix.001 file - promoters60/1029395
aataat

SEQ ID NO: 45460 - DNA, 8 bp, Unknown
  misc_feature (1)..( 8): Matrix.001 file - promoters60/1029395
aaacatgt

SEQ ID NO: 45461 - DNA, 9 bp, Unknown
  misc_feature (1)..( 9): Matrix.001 file - promoters60/1029395
tttatttga

SEQ ID NO: 45462 - DNA, 6 bp, Unknown
  misc_feature (1)..( 6): Matrix.001 file - promoters60/1029395
actatt

SEQ ID NO: 45463 - DNA, 8 bp, Unknown
  misc_feature (1)..( 8): Matrix.001 file - promoters60/1029395
tctcttat

SEQ ID NO: 45464 - DNA, 6 bp, Unknown
  misc_feature (1)..( 6): Matrix.001 file - promoters60/1029395
tttgta

SEQ ID NO: 45465 - DNA, 6 bp, Unknown
  misc_feature (1)..( 6): Matrix.001 file - promoters60/1029395
tcactc

SEQ ID NO: 45466 - DNA, 6 bp, Unknown
  misc_feature (1)..( 6): Matrix.001 file - promoters60/1029636
atcatt

SEQ ID NO: 45467 - DNA, 8 bp, Unknown
  misc_feature (1)..( 8): Matrix.001 file - promoters60/1029636
aatcattt

SEQ ID NO: 45468 - DNA, 15 bp, Unknown
  misc_feature (1)..( 15): Matrix.001 file - promoters60/1029636
attattaaaaaaaaa

SEQ ID NO: 45469 - DNA, 6 bp, Unknown
  misc_feature (1)..( 6): Matrix.001 file - promoters60/1029636
agagaa

SEQ ID NO: 45470 - DNA, 7 bp, Unknown
  misc_feature (1)..( 7): Matrix.001 file - promoters60/1029636
gatagga

SEQ ID NO: 45471 - DNA, 8 bp, Unknown
  misc_feature (1)..( 8): Matrix.001 file - promoters60/1029636
agtgacat

SEQ ID NO: 45472 - DNA, 12 bp, Unknown
  misc_feature (1)..( 12): Matrix.001 file - promoters60/1029636
gttaggttcgat

SEQ ID NO: 45473 - DNA, 7 bp, Unknown
  misc_feature (1)..( 7): Matrix.001 file - promoters60/1029636
aaaaccg

SEQ ID NO: 45474 - DNA, 6 bp, Unknown
  misc_feature (1)..( 6): Matrix.001 file - promoters60/1029636
tgtttc

SEQ ID NO: 45475 - DNA, 6 bp, Unknown
  misc_feature (1)..( 6): Matrix.001 file - promoters60/1029837
ataaat

SEQ ID NO: 45476 - DNA, 6 bp, Unknown
  misc_feature (1)..( 6): Matrix.001 file - promoters60/1029837
caaaat

SEQ ID NO: 45477 - DNA, 6 bp, Unknown
  misc_feature (1)..( 6): Matrix.001 file - promoters60/1029837
ataata

SEQ ID NO: 45478 - DNA, 6 bp, Unknown
  misc_feature (1)..( 6): Matrix.001 file - promoters60/1029837
aatttt

SEQ ID NO: 45479 - DNA, 8 bp, Unknown
  misc_feature (1)..( 8): Matrix.001 file - promoters60/1029837
ataaagaa

SEQ ID NO: 45480 - DNA, 6 bp, Unknown
  misc_feature (1)..( 6): Matrix.001 file - promoters60/1029837
agtcgc

SEQ ID NO: 45481 - DNA, 7 bp, Unknown
  misc_feature (1)..( 7): Matrix.001 file - promoters60/1029837
gccgagt

SEQ ID NO: 45482 - DNA, 7 bp, Unknown
  misc_feature (1)..( 7): Matrix.001 file - promoters60/1029837
acggttc

SEQ ID NO: 45483 - DNA, 8 bp, Unknown
  misc_feature (1)..( 8): Matrix.001 file - promoters60/1029837
tctaactc

SEQ ID NO: 45484 - DNA, 6 bp, Unknown
  misc_feature (1)..( 6): Matrix.001 file - promoters60/1029837
agatta

SEQ ID NO: 45485 - DNA, 17 bp, Unknown
  misc_feature (1)..( 17): Matrix.001 file - promoters60/1029837
aaatattaataataaaa

SEQ ID NO: 45486 - DNA, 7 bp, Unknown
  misc_feature (1)..( 7): Matrix.001 file - promoters60/1029837
tttttga

SEQ ID NO: 45487 - DNA, 7 bp, Unknown
  misc_feature (1)..( 7): Matrix.001 file - promoters60/1029837
tttaaat

SEQ ID NO: 45488 - DNA, 8 bp, Unknown
  misc_feature (1)..( 8): Matrix.001 file - promoters60/1029837
aataaatt

SEQ ID NO: 45489 - DNA, 7 bp, Unknown
  misc_feature (1)..( 7): Matrix.001 file - promoters60/1029837
tcattaa

SEQ ID NO: 45490 - DNA, 7 bp, Unknown
  misc_feature (1)..( 7): Matrix.001 file - promoters60/1029837
tctctga

SEQ ID NO: 45491 - DNA, 6 bp, Unknown
  misc_feature (1)..( 6): Matrix.001 file - promoters60/1029837
cctata

SEQ ID NO: 45492 - DNA, 8 bp, Unknown
  misc_feature (1)..( 8): Matrix.001 file - promoters60/1029837
aaaattta

SEQ ID NO: 45493 - DNA, 6 bp, Unknown
  misc_feature (1)..( 6): Matrix.001 file - promoters60/1029837
aacttt

SEQ ID NO: 45494 - DNA, 7 bp, Unknown
  misc_feature (1)..( 7): Matrix.001 file - promoters60/1029837
agatcca

SEQ ID NO: 45495 - DNA, 6 bp, Unknown
  misc_feature (1)..( 6): Matrix.001 file - promoters60/1029837
ttaatg

SEQ ID NO: 45496 - DNA, 6 bp, Unknown
  misc_feature (1)..( 6): Matrix.001 file - promoters60/1029837
gaaaaa

SEQ ID NO: 45497 - DNA, 8 bp, Unknown
  misc_feature (1)..( 8): Matrix.001 file - promoters60/1029841
aaaacaaa

SEQ ID NO: 45498 - DNA, 8 bp, Unknown
  misc_feature (1)..( 8): Matrix.001 file - promoters60/1029841
cataagat

SEQ ID NO: 45499 - DNA, 10 bp, Unknown
  misc_feature (1)..( 10): Matrix.001 file - promoters60/1029841
aaaaaaaaag

SEQ ID NO: 45500 - DNA, 9 bp, Unknown
  misc_feature (1)..( 9): Matrix.001 file - promoters60/1029841
taataatca

SEQ ID NO: 45501 - DNA, 7 bp, Unknown
  misc_feature (1)..( 7): Matrix.001 file - promoters60/1029841
taaattg

SEQ ID NO: 45502 - DNA, 11 bp, Unknown
  misc_feature (1)..( 11): Matrix.001 file - promoters60/1029841
aaaacaaaaca

SEQ ID NO: 45503 - DNA, 10 bp, Unknown
  misc_feature (1)..( 10): Matrix.001 file - promoters60/1029841
gtaatgtaca

SEQ ID NO: 45504 - DNA, 8 bp, Unknown
  misc_feature (1)..( 8): Matrix.001 file - promoters60/1029841
aaaaagaa

SEQ ID NO: 45505 - DNA, 15 bp, Unknown
  misc_feature (1)..( 15): Matrix.001 file - promoters60/1029908
gagaaagattaagta

SEQ ID NO: 45506 - DNA, 12 bp, Unknown
  misc_feature (1)..( 12): Matrix.001 file - promoters60/1029931
gaaagctttaaa

SEQ ID NO: 45507 - DNA, 6 bp, Unknown
  misc_feature (1)..( 6): Matrix.001 file - promoters60/1030139
ttcaca

SEQ ID NO: 45508 - DNA, 6 bp, Unknown
  misc_feature (1)..( 6): Matrix.001 file - promoters60/1030139
agcttt

SEQ ID NO: 45509 - DNA, 6 bp, Unknown
  misc_feature (1)..( 6): Matrix.001 file - promoters60/1030139
ttttca

SEQ ID NO: 45510 - DNA, 7 bp, Unknown
  misc_feature (1)..( 7): Matrix.001 file - promoters60/1030139
atataag

SEQ ID NO: 45511 - DNA, 6 bp, Unknown
  misc_feature (1)..( 6): Matrix.001 file - promoters60/1030139
tcacta

SEQ ID NO: 45512 - DNA, 6 bp, Unknown
  misc_feature (1)..( 6): Matrix.001 file - promoters60/1030139
tcaatc

SEQ ID NO: 45513 - DNA, 6 bp, Unknown
  misc_feature (1)..( 6): Matrix.001 file - promoters60/1030139
agtaag

SEQ ID NO: 45514 - DNA, 7 bp, Unknown
  misc_feature (1)..( 7): Matrix.001 file - promoters60/1030139
accaaac

SEQ ID NO: 45515 - DNA, 7 bp, Unknown
  misc_feature (1)..( 7): Matrix.001 file - promoters60/1030139
ttgatgt

SEQ ID NO: 45516 - DNA, 7 bp, Unknown
  misc_feature (1)..( 7): Matrix.001 file - promoters60/1030157
aacattt

SEQ ID NO: 45517 - DNA, 7 bp, Unknown
  misc_feature (1)..( 7): Matrix.001 file - promoters60/1030157
taaacta

SEQ ID NO: 45518 - DNA, 6 bp, Unknown
  misc_feature (1)..( 6): Matrix.001 file - promoters60/1030157
gaaatt

SEQ ID NO: 45519 - DNA, 7 bp, Unknown
  misc_feature (1)..( 7): Matrix.001 file - promoters60/1030157
taaaata

SEQ ID NO: 45520 - DNA, 6 bp, Unknown
  misc_feature (1)..( 6): Matrix.001 file - promoters60/1030157
taatta

SEQ ID NO: 45521 - DNA, 6 bp, Unknown
  misc_feature (1)..( 6): Matrix.001 file - promoters60/1030157
aaaata

SEQ ID NO: 45522 - DNA, 7 bp, Unknown
  misc_feature (1)..( 7): Matrix.001 file - promoters60/1030157
aataaca

SEQ ID NO: 45523 - DNA, 7 bp, Unknown
  misc_feature (1)..( 7): Matrix.001 file - promoters60/1030157
tttcttt

SEQ ID NO: 45524 - DNA, 8 bp, Unknown
  misc_feature (1)..( 8): Matrix.001 file - promoters60/1030157
tgaaatat

SEQ ID NO: 45525 - DNA, 6 bp, Unknown
  misc_feature (1)..( 6): Matrix.001 file - promoters60/1030157
tcaaat

SEQ ID NO: 45526 - DNA, 7 bp, Unknown
  misc_feature (1)..( 7): Matrix.001 file - promoters60/1030157
caaatcg

SEQ ID NO: 45527 - DNA, 6 bp, Unknown
  misc_feature (1)..( 6): Matrix.001 file - promoters60/1030157
aaaata

SEQ ID NO: 45528 - DNA, 6 bp, Unknown
  misc_feature (1)..( 6): Matrix.001 file - promoters60/1030157
tataac

SEQ ID NO: 45529 - DNA, 8 bp, Unknown
  misc_feature (1)..( 8): Matrix.001 file - promoters60/1030157
agtgaaga

SEQ ID NO: 45530 - DNA, 6 bp, Unknown
  misc_feature (1)..( 6): Matrix.001 file - promoters60/1030157
agacga

SEQ ID NO: 45531 - DNA, 6 bp, Unknown
  misc_feature (1)..( 6): Matrix.001 file - promoters60/1030209
tattct

SEQ ID NO: 45532 - DNA, 9 bp, Unknown
  misc_feature (1)..( 9): Matrix.001 file - promoters60/1030209
atgatatct

SEQ ID NO: 45533 - DNA, 11 bp, Unknown
  misc_feature (1)..( 11): Matrix.001 file - promoters60/1030209
tctactcaaca

SEQ ID NO: 45534 - DNA, 11 bp, Unknown
  misc_feature (1)..( 11): Matrix.001 file - promoters60/1030209
gttacatcaag

SEQ ID NO: 45535 - DNA, 7 bp, Unknown
  misc_feature (1)..( 7): Matrix.001 file - promoters60/1030209
aagaaaa

SEQ ID NO: 45536 - DNA, 7 bp, Unknown
  misc_feature (1)..( 7): Matrix.001 file - promoters60/1030209
aaagccc

SEQ ID NO: 45537 - DNA, 6 bp, Unknown
  misc_feature (1)..( 6): Matrix.001 file - promoters60/1030209
tatttt

SEQ ID NO: 45538 - DNA, 9 bp, Unknown
  misc_feature (1)..( 9): Matrix.001 file - promoters60/1030209
ttttaaaaa

SEQ ID NO: 45539 - DNA, 6 bp, Unknown
  misc_feature (1)..( 6): Matrix.001 file - promoters60/1030209
aaacag

SEQ ID NO: 45540 - DNA, 8 bp, Unknown
  misc_feature (1)..( 8): Matrix.001 file - promoters60/1030209
aaaaagtt

SEQ ID NO: 45541 - DNA, 11 bp, Unknown
  misc_feature (1)..( 11): Matrix.001 file - promoters60/1030209
gatcagagaaa

SEQ ID NO: 45542 - DNA, 7 bp, Unknown
  misc_feature (1)..( 7): Matrix.001 file - promoters60/1030209
gaaaatt

SEQ ID NO: 45543 - DNA, 6 bp, Unknown
  misc_feature (1)..( 6): Matrix.001 file - promoters60/1030209
tttctc

SEQ ID NO: 45544 - DNA, 6 bp, Unknown
  misc_feature (1)..( 6): Matrix.001 file - promoters60/1030209
aaaaat

SEQ ID NO: 45545 - DNA, 7 bp, Unknown
  misc_feature (1)..( 7): Matrix.001 file - promoters60/1030209
aaaataa

SEQ ID NO: 45546 - DNA, 6 bp, Unknown
  misc_feature (1)..( 6): Matrix.001 file - promoters60/1030209
aaaaac

SEQ ID NO: 45547 - DNA, 12 bp, Unknown
  misc_feature (1)..( 12): Matrix.001 file - promoters60/1030259
atttatttctat

SEQ ID NO: 45548 - DNA, 7 bp, Unknown
  misc_feature (1)..( 7): Matrix.001 file - promoters60/1030336
cgccgcc

SEQ ID NO: 45549 - DNA, 10 bp, Unknown
  misc_feature (1)..( 10): Matrix.001 file - promoters60/1030336
aatcattcaa

SEQ ID NO: 45550 - DNA, 7 bp, Unknown
  misc_feature (1)..( 7): Matrix.001 file - promoters60/1030336
caaattc

SEQ ID NO: 45551 - DNA, 12 bp, Unknown
  misc_feature (1)..( 12): Matrix.001 file - promoters60/1030336
ggtaaaacagaa

SEQ ID NO: 45552 - DNA, 8 bp, Unknown
  misc_feature (1)..( 8): Matrix.001 file - promoters60/1030336
tttaagaa

SEQ ID NO: 45553 - DNA, 6 bp, Unknown
  misc_feature (1)..( 6): Matrix.001 file - promoters60/1030336
gtttcg

SEQ ID NO: 45554 - DNA, 7 bp, Unknown
  misc_feature (1)..( 7): Matrix.001 file - promoters60/1030336
cgccttt

SEQ ID NO: 45555 - DNA, 6 bp, Unknown
  misc_feature (1)..( 6): Matrix.001 file - promoters60/1030336
aatttc

SEQ ID NO: 45556 - DNA, 8 bp, Unknown
  misc_feature (1)..( 8): Matrix.001 file - promoters60/1030336
ccaaaaga

SEQ ID NO: 45557 - DNA, 6 bp, Unknown
  misc_feature (1)..( 6): Matrix.001 file - promoters60/1030336
aagaga

SEQ ID NO: 45558 - DNA, 7 bp, Unknown
  misc_feature (1)..( 7): Matrix.001 file - promoters60/1030336
atcatcg

SEQ ID NO: 45559 - DNA, 6 bp, Unknown
  misc_feature (1)..( 6): Matrix.001 file - promoters60/1030336
cggtta

SEQ ID NO: 45560 - DNA, 8 bp, Unknown
  misc_feature (1)..( 8): Matrix.001 file - promoters60/1030428
tattttta

SEQ ID NO: 45561 - DNA, 8 bp, Unknown
  misc_feature (1)..( 8): Matrix.001 file - promoters60/1030428
atatgtta

SEQ ID NO: 45562 - DNA, 7 bp, Unknown
  misc_feature (1)..( 7): Matrix.001 file - promoters60/1030428
tataaag

SEQ ID NO: 45563 - DNA, 9 bp, Unknown
  misc_feature (1)..( 9): Matrix.001 file - promoters60/1030428
gattacata

SEQ ID NO: 45564 - DNA, 7 bp, Unknown
  misc_feature (1)..( 7): Matrix.001 file - promoters60/1030428
aaaagaa

SEQ ID NO: 45565 - DNA, 8 bp, Unknown
  misc_feature (1)..( 8): Matrix.001 file - promoters60/1030428
cttgtttt

SEQ ID NO: 45566 - DNA, 7 bp, Unknown
  misc_feature (1)..( 7): Matrix.001 file - promoters60/1030528
ttaaaaa

SEQ ID NO: 45567 - DNA, 9 bp, Unknown
  misc_feature (1)..( 9): Matrix.001 file - promoters60/1030528
ataataatt

SEQ ID NO: 45568 - DNA, 11 bp, Unknown
  misc_feature (1)..( 11): Matrix.001 file - promoters60/1030528
taattctttta

SEQ ID NO: 45569 - DNA, 7 bp, Unknown
  misc_feature (1)..( 7): Matrix.001 file - promoters60/1030528
aaaagtt

SEQ ID NO: 45570 - DNA, 9 bp, Unknown
  misc_feature (1)..( 9): Matrix.001 file - promoters60/1030528
tataaaaac

SEQ ID NO: 45571 - DNA, 17 bp, Unknown
  misc_feature (1)..( 17): Matrix.001 file - promoters60/1030530
ttttaattatttaaata

SEQ ID NO: 45572 - DNA, 8 bp, Unknown
  misc_feature (1)..( 8): Matrix.001 file - promoters60/1030530
aacatgta

SEQ ID NO: 45573 - DNA, 13 bp, Unknown
  misc_feature (1)..( 13): Matrix.001 file - promoters60/1030530
aacatgtatgaat

SEQ ID NO: 45574 - DNA, 14 bp, Unknown
  misc_feature (1)..( 14): Matrix.001 file - promoters60/1030547
taaatttgttaaca

SEQ ID NO: 45575 - DNA, 10 bp, Unknown
  misc_feature (1)..( 10): Matrix.001 file - promoters60/1030547
aaatcaaaat

SEQ ID NO: 45576 - DNA, 16 bp, Unknown
  misc_feature (1)..( 16): Matrix.001 file - promoters60/1030547
attagaatttttaaaa

SEQ ID NO: 45577 - DNA, 8 bp, Unknown
  misc_feature (1)..( 8): Matrix.001 file - promoters60/1030547
ttttgaag

SEQ ID NO: 45578 - DNA, 15 bp, Unknown
  misc_feature (1)..( 15): Matrix.001 file - promoters60/1030547
atataaattttaaaa

SEQ ID NO: 45579 - DNA, 11 bp, Unknown
  misc_feature (1)..( 11): Matrix.001 file - promoters60/1030547
tatatataaac

SEQ ID NO: 45580 - DNA, 10 bp, Unknown
  misc_feature (1)..( 10): Matrix.001 file - promoters60/1030547
tataaaaacc

SEQ ID NO: 45581 - DNA, 11 bp, Unknown
  misc_feature (1)..( 11): Matrix.001 file - promoters60/1030547
gaataatttta

SEQ ID NO: 45582 - DNA, 10 bp, Unknown
  misc_feature (1)..( 10): Matrix.001 file - promoters60/1030547
gattagaaaa

SEQ ID NO: 45583 - DNA, 10 bp, Unknown
  misc_feature (1)..( 10): Matrix.001 file - promoters60/1030547
attattttaa

SEQ ID NO: 45584 - DNA, 8 bp, Unknown
  misc_feature (1)..( 8): Matrix.001 file - promoters60/1030547
aaaacctt

SEQ ID NO: 45585 - DNA, 10 bp, Unknown
  misc_feature (1)..( 10): Matrix.001 file - promoters60/1030581
aattttgaaa

SEQ ID NO: 45586 - DNA, 11 bp, Unknown
  misc_feature (1)..( 11): Matrix.001 file - promoters60/1030605
ttaaactataa

SEQ ID NO: 45587 - DNA, 14 bp, Unknown
  misc_feature (1)..( 14): Matrix.001 file - promoters60/1030605
ttaaactatattta

SEQ ID NO: 45588 - DNA, 12 bp, Unknown
  misc_feature (1)..( 12): Matrix.001 file - promoters60/1030605
caaaaaaaaaaa

SEQ ID NO: 45589 - DNA, 13 bp, Unknown
  misc_feature (1)..( 13): Matrix.001 file - promoters60/1030605
taattttgatatc

SEQ ID NO: 45590 - DNA, 8 bp, Unknown
  misc_feature (1)..( 8): Matrix.001 file - promoters60/1030605
aacaaatt

SEQ ID NO: 45591 - DNA, 11 bp, Unknown
  misc_feature (1)..( 11): Matrix.001 file - promoters60/1030605
tttgaaaaatt

SEQ ID NO: 45592 - DNA, 7 bp, Unknown
  misc_feature (1)..( 7): Matrix.001 file - promoters60/1030605
atataaa

SEQ ID NO: 45593 - DNA, 7 bp, Unknown
  misc_feature (1)..( 7): Matrix.001 file - promoters60/1030605
atatatt

SEQ ID NO: 45594 - DNA, 10 bp, Unknown
  misc_feature (1)..( 10): Matrix.001 file - promoters60/1030605
taaattggaa

SEQ ID NO: 45595 - DNA, 14 bp, Unknown
  misc_feature (1)..( 14): Matrix.001 file - promoters60/1030605
cttactatataaaa

SEQ ID NO: 45596 - DNA, 10 bp, Unknown
  misc_feature (1)..( 10): Matrix.001 file - promoters60/1030605
tatttagaaa

SEQ ID NO: 45597 - DNA, 8 bp, Unknown
  misc_feature (1)..( 8): Matrix.001 file - promoters60/1030616
ttctataa

SEQ ID NO: 45598 - DNA, 6 bp, Unknown
  misc_feature (1)..( 6): Matrix.001 file - promoters60/1030616
tttgct

SEQ ID NO: 45599 - DNA, 7 bp, Unknown
  misc_feature (1)..( 7): Matrix.001 file - promoters60/1030616
gaaatta

SEQ ID NO: 45600 - DNA, 6 bp, Unknown
  misc_feature (1)..( 6): Matrix.001 file - promoters60/1030616
atttgt

SEQ ID NO: 45601 - DNA, 7 bp, Unknown
  misc_feature (1)..( 7): Matrix.001 file - promoters60/1030616
tgtaaat

SEQ ID NO: 45602 - DNA, 10 bp, Unknown
  misc_feature (1)..( 10): Matrix.001 file - promoters60/1030616
ctacaattag

SEQ ID NO: 45603 - DNA, 6 bp, Unknown
  misc_feature (1)..( 6): Matrix.001 file - promoters60/1030616
gattta

SEQ ID NO: 45604 - DNA, 6 bp, Unknown
  misc_feature (1)..( 6): Matrix.001 file - promoters60/1030616
aaatga

SEQ ID NO: 45605 - DNA, 10 bp, Unknown
  misc_feature (1)..( 10): Matrix.001 file - promoters60/1030616
ccgaaatttt

SEQ ID NO: 45606 - DNA, 6 bp, Unknown
  misc_feature (1)..( 6): Matrix.001 file - promoters60/1030616
caaaaa

SEQ ID NO: 45607 - DNA, 7 bp, Unknown
  misc_feature (1)..( 7): Matrix.001 file - promoters60/1030616
gccaaat

SEQ ID NO: 45608 - DNA, 8 bp, Unknown
  misc_feature (1)..( 8): Matrix.001 file - promoters60/1030616
aaatcctc

SEQ ID NO: 45609 - DNA, 8 bp, Unknown
  misc_feature (1)..( 8): Matrix.001 file - promoters60/1030616
aaatttct

SEQ ID NO: 45610 - DNA, 7 bp, Unknown
  misc_feature (1)..( 7): Matrix.001 file - promoters60/1030616
tttataa

SEQ ID NO: 45611 - DNA, 6 bp, Unknown
  misc_feature (1)..( 6): Matrix.001 file - promoters60/1030616
ttgtta

SEQ ID NO: 45612 - DNA, 7 bp, Unknown
  misc_feature (1)..( 7): Matrix.001 file - promoters60/1030616
ttttgat

SEQ ID NO: 45613 - DNA, 8 bp, Unknown
  misc_feature (1)..( 8): Matrix.001 file - promoters60/1030616
agaccctt

SEQ ID NO: 45614 - DNA, 6 bp, Unknown
  misc_feature (1)..( 6): Matrix.001 file - promoters60/1030616
ttgaga

SEQ ID NO: 45615 - DNA, 7 bp, Unknown
  misc_feature (1)..( 7): Matrix.001 file - promoters60/1030616
taaattg

SEQ ID NO: 45616 - DNA, 10 bp, Unknown
  misc_feature (1)..( 10): Matrix.001 file - promoters60/1030616
aaacttttaa

SEQ ID NO: 45617 - DNA, 6 bp, Unknown
  misc_feature (1)..( 6): Matrix.001 file - promoters60/1030616
atacct

SEQ ID NO: 45618 - DNA, 7 bp, Unknown
  misc_feature (1)..( 7): Matrix.001 file - promoters60/1030616
aaacata

SEQ ID NO: 45619 - DNA, 9 bp, Unknown
  misc_feature (1)..( 9): Matrix.001 file - promoters60/1030616
taaaacatt

SEQ ID NO: 45620 - DNA, 8 bp, Unknown
  misc_feature (1)..( 8): Matrix.001 file - promoters60/1030616
ctttacat

SEQ ID NO: 45621 - DNA, 7 bp, Unknown
  misc_feature (1)..( 7): Matrix.001 file - promoters60/1030616
aaagaaa

SEQ ID NO: 45622 - DNA, 6 bp, Unknown
  misc_feature (1)..( 6): Matrix.001 file - promoters60/1030616
ttacct

SEQ ID NO: 45623 - DNA, 9 bp, Unknown
  misc_feature (1)..( 9): Matrix.001 file - promoters60/1030699
ttaacaaaa

SEQ ID NO: 45624 - DNA, 9 bp, Unknown
  misc_feature (1)..( 9): Matrix.001 file - promoters60/1030699
acaaatttt

SEQ ID NO: 45625 - DNA, 15 bp, Unknown
  misc_feature (1)..( 15): Matrix.001 file - promoters60/1030699
tttaattttttcaaa

SEQ ID NO: 45626 - DNA, 11 bp, Unknown
  misc_feature (1)..( 11): Matrix.001 file - promoters60/1030699
aacaaaaacaa

SEQ ID NO: 45627 - DNA, 15 bp, Unknown
  misc_feature (1)..( 15): Matrix.001 file - promoters60/1030699
caaactttttatttt

SEQ ID NO: 45628 - DNA, 7 bp, Unknown
  misc_feature (1)..( 7): Matrix.001 file - promoters60/1030699
atgtttg

SEQ ID NO: 45629 - DNA, 9 bp, Unknown
  misc_feature (1)..( 9): Matrix.001 file - promoters60/1030715
ttcataata

SEQ ID NO: 45630 - DNA, 6 bp, Unknown
  misc_feature (1)..( 6): Matrix.001 file - promoters60/1030715
acaaag

SEQ ID NO: 45631 - DNA, 8 bp, Unknown
  misc_feature (1)..( 8): Matrix.001 file - promoters60/1030715
atgaattc

SEQ ID NO: 45632 - DNA, 7 bp, Unknown
  misc_feature (1)..( 7): Matrix.001 file - promoters60/1030715
aaattga

SEQ ID NO: 45633 - DNA, 7 bp, Unknown
  misc_feature (1)..( 7): Matrix.001 file - promoters60/1030715
atatttc

SEQ ID NO: 45634 - DNA, 7 bp, Unknown
  misc_feature (1)..( 7): Matrix.001 file - promoters60/1030715
aagaatg

SEQ ID NO: 45635 - DNA, 7 bp, Unknown
  misc_feature (1)..( 7): Matrix.001 file - promoters60/1030715
gtttgtg

SEQ ID NO: 45636 - DNA, 6 bp, Unknown
  misc_feature (1)..( 6): Matrix.001 file - promoters60/1030715
tgctaa

SEQ ID NO: 45637 - DNA, 8 bp, Unknown
  misc_feature (1)..( 8): Matrix.001 file - promoters60/1030715
taaaagtt

SEQ ID NO: 45638 - DNA, 11 bp, Unknown
  misc_feature (1)..( 11): Matrix.001 file - promoters60/1030715
ttgtacttatt

SEQ ID NO: 45639 - DNA, 6 bp, Unknown
  misc_feature (1)..( 6): Matrix.001 file - promoters60/1030715
tttatt

SEQ ID NO: 45640 - DNA, 7 bp, Unknown
  misc_feature (1)..( 7): Matrix.001 file - promoters60/1030715
tttaaga

SEQ ID NO: 45641 - DNA, 6 bp, Unknown
  misc_feature (1)..( 6): Matrix.001 file - promoters60/1030715
tttgtg

SEQ ID NO: 45642 - DNA, 7 bp, Unknown
  misc_feature (1)..( 7): Matrix.001 file - promoters60/1030715
aaaatga

SEQ ID NO: 45643 - DNA, 6 bp, Unknown
  misc_feature (1)..( 6): Matrix.001 file - promoters60/1030715
ttaaac

SEQ ID NO: 45644 - DNA, 6 bp, Unknown
  misc_feature (1)..( 6): Matrix.001 file - promoters60/1030715
gaattt

SEQ ID NO: 45645 - DNA, 6 bp, Unknown
  misc_feature (1)..( 6): Matrix.001 file - promoters60/1030715
ttatta

SEQ ID NO: 45646 - DNA, 8 bp, Unknown
  misc_feature (1)..( 8): Matrix.001 file - promoters60/1030715
ttacaaat

SEQ ID NO: 45647 - DNA, 6 bp, Unknown
  misc_feature (1)..( 6): Matrix.001 file - promoters60/1030715
taataa

SEQ ID NO: 45648 - DNA, 8 bp, Unknown
  misc_feature (1)..( 8): Matrix.001 file - promoters60/1030715
taaagatt

SEQ ID NO: 45649 - DNA, 7 bp, Unknown
  misc_feature (1)..( 7): Matrix.001 file - promoters60/1030715
tttcttt

SEQ ID NO: 45650 - DNA, 7 bp, Unknown
  misc_feature (1)..( 7): Matrix.001 file - promoters60/1030715
ttggatg

SEQ ID NO: 45651 - DNA, 7 bp, Unknown
  misc_feature (1)..( 7): Matrix.001 file - promoters60/1030715
tgactat

SEQ ID NO: 45652 - DNA, 6 bp, Unknown
  misc_feature (1)..( 6): Matrix.001 file - promoters60/1030715
atctaa

SEQ ID NO: 45653 - DNA, 6 bp, Unknown
  misc_feature (1)..( 6): Matrix.001 file - promoters60/1030715
taggtg

SEQ ID NO: 45654 - DNA, 11 bp, Unknown
  misc_feature (1)..( 11): Matrix.001 file - promoters60/1030757
caaatacattt

SEQ ID NO: 45655 - DNA, 8 bp, Unknown
  misc_feature (1)..( 8): Matrix.001 file - promoters60/1030757
caaataat

SEQ ID NO: 45656 - DNA, 6 bp, Unknown
  misc_feature (1)..( 6): Matrix.001 file - promoters60/1030757
tttttt

SEQ ID NO: 45657 - DNA, 8 bp, Unknown
  misc_feature (1)..( 8): Matrix.001 file - promoters60/1030757
cttttgaa

SEQ ID NO: 45658 - DNA, 10 bp, Unknown
  misc_feature (1)..( 10): Matrix.001 file - promoters60/1030757
gttttttgag

SEQ ID NO: 45659 - DNA, 10 bp, Unknown
  misc_feature (1)..( 10): Matrix.001 file - promoters60/1030757
aatatatttc

SEQ ID NO: 45660 - DNA, 11 bp, Unknown
  misc_feature (1)..( 11): Matrix.001 file - promoters60/1030757
aattttatata

SEQ ID NO: 45661 - DNA, 9 bp, Unknown
  misc_feature (1)..( 9): Matrix.001 file - promoters60/1030757
tttgtataa

SEQ ID NO: 45662 - DNA, 8 bp, Unknown
  misc_feature (1)..( 8): Matrix.001 file - promoters60/1030757
aatttttt

SEQ ID NO: 45663 - DNA, 9 bp, Unknown
  misc_feature (1)..( 9): Matrix.001 file - promoters60/1030757
caccagtct

SEQ ID NO: 45664 - DNA, 9 bp, Unknown
  misc_feature (1)..( 9): Matrix.001 file - promoters60/1030757
tttcatttt

SEQ ID NO: 45665 - DNA, 11 bp, Unknown
  misc_feature (1)..( 11): Matrix.001 file - promoters60/1030757
tatataaaaat

SEQ ID NO: 45666 - DNA, 11 bp, Unknown
  misc_feature (1)..( 11): Matrix.001 file - promoters60/1030757
aaaagtgaaag

SEQ ID NO: 45667 - DNA, 7 bp, Unknown
  misc_feature (1)..( 7): Matrix.001 file - promoters60/1030757
ggattta

SEQ ID NO: 45668 - DNA, 8 bp, Unknown
  misc_feature (1)..( 8): Matrix.001 file - promoters60/1030771
tgtatctc

SEQ ID NO: 45669 - DNA, 7 bp, Unknown
  misc_feature (1)..( 7): Matrix.001 file - promoters60/1030771
agagtct

SEQ ID NO: 45670 - DNA, 7 bp, Unknown
  misc_feature (1)..( 7): Matrix.001 file - promoters60/1030771
cttactc

SEQ ID NO: 45671 - DNA, 6 bp, Unknown
  misc_feature (1)..( 6): Matrix.001 file - promoters60/1030771
ctttta

SEQ ID NO: 45672 - DNA, 6 bp, Unknown
  misc_feature (1)..( 6): Matrix.001 file - promoters60/1030771
ccaatc

SEQ ID NO: 45673 - DNA, 9 bp, Unknown
  misc_feature (1)..( 9): Matrix.001 file - promoters60/1030771
tgaaaaagt

SEQ ID NO: 45674 - DNA, 6 bp, Unknown
  misc_feature (1)..( 6): Matrix.001 file - promoters60/1030771
aaaaac

SEQ ID NO: 45675 - DNA, 6 bp, Unknown
  misc_feature (1)..( 6): Matrix.001 file - promoters60/1030771
taaaaa

SEQ ID NO: 45676 - DNA, 7 bp, Unknown
  misc_feature (1)..( 7): Matrix.001 file - promoters60/1030771
aagccca

SEQ ID NO: 45677 - DNA, 6 bp, Unknown
  misc_feature (1)..( 6): Matrix.001 file - promoters60/1030771
atccaa

SEQ ID NO: 45678 - DNA, 7 bp, Unknown
  misc_feature (1)..( 7): Matrix.001 file - promoters60/1030771
catattt

SEQ ID NO: 45679 - DNA, 6 bp, Unknown
  misc_feature (1)..( 6): Matrix.001 file - promoters60/1030771
tttcat

SEQ ID NO: 45680 - DNA, 6 bp, Unknown
  misc_feature (1)..( 6): Matrix.001 file - promoters60/1030771
ttatta

SEQ ID NO: 45681 - DNA, 7 bp, Unknown
  misc_feature (1)..( 7): Matrix.001 file - promoters60/1030771
gcccatt

SEQ ID NO: 45682 - DNA, 7 bp, Unknown
  misc_feature (1)..( 7): Matrix.001 file - promoters60/1030771
tctgcct

SEQ ID NO: 45683 - DNA, 6 bp, Unknown
  misc_feature (1)..( 6): Matrix.001 file - promoters60/1030771
gtaata

SEQ ID NO: 45684 - DNA, 6 bp, Unknown
  misc_feature (1)..( 6): Matrix.001 file - promoters60/1030778
agagca

SEQ ID NO: 45685 - DNA, 6 bp, Unknown
  misc_feature (1)..( 6): Matrix.001 file - promoters60/1030778
atagag

SEQ ID NO: 45686 - DNA, 7 bp, Unknown
  misc_feature (1)..( 7): Matrix.001 file - promoters60/1030778
tatattg

SEQ ID NO: 45687 - DNA, 6 bp, Unknown
  misc_feature (1)..( 6): Matrix.001 file - promoters60/1030778
aaagac

SEQ ID NO: 45688 - DNA, 7 bp, Unknown
  misc_feature (1)..( 7): Matrix.001 file - promoters60/1030778
taaaaaa

SEQ ID NO: 45689 - DNA, 6 bp, Unknown
  misc_feature (1)..( 6): Matrix.001 file - promoters60/1030778
taaaaa

SEQ ID NO: 45690 - DNA, 6 bp, Unknown
  misc_feature (1)..( 6): Matrix.001 file - promoters60/1030778
cttcta

SEQ ID NO: 45691 - DNA, 7 bp, Unknown
  misc_feature (1)..( 7): Matrix.001 file - promoters60/1030778
tttctat

SEQ ID NO: 45692 - DNA, 7 bp, Unknown
  misc_feature (1)..( 7): Matrix.001 file - promoters60/1030778
tatattg

SEQ ID NO: 45693 - DNA, 8 bp, Unknown
  misc_feature (1)..( 8): Matrix.001 file - promoters60/1030778
tgttaaaa

SEQ ID NO: 45694 - DNA, 8 bp, Unknown
  misc_feature (1)..( 8): Matrix.001 file - promoters60/1030778
cattaaac

SEQ ID NO: 45695 - DNA, 6 bp, Unknown
  misc_feature (1)..( 6): Matrix.001 file - promoters60/1030778
tctcca

SEQ ID NO: 45696 - DNA, 7 bp, Unknown
  misc_feature (1)..( 7): Matrix.001 file - promoters60/1030778
ccatttt

SEQ ID NO: 45697 - DNA, 6 bp, Unknown
  misc_feature (1)..( 6): Matrix.001 file - promoters60/1030778
ttttca

SEQ ID NO: 45698 - DNA, 6 bp, Unknown
  misc_feature (1)..( 6): Matrix.001 file - promoters60/1030778
tgtctt

SEQ ID NO: 45699 - DNA, 6 bp, Unknown
  misc_feature (1)..( 6): Matrix.001 file - promoters60/1030778
caagct

SEQ ID NO: 45700 - DNA, 7 bp, Unknown
  misc_feature (1)..( 7): Matrix.001 file - promoters60/1030778
ataaata

SEQ ID NO: 45701 - DNA, 7 bp, Unknown
  misc_feature (1)..( 7): Matrix.001 file - promoters60/1030782
atgcctg

SEQ ID NO: 45702 - DNA, 8 bp, Unknown
  misc_feature (1)..( 8): Matrix.001 file - promoters60/1030782
tcataatg

SEQ ID NO: 45703 - DNA, 8 bp, Unknown
  misc_feature (1)..( 8): Matrix.001 file - promoters60/1030782
atttggat

SEQ ID NO: 45704 - DNA, 8 bp, Unknown
  misc_feature (1)..( 8): Matrix.001 file - promoters60/1030782
cgttcaaa

SEQ ID NO: 45705 - DNA, 7 bp, Unknown
  misc_feature (1)..( 7): Matrix.001 file - promoters60/1030782
gaaataa

SEQ ID NO: 45706 - DNA, 6 bp, Unknown
  misc_feature (1)..( 6): Matrix.001 file - promoters60/1030782
aataaa

SEQ ID NO: 45707 - DNA, 7 bp, Unknown
  misc_feature (1)..( 7): Matrix.001 file - promoters60/1030782
atagttt

SEQ ID NO: 45708 - DNA, 6 bp, Unknown
  misc_feature (1)..( 6): Matrix.001 file - promoters60/1030782
agatca

SEQ ID NO: 45709 - DNA, 7 bp, Unknown
  misc_feature (1)..( 7): Matrix.001 file - promoters60/1030782
aaagaaa

SEQ ID NO: 45710 - DNA, 6 bp, Unknown
  misc_feature (1)..( 6): Matrix.001 file - promoters60/1030782
atgaca

SEQ ID NO: 45711 - DNA, 7 bp, Unknown
  misc_feature (1)..( 7): Matrix.001 file - promoters60/1030782
aaaggta

SEQ ID NO: 45712 - DNA, 9 bp, Unknown
  misc_feature (1)..( 9): Matrix.001 file - promoters60/1030782
attaacacc

SEQ ID NO: 45713 - DNA, 6 bp, Unknown
  misc_feature (1)..( 6): Matrix.001 file - promoters60/1030782
caatca

SEQ ID NO: 45714 - DNA, 8 bp, Unknown
  misc_feature (1)..( 8): Matrix.001 file - promoters60/1030782
aaagagaa

SEQ ID NO: 45715 - DNA, 6 bp, Unknown
  misc_feature (1)..( 6): Matrix.001 file - promoters60/1030782
atgaga

SEQ ID NO: 45716 - DNA, 9 bp, Unknown
  misc_feature (1)..( 9): Matrix.001 file - promoters60/1030803
tcggtgaag

SEQ ID NO: 45717 - DNA, 8 bp, Unknown
  misc_feature (1)..( 8): Matrix.001 file - promoters60/1030803
tcggagaa

SEQ ID NO: 45718 - DNA, 8 bp, Unknown
  misc_feature (1)..( 8): Matrix.001 file - promoters60/1030803
aatattac

SEQ ID NO: 45719 - DNA, 7 bp, Unknown
  misc_feature (1)..( 7): Matrix.001 file - promoters60/1030803
aggcaaa

SEQ ID NO: 45720 - DNA, 7 bp, Unknown
  misc_feature (1)..( 7): Matrix.001 file - promoters60/1030803
gtgggtt

SEQ ID NO: 45721 - DNA, 7 bp, Unknown
  misc_feature (1)..( 7): Matrix.001 file - promoters60/1030803
caaccac

SEQ ID NO: 45722 - DNA, 6 bp, Unknown
  misc_feature (1)..( 6): Matrix.001 file - promoters60/1030803
ggctga

SEQ ID NO: 45723 - DNA, 11 bp, Unknown
  misc_feature (1)..( 11): Matrix.001 file - promoters60/1030803
agggtctcaga

SEQ ID NO: 45724 - DNA, 6 bp, Unknown
  misc_feature (1)..( 6): Matrix.001 file - promoters60/1030803
agattt

SEQ ID NO: 45725 - DNA, 9 bp, Unknown
  misc_feature (1)..( 9): Matrix.001 file - promoters60/1030821
cttgtttaa

SEQ ID NO: 45726 - DNA, 8 bp, Unknown
  misc_feature (1)..( 8): Matrix.001 file - promoters60/1030894
attgtttt

SEQ ID NO: 45727 - DNA, 13 bp, Unknown
  misc_feature (1)..( 13): Matrix.001 file - promoters60/1030894
caaaaacaacaat

SEQ ID NO: 45728 - DNA, 8 bp, Unknown
  misc_feature (1)..( 8): Matrix.001 file - promoters60/1030894
aaaaacaa

SEQ ID NO: 45729 - DNA, 13 bp, Unknown
  misc_feature (1)..( 13): Matrix.001 file - promoters60/1030902
gtcatataaataa

SEQ ID NO: 45730 - DNA, 5 bp, Unknown
  misc_feature (1)..( 5): Matrix.001 file - promoters60/1030916
gtaat

SEQ ID NO: 45731 - DNA, 11 bp, Unknown
  misc_feature (1)..( 11): Matrix.001 file - promoters60/1030916
agcaaaaacgt

SEQ ID NO: 45732 - DNA, 12 bp, Unknown
  misc_feature (1)..( 12): Matrix.001 file - promoters60/1030916
atttgcttttaa

SEQ ID NO: 45733 - DNA, 10 bp, Unknown
  misc_feature (1)..( 10): Matrix.001 file - promoters60/1030916
actttataat

SEQ ID NO: 45734 - DNA, 7 bp, Unknown
  misc_feature (1)..( 7): Matrix.001 file - promoters60/1030916
acaaaat

SEQ ID NO: 45735 - DNA, 11 bp, Unknown
  misc_feature (1)..( 11): Matrix.001 file - promoters60/1030918
ctttattgaaa

SEQ ID NO: 45736 - DNA, 7 bp, Unknown
  misc_feature (1)..( 7): Matrix.001 file - promoters60/1030933
taaagtt

SEQ ID NO: 45737 - DNA, 7 bp, Unknown
  misc_feature (1)..( 7): Matrix.001 file - promoters60/1030933
tgttaag

SEQ ID NO: 45738 - DNA, 7 bp, Unknown
  misc_feature (1)..( 7): Matrix.001 file - promoters60/1030933
ttttaga

SEQ ID NO: 45739 - DNA, 9 bp, Unknown
  misc_feature (1)..( 9): Matrix.001 file - promoters60/1030933
tataaccat

SEQ ID NO: 45740 - DNA, 9 bp, Unknown
  misc_feature (1)..( 9): Matrix.001 file - promoters60/1030933
tgaaaaaaa

SEQ ID NO: 45741 - DNA, 6 bp, Unknown
  misc_feature (1)..( 6): Matrix.001 file - promoters60/1030933
aagata

SEQ ID NO: 45742 - DNA, 7 bp, Unknown
  misc_feature (1)..( 7): Matrix.001 file - promoters60/1030933
taaaaat

SEQ ID NO: 45743 - DNA, 8 bp, Unknown
  misc_feature (1)..( 8): Matrix.001 file - promoters60/1030933
ttaaacca

SEQ ID NO: 45744 - DNA, 6 bp, Unknown
  misc_feature (1)..( 6): Matrix.001 file - promoters60/1030933
acaaaa

SEQ ID NO: 45745 - DNA, 6 bp, Unknown
  misc_feature (1)..( 6): Matrix.001 file - promoters60/1030933
tttata

SEQ ID NO: 45746 - DNA, 7 bp, Unknown
  misc_feature (1)..( 7): Matrix.001 file - promoters60/1030933
tttcttt

SEQ ID NO: 45747 - DNA, 6 bp, Unknown
  misc_feature (1)..( 6): Matrix.001 file - promoters60/1030933
tttttc

SEQ ID NO: 45748 - DNA, 6 bp, Unknown
  misc_feature (1)..( 6): Matrix.001 file - promoters60/1030933
agatat

SEQ ID NO: 45749 - DNA, 11 bp, Unknown
  misc_feature (1)..( 11): Matrix.001 file - promoters60/1030933
agccaatgttt

SEQ ID NO: 45750 - DNA, 6 bp, Unknown
  misc_feature (1)..( 6): Matrix.001 file - promoters60/1030933
gatatc

SEQ ID NO: 45751 - DNA, 7 bp, Unknown
  misc_feature (1)..( 7): Matrix.001 file - promoters60/1030933
aatcaaa

SEQ ID NO: 45752 - DNA, 6 bp, Unknown
  misc_feature (1)..( 6): Matrix.001 file - promoters60/1030933
gaaaat

SEQ ID NO: 45753 - DNA, 8 bp, Unknown
  misc_feature (1)..( 8): Matrix.001 file - promoters60/1030933
aaattgaa

SEQ ID NO: 45754 - DNA, 6 bp, Unknown
  misc_feature (1)..( 6): Matrix.001 file - promoters60/1030933
attttt

SEQ ID NO: 45755 - DNA, 7 bp, Unknown
  misc_feature (1)..( 7): Matrix.001 file - promoters60/1030933
tagatga

SEQ ID NO: 45756 - DNA, 7 bp, Unknown
  misc_feature (1)..( 7): Matrix.001 file - promoters60/1030933
gagataa

SEQ ID NO: 45757 - DNA, 7 bp, Unknown
  misc_feature (1)..( 7): Matrix.001 file - promoters60/1030933
caacaag

SEQ ID NO: 45758 - DNA, 6 bp, Unknown
  misc_feature (1)..( 6): Matrix.001 file - promoters60/1030933
aaatct

SEQ ID NO: 45759 - DNA, 6 bp, Unknown
  misc_feature (1)..( 6): Matrix.001 file - promoters60/1030933
aattgt

SEQ ID NO: 45760 - DNA, 7 bp, Unknown
  misc_feature (1)..( 7): Matrix.001 file - promoters60/1030933
aataaat

SEQ ID NO: 45761 - DNA, 6 bp, Unknown
  misc_feature (1)..( 6): Matrix.001 file - promoters60/1030933
gaaaac

SEQ ID NO: 45762 - DNA, 6 bp, Unknown
  misc_feature (1)..( 6): Matrix.001 file - promoters60/1030933
ccaatc

SEQ ID NO: 45763 - DNA, 6 bp, Unknown
  misc_feature (1)..( 6): Matrix.001 file - promoters60/1030933
agaaat

SEQ ID NO: 45764 - DNA, 13 bp, Unknown
  misc_feature (1)..( 13): Matrix.001 file - promoters60/1030940
actaaacaaagta

SEQ ID NO: 45765 - DNA, 6 bp, Unknown
  misc_feature (1)..( 6): Matrix.001 file - promoters60/1030940
catgaa

SEQ ID NO: 45766 - DNA, 6 bp, Unknown
  misc_feature (1)..( 6): Matrix.001 file - promoters60/1031035
tttgat

SEQ ID NO: 45767 - DNA, 10 bp, Unknown
  misc_feature (1)..( 10): Matrix.001 file - promoters60/1031035
acaaacaaaa

SEQ ID NO: 45768 - DNA, 11 bp, Unknown
  misc_feature (1)..( 11): Matrix.001 file - promoters60/1031035
acagacaaaac

SEQ ID NO: 45769 - DNA, 7 bp, Unknown
  misc_feature (1)..( 7): Matrix.001 file - promoters60/1031035
acaaaaa

SEQ ID NO: 45770 - DNA, 8 bp, Unknown
  misc_feature (1)..( 8): Matrix.001 file - promoters60/1031048
tggtatta

SEQ ID NO: 45771 - DNA, 7 bp, Unknown
  misc_feature (1)..( 7): Matrix.001 file - promoters60/1031048
aacctca

SEQ ID NO: 45772 - DNA, 8 bp, Unknown
  misc_feature (1)..( 8): Matrix.001 file - promoters60/1031048
acgctgcc

SEQ ID NO: 45773 - DNA, 7 bp, Unknown
  misc_feature (1)..( 7): Matrix.001 file - promoters60/1031048
tggagtt

SEQ ID NO: 45774 - DNA, 7 bp, Unknown
  misc_feature (1)..( 7): Matrix.001 file - promoters60/1031048
ttaatgg

SEQ ID NO: 45775 - DNA, 8 bp, Unknown
  misc_feature (1)..( 8): Matrix.001 file - promoters60/1031048
ttcaacta

SEQ ID NO: 45776 - DNA, 6 bp, Unknown
  misc_feature (1)..( 6): Matrix.001 file - promoters60/1031048
tacaaa

SEQ ID NO: 45777 - DNA, 6 bp, Unknown
  misc_feature (1)..( 6): Matrix.001 file - promoters60/1031048
gttttt

SEQ ID NO: 45778 - DNA, 9 bp, Unknown
  misc_feature (1)..( 9): Matrix.001 file - promoters60/1031084
tagagaatg

SEQ ID NO: 45779 - DNA, 8 bp, Unknown
  misc_feature (1)..( 8): Matrix.001 file - promoters60/1031084
taataagt

SEQ ID NO: 45780 - DNA, 7 bp, Unknown
  misc_feature (1)..( 7): Matrix.001 file - promoters60/1031084
attaaaa

SEQ ID NO: 45781 - DNA, 12 bp, Unknown
  misc_feature (1)..( 12): Matrix.001 file - promoters60/1031084
aaaatagaaaaa

SEQ ID NO: 45782 - DNA, 10 bp, Unknown
  misc_feature (1)..( 10): Matrix.001 file - promoters60/1031084
aaaaaagaaa

SEQ ID NO: 45783 - DNA, 7 bp, Unknown
  misc_feature (1)..( 7): Matrix.001 file - promoters60/1031084
taaacca

SEQ ID NO: 45784 - DNA, 7 bp, Unknown
  misc_feature (1)..( 7): Matrix.001 file - promoters60/1031084
atcaaaa

SEQ ID NO: 45785 - DNA, 8 bp, Unknown
  misc_feature (1)..( 8): Matrix.001 file - promoters60/1031084
cacaagca

SEQ ID NO: 45786 - DNA, 9 bp, Unknown
  misc_feature (1)..( 9): Matrix.001 file - promoters60/1031103
gtgttattt

SEQ ID NO: 45787 - DNA, 6 bp, Unknown
  misc_feature (1)..( 6): Matrix.001 file - promoters60/1031103
aattat

SEQ ID NO: 45788 - DNA, 7 bp, Unknown
  misc_feature (1)..( 7): Matrix.001 file - promoters60/1031103
aaagtgg

SEQ ID NO: 45789 - DNA, 6 bp, Unknown
  misc_feature (1)..( 6): Matrix.001 file - promoters60/1031103
ttttga

SEQ ID NO: 45790 - DNA, 8 bp, Unknown
  misc_feature (1)..( 8): Matrix.001 file - promoters60/1031103
aatacaaa

SEQ ID NO: 45791 - DNA, 7 bp, Unknown
  misc_feature (1)..( 7): Matrix.001 file - promoters60/1031103
aaaaccc

SEQ ID NO: 45792 - DNA, 8 bp, Unknown
  misc_feature (1)..( 8): Matrix.001 file - promoters60/1031103
agattgat

SEQ ID NO: 45793 - DNA, 7 bp, Unknown
  misc_feature (1)..( 7): Matrix.001 file - promoters60/1031103
ttatgga

SEQ ID NO: 45794 - DNA, 6 bp, Unknown
  misc_feature (1)..( 6): Matrix.001 file - promoters60/1031103
tatttt

SEQ ID NO: 45795 - DNA, 6 bp, Unknown
  misc_feature (1)..( 6): Matrix.001 file - promoters60/1031103
ttttct

SEQ ID NO: 45796 - DNA, 6 bp, Unknown
  misc_feature (1)..( 6): Matrix.001 file - promoters60/1031103
tttaga

SEQ ID NO: 45797 - DNA, 7 bp, Unknown
  misc_feature (1)..( 7): Matrix.001 file - promoters60/1031103
agaaaat

SEQ ID NO: 45798 - DNA, 6 bp, Unknown
  misc_feature (1)..( 6): Matrix.001 file - promoters60/1031103
atgtag

SEQ ID NO: 45799 - DNA, 7 bp, Unknown
  misc_feature (1)..( 7): Matrix.001 file - promoters60/1031103
gcactaa

SEQ ID NO: 45800 - DNA, 7 bp, Unknown
  misc_feature (1)..( 7): Matrix.001 file - promoters60/1031103
taaattt

SEQ ID NO: 45801 - DNA, 6 bp, Unknown
  misc_feature (1)..( 6): Matrix.001 file - promoters60/1031103
tttcta

SEQ ID NO: 45802 - DNA, 7 bp, Unknown
  misc_feature (1)..( 7): Matrix.001 file - promoters60/1031103
tatattc

SEQ ID NO: 45803 - DNA, 7 bp, Unknown
  misc_feature (1)..( 7): Matrix.001 file - promoters60/1031103
ttacatt

SEQ ID NO: 45804 - DNA, 6 bp, Unknown
  misc_feature (1)..( 6): Matrix.001 file - promoters60/1031208
tataat

SEQ ID NO: 45805 - DNA, 11 bp, Unknown
  misc_feature (1)..( 11): Matrix.001 file - promoters60/1031208
aaaaagaaaaa

SEQ ID NO: 45806 - DNA, 8 bp, Unknown
  misc_feature (1)..( 8): Matrix.001 file - promoters60/1031208
aatttttt

SEQ ID NO: 45807 - DNA, 10 bp, Unknown
  misc_feature (1)..( 10): Matrix.001 file - promoters60/1031208
tcaattaaaa

SEQ ID NO: 45808 - DNA, 6 bp, Unknown
  misc_feature (1)..( 6): Matrix.001 file - promoters60/1031208
aaaaaa

SEQ ID NO: 45809 - DNA, 9 bp, Unknown
  misc_feature (1)..( 9): Matrix.001 file - promoters60/1031208
cttaatttg

SEQ ID NO: 45810 - DNA, 8 bp, Unknown
  misc_feature (1)..( 8): Matrix.001 file - promoters60/1031208
attatctt

SEQ ID NO: 45811 - DNA, 14 bp, Unknown
  misc_feature (1)..( 14): Matrix.001 file - promoters60/1031208
aatatggtctaaaa

SEQ ID NO: 45812 - DNA, 7 bp, Unknown
  misc_feature (1)..( 7): Matrix.001 file - promoters60/1031208
ttttgtt

SEQ ID NO: 45813 - DNA, 7 bp, Unknown
  misc_feature (1)..( 7): Matrix.001 file - promoters60/1031208
ttatttg

SEQ ID NO: 45814 - DNA, 10 bp, Unknown
  misc_feature (1)..( 10): Matrix.001 file - promoters60/1031208
ttattctcta

SEQ ID NO: 45815 - DNA, 7 bp, Unknown
  misc_feature (1)..( 7): Matrix.001 file - promoters60/1031208
ataatta

SEQ ID NO: 45816 - DNA, 7 bp, Unknown
  misc_feature (1)..( 7): Matrix.001 file - promoters60/1031208
attaatc

SEQ ID NO: 45817 - DNA, 10 bp, Unknown
  misc_feature (1)..( 10): Matrix.001 file - promoters60/1031208
ttttattatt

SEQ ID NO: 45818 - DNA, 6 bp, Unknown
  misc_feature (1)..( 6): Matrix.001 file - promoters60/1031208
gtatgt

SEQ ID NO: 45819 - DNA, 8 bp, Unknown
  misc_feature (1)..( 8): Matrix.001 file - promoters60/1031208
tcaacaac

SEQ ID NO: 45820 - DNA, 6 bp, Unknown
  misc_feature (1)..( 6): Matrix.001 file - promoters60/1031208
tcggcc

SEQ ID NO: 45821 - DNA, 10 bp, Unknown
  misc_feature (1)..( 10): Matrix.001 file - promoters60/1031229
agttttactc

SEQ ID NO: 45822 - DNA, 12 bp, Unknown
  misc_feature (1)..( 12): Matrix.001 file - promoters60/1031229
ttttcttgttgt

SEQ ID NO: 45823 - DNA, 11 bp, Unknown
  misc_feature (1)..( 11): Matrix.001 file - promoters60/1031229
ttactttttta

SEQ ID NO: 45824 - DNA, 10 bp, Unknown
  misc_feature (1)..( 10): Matrix.001 file - promoters60/1031267
atgacttgga

SEQ ID NO: 45825 - DNA, 15 bp, Unknown
  misc_feature (1)..( 15): Matrix.001 file - promoters60/1031291
actctcaaaaaatga

SEQ ID NO: 45826 - DNA, 7 bp, Unknown
  misc_feature (1)..( 7): Matrix.001 file - promoters60/1031299
taaacat

SEQ ID NO: 45827 - DNA, 16 bp, Unknown
  misc_feature (1)..( 16): Matrix.001 file - promoters60/1031299
ttaatttaactgataa

SEQ ID NO: 45828 - DNA, 8 bp, Unknown
  misc_feature (1)..( 8): Matrix.001 file - promoters60/1031299
agatttta

SEQ ID NO: 45829 - DNA, 8 bp, Unknown
  misc_feature (1)..( 8): Matrix.001 file - promoters60/1031299
aaatatat

SEQ ID NO: 45830 - DNA, 10 bp, Unknown
  misc_feature (1)..( 10): Matrix.001 file - promoters60/1031299
acaattttta

SEQ ID NO: 45831 - DNA, 8 bp, Unknown
  misc_feature (1)..( 8): Matrix.001 file - promoters60/1031299
tttaaaat

SEQ ID NO: 45832 - DNA, 7 bp, Unknown
  misc_feature (1)..( 7): Matrix.001 file - promoters60/1031299
aatgtta

SEQ ID NO: 45833 - DNA, 14 bp, Unknown
  misc_feature (1)..( 14): Matrix.001 file - promoters60/1031299
taatttaaaataaa

SEQ ID NO: 45834 - DNA, 8 bp, Unknown
  misc_feature (1)..( 8): Matrix.001 file - promoters60/1031299
tataaata

SEQ ID NO: 45835 - DNA, 8 bp, Unknown
  misc_feature (1)..( 8): Matrix.001 file - promoters60/1031336
tgttgact

SEQ ID NO: 45836 - DNA, 6 bp, Unknown
  misc_feature (1)..( 6): Matrix.001 file - promoters60/1031336
ctttgt

SEQ ID NO: 45837 - DNA, 6 bp, Unknown
  misc_feature (1)..( 6): Matrix.001 file - promoters60/1031336
gtagct

SEQ ID NO: 45838 - DNA, 7 bp, Unknown
  misc_feature (1)..( 7): Matrix.001 file - promoters60/1031336
ttcttct

SEQ ID NO: 45839 - DNA, 8 bp, Unknown
  misc_feature (1)..( 8): Matrix.001 file - promoters60/1031336
ccagattt

SEQ ID NO: 45840 - DNA, 7 bp, Unknown
  misc_feature (1)..( 7): Matrix.001 file - promoters60/1031336
tttaact

SEQ ID NO: 45841 - DNA, 9 bp, Unknown
  misc_feature (1)..( 9): Matrix.001 file - promoters60/1031336
aaaacaaaa

SEQ ID NO: 45842 - DNA, 6 bp, Unknown
  misc_feature (1)..( 6): Matrix.001 file - promoters60/1031336
aaatat

SEQ ID NO: 45843 - DNA, 6 bp, Unknown
  misc_feature (1)..( 6): Matrix.001 file - promoters60/1031336
caaaaa

SEQ ID NO: 45844 - DNA, 7 bp, Unknown
  misc_feature (1)..( 7): Matrix.001 file - promoters60/1031336
actgaat

SEQ ID NO: 45845 - DNA, 9 bp, Unknown
  misc_feature (1)..( 9): Matrix.001 file - promoters60/1031336
ctcaaattt

SEQ ID NO: 45846 - DNA, 6 bp, Unknown
  misc_feature (1)..( 6): Matrix.001 file - promoters60/1031336
aaacaa

SEQ ID NO: 45847 - DNA, 10 bp, Unknown
  misc_feature (1)..( 10): Matrix.001 file - promoters60/1031336
attaaaggaa

SEQ ID NO: 45848 - DNA, 9 bp, Unknown
  misc_feature (1)..( 9): Matrix.001 file - promoters60/1031336
aaaacaaaa

SEQ ID NO: 45849 - DNA, 7 bp, Unknown
  misc_feature (1)..( 7): Matrix.001 file - promoters60/1031336
aaaaacg

SEQ ID NO: 45850 - DNA, 7 bp, Unknown
  misc_feature (1)..( 7): Matrix.001 file - promoters60/1031336
tgtaatt

SEQ ID NO: 45851 - DNA, 8 bp, Unknown
  misc_feature (1)..( 8): Matrix.001 file - promoters60/1031336
attattat

SEQ ID NO: 45852 - DNA, 10 bp, Unknown
  misc_feature (1)..( 10): Matrix.001 file - promoters60/1031336
ttgtaatgat

SEQ ID NO: 45853 - DNA, 6 bp, Unknown
  misc_feature (1)..( 6): Matrix.001 file - promoters60/1031336
tagaat

SEQ ID NO: 45854 - DNA, 9 bp, Unknown
  misc_feature (1)..( 9): Matrix.001 file - promoters60/1031336
taaagtttt

SEQ ID NO: 45855 - DNA, 8 bp, Unknown
  misc_feature (1)..( 8): Matrix.001 file - promoters60/1031336
ttttagtt

SEQ ID NO: 45856 - DNA, 10 bp, Unknown
  misc_feature (1)..( 10): Matrix.001 file - promoters60/1031368
ttcgtagaca

SEQ ID NO: 45857 - DNA, 7 bp, Unknown
  misc_feature (1)..( 7): Matrix.001 file - promoters60/1031368
tgactat

SEQ ID NO: 45858 - DNA, 6 bp, Unknown
  misc_feature (1)..( 6): Matrix.001 file - promoters60/1031368
gtcaat

SEQ ID NO: 45859 - DNA, 9 bp, Unknown
  misc_feature (1)..( 9): Matrix.001 file - promoters60/1031368
tttattgtt

SEQ ID NO: 45860 - DNA, 6 bp, Unknown
  misc_feature (1)..( 6): Matrix.001 file - promoters60/1031368
attgta

SEQ ID NO: 45861 - DNA, 8 bp, Unknown
  misc_feature (1)..( 8): Matrix.001 file - promoters60/1031368
caaataat

SEQ ID NO: 45862 - DNA, 6 bp, Unknown
  misc_feature (1)..( 6): Matrix.001 file - promoters60/1031368
tacaaa

SEQ ID NO: 45863 - DNA, 9 bp, Unknown
  misc_feature (1)..( 9): Matrix.001 file - promoters60/1031368
cataaattt

SEQ ID NO: 45864 - DNA, 6 bp, Unknown
  misc_feature (1)..( 6): Matrix.001 file - promoters60/1031368
ttatat

SEQ ID NO: 45865 - DNA, 6 bp, Unknown
  misc_feature (1)..( 6): Matrix.001 file - promoters60/1031368
ggtttg

SEQ ID NO: 45866 - DNA, 6 bp, Unknown
  misc_feature (1)..( 6): Matrix.001 file - promoters60/1031368
ggttga

SEQ ID NO: 45867 - DNA, 6 bp, Unknown
  misc_feature (1)..( 6): Matrix.001 file - promoters60/1031368
ttattg

SEQ ID NO: 45868 - DNA, 7 bp, Unknown
  misc_feature (1)..( 7): Matrix.001 file - promoters60/1031368
ttgtatg

SEQ ID NO: 45869 - DNA, 6 bp, Unknown
  misc_feature (1)..( 6): Matrix.001 file - promoters60/1031368
cgtgtc

SEQ ID NO: 45870 - DNA, 7 bp, Unknown
  misc_feature (1)..( 7): Matrix.001 file - promoters60/1031368
aatatat

SEQ ID NO: 45871 - DNA, 8 bp, Unknown
  misc_feature (1)..( 8): Matrix.001 file - promoters60/1031386
attaataa

SEQ ID NO: 45872 - DNA, 6 bp, Unknown
  misc_feature (1)..( 6): Matrix.001 file - promoters60/1031386
tcaaat

SEQ ID NO: 45873 - DNA, 8 bp, Unknown
  misc_feature (1)..( 8): Matrix.001 file - promoters60/1031386
tgaataaa

SEQ ID NO: 45874 - DNA, 8 bp, Unknown
  misc_feature (1)..( 8): Matrix.001 file - promoters60/1031386
atttaaat

SEQ ID NO: 45875 - DNA, 8 bp, Unknown
  misc_feature (1)..( 8): Matrix.001 file - promoters60/1031386
ttatgagt

SEQ ID NO: 45876 - DNA, 6 bp, Unknown
  misc_feature (1)..( 6): Matrix.001 file - promoters60/1031386
atatat

SEQ ID NO: 45877 - DNA, 7 bp, Unknown
  misc_feature (1)..( 7): Matrix.001 file - promoters60/1031386
aaccaaa

SEQ ID NO: 45878 - DNA, 6 bp, Unknown
  misc_feature (1)..( 6): Matrix.001 file - promoters60/1031386
gtcatg

SEQ ID NO: 45879 - DNA, 6 bp, Unknown
  misc_feature (1)..( 6): Matrix.001 file - promoters60/1031386
ttttag

SEQ ID NO: 45880 - DNA, 8 bp, Unknown
  misc_feature (1)..( 8): Matrix.001 file - promoters60/1031386
aatccaat

SEQ ID NO: 45881 - DNA, 6 bp, Unknown
  misc_feature (1)..( 6): Matrix.001 file - promoters60/1031386
ttacat

SEQ ID NO: 45882 - DNA, 8 bp, Unknown
  misc_feature (1)..( 8): Matrix.001 file - promoters60/1031386
aaatatcc

SEQ ID NO: 45883 - DNA, 7 bp, Unknown
  misc_feature (1)..( 7): Matrix.001 file - promoters60/1031386
cgaaatc

SEQ ID NO: 45884 - DNA, 8 bp, Unknown
  misc_feature (1)..( 8): Matrix.001 file - promoters60/1031386
agaaaaca

SEQ ID NO: 45885 - DNA, 6 bp, Unknown
  misc_feature (1)..( 6): Matrix.001 file - promoters60/1031386
aagaaa

SEQ ID NO: 45886 - DNA, 10 bp, Unknown
  misc_feature (1)..( 10): Matrix.001 file - promoters60/1031386
ataaatttag

SEQ ID NO: 45887 - DNA, 6 bp, Unknown
  misc_feature (1)..( 6): Matrix.001 file - promoters60/1031386
tttcat

SEQ ID NO: 45888 - DNA, 7 bp, Unknown
  misc_feature (1)..( 7): Matrix.001 file - promoters60/1031386
tgagttt

SEQ ID NO: 45889 - DNA, 6 bp, Unknown
  misc_feature (1)..( 6): Matrix.001 file - promoters60/1031386
gaaaaa

SEQ ID NO: 45890 - DNA, 8 bp, Unknown
  misc_feature (1)..( 8): Matrix.001 file - promoters60/1031386
taaacgat

SEQ ID NO: 45891 - DNA, 7 bp, Unknown
  misc_feature (1)..( 7): Matrix.001 file - promoters60/1031386
tatacta

SEQ ID NO: 45892 - DNA, 6 bp, Unknown
  misc_feature (1)..( 6): Matrix.001 file - promoters60/1031386
taaaat

SEQ ID NO: 45893 - DNA, 7 bp, Unknown
  misc_feature (1)..( 7): Matrix.001 file - promoters60/1031386
ataggaa

SEQ ID NO: 45894 - DNA, 7 bp, Unknown
  misc_feature (1)..( 7): Matrix.001 file - promoters60/1031386
cgaacaa

SEQ ID NO: 45895 - DNA, 9 bp, Unknown
  misc_feature (1)..( 9): Matrix.001 file - promoters60/1031386
atgtaaaat

SEQ ID NO: 45896 - DNA, 9 bp, Unknown
  misc_feature (1)..( 9): Matrix.001 file - promoters60/1031386
gttcacttt

SEQ ID NO: 45897 - DNA, 8 bp, Unknown
  misc_feature (1)..( 8): Matrix.001 file - promoters60/1031386
gtttgttt

SEQ ID NO: 45898 - DNA, 13 bp, Unknown
  misc_feature (1)..( 13): Matrix.001 file - promoters60/1031390
actattttcaaaa

SEQ ID NO: 45899 - DNA, 8 bp, Unknown
  misc_feature (1)..( 8): Matrix.001 file - promoters60/1031390
taaaaagg

SEQ ID NO: 45900 - DNA, 6 bp, Unknown
  misc_feature (1)..( 6): Matrix.001 file - promoters60/1031390
tgatat

SEQ ID NO: 45901 - DNA, 10 bp, Unknown
  misc_feature (1)..( 10): Matrix.001 file - promoters60/1031390
attattataa

SEQ ID NO: 45902 - DNA, 7 bp, Unknown
  misc_feature (1)..( 7): Matrix.001 file - promoters60/1031425
tcaaacc

SEQ ID NO: 45903 - DNA, 8 bp, Unknown
  misc_feature (1)..( 8): Matrix.001 file - promoters60/1031425
caatattt

SEQ ID NO: 45904 - DNA, 15 bp, Unknown
  misc_feature (1)..( 15): Matrix.001 file - promoters60/1031563
acaatagtcttaaac

SEQ ID NO: 45905 - DNA, 7 bp, Unknown
  misc_feature (1)..( 7): Matrix.001 file - promoters60/1031563
gtgtagt

SEQ ID NO: 45906 - DNA, 7 bp, Unknown
  misc_feature (1)..( 7): Matrix.001 file - promoters60/1031563
acaaaat

SEQ ID NO: 45907 - DNA, 7 bp, Unknown
  misc_feature (1)..( 7): Matrix.001 file - promoters60/1031563
cacacaa

SEQ ID NO: 45908 - DNA, 6 bp, Unknown
  misc_feature (1)..( 6): Matrix.001 file - promoters60/1031563
gaaact

SEQ ID NO: 45909 - DNA, 7 bp, Unknown
  misc_feature (1)..( 7): Matrix.001 file - promoters60/1031563
gaaacgt

SEQ ID NO: 45910 - DNA, 8 bp, Unknown
  misc_feature (1)..( 8): Matrix.001 file - promoters60/1031563
ctaaagag

SEQ ID NO: 45911 - DNA, 7 bp, Unknown
  misc_feature (1)..( 7): Matrix.001 file - promoters60/1031563
caaaagt

SEQ ID NO: 45912 - DNA, 8 bp, Unknown
  misc_feature (1)..( 8): Matrix.001 file - promoters60/1031563
agcgattt

SEQ ID NO: 45913 - DNA, 7 bp, Unknown
  misc_feature (1)..( 7): Matrix.001 file - promoters60/1031563
tacaaac

SEQ ID NO: 45914 - DNA, 8 bp, Unknown
  misc_feature (1)..( 8): Matrix.001 file - promoters60/1031563
ttataaca

SEQ ID NO: 45915 - DNA, 6 bp, Unknown
  misc_feature (1)..( 6): Matrix.001 file - promoters60/1031563
agattc

SEQ ID NO: 45916 - DNA, 7 bp, Unknown
  misc_feature (1)..( 7): Matrix.001 file - promoters60/1031563
tttagta

SEQ ID NO: 45917 - DNA, 7 bp, Unknown
  misc_feature (1)..( 7): Matrix.001 file - promoters60/1031563
attacct

SEQ ID NO: 45918 - DNA, 7 bp, Unknown
  misc_feature (1)..( 7): Matrix.001 file - promoters60/1031563
cctattc

SEQ ID NO: 45919 - DNA, 7 bp, Unknown
  misc_feature (1)..( 7): Matrix.001 file - promoters60/1031563
ttgtgtt

SEQ ID NO: 45920 - DNA, 8 bp, Unknown
  misc_feature (1)..( 8): Matrix.001 file - promoters60/1031563
tgttaata

SEQ ID NO: 45921 - DNA, 7 bp, Unknown
  misc_feature (1)..( 7): Matrix.001 file - promoters60/1031563
aaaaaat

SEQ ID NO: 45922 - DNA, 7 bp, Unknown
  misc_feature (1)..( 7): Matrix.001 file - promoters60/1031563
aaatact

SEQ ID NO: 45923 - DNA, 9 bp, Unknown
  misc_feature (1)..( 9): Matrix.001 file - promoters60/1031563
tttaataga

SEQ ID NO: 45924 - DNA, 6 bp, Unknown
  misc_feature (1)..( 6): Matrix.001 file - promoters60/1031563
aaaagc

SEQ ID NO: 45925 - DNA, 6 bp, Unknown
  misc_feature (1)..( 6): Matrix.001 file - promoters60/1031563
aatttc

SEQ ID NO: 45926 - DNA, 6 bp, Unknown
  misc_feature (1)..( 6): Matrix.001 file - promoters60/1031563
ttgaaa

SEQ ID NO: 45927 - DNA, 6 bp, Unknown
  misc_feature (1)..( 6): Matrix.001 file - promoters60/1031563
aaaaaa

SEQ ID NO: 45928 - DNA, 7 bp, Unknown
  misc_feature (1)..( 7): Matrix.001 file - promoters60/1031638
tccaaaa

SEQ ID NO: 45929 - DNA, 9 bp, Unknown
  misc_feature (1)..( 9): Matrix.001 file - promoters60/1031638
aaaaacaaa

SEQ ID NO: 45930 - DNA, 7 bp, Unknown
  misc_feature (1)..( 7): Matrix.001 file - promoters60/1031638
cccacga

SEQ ID NO: 45931 - DNA, 8 bp, Unknown
  misc_feature (1)..( 8): Matrix.001 file - promoters60/1031638
aaattata

SEQ ID NO: 45932 - DNA, 8 bp, Unknown
  misc_feature (1)..( 8): Matrix.001 file - promoters60/1031638
aaaaataa

SEQ ID NO: 45933 - DNA, 10 bp, Unknown
  misc_feature (1)..( 10): Matrix.001 file - promoters60/1031638
aaatatttaa

SEQ ID NO: 45934 - DNA, 9 bp, Unknown
  misc_feature (1)..( 9): Matrix.001 file - promoters60/1031638
ttaaacata

SEQ ID NO: 45935 - DNA, 9 bp, Unknown
  misc_feature (1)..( 9): Matrix.001 file - promoters60/1031638
attttgtaa

SEQ ID NO: 45936 - DNA, 7 bp, Unknown
  misc_feature (1)..( 7): Matrix.001 file - promoters60/1031638
aaaatta

SEQ ID NO: 45937 - DNA, 7 bp, Unknown
  misc_feature (1)..( 7): Matrix.001 file - promoters60/1031638
gtaaaat

SEQ ID NO: 45938 - DNA, 9 bp, Unknown
  misc_feature (1)..( 9): Matrix.001 file - promoters60/1031638
ataatattt

SEQ ID NO: 45939 - DNA, 6 bp, Unknown
  misc_feature (1)..( 6): Matrix.001 file - promoters60/1031638
ttcaaa

SEQ ID NO: 45940 - DNA, 9 bp, Unknown
  misc_feature (1)..( 9): Matrix.001 file - promoters60/1031638
tttttttta

SEQ ID NO: 45941 - DNA, 10 bp, Unknown
  misc_feature (1)..( 10): Matrix.001 file - promoters60/1031638
attaatgttc

SEQ ID NO: 45942 - DNA, 9 bp, Unknown
  misc_feature (1)..( 9): Matrix.001 file - promoters60/1031638
ttaaaaata

SEQ ID NO: 45943 - DNA, 9 bp, Unknown
  misc_feature (1)..( 9): Matrix.001 file - promoters60/1031638
ttaaaaata

SEQ ID NO: 45944 - DNA, 7 bp, Unknown
  misc_feature (1)..( 7): Matrix.001 file - promoters60/1031665
ttagtca

SEQ ID NO: 45945 - DNA, 7 bp, Unknown
  misc_feature (1)..( 7): Matrix.001 file - promoters60/1031665
atagatt

SEQ ID NO: 45946 - DNA, 9 bp, Unknown
  misc_feature (1)..( 9): Matrix.001 file - promoters60/1031665
gtataaatt

SEQ ID NO: 45947 - DNA, 7 bp, Unknown
  misc_feature (1)..( 7): Matrix.001 file - promoters60/1031665
ttttgtt

SEQ ID NO: 45948 - DNA, 6 bp, Unknown
  misc_feature (1)..( 6): Matrix.001 file - promoters60/1031665
ttgttt

SEQ ID NO: 45949 - DNA, 9 bp, Unknown
  misc_feature (1)..( 9): Matrix.001 file - promoters60/1031665
aaatcaaat

SEQ ID NO: 45950 - DNA, 12 bp, Unknown
  misc_feature (1)..( 12): Matrix.001 file - promoters60/1031665
aaaaaaataaaa

SEQ ID NO: 45951 - DNA, 7 bp, Unknown
  misc_feature (1)..( 7): Matrix.001 file - promoters60/1031665
tttattt

SEQ ID NO: 45952 - DNA, 8 bp, Unknown
  misc_feature (1)..( 8): Matrix.001 file - promoters60/1031665
gtccaaac

SEQ ID NO: 45953 - DNA, 8 bp, Unknown
  misc_feature (1)..( 8): Matrix.001 file - promoters60/1031665
ttgaactc

SEQ ID NO: 45954 - DNA, 7 bp, Unknown
  misc_feature (1)..( 7): Matrix.001 file - promoters60/1031665
ttttaat

SEQ ID NO: 45955 - DNA, 7 bp, Unknown
  misc_feature (1)..( 7): Matrix.001 file - promoters60/1031665
aaaccaa

SEQ ID NO: 45956 - DNA, 6 bp, Unknown
  misc_feature (1)..( 6): Matrix.001 file - promoters60/1031665
aaccaa

SEQ ID NO: 45957 - DNA, 6 bp, Unknown
  misc_feature (1)..( 6): Matrix.001 file - promoters60/1031665
aagaaa

SEQ ID NO: 45958 - DNA, 7 bp, Unknown
  misc_feature (1)..( 7): Matrix.001 file - promoters60/1031665
aataatt

SEQ ID NO: 45959 - DNA, 9 bp, Unknown
  misc_feature (1)..( 9): Matrix.001 file - promoters60/1031665
caaaaagag

SEQ ID NO: 45960 - DNA, 6 bp, Unknown
  misc_feature (1)..( 6): Matrix.001 file - promoters60/1031665
aaattg

SEQ ID NO: 45961 - DNA, 9 bp, Unknown
  misc_feature (1)..( 9): Matrix.001 file - promoters60/1031665
tgaaacaaa

SEQ ID NO: 45962 - DNA, 7 bp, Unknown
  misc_feature (1)..( 7): Matrix.001 file - promoters60/1031665
tattgtg

SEQ ID NO: 45963 - DNA, 10 bp, Unknown
  misc_feature (1)..( 10): Matrix.001 file - promoters60/1031706
tcaaccaaat

SEQ ID NO: 45964 - DNA, 8 bp, Unknown
  misc_feature (1)..( 8): Matrix.001 file - promoters60/1031706
aaaacaaa

SEQ ID NO: 45965 - DNA, 9 bp, Unknown
  misc_feature (1)..( 9): Matrix.001 file - promoters60/1031706
taacaaaca

SEQ ID NO: 45966 - DNA, 9 bp, Unknown
  misc_feature (1)..( 9): Matrix.001 file - promoters60/1031706
gataaaaat

SEQ ID NO: 45967 - DNA, 13 bp, Unknown
  misc_feature (1)..( 13): Matrix.001 file - promoters60/1031706
tcctttatatata

SEQ ID NO: 45968 - DNA, 11 bp, Unknown
  misc_feature (1)..( 11): Matrix.001 file - promoters60/1031706
aaataatttta

SEQ ID NO: 45969 - DNA, 6 bp, Unknown
  misc_feature (1)..( 6): Matrix.001 file - promoters60/1031706
aaaaac

SEQ ID NO: 45970 - DNA, 11 bp, Unknown
  misc_feature (1)..( 11): Matrix.001 file - promoters60/1031706
aaattccataa

SEQ ID NO: 45971 - DNA, 7 bp, Unknown
  misc_feature (1)..( 7): Matrix.001 file - promoters60/1032026
attaaaa

SEQ ID NO: 45972 - DNA, 6 bp, Unknown
  misc_feature (1)..( 6): Matrix.001 file - promoters60/1032026
tattta

SEQ ID NO: 45973 - DNA, 7 bp, Unknown
  misc_feature (1)..( 7): Matrix.001 file - promoters60/1032026
gatattc

SEQ ID NO: 45974 - DNA, 6 bp, Unknown
  misc_feature (1)..( 6): Matrix.001 file - promoters60/1032026
aaaaca

SEQ ID NO: 45975 - DNA, 10 bp, Unknown
  misc_feature (1)..( 10): Matrix.001 file - promoters60/1032026
agaaaaaaaa

SEQ ID NO: 45976 - DNA, 6 bp, Unknown
  misc_feature (1)..( 6): Matrix.001 file - promoters60/1032026
ataata

SEQ ID NO: 45977 - DNA, 7 bp, Unknown
  misc_feature (1)..( 7): Matrix.001 file - promoters60/1032026
aaacaca

SEQ ID NO: 45978 - DNA, 7 bp, Unknown
  misc_feature (1)..( 7): Matrix.001 file - promoters60/1032026
actatag

SEQ ID NO: 45979 - DNA, 6 bp, Unknown
  misc_feature (1)..( 6): Matrix.001 file - promoters60/1032026
actata

SEQ ID NO: 45980 - DNA, 7 bp, Unknown
  misc_feature (1)..( 7): Matrix.001 file - promoters60/1032026
acagtta

SEQ ID NO: 45981 - DNA, 6 bp, Unknown
  misc_feature (1)..( 6): Matrix.001 file - promoters60/1032026
ttaatc

SEQ ID NO: 45982 - DNA, 8 bp, Unknown
  misc_feature (1)..( 8): Matrix.001 file - promoters60/1032026
tacaaaaa

SEQ ID NO: 45983 - DNA, 6 bp, Unknown
  misc_feature (1)..( 6): Matrix.001 file - promoters60/1032026
aattat

SEQ ID NO: 45984 - DNA, 7 bp, Unknown
  misc_feature (1)..( 7): Matrix.001 file - promoters60/1032026
taaacac

SEQ ID NO: 45985 - DNA, 6 bp, Unknown
  misc_feature (1)..( 6): Matrix.001 file - promoters60/1032026
caaaac

SEQ ID NO: 45986 - DNA, 8 bp, Unknown
  misc_feature (1)..( 8): Matrix.001 file - promoters60/1032026
tacaattt

SEQ ID NO: 45987 - DNA, 9 bp, Unknown
  misc_feature (1)..( 9): Matrix.001 file - promoters60/1032026
cagcttttt

SEQ ID NO: 45988 - DNA, 6 bp, Unknown
  misc_feature (1)..( 6): Matrix.001 file - promoters60/1032026
acaact

SEQ ID NO: 45989 - DNA, 7 bp, Unknown
  misc_feature (1)..( 7): Matrix.001 file - promoters60/1032026
tttctaa

SEQ ID NO: 45990 - DNA, 6 bp, Unknown
  misc_feature (1)..( 6): Matrix.001 file - promoters60/1032026
ctccaa

SEQ ID NO: 45991 - DNA, 7 bp, Unknown
  misc_feature (1)..( 7): Matrix.001 file - promoters60/1032026
tacaatt

SEQ ID NO: 45992 - DNA, 7 bp, Unknown
  misc_feature (1)..( 7): Matrix.001 file - promoters60/1032026
acataaa

SEQ ID NO: 45993 - DNA, 7 bp, Unknown
  misc_feature (1)..( 7): Matrix.001 file - promoters60/1032026
aaacttt

SEQ ID NO: 45994 - DNA, 6 bp, Unknown
  misc_feature (1)..( 6): Matrix.001 file - promoters60/1032026
taaata

SEQ ID NO: 45995 - DNA, 7 bp, Unknown
  misc_feature (1)..( 7): Matrix.001 file - promoters60/1032047
caatatt

SEQ ID NO: 45996 - DNA, 7 bp, Unknown
  misc_feature (1)..( 7): Matrix.001 file - promoters60/1032047
tttttac

SEQ ID NO: 45997 - DNA, 12 bp, Unknown
  misc_feature (1)..( 12): Matrix.001 file - promoters60/1032047
aaaggaaaaaat

SEQ ID NO: 45998 - DNA, 13 bp, Unknown
  misc_feature (1)..( 13): Matrix.001 file - promoters60/1032047
ctcctataaattg

SEQ ID NO: 45999 - DNA, 15 bp, Unknown
  misc_feature (1)..( 15): Matrix.001 file - promoters60/1032047
acataaaagaaatat

SEQ ID NO: 46000 - DNA, 9 bp, Unknown
  misc_feature (1)..( 9): Matrix.001 file - promoters60/1032047
ataggaata

SEQ ID NO: 46001 - DNA, 13 bp, Unknown
  misc_feature (1)..( 13): Matrix.001 file - promoters60/1032047
ccataaaggaaaa

SEQ ID NO: 46002 - DNA, 8 bp, Unknown
  misc_feature (1)..( 8): Matrix.001 file - promoters60/1032149
ttagtgca

SEQ ID NO: 46003 - DNA, 6 bp, Unknown
  misc_feature (1)..( 6): Matrix.001 file - promoters60/1032149
aaatta

SEQ ID NO: 46004 - DNA, 9 bp, Unknown
  misc_feature (1)..( 9): Matrix.001 file - promoters60/1032149
ataaaaata

SEQ ID NO: 46005 - DNA, 9 bp, Unknown
  misc_feature (1)..( 9): Matrix.001 file - promoters60/1032149
tttgcataa

SEQ ID NO: 46006 - DNA, 12 bp, Unknown
  misc_feature (1)..( 12): Matrix.001 file - promoters60/1032149
agtgattaatca

SEQ ID NO: 46007 - DNA, 11 bp, Unknown
  misc_feature (1)..( 11): Matrix.001 file - promoters60/1032149
agttattaatc

SEQ ID NO: 46008 - DNA, 6 bp, Unknown
  misc_feature (1)..( 6): Matrix.001 file - promoters60/1032149
ttttac

SEQ ID NO: 46009 - DNA, 11 bp, Unknown
  misc_feature (1)..( 11): Matrix.001 file - promoters60/1032149
tttcttacaca

SEQ ID NO: 46010 - DNA, 6 bp, Unknown
  misc_feature (1)..( 6): Matrix.001 file - promoters60/1032149
ctaaca

SEQ ID NO: 46011 - DNA, 7 bp, Unknown
  misc_feature (1)..( 7): Matrix.001 file - promoters60/1032149
caactaa

SEQ ID NO: 46012 - DNA, 7 bp, Unknown
  misc_feature (1)..( 7): Matrix.001 file - promoters60/1032149
tacaatt

SEQ ID NO: 46013 - DNA, 6 bp, Unknown
  misc_feature (1)..( 6): Matrix.001 file - promoters60/1032149
taaaaa

SEQ ID NO: 46014 - DNA, 6 bp, Unknown
  misc_feature (1)..( 6): Matrix.001 file - promoters60/1032149
atttat

SEQ ID NO: 46015 - DNA, 6 bp, Unknown
  misc_feature (1)..( 6): Matrix.001 file - promoters60/1032149
ttcttt

SEQ ID NO: 46016 - DNA, 9 bp, Unknown
  misc_feature (1)..( 9): Matrix.001 file - promoters60/1032149
aataaatta

SEQ ID NO: 46017 - DNA, 8 bp, Unknown
  misc_feature (1)..( 8): Matrix.001 file - promoters60/1032149
gatcggta

SEQ ID NO: 46018 - DNA, 6 bp, Unknown
  misc_feature (1)..( 6): Matrix.001 file - promoters60/1032149
atagtt

SEQ ID NO: 46019 - DNA, 10 bp, Unknown
  misc_feature (1)..( 10): Matrix.001 file - promoters60/1032149
atttttaatc

SEQ ID NO: 46020 - DNA, 8 bp, Unknown
  misc_feature (1)..( 8): Matrix.001 file - promoters60/1032149
catactgt

SEQ ID NO: 46021 - DNA, 9 bp, Unknown
  misc_feature (1)..( 9): Matrix.001 file - promoters60/1032149
tttattaaa

SEQ ID NO: 46022 - DNA, 6 bp, Unknown
  misc_feature (1)..( 6): Matrix.001 file - promoters60/1032149
acaaaa

SEQ ID NO: 46023 - DNA, 7 bp, Unknown
  misc_feature (1)..( 7): Matrix.001 file - promoters60/1032149
aaaagtt

SEQ ID NO: 46024 - DNA, 7 bp, Unknown
  misc_feature (1)..( 7): Matrix.001 file - promoters60/1032149
tttctta

SEQ ID NO: 46025 - DNA, 9 bp, Unknown
  misc_feature (1)..( 9): Matrix.001 file - promoters60/1032160
caaagagac

SEQ ID NO: 46026 - DNA, 12 bp, Unknown
  misc_feature (1)..( 12): Matrix.001 file - promoters60/1032160
aattttacgatt

SEQ ID NO: 46027 - DNA, 8 bp, Unknown
  misc_feature (1)..( 8): Matrix.001 file - promoters60/1032258
tgttgcta

SEQ ID NO: 46028 - DNA, 7 bp, Unknown
  misc_feature (1)..( 7): Matrix.001 file - promoters60/1032258
gcagttt

SEQ ID NO: 46029 - DNA, 6 bp, Unknown
  misc_feature (1)..( 6): Matrix.001 file - promoters60/1032258
atattg

SEQ ID NO: 46030 - DNA, 7 bp, Unknown
  misc_feature (1)..( 7): Matrix.001 file - promoters60/1032258
ccacata

SEQ ID NO: 46031 - DNA, 6 bp, Unknown
  misc_feature (1)..( 6): Matrix.001 file - promoters60/1032258
attgaa

SEQ ID NO: 46032 - DNA, 7 bp, Unknown
  misc_feature (1)..( 7): Matrix.001 file - promoters60/1032258
attataa

SEQ ID NO: 46033 - DNA, 6 bp, Unknown
  misc_feature (1)..( 6): Matrix.001 file - promoters60/1032258
aaaaac

SEQ ID NO: 46034 - DNA, 6 bp, Unknown
  misc_feature (1)..( 6): Matrix.001 file - promoters60/1032258
gaaaat

SEQ ID NO: 46035 - DNA, 6 bp, Unknown
  misc_feature (1)..( 6): Matrix.001 file - promoters60/1032258
atgatg

SEQ ID NO: 46036 - DNA, 6 bp, Unknown
  misc_feature (1)..( 6): Matrix.001 file - promoters60/1032258
tattgt

SEQ ID NO: 46037 - DNA, 7 bp, Unknown
  misc_feature (1)..( 7): Matrix.001 file - promoters60/1032258
atattta

SEQ ID NO: 46038 - DNA, 6 bp, Unknown
  misc_feature (1)..( 6): Matrix.001 file - promoters60/1032258
agtatt

SEQ ID NO: 46039 - DNA, 6 bp, Unknown
  misc_feature (1)..( 6): Matrix.001 file - promoters60/1032258
aataca

SEQ ID NO: 46040 - DNA, 7 bp, Unknown
  misc_feature (1)..( 7): Matrix.001 file - promoters60/1032258
attctct

SEQ ID NO: 46041 - DNA, 7 bp, Unknown
  misc_feature (1)..( 7): Matrix.001 file - promoters60/1032258
tttataa

SEQ ID NO: 46042 - DNA, 6 bp, Unknown
  misc_feature (1)..( 6): Matrix.001 file - promoters60/1032258
tgtaaa

SEQ ID NO: 46043 - DNA, 7 bp, Unknown
  misc_feature (1)..( 7): Matrix.001 file - promoters60/1032266
agtcttt

SEQ ID NO: 46044 - DNA, 6 bp, Unknown
  misc_feature (1)..( 6): Matrix.001 file - promoters60/1032266
attcta

SEQ ID NO: 46045 - DNA, 6 bp, Unknown
  misc_feature (1)..( 6): Matrix.001 file - promoters60/1032266
gaacat

SEQ ID NO: 46046 - DNA, 6 bp, Unknown
  misc_feature (1)..( 6): Matrix.001 file - promoters60/1032266
tctaca

SEQ ID NO: 46047 - DNA, 6 bp, Unknown
  misc_feature (1)..( 6): Matrix.001 file - promoters60/1032266
cgtaga

SEQ ID NO: 46048 - DNA, 11 bp, Unknown
  misc_feature (1)..( 11): Matrix.001 file - promoters60/1032266
atttattagtg

SEQ ID NO: 46049 - DNA, 6 bp, Unknown
  misc_feature (1)..( 6): Matrix.001 file - promoters60/1032266
aaatat

SEQ ID NO: 46050 - DNA, 8 bp, Unknown
  misc_feature (1)..( 8): Matrix.001 file - promoters60/1032266
atatcttc

SEQ ID NO: 46051 - DNA, 8 bp, Unknown
  misc_feature (1)..( 8): Matrix.001 file - promoters60/1032266
aaaatttg

SEQ ID NO: 46052 - DNA, 7 bp, Unknown
  misc_feature (1)..( 7): Matrix.001 file - promoters60/1032266
atgaact

SEQ ID NO: 46053 - DNA, 6 bp, Unknown
  misc_feature (1)..( 6): Matrix.001 file - promoters60/1032266
aaaaag

SEQ ID NO: 46054 - DNA, 7 bp, Unknown
  misc_feature (1)..( 7): Matrix.001 file - promoters60/1032266
agattta

SEQ ID NO: 46055 - DNA, 6 bp, Unknown
  misc_feature (1)..( 6): Matrix.001 file - promoters60/1032266
attatt

SEQ ID NO: 46056 - DNA, 10 bp, Unknown
  misc_feature (1)..( 10): Matrix.001 file - promoters60/1032266
tttgcaacgt

SEQ ID NO: 46057 - DNA, 6 bp, Unknown
  misc_feature (1)..( 6): Matrix.001 file - promoters60/1032266
tgatat

SEQ ID NO: 46058 - DNA, 6 bp, Unknown
  misc_feature (1)..( 6): Matrix.001 file - promoters60/1032266
ttaaaa

SEQ ID NO: 46059 - DNA, 8 bp, Unknown
  misc_feature (1)..( 8): Matrix.001 file - promoters60/1032266
ttcattaa

SEQ ID NO: 46060 - DNA, 11 bp, Unknown
  misc_feature (1)..( 11): Matrix.001 file - promoters60/1032316
actaaaaacac

SEQ ID NO: 46061 - DNA, 9 bp, Unknown
  misc_feature (1)..( 9): Matrix.001 file - promoters60/1032400
gaagaggaa

SEQ ID NO: 46062 - DNA, 8 bp, Unknown
  misc_feature (1)..( 8): Matrix.001 file - promoters60/1032400
aatgagct

SEQ ID NO: 46063 - DNA, 9 bp, Unknown
  misc_feature (1)..( 9): Matrix.001 file - promoters60/1032400
tgctaaatt

SEQ ID NO: 46064 - DNA, 7 bp, Unknown
  misc_feature (1)..( 7): Matrix.001 file - promoters60/1032400
taatgaa

SEQ ID NO: 46065 - DNA, 8 bp, Unknown
  misc_feature (1)..( 8): Matrix.001 file - promoters60/1032400
tggctgtt

SEQ ID NO: 46066 - DNA, 8 bp, Unknown
  misc_feature (1)..( 8): Matrix.001 file - promoters60/1032400
aattgatt

SEQ ID NO: 46067 - DNA, 7 bp, Unknown
  misc_feature (1)..( 7): Matrix.001 file - promoters60/1032400
gttaaat

SEQ ID NO: 46068 - DNA, 9 bp, Unknown
  misc_feature (1)..( 9): Matrix.001 file - promoters60/1032400
cccgagaaa

SEQ ID NO: 46069 - DNA, 7 bp, Unknown
  misc_feature (1)..( 7): Matrix.001 file - promoters60/1032400
acacaag

SEQ ID NO: 46070 - DNA, 7 bp, Unknown
  misc_feature (1)..( 7): Matrix.001 file - promoters60/1032400
agaaaaa

SEQ ID NO: 46071 - DNA, 7 bp, Unknown
  misc_feature (1)..( 7): Matrix.001 file - promoters60/1032400
ttcaatg

SEQ ID NO: 46072 - DNA, 8 bp, Unknown
  misc_feature (1)..( 8): Matrix.001 file - promoters60/1032400
tcttaatt

SEQ ID NO: 46073 - DNA, 6 bp, Unknown
  misc_feature (1)..( 6): Matrix.001 file - promoters60/1032436
ttggtt

SEQ ID NO: 46074 - DNA, 8 bp, Unknown
  misc_feature (1)..( 8): Matrix.001 file - promoters60/1032436
tactcaaa

SEQ ID NO: 46075 - DNA, 6 bp, Unknown
  misc_feature (1)..( 6): Matrix.001 file - promoters60/1032436
ttctgt

SEQ ID NO: 46076 - DNA, 7 bp, Unknown
  misc_feature (1)..( 7): Matrix.001 file - promoters60/1032436
gaaaata

SEQ ID NO: 46077 - DNA, 7 bp, Unknown
  misc_feature (1)..( 7): Matrix.001 file - promoters60/1032436
ggttttg

SEQ ID NO: 46078 - DNA, 6 bp, Unknown
  misc_feature (1)..( 6): Matrix.001 file - promoters60/1032436
gaaaaa

SEQ ID NO: 46079 - DNA, 6 bp, Unknown
  misc_feature (1)..( 6): Matrix.001 file - promoters60/1032436
aataat

SEQ ID NO: 46080 - DNA, 8 bp, Unknown
  misc_feature (1)..( 8): Matrix.001 file - promoters60/1032436
gccactac

SEQ ID NO: 46081 - DNA, 7 bp, Unknown
  misc_feature (1)..( 7): Matrix.001 file - promoters60/1032436
actgttc

SEQ ID NO: 46082 - DNA, 7 bp, Unknown
  misc_feature (1)..( 7): Matrix.001 file - promoters60/1032436
aaagtaa

SEQ ID NO: 46083 - DNA, 9 bp, Unknown
  misc_feature (1)..( 9): Matrix.001 file - promoters60/1032436
ttaaaaaaa

SEQ ID NO: 46084 - DNA, 8 bp, Unknown
  misc_feature (1)..( 8): Matrix.001 file - promoters60/1032436
ctcaatta

SEQ ID NO: 46085 - DNA, 7 bp, Unknown
  misc_feature (1)..( 7): Matrix.001 file - promoters60/1032436
tatttgt

SEQ ID NO: 46086 - DNA, 9 bp, Unknown
  misc_feature (1)..( 9): Matrix.001 file - promoters60/1032436
taatctatt

SEQ ID NO: 46087 - DNA, 9 bp, Unknown
  misc_feature (1)..( 9): Matrix.001 file - promoters60/1032436
gattcgttt

SEQ ID NO: 46088 - DNA, 7 bp, Unknown
  misc_feature (1)..( 7): Matrix.001 file - promoters60/1032436
gttcctt

SEQ ID NO: 46089 - DNA, 13 bp, Unknown
  misc_feature (1)..( 13): Matrix.001 file - promoters60/1032436
aagaattaatgat

SEQ ID NO: 46090 - DNA, 11 bp, Unknown
  misc_feature (1)..( 11): Matrix.001 file - promoters60/1032668
taaaaaggatt

SEQ ID NO: 46091 - DNA, 9 bp, Unknown
  misc_feature (1)..( 9): Matrix.001 file - promoters60/1032668
aaaaatgaa

SEQ ID NO: 46092 - DNA, 6 bp, Unknown
  misc_feature (1)..( 6): Matrix.001 file - promoters60/1032698
caaatc

SEQ ID NO: 46093 - DNA, 7 bp, Unknown
  misc_feature (1)..( 7): Matrix.001 file - promoters60/1032698
ttcacta

SEQ ID NO: 46094 - DNA, 7 bp, Unknown
  misc_feature (1)..( 7): Matrix.001 file - promoters60/1032698
agacgga

SEQ ID NO: 46095 - DNA, 7 bp, Unknown
  misc_feature (1)..( 7): Matrix.001 file - promoters60/1032698
cataatt

SEQ ID NO: 46096 - DNA, 7 bp, Unknown
  misc_feature (1)..( 7): Matrix.001 file - promoters60/1032698
tttcagc

SEQ ID NO: 46097 - DNA, 6 bp, Unknown
  misc_feature (1)..( 6): Matrix.001 file - promoters60/1032698
actttt

SEQ ID NO: 46098 - DNA, 7 bp, Unknown
  misc_feature (1)..( 7): Matrix.001 file - promoters60/1032698
tataaaa

SEQ ID NO: 46099 - DNA, 6 bp, Unknown
  misc_feature (1)..( 6): Matrix.001 file - promoters60/1032698
gaatct

SEQ ID NO: 46100 - DNA, 7 bp, Unknown
  misc_feature (1)..( 7): Matrix.001 file - promoters60/1032698
tggaaat

SEQ ID NO: 46101 - DNA, 6 bp, Unknown
  misc_feature (1)..( 6): Matrix.001 file - promoters60/1032698
gagata

SEQ ID NO: 46102 - DNA, 9 bp, Unknown
  misc_feature (1)..( 9): Matrix.001 file - promoters60/1032698
caaacaaaa

SEQ ID NO: 46103 - DNA, 7 bp, Unknown
  misc_feature (1)..( 7): Matrix.001 file - promoters60/1032698
tatattt

SEQ ID NO: 46104 - DNA, 8 bp, Unknown
  misc_feature (1)..( 8): Matrix.001 file - promoters60/1032698
atcagaaa

SEQ ID NO: 46105 - DNA, 7 bp, Unknown
  misc_feature (1)..( 7): Matrix.001 file - promoters60/1032698
atgagaa

SEQ ID NO: 46106 - DNA, 7 bp, Unknown
  misc_feature (1)..( 7): Matrix.001 file - promoters60/1032698
aggctca

SEQ ID NO: 46107 - DNA, 6 bp, Unknown
  misc_feature (1)..( 6): Matrix.001 file - promoters60/1032698
gaagat

SEQ ID NO: 46108 - DNA, 7 bp, Unknown
  misc_feature (1)..( 7): Matrix.001 file - promoters60/1032698
ttgatcc

SEQ ID NO: 46109 - DNA, 6 bp, Unknown
  misc_feature (1)..( 6): Matrix.001 file - promoters60/1032698
acttgg

SEQ ID NO: 46110 - DNA, 8 bp, Unknown
  misc_feature (1)..( 8): Matrix.001 file - promoters60/1032698
aaagaaaa

SEQ ID NO: 46111 - DNA, 7 bp, Unknown
  misc_feature (1)..( 7): Matrix.001 file - promoters60/1032709
aatatgt

SEQ ID NO: 46112 - DNA, 8 bp, Unknown
  misc_feature (1)..( 8): Matrix.001 file - promoters60/1032709
tgatggat

SEQ ID NO: 46113 - DNA, 6 bp, Unknown
  misc_feature (1)..( 6): Matrix.001 file - promoters60/1032709
cagtct

SEQ ID NO: 46114 - DNA, 8 bp, Unknown
  misc_feature (1)..( 8): Matrix.001 file - promoters60/1032709
tcctagaa

SEQ ID NO: 46115 - DNA, 7 bp, Unknown
  misc_feature (1)..( 7): Matrix.001 file - promoters60/1032709
ctggtct

SEQ ID NO: 46116 - DNA, 7 bp, Unknown
  misc_feature (1)..( 7): Matrix.001 file - promoters60/1032709
ttgactc

SEQ ID NO: 46117 - DNA, 7 bp, Unknown
  misc_feature (1)..( 7): Matrix.001 file - promoters60/1032709
agacgag

SEQ ID NO: 46118 - DNA, 9 bp, Unknown
  misc_feature (1)..( 9): Matrix.001 file - promoters60/1032709
agaaaaaaa

SEQ ID NO: 46119 - DNA, 7 bp, Unknown
  misc_feature (1)..( 7): Matrix.001 file - promoters60/1032709
atattta

SEQ ID NO: 46120 - DNA, 7 bp, Unknown
  misc_feature (1)..( 7): Matrix.001 file - promoters60/1032709
aacacag

SEQ ID NO: 46121 - DNA, 9 bp, Unknown
  misc_feature (1)..( 9): Matrix.001 file - promoters60/1032709
ttgttatta

SEQ ID NO: 46122 - DNA, 6 bp, Unknown
  misc_feature (1)..( 6): Matrix.001 file - promoters60/1032709
aatatc

SEQ ID NO: 46123 - DNA, 7 bp, Unknown
  misc_feature (1)..( 7): Matrix.001 file - promoters60/1032709
ctaaacc

SEQ ID NO: 46124 - DNA, 7 bp, Unknown
  misc_feature (1)..( 7): Matrix.001 file - promoters60/1032709
cgtattg

SEQ ID NO: 46125 - DNA, 7 bp, Unknown
  misc_feature (1)..( 7): Matrix.001 file - promoters60/1032709
aaaccaa

SEQ ID NO: 46126 - DNA, 7 bp, Unknown
  misc_feature (1)..( 7): Matrix.001 file - promoters60/1032709
gaaaaaa

SEQ ID NO: 46127 - DNA, 9 bp, Unknown
  misc_feature (1)..( 9): Matrix.001 file - promoters60/1032713
tttgaaaca

SEQ ID NO: 46128 - DNA, 9 bp, Unknown
  misc_feature (1)..( 9): Matrix.001 file - promoters60/1032713
aaacgccaa

SEQ ID NO: 46129 - DNA, 7 bp, Unknown
  misc_feature (1)..( 7): Matrix.001 file - promoters60/1032713
caaaata

SEQ ID NO: 46130 - DNA, 10 bp, Unknown
  misc_feature (1)..( 10): Matrix.001 file - promoters60/1032713
attacttact

SEQ ID NO: 46131 - DNA, 9 bp, Unknown
  misc_feature (1)..( 9): Matrix.001 file - promoters60/1032713
aaaagccat

SEQ ID NO: 46132 - DNA, 7 bp, Unknown
  misc_feature (1)..( 7): Matrix.001 file - promoters60/1032730
ctaaata

SEQ ID NO: 46133 - DNA, 9 bp, Unknown
  misc_feature (1)..( 9): Matrix.001 file - promoters60/1032730
gtagtatat

SEQ ID NO: 46134 - DNA, 8 bp, Unknown
  misc_feature (1)..( 8): Matrix.001 file - promoters60/1032730
tgtcgttt

SEQ ID NO: 46135 - DNA, 6 bp, Unknown
  misc_feature (1)..( 6): Matrix.001 file - promoters60/1032730
cccaaa

SEQ ID NO: 46136 - DNA, 6 bp, Unknown
  misc_feature (1)..( 6): Matrix.001 file - promoters60/1032730
acaaat

SEQ ID NO: 46137 - DNA, 7 bp, Unknown
  misc_feature (1)..( 7): Matrix.001 file - promoters60/1032730
aaaatca

SEQ ID NO: 46138 - DNA, 8 bp, Unknown
  misc_feature (1)..( 8): Matrix.001 file - promoters60/1032730
ttttaaaa

SEQ ID NO: 46139 - DNA, 7 bp, Unknown
  misc_feature (1)..( 7): Matrix.001 file - promoters60/1032730
aaaaaga

SEQ ID NO: 46140 - DNA, 8 bp, Unknown
  misc_feature (1)..( 8): Matrix.001 file - promoters60/1032730
cgttaata

SEQ ID NO: 46141 - DNA, 6 bp, Unknown
  misc_feature (1)..( 6): Matrix.001 file - promoters60/1032730
agaatc

SEQ ID NO: 46142 - DNA, 6 bp, Unknown
  misc_feature (1)..( 6): Matrix.001 file - promoters60/1032730
actcaa

SEQ ID NO: 46143 - DNA, 8 bp, Unknown
  misc_feature (1)..( 8): Matrix.001 file - promoters60/1032730
aatcaaaa

SEQ ID NO: 46144 - DNA, 6 bp, Unknown
  misc_feature (1)..( 6): Matrix.001 file - promoters60/1032730
cagaaa

SEQ ID NO: 46145 - DNA, 7 bp, Unknown
  misc_feature (1)..( 7): Matrix.001 file - promoters60/1032730
attaaaa

SEQ ID NO: 46146 - DNA, 6 bp, Unknown
  misc_feature (1)..( 6): Matrix.001 file - promoters60/1032730
acgaaa

SEQ ID NO: 46147 - DNA, 6 bp, Unknown
  misc_feature (1)..( 6): Matrix.001 file - promoters60/1032730
gacttt

SEQ ID NO: 46148 - DNA, 8 bp, Unknown
  misc_feature (1)..( 8): Matrix.001 file - promoters60/1032752
aaaaaaat

SEQ ID NO: 46149 - DNA, 12 bp, Unknown
  misc_feature (1)..( 12): Matrix.001 file - promoters60/1032752
cttttctatttg

SEQ ID NO: 46150 - DNA, 9 bp, Unknown
  misc_feature (1)..( 9): Matrix.001 file - promoters60/1032752
aatttataa

SEQ ID NO: 46151 - DNA, 16 bp, Unknown
  misc_feature (1)..( 16): Matrix.001 file - promoters60/1032752
tacaaaaaaaagtaat

SEQ ID NO: 46152 - DNA, 11 bp, Unknown
  misc_feature (1)..( 11): Matrix.001 file - promoters60/1032752
attgtcttatt

SEQ ID NO: 46153 - DNA, 9 bp, Unknown
  misc_feature (1)..( 9): Matrix.001 file - promoters60/1032752
catgaataa

SEQ ID NO: 46154 - DNA, 9 bp, Unknown
  misc_feature (1)..( 9): Matrix.001 file - promoters60/1032752
aaagaaagt

SEQ ID NO: 46155 - DNA, 10 bp, Unknown
  misc_feature (1)..( 10): Matrix.001 file - promoters60/1032752
aaaaattaat

SEQ ID NO: 46156 - DNA, 10 bp, Unknown
  misc_feature (1)..( 10): Matrix.001 file - promoters60/1032752
aaatttaatt

SEQ ID NO: 46157 - DNA, 11 bp, Unknown
  misc_feature (1)..( 11): Matrix.001 file - promoters60/1032752
atttaaattta

SEQ ID NO: 46158 - DNA, 12 bp, Unknown
  misc_feature (1)..( 12): Matrix.001 file - promoters60/1032788
ataagtttaaaa

SEQ ID NO: 46159 - DNA, 7 bp, Unknown
  misc_feature (1)..( 7): Matrix.001 file - promoters60/1032788
aaaaata

SEQ ID NO: 46160 - DNA, 12 bp, Unknown
  misc_feature (1)..( 12): Matrix.001 file - promoters60/1032788
aaaaaattaaaa

SEQ ID NO: 46161 - DNA, 10 bp, Unknown
  misc_feature (1)..( 10): Matrix.001 file - promoters60/1032788
atattattaa

SEQ ID NO: 46162 - DNA, 8 bp, Unknown
  misc_feature (1)..( 8): Matrix.001 file - promoters60/1032788
ttttattt

SEQ ID NO: 46163 - DNA, 11 bp, Unknown
  misc_feature (1)..( 11): Matrix.001 file - promoters60/1032788
aaattaaaaac

SEQ ID NO: 46164 - DNA, 9 bp, Unknown
  misc_feature (1)..( 9): Matrix.001 file - promoters60/1032788
taaaaattc

SEQ ID NO: 46165 - DNA, 8 bp, Unknown
  misc_feature (1)..( 8): Matrix.001 file - promoters60/1032788
aaaacaaa

SEQ ID NO: 46166 - DNA, 9 bp, Unknown
  misc_feature (1)..( 9): Matrix.001 file - promoters60/1032788
tgaaaaaat

SEQ ID NO: 46167 - DNA, 9 bp, Unknown
  misc_feature (1)..( 9): Matrix.001 file - promoters60/1032788
atataataa

SEQ ID NO: 46168 - DNA, 10 bp, Unknown
  misc_feature (1)..( 10): Matrix.001 file - promoters60/1032815
gaagtttcta

SEQ ID NO: 46169 - DNA, 6 bp, Unknown
  misc_feature (1)..( 6): Matrix.001 file - promoters60/1032844
aatcgt

SEQ ID NO: 46170 - DNA, 9 bp, Unknown
  misc_feature (1)..( 9): Matrix.001 file - promoters60/1032844
taagattgg

SEQ ID NO: 46171 - DNA, 7 bp, Unknown
  misc_feature (1)..( 7): Matrix.001 file - promoters60/1032844
ataaaaa

SEQ ID NO: 46172 - DNA, 7 bp, Unknown
  misc_feature (1)..( 7): Matrix.001 file - promoters60/1032844
agaagct

SEQ ID NO: 46173 - DNA, 15 bp, Unknown
  misc_feature (1)..( 15): Matrix.001 file - promoters60/1032844
ttaatatatattact

SEQ ID NO: 46174 - DNA, 6 bp, Unknown
  misc_feature (1)..( 6): Matrix.001 file - promoters60/1032844
ttttaa

SEQ ID NO: 46175 - DNA, 7 bp, Unknown
  misc_feature (1)..( 7): Matrix.001 file - promoters60/1032844
actcaaa

SEQ ID NO: 46176 - DNA, 7 bp, Unknown
  misc_feature (1)..( 7): Matrix.001 file - promoters60/1032844
tttagtt

SEQ ID NO: 46177 - DNA, 9 bp, Unknown
  misc_feature (1)..( 9): Matrix.001 file - promoters60/1032844
agcccaata

SEQ ID NO: 46178 - DNA, 6 bp, Unknown
  misc_feature (1)..( 6): Matrix.001 file - promoters60/1032844
agccca

SEQ ID NO: 46179 - DNA, 8 bp, Unknown
  misc_feature (1)..( 8): Matrix.001 file - promoters60/1032844
tcatcatc

SEQ ID NO: 46180 - DNA, 8 bp, Unknown
  misc_feature (1)..( 8): Matrix.001 file - promoters60/1032844
aagtggta

SEQ ID NO: 46181 - DNA, 7 bp, Unknown
  misc_feature (1)..( 7): Matrix.001 file - promoters60/1032844
gctcatt

SEQ ID NO: 46182 - DNA, 12 bp, Unknown
  misc_feature (1)..( 12): Matrix.001 file - promoters60/1032897
agaattaaaatc

SEQ ID NO: 46183 - DNA, 11 bp, Unknown
  misc_feature (1)..( 11): Matrix.001 file - promoters60/1032897
tatataaagcc

SEQ ID NO: 46184 - DNA, 11 bp, Unknown
  misc_feature (1)..( 11): Matrix.001 file - promoters60/1032897
ctatataaaaa

SEQ ID NO: 46185 - DNA, 7 bp, Unknown
  misc_feature (1)..( 7): Matrix.001 file - promoters60/1032940
taaacgc

SEQ ID NO: 46186 - DNA, 7 bp, Unknown
  misc_feature (1)..( 7): Matrix.001 file - promoters60/1032940
agaccca

SEQ ID NO: 46187 - DNA, 7 bp, Unknown
  misc_feature (1)..( 7): Matrix.001 file - promoters60/1032940
aaagtaa

SEQ ID NO: 46188 - DNA, 6 bp, Unknown
  misc_feature (1)..( 6): Matrix.001 file - promoters60/1032940
aataaa

SEQ ID NO: 46189 - DNA, 7 bp, Unknown
  misc_feature (1)..( 7): Matrix.001 file - promoters60/1032940
tttaaaa

SEQ ID NO: 46190 - DNA, 8 bp, Unknown
  misc_feature (1)..( 8): Matrix.001 file - promoters60/1032940
ttcggaaa

SEQ ID NO: 46191 - DNA, 6 bp, Unknown
  misc_feature (1)..( 6): Matrix.001 file - promoters60/1032940
agttgt

SEQ ID NO: 46192 - DNA, 7 bp, Unknown
  misc_feature (1)..( 7): Matrix.001 file - promoters60/1032940
tttagga

SEQ ID NO: 46193 - DNA, 8 bp, Unknown
  misc_feature (1)..( 8): Matrix.001 file - promoters60/1032940
taaagttt

SEQ ID NO: 46194 - DNA, 8 bp, Unknown
  misc_feature (1)..( 8): Matrix.001 file - promoters60/1032940
atataata

SEQ ID NO: 46195 - DNA, 6 bp, Unknown
  misc_feature (1)..( 6): Matrix.001 file - promoters60/1032940
tttttt

SEQ ID NO: 46196 - DNA, 6 bp, Unknown
  misc_feature (1)..( 6): Matrix.001 file - promoters60/1032940
tatata

SEQ ID NO: 46197 - DNA, 6 bp, Unknown
  misc_feature (1)..( 6): Matrix.001 file - promoters60/1032940
ttagaa

SEQ ID NO: 46198 - DNA, 8 bp, Unknown
  misc_feature (1)..( 8): Matrix.001 file - promoters60/1032940
ttttgtat

SEQ ID NO: 46199 - DNA, 10 bp, Unknown
  misc_feature (1)..( 10): Matrix.001 file - promoters60/1032940
ttttaaatta

SEQ ID NO: 46200 - DNA, 9 bp, Unknown
  misc_feature (1)..( 9): Matrix.001 file - promoters60/1032940
aatctttga

SEQ ID NO: 46201 - DNA, 8 bp, Unknown
  misc_feature (1)..( 8): Matrix.001 file - promoters60/1032940
ttaaatta

SEQ ID NO: 46202 - DNA, 7 bp, Unknown
  misc_feature (1)..( 7): Matrix.001 file - promoters60/1032940
tttgtta

SEQ ID NO: 46203 - DNA, 9 bp, Unknown
  misc_feature (1)..( 9): Matrix.001 file - promoters60/1032940
aattaaaat

SEQ ID NO: 46204 - DNA, 6 bp, Unknown
  misc_feature (1)..( 6): Matrix.001 file - promoters60/1032940
tcaatt

SEQ ID NO: 46205 - DNA, 7 bp, Unknown
  misc_feature (1)..( 7): Matrix.001 file - promoters60/1032940
aaataca

SEQ ID NO: 46206 - DNA, 8 bp, Unknown
  misc_feature (1)..( 8): Matrix.001 file - promoters60/1032940
taaataca

SEQ ID NO: 46207 - DNA, 9 bp, Unknown
  misc_feature (1)..( 9): Matrix.001 file - promoters60/1032940
caatttaaa

SEQ ID NO: 46208 - DNA, 10 bp, Unknown
  misc_feature (1)..( 10): Matrix.001 file - promoters60/1032940
atataaaata

SEQ ID NO: 46209 - DNA, 11 bp, Unknown
  misc_feature (1)..( 11): Matrix.001 file - promoters60/1033164
ctttatttgat

SEQ ID NO: 46210 - DNA, 7 bp, Unknown
  misc_feature (1)..( 7): Matrix.001 file - promoters60/1033164
cgagaga

SEQ ID NO: 46211 - DNA, 10 bp, Unknown
  misc_feature (1)..( 10): Matrix.001 file - promoters60/1033184
acttaattca

SEQ ID NO: 46212 - DNA, 14 bp, Unknown
  misc_feature (1)..( 14): Matrix.001 file - promoters60/1033184
ttatataagtccta

SEQ ID NO: 46213 - DNA, 13 bp, Unknown
  misc_feature (1)..( 13): Matrix.001 file - promoters60/1033184
tgattatgttttt

SEQ ID NO: 46214 - DNA, 9 bp, Unknown
  misc_feature (1)..( 9): Matrix.001 file - promoters60/1033208
taacttttg

SEQ ID NO: 46215 - DNA, 7 bp, Unknown
  misc_feature (1)..( 7): Matrix.001 file - promoters60/1033208
ttaacaa

SEQ ID NO: 46216 - DNA, 11 bp, Unknown
  misc_feature (1)..( 11): Matrix.001 file - promoters60/1033208
ttggaaaatgt

SEQ ID NO: 46217 - DNA, 11 bp, Unknown
  misc_feature (1)..( 11): Matrix.001 file - promoters60/1033208
cactttttaaa

SEQ ID NO: 46218 - DNA, 10 bp, Unknown
  misc_feature (1)..( 10): Matrix.001 file - promoters60/1033208
aagtaaatga

SEQ ID NO: 46219 - DNA, 7 bp, Unknown
  misc_feature (1)..( 7): Matrix.001 file - promoters60/1033217
aagatga

SEQ ID NO: 46220 - DNA, 6 bp, Unknown
  misc_feature (1)..( 6): Matrix.001 file - promoters60/1033217
tgaaga

SEQ ID NO: 46221 - DNA, 7 bp, Unknown
  misc_feature (1)..( 7): Matrix.001 file - promoters60/1033217
tatcaac

SEQ ID NO: 46222 - DNA, 6 bp, Unknown
  misc_feature (1)..( 6): Matrix.001 file - promoters60/1033217
ggggaa

SEQ ID NO: 46223 - DNA, 6 bp, Unknown
  misc_feature (1)..( 6): Matrix.001 file - promoters60/1033217
ttgaag

SEQ ID NO: 46224 - DNA, 7 bp, Unknown
  misc_feature (1)..( 7): Matrix.001 file - promoters60/1033217
tatttta

SEQ ID NO: 46225 - DNA, 7 bp, Unknown
  misc_feature (1)..( 7): Matrix.001 file - promoters60/1033217
aaaaaaa

SEQ ID NO: 46226 - DNA, 6 bp, Unknown
  misc_feature (1)..( 6): Matrix.001 file - promoters60/1033217
taaaaa

SEQ ID NO: 46227 - DNA, 6 bp, Unknown
  misc_feature (1)..( 6): Matrix.001 file - promoters60/1033217
aaaaca

SEQ ID NO: 46228 - DNA, 6 bp, Unknown
  misc_feature (1)..( 6): Matrix.001 file - promoters60/1033217
acaaac

SEQ ID NO: 46229 - DNA, 7 bp, Unknown
  misc_feature (1)..( 7): Matrix.001 file - promoters60/1033217
atgatga

SEQ ID NO: 46230 - DNA, 8 bp, Unknown
  misc_feature (1)..( 8): Matrix.001 file - promoters60/1033217
attgtttt

SEQ ID NO: 46231 - DNA, 8 bp, Unknown
  misc_feature (1)..( 8): Matrix.001 file - promoters60/1033217
tgagtatt

SEQ ID NO: 46232 - DNA, 8 bp, Unknown
  misc_feature (1)..( 8): Matrix.001 file - promoters60/1033217
aagaggat

SEQ ID NO: 46233 - DNA, 10 bp, Unknown
  misc_feature (1)..( 10): Matrix.001 file - promoters60/1033217
tttatttata

SEQ ID NO: 46234 - DNA, 7 bp, Unknown
  misc_feature (1)..( 7): Matrix.001 file - promoters60/1033217
tctaaaa

SEQ ID NO: 46235 - DNA, 9 bp, Unknown
  misc_feature (1)..( 9): Matrix.001 file - promoters60/1033262
agtacaaat

SEQ ID NO: 46236 - DNA, 13 bp, Unknown
  misc_feature (1)..( 13): Matrix.001 file - promoters60/1033262
taagaacaaaaat

SEQ ID NO: 46237 - DNA, 14 bp, Unknown
  misc_feature (1)..( 14): Matrix.001 file - promoters60/1033262
cccatataaaaatc

SEQ ID NO: 46238 - DNA, 13 bp, Unknown
  misc_feature (1)..( 13): Matrix.001 file - promoters60/1033360
tgtttaaagaatt

SEQ ID NO: 46239 - DNA, 11 bp, Unknown
  misc_feature (1)..( 11): Matrix.001 file - promoters60/1033360
taaatttttca

SEQ ID NO: 46240 - DNA, 14 bp, Unknown
  misc_feature (1)..( 14): Matrix.001 file - promoters60/1033360
tgagatataattga

SEQ ID NO: 46241 - DNA, 8 bp, Unknown
  misc_feature (1)..( 8): Matrix.001 file - promoters60/1033360
attgattt

SEQ ID NO: 46242 - DNA, 11 bp, Unknown
  misc_feature (1)..( 11): Matrix.001 file - promoters60/1033360
gtttattattt

SEQ ID NO: 46243 - DNA, 13 bp, Unknown
  misc_feature (1)..( 13): Matrix.001 file - promoters60/1033360
tatgaataaacat

SEQ ID NO: 46244 - DNA, 11 bp, Unknown
  misc_feature (1)..( 11): Matrix.001 file - promoters60/1033430
cttttggtttt

SEQ ID NO: 46245 - DNA, 7 bp, Unknown
  misc_feature (1)..( 7): Matrix.001 file - promoters60/1033430
ttaattt

SEQ ID NO: 46246 - DNA, 9 bp, Unknown
  misc_feature (1)..( 9): Matrix.001 file - promoters60/1033430
tttggtttt

SEQ ID NO: 46247 - DNA, 7 bp, Unknown
  misc_feature (1)..( 7): Matrix.001 file - promoters60/1033430
gttataa

SEQ ID NO: 46248 - DNA, 7 bp, Unknown
  misc_feature (1)..( 7): Matrix.001 file - promoters60/1033430
taatttt

SEQ ID NO: 46249 - DNA, 13 bp, Unknown
  misc_feature (1)..( 13): Matrix.001 file - promoters60/1033430
ttgattcaatatt

SEQ ID NO: 46250 - DNA, 8 bp, Unknown
  misc_feature (1)..( 8): Matrix.001 file - promoters60/1033430
atttctct

SEQ ID NO: 46251 - DNA, 13 bp, Unknown
  misc_feature (1)..( 13): Matrix.001 file - promoters60/1033430
ttgaatcaaaatt

SEQ ID NO: 46252 - DNA, 6 bp, Unknown
  misc_feature (1)..( 6): Matrix.001 file - promoters60/1033430
tggatt

SEQ ID NO: 46253 - DNA, 13 bp, Unknown
  misc_feature (1)..( 13): Matrix.001 file - promoters60/1033430
ttgaatcaaaatt

SEQ ID NO: 46254 - DNA, 6 bp, Unknown
  misc_feature (1)..( 6): Matrix.001 file - promoters60/1033526
ttgaag

SEQ ID NO: 46255 - DNA, 6 bp, Unknown
  misc_feature (1)..( 6): Matrix.001 file - promoters60/1033526
acgagc

SEQ ID NO: 46256 - DNA, 8 bp, Unknown
  misc_feature (1)..( 8): Matrix.001 file - promoters60/1033526
cttacttt

SEQ ID NO: 46257 - DNA, 7 bp, Unknown
  misc_feature (1)..( 7): Matrix.001 file - promoters60/1033526
cttttgt

SEQ ID NO: 46258 - DNA, 10 bp, Unknown
  misc_feature (1)..( 10): Matrix.001 file - promoters60/1033526
ttgtttctct

SEQ ID NO: 46259 - DNA, 7 bp, Unknown
  misc_feature (1)..( 7): Matrix.001 file - promoters60/1033526
actgact

SEQ ID NO: 46260 - DNA, 7 bp, Unknown
  misc_feature (1)..( 7): Matrix.001 file - promoters60/1033526
agattat

SEQ ID NO: 46261 - DNA, 7 bp, Unknown
  misc_feature (1)..( 7): Matrix.001 file - promoters60/1033526
tatgatt

SEQ ID NO: 46262 - DNA, 7 bp, Unknown
  misc_feature (1)..( 7): Matrix.001 file - promoters60/1033526
gcaatta

SEQ ID NO: 46263 - DNA, 9 bp, Unknown
  misc_feature (1)..( 9): Matrix.001 file - promoters60/1033526
aagaaaatt

SEQ ID NO: 46264 - DNA, 7 bp, Unknown
  misc_feature (1)..( 7): Matrix.001 file - promoters60/1033526
gacattg

SEQ ID NO: 46265 - DNA, 6 bp, Unknown
  misc_feature (1)..( 6): Matrix.001 file - promoters60/1033526
cttgat

SEQ ID NO: 46266 - DNA, 7 bp, Unknown
  misc_feature (1)..( 7): Matrix.001 file - promoters60/1033526
gaggtaa

SEQ ID NO: 46267 - DNA, 8 bp, Unknown
  misc_feature (1)..( 8): Matrix.001 file - promoters60/1033526
tctgcatt

SEQ ID NO: 46268 - DNA, 8 bp, Unknown
  misc_feature (1)..( 8): Matrix.001 file - promoters60/1033526
tttatatc

SEQ ID NO: 46269 - DNA, 6 bp, Unknown
  misc_feature (1)..( 6): Matrix.001 file - promoters60/1033526
atcttc

SEQ ID NO: 46270 - DNA, 7 bp, Unknown
  misc_feature (1)..( 7): Matrix.001 file - promoters60/1033526
tgagatt

SEQ ID NO: 46271 - DNA, 8 bp, Unknown
  misc_feature (1)..( 8): Matrix.001 file - promoters60/1033526
tatattta

SEQ ID NO: 46272 - DNA, 6 bp, Unknown
  misc_feature (1)..( 6): Matrix.001 file - promoters60/1033679
gttgta

SEQ ID NO: 46273 - DNA, 6 bp, Unknown
  misc_feature (1)..( 6): Matrix.001 file - promoters60/1033679
aaacaa

SEQ ID NO: 46274 - DNA, 6 bp, Unknown
  misc_feature (1)..( 6): Matrix.001 file - promoters60/1033679
acaatc

SEQ ID NO: 46275 - DNA, 7 bp, Unknown
  misc_feature (1)..( 7): Matrix.001 file - promoters60/1033679
ctagttc

SEQ ID NO: 46276 - DNA, 6 bp, Unknown
  misc_feature (1)..( 6): Matrix.001 file - promoters60/1033679
gcgttt

SEQ ID NO: 46277 - DNA, 8 bp, Unknown
  misc_feature (1)..( 8): Matrix.001 file - promoters60/1033679
gtaaaaat

SEQ ID NO: 46278 - DNA, 7 bp, Unknown
  misc_feature (1)..( 7): Matrix.001 file - promoters60/1033679
acattgt

SEQ ID NO: 46279 - DNA, 6 bp, Unknown
  misc_feature (1)..( 6): Matrix.001 file - promoters60/1033679
caaaaa

SEQ ID NO: 46280 - DNA, 8 bp, Unknown
  misc_feature (1)..( 8): Matrix.001 file - promoters60/1033679
ttgttcta

SEQ ID NO: 46281 - DNA, 6 bp, Unknown
  misc_feature (1)..( 6): Matrix.001 file - promoters60/1033679
aaaaac

SEQ ID NO: 46282 - DNA, 6 bp, Unknown
  misc_feature (1)..( 6): Matrix.001 file - promoters60/1033679
ttaaaa

SEQ ID NO: 46283 - DNA, 7 bp, Unknown
  misc_feature (1)..( 7): Matrix.001 file - promoters60/1033679
agtattc

SEQ ID NO: 46284 - DNA, 6 bp, Unknown
  misc_feature (1)..( 6): Matrix.001 file - promoters60/1033679
aatgga

SEQ ID NO: 46285 - DNA, 6 bp, Unknown
  misc_feature (1)..( 6): Matrix.001 file - promoters60/1033679
ttcata

SEQ ID NO: 46286 - DNA, 6 bp, Unknown
  misc_feature (1)..( 6): Matrix.001 file - promoters60/1033679
cccaat

SEQ ID NO: 46287 - DNA, 6 bp, Unknown
  misc_feature (1)..( 6): Matrix.001 file - promoters60/1033679
ttacgt

SEQ ID NO: 46288 - DNA, 6 bp, Unknown
  misc_feature (1)..( 6): Matrix.001 file - promoters60/1033716
ttaaaa

SEQ ID NO: 46289 - DNA, 6 bp, Unknown
  misc_feature (1)..( 6): Matrix.001 file - promoters60/1033716
aaaaga

SEQ ID NO: 46290 - DNA, 6 bp, Unknown
  misc_feature (1)..( 6): Matrix.001 file - promoters60/1033716
aaaacg

SEQ ID NO: 46291 - DNA, 8 bp, Unknown
  misc_feature (1)..( 8): Matrix.001 file - promoters60/1033716
gtagtaac

SEQ ID NO: 46292 - DNA, 6 bp, Unknown
  misc_feature (1)..( 6): Matrix.001 file - promoters60/1033716
agatga

SEQ ID NO: 46293 - DNA, 10 bp, Unknown
  misc_feature (1)..( 10): Matrix.001 file - promoters60/1033716
aaaagaaaaa

SEQ ID NO: 46294 - DNA, 7 bp, Unknown
  misc_feature (1)..( 7): Matrix.001 file - promoters60/1033716
agattct

SEQ ID NO: 46295 - DNA, 8 bp, Unknown
  misc_feature (1)..( 8): Matrix.001 file - promoters60/1033716
ctcaaagc

SEQ ID NO: 46296 - DNA, 6 bp, Unknown
  misc_feature (1)..( 6): Matrix.001 file - promoters60/1033716
attatc

SEQ ID NO: 46297 - DNA, 9 bp, Unknown
  misc_feature (1)..( 9): Matrix.001 file - promoters60/1033716
tattgaaaa

SEQ ID NO: 46298 - DNA, 8 bp, Unknown
  misc_feature (1)..( 8): Matrix.001 file - promoters60/1033716
aaaacgac

SEQ ID NO: 46299 - DNA, 9 bp, Unknown
  misc_feature (1)..( 9): Matrix.001 file - promoters60/1033716
gggtaagag

SEQ ID NO: 46300 - DNA, 8 bp, Unknown
  misc_feature (1)..( 8): Matrix.001 file - promoters60/1033716
aatcgaat

SEQ ID NO: 46301 - DNA, 7 bp, Unknown
  misc_feature (1)..( 7): Matrix.001 file - promoters60/1033716
tattggt

SEQ ID NO: 46302 - DNA, 7 bp, Unknown
  misc_feature (1)..( 7): Matrix.001 file - promoters60/1033716
ttctcat

SEQ ID NO: 46303 - DNA, 10 bp, Unknown
  misc_feature (1)..( 10): Matrix.001 file - promoters60/1033723
atggaaatta

SEQ ID NO: 46304 - DNA, 7 bp, Unknown
  misc_feature (1)..( 7): Matrix.001 file - promoters60/1033723
gatgatg

SEQ ID NO: 46305 - DNA, 7 bp, Unknown
  misc_feature (1)..( 7): Matrix.001 file - promoters60/1033723
atgaaga

SEQ ID NO: 46306 - DNA, 7 bp, Unknown
  misc_feature (1)..( 7): Matrix.001 file - promoters60/1033723
agaagga

SEQ ID NO: 46307 - DNA, 6 bp, Unknown
  misc_feature (1)..( 6): Matrix.001 file - promoters60/1033723
ataatt

SEQ ID NO: 46308 - DNA, 9 bp, Unknown
  misc_feature (1)..( 9): Matrix.001 file - promoters60/1033723
ggatcgggt

SEQ ID NO: 46309 - DNA, 6 bp, Unknown
  misc_feature (1)..( 6): Matrix.001 file - promoters60/1033723
ttcgga

SEQ ID NO: 46310 - DNA, 6 bp, Unknown
  misc_feature (1)..( 6): Matrix.001 file - promoters60/1033723
cggcga

SEQ ID NO: 46311 - DNA, 8 bp, Unknown
  misc_feature (1)..( 8): Matrix.001 file - promoters60/1033723
ggaggatc

SEQ ID NO: 46312 - DNA, 11 bp, Unknown
  misc_feature (1)..( 11): Matrix.001 file - promoters60/1033723
gaagggagatg

SEQ ID NO: 46313 - DNA, 12 bp, Unknown
  misc_feature (1)..( 12): Matrix.001 file - promoters60/1033781
taaatcaaaaaa

SEQ ID NO: 46314 - DNA, 13 bp, Unknown
  misc_feature (1)..( 13): Matrix.001 file - promoters60/1033781
aggcccaaaaaaa

SEQ ID NO: 46315 - DNA, 9 bp, Unknown
  misc_feature (1)..( 9): Matrix.001 file - promoters60/1033781
acataaatc

SEQ ID NO: 46316 - DNA, 7 bp, Unknown
  misc_feature (1)..( 7): Matrix.001 file - promoters60/1033781
taattaa

SEQ ID NO: 46317 - DNA, 10 bp, Unknown
  misc_feature (1)..( 10): Matrix.001 file - promoters60/1033781
ttcaaaaaat

SEQ ID NO: 46318 - DNA, 14 bp, Unknown
  misc_feature (1)..( 14): Matrix.001 file - promoters60/1033841
aaatgggcttatta

SEQ ID NO: 46319 - DNA, 7 bp, Unknown
  misc_feature (1)..( 7): Matrix.001 file - promoters60/1033849
attcact

SEQ ID NO: 46320 - DNA, 6 bp, Unknown
  misc_feature (1)..( 6): Matrix.001 file - promoters60/1033849
taaaga

SEQ ID NO: 46321 - DNA, 11 bp, Unknown
  misc_feature (1)..( 11): Matrix.001 file - promoters60/1033849
acaatttataa

SEQ ID NO: 46322 - DNA, 7 bp, Unknown
  misc_feature (1)..( 7): Matrix.001 file - promoters60/1033849
gtaacta

SEQ ID NO: 46323 - DNA, 7 bp, Unknown
  misc_feature (1)..( 7): Matrix.001 file - promoters60/1033849
aattttt

SEQ ID NO: 46324 - DNA, 7 bp, Unknown
  misc_feature (1)..( 7): Matrix.001 file - promoters60/1033849
tttgttt

SEQ ID NO: 46325 - DNA, 7 bp, Unknown
  misc_feature (1)..( 7): Matrix.001 file - promoters60/1033849
tgtcaaa

SEQ ID NO: 46326 - DNA, 7 bp, Unknown
  misc_feature (1)..( 7): Matrix.001 file - promoters60/1033849
tagaaaa

SEQ ID NO: 46327 - DNA, 7 bp, Unknown
  misc_feature (1)..( 7): Matrix.001 file - promoters60/1033849
tatataa

SEQ ID NO: 46328 - DNA, 8 bp, Unknown
  misc_feature (1)..( 8): Matrix.001 file - promoters60/1033849
atatatac

SEQ ID NO: 46329 - DNA, 6 bp, Unknown
  misc_feature (1)..( 6): Matrix.001 file - promoters60/1033849
tagata

SEQ ID NO: 46330 - DNA, 7 bp, Unknown
  misc_feature (1)..( 7): Matrix.001 file - promoters60/1033849
caaaaag

SEQ ID NO: 46331 - DNA, 6 bp, Unknown
  misc_feature (1)..( 6): Matrix.001 file - promoters60/1033849
gcaata

SEQ ID NO: 46332 - DNA, 7 bp, Unknown
  misc_feature (1)..( 7): Matrix.001 file - promoters60/1033849
aaactat

SEQ ID NO: 46333 - DNA, 6 bp, Unknown
  misc_feature (1)..( 6): Matrix.001 file - promoters60/1033849
aaaata

SEQ ID NO: 46334 - DNA, 13 bp, Unknown
  misc_feature (1)..( 13): Matrix.001 file - promoters60/1033865
aaaagcttttttt

SEQ ID NO: 46335 - DNA, 8 bp, Unknown
  misc_feature (1)..( 8): Matrix.001 file - promoters60/1033865
attatttg

SEQ ID NO: 46336 - DNA, 10 bp, Unknown
  misc_feature (1)..( 10): Matrix.001 file - promoters60/1033865
atgctttttt

SEQ ID NO: 46337 - DNA, 14 bp, Unknown
  misc_feature (1)..( 14): Matrix.001 file - promoters60/1033865
tagaaagattcttt

SEQ ID NO: 46338 - DNA, 9 bp, Unknown
  misc_feature (1)..( 9): Matrix.001 file - promoters60/1034030
tttttaaat

SEQ ID NO: 46339 - DNA, 12 bp, Unknown
  misc_feature (1)..( 12): Matrix.001 file - promoters60/1034030
cattagtcaatt

SEQ ID NO: 46340 - DNA, 13 bp, Unknown
  misc_feature (1)..( 13): Matrix.001 file - promoters60/1034030
aaaccaaaaaagt

SEQ ID NO: 46341 - DNA, 6 bp, Unknown
  misc_feature (1)..( 6): Matrix.001 file - promoters60/1034034
tttatt

SEQ ID NO: 46342 - DNA, 7 bp, Unknown
  misc_feature (1)..( 7): Matrix.001 file - promoters60/1034034
ttgcggt

SEQ ID NO: 46343 - DNA, 7 bp, Unknown
  misc_feature (1)..( 7): Matrix.001 file - promoters60/1034034
cttctgt

SEQ ID NO: 46344 - DNA, 7 bp, Unknown
  misc_feature (1)..( 7): Matrix.001 file - promoters60/1034034
ttactcc

SEQ ID NO: 46345 - DNA, 9 bp, Unknown
  misc_feature (1)..( 9): Matrix.001 file - promoters60/1034034
tttggattt

SEQ ID NO: 46346 - DNA, 7 bp, Unknown
  misc_feature (1)..( 7): Matrix.001 file - promoters60/1034034
agaaatg

SEQ ID NO: 46347 - DNA, 6 bp, Unknown
  misc_feature (1)..( 6): Matrix.001 file - promoters60/1034034
gagaag

SEQ ID NO: 46348 - DNA, 7 bp, Unknown
  misc_feature (1)..( 7): Matrix.001 file - promoters60/1034034
agaattt

SEQ ID NO: 46349 - DNA, 8 bp, Unknown
  misc_feature (1)..( 8): Matrix.001 file - promoters60/1034034
tcaaagat

SEQ ID NO: 46350 - DNA, 8 bp, Unknown
  misc_feature (1)..( 8): Matrix.001 file - promoters60/1034034
ttcaattc

SEQ ID NO: 46351 - DNA, 8 bp, Unknown
  misc_feature (1)..( 8): Matrix.001 file - promoters60/1034034
gaacaaac

SEQ ID NO: 46352 - DNA, 6 bp, Unknown
  misc_feature (1)..( 6): Matrix.001 file - promoters60/1034034
gaatca

SEQ ID NO: 46353 - DNA, 7 bp, Unknown
  misc_feature (1)..( 7): Matrix.001 file - promoters60/1034034
tccagtt

SEQ ID NO: 46354 - DNA, 6 bp, Unknown
  misc_feature (1)..( 6): Matrix.001 file - promoters60/1034034
tttccg

SEQ ID NO: 46355 - DNA, 6 bp, Unknown
  misc_feature (1)..( 6): Matrix.001 file - promoters60/1034034
ataaat

SEQ ID NO: 46356 - DNA, 6 bp, Unknown
  misc_feature (1)..( 6): Matrix.001 file - promoters60/1034034
aaccct

SEQ ID NO: 46357 - DNA, 6 bp, Unknown
  misc_feature (1)..( 6): Matrix.001 file - promoters60/1034119
aataat

SEQ ID NO: 46358 - DNA, 11 bp, Unknown
  misc_feature (1)..( 11): Matrix.001 file - promoters60/1034119
ataataataat

SEQ ID NO: 46359 - DNA, 7 bp, Unknown
  misc_feature (1)..( 7): Matrix.001 file - promoters60/1034119
atcgtca

SEQ ID NO: 46360 - DNA, 10 bp, Unknown
  misc_feature (1)..( 10): Matrix.001 file - promoters60/1034119
aacataaggc

SEQ ID NO: 46361 - DNA, 6 bp, Unknown
  misc_feature (1)..( 6): Matrix.001 file - promoters60/1034119
aattta

SEQ ID NO: 46362 - DNA, 6 bp, Unknown
  misc_feature (1)..( 6): Matrix.001 file - promoters60/1034119
tttatt

SEQ ID NO: 46363 - DNA, 7 bp, Unknown
  misc_feature (1)..( 7): Matrix.001 file - promoters60/1034119
tatgtta

SEQ ID NO: 46364 - DNA, 6 bp, Unknown
  misc_feature (1)..( 6): Matrix.001 file - promoters60/1034119
taaaaa

SEQ ID NO: 46365 - DNA, 6 bp, Unknown
  misc_feature (1)..( 6): Matrix.001 file - promoters60/1034119
tataaa

SEQ ID NO: 46366 - DNA, 9 bp, Unknown
  misc_feature (1)..( 9): Matrix.001 file - promoters60/1034137
ttaaaaaaa

SEQ ID NO: 46367 - DNA, 10 bp, Unknown
  misc_feature (1)..( 10): Matrix.001 file - promoters60/1034137
acaaatggaa

SEQ ID NO: 46368 - DNA, 28 bp, Unknown
  misc_feature (1)..( 28): Matrix.001 file - promoters60/1034137
aagcctatataaaaggctacaagcatga

SEQ ID NO: 46369 - DNA, 8 bp, Unknown
  misc_feature (1)..( 8): Matrix.001 file - promoters60/1034145
taataagt

SEQ ID NO: 46370 - DNA, 6 bp, Unknown
  misc_feature (1)..( 6): Matrix.001 file - promoters60/1034145
atatcc

SEQ ID NO: 46371 - DNA, 8 bp, Unknown
  misc_feature (1)..( 8): Matrix.001 file - promoters60/1034145
tctatata

SEQ ID NO: 46372 - DNA, 7 bp, Unknown
  misc_feature (1)..( 7): Matrix.001 file - promoters60/1034145
aaaaaat

SEQ ID NO: 46373 - DNA, 9 bp, Unknown
  misc_feature (1)..( 9): Matrix.001 file - promoters60/1034145
aaagagagt

SEQ ID NO: 46374 - DNA, 6 bp, Unknown
  misc_feature (1)..( 6): Matrix.001 file - promoters60/1034145
ctttat

SEQ ID NO: 46375 - DNA, 10 bp, Unknown
  misc_feature (1)..( 10): Matrix.001 file - promoters60/1034145
ctaatatgaa

SEQ ID NO: 46376 - DNA, 7 bp, Unknown
  misc_feature (1)..( 7): Matrix.001 file - promoters60/1034145
tctagca

SEQ ID NO: 46377 - DNA, 7 bp, Unknown
  misc_feature (1)..( 7): Matrix.001 file - promoters60/1034145
aaaagag

SEQ ID NO: 46378 - DNA, 6 bp, Unknown
  misc_feature (1)..( 6): Matrix.001 file - promoters60/1034145
agcctt

SEQ ID NO: 46379 - DNA, 7 bp, Unknown
  misc_feature (1)..( 7): Matrix.001 file - promoters60/1034145
gagcaaa

SEQ ID NO: 46380 - DNA, 7 bp, Unknown
  misc_feature (1)..( 7): Matrix.001 file - promoters60/1034145
ttgttgt

SEQ ID NO: 46381 - DNA, 9 bp, Unknown
  misc_feature (1)..( 9): Matrix.001 file - promoters60/1034145
ttgaatttt

SEQ ID NO: 46382 - DNA, 6 bp, Unknown
  misc_feature (1)..( 6): Matrix.001 file - promoters60/1034145
ttttga

SEQ ID NO: 46383 - DNA, 8 bp, Unknown
  misc_feature (1)..( 8): Matrix.001 file - promoters60/1034145
aagagatt

SEQ ID NO: 46384 - DNA, 6 bp, Unknown
  misc_feature (1)..( 6): Matrix.001 file - promoters60/1034145
taaaaa

SEQ ID NO: 46385 - DNA, 10 bp, Unknown
  misc_feature (1)..( 10): Matrix.001 file - promoters60/1034306
taaataaatt

SEQ ID NO: 46386 - DNA, 9 bp, Unknown
  misc_feature (1)..( 9): Matrix.001 file - promoters60/1034306
taaataaaa

SEQ ID NO: 46387 - DNA, 12 bp, Unknown
  misc_feature (1)..( 12): Matrix.001 file - promoters60/1034306
attttttaatat

SEQ ID NO: 46388 - DNA, 9 bp, Unknown
  misc_feature (1)..( 9): Matrix.001 file - promoters60/1034306
aacataaaa

SEQ ID NO: 46389 - DNA, 6 bp, Unknown
  misc_feature (1)..( 6): Matrix.001 file - promoters60/1034306
acattt

SEQ ID NO: 46390 - DNA, 11 bp, Unknown
  misc_feature (1)..( 11): Matrix.001 file - promoters60/1034306
tataatatgaa

SEQ ID NO: 46391 - DNA, 9 bp, Unknown
  misc_feature (1)..( 9): Matrix.001 file - promoters60/1034306
gttagatat

SEQ ID NO: 46392 - DNA, 9 bp, Unknown
  misc_feature (1)..( 9): Matrix.001 file - promoters60/1034322
tataaatat

SEQ ID NO: 46393 - DNA, 10 bp, Unknown
  misc_feature (1)..( 10): Matrix.001 file - promoters60/1034349
atcaaaaaaa

SEQ ID NO: 46394 - DNA, 9 bp, Unknown
  misc_feature (1)..( 9): Matrix.001 file - promoters60/1034349
tatatttaa

SEQ ID NO: 46395 - DNA, 10 bp, Unknown
  misc_feature (1)..( 10): Matrix.001 file - promoters60/1034349
tatataaata

SEQ ID NO: 46396 - DNA, 10 bp, Unknown
  misc_feature (1)..( 10): Matrix.001 file - promoters60/1034349
atcaacaaaa

SEQ ID NO: 46397 - DNA, 10 bp, Unknown
  misc_feature (1)..( 10): Matrix.001 file - promoters60/1034353
ataatagaca

SEQ ID NO: 46398 - DNA, 9 bp, Unknown
  misc_feature (1)..( 9): Matrix.001 file - promoters60/1034497
agattttct

SEQ ID NO: 46399 - DNA, 14 bp, Unknown
  misc_feature (1)..( 14): Matrix.001 file - promoters60/1034497
gacaatattttatt

SEQ ID NO: 46400 - DNA, 10 bp, Unknown
  misc_feature (1)..( 10): Matrix.001 file - promoters60/1034497
tattttattt

SEQ ID NO: 46401 - DNA, 9 bp, Unknown
  misc_feature (1)..( 9): Matrix.001 file - promoters60/1034497
tttaaatag

SEQ ID NO: 46402 - DNA, 12 bp, Unknown
  misc_feature (1)..( 12): Matrix.001 file - promoters60/1034497
atttaatcgatt

SEQ ID NO: 46403 - DNA, 8 bp, Unknown
  misc_feature (1)..( 8): Matrix.001 file - promoters60/1034497
tattacca

SEQ ID NO: 46404 - DNA, 11 bp, Unknown
  misc_feature (1)..( 11): Matrix.001 file - promoters60/1034497
atttatttgtg

SEQ ID NO: 46405 - DNA, 8 bp, Unknown
  misc_feature (1)..( 8): Matrix.001 file - promoters60/1034497
atgtacta

SEQ ID NO: 46406 - DNA, 9 bp, Unknown
  misc_feature (1)..( 9): Matrix.001 file - promoters60/1034497
accaagtag

SEQ ID NO: 46407 - DNA, 11 bp, Unknown
  misc_feature (1)..( 11): Matrix.001 file - promoters60/1034497
atttattagtg

SEQ ID NO: 46408 - DNA, 10 bp, Unknown
  misc_feature (1)..( 10): Matrix.001 file - promoters60/1034497
attcaattct

SEQ ID NO: 46409 - DNA, 10 bp, Unknown
  misc_feature (1)..( 10): Matrix.001 file - promoters60/1034497
ttatattttc

SEQ ID NO: 46410 - DNA, 9 bp, Unknown
  misc_feature (1)..( 9): Matrix.001 file - promoters60/1034652
caaaaaaaa

SEQ ID NO: 46411 - DNA, 6 bp, Unknown
  misc_feature (1)..( 6): Matrix.001 file - promoters60/1034692
ttactt

SEQ ID NO: 46412 - DNA, 9 bp, Unknown
  misc_feature (1)..( 9): Matrix.001 file - promoters60/1034692
aaaatcaac

SEQ ID NO: 46413 - DNA, 8 bp, Unknown
  misc_feature (1)..( 8): Matrix.001 file - promoters60/1034692
aaaaggaa

SEQ ID NO: 46414 - DNA, 9 bp, Unknown
  misc_feature (1)..( 9): Matrix.001 file - promoters60/1034715
tgtcagatg

SEQ ID NO: 46415 - DNA, 6 bp, Unknown
  misc_feature (1)..( 6): Matrix.001 file - promoters60/1034715
tagttt

SEQ ID NO: 46416 - DNA, 7 bp, Unknown
  misc_feature (1)..( 7): Matrix.001 file - promoters60/1034715
tagatca

SEQ ID NO: 46417 - DNA, 6 bp, Unknown
  misc_feature (1)..( 6): Matrix.001 file - promoters60/1034715
ccgtga

SEQ ID NO: 46418 - DNA, 7 bp, Unknown
  misc_feature (1)..( 7): Matrix.001 file - promoters60/1034715
tcttctg

SEQ ID NO: 46419 - DNA, 6 bp, Unknown
  misc_feature (1)..( 6): Matrix.001 file - promoters60/1034715
catttt

SEQ ID NO: 46420 - DNA, 9 bp, Unknown
  misc_feature (1)..( 9): Matrix.001 file - promoters60/1034715
tttacagat

SEQ ID NO: 46421 - DNA, 7 bp, Unknown
  misc_feature (1)..( 7): Matrix.001 file - promoters60/1034715
cagggaa

SEQ ID NO: 46422 - DNA, 9 bp, Unknown
  misc_feature (1)..( 9): Matrix.001 file - promoters60/1034810
aacaaggca

SEQ ID NO: 46423 - DNA, 7 bp, Unknown
  misc_feature (1)..( 7): Matrix.001 file - promoters60/1034810
gagtgtt

SEQ ID NO: 46424 - DNA, 6 bp, Unknown
  misc_feature (1)..( 6): Matrix.001 file - promoters60/1034810
ggaagc

SEQ ID NO: 46425 - DNA, 7 bp, Unknown
  misc_feature (1)..( 7): Matrix.001 file - promoters60/1034810
aaaagtg

SEQ ID NO: 46426 - DNA, 6 bp, Unknown
  misc_feature (1)..( 6): Matrix.001 file - promoters60/1034810
atacac

SEQ ID NO: 46427 - DNA, 9 bp, Unknown
  misc_feature (1)..( 9): Matrix.001 file - promoters60/1034810
cattaactt

SEQ ID NO: 46428 - DNA, 8 bp, Unknown
  misc_feature (1)..( 8): Matrix.001 file - promoters60/1034810
gctgaact

SEQ ID NO: 46429 - DNA, 6 bp, Unknown
  misc_feature (1)..( 6): Matrix.001 file - promoters60/1034810
cttagg

SEQ ID NO: 46430 - DNA, 6 bp, Unknown
  misc_feature (1)..( 6): Matrix.001 file - promoters60/1034810
tcttga

SEQ ID NO: 46431 - DNA, 8 bp, Unknown
  misc_feature (1)..( 8): Matrix.001 file - promoters60/1034810
gttcattg

SEQ ID NO: 46432 - DNA, 6 bp, Unknown
  misc_feature (1)..( 6): Matrix.001 file - promoters60/1034810
ggcttg

SEQ ID NO: 46433 - DNA, 10 bp, Unknown
  misc_feature (1)..( 10): Matrix.001 file - promoters60/1034837
tcaaaaaaaa

SEQ ID NO: 46434 - DNA, 12 bp, Unknown
  misc_feature (1)..( 12): Matrix.001 file - promoters60/1034837
aaacaatttaca

SEQ ID NO: 46435 - DNA, 12 bp, Unknown
  misc_feature (1)..( 12): Matrix.001 file - promoters60/1034837
ttaaaaacattt

SEQ ID NO: 46436 - DNA, 8 bp, Unknown
  misc_feature (1)..( 8): Matrix.001 file - promoters60/1034837
attaaatt

SEQ ID NO: 46437 - DNA, 10 bp, Unknown
  misc_feature (1)..( 10): Matrix.001 file - promoters60/1034870
agagcaatga

SEQ ID NO: 46438 - DNA, 8 bp, Unknown
  misc_feature (1)..( 8): Matrix.001 file - promoters60/1034962
attttttt

SEQ ID NO: 46439 - DNA, 7 bp, Unknown
  misc_feature (1)..( 7): Matrix.001 file - promoters60/1034962
aatatta

SEQ ID NO: 46440 - DNA, 7 bp, Unknown
  misc_feature (1)..( 7): Matrix.001 file - promoters60/1034962
aatgaaa

SEQ ID NO: 46441 - DNA, 9 bp, Unknown
  misc_feature (1)..( 9): Matrix.001 file - promoters60/1034962
caatcattt

SEQ ID NO: 46442 - DNA, 6 bp, Unknown
  misc_feature (1)..( 6): Matrix.001 file - promoters60/1034962
gattta

SEQ ID NO: 46443 - DNA, 7 bp, Unknown
  misc_feature (1)..( 7): Matrix.001 file - promoters60/1034962
agaacat

SEQ ID NO: 46444 - DNA, 8 bp, Unknown
  misc_feature (1)..( 8): Matrix.001 file - promoters60/1034962
taatccac

SEQ ID NO: 46445 - DNA, 11 bp, Unknown
  misc_feature (1)..( 11): Matrix.001 file - promoters60/1034962
tctgataacaa

SEQ ID NO: 46446 - DNA, 6 bp, Unknown
  misc_feature (1)..( 6): Matrix.001 file - promoters60/1034962
tcaatt

SEQ ID NO: 46447 - DNA, 7 bp, Unknown
  misc_feature (1)..( 7): Matrix.001 file - promoters60/1034962
aataaat

SEQ ID NO: 46448 - DNA, 8 bp, Unknown
  misc_feature (1)..( 8): Matrix.002 file - promoters60/1034962
tctaggga

SEQ ID NO: 46449 - DNA, 10 bp, Unknown
  misc_feature (1)..( 10): Matrix.002 file - promoters60/1034962
aatttaaaag

SEQ ID NO: 46450 - DNA, 7 bp, Unknown
  misc_feature (1)..( 7): Matrix.002 file - promoters60/1034962
ttcggtt

SEQ ID NO: 46451 - DNA, 7 bp, Unknown
  misc_feature (1)..( 7): Matrix.002 file - promoters60/1034962
gaagaga

SEQ ID NO: 46452 - DNA, 7 bp, Unknown
  misc_feature (1)..( 7): Matrix.002 file - promoters60/1034962
tatttta

SEQ ID NO: 46453 - DNA, 7 bp, Unknown
  misc_feature (1)..( 7): Matrix.002 file - promoters60/1034962
tttagaa

SEQ ID NO: 46454 - DNA, 7 bp, Unknown
  misc_feature (1)..( 7): Matrix.002 file - promoters60/1034962
cttcctc

SEQ ID NO: 46455 - DNA, 7 bp, Unknown
  misc_feature (1)..( 7): Matrix.002 file - promoters60/1035027
tttatat

SEQ ID NO: 46456 - DNA, 7 bp, Unknown
  misc_feature (1)..( 7): Matrix.002 file - promoters60/1035027
gtaaata

SEQ ID NO: 46457 - DNA, 6 bp, Unknown
  misc_feature (1)..( 6): Matrix.002 file - promoters60/1035027
atatat

SEQ ID NO: 46458 - DNA, 8 bp, Unknown
  misc_feature (1)..( 8): Matrix.002 file - promoters60/1035027
aatataca

SEQ ID NO: 46459 - DNA, 7 bp, Unknown
  misc_feature (1)..( 7): Matrix.002 file - promoters60/1035027
aaagaaa

SEQ ID NO: 46460 - DNA, 12 bp, Unknown
  misc_feature (1)..( 12): Matrix.002 file - promoters60/1035027
aattatatttta

SEQ ID NO: 46461 - DNA, 6 bp, Unknown
  misc_feature (1)..( 6): Matrix.002 file - promoters60/1035027
tttcct

SEQ ID NO: 46462 - DNA, 6 bp, Unknown
  misc_feature (1)..( 6): Matrix.002 file - promoters60/1035027
caaact

SEQ ID NO: 46463 - DNA, 6 bp, Unknown
  misc_feature (1)..( 6): Matrix.002 file - promoters60/1035027
ctatac

SEQ ID NO: 46464 - DNA, 6 bp, Unknown
  misc_feature (1)..( 6): Matrix.002 file - promoters60/1035027
tttgtt

SEQ ID NO: 46465 - DNA, 7 bp, Unknown
  misc_feature (1)..( 7): Matrix.002 file - promoters60/1035027
aatagaa

SEQ ID NO: 46466 - DNA, 7 bp, Unknown
  misc_feature (1)..( 7): Matrix.002 file - promoters60/1035027
aaataat

SEQ ID NO: 46467 - DNA, 7 bp, Unknown
  misc_feature (1)..( 7): Matrix.002 file - promoters60/1035027
aatcaat

SEQ ID NO: 46468 - DNA, 8 bp, Unknown
  misc_feature (1)..( 8): Matrix.002 file - promoters60/1035027
aactaatc

SEQ ID NO: 46469 - DNA, 13 bp, Unknown
  misc_feature (1)..( 13): Matrix.002 file - promoters60/1035027
ctttcactttttt

SEQ ID NO: 46470 - DNA, 9 bp, Unknown
  misc_feature (1)..( 9): Matrix.002 file - promoters60/1035027
attaaaaaa

SEQ ID NO: 46471 - DNA, 15 bp, Unknown
  misc_feature (1)..( 15): Matrix.002 file - promoters60/1035027
aaaaagaagaaaatg

SEQ ID NO: 46472 - DNA, 7 bp, Unknown
  misc_feature (1)..( 7): Matrix.002 file - promoters60/1035027
tataaac

SEQ ID NO: 46473 - DNA, 6 bp, Unknown
  misc_feature (1)..( 6): Matrix.002 file - promoters60/1035027
agtatt

SEQ ID NO: 46474 - DNA, 6 bp, Unknown
  misc_feature (1)..( 6): Matrix.002 file - promoters60/1035027
tattta

SEQ ID NO: 46475 - DNA, 6 bp, Unknown
  misc_feature (1)..( 6): Matrix.002 file - promoters60/1035027
aaataa

SEQ ID NO: 46476 - DNA, 9 bp, Unknown
  misc_feature (1)..( 9): Matrix.002 file - promoters60/1035027
gaaaacagt

SEQ ID NO: 46477 - DNA, 13 bp, Unknown
  misc_feature (1)..( 13): Matrix.002 file - promoters60/1035083
caatatttgtatt

SEQ ID NO: 46478 - DNA, 13 bp, Unknown
  misc_feature (1)..( 13): Matrix.002 file - promoters60/1035083
atattttatgaat

SEQ ID NO: 46479 - DNA, 14 bp, Unknown
  misc_feature (1)..( 14): Matrix.002 file - promoters60/1035083
taaattttttataa

SEQ ID NO: 46480 - DNA, 9 bp, Unknown
  misc_feature (1)..( 9): Matrix.002 file - promoters60/1035083
tataaataa

SEQ ID NO: 46481 - DNA, 10 bp, Unknown
  misc_feature (1)..( 10): Matrix.002 file - promoters60/1035083
tataaaaaaa

SEQ ID NO: 46482 - DNA, 10 bp, Unknown
  misc_feature (1)..( 10): Matrix.002 file - promoters60/1035083
caatatttta

SEQ ID NO: 46483 - DNA, 7 bp, Unknown
  misc_feature (1)..( 7): Matrix.002 file - promoters60/1035083
tattata

SEQ ID NO: 46484 - DNA, 12 bp, Unknown
  misc_feature (1)..( 12): Matrix.002 file - promoters60/1035083
gttataccacaa

SEQ ID NO: 46485 - DNA, 7 bp, Unknown
  misc_feature (1)..( 7): Matrix.002 file - promoters60/1035097
aaaataa

SEQ ID NO: 46486 - DNA, 8 bp, Unknown
  misc_feature (1)..( 8): Matrix.002 file - promoters60/1035097
gaaaaaat

SEQ ID NO: 46487 - DNA, 9 bp, Unknown
  misc_feature (1)..( 9): Matrix.002 file - promoters60/1035117
tattttttg

SEQ ID NO: 46488 - DNA, 9 bp, Unknown
  misc_feature (1)..( 9): Matrix.002 file - promoters60/1035117
tattcttca

SEQ ID NO: 46489 - DNA, 7 bp, Unknown
  misc_feature (1)..( 7): Matrix.002 file - promoters60/1035117
aaactct

SEQ ID NO: 46490 - DNA, 9 bp, Unknown
  misc_feature (1)..( 9): Matrix.002 file - promoters60/1035117
ctttgttat

SEQ ID NO: 46491 - DNA, 6 bp, Unknown
  misc_feature (1)..( 6): Matrix.002 file - promoters60/1035117
tataca

SEQ ID NO: 46492 - DNA, 10 bp, Unknown
  misc_feature (1)..( 10): Matrix.002 file - promoters60/1035117
tctatagaaa

SEQ ID NO: 46493 - DNA, 6 bp, Unknown
  misc_feature (1)..( 6): Matrix.002 file - promoters60/1035117
aaaact

SEQ ID NO: 46494 - DNA, 6 bp, Unknown
  misc_feature (1)..( 6): Matrix.002 file - promoters60/1035117
ctttta

SEQ ID NO: 46495 - DNA, 8 bp, Unknown
  misc_feature (1)..( 8): Matrix.002 file - promoters60/1035117
atcaaaaa

SEQ ID NO: 46496 - DNA, 8 bp, Unknown
  misc_feature (1)..( 8): Matrix.002 file - promoters60/1035117
ttaaagtt

SEQ ID NO: 46497 - DNA, 11 bp, Unknown
  misc_feature (1)..( 11): Matrix.002 file - promoters60/1035117
aaacaacaaat

SEQ ID NO: 46498 - DNA, 7 bp, Unknown
  misc_feature (1)..( 7): Matrix.002 file - promoters60/1035117
ctattta

SEQ ID NO: 46499 - DNA, 8 bp, Unknown
  misc_feature (1)..( 8): Matrix.002 file - promoters60/1035117
gatatgtc

SEQ ID NO: 46500 - DNA, 11 bp, Unknown
  misc_feature (1)..( 11): Matrix.002 file - promoters60/1035117
tttatttaatt

SEQ ID NO: 46501 - DNA, 8 bp, Unknown
  misc_feature (1)..( 8): Matrix.002 file - promoters60/1035117
tataacaa

SEQ ID NO: 46502 - DNA, 6 bp, Unknown
  misc_feature (1)..( 6): Matrix.002 file - promoters60/1035117
aaaatc

SEQ ID NO: 46503 - DNA, 8 bp, Unknown
  misc_feature (1)..( 8): Matrix.002 file - promoters60/1035117
ttacatat

SEQ ID NO: 46504 - DNA, 7 bp, Unknown
  misc_feature (1)..( 7): Matrix.002 file - promoters60/1035117
acgattc

SEQ ID NO: 46505 - DNA, 8 bp, Unknown
  misc_feature (1)..( 8): Matrix.002 file - promoters60/1035160
attgattt

SEQ ID NO: 46506 - DNA, 10 bp, Unknown
  misc_feature (1)..( 10): Matrix.002 file - promoters60/1035160
atttgaggat

SEQ ID NO: 46507 - DNA, 9 bp, Unknown
  misc_feature (1)..( 9): Matrix.002 file - promoters60/1035160
tttgaacat

SEQ ID NO: 46508 - DNA, 10 bp, Unknown
  misc_feature (1)..( 10): Matrix.002 file - promoters60/1035160
aaaacacgtg

SEQ ID NO: 46509 - DNA, 7 bp, Unknown
  misc_feature (1)..( 7): Matrix.002 file - promoters60/1035160
tctatat

SEQ ID NO: 46510 - DNA, 7 bp, Unknown
  misc_feature (1)..( 7): Matrix.002 file - promoters60/1035160
caacgaa

SEQ ID NO: 46511 - DNA, 9 bp, Unknown
  misc_feature (1)..( 9): Matrix.002 file - promoters60/1035160
gaaaacagg

SEQ ID NO: 46512 - DNA, 8 bp, Unknown
  misc_feature (1)..( 8): Matrix.002 file - promoters60/1035172
ctataaaa

SEQ ID NO: 46513 - DNA, 8 bp, Unknown
  misc_feature (1)..( 8): Matrix.002 file - promoters60/1035172
aaaaataa

SEQ ID NO: 46514 - DNA, 10 bp, Unknown
  misc_feature (1)..( 10): Matrix.002 file - promoters60/1035176
aatataaaaa

SEQ ID NO: 46515 - DNA, 9 bp, Unknown
  misc_feature (1)..( 9): Matrix.002 file - promoters60/1035176
cctataaat

SEQ ID NO: 46516 - DNA, 10 bp, Unknown
  misc_feature (1)..( 10): Matrix.002 file - promoters60/1035176
ttaaaaaaag

SEQ ID NO: 46517 - DNA, 8 bp, Unknown
  misc_feature (1)..( 8): Matrix.002 file - promoters60/1035176
taaaaaaa

SEQ ID NO: 46518 - DNA, 9 bp, Unknown
  misc_feature (1)..( 9): Matrix.002 file - promoters60/1035267
taaaataaa

SEQ ID NO: 46519 - DNA, 10 bp, Unknown
  misc_feature (1)..( 10): Matrix.002 file - promoters60/1035267
aatttgtcta

SEQ ID NO: 46520 - DNA, 7 bp, Unknown
  misc_feature (1)..( 7): Matrix.002 file - promoters60/1035306
tgtagtt

SEQ ID NO: 46521 - DNA, 6 bp, Unknown
  misc_feature (1)..( 6): Matrix.002 file - promoters60/1035306
cgtaaa

SEQ ID NO: 46522 - DNA, 8 bp, Unknown
  misc_feature (1)..( 8): Matrix.002 file - promoters60/1035306
taaaacaa

SEQ ID NO: 46523 - DNA, 11 bp, Unknown
  misc_feature (1)..( 11): Matrix.002 file - promoters60/1035306
caaataatatt

SEQ ID NO: 46524 - DNA, 6 bp, Unknown
  misc_feature (1)..( 6): Matrix.002 file - promoters60/1035306
atattt

SEQ ID NO: 46525 - DNA, 6 bp, Unknown
  misc_feature (1)..( 6): Matrix.002 file - promoters60/1035306
ttgtat

SEQ ID NO: 46526 - DNA, 7 bp, Unknown
  misc_feature (1)..( 7): Matrix.002 file - promoters60/1035306
ataataa

SEQ ID NO: 46527 - DNA, 7 bp, Unknown
  misc_feature (1)..( 7): Matrix.002 file - promoters60/1035306
tatatat

SEQ ID NO: 46528 - DNA, 7 bp, Unknown
  misc_feature (1)..( 7): Matrix.002 file - promoters60/1035306
tgtaaaa

SEQ ID NO: 46529 - DNA, 6 bp, Unknown
  misc_feature (1)..( 6): Matrix.002 file - promoters60/1035306
gtagaa

SEQ ID NO: 46530 - DNA, 8 bp, Unknown
  misc_feature (1)..( 8): Matrix.002 file - promoters60/1035306
aacatgca

SEQ ID NO: 46531 - DNA, 10 bp, Unknown
  misc_feature (1)..( 10): Matrix.002 file - promoters60/1035306
ctttaaaaaa

SEQ ID NO: 46532 - DNA, 9 bp, Unknown
  misc_feature (1)..( 9): Matrix.002 file - promoters60/1035306
tattaaaat

SEQ ID NO: 46533 - DNA, 7 bp, Unknown
  misc_feature (1)..( 7): Matrix.002 file - promoters60/1035306
atcaaat

SEQ ID NO: 46534 - DNA, 6 bp, Unknown
  misc_feature (1)..( 6): Matrix.002 file - promoters60/1035306
aattat

SEQ ID NO: 46535 - DNA, 11 bp, Unknown
  misc_feature (1)..( 11): Matrix.002 file - promoters60/1035306
atttataaaat

SEQ ID NO: 46536 - DNA, 9 bp, Unknown
  misc_feature (1)..( 9): Matrix.002 file - promoters60/1035306
aaaagttat

SEQ ID NO: 46537 - DNA, 12 bp, Unknown
  misc_feature (1)..( 12): Matrix.002 file - promoters60/1035312
aaaatcaaaaat

SEQ ID NO: 46538 - DNA, 10 bp, Unknown
  misc_feature (1)..( 10): Matrix.002 file - promoters60/1035312
aaatgttttt

SEQ ID NO: 46539 - DNA, 6 bp, Unknown
  misc_feature (1)..( 6): Matrix.002 file - promoters60/1035323
acaaaa

SEQ ID NO: 46540 - DNA, 6 bp, Unknown
  misc_feature (1)..( 6): Matrix.002 file - promoters60/1035323
ttgaaa

SEQ ID NO: 46541 - DNA, 7 bp, Unknown
  misc_feature (1)..( 7): Matrix.002 file - promoters60/1035323
ttccttt

SEQ ID NO: 46542 - DNA, 8 bp, Unknown
  misc_feature (1)..( 8): Matrix.002 file - promoters60/1035323
tttatttt

SEQ ID NO: 46543 - DNA, 7 bp, Unknown
  misc_feature (1)..( 7): Matrix.002 file - promoters60/1035323
ttcgtct

SEQ ID NO: 46544 - DNA, 6 bp, Unknown
  misc_feature (1)..( 6): Matrix.002 file - promoters60/1035323
tgatca

SEQ ID NO: 46545 - DNA, 9 bp, Unknown
  misc_feature (1)..( 9): Matrix.002 file - promoters60/1035323
tgaacaact

SEQ ID NO: 46546 - DNA, 12 bp, Unknown
  misc_feature (1)..( 12): Matrix.002 file - promoters60/1035323
tttatgaaattt

SEQ ID NO: 46547 - DNA, 8 bp, Unknown
  misc_feature (1)..( 8): Matrix.002 file - promoters60/1035323
aaactgtt

SEQ ID NO: 46548 - DNA, 6 bp, Unknown
  misc_feature (1)..( 6): Matrix.002 file - promoters60/1035323
taataa

SEQ ID NO: 46549 - DNA, 6 bp, Unknown
  misc_feature (1)..( 6): Matrix.002 file - promoters60/1035323
ttttct

SEQ ID NO: 46550 - DNA, 7 bp, Unknown
  misc_feature (1)..( 7): Matrix.002 file - promoters60/1035323
atcgtca

SEQ ID NO: 46551 - DNA, 7 bp, Unknown
  misc_feature (1)..( 7): Matrix.002 file - promoters60/1035323
aaaccgg

SEQ ID NO: 46552 - DNA, 9 bp, Unknown
  misc_feature (1)..( 9): Matrix.002 file - promoters60/1035323
cttttttcc

SEQ ID NO: 46553 - DNA, 6 bp, Unknown
  misc_feature (1)..( 6): Matrix.002 file - promoters60/1035323
aatttg

SEQ ID NO: 46554 - DNA, 7 bp, Unknown
  misc_feature (1)..( 7): Matrix.002 file - promoters60/1035323
ttgataa

SEQ ID NO: 46555 - DNA, 6 bp, Unknown
  misc_feature (1)..( 6): Matrix.002 file - promoters60/1035323
gtatat

SEQ ID NO: 46556 - DNA, 6 bp, Unknown
  misc_feature (1)..( 6): Matrix.002 file - promoters60/1035373
taaagg

SEQ ID NO: 46557 - DNA, 7 bp, Unknown
  misc_feature (1)..( 7): Matrix.002 file - promoters60/1035373
ctacaaa

SEQ ID NO: 46558 - DNA, 7 bp, Unknown
  misc_feature (1)..( 7): Matrix.002 file - promoters60/1035373
aaacgct

SEQ ID NO: 46559 - DNA, 7 bp, Unknown
  misc_feature (1)..( 7): Matrix.002 file - promoters60/1035373
attgaga

SEQ ID NO: 46560 - DNA, 7 bp, Unknown
  misc_feature (1)..( 7): Matrix.002 file - promoters60/1035373
gatacag

SEQ ID NO: 46561 - DNA, 6 bp, Unknown
  misc_feature (1)..( 6): Matrix.002 file - promoters60/1035373
attcca

SEQ ID NO: 46562 - DNA, 7 bp, Unknown
  misc_feature (1)..( 7): Matrix.002 file - promoters60/1035373
aaacctg

SEQ ID NO: 46563 - DNA, 6 bp, Unknown
  misc_feature (1)..( 6): Matrix.002 file - promoters60/1035373
tttgac

SEQ ID NO: 46564 - DNA, 6 bp, Unknown
  misc_feature (1)..( 6): Matrix.002 file - promoters60/1035373
acggta

SEQ ID NO: 46565 - DNA, 7 bp, Unknown
  misc_feature (1)..( 7): Matrix.002 file - promoters60/1035373
tcaagtt

SEQ ID NO: 46566 - DNA, 9 bp, Unknown
  misc_feature (1)..( 9): Matrix.002 file - promoters60/1035373
atttaattt

SEQ ID NO: 46567 - DNA, 8 bp, Unknown
  misc_feature (1)..( 8): Matrix.002 file - promoters60/1035507
caaaaagt

SEQ ID NO: 46568 - DNA, 9 bp, Unknown
  misc_feature (1)..( 9): Matrix.002 file - promoters60/1035507
tttaaattt

SEQ ID NO: 46569 - DNA, 9 bp, Unknown
  misc_feature (1)..( 9): Matrix.002 file - promoters60/1035507
ttcaatttg

SEQ ID NO: 46570 - DNA, 12 bp, Unknown
  misc_feature (1)..( 12): Matrix.002 file - promoters60/1035507
tctttgtttatt

SEQ ID NO: 46571 - DNA, 7 bp, Unknown
  misc_feature (1)..( 7): Matrix.002 file - promoters60/1035507
cataaaa

SEQ ID NO: 46572 - DNA, 7 bp, Unknown
  misc_feature (1)..( 7): Matrix.002 file - promoters60/1035623
ttagcca

SEQ ID NO: 46573 - DNA, 7 bp, Unknown
  misc_feature (1)..( 7): Matrix.002 file - promoters60/1035623
cagagac

SEQ ID NO: 46574 - DNA, 6 bp, Unknown
  misc_feature (1)..( 6): Matrix.002 file - promoters60/1035623
tttgtt

SEQ ID NO: 46575 - DNA, 6 bp, Unknown
  misc_feature (1)..( 6): Matrix.002 file - promoters60/1035623
cttctt

SEQ ID NO: 46576 - DNA, 7 bp, Unknown
  misc_feature (1)..( 7): Matrix.002 file - promoters60/1035623
ttctgga

SEQ ID NO: 46577 - DNA, 7 bp, Unknown
  misc_feature (1)..( 7): Matrix.002 file - promoters60/1035623
tgtatat

SEQ ID NO: 46578 - DNA, 8 bp, Unknown
  misc_feature (1)..( 8): Matrix.002 file - promoters60/1035623
tctggttt

SEQ ID NO: 46579 - DNA, 7 bp, Unknown
  misc_feature (1)..( 7): Matrix.002 file - promoters60/1035623
tttactt

SEQ ID NO: 46580 - DNA, 8 bp, Unknown
  misc_feature (1)..( 8): Matrix.002 file - promoters60/1035623
cttgtctc

SEQ ID NO: 46581 - DNA, 7 bp, Unknown
  misc_feature (1)..( 7): Matrix.002 file - promoters60/1035623
ttgaagc

SEQ ID NO: 46582 - DNA, 6 bp, Unknown
  misc_feature (1)..( 6): Matrix.002 file - promoters60/1035623
cctttt

SEQ ID NO: 46583 - DNA, 7 bp, Unknown
  misc_feature (1)..( 7): Matrix.002 file - promoters60/1035623
ttttttt

SEQ ID NO: 46584 - DNA, 7 bp, Unknown
  misc_feature (1)..( 7): Matrix.002 file - promoters60/1035623
ggcctat

SEQ ID NO: 46585 - DNA, 8 bp, Unknown
  misc_feature (1)..( 8): Matrix.002 file - promoters60/1035632
taataaaa

SEQ ID NO: 46586 - DNA, 6 bp, Unknown
  misc_feature (1)..( 6): Matrix.002 file - promoters60/1035632
cacaaa

SEQ ID NO: 46587 - DNA, 8 bp, Unknown
  misc_feature (1)..( 8): Matrix.002 file - promoters60/1035632
gtgttttt

SEQ ID NO: 46588 - DNA, 6 bp, Unknown
  misc_feature (1)..( 6): Matrix.002 file - promoters60/1035632
ttttct

SEQ ID NO: 46589 - DNA, 7 bp, Unknown
  misc_feature (1)..( 7): Matrix.002 file - promoters60/1035665
gtgaaat

SEQ ID NO: 46590 - DNA, 7 bp, Unknown
  misc_feature (1)..( 7): Matrix.002 file - promoters60/1035665
taaatta

SEQ ID NO: 46591 - DNA, 16 bp, Unknown
  misc_feature (1)..( 16): Matrix.002 file - promoters60/1035665
ttatttactaattttt

SEQ ID NO: 46592 - DNA, 7 bp, Unknown
  misc_feature (1)..( 7): Matrix.002 file - promoters60/1035665
catctta

SEQ ID NO: 46593 - DNA, 7 bp, Unknown
  misc_feature (1)..( 7): Matrix.002 file - promoters60/1035665
tgcattt

SEQ ID NO: 46594 - DNA, 6 bp, Unknown
  misc_feature (1)..( 6): Matrix.002 file - promoters60/1035665
ttaaaa

SEQ ID NO: 46595 - DNA, 7 bp, Unknown
  misc_feature (1)..( 7): Matrix.002 file - promoters60/1035665
aaaagta

SEQ ID NO: 46596 - DNA, 9 bp, Unknown
  misc_feature (1)..( 9): Matrix.002 file - promoters60/1035665
atcagtttt

SEQ ID NO: 46597 - DNA, 8 bp, Unknown
  misc_feature (1)..( 8): Matrix.002 file - promoters60/1035665
tgaatttt

SEQ ID NO: 46598 - DNA, 6 bp, Unknown
  misc_feature (1)..( 6): Matrix.002 file - promoters60/1035665
tttgtt

SEQ ID NO: 46599 - DNA, 8 bp, Unknown
  misc_feature (1)..( 8): Matrix.002 file - promoters60/1035665
atttcatt

SEQ ID NO: 46600 - DNA, 6 bp, Unknown
  misc_feature (1)..( 6): Matrix.002 file - promoters60/1035665
aaaaaa

SEQ ID NO: 46601 - DNA, 8 bp, Unknown
  misc_feature (1)..( 8): Matrix.002 file - promoters60/1035665
caaaaact

SEQ ID NO: 46602 - DNA, 9 bp, Unknown
  misc_feature (1)..( 9): Matrix.002 file - promoters60/1035665
ttgggcctt

SEQ ID NO: 46603 - DNA, 12 bp, Unknown
  misc_feature (1)..( 12): Matrix.002 file - promoters60/1035665
ttttctttattt

SEQ ID NO: 46604 - DNA, 8 bp, Unknown
  misc_feature (1)..( 8): Matrix.002 file - promoters60/1035665
ttaaatat

SEQ ID NO: 46605 - DNA, 6 bp, Unknown
  misc_feature (1)..( 6): Matrix.002 file - promoters60/1035665
tttaat

SEQ ID NO: 46606 - DNA, 6 bp, Unknown
  misc_feature (1)..( 6): Matrix.002 file - promoters60/1035665
ccaagt

SEQ ID NO: 46607 - DNA, 11 bp, Unknown
  misc_feature (1)..( 11): Matrix.002 file - promoters60/1035665
taaaatttgat

SEQ ID NO: 46608 - DNA, 7 bp, Unknown
  misc_feature (1)..( 7): Matrix.002 file - promoters60/1035665
aaaaagt

SEQ ID NO: 46609 - DNA, 6 bp, Unknown
  misc_feature (1)..( 6): Matrix.002 file - promoters60/1035665
caaaaa

SEQ ID NO: 46610 - DNA, 6 bp, Unknown
  misc_feature (1)..( 6): Matrix.002 file - promoters60/1035665
ttgtgt

SEQ ID NO: 46611 - DNA, 11 bp, Unknown
  misc_feature (1)..( 11): Matrix.002 file - promoters60/1035665
gtttgacatat

SEQ ID NO: 46612 - DNA, 7 bp, Unknown
  misc_feature (1)..( 7): Matrix.002 file - promoters60/1035665
ttacttc

SEQ ID NO: 46613 - DNA, 6 bp, Unknown
  misc_feature (1)..( 6): Matrix.002 file - promoters60/1035665
tttgat

SEQ ID NO: 46614 - DNA, 9 bp, Unknown
  misc_feature (1)..( 9): Matrix.002 file - promoters60/1375217
tttacaaaa

SEQ ID NO: 46615 - DNA, 9 bp, Unknown
  misc_feature (1)..( 9): Matrix.002 file - promoters60/1375217
taaaaattc

SEQ ID NO: 46616 - DNA, 6 bp, Unknown
  misc_feature (1)..( 6): Matrix.002 file - promoters60/1375217
aaaatt

SEQ ID NO: 46617 - DNA, 6 bp, Unknown
  misc_feature (1)..( 6): Matrix.002 file - promoters60/1375217
aataaa

SEQ ID NO: 46618 - DNA, 9 bp, Unknown
  misc_feature (1)..( 9): Matrix.002 file - promoters60/1375217
aaaacaaat

SEQ ID NO: 46619 - DNA, 10 bp, Unknown
  misc_feature (1)..( 10): Matrix.002 file - promoters60/1375217
atattattaa

SEQ ID NO: 46620 - DNA, 9 bp, Unknown
  misc_feature (1)..( 9): Matrix.002 file - promoters60/1375217
ctttttttt

SEQ ID NO: 46621 - DNA, 9 bp, Unknown
  misc_feature (1)..( 9): Matrix.002 file - promoters60/1375217
attaaaaaa

SEQ ID NO: 46622 - DNA, 13 bp, Unknown
  misc_feature (1)..( 13): Matrix.002 file - promoters60/1375217
tcctttatatata

SEQ ID NO: 46623 - DNA, 11 bp, Unknown
  misc_feature (1)..( 11): Matrix.002 file - promoters60/1375217
atttaaaaaca

SEQ ID NO: 46624 - DNA, 8 bp, Unknown
  misc_feature (1)..( 8): Matrix.002 file - promoters60/1375217
ttaatatt

SEQ ID NO: 46625 - DNA, 7 bp, Unknown
  misc_feature (1)..( 7): Matrix.002 file - promoters60/1375217
aaatttt

SEQ ID NO: 46626 - DNA, 5 bp, Unknown
  misc_feature (1)..( 5): Matrix.002 file - promoters60/1375217
agtta

SEQ ID NO: 46627 - DNA, 8 bp, Unknown
  misc_feature (1)..( 8): Matrix.002 file - promoters60/1375252
ataaatag

SEQ ID NO: 46628 - DNA, 7 bp, Unknown
  misc_feature (1)..( 7): Matrix.002 file - promoters60/1375252
actgtct

SEQ ID NO: 46629 - DNA, 7 bp, Unknown
  misc_feature (1)..( 7): Matrix.002 file - promoters60/1375266
gaaacgt

SEQ ID NO: 46630 - DNA, 6 bp, Unknown
  misc_feature (1)..( 6): Matrix.002 file - promoters60/1375266
tctctc

SEQ ID NO: 46631 - DNA, 8 bp, Unknown
  misc_feature (1)..( 8): Matrix.002 file - promoters60/1375266
ccgataac

SEQ ID NO: 46632 - DNA, 6 bp, Unknown
  misc_feature (1)..( 6): Matrix.002 file - promoters60/1375266
ttgaag

SEQ ID NO: 46633 - DNA, 7 bp, Unknown
  misc_feature (1)..( 7): Matrix.002 file - promoters60/1375266
aaaaaaa

SEQ ID NO: 46634 - DNA, 7 bp, Unknown
  misc_feature (1)..( 7): Matrix.002 file - promoters60/1375266
acaaaat

SEQ ID NO: 46635 - DNA, 8 bp, Unknown
  misc_feature (1)..( 8): Matrix.002 file - promoters60/1375266
ataaaaaa

SEQ ID NO: 46636 - DNA, 9 bp, Unknown
  misc_feature (1)..( 9): Matrix.002 file - promoters60/1375266
taaataaaa

SEQ ID NO: 46637 - DNA, 7 bp, Unknown
  misc_feature (1)..( 7): Matrix.002 file - promoters60/1375266
atgatga

SEQ ID NO: 46638 - DNA, 8 bp, Unknown
  misc_feature (1)..( 8): Matrix.002 file - promoters60/1375266
attgtttt

SEQ ID NO: 46639 - DNA, 8 bp, Unknown
  misc_feature (1)..( 8): Matrix.002 file - promoters60/1375266
tgagtatt

SEQ ID NO: 46640 - DNA, 8 bp, Unknown
  misc_feature (1)..( 8): Matrix.002 file - promoters60/1375266
aagaggat

SEQ ID NO: 46641 - DNA, 10 bp, Unknown
  misc_feature (1)..( 10): Matrix.002 file - promoters60/1375266
tttatttata

SEQ ID NO: 46642 - DNA, 7 bp, Unknown
  misc_feature (1)..( 7): Matrix.002 file - promoters60/1375266
tctaaaa

SEQ ID NO: 46643 - DNA, 6 bp, Unknown
  misc_feature (1)..( 6): Matrix.002 file - promoters60/1375329
aaaaca

SEQ ID NO: 46644 - DNA, 7 bp, Unknown
  misc_feature (1)..( 7): Matrix.002 file - promoters60/1375329
atcatga

SEQ ID NO: 46645 - DNA, 6 bp, Unknown
  misc_feature (1)..( 6): Matrix.002 file - promoters60/1375329
gtttta

SEQ ID NO: 46646 - DNA, 7 bp, Unknown
  misc_feature (1)..( 7): Matrix.002 file - promoters60/1375329
tttatgt

SEQ ID NO: 46647 - DNA, 7 bp, Unknown
  misc_feature (1)..( 7): Matrix.002 file - promoters60/1375329
ttaaaac

SEQ ID NO: 46648 - DNA, 8 bp, Unknown
  misc_feature (1)..( 8): Matrix.002 file - promoters60/1375329
tctgtttg

SEQ ID NO: 46649 - DNA, 8 bp, Unknown
  misc_feature (1)..( 8): Matrix.002 file - promoters60/1375329
aaaaacat

SEQ ID NO: 46650 - DNA, 7 bp, Unknown
  misc_feature (1)..( 7): Matrix.002 file - promoters60/1375329
aaccaat

SEQ ID NO: 46651 - DNA, 6 bp, Unknown
  misc_feature (1)..( 6): Matrix.002 file - promoters60/1375329
cctata

SEQ ID NO: 46652 - DNA, 15 bp, Unknown
  misc_feature (1)..( 15): Matrix.002 file - promoters60/1375329
aaggcaggctgtcac

SEQ ID NO: 46653 - DNA, 27 bp, Unknown
  misc_feature (1)..( 27): Matrix.002 file - promoters60/1375329
tggcggaccccaacaaattatcaaatc

SEQ ID NO: 46654 - DNA, 8 bp, Unknown
  misc_feature (1)..( 8): Matrix.002 file - promoters60/1375329
aataaatt

SEQ ID NO: 46655 - DNA, 10 bp, Unknown
  misc_feature (1)..( 10): Matrix.002 file - promoters60/1375329
aaaccaatcc

SEQ ID NO: 46656 - DNA, 10 bp, Unknown
  misc_feature (1)..( 10): Matrix.002 file - promoters60/1375329
ataacaataa

SEQ ID NO: 46657 - DNA, 7 bp, Unknown
  misc_feature (1)..( 7): Matrix.002 file - promoters60/1375329
taaataa

SEQ ID NO: 46658 - DNA, 8 bp, Unknown
  misc_feature (1)..( 8): Matrix.002 file - promoters60/1375329
acaacctt

SEQ ID NO: 46659 - DNA, 6 bp, Unknown
  misc_feature (1)..( 6): Matrix.002 file - promoters60/1375329
cttaca

SEQ ID NO: 46660 - DNA, 7 bp, Unknown
  misc_feature (1)..( 7): Matrix.002 file - promoters60/1375329
ttccttt

SEQ ID NO: 46661 - DNA, 8 bp, Unknown
  misc_feature (1)..( 8): Matrix.002 file - promoters60/1375456
gcttcgtt

SEQ ID NO: 46662 - DNA, 7 bp, Unknown
  misc_feature (1)..( 7): Matrix.002 file - promoters60/1375456
aaaagca

SEQ ID NO: 46663 - DNA, 9 bp, Unknown
  misc_feature (1)..( 9): Matrix.002 file - promoters60/1375456
ttggaacaa

SEQ ID NO: 46664 - DNA, 9 bp, Unknown
  misc_feature (1)..( 9): Matrix.002 file - promoters60/1375456
agaaagaaa

SEQ ID NO: 46665 - DNA, 10 bp, Unknown
  misc_feature (1)..( 10): Matrix.002 file - promoters60/1375456
agaaaagaaa

SEQ ID NO: 46666 - DNA, 6 bp, Unknown
  misc_feature (1)..( 6): Matrix.002 file - promoters60/1375456
gaagaa

SEQ ID NO: 46667 - DNA, 6 bp, Unknown
  misc_feature (1)..( 6): Matrix.002 file - promoters60/1375456
ttctct

SEQ ID NO: 46668 - DNA, 11 bp, Unknown
  misc_feature (1)..( 11): Matrix.002 file - promoters60/1375456
gaaatataata

SEQ ID NO: 46669 - DNA, 6 bp, Unknown
  misc_feature (1)..( 6): Matrix.002 file - promoters60/1375456
agtaaa

SEQ ID NO: 46670 - DNA, 7 bp, Unknown
  misc_feature (1)..( 7): Matrix.002 file - promoters60/1375456
aatcggg

SEQ ID NO: 46671 - DNA, 7 bp, Unknown
  misc_feature (1)..( 7): Matrix.002 file - promoters60/1375456
cccacta

SEQ ID NO: 46672 - DNA, 9 bp, Unknown
  misc_feature (1)..( 9): Matrix.002 file - promoters60/1375456
aaagaaaag

SEQ ID NO: 46673 - DNA, 7 bp, Unknown
  misc_feature (1)..( 7): Matrix.002 file - promoters60/1375456
gtatata

SEQ ID NO: 46674 - DNA, 8 bp, Unknown
  misc_feature (1)..( 8): Matrix.002 file - promoters60/1375471
tttaattc

SEQ ID NO: 46675 - DNA, 8 bp, Unknown
  misc_feature (1)..( 8): Matrix.002 file - promoters60/1375471
gaatctaa

SEQ ID NO: 46676 - DNA, 7 bp, Unknown
  misc_feature (1)..( 7): Matrix.002 file - promoters60/1375471
aaaaaat

SEQ ID NO: 46677 - DNA, 13 bp, Unknown
  misc_feature (1)..( 13): Matrix.002 file - promoters60/1375471
tgataaaatttca

SEQ ID NO: 46678 - DNA, 10 bp, Unknown
  misc_feature (1)..( 10): Matrix.002 file - promoters60/1375471
caatattata

SEQ ID NO: 46679 - DNA, 8 bp, Unknown
  misc_feature (1)..( 8): Matrix.002 file - promoters60/1375474
taatgtca

SEQ ID NO: 46680 - DNA, 7 bp, Unknown
  misc_feature (1)..( 7): Matrix.002 file - promoters60/1375474
atgccat

SEQ ID NO: 46681 - DNA, 6 bp, Unknown
  misc_feature (1)..( 6): Matrix.002 file - promoters60/1375474
attagt

SEQ ID NO: 46682 - DNA, 7 bp, Unknown
  misc_feature (1)..( 7): Matrix.002 file - promoters60/1375474
tcatata

SEQ ID NO: 46683 - DNA, 10 bp, Unknown
  misc_feature (1)..( 10): Matrix.002 file - promoters60/1375474
aaacctaaat

SEQ ID NO: 46684 - DNA, 9 bp, Unknown
  misc_feature (1)..( 9): Matrix.002 file - promoters60/1375474
gtagtatta

SEQ ID NO: 46685 - DNA, 7 bp, Unknown
  misc_feature (1)..( 7): Matrix.002 file - promoters60/1375474
aatgtaa

SEQ ID NO: 46686 - DNA, 6 bp, Unknown
  misc_feature (1)..( 6): Matrix.002 file - promoters60/1375474
aaccaa

SEQ ID NO: 46687 - DNA, 10 bp, Unknown
  misc_feature (1)..( 10): Matrix.002 file - promoters60/1375474
tatcatattt

SEQ ID NO: 46688 - DNA, 8 bp, Unknown
  misc_feature (1)..( 8): Matrix.002 file - promoters60/1375474
aatacgtt

SEQ ID NO: 46689 - DNA, 10 bp, Unknown
  misc_feature (1)..( 10): Matrix.002 file - promoters60/1375474
cactttcttc

SEQ ID NO: 46690 - DNA, 6 bp, Unknown
  misc_feature (1)..( 6): Matrix.002 file - promoters60/1375474
aagttg

SEQ ID NO: 46691 - DNA, 6 bp, Unknown
  misc_feature (1)..( 6): Matrix.002 file - promoters60/1375474
cattct

SEQ ID NO: 46692 - DNA, 6 bp, Unknown
  misc_feature (1)..( 6): Matrix.002 file - promoters60/1375474
tctgga

SEQ ID NO: 46693 - DNA, 7 bp, Unknown
  misc_feature (1)..( 7): Matrix.002 file - promoters60/1375474
attgtta

SEQ ID NO: 46694 - DNA, 10 bp, Unknown
  misc_feature (1)..( 10): Matrix.002 file - promoters60/1375547
cgaaagacag

SEQ ID NO: 46695 - DNA, 11 bp, Unknown
  misc_feature (1)..( 11): Matrix.002 file - promoters60/1375547
ctttattcgat

SEQ ID NO: 46696 - DNA, 8 bp, Unknown
  misc_feature (1)..( 8): Matrix.002 file - promoters60/1375547
ataactgg

SEQ ID NO: 46697 - DNA, 7 bp, Unknown
  misc_feature (1)..( 7): Matrix.002 file - promoters60/1375547
cttattc

SEQ ID NO: 46698 - DNA, 6 bp, Unknown
  misc_feature (1)..( 6): Matrix.002 file - promoters60/1375547
ttcatc

SEQ ID NO: 46699 - DNA, 7 bp, Unknown
  misc_feature (1)..( 7): Matrix.002 file - promoters60/1375547
atttgtt

SEQ ID NO: 46700 - DNA, 6 bp, Unknown
  misc_feature (1)..( 6): Matrix.002 file - promoters60/1375547
tctcgc

SEQ ID NO: 46701 - DNA, 6 bp, Unknown
  misc_feature (1)..( 6): Matrix.002 file - promoters60/1375547
gaacat

SEQ ID NO: 46702 - DNA, 6 bp, Unknown
  misc_feature (1)..( 6): Matrix.002 file - promoters60/1375547
aagaaa

SEQ ID NO: 46703 - DNA, 6 bp, Unknown
  misc_feature (1)..( 6): Matrix.002 file - promoters60/1375547
acgccg

SEQ ID NO: 46704 - DNA, 6 bp, Unknown
  misc_feature (1)..( 6): Matrix.002 file - promoters60/1375547
gcggcg

SEQ ID NO: 46705 - DNA, 7 bp, Unknown
  misc_feature (1)..( 7): Matrix.002 file - promoters60/1375547
gttcgtt

SEQ ID NO: 46706 - DNA, 7 bp, Unknown
  misc_feature (1)..( 7): Matrix.002 file - promoters60/1375547
tttattc

SEQ ID NO: 46707 - DNA, 6 bp, Unknown
  misc_feature (1)..( 6): Matrix.002 file - promoters60/1375570
tgaaga

SEQ ID NO: 46708 - DNA, 6 bp, Unknown
  misc_feature (1)..( 6): Matrix.002 file - promoters60/1375570
tgttac

SEQ ID NO: 46709 - DNA, 7 bp, Unknown
  misc_feature (1)..( 7): Matrix.002 file - promoters60/1375570
agaagaa

SEQ ID NO: 46710 - DNA, 6 bp, Unknown
  misc_feature (1)..( 6): Matrix.002 file - promoters60/1375570
tggaag

SEQ ID NO: 46711 - DNA, 11 bp, Unknown
  misc_feature (1)..( 11): Matrix.002 file - promoters60/1375570
tgtgatgatgt

SEQ ID NO: 46712 - DNA, 10 bp, Unknown
  misc_feature (1)..( 10): Matrix.002 file - promoters60/1375570
aaatcgaacc

SEQ ID NO: 46713 - DNA, 7 bp, Unknown
  misc_feature (1)..( 7): Matrix.002 file - promoters60/1375570
tgaacaa

SEQ ID NO: 46714 - DNA, 6 bp, Unknown
  misc_feature (1)..( 6): Matrix.002 file - promoters60/1375570
tgaaag

SEQ ID NO: 46715 - DNA, 6 bp, Unknown
  misc_feature (1)..( 6): Matrix.002 file - promoters60/1375570
tttgtc

SEQ ID NO: 46716 - DNA, 7 bp, Unknown
  misc_feature (1)..( 7): Matrix.002 file - promoters60/1375570
aaggaca

SEQ ID NO: 46717 - DNA, 7 bp, Unknown
  misc_feature (1)..( 7): Matrix.002 file - promoters60/1375570
gtcaagg

SEQ ID NO: 46718 - DNA, 6 bp, Unknown
  misc_feature (1)..( 6): Matrix.002 file - promoters60/1375570
gttgga

SEQ ID NO: 46719 - DNA, 7 bp, Unknown
  misc_feature (1)..( 7): Matrix.002 file - promoters60/1375570
gagcttc

SEQ ID NO: 46720 - DNA, 8 bp, Unknown
  misc_feature (1)..( 8): Matrix.002 file - promoters60/1375615
atcatatt

SEQ ID NO: 46721 - DNA, 9 bp, Unknown
  misc_feature (1)..( 9): Matrix.002 file - promoters60/1375615
tttgtagtg

SEQ ID NO: 46722 - DNA, 8 bp, Unknown
  misc_feature (1)..( 8): Matrix.002 file - promoters60/1375615
tgatttgt

SEQ ID NO: 46723 - DNA, 6 bp, Unknown
  misc_feature (1)..( 6): Matrix.002 file - promoters60/1375615
atattt

SEQ ID NO: 46724 - DNA, 7 bp, Unknown
  misc_feature (1)..( 7): Matrix.002 file - promoters60/1375615
gtttgtt

SEQ ID NO: 46725 - DNA, 6 bp, Unknown
  misc_feature (1)..( 6): Matrix.002 file - promoters60/1375615
tgatgt

SEQ ID NO: 46726 - DNA, 8 bp, Unknown
  misc_feature (1)..( 8): Matrix.002 file - promoters60/1375615
gatttgtt

SEQ ID NO: 46727 - DNA, 7 bp, Unknown
  misc_feature (1)..( 7): Matrix.002 file - promoters60/1375615
gttttgt

SEQ ID NO: 46728 - DNA, 7 bp, Unknown
  misc_feature (1)..( 7): Matrix.002 file - promoters60/1375615
aagaaca

SEQ ID NO: 46729 - DNA, 6 bp, Unknown
  misc_feature (1)..( 6): Matrix.002 file - promoters60/1375615
tgtgat

SEQ ID NO: 46730 - DNA, 8 bp, Unknown
  misc_feature (1)..( 8): Matrix.002 file - promoters60/1375615
ataatttg

SEQ ID NO: 46731 - DNA, 8 bp, Unknown
  misc_feature (1)..( 8): Matrix.002 file - promoters60/1375615
agtatgtt

SEQ ID NO: 46732 - DNA, 6 bp, Unknown
  misc_feature (1)..( 6): Matrix.002 file - promoters60/1375615
tgtttg

SEQ ID NO: 46733 - DNA, 6 bp, Unknown
  misc_feature (1)..( 6): Matrix.002 file - promoters60/1375615
gagttt

SEQ ID NO: 46734 - DNA, 6 bp, Unknown
  misc_feature (1)..( 6): Matrix.002 file - promoters60/1375615
ctgatt

SEQ ID NO: 46735 - DNA, 6 bp, Unknown
  misc_feature (1)..( 6): Matrix.002 file - promoters60/1375615
ttagtt

SEQ ID NO: 46736 - DNA, 11 bp, Unknown
  misc_feature (1)..( 11): Matrix.002 file - promoters60/1375634
tcaattttatc

SEQ ID NO: 46737 - DNA, 7 bp, Unknown
  misc_feature (1)..( 7): Matrix.002 file - promoters60/1375634
aaatatg

SEQ ID NO: 46738 - DNA, 9 bp, Unknown
  misc_feature (1)..( 9): Matrix.002 file - promoters60/1375634
aatatgtac

SEQ ID NO: 46739 - DNA, 8 bp, Unknown
  misc_feature (1)..( 8): Matrix.002 file - promoters60/1375634
aaaacaac

SEQ ID NO: 46740 - DNA, 9 bp, Unknown
  misc_feature (1)..( 9): Matrix.002 file - promoters60/1375634
tgtatgcat

SEQ ID NO: 46741 - DNA, 10 bp, Unknown
  misc_feature (1)..( 10): Matrix.002 file - promoters60/1375634
tcaattttat

SEQ ID NO: 46742 - DNA, 10 bp, Unknown
  misc_feature (1)..( 10): Matrix.002 file - promoters60/1375634
tcaattttat

SEQ ID NO: 46743 - DNA, 9 bp, Unknown
  misc_feature (1)..( 9): Matrix.002 file - promoters60/1375634
tatttaaaa

SEQ ID NO: 46744 - DNA, 6 bp, Unknown
  misc_feature (1)..( 6): Matrix.002 file - promoters60/1375634
aaactt

SEQ ID NO: 46745 - DNA, 9 bp, Unknown
  misc_feature (1)..( 9): Matrix.002 file - promoters60/1375793
tgtttgttt

SEQ ID NO: 46746 - DNA, 7 bp, Unknown
  misc_feature (1)..( 7): Matrix.002 file - promoters60/1375957
taaacat

SEQ ID NO: 46747 - DNA, 15 bp, Unknown
  misc_feature (1)..( 15): Matrix.002 file - promoters60/1375957
aaacttaactgataa

SEQ ID NO: 46748 - DNA, 8 bp, Unknown
  misc_feature (1)..( 8): Matrix.002 file - promoters60/1375957
agatttta

SEQ ID NO: 46749 - DNA, 9 bp, Unknown
  misc_feature (1)..( 9): Matrix.002 file - promoters60/1375957
ataaatata

SEQ ID NO: 46750 - DNA, 10 bp, Unknown
  misc_feature (1)..( 10): Matrix.002 file - promoters60/1375957
tttttggtgc

SEQ ID NO: 46751 - DNA, 9 bp, Unknown
  misc_feature (1)..( 9): Matrix.002 file - promoters60/1375957
cttattatg

SEQ ID NO: 46752 - DNA, 9 bp, Unknown
  misc_feature (1)..( 9): Matrix.002 file - promoters60/1375957
aacctattt

SEQ ID NO: 46753 - DNA, 7 bp, Unknown
  misc_feature (1)..( 7): Matrix.002 file - promoters60/1375975
tttcatt

SEQ ID NO: 46754 - DNA, 6 bp, Unknown
  misc_feature (1)..( 6): Matrix.002 file - promoters60/1375975
aatgtt

SEQ ID NO: 46755 - DNA, 8 bp, Unknown
  misc_feature (1)..( 8): Matrix.002 file - promoters60/1375975
aatcttct

SEQ ID NO: 46756 - DNA, 7 bp, Unknown
  misc_feature (1)..( 7): Matrix.002 file - promoters60/1375975
actgaaa

SEQ ID NO: 46757 - DNA, 8 bp, Unknown
  misc_feature (1)..( 8): Matrix.002 file - promoters60/1375975
ttaaaata

SEQ ID NO: 46758 - DNA, 7 bp, Unknown
  misc_feature (1)..( 7): Matrix.002 file - promoters60/1375975
aatataa

SEQ ID NO: 46759 - DNA, 7 bp, Unknown
  misc_feature (1)..( 7): Matrix.002 file - promoters60/1375975
ttggatg

SEQ ID NO: 46760 - DNA, 7 bp, Unknown
  misc_feature (1)..( 7): Matrix.002 file - promoters60/1375975
gttcata

SEQ ID NO: 46761 - DNA, 9 bp, Unknown
  misc_feature (1)..( 9): Matrix.002 file - promoters60/1375975
atgtagata

SEQ ID NO: 46762 - DNA, 6 bp, Unknown
  misc_feature (1)..( 6): Matrix.002 file - promoters60/1375975
gaatat

SEQ ID NO: 46763 - DNA, 7 bp, Unknown
  misc_feature (1)..( 7): Matrix.002 file - promoters60/1375975
aacagtt

SEQ ID NO: 46764 - DNA, 7 bp, Unknown
  misc_feature (1)..( 7): Matrix.002 file - promoters60/1375975
aaaaatt

SEQ ID NO: 46765 - DNA, 8 bp, Unknown
  misc_feature (1)..( 8): Matrix.002 file - promoters60/1375975
atccatca

SEQ ID NO: 46766 - DNA, 8 bp, Unknown
  misc_feature (1)..( 8): Matrix.002 file - promoters60/1375975
aaaggcta

SEQ ID NO: 46767 - DNA, 6 bp, Unknown
  misc_feature (1)..( 6): Matrix.002 file - promoters60/1375975
caaaaa

SEQ ID NO: 46768 - DNA, 8 bp, Unknown
  misc_feature (1)..( 8): Matrix.002 file - promoters60/1375975
aaataaaa

SEQ ID NO: 46769 - DNA, 6 bp, Unknown
  misc_feature (1)..( 6): Matrix.002 file - promoters60/1375975
tgaaat

SEQ ID NO: 46770 - DNA, 6 bp, Unknown
  misc_feature (1)..( 6): Matrix.002 file - promoters60/1375975
atatta

SEQ ID NO: 46771 - DNA, 6 bp, Unknown
  misc_feature (1)..( 6): Matrix.002 file - promoters60/1375975
aagaat

SEQ ID NO: 46772 - DNA, 8 bp, Unknown
  misc_feature (1)..( 8): Matrix.002 file - promoters60/1375975
cttataat

SEQ ID NO: 46773 - DNA, 6 bp, Unknown
  misc_feature (1)..( 6): Matrix.002 file - promoters60/1375975
atttgg

SEQ ID NO: 46774 - DNA, 7 bp, Unknown
  misc_feature (1)..( 7): Matrix.002 file - promoters60/1375975
ttaattt

SEQ ID NO: 46775 - DNA, 7 bp, Unknown
  misc_feature (1)..( 7): Matrix.002 file - promoters60/1376361
cgatcat

SEQ ID NO: 46776 - DNA, 3 bp, Unknown
  misc_feature (1)..( 3): Matrix.002 file - promoters60/1376455
taa

SEQ ID NO: 46777 - DNA, 12 bp, Unknown
  misc_feature (1)..( 12): Matrix.002 file - promoters60/1376455
attgataaatat

SEQ ID NO: 46778 - DNA, 7 bp, Unknown
  misc_feature (1)..( 7): Matrix.002 file - promoters60/1376455
ataataa

SEQ ID NO: 46779 - DNA, 11 bp, Unknown
  misc_feature (1)..( 11): Matrix.002 file - promoters60/1376455
attaaaaaaaa

SEQ ID NO: 46780 - DNA, 8 bp, Unknown
  misc_feature (1)..( 8): Matrix.002 file - promoters60/1376650
gaaatcaa

SEQ ID NO: 46781 - DNA, 8 bp, Unknown
  misc_feature (1)..( 8): Matrix.002 file - promoters60/1376650
gaactcag

SEQ ID NO: 46782 - DNA, 9 bp, Unknown
  misc_feature (1)..( 9): Matrix.002 file - promoters60/1376650
aagaaaaaa

SEQ ID NO: 46783 - DNA, 8 bp, Unknown
  misc_feature (1)..( 8): Matrix.002 file - promoters60/1376650
tgggaaat

SEQ ID NO: 46784 - DNA, 9 bp, Unknown
  misc_feature (1)..( 9): Matrix.002 file - promoters60/1376650
atatataaa

SEQ ID NO: 46785 - DNA, 9 bp, Unknown
  misc_feature (1)..( 9): Matrix.002 file - promoters60/1376650
tgaaacaaa

SEQ ID NO: 46786 - DNA, 6 bp, Unknown
  misc_feature (1)..( 6): Matrix.002 file - promoters60/1376726
agaatt

SEQ ID NO: 46787 - DNA, 8 bp, Unknown
  misc_feature (1)..( 8): Matrix.002 file - promoters60/1376726
agtttgat

SEQ ID NO: 46788 - DNA, 7 bp, Unknown
  misc_feature (1)..( 7): Matrix.002 file - promoters60/1376726
attagaa

SEQ ID NO: 46789 - DNA, 8 bp, Unknown
  misc_feature (1)..( 8): Matrix.002 file - promoters60/1376726
taataatc

SEQ ID NO: 46790 - DNA, 7 bp, Unknown
  misc_feature (1)..( 7): Matrix.002 file - promoters60/1376726
aataaaa

SEQ ID NO: 46791 - DNA, 7 bp, Unknown
  misc_feature (1)..( 7): Matrix.002 file - promoters60/1376726
cagagga

SEQ ID NO: 46792 - DNA, 7 bp, Unknown
  misc_feature (1)..( 7): Matrix.002 file - promoters60/1376726
tttggac

SEQ ID NO: 46793 - DNA, 6 bp, Unknown
  misc_feature (1)..( 6): Matrix.002 file - promoters60/1376726
ctggga

SEQ ID NO: 46794 - DNA, 7 bp, Unknown
  misc_feature (1)..( 7): Matrix.002 file - promoters60/1376726
atctgat

SEQ ID NO: 46795 - DNA, 8 bp, Unknown
  misc_feature (1)..( 8): Matrix.002 file - promoters60/1376726
tcttaatt

SEQ ID NO: 46796 - DNA, 8 bp, Unknown
  misc_feature (1)..( 8): Matrix.002 file - promoters60/1376726
tattctct

SEQ ID NO: 46797 - DNA, 7 bp, Unknown
  misc_feature (1)..( 7): Matrix.002 file - promoters60/1376726
aaaatct

SEQ ID NO: 46798 - DNA, 7 bp, Unknown
  misc_feature (1)..( 7): Matrix.002 file - promoters60/1376726
aaaaatt

SEQ ID NO: 46799 - DNA, 10 bp, Unknown
  misc_feature (1)..( 10): Matrix.002 file - promoters60/1376726
aattacattt

SEQ ID NO: 46800 - DNA, 6 bp, Unknown
  misc_feature (1)..( 6): Matrix.002 file - promoters60/1376881
taaaca

SEQ ID NO: 46801 - DNA, 6 bp, Unknown
  misc_feature (1)..( 6): Matrix.002 file - promoters60/1376881
ttaata

SEQ ID NO: 46802 - DNA, 6 bp, Unknown
  misc_feature (1)..( 6): Matrix.002 file - promoters60/1376881
agtaaa

SEQ ID NO: 46803 - DNA, 8 bp, Unknown
  misc_feature (1)..( 8): Matrix.002 file - promoters60/1376881
aaaaccct

SEQ ID NO: 46804 - DNA, 7 bp, Unknown
  misc_feature (1)..( 7): Matrix.002 file - promoters60/1376881
gctggtt

SEQ ID NO: 46805 - DNA, 10 bp, Unknown
  misc_feature (1)..( 10): Matrix.002 file - promoters60/1376881
aagagaatga

SEQ ID NO: 46806 - DNA, 10 bp, Unknown
  misc_feature (1)..( 10): Matrix.002 file - promoters60/1376881
gaaacaaaaa

SEQ ID NO: 46807 - DNA, 11 bp, Unknown
  misc_feature (1)..( 11): Matrix.002 file - promoters60/1376881
tgaacgtcatt

SEQ ID NO: 46808 - DNA, 7 bp, Unknown
  misc_feature (1)..( 7): Matrix.002 file - promoters60/1376881
aatcggg

SEQ ID NO: 46809 - DNA, 10 bp, Unknown
  misc_feature (1)..( 10): Matrix.002 file - promoters60/1376881
ggaaaagaaa

SEQ ID NO: 46810 - DNA, 7 bp, Unknown
  misc_feature (1)..( 7): Matrix.002 file - promoters60/1376881
cccacta

SEQ ID NO: 46811 - DNA, 9 bp, Unknown
  misc_feature (1)..( 9): Matrix.002 file - promoters60/1376881
aaagaaaag

SEQ ID NO: 46812 - DNA, 7 bp, Unknown
  misc_feature (1)..( 7): Matrix.002 file - promoters60/1376881
gtatata

SEQ ID NO: 46813 - DNA, 6 bp, Unknown
  misc_feature (1)..( 6): Matrix.002 file - promoters60/1376888
ctttat

SEQ ID NO: 46814 - DNA, 7 bp, Unknown
  misc_feature (1)..( 7): Matrix.002 file - promoters60/1376888
tatattt

SEQ ID NO: 46815 - DNA, 8 bp, Unknown
  misc_feature (1)..( 8): Matrix.002 file - promoters60/1376888
tttagttt

SEQ ID NO: 46816 - DNA, 8 bp, Unknown
  misc_feature (1)..( 8): Matrix.002 file - promoters60/1376888
ttttgttt

SEQ ID NO: 46817 - DNA, 6 bp, Unknown
  misc_feature (1)..( 6): Matrix.002 file - promoters60/1376902
taatgc

SEQ ID NO: 46818 - DNA, 7 bp, Unknown
  misc_feature (1)..( 7): Matrix.002 file - promoters60/1376902
atactaa

SEQ ID NO: 46819 - DNA, 8 bp, Unknown
  misc_feature (1)..( 8): Matrix.002 file - promoters60/1376902
aagggtaa

SEQ ID NO: 46820 - DNA, 7 bp, Unknown
  misc_feature (1)..( 7): Matrix.002 file - promoters60/1376902
tttgttg

SEQ ID NO: 46821 - DNA, 7 bp, Unknown
  misc_feature (1)..( 7): Matrix.002 file - promoters60/1376902
ttccatt

SEQ ID NO: 46822 - DNA, 7 bp, Unknown
  misc_feature (1)..( 7): Matrix.002 file - promoters60/1376902
acaaact

SEQ ID NO: 46823 - DNA, 7 bp, Unknown
  misc_feature (1)..( 7): Matrix.002 file - promoters60/1376902
ccttttg

SEQ ID NO: 46824 - DNA, 8 bp, Unknown
  misc_feature (1)..( 8): Matrix.002 file - promoters60/1376902
caacatca

SEQ ID NO: 46825 - DNA, 7 bp, Unknown
  misc_feature (1)..( 7): Matrix.002 file - promoters60/1376902
aacattt

SEQ ID NO: 46826 - DNA, 6 bp, Unknown
  misc_feature (1)..( 6): Matrix.002 file - promoters60/1376902
cttctt

SEQ ID NO: 46827 - DNA, 6 bp, Unknown
  misc_feature (1)..( 6): Matrix.002 file - promoters60/1376902
catctc

SEQ ID NO: 46828 - DNA, 6 bp, Unknown
  misc_feature (1)..( 6): Matrix.002 file - promoters60/1376902
agtttt

SEQ ID NO: 46829 - DNA, 7 bp, Unknown
  misc_feature (1)..( 7): Matrix.002 file - promoters60/1376902
acaaaaa

SEQ ID NO: 46830 - DNA, 10 bp, Unknown
  misc_feature (1)..( 10): Matrix.002 file - promoters60/1376958
aatcatacaa

SEQ ID NO: 46831 - DNA, 6 bp, Unknown
  misc_feature (1)..( 6): Matrix.002 file - promoters60/1376958
tcttga

SEQ ID NO: 46832 - DNA, 7 bp, Unknown
  misc_feature (1)..( 7): Matrix.002 file - promoters60/1376958
tagaata

SEQ ID NO: 46833 - DNA, 11 bp, Unknown
  misc_feature (1)..( 11): Matrix.002 file - promoters60/1376958
acacattaagt

SEQ ID NO: 46834 - DNA, 7 bp, Unknown
  misc_feature (1)..( 7): Matrix.002 file - promoters60/1376958
caaataa

SEQ ID NO: 46835 - DNA, 7 bp, Unknown
  misc_feature (1)..( 7): Matrix.002 file - promoters60/1376958
ctaaata

SEQ ID NO: 46836 - DNA, 6 bp, Unknown
  misc_feature (1)..( 6): Matrix.002 file - promoters60/1376958
tataaa

SEQ ID NO: 46837 - DNA, 7 bp, Unknown
  misc_feature (1)..( 7): Matrix.002 file - promoters60/1376958
cacacaa

SEQ ID NO: 46838 - DNA, 7 bp, Unknown
  misc_feature (1)..( 7): Matrix.002 file - promoters60/1376958
aatatca

SEQ ID NO: 46839 - DNA, 8 bp, Unknown
  misc_feature (1)..( 8): Matrix.002 file - promoters60/1376958
atacaaat

SEQ ID NO: 46840 - DNA, 7 bp, Unknown
  misc_feature (1)..( 7): Matrix.002 file - promoters60/1376958
ataaata

SEQ ID NO: 46841 - DNA, 8 bp, Unknown
  misc_feature (1)..( 8): Matrix.002 file - promoters60/1376958
aataataa

SEQ ID NO: 46842 - DNA, 8 bp, Unknown
  misc_feature (1)..( 8): Matrix.002 file - promoters60/1376958
acaaaaag

SEQ ID NO: 46843 - DNA, 6 bp, Unknown
  misc_feature (1)..( 6): Matrix.002 file - promoters60/1376958
ataaac

SEQ ID NO: 46844 - DNA, 7 bp, Unknown
  misc_feature (1)..( 7): Matrix.002 file - promoters60/1376958
tgaacaa

SEQ ID NO: 46845 - DNA, 6 bp, Unknown
  misc_feature (1)..( 6): Matrix.002 file - promoters60/1376958
cgatta

SEQ ID NO: 46846 - DNA, 6 bp, Unknown
  misc_feature (1)..( 6): Matrix.002 file - promoters60/1376958
ttttga

SEQ ID NO: 46847 - DNA, 6 bp, Unknown
  misc_feature (1)..( 6): Matrix.002 file - promoters60/1376958
acagta

SEQ ID NO: 46848 - DNA, 7 bp, Unknown
  misc_feature (1)..( 7): Matrix.002 file - promoters60/1376958
taaaata

SEQ ID NO: 46849 - DNA, 6 bp, Unknown
  misc_feature (1)..( 6): Matrix.002 file - promoters60/1376958
ttgaca

SEQ ID NO: 46850 - DNA, 7 bp, Unknown
  misc_feature (1)..( 7): Matrix.002 file - promoters60/1376958
aaccaag

SEQ ID NO: 46851 - DNA, 8 bp, Unknown
  misc_feature (1)..( 8): Matrix.002 file - promoters60/1376958
acgatgac

SEQ ID NO: 46852 - DNA, 6 bp, Unknown
  misc_feature (1)..( 6): Matrix.002 file - promoters60/1377045
aatatc

SEQ ID NO: 46853 - DNA, 6 bp, Unknown
  misc_feature (1)..( 6): Matrix.002 file - promoters60/1377045
aatgaa

SEQ ID NO: 46854 - DNA, 7 bp, Unknown
  misc_feature (1)..( 7): Matrix.002 file - promoters60/1377045
ataattg

SEQ ID NO: 46855 - DNA, 6 bp, Unknown
  misc_feature (1)..( 6): Matrix.002 file - promoters60/1377045
gggtaa

SEQ ID NO: 46856 - DNA, 8 bp, Unknown
  misc_feature (1)..( 8): Matrix.002 file - promoters60/1377045
aaagaaaa

SEQ ID NO: 46857 - DNA, 8 bp, Unknown
  misc_feature (1)..( 8): Matrix.002 file - promoters60/1377045
aaaacaaa

SEQ ID NO: 46858 - DNA, 8 bp, Unknown
  misc_feature (1)..( 8): Matrix.002 file - promoters60/1377045
ttttgaaa

SEQ ID NO: 46859 - DNA, 6 bp, Unknown
  misc_feature (1)..( 6): Matrix.002 file - promoters60/1377045
agttaa

SEQ ID NO: 46860 - DNA, 6 bp, Unknown
  misc_feature (1)..( 6): Matrix.002 file - promoters60/1377045
accaaa

SEQ ID NO: 46861 - DNA, 8 bp, Unknown
  misc_feature (1)..( 8): Matrix.002 file - promoters60/1377045
aatgcttt

SEQ ID NO: 46862 - DNA, 7 bp, Unknown
  misc_feature (1)..( 7): Matrix.002 file - promoters60/1377045
atatttt

SEQ ID NO: 46863 - DNA, 7 bp, Unknown
  misc_feature (1)..( 7): Matrix.002 file - promoters60/1377045
aaataaa

SEQ ID NO: 46864 - DNA, 7 bp, Unknown
  misc_feature (1)..( 7): Matrix.002 file - promoters60/1377045
gtaaaac

SEQ ID NO: 46865 - DNA, 6 bp, Unknown
  misc_feature (1)..( 6): Matrix.002 file - promoters60/1377045
caaagg

SEQ ID NO: 46866 - DNA, 9 bp, Unknown
  misc_feature (1)..( 9): Matrix.002 file - promoters60/1377139
agttgaaga

SEQ ID NO: 46867 - DNA, 8 bp, Unknown
  misc_feature (1)..( 8): Matrix.002 file - promoters60/1377139
gaaactct

SEQ ID NO: 46868 - DNA, 11 bp, Unknown
  misc_feature (1)..( 11): Matrix.002 file - promoters60/1377139
gattttgttta

SEQ ID NO: 46869 - DNA, 11 bp, Unknown
  misc_feature (1)..( 11): Matrix.002 file - promoters60/1377139
tcaatttaaaa

SEQ ID NO: 46870 - DNA, 8 bp, Unknown
  misc_feature (1)..( 8): Matrix.002 file - promoters60/1377139
tttgagag

SEQ ID NO: 46871 - DNA, 11 bp, Unknown
  misc_feature (1)..( 11): Matrix.002 file - promoters60/1377192
taaaaaaaaaa

SEQ ID NO: 46872 - DNA, 16 bp, Unknown
  misc_feature (1)..( 16): Matrix.002 file - promoters60/1377192
tttactcaacagcttg

SEQ ID NO: 46873 - DNA, 13 bp, Unknown
  misc_feature (1)..( 13): Matrix.002 file - promoters60/1377192
aaataaacaaaaa

SEQ ID NO: 46874 - DNA, 11 bp, Unknown
  misc_feature (1)..( 11): Matrix.002 file - promoters60/1377192
ttaatctttaa

SEQ ID NO: 46875 - DNA, 9 bp, Unknown
  misc_feature (1)..( 9): Matrix.002 file - promoters60/1377192
aaagaaaca

SEQ ID NO: 46876 - DNA, 10 bp, Unknown
  misc_feature (1)..( 10): Matrix.002 file - promoters60/1377192
cgttttcaca

SEQ ID NO: 46877 - DNA, 10 bp, Unknown
  misc_feature (1)..( 10): Matrix.002 file - promoters60/1377192
gacattcact

SEQ ID NO: 46878 - DNA, 8 bp, Unknown
  misc_feature (1)..( 8): Matrix.002 file - promoters60/1377197
caaagaaa

SEQ ID NO: 46879 - DNA, 9 bp, Unknown
  misc_feature (1)..( 9): Matrix.002 file - promoters60/1377197
aaagaaaga

SEQ ID NO: 46880 - DNA, 7 bp, Unknown
  misc_feature (1)..( 7): Matrix.002 file - promoters60/1377197
ataaaaa

SEQ ID NO: 46881 - DNA, 11 bp, Unknown
  misc_feature (1)..( 11): Matrix.002 file - promoters60/1377197
tatgaaaaaaa

SEQ ID NO: 46882 - DNA, 11 bp, Unknown
  misc_feature (1)..( 11): Matrix.002 file - promoters60/1377268
ctaatcagaaa

SEQ ID NO: 46883 - DNA, 7 bp, Unknown
  misc_feature (1)..( 7): Matrix.002 file - promoters60/1377268
tctattt

SEQ ID NO: 46884 - DNA, 10 bp, Unknown
  misc_feature (1)..( 10): Matrix.002 file - promoters60/1377268
aaactacaac

SEQ ID NO: 46885 - DNA, 10 bp, Unknown
  misc_feature (1)..( 10): Matrix.002 file - promoters60/1377268
aaacgtgaaa

SEQ ID NO: 46886 - DNA, 6 bp, Unknown
  misc_feature (1)..( 6): Matrix.002 file - promoters60/1377268
tttact

SEQ ID NO: 46887 - DNA, 14 bp, Unknown
  misc_feature (1)..( 14): Matrix.002 file - promoters60/1377268
taccttttgttaac

SEQ ID NO: 46888 - DNA, 6 bp, Unknown
  misc_feature (1)..( 6): Matrix.002 file - promoters60/1377268
acaatt

SEQ ID NO: 46889 - DNA, 6 bp, Unknown
  misc_feature (1)..( 6): Matrix.002 file - promoters60/1377268
cttcaa

SEQ ID NO: 46890 - DNA, 6 bp, Unknown
  misc_feature (1)..( 6): Matrix.002 file - promoters60/1377268
tattta

SEQ ID NO: 46891 - DNA, 7 bp, Unknown
  misc_feature (1)..( 7): Matrix.002 file - promoters60/1377268
ctaccaa

SEQ ID NO: 46892 - DNA, 7 bp, Unknown
  misc_feature (1)..( 7): Matrix.002 file - promoters60/1377268
tacgaaa

SEQ ID NO: 46893 - DNA, 7 bp, Unknown
  misc_feature (1)..( 7): Matrix.002 file - promoters60/1377268
agaaata

SEQ ID NO: 46894 - DNA, 8 bp, Unknown
  misc_feature (1)..( 8): Matrix.002 file - promoters60/1377268
taagatta

SEQ ID NO: 46895 - DNA, 11 bp, Unknown
  misc_feature (1)..( 11): Matrix.002 file - promoters60/1377268
tatatataaag

SEQ ID NO: 46896 - DNA, 6 bp, Unknown
  misc_feature (1)..( 6): Matrix.002 file - promoters60/1377268
aatatt

SEQ ID NO: 46897 - DNA, 6 bp, Unknown
  misc_feature (1)..( 6): Matrix.002 file - promoters60/1377268
acttat

SEQ ID NO: 46898 - DNA, 6 bp, Unknown
  misc_feature (1)..( 6): Matrix.002 file - promoters60/1377268
ataaac

SEQ ID NO: 46899 - DNA, 6 bp, Unknown
  misc_feature (1)..( 6): Matrix.002 file - promoters60/1377268
aagata

SEQ ID NO: 46900 - DNA, 7 bp, Unknown
  misc_feature (1)..( 7): Matrix.002 file - promoters60/1377268
atttatt

SEQ ID NO: 46901 - DNA, 8 bp, Unknown
  misc_feature (1)..( 8): Matrix.002 file - promoters60/1377412
tactattt

SEQ ID NO: 46902 - DNA, 7 bp, Unknown
  misc_feature (1)..( 7): Matrix.002 file - promoters60/1377472
aaaacaa

SEQ ID NO: 46903 - DNA, 8 bp, Unknown
  misc_feature (1)..( 8): Matrix.002 file - promoters60/1377472
catcgttt

SEQ ID NO: 46904 - DNA, 8 bp, Unknown
  misc_feature (1)..( 8): Matrix.002 file - promoters60/1377472
gattcttt

SEQ ID NO: 46905 - DNA, 7 bp, Unknown
  misc_feature (1)..( 7): Matrix.002 file - promoters60/1377522
gttcctt

SEQ ID NO: 46906 - DNA, 8 bp, Unknown
  misc_feature (1)..( 8): Matrix.002 file - promoters60/1377522
aaatgtta

SEQ ID NO: 46907 - DNA, 7 bp, Unknown
  misc_feature (1)..( 7): Matrix.002 file - promoters60/1377522
gttgatt

SEQ ID NO: 46908 - DNA, 8 bp, Unknown
  misc_feature (1)..( 8): Matrix.002 file - promoters60/1377522
cgacatgt

SEQ ID NO: 46909 - DNA, 6 bp, Unknown
  misc_feature (1)..( 6): Matrix.002 file - promoters60/1377522
acatgt

SEQ ID NO: 46910 - DNA, 7 bp, Unknown
  misc_feature (1)..( 7): Matrix.002 file - promoters60/1377564
attttac

SEQ ID NO: 46911 - DNA, 9 bp, Unknown
  misc_feature (1)..( 9): Matrix.002 file - promoters60/1377564
aagtaataa

SEQ ID NO: 46912 - DNA, 7 bp, Unknown
  misc_feature (1)..( 7): Matrix.002 file - promoters60/1377564
caaaatc

SEQ ID NO: 46913 - DNA, 8 bp, Unknown
  misc_feature (1)..( 8): Matrix.002 file - promoters60/1377564
ttatgtct

SEQ ID NO: 46914 - DNA, 7 bp, Unknown
  misc_feature (1)..( 7): Matrix.002 file - promoters60/1377564
gatcgat

SEQ ID NO: 46915 - DNA, 10 bp, Unknown
  misc_feature (1)..( 10): Matrix.002 file - promoters60/1377642
taaaaaggat

SEQ ID NO: 46916 - DNA, 13 bp, Unknown
  misc_feature (1)..( 13): Matrix.002 file - promoters60/1377642
acttataataaaa

SEQ ID NO: 46917 - DNA, 7 bp, Unknown
  misc_feature (1)..( 7): Matrix.002 file - promoters60/1377642
atataat

SEQ ID NO: 46918 - DNA, 9 bp, Unknown
  misc_feature (1)..( 9): Matrix.002 file - promoters60/1377642
aaaatatat

SEQ ID NO: 46919 - DNA, 11 bp, Unknown
  misc_feature (1)..( 11): Matrix.002 file - promoters60/1377642
ataaaattaat

SEQ ID NO: 46920 - DNA, 12 bp, Unknown
  misc_feature (1)..( 12): Matrix.002 file - promoters60/1377642
ttttgtaaacaa

SEQ ID NO: 46921 - DNA, 8 bp, Unknown
  misc_feature (1)..( 8): Matrix.002 file - promoters60/1377642
aaatttat

SEQ ID NO: 46922 - DNA, 8 bp, Unknown
  misc_feature (1)..( 8): Matrix.002 file - promoters60/1377642
aatcaaaa

SEQ ID NO: 46923 - DNA, 11 bp, Unknown
  misc_feature (1)..( 11): Matrix.002 file - promoters60/1377642
aaaaacacgaa

SEQ ID NO: 46924 - DNA, 8 bp, Unknown
  misc_feature (1)..( 8): Matrix.002 file - promoters60/1377642
aaacttta

SEQ ID NO: 46925 - DNA, 10 bp, Unknown
  misc_feature (1)..( 10): Matrix.002 file - promoters60/1377642
ctttattgat

SEQ ID NO: 46926 - DNA, 8 bp, Unknown
  misc_feature (1)..( 8): Matrix.002 file - promoters60/1377642
tttcaaat

SEQ ID NO: 46927 - DNA, 11 bp, Unknown
  misc_feature (1)..( 11): Matrix.002 file - promoters60/1377642
tgaccaaaaat

SEQ ID NO: 46928 - DNA, 8 bp, Unknown
  misc_feature (1)..( 8): Matrix.002 file - promoters60/1377642
atataata

SEQ ID NO: 46929 - DNA, 7 bp, Unknown
  misc_feature (1)..( 7): Matrix.002 file - promoters60/1377642
aattttt

SEQ ID NO: 46930 - DNA, 10 bp, Unknown
  misc_feature (1)..( 10): Matrix.002 file - promoters60/1377680
aaatcatatt

SEQ ID NO: 46931 - DNA, 6 bp, Unknown
  misc_feature (1)..( 6): Matrix.002 file - promoters60/1377687
attcaa

SEQ ID NO: 46932 - DNA, 7 bp, Unknown
  misc_feature (1)..( 7): Matrix.002 file - promoters60/1377687
cttatct

SEQ ID NO: 46933 - DNA, 8 bp, Unknown
  misc_feature (1)..( 8): Matrix.002 file - promoters60/1377687
tctaaaac

SEQ ID NO: 46934 - DNA, 8 bp, Unknown
  misc_feature (1)..( 8): Matrix.002 file - promoters60/1377687
aaaacaat

SEQ ID NO: 46935 - DNA, 6 bp, Unknown
  misc_feature (1)..( 6): Matrix.002 file - promoters60/1377687
gcaaaa

SEQ ID NO: 46936 - DNA, 8 bp, Unknown
  misc_feature (1)..( 8): Matrix.002 file - promoters60/1377687
tatatata

SEQ ID NO: 46937 - DNA, 8 bp, Unknown
  misc_feature (1)..( 8): Matrix.002 file - promoters60/1377687
ttcaaaac

SEQ ID NO: 46938 - DNA, 15 bp, Unknown
  misc_feature (1)..( 15): Matrix.002 file - promoters60/1377687
acaaaaataaatcac

SEQ ID NO: 46939 - DNA, 6 bp, Unknown
  misc_feature (1)..( 6): Matrix.002 file - promoters60/1377687
tactaa

SEQ ID NO: 46940 - DNA, 7 bp, Unknown
  misc_feature (1)..( 7): Matrix.002 file - promoters60/1377687
aaaatca

SEQ ID NO: 46941 - DNA, 6 bp, Unknown
  misc_feature (1)..( 6): Matrix.002 file - promoters60/1377687
aattat

SEQ ID NO: 46942 - DNA, 7 bp, Unknown
  misc_feature (1)..( 7): Matrix.002 file - promoters60/1377687
ataaatt

SEQ ID NO: 46943 - DNA, 8 bp, Unknown
  misc_feature (1)..( 8): Matrix.002 file - promoters60/1377714
gaaaccac

SEQ ID NO: 46944 - DNA, 8 bp, Unknown
  misc_feature (1)..( 8): Matrix.002 file - promoters60/1377714
gaagaaat

SEQ ID NO: 46945 - DNA, 13 bp, Unknown
  misc_feature (1)..( 13): Matrix.002 file - promoters60/1377714
gttataatttttt

SEQ ID NO: 46946 - DNA, 8 bp, Unknown
  misc_feature (1)..( 8): Matrix.002 file - promoters60/1377714
ttgatata

SEQ ID NO: 46947 - DNA, 7 bp, Unknown
  misc_feature (1)..( 7): Matrix.002 file - promoters60/1377718
gtcgaaa

SEQ ID NO: 46948 - DNA, 7 bp, Unknown
  misc_feature (1)..( 7): Matrix.002 file - promoters60/1377718
aaacatt

SEQ ID NO: 46949 - DNA, 10 bp, Unknown
  misc_feature (1)..( 10): Matrix.002 file - promoters60/1377718
taaatttgct

SEQ ID NO: 46950 - DNA, 9 bp, Unknown
  misc_feature (1)..( 9): Matrix.002 file - promoters60/1377718
tcagtaaga

SEQ ID NO: 46951 - DNA, 7 bp, Unknown
  misc_feature (1)..( 7): Matrix.002 file - promoters60/1377718
tttattg

SEQ ID NO: 46952 - DNA, 7 bp, Unknown
  misc_feature (1)..( 7): Matrix.002 file - promoters60/1377718
tgaaaaa

SEQ ID NO: 46953 - DNA, 6 bp, Unknown
  misc_feature (1)..( 6): Matrix.002 file - promoters60/1377718
aatatt

SEQ ID NO: 46954 - DNA, 12 bp, Unknown
  misc_feature (1)..( 12): Matrix.002 file - promoters60/1377718
ttagtttggtct

SEQ ID NO: 46955 - DNA, 6 bp, Unknown
  misc_feature (1)..( 6): Matrix.002 file - promoters60/1377718
ttttat

SEQ ID NO: 46956 - DNA, 9 bp, Unknown
  misc_feature (1)..( 9): Matrix.002 file - promoters60/1377718
attagaaga

SEQ ID NO: 46957 - DNA, 7 bp, Unknown
  misc_feature (1)..( 7): Matrix.002 file - promoters60/1377734
tatgtgc

SEQ ID NO: 46958 - DNA, 6 bp, Unknown
  misc_feature (1)..( 6): Matrix.002 file - promoters60/1377734
tcatct

SEQ ID NO: 46959 - DNA, 6 bp, Unknown
  misc_feature (1)..( 6): Matrix.002 file - promoters60/1377734
ttttcc

SEQ ID NO: 46960 - DNA, 7 bp, Unknown
  misc_feature (1)..( 7): Matrix.002 file - promoters60/1377734
ttagttt

SEQ ID NO: 46961 - DNA, 6 bp, Unknown
  misc_feature (1)..( 6): Matrix.002 file - promoters60/1377734
agagct

SEQ ID NO: 46962 - DNA, 7 bp, Unknown
  misc_feature (1)..( 7): Matrix.002 file - promoters60/1377734
taaaaat

SEQ ID NO: 46963 - DNA, 7 bp, Unknown
  misc_feature (1)..( 7): Matrix.002 file - promoters60/1377734
tttaatt

SEQ ID NO: 46964 - DNA, 8 bp, Unknown
  misc_feature (1)..( 8): Matrix.002 file - promoters60/1377734
tgaaatat

SEQ ID NO: 46965 - DNA, 7 bp, Unknown
  misc_feature (1)..( 7): Matrix.002 file - promoters60/1377734
ttgactc

SEQ ID NO: 46966 - DNA, 6 bp, Unknown
  misc_feature (1)..( 6): Matrix.002 file - promoters60/1377734
ctaaat

SEQ ID NO: 46967 - DNA, 9 bp, Unknown
  misc_feature (1)..( 9): Matrix.002 file - promoters60/1377734
gagcctgat

SEQ ID NO: 46968 - DNA, 6 bp, Unknown
  misc_feature (1)..( 6): Matrix.002 file - promoters60/1377734
aattgc

SEQ ID NO: 46969 - DNA, 6 bp, Unknown
  misc_feature (1)..( 6): Matrix.002 file - promoters60/1377734
tccaaa

SEQ ID NO: 46970 - DNA, 6 bp, Unknown
  misc_feature (1)..( 6): Matrix.002 file - promoters60/1377734
aaacga

SEQ ID NO: 46971 - DNA, 6 bp, Unknown
  misc_feature (1)..( 6): Matrix.002 file - promoters60/1377734
tctaaa

SEQ ID NO: 46972 - DNA, 8 bp, Unknown
  misc_feature (1)..( 8): Matrix.002 file - promoters60/1377734
aacaaaaa

SEQ ID NO: 46973 - DNA, 8 bp, Unknown
  misc_feature (1)..( 8): Matrix.002 file - promoters60/1377734
ccaagacg

SEQ ID NO: 46974 - DNA, 7 bp, Unknown
  misc_feature (1)..( 7): Matrix.002 file - promoters60/1377734
aggccca

SEQ ID NO: 46975 - DNA, 6 bp, Unknown
  misc_feature (1)..( 6): Matrix.002 file - promoters60/1377835
ttgttt

SEQ ID NO: 46976 - DNA, 6 bp, Unknown
  misc_feature (1)..( 6): Matrix.002 file - promoters60/1377835
tatttt

SEQ ID NO: 46977 - DNA, 7 bp, Unknown
  misc_feature (1)..( 7): Matrix.002 file - promoters60/1377835
tttactt

SEQ ID NO: 46978 - DNA, 6 bp, Unknown
  misc_feature (1)..( 6): Matrix.002 file - promoters60/1377835
aaaaga

SEQ ID NO: 46979 - DNA, 6 bp, Unknown
  misc_feature (1)..( 6): Matrix.002 file - promoters60/1377835
aataaa

SEQ ID NO: 46980 - DNA, 7 bp, Unknown
  misc_feature (1)..( 7): Matrix.002 file - promoters60/1377835
ttcctcc

SEQ ID NO: 46981 - DNA, 10 bp, Unknown
  misc_feature (1)..( 10): Matrix.002 file - promoters60/1377835
gtaaaaattt

SEQ ID NO: 46982 - DNA, 7 bp, Unknown
  misc_feature (1)..( 7): Matrix.002 file - promoters60/1377835
ttgctca

SEQ ID NO: 46983 - DNA, 7 bp, Unknown
  misc_feature (1)..( 7): Matrix.002 file - promoters60/1377835
ccactaa

SEQ ID NO: 46984 - DNA, 6 bp, Unknown
  misc_feature (1)..( 6): Matrix.002 file - promoters60/1377835
ataaaa

SEQ ID NO: 46985 - DNA, 8 bp, Unknown
  misc_feature (1)..( 8): Matrix.002 file - promoters60/1377835
tttatttt

SEQ ID NO: 46986 - DNA, 6 bp, Unknown
  misc_feature (1)..( 6): Matrix.002 file - promoters60/1377835
tttact

SEQ ID NO: 46987 - DNA, 9 bp, Unknown
  misc_feature (1)..( 9): Matrix.002 file - promoters60/1377835
cttagtttt

SEQ ID NO: 46988 - DNA, 8 bp, Unknown
  misc_feature (1)..( 8): Matrix.002 file - promoters60/1377835
tttgtttg

SEQ ID NO: 46989 - DNA, 6 bp, Unknown
  misc_feature (1)..( 6): Matrix.002 file - promoters60/1377835
aagttt

SEQ ID NO: 46990 - DNA, 10 bp, Unknown
  misc_feature (1)..( 10): Matrix.002 file - promoters60/1377835
caaactaatt

SEQ ID NO: 46991 - DNA, 7 bp, Unknown
  misc_feature (1)..( 7): Matrix.002 file - promoters60/1377835
attagaa

SEQ ID NO: 46992 - DNA, 8 bp, Unknown
  misc_feature (1)..( 8): Matrix.002 file - promoters60/1377835
aacaaaat

SEQ ID NO: 46993 - DNA, 8 bp, Unknown
  misc_feature (1)..( 8): Matrix.002 file - promoters60/1377847
aaaaaata

SEQ ID NO: 46994 - DNA, 10 bp, Unknown
  misc_feature (1)..( 10): Matrix.002 file - promoters60/1377847
aaattataaa

SEQ ID NO: 46995 - DNA, 5 bp, Unknown
  misc_feature (1)..( 5): Matrix.002 file - promoters60/1377847
taaaa

SEQ ID NO: 46996 - DNA, 13 bp, Unknown
  misc_feature (1)..( 13): Matrix.002 file - promoters60/1377847
attacaaaaataa

SEQ ID NO: 46997 - DNA, 10 bp, Unknown
  misc_feature (1)..( 10): Matrix.002 file - promoters60/1377847
aaaaaataaa

SEQ ID NO: 46998 - DNA, 10 bp, Unknown
  misc_feature (1)..( 10): Matrix.002 file - promoters60/1377847
atattattat

SEQ ID NO: 46999 - DNA, 8 bp, Unknown
  misc_feature (1)..( 8): Matrix.002 file - promoters60/1377847
aaaccaat

SEQ ID NO: 47000 - DNA, 10 bp, Unknown
  misc_feature (1)..( 10): Matrix.002 file - promoters60/1377847
gaaaaaataa

SEQ ID NO: 47001 - DNA, 9 bp, Unknown
  misc_feature (1)..( 9): Matrix.002 file - promoters60/1377847
aaatgttta

SEQ ID NO: 47002 - DNA, 8 bp, Unknown
  misc_feature (1)..( 8): Matrix.002 file - promoters60/1378049
aaaaattt

SEQ ID NO: 47003 - DNA, 8 bp, Unknown
  misc_feature (1)..( 8): Matrix.002 file - promoters60/1378049
aaaacaaa

SEQ ID NO: 47004 - DNA, 12 bp, Unknown
  misc_feature (1)..( 12): Matrix.002 file - promoters60/1378049
tcatttgaataa

SEQ ID NO: 47005 - DNA, 12 bp, Unknown
  misc_feature (1)..( 12): Matrix.002 file - promoters60/1378049
ttgagttttaaa

SEQ ID NO: 47006 - DNA, 12 bp, Unknown
  misc_feature (1)..( 12): Matrix.002 file - promoters60/1378049
ttccaaaaataa

SEQ ID NO: 47007 - DNA, 10 bp, Unknown
  misc_feature (1)..( 10): Matrix.002 file - promoters60/1378049
atatatataa

SEQ ID NO: 47008 - DNA, 14 bp, Unknown
  misc_feature (1)..( 14): Matrix.002 file - promoters60/1378049
attttagatttgcg

SEQ ID NO: 47009 - DNA, 12 bp, Unknown
  misc_feature (1)..( 12): Matrix.002 file - promoters60/1378088
aaattattttat

SEQ ID NO: 47010 - DNA, 9 bp, Unknown
  misc_feature (1)..( 9): Matrix.002 file - promoters60/1378088
aaaaatttt

SEQ ID NO: 47011 - DNA, 11 bp, Unknown
  misc_feature (1)..( 11): Matrix.002 file - promoters60/1378088
aaaattgtttt

SEQ ID NO: 47012 - DNA, 13 bp, Unknown
  misc_feature (1)..( 13): Matrix.002 file - promoters60/1378088
taaaaaaacataa

SEQ ID NO: 47013 - DNA, 8 bp, Unknown
  misc_feature (1)..( 8): Matrix.002 file - promoters60/1378088
aatattta

SEQ ID NO: 47014 - DNA, 7 bp, Unknown
  misc_feature (1)..( 7): Matrix.002 file - promoters60/1378088
tagattt

SEQ ID NO: 47015 - DNA, 8 bp, Unknown
  misc_feature (1)..( 8): Matrix.002 file - promoters60/1378088
aaattatt

SEQ ID NO: 47016 - DNA, 12 bp, Unknown
  misc_feature (1)..( 12): Matrix.002 file - promoters60/1378088
aattagattcga

SEQ ID NO: 47017 - DNA, 9 bp, Unknown
  misc_feature (1)..( 9): Matrix.002 file - promoters60/1378088
aaaaacatt

SEQ ID NO: 47018 - DNA, 9 bp, Unknown
  misc_feature (1)..( 9): Matrix.002 file - promoters60/1378088
aaaaaatta

SEQ ID NO: 47019 - DNA, 7 bp, Unknown
  misc_feature (1)..( 7): Matrix.002 file - promoters60/1378088
taaaaat

SEQ ID NO: 47020 - DNA, 8 bp, Unknown
  misc_feature (1)..( 8): Matrix.002 file - promoters60/1378088
aatcataa

SEQ ID NO: 47021 - DNA, 17 bp, Unknown
  misc_feature (1)..( 17): Matrix.002 file - promoters60/1378088
attttaatcaacaataa

SEQ ID NO: 47022 - DNA, 11 bp, Unknown
  misc_feature (1)..( 11): Matrix.002 file - promoters60/1378088
ttaatttttta

SEQ ID NO: 47023 - DNA, 10 bp, Unknown
  misc_feature (1)..( 10): Matrix.002 file - promoters60/1378088
attttaaaat

SEQ ID NO: 47024 - DNA, 13 bp, Unknown
  misc_feature (1)..( 13): Matrix.002 file - promoters60/1378088
ttataaaaagata

SEQ ID NO: 47025 - DNA, 9 bp, Unknown
  misc_feature (1)..( 9): Matrix.002 file - promoters60/1378088
gttaaaaaa

SEQ ID NO: 47026 - DNA, 12 bp, Unknown
  misc_feature (1)..( 12): Matrix.002 file - promoters60/1378088
taaaaaacaatg

SEQ ID NO: 47027 - DNA, 9 bp, Unknown
  misc_feature (1)..( 9): Matrix.002 file - promoters60/1378088
aaaattaac

SEQ ID NO: 47028 - DNA, 10 bp, Unknown
  misc_feature (1)..( 10): Matrix.002 file - promoters60/1378088
caaaaaaaaa

SEQ ID NO: 47029 - DNA, 8 bp, Unknown
  misc_feature (1)..( 8): Matrix.002 file - promoters60/1378088
aaaacaaa

SEQ ID NO: 47030 - DNA, 9 bp, Unknown
  misc_feature (1)..( 9): Matrix.002 file - promoters60/1378287
atttgagag

SEQ ID NO: 47031 - DNA, 11 bp, Unknown
  misc_feature (1)..( 11): Matrix.002 file - promoters60/1378287
aaaatgtgaaa

SEQ ID NO: 47032 - DNA, 8 bp, Unknown
  misc_feature (1)..( 8): Matrix.002 file - promoters60/1378287
aaatatta

SEQ ID NO: 47033 - DNA, 10 bp, Unknown
  misc_feature (1)..( 10): Matrix.002 file - promoters60/1378287
taaattgaaa

SEQ ID NO: 47034 - DNA, 8 bp, Unknown
  misc_feature (1)..( 8): Matrix.002 file - promoters60/1378297
taagattt

SEQ ID NO: 47035 - DNA, 9 bp, Unknown
  misc_feature (1)..( 9): Matrix.002 file - promoters60/1378297
aaatggttt

SEQ ID NO: 47036 - DNA, 6 bp, Unknown
  misc_feature (1)..( 6): Matrix.002 file - promoters60/1378297
aaaaaa

SEQ ID NO: 47037 - DNA, 6 bp, Unknown
  misc_feature (1)..( 6): Matrix.002 file - promoters60/1378297
aaaaat

SEQ ID NO: 47038 - DNA, 7 bp, Unknown
  misc_feature (1)..( 7): Matrix.002 file - promoters60/1378297
aaacaaa

SEQ ID NO: 47039 - DNA, 6 bp, Unknown
  misc_feature (1)..( 6): Matrix.002 file - promoters60/1378297
aaataa

SEQ ID NO: 47040 - DNA, 6 bp, Unknown
  misc_feature (1)..( 6): Matrix.002 file - promoters60/1378297
atttcc

SEQ ID NO: 47041 - DNA, 8 bp, Unknown
  misc_feature (1)..( 8): Matrix.002 file - promoters60/1378297
aaataatc

SEQ ID NO: 47042 - DNA, 6 bp, Unknown
  misc_feature (1)..( 6): Matrix.002 file - promoters60/1378297
aaaatc

SEQ ID NO: 47043 - DNA, 7 bp, Unknown
  misc_feature (1)..( 7): Matrix.002 file - promoters60/1378297
tatgctt

SEQ ID NO: 47044 - DNA, 8 bp, Unknown
  misc_feature (1)..( 8): Matrix.002 file - promoters60/1378297
aaaataca

SEQ ID NO: 47045 - DNA, 6 bp, Unknown
  misc_feature (1)..( 6): Matrix.002 file - promoters60/1378297
ttgatc

SEQ ID NO: 47046 - DNA, 6 bp, Unknown
  misc_feature (1)..( 6): Matrix.002 file - promoters60/1378297
cacaga

SEQ ID NO: 47047 - DNA, 7 bp, Unknown
  misc_feature (1)..( 7): Matrix.002 file - promoters60/1378297
tacatta

SEQ ID NO: 47048 - DNA, 10 bp, Unknown
  misc_feature (1)..( 10): Matrix.002 file - promoters60/1378297
tgatatcatt

SEQ ID NO: 47049 - DNA, 9 bp, Unknown
  misc_feature (1)..( 9): Matrix.002 file - promoters60/1378297
ataaagaaa

SEQ ID NO: 47050 - DNA, 7 bp, Unknown
  misc_feature (1)..( 7): Matrix.002 file - promoters60/1378297
gtggagc

SEQ ID NO: 47051 - DNA, 8 bp, Unknown
  misc_feature (1)..( 8): Matrix.002 file - promoters60/1378297
gcttttgc

SEQ ID NO: 47052 - DNA, 6 bp, Unknown
  misc_feature (1)..( 6): Matrix.002 file - promoters60/1378333
cgtgga

SEQ ID NO: 47053 - DNA, 7 bp, Unknown
  misc_feature (1)..( 7): Matrix.002 file - promoters60/1378333
gctgaaa

SEQ ID NO: 47054 - DNA, 6 bp, Unknown
  misc_feature (1)..( 6): Matrix.002 file - promoters60/1378333
attcaa

SEQ ID NO: 47055 - DNA, 9 bp, Unknown
  misc_feature (1)..( 9): Matrix.002 file - promoters60/1378333
tttggattt

SEQ ID NO: 47056 - DNA, 8 bp, Unknown
  misc_feature (1)..( 8): Matrix.002 file - promoters60/1378333
cacaccgt

SEQ ID NO: 47057 - DNA, 7 bp, Unknown
  misc_feature (1)..( 7): Matrix.002 file - promoters60/1378333
gtgaatt

SEQ ID NO: 47058 - DNA, 6 bp, Unknown
  misc_feature (1)..( 6): Matrix.002 file - promoters60/1378333
ccgttg

SEQ ID NO: 47059 - DNA, 6 bp, Unknown
  misc_feature (1)..( 6): Matrix.002 file - promoters60/1378333
atcgta

SEQ ID NO: 47060 - DNA, 6 bp, Unknown
  misc_feature (1)..( 6): Matrix.002 file - promoters60/1378333
agtcga

SEQ ID NO: 47061 - DNA, 9 bp, Unknown
  misc_feature (1)..( 9): Matrix.002 file - promoters60/1378333
gtgtcctct

SEQ ID NO: 47062 - DNA, 6 bp, Unknown
  misc_feature (1)..( 6): Matrix.002 file - promoters60/1378333
aaccgt

SEQ ID NO: 47063 - DNA, 7 bp, Unknown
  misc_feature (1)..( 7): Matrix.002 file - promoters60/1378333
aatacaa

SEQ ID NO: 47064 - DNA, 7 bp, Unknown
  misc_feature (1)..( 7): Matrix.002 file - promoters60/1378333
agaaagg

SEQ ID NO: 47065 - DNA, 7 bp, Unknown
  misc_feature (1)..( 7): Matrix.002 file - promoters60/1378333
ttgaaga

SEQ ID NO: 47066 - DNA, 7 bp, Unknown
  misc_feature (1)..( 7): Matrix.002 file - promoters60/1378333
cgtggat

SEQ ID NO: 47067 - DNA, 7 bp, Unknown
  misc_feature (1)..( 7): Matrix.002 file - promoters60/1378333
catcgag

SEQ ID NO: 47068 - DNA, 6 bp, Unknown
  misc_feature (1)..( 6): Matrix.002 file - promoters60/1378333
atcgga

SEQ ID NO: 47069 - DNA, 8 bp, Unknown
  misc_feature (1)..( 8): Matrix.002 file - promoters60/1378333
gtaagttt

SEQ ID NO: 47070 - DNA, 7 bp, Unknown
  misc_feature (1)..( 7): Matrix.002 file - promoters60/1378333
ctaaaca

SEQ ID NO: 47071 - DNA, 14 bp, Unknown
  misc_feature (1)..( 14): Matrix.002 file - promoters60/1378393
gaaaatatcagaat

SEQ ID NO: 47072 - DNA, 15 bp, Unknown
  misc_feature (1)..( 15): Matrix.002 file - promoters60/1378400
cccatagctccttaa

SEQ ID NO: 47073 - DNA, 7 bp, Unknown
  misc_feature (1)..( 7): Matrix.002 file - promoters60/1378400
tttggtt

SEQ ID NO: 47074 - DNA, 8 bp, Unknown
  misc_feature (1)..( 8): Matrix.002 file - promoters60/1378400
gaagagaa

SEQ ID NO: 47075 - DNA, 14 bp, Unknown
  misc_feature (1)..( 14): Matrix.002 file - promoters60/1378400
ttagcttcagcttc

SEQ ID NO: 47076 - DNA, 13 bp, Unknown
  misc_feature (1)..( 13): Matrix.002 file - promoters60/1378400
agagagagagaga

SEQ ID NO: 47077 - DNA, 7 bp, Unknown
  misc_feature (1)..( 7): Matrix.002 file - promoters60/1378400
agagaag

SEQ ID NO: 47078 - DNA, 7 bp, Unknown
  misc_feature (1)..( 7): Matrix.002 file - promoters60/1378400
ggatcaa

SEQ ID NO: 47079 - DNA, 11 bp, Unknown
  misc_feature (1)..( 11): Matrix.002 file - promoters60/1378400
attcagggttt

SEQ ID NO: 47080 - DNA, 8 bp, Unknown
  misc_feature (1)..( 8): Matrix.002 file - promoters60/1378400
aaacaatt

SEQ ID NO: 47081 - DNA, 7 bp, Unknown
  misc_feature (1)..( 7): Matrix.002 file - promoters60/1378400
aacgcga

SEQ ID NO: 47082 - DNA, 8 bp, Unknown
  misc_feature (1)..( 8): Matrix.002 file - promoters60/1378400
aaagagaa

SEQ ID NO: 47083 - DNA, 8 bp, Unknown
  misc_feature (1)..( 8): Matrix.002 file - promoters60/1378400
aacgcgaa

SEQ ID NO: 47084 - DNA, 6 bp, Unknown
  misc_feature (1)..( 6): Matrix.002 file - promoters60/1378400
ttatat

SEQ ID NO: 47085 - DNA, 7 bp, Unknown
  misc_feature (1)..( 7): Matrix.002 file - promoters60/1378400
tttggtt

SEQ ID NO: 47086 - DNA, 6 bp, Unknown
  misc_feature (1)..( 6): Matrix.002 file - promoters60/1378400
tagctt

SEQ ID NO: 47087 - DNA, 7 bp, Unknown
  misc_feature (1)..( 7): Matrix.002 file - promoters60/1378400
aacgcga

SEQ ID NO: 47088 - DNA, 7 bp, Unknown
  misc_feature (1)..( 7): Matrix.002 file - promoters60/1378458
gcttctc

SEQ ID NO: 47089 - DNA, 8 bp, Unknown
  misc_feature (1)..( 8): Matrix.002 file - promoters60/1378458
aaagaaaa

SEQ ID NO: 47090 - DNA, 9 bp, Unknown
  misc_feature (1)..( 9): Matrix.002 file - promoters60/1378458
aaccaatcc

SEQ ID NO: 47091 - DNA, 6 bp, Unknown
  misc_feature (1)..( 6): Matrix.002 file - promoters60/1378458
tgtcaa

SEQ ID NO: 47092 - DNA, 10 bp, Unknown
  misc_feature (1)..( 10): Matrix.002 file - promoters60/1378458
ttcttcatta

SEQ ID NO: 47093 - DNA, 8 bp, Unknown
  misc_feature (1)..( 8): Matrix.002 file - promoters60/1378458
gatgggaa

SEQ ID NO: 47094 - DNA, 7 bp, Unknown
  misc_feature (1)..( 7): Matrix.002 file - promoters60/1378458
tctgcag

SEQ ID NO: 47095 - DNA, 7 bp, Unknown
  misc_feature (1)..( 7): Matrix.002 file - promoters60/1378458
gtcctat

SEQ ID NO: 47096 - DNA, 7 bp, Unknown
  misc_feature (1)..( 7): Matrix.002 file - promoters60/1378458
tggtggg

SEQ ID NO: 47097 - DNA, 7 bp, Unknown
  misc_feature (1)..( 7): Matrix.002 file - promoters60/1378458
gaagttg

SEQ ID NO: 47098 - DNA, 8 bp, Unknown
  misc_feature (1)..( 8): Matrix.002 file - promoters60/1378458
tttagctt

SEQ ID NO: 47099 - DNA, 6 bp, Unknown
  misc_feature (1)..( 6): Matrix.002 file - promoters60/1378458
gaatta

SEQ ID NO: 47100 - DNA, 6 bp, Unknown
  misc_feature (1)..( 6): Matrix.002 file - promoters60/1378458
gcggaa

SEQ ID NO: 47101 - DNA, 7 bp, Unknown
  misc_feature (1)..( 7): Matrix.002 file - promoters60/1378458
tatcttc

SEQ ID NO: 47102 - DNA, 6 bp, Unknown
  misc_feature (1)..( 6): Matrix.002 file - promoters60/1378458
tccttg

SEQ ID NO: 47103 - DNA, 7 bp, Unknown
  misc_feature (1)..( 7): Matrix.002 file - promoters60/1378458
gatatat

SEQ ID NO: 47104 - DNA, 10 bp, Unknown
  misc_feature (1)..( 10): Matrix.002 file - promoters60/1378528
taattttgga

SEQ ID NO: 47105 - DNA, 7 bp, Unknown
  misc_feature (1)..( 7): Matrix.002 file - promoters60/1378528
aaaaaaa

SEQ ID NO: 47106 - DNA, 9 bp, Unknown
  misc_feature (1)..( 9): Matrix.002 file - promoters60/1378528
agtatttag

SEQ ID NO: 47107 - DNA, 7 bp, Unknown
  misc_feature (1)..( 7): Matrix.002 file - promoters60/1378528
tatacaa

SEQ ID NO: 47108 - DNA, 11 bp, Unknown
  misc_feature (1)..( 11): Matrix.002 file - promoters60/1378528
ccaaaataaaa

SEQ ID NO: 47109 - DNA, 9 bp, Unknown
  misc_feature (1)..( 9): Matrix.002 file - promoters60/1378528
ataaaataa

SEQ ID NO: 47110 - DNA, 9 bp, Unknown
  misc_feature (1)..( 9): Matrix.002 file - promoters60/1378528
tttttaatt

SEQ ID NO: 47111 - DNA, 11 bp, Unknown
  misc_feature (1)..( 11): Matrix.002 file - promoters60/1378528
tttaaaagatt

SEQ ID NO: 47112 - DNA, 6 bp, Unknown
  misc_feature (1)..( 6): Matrix.002 file - promoters60/1378528
ttttct

SEQ ID NO: 47113 - DNA, 7 bp, Unknown
  misc_feature (1)..( 7): Matrix.002 file - promoters60/1378622
tttatta

SEQ ID NO: 47114 - DNA, 8 bp, Unknown
  misc_feature (1)..( 8): Matrix.002 file - promoters60/1378622
tttatcta

SEQ ID NO: 47115 - DNA, 6 bp, Unknown
  misc_feature (1)..( 6): Matrix.002 file - promoters60/1378622
attttt

SEQ ID NO: 47116 - DNA, 8 bp, Unknown
  misc_feature (1)..( 8): Matrix.002 file - promoters60/1378622
aaagattt

SEQ ID NO: 47117 - DNA, 8 bp, Unknown
  misc_feature (1)..( 8): Matrix.002 file - promoters60/1378622
ggtatttg

SEQ ID NO: 47118 - DNA, 6 bp, Unknown
  misc_feature (1)..( 6): Matrix.002 file - promoters60/1378622
atgaat

SEQ ID NO: 47119 - DNA, 7 bp, Unknown
  misc_feature (1)..( 7): Matrix.002 file - promoters60/1378622
ttacaat

SEQ ID NO: 47120 - DNA, 9 bp, Unknown
  misc_feature (1)..( 9): Matrix.002 file - promoters60/1378622
aattttaac

SEQ ID NO: 47121 - DNA, 14 bp, Unknown
  misc_feature (1)..( 14): Matrix.002 file - promoters60/1378622
aatttctcccaaaa

SEQ ID NO: 47122 - DNA, 8 bp, Unknown
  misc_feature (1)..( 8): Matrix.002 file - promoters60/1378622
ttaacctt

SEQ ID NO: 47123 - DNA, 13 bp, Unknown
  misc_feature (1)..( 13): Matrix.002 file - promoters60/1378622
ttgaatcaaaatt

SEQ ID NO: 47124 - DNA, 7 bp, Unknown
  misc_feature (1)..( 7): Matrix.002 file - promoters60/1378622
tggattt

SEQ ID NO: 47125 - DNA, 6 bp, Unknown
  misc_feature (1)..( 6): Matrix.002 file - promoters60/1378622
ttggtt

SEQ ID NO: 47126 - DNA, 7 bp, Unknown
  misc_feature (1)..( 7): Matrix.002 file - promoters60/1378622
ctcactc

SEQ ID NO: 47127 - DNA, 8 bp, Unknown
  misc_feature (1)..( 8): Matrix.002 file - promoters60/1378692
attatata

SEQ ID NO: 47128 - DNA, 8 bp, Unknown
  misc_feature (1)..( 8): Matrix.002 file - promoters60/1378692
aatattta

SEQ ID NO: 47129 - DNA, 12 bp, Unknown
  misc_feature (1)..( 12): Matrix.002 file - promoters60/1378692
cgctatttctca

SEQ ID NO: 47130 - DNA, 11 bp, Unknown
  misc_feature (1)..( 11): Matrix.002 file - promoters60/1378692
gaattttataa

SEQ ID NO: 47131 - DNA, 9 bp, Unknown
  misc_feature (1)..( 9): Matrix.002 file - promoters60/1378692
tatacaatg

SEQ ID NO: 47132 - DNA, 8 bp, Unknown
  misc_feature (1)..( 8): Matrix.002 file - promoters60/1378692
aacaatca

SEQ ID NO: 47133 - DNA, 9 bp, Unknown
  misc_feature (1)..( 9): Matrix.002 file - promoters60/1378692
tattataaa

SEQ ID NO: 47134 - DNA, 9 bp, Unknown
  misc_feature (1)..( 9): Matrix.002 file - promoters60/1378692
gatattatt

SEQ ID NO: 47135 - DNA, 6 bp, Unknown
  misc_feature (1)..( 6): Matrix.002 file - promoters60/1378800
gttttt

SEQ ID NO: 47136 - DNA, 8 bp, Unknown
  misc_feature (1)..( 8): Matrix.002 file - promoters60/1378800
gtttcttt

SEQ ID NO: 47137 - DNA, 7 bp, Unknown
  misc_feature (1)..( 7): Matrix.002 file - promoters60/1378800
tttcttt

SEQ ID NO: 47138 - DNA, 8 bp, Unknown
  misc_feature (1)..( 8): Matrix.002 file - promoters60/1378800
attttttt

SEQ ID NO: 47139 - DNA, 9 bp, Unknown
  misc_feature (1)..( 9): Matrix.002 file - promoters60/1378800
ttttttaaa

SEQ ID NO: 47140 - DNA, 8 bp, Unknown
  misc_feature (1)..( 8): Matrix.002 file - promoters60/1378800
cataaaaa

SEQ ID NO: 47141 - DNA, 6 bp, Unknown
  misc_feature (1)..( 6): Matrix.002 file - promoters60/1378880
tgaata

SEQ ID NO: 47142 - DNA, 7 bp, Unknown
  misc_feature (1)..( 7): Matrix.002 file - promoters60/1378880
aaagaaa

SEQ ID NO: 47143 - DNA, 7 bp, Unknown
  misc_feature (1)..( 7): Matrix.002 file - promoters60/1378880
aaaatat

SEQ ID NO: 47144 - DNA, 6 bp, Unknown
  misc_feature (1)..( 6): Matrix.002 file - promoters60/1378880
tcacaa

SEQ ID NO: 47145 - DNA, 7 bp, Unknown
  misc_feature (1)..( 7): Matrix.002 file - promoters60/1378880
atctaac

SEQ ID NO: 47146 - DNA, 15 bp, Unknown
  misc_feature (1)..( 15): Matrix.002 file - promoters60/1378880
gcttatgatgtgtcg

SEQ ID NO: 47147 - DNA, 7 bp, Unknown
  misc_feature (1)..( 7): Matrix.002 file - promoters60/1378880
atacaaa

SEQ ID NO: 47148 - DNA, 7 bp, Unknown
  misc_feature (1)..( 7): Matrix.002 file - promoters60/1378880
atatata

SEQ ID NO: 47149 - DNA, 7 bp, Unknown
  misc_feature (1)..( 7): Matrix.002 file - promoters60/1378880
aaaatat

SEQ ID NO: 47150 - DNA, 7 bp, Unknown
  misc_feature (1)..( 7): Matrix.002 file - promoters60/1378880
aaacaaa

SEQ ID NO: 47151 - DNA, 8 bp, Unknown
  misc_feature (1)..( 8): Matrix.002 file - promoters60/1378880
ctaatttc

SEQ ID NO: 47152 - DNA, 6 bp, Unknown
  misc_feature (1)..( 6): Matrix.002 file - promoters60/1378880
gattct

SEQ ID NO: 47153 - DNA, 7 bp, Unknown
  misc_feature (1)..( 7): Matrix.002 file - promoters60/1378880
cacctgt

SEQ ID NO: 47154 - DNA, 9 bp, Unknown
  misc_feature (1)..( 9): Matrix.002 file - promoters60/1378880
ttcacaata

SEQ ID NO: 47155 - DNA, 6 bp, Unknown
  misc_feature (1)..( 6): Matrix.002 file - promoters60/1378880
gcaaag

SEQ ID NO: 47156 - DNA, 6 bp, Unknown
  misc_feature (1)..( 6): Matrix.002 file - promoters60/1378880
gtaacg

SEQ ID NO: 47157 - DNA, 6 bp, Unknown
  misc_feature (1)..( 6): Matrix.002 file - promoters60/1378888
cttttg

SEQ ID NO: 47158 - DNA, 6 bp, Unknown
  misc_feature (1)..( 6): Matrix.002 file - promoters60/1378888
atctct

SEQ ID NO: 47159 - DNA, 11 bp, Unknown
  misc_feature (1)..( 11): Matrix.002 file - promoters60/1378888
caagtatctga

SEQ ID NO: 47160 - DNA, 6 bp, Unknown
  misc_feature (1)..( 6): Matrix.002 file - promoters60/1378888
tttcat

SEQ ID NO: 47161 - DNA, 6 bp, Unknown
  misc_feature (1)..( 6): Matrix.002 file - promoters60/1378888
gaaatt

SEQ ID NO: 47162 - DNA, 7 bp, Unknown
  misc_feature (1)..( 7): Matrix.002 file - promoters60/1378888
agtttga

SEQ ID NO: 47163 - DNA, 8 bp, Unknown
  misc_feature (1)..( 8): Matrix.002 file - promoters60/1378888
actacttt

SEQ ID NO: 47164 - DNA, 8 bp, Unknown
  misc_feature (1)..( 8): Matrix.002 file - promoters60/1378888
tgtcagaa

SEQ ID NO: 47165 - DNA, 6 bp, Unknown
  misc_feature (1)..( 6): Matrix.002 file - promoters60/1378888
attact

SEQ ID NO: 47166 - DNA, 8 bp, Unknown
  misc_feature (1)..( 8): Matrix.002 file - promoters60/1378888
ttgaaatt

SEQ ID NO: 47167 - DNA, 8 bp, Unknown
  misc_feature (1)..( 8): Matrix.002 file - promoters60/1378888
atatttgt

SEQ ID NO: 47168 - DNA, 7 bp, Unknown
  misc_feature (1)..( 7): Matrix.002 file - promoters60/1378888
tatctat

SEQ ID NO: 47169 - DNA, 8 bp, Unknown
  misc_feature (1)..( 8): Matrix.002 file - promoters60/1378888
ttgaatga

SEQ ID NO: 47170 - DNA, 6 bp, Unknown
  misc_feature (1)..( 6): Matrix.002 file - promoters60/1378888
aaaaat

SEQ ID NO: 47171 - DNA, 6 bp, Unknown
  misc_feature (1)..( 6): Matrix.002 file - promoters60/1378888
tttcag

SEQ ID NO: 47172 - DNA, 7 bp, Unknown
  misc_feature (1)..( 7): Matrix.002 file - promoters60/1378888
aaaatga

SEQ ID NO: 47173 - DNA, 6 bp, Unknown
  misc_feature (1)..( 6): Matrix.002 file - promoters60/1378888
tgtatt

SEQ ID NO: 47174 - DNA, 7 bp, Unknown
  misc_feature (1)..( 7): Matrix.002 file - promoters60/1378888
attgtat

SEQ ID NO: 47175 - DNA, 9 bp, Unknown
  misc_feature (1)..( 9): Matrix.002 file - promoters60/1378888
tttctgttt

SEQ ID NO: 47176 - DNA, 8 bp, Unknown
  misc_feature (1)..( 8): Matrix.002 file - promoters60/1378888
cttaaaat

SEQ ID NO: 47177 - DNA, 11 bp, Unknown
  misc_feature (1)..( 11): Matrix.002 file - promoters60/1378888
aaataataatt

SEQ ID NO: 47178 - DNA, 6 bp, Unknown
  misc_feature (1)..( 6): Matrix.002 file - promoters60/1378888
acaaaa

SEQ ID NO: 47179 - DNA, 6 bp, Unknown
  misc_feature (1)..( 6): Matrix.002 file - promoters60/1379005
ttaaaa

SEQ ID NO: 47180 - DNA, 6 bp, Unknown
  misc_feature (1)..( 6): Matrix.002 file - promoters60/1379005
taaaac

SEQ ID NO: 47181 - DNA, 6 bp, Unknown
  misc_feature (1)..( 6): Matrix.002 file - promoters60/1379005
aaactt

SEQ ID NO: 47182 - DNA, 7 bp, Unknown
  misc_feature (1)..( 7): Matrix.002 file - promoters60/1379005
cacaatc

SEQ ID NO: 47183 - DNA, 7 bp, Unknown
  misc_feature (1)..( 7): Matrix.002 file - promoters60/1379005
aaaccaa

SEQ ID NO: 47184 - DNA, 7 bp, Unknown
  misc_feature (1)..( 7): Matrix.002 file - promoters60/1379005
aaaccaa

SEQ ID NO: 47185 - DNA, 6 bp, Unknown
  misc_feature (1)..( 6): Matrix.002 file - promoters60/1379005
aataaa

SEQ ID NO: 47186 - DNA, 7 bp, Unknown
  misc_feature (1)..( 7): Matrix.002 file - promoters60/1379005
aagaaga

SEQ ID NO: 47187 - DNA, 9 bp, Unknown
  misc_feature (1)..( 9): Matrix.002 file - promoters60/1379005
ttacagtta

SEQ ID NO: 47188 - DNA, 6 bp, Unknown
  misc_feature (1)..( 6): Matrix.002 file - promoters60/1379005
cagaaa

SEQ ID NO: 47189 - DNA, 7 bp, Unknown
  misc_feature (1)..( 7): Matrix.002 file - promoters60/1379005
tccacca

SEQ ID NO: 47190 - DNA, 6 bp, Unknown
  misc_feature (1)..( 6): Matrix.002 file - promoters60/1379005
ttttga

SEQ ID NO: 47191 - DNA, 6 bp, Unknown
  misc_feature (1)..( 6): Matrix.002 file - promoters60/1379005
tcttct

SEQ ID NO: 47192 - DNA, 7 bp, Unknown
  misc_feature (1)..( 7): Matrix.002 file - promoters60/1379005
cacacca

SEQ ID NO: 47193 - DNA, 11 bp, Unknown
  misc_feature (1)..( 11): Matrix.002 file - promoters60/1379005
ctttcttcttt

SEQ ID NO: 47194 - DNA, 8 bp, Unknown
  misc_feature (1)..( 8): Matrix.002 file - promoters60/1379005
tttgcttc

SEQ ID NO: 47195 - DNA, 7 bp, Unknown
  misc_feature (1)..( 7): Matrix.002 file - promoters60/1379005
caagttg

SEQ ID NO: 47196 - DNA, 8 bp, Unknown
  misc_feature (1)..( 8): Matrix.002 file - promoters60/1379005
taaaaaaa

SEQ ID NO: 47197 - DNA, 8 bp, Unknown
  misc_feature (1)..( 8): Matrix.002 file - promoters60/1379005
caagaaaa

SEQ ID NO: 47198 - DNA, 8 bp, Unknown
  misc_feature (1)..( 8): Matrix.002 file - promoters60/1379005
aagaatct

SEQ ID NO: 47199 - DNA, 8 bp, Unknown
  misc_feature (1)..( 8): Matrix.002 file - promoters60/1379005
tccaacaa

SEQ ID NO: 47200 - DNA, 7 bp, Unknown
  misc_feature (1)..( 7): Matrix.002 file - promoters60/1379014
ttagttt

SEQ ID NO: 47201 - DNA, 7 bp, Unknown
  misc_feature (1)..( 7): Matrix.002 file - promoters60/1379014
aaaaaag

SEQ ID NO: 47202 - DNA, 7 bp, Unknown
  misc_feature (1)..( 7): Matrix.002 file - promoters60/1379014
catgcaa

SEQ ID NO: 47203 - DNA, 6 bp, Unknown
  misc_feature (1)..( 6): Matrix.002 file - promoters60/1379014
cataga

SEQ ID NO: 47204 - DNA, 7 bp, Unknown
  misc_feature (1)..( 7): Matrix.002 file - promoters60/1379014
aatctat

SEQ ID NO: 47205 - DNA, 6 bp, Unknown
  misc_feature (1)..( 6): Matrix.002 file - promoters60/1379014
caaaac

SEQ ID NO: 47206 - DNA, 6 bp, Unknown
  misc_feature (1)..( 6): Matrix.002 file - promoters60/1379014
ccaaaa

SEQ ID NO: 47207 - DNA, 6 bp, Unknown
  misc_feature (1)..( 6): Matrix.002 file - promoters60/1379014
atacaa

SEQ ID NO: 47208 - DNA, 6 bp, Unknown
  misc_feature (1)..( 6): Matrix.002 file - promoters60/1379014
aaattc

SEQ ID NO: 47209 - DNA, 8 bp, Unknown
  misc_feature (1)..( 8): Matrix.002 file - promoters60/1379014
aatttaaa

SEQ ID NO: 47210 - DNA, 6 bp, Unknown
  misc_feature (1)..( 6): Matrix.002 file - promoters60/1379014
aaataa

SEQ ID NO: 47211 - DNA, 6 bp, Unknown
  misc_feature (1)..( 6): Matrix.002 file - promoters60/1379014
taaata

SEQ ID NO: 47212 - DNA, 6 bp, Unknown
  misc_feature (1)..( 6): Matrix.002 file - promoters60/1379014
atgaag

SEQ ID NO: 47213 - DNA, 11 bp, Unknown
  misc_feature (1)..( 11): Matrix.002 file - promoters60/1379014
tttctctttca

SEQ ID NO: 47214 - DNA, 6 bp, Unknown
  misc_feature (1)..( 6): Matrix.002 file - promoters60/1379014
acaatt

SEQ ID NO: 47215 - DNA, 6 bp, Unknown
  misc_feature (1)..( 6): Matrix.002 file - promoters60/1379014
aaaata

SEQ ID NO: 47216 - DNA, 7 bp, Unknown
  misc_feature (1)..( 7): Matrix.002 file - promoters60/1379014
aaaaaga

SEQ ID NO: 47217 - DNA, 6 bp, Unknown
  misc_feature (1)..( 6): Matrix.002 file - promoters60/1379014
atagac

SEQ ID NO: 47218 - DNA, 7 bp, Unknown
  misc_feature (1)..( 7): Matrix.002 file - promoters60/1379014
agaattt

SEQ ID NO: 47219 - DNA, 11 bp, Unknown
  misc_feature (1)..( 11): Matrix.002 file - promoters60/1379037
ttcaaataaaa

SEQ ID NO: 47220 - DNA, 10 bp, Unknown
  misc_feature (1)..( 10): Matrix.002 file - promoters60/1379037
ccaaaatagt

SEQ ID NO: 47221 - DNA, 9 bp, Unknown
  misc_feature (1)..( 9): Matrix.002 file - promoters60/1379037
aagaaaaaa

SEQ ID NO: 47222 - DNA, 11 bp, Unknown
  misc_feature (1)..( 11): Matrix.002 file - promoters60/1379037
aaaaaactcaa

SEQ ID NO: 47223 - DNA, 12 bp, Unknown
  misc_feature (1)..( 12): Matrix.002 file - promoters60/1379037
aaataaatggaa

SEQ ID NO: 47224 - DNA, 6 bp, Unknown
  misc_feature (1)..( 6): Matrix.002 file - promoters60/1379037
cagaaa

SEQ ID NO: 47225 - DNA, 11 bp, Unknown
  misc_feature (1)..( 11): Matrix.002 file - promoters60/1379037
agaaaagaaaa

SEQ ID NO: 47226 - DNA, 10 bp, Unknown
  misc_feature (1)..( 10): Matrix.002 file - promoters60/1379037
aaataaaata

SEQ ID NO: 47227 - DNA, 9 bp, Unknown
  misc_feature (1)..( 9): Matrix.002 file - promoters60/1379037
aaagtaaag

SEQ ID NO: 47228 - DNA, 8 bp, Unknown
  misc_feature (1)..( 8): Matrix.002 file - promoters60/1379043
atttgatt

SEQ ID NO: 47229 - DNA, 7 bp, Unknown
  misc_feature (1)..( 7): Matrix.002 file - promoters60/1379043
ttctccc

SEQ ID NO: 47230 - DNA, 7 bp, Unknown
  misc_feature (1)..( 7): Matrix.002 file - promoters60/1379043
acaatct

SEQ ID NO: 47231 - DNA, 7 bp, Unknown
  misc_feature (1)..( 7): Matrix.002 file - promoters60/1379043
tctatat

SEQ ID NO: 47232 - DNA, 8 bp, Unknown
  misc_feature (1)..( 8): Matrix.002 file - promoters60/1379043
tatcgttg

SEQ ID NO: 47233 - DNA, 6 bp, Unknown
  misc_feature (1)..( 6): Matrix.002 file - promoters60/1379043
ctccaa

SEQ ID NO: 47234 - DNA, 6 bp, Unknown
  misc_feature (1)..( 6): Matrix.002 file - promoters60/1379043
ttaaca

SEQ ID NO: 47235 - DNA, 6 bp, Unknown
  misc_feature (1)..( 6): Matrix.002 file - promoters60/1379043
gtggac

SEQ ID NO: 47236 - DNA, 6 bp, Unknown
  misc_feature (1)..( 6): Matrix.002 file - promoters60/1379043
attata

SEQ ID NO: 47237 - DNA, 6 bp, Unknown
  misc_feature (1)..( 6): Matrix.002 file - promoters60/1379043
tatttt

SEQ ID NO: 47238 - DNA, 11 bp, Unknown
  misc_feature (1)..( 11): Matrix.002 file - promoters60/1379043
ccaaatattaa

SEQ ID NO: 47239 - DNA, 6 bp, Unknown
  misc_feature (1)..( 6): Matrix.002 file - promoters60/1379043
ataaaa

SEQ ID NO: 47240 - DNA, 8 bp, Unknown
  misc_feature (1)..( 8): Matrix.002 file - promoters60/1379043
aaaagaag

SEQ ID NO: 47241 - DNA, 7 bp, Unknown
  misc_feature (1)..( 7): Matrix.002 file - promoters60/1379043
aaaaaga

SEQ ID NO: 47242 - DNA, 7 bp, Unknown
  misc_feature (1)..( 7): Matrix.002 file - promoters60/1379043
aaaacaa

SEQ ID NO: 47243 - DNA, 6 bp, Unknown
  misc_feature (1)..( 6): Matrix.002 file - promoters60/1379043
ggtctc

SEQ ID NO: 47244 - DNA, 7 bp, Unknown
  misc_feature (1)..( 7): Matrix.002 file - promoters60/1379043
ctaattt

SEQ ID NO: 47245 - DNA, 6 bp, Unknown
  misc_feature (1)..( 6): Matrix.002 file - promoters60/1379043
tttgga

SEQ ID NO: 47246 - DNA, 6 bp, Unknown
  misc_feature (1)..( 6): Matrix.002 file - promoters60/1379043
gatttg

SEQ ID NO: 47247 - DNA, 8 bp, Unknown
  misc_feature (1)..( 8): Matrix.002 file - promoters60/1379043
aaaacttt

SEQ ID NO: 47248 - DNA, 6 bp, Unknown
  misc_feature (1)..( 6): Matrix.002 file - promoters60/1379050
aacaaa

SEQ ID NO: 47249 - DNA, 7 bp, Unknown
  misc_feature (1)..( 7): Matrix.002 file - promoters60/1379050
tttaaac

SEQ ID NO: 47250 - DNA, 6 bp, Unknown
  misc_feature (1)..( 6): Matrix.002 file - promoters60/1379050
tgaaga

SEQ ID NO: 47251 - DNA, 9 bp, Unknown
  misc_feature (1)..( 9): Matrix.002 file - promoters60/1379050
tgaaggaaa

SEQ ID NO: 47252 - DNA, 6 bp, Unknown
  misc_feature (1)..( 6): Matrix.002 file - promoters60/1379050
tctctc

SEQ ID NO: 47253 - DNA, 7 bp, Unknown
  misc_feature (1)..( 7): Matrix.002 file - promoters60/1379050
taaagag

SEQ ID NO: 47254 - DNA, 6 bp, Unknown
  misc_feature (1)..( 6): Matrix.002 file - promoters60/1379050
acgctt

SEQ ID NO: 47255 - DNA, 7 bp, Unknown
  misc_feature (1)..( 7): Matrix.002 file - promoters60/1379050
tatataa

SEQ ID NO: 47256 - DNA, 7 bp, Unknown
  misc_feature (1)..( 7): Matrix.002 file - promoters60/1379050
cttgtat

SEQ ID NO: 47257 - DNA, 7 bp, Unknown
  misc_feature (1)..( 7): Matrix.002 file - promoters60/1379050
cgaggaa

SEQ ID NO: 47258 - DNA, 7 bp, Unknown
  misc_feature (1)..( 7): Matrix.002 file - promoters60/1379050
ttacacg

SEQ ID NO: 47259 - DNA, 8 bp, Unknown
  misc_feature (1)..( 8): Matrix.002 file - promoters60/1379050
agatgttt

SEQ ID NO: 47260 - DNA, 9 bp, Unknown
  misc_feature (1)..( 9): Matrix.002 file - promoters60/1379050
gaggtttat

SEQ ID NO: 47261 - DNA, 6 bp, Unknown
  misc_feature (1)..( 6): Matrix.002 file - promoters60/1379050
ctaata

SEQ ID NO: 47262 - DNA, 7 bp, Unknown
  misc_feature (1)..( 7): Matrix.002 file - promoters60/1379050
aattata

SEQ ID NO: 47263 - DNA, 7 bp, Unknown
  misc_feature (1)..( 7): Matrix.002 file - promoters60/1379075
tatctta

SEQ ID NO: 47264 - DNA, 6 bp, Unknown
  misc_feature (1)..( 6): Matrix.002 file - promoters60/1379075
tattaa

SEQ ID NO: 47265 - DNA, 9 bp, Unknown
  misc_feature (1)..( 9): Matrix.002 file - promoters60/1379075
gaatataaa

SEQ ID NO: 47266 - DNA, 8 bp, Unknown
  misc_feature (1)..( 8): Matrix.002 file - promoters60/1379075
aaattaaa

SEQ ID NO: 47267 - DNA, 10 bp, Unknown
  misc_feature (1)..( 10): Matrix.002 file - promoters60/1379075
tttaaacaaa

SEQ ID NO: 47268 - DNA, 6 bp, Unknown
  misc_feature (1)..( 6): Matrix.002 file - promoters60/1379075
attaat

SEQ ID NO: 47269 - DNA, 12 bp, Unknown
  misc_feature (1)..( 12): Matrix.002 file - promoters60/1379075
attaaaaaataa

SEQ ID NO: 47270 - DNA, 6 bp, Unknown
  misc_feature (1)..( 6): Matrix.002 file - promoters60/1379075
taaaat

SEQ ID NO: 47271 - DNA, 9 bp, Unknown
  misc_feature (1)..( 9): Matrix.002 file - promoters60/1379075
ccataaaca

SEQ ID NO: 47272 - DNA, 7 bp, Unknown
  misc_feature (1)..( 7): Matrix.002 file - promoters60/1379075
agaagaa

SEQ ID NO: 47273 - DNA, 6 bp, Unknown
  misc_feature (1)..( 6): Matrix.002 file - promoters60/1379075
cgttaa

SEQ ID NO: 47274 - DNA, 6 bp, Unknown
  misc_feature (1)..( 6): Matrix.002 file - promoters60/1379075
ttttta

SEQ ID NO: 47275 - DNA, 11 bp, Unknown
  misc_feature (1)..( 11): Matrix.002 file - promoters60/1379075
ataaataaata

SEQ ID NO: 47276 - DNA, 7 bp, Unknown
  misc_feature (1)..( 7): Matrix.002 file - promoters60/1379075
aaacttt

SEQ ID NO: 47277 - DNA, 13 bp, Unknown
  misc_feature (1)..( 13): Matrix.002 file - promoters60/1379075
cttttaaatactt

SEQ ID NO: 47278 - DNA, 13 bp, Unknown
  misc_feature (1)..( 13): Matrix.002 file - promoters60/1379075
ttaaaaacttttt

SEQ ID NO: 47279 - DNA, 15 bp, Unknown
  misc_feature (1)..( 15): Matrix.002 file - promoters60/1379075
tttaattctcaattt

SEQ ID NO: 47280 - DNA, 6 bp, Unknown
  misc_feature (1)..( 6): Matrix.002 file - promoters60/1379075
gtattc

SEQ ID NO: 47281 - DNA, 7 bp, Unknown
  misc_feature (1)..( 7): Matrix.002 file - promoters60/1379075
tgtagct

SEQ ID NO: 47282 - DNA, 8 bp, Unknown
  misc_feature (1)..( 8): Matrix.002 file - promoters60/1379075
ggataaga

SEQ ID NO: 47283 - DNA, 7 bp, Unknown
  misc_feature (1)..( 7): Matrix.002 file - promoters60/1379075
tttatga

SEQ ID NO: 47284 - DNA, 8 bp, Unknown
  misc_feature (1)..( 8): Matrix.002 file - promoters60/1379075
aatcaccc

SEQ ID NO: 47285 - DNA, 8 bp, Unknown
  misc_feature (1)..( 8): Matrix.002 file - promoters60/1379141
aatcattt

SEQ ID NO: 47286 - DNA, 7 bp, Unknown
  misc_feature (1)..( 7): Matrix.002 file - promoters60/1379141
aaaatta

SEQ ID NO: 47287 - DNA, 8 bp, Unknown
  misc_feature (1)..( 8): Matrix.002 file - promoters60/1379141
tatcggtt

SEQ ID NO: 47288 - DNA, 9 bp, Unknown
  misc_feature (1)..( 9): Matrix.002 file - promoters60/1379141
tttcaataa

SEQ ID NO: 47289 - DNA, 7 bp, Unknown
  misc_feature (1)..( 7): Matrix.002 file - promoters60/1379141
tattttc

SEQ ID NO: 47290 - DNA, 7 bp, Unknown
  misc_feature (1)..( 7): Matrix.002 file - promoters60/1379141
aaataaa

SEQ ID NO: 47291 - DNA, 6 bp, Unknown
  misc_feature (1)..( 6): Matrix.002 file - promoters60/1379141
taacaa

SEQ ID NO: 47292 - DNA, 8 bp, Unknown
  misc_feature (1)..( 8): Matrix.002 file - promoters60/1379141
aagttgat

SEQ ID NO: 47293 - DNA, 6 bp, Unknown
  misc_feature (1)..( 6): Matrix.002 file - promoters60/1379141
tagtat

SEQ ID NO: 47294 - DNA, 8 bp, Unknown
  misc_feature (1)..( 8): Matrix.002 file - promoters60/1379141
tttcagga

SEQ ID NO: 47295 - DNA, 7 bp, Unknown
  misc_feature (1)..( 7): Matrix.002 file - promoters60/1379141
tcacaaa

SEQ ID NO: 47296 - DNA, 7 bp, Unknown
  misc_feature (1)..( 7): Matrix.002 file - promoters60/1379141
aataaaa

SEQ ID NO: 47297 - DNA, 9 bp, Unknown
  misc_feature (1)..( 9): Matrix.002 file - promoters60/1379141
taaaaaaat

SEQ ID NO: 47298 - DNA, 7 bp, Unknown
  misc_feature (1)..( 7): Matrix.002 file - promoters60/1379141
acggttc

SEQ ID NO: 47299 - DNA, 9 bp, Unknown
  misc_feature (1)..( 9): Matrix.002 file - promoters60/1379141
aagaattta

SEQ ID NO: 47300 - DNA, 6 bp, Unknown
  misc_feature (1)..( 6): Matrix.002 file - promoters60/1379141
tttttg

SEQ ID NO: 47301 - DNA, 6 bp, Unknown
  misc_feature (1)..( 6): Matrix.002 file - promoters60/1379141
ttagct

SEQ ID NO: 47302 - DNA, 8 bp, Unknown
  misc_feature (1)..( 8): Matrix.002 file - promoters60/1379141
taagaata

SEQ ID NO: 47303 - DNA, 6 bp, Unknown
  misc_feature (1)..( 6): Matrix.002 file - promoters60/1379141
caaaaa

SEQ ID NO: 47304 - DNA, 7 bp, Unknown
  misc_feature (1)..( 7): Matrix.002 file - promoters60/1379141
ttcctct

SEQ ID NO: 47305 - DNA, 7 bp, Unknown
  misc_feature (1)..( 7): Matrix.002 file - promoters60/1379166
ttgctat

SEQ ID NO: 47306 - DNA, 7 bp, Unknown
  misc_feature (1)..( 7): Matrix.002 file - promoters60/1379166
gttttgt

SEQ ID NO: 47307 - DNA, 7 bp, Unknown
  misc_feature (1)..( 7): Matrix.002 file - promoters60/1379166
aaattaa

SEQ ID NO: 47308 - DNA, 6 bp, Unknown
  misc_feature (1)..( 6): Matrix.002 file - promoters60/1379166
atctcc

SEQ ID NO: 47309 - DNA, 6 bp, Unknown
  misc_feature (1)..( 6): Matrix.002 file - promoters60/1379166
ctaaat

SEQ ID NO: 47310 - DNA, 6 bp, Unknown
  misc_feature (1)..( 6): Matrix.002 file - promoters60/1379166
attttg

SEQ ID NO: 47311 - DNA, 6 bp, Unknown
  misc_feature (1)..( 6): Matrix.002 file - promoters60/1379166
tttgtt

SEQ ID NO: 47312 - DNA, 8 bp, Unknown
  misc_feature (1)..( 8): Matrix.002 file - promoters60/1379166
cattgtta

SEQ ID NO: 47313 - DNA, 7 bp, Unknown
  misc_feature (1)..( 7): Matrix.002 file - promoters60/1379166
aacaaaa

SEQ ID NO: 47314 - DNA, 7 bp, Unknown
  misc_feature (1)..( 7): Matrix.002 file - promoters60/1379166
aaaactt

SEQ ID NO: 47315 - DNA, 6 bp, Unknown
  misc_feature (1)..( 6): Matrix.002 file - promoters60/1379166
ttattg

SEQ ID NO: 47316 - DNA, 6 bp, Unknown
  misc_feature (1)..( 6): Matrix.002 file - promoters60/1379166
agaaga

SEQ ID NO: 47317 - DNA, 6 bp, Unknown
  misc_feature (1)..( 6): Matrix.002 file - promoters60/1379166
tggtta

SEQ ID NO: 47318 - DNA, 8 bp, Unknown
  misc_feature (1)..( 8): Matrix.002 file - promoters60/1379166
atcgagaa

SEQ ID NO: 47319 - DNA, 6 bp, Unknown
  misc_feature (1)..( 6): Matrix.002 file - promoters60/1379166
cgattc

SEQ ID NO: 47320 - DNA, 7 bp, Unknown
  misc_feature (1)..( 7): Matrix.002 file - promoters60/1379166
tccaaag

SEQ ID NO: 47321 - DNA, 7 bp, Unknown
  misc_feature (1)..( 7): Matrix.002 file - promoters60/1379166
aaaacaa

SEQ ID NO: 47322 - DNA, 12 bp, Unknown
  misc_feature (1)..( 12): Matrix.002 file - promoters60/1379201
caaattacgaag

SEQ ID NO: 47323 - DNA, 8 bp, Unknown
  misc_feature (1)..( 8): Matrix.002 file - promoters60/1379201
acatttta

SEQ ID NO: 47324 - DNA, 12 bp, Unknown
  misc_feature (1)..( 12): Matrix.002 file - promoters60/1379201
aaaatacgaaga

SEQ ID NO: 47325 - DNA, 10 bp, Unknown
  misc_feature (1)..( 10): Matrix.002 file - promoters60/1379201
ccgattctct

SEQ ID NO: 47326 - DNA, 6 bp, Unknown
  misc_feature (1)..( 6): Matrix.002 file - promoters60/1379229
atttat

SEQ ID NO: 47327 - DNA, 7 bp, Unknown
  misc_feature (1)..( 7): Matrix.002 file - promoters60/1379229
taaaaga

SEQ ID NO: 47328 - DNA, 8 bp, Unknown
  misc_feature (1)..( 8): Matrix.002 file - promoters60/1379229
tttaaaaa

SEQ ID NO: 47329 - DNA, 6 bp, Unknown
  misc_feature (1)..( 6): Matrix.002 file - promoters60/1379229
tgaaat

SEQ ID NO: 47330 - DNA, 9 bp, Unknown
  misc_feature (1)..( 9): Matrix.002 file - promoters60/1379229
acaaaagaa

SEQ ID NO: 47331 - DNA, 9 bp, Unknown
  misc_feature (1)..( 9): Matrix.002 file - promoters60/1379229
ggtcacacc

SEQ ID NO: 47332 - DNA, 6 bp, Unknown
  misc_feature (1)..( 6): Matrix.002 file - promoters60/1379229
ataatt

SEQ ID NO: 47333 - DNA, 6 bp, Unknown
  misc_feature (1)..( 6): Matrix.002 file - promoters60/1379229
tgaaga

SEQ ID NO: 47334 - DNA, 6 bp, Unknown
  misc_feature (1)..( 6): Matrix.002 file - promoters60/1379229
acaaat

SEQ ID NO: 47335 - DNA, 6 bp, Unknown
  misc_feature (1)..( 6): Matrix.002 file - promoters60/1379229
gatacc

SEQ ID NO: 47336 - DNA, 6 bp, Unknown
  misc_feature (1)..( 6): Matrix.002 file - promoters60/1379229
tagata

SEQ ID NO: 47337 - DNA, 9 bp, Unknown
  misc_feature (1)..( 9): Matrix.002 file - promoters60/1379229
actaaactc

SEQ ID NO: 47338 - DNA, 6 bp, Unknown
  misc_feature (1)..( 6): Matrix.002 file - promoters60/1379239
atttta

SEQ ID NO: 47339 - DNA, 9 bp, Unknown
  misc_feature (1)..( 9): Matrix.002 file - promoters60/1379239
aaattaaac

SEQ ID NO: 47340 - DNA, 6 bp, Unknown
  misc_feature (1)..( 6): Matrix.002 file - promoters60/1379239
agttaa

SEQ ID NO: 47341 - DNA, 9 bp, Unknown
  misc_feature (1)..( 9): Matrix.002 file - promoters60/1379239
atacccggt

SEQ ID NO: 47342 - DNA, 9 bp, Unknown
  misc_feature (1)..( 9): Matrix.002 file - promoters60/1379239
tataaaaac

SEQ ID NO: 47343 - DNA, 6 bp, Unknown
  misc_feature (1)..( 6): Matrix.002 file - promoters60/1379239
ttggaa

SEQ ID NO: 47344 - DNA, 8 bp, Unknown
  misc_feature (1)..( 8): Matrix.002 file - promoters60/1379239
aacattag

SEQ ID NO: 47345 - DNA, 8 bp, Unknown
  misc_feature (1)..( 8): Matrix.002 file - promoters60/1379239
caataaat

SEQ ID NO: 47346 - DNA, 7 bp, Unknown
  misc_feature (1)..( 7): Matrix.002 file - promoters60/1379239
tccaatt

SEQ ID NO: 47347 - DNA, 6 bp, Unknown
  misc_feature (1)..( 6): Matrix.002 file - promoters60/1379239
tttgtt

SEQ ID NO: 47348 - DNA, 8 bp, Unknown
  misc_feature (1)..( 8): Matrix.002 file - promoters60/1379239
aaaacaaa

SEQ ID NO: 47349 - DNA, 6 bp, Unknown
  misc_feature (1)..( 6): Matrix.002 file - promoters60/1379239
cagaaa

SEQ ID NO: 47350 - DNA, 7 bp, Unknown
  misc_feature (1)..( 7): Matrix.002 file - promoters60/1379239
ttcaaga

SEQ ID NO: 47351 - DNA, 8 bp, Unknown
  misc_feature (1)..( 8): Matrix.002 file - promoters60/1379239
aatatctc

SEQ ID NO: 47352 - DNA, 6 bp, Unknown
  misc_feature (1)..( 6): Matrix.002 file - promoters60/1379239
taatgt

SEQ ID NO: 47353 - DNA, 6 bp, Unknown
  misc_feature (1)..( 6): Matrix.002 file - promoters60/1379239
tcgact

SEQ ID NO: 47354 - DNA, 8 bp, Unknown
  misc_feature (1)..( 8): Matrix.002 file - promoters60/1379239
aaataata

SEQ ID NO: 47355 - DNA, 7 bp, Unknown
  misc_feature (1)..( 7): Matrix.002 file - promoters60/1379239
tatagct

SEQ ID NO: 47356 - DNA, 9 bp, Unknown
  misc_feature (1)..( 9): Matrix.002 file - promoters60/1379607
tttataaaa

SEQ ID NO: 47357 - DNA, 8 bp, Unknown
  misc_feature (1)..( 8): Matrix.002 file - promoters60/1379607
ttaattaa

SEQ ID NO: 47358 - DNA, 8 bp, Unknown
  misc_feature (1)..( 8): Matrix.002 file - promoters60/1379607
taatttaa

SEQ ID NO: 47359 - DNA, 7 bp, Unknown
  misc_feature (1)..( 7): Matrix.002 file - promoters60/1379671
tggagag

SEQ ID NO: 47360 - DNA, 6 bp, Unknown
  misc_feature (1)..( 6): Matrix.002 file - promoters60/1379671
agtatc

SEQ ID NO: 47361 - DNA, 7 bp, Unknown
  misc_feature (1)..( 7): Matrix.002 file - promoters60/1379671
tgatctt

SEQ ID NO: 47362 - DNA, 7 bp, Unknown
  misc_feature (1)..( 7): Matrix.002 file - promoters60/1379671
acaaagt

SEQ ID NO: 47363 - DNA, 6 bp, Unknown
  misc_feature (1)..( 6): Matrix.002 file - promoters60/1379671
attatt

SEQ ID NO: 47364 - DNA, 7 bp, Unknown
  misc_feature (1)..( 7): Matrix.002 file - promoters60/1379671
attgtgt

SEQ ID NO: 47365 - DNA, 6 bp, Unknown
  misc_feature (1)..( 6): Matrix.002 file - promoters60/1379671
cttcag

SEQ ID NO: 47366 - DNA, 6 bp, Unknown
  misc_feature (1)..( 6): Matrix.002 file - promoters60/1379671
ttaata

SEQ ID NO: 47367 - DNA, 9 bp, Unknown
  misc_feature (1)..( 9): Matrix.002 file - promoters60/1379671
gaataaatt

SEQ ID NO: 47368 - DNA, 7 bp, Unknown
  misc_feature (1)..( 7): Matrix.002 file - promoters60/1379671
caccacc

SEQ ID NO: 47369 - DNA, 7 bp, Unknown
  misc_feature (1)..( 7): Matrix.002 file - promoters60/1379671
gtatcaa

SEQ ID NO: 47370 - DNA, 9 bp, Unknown
  misc_feature (1)..( 9): Matrix.002 file - promoters60/1379671
aataaccaa

SEQ ID NO: 47371 - DNA, 8 bp, Unknown
  misc_feature (1)..( 8): Matrix.002 file - promoters60/1379671
cagctatt

SEQ ID NO: 47372 - DNA, 7 bp, Unknown
  misc_feature (1)..( 7): Matrix.002 file - promoters60/1379671
attgttg

SEQ ID NO: 47373 - DNA, 8 bp, Unknown
  misc_feature (1)..( 8): Matrix.002 file - promoters60/1379671
cataaaaa

SEQ ID NO: 47374 - DNA, 7 bp, Unknown
  misc_feature (1)..( 7): Matrix.002 file - promoters60/1379671
acagatt

SEQ ID NO: 47375 - DNA, 7 bp, Unknown
  misc_feature (1)..( 7): Matrix.002 file - promoters60/1379671
tttagtt

SEQ ID NO: 47376 - DNA, 8 bp, Unknown
  misc_feature (1)..( 8): Matrix.002 file - promoters60/1379671
ttcaaaaa

SEQ ID NO: 47377 - DNA, 7 bp, Unknown
  misc_feature (1)..( 7): Matrix.002 file - promoters60/1379818
agaacgt

SEQ ID NO: 47378 - DNA, 6 bp, Unknown
  misc_feature (1)..( 6): Matrix.002 file - promoters60/1379818
gttttg

SEQ ID NO: 47379 - DNA, 6 bp, Unknown
  misc_feature (1)..( 6): Matrix.002 file - promoters60/1379818
tgtata

SEQ ID NO: 47380 - DNA, 8 bp, Unknown
  misc_feature (1)..( 8): Matrix.002 file - promoters60/1379818
tgtcaatt

SEQ ID NO: 47381 - DNA, 6 bp, Unknown
  misc_feature (1)..( 6): Matrix.002 file - promoters60/1379818
aattca

SEQ ID NO: 47382 - DNA, 6 bp, Unknown
  misc_feature (1)..( 6): Matrix.002 file - promoters60/1379818
ttttta

SEQ ID NO: 47383 - DNA, 9 bp, Unknown
  misc_feature (1)..( 9): Matrix.002 file - promoters60/1379818
aaaatctct

SEQ ID NO: 47384 - DNA, 6 bp, Unknown
  misc_feature (1)..( 6): Matrix.002 file - promoters60/1379818
gaatta

SEQ ID NO: 47385 - DNA, 8 bp, Unknown
  misc_feature (1)..( 8): Matrix.002 file - promoters60/1379818
atttattt

SEQ ID NO: 47386 - DNA, 11 bp, Unknown
  misc_feature (1)..( 11): Matrix.002 file - promoters60/1379818
tactgtattag

SEQ ID NO: 47387 - DNA, 6 bp, Unknown
  misc_feature (1)..( 6): Matrix.002 file - promoters60/1379818
aatatt

SEQ ID NO: 47388 - DNA, 6 bp, Unknown
  misc_feature (1)..( 6): Matrix.002 file - promoters60/1379818
tataat

SEQ ID NO: 47389 - DNA, 8 bp, Unknown
  misc_feature (1)..( 8): Matrix.002 file - promoters60/1379818
taatatta

SEQ ID NO: 47390 - DNA, 8 bp, Unknown
  misc_feature (1)..( 8): Matrix.002 file - promoters60/1379818
attaaaaa

SEQ ID NO: 47391 - DNA, 6 bp, Unknown
  misc_feature (1)..( 6): Matrix.002 file - promoters60/1379981
cgatta

SEQ ID NO: 47392 - DNA, 6 bp, Unknown
  misc_feature (1)..( 6): Matrix.002 file - promoters60/1379981
atttaa

SEQ ID NO: 47393 - DNA, 7 bp, Unknown
  misc_feature (1)..( 7): Matrix.002 file - promoters60/1379981
tcatttt

SEQ ID NO: 47394 - DNA, 8 bp, Unknown
  misc_feature (1)..( 8): Matrix.002 file - promoters60/1379981
ttttaata

SEQ ID NO: 47395 - DNA, 7 bp, Unknown
  misc_feature (1)..( 7): Matrix.002 file - promoters60/1379981
gttatgt

SEQ ID NO: 47396 - DNA, 9 bp, Unknown
  misc_feature (1)..( 9): Matrix.002 file - promoters60/1379981
attaataaa

SEQ ID NO: 47397 - DNA, 10 bp, Unknown
  misc_feature (1)..( 10): Matrix.002 file - promoters60/1379981
ctaataaatt

SEQ ID NO: 47398 - DNA, 8 bp, Unknown
  misc_feature (1)..( 8): Matrix.002 file - promoters60/1379981
cattcttt

SEQ ID NO: 47399 - DNA, 7 bp, Unknown
  misc_feature (1)..( 7): Matrix.002 file - promoters60/1379981
tgtttca

SEQ ID NO: 47400 - DNA, 10 bp, Unknown
  misc_feature (1)..( 10): Matrix.002 file - promoters60/1379981
cttaaataat

SEQ ID NO: 47401 - DNA, 7 bp, Unknown
  misc_feature (1)..( 7): Matrix.002 file - promoters60/1379981
aatattt

SEQ ID NO: 47402 - DNA, 7 bp, Unknown
  misc_feature (1)..( 7): Matrix.002 file - promoters60/1379981
ttcattc

SEQ ID NO: 47403 - DNA, 6 bp, Unknown
  misc_feature (1)..( 6): Matrix.002 file - promoters60/1379981
aaatct

SEQ ID NO: 47404 - DNA, 7 bp, Unknown
  misc_feature (1)..( 7): Matrix.002 file - promoters60/1379981
ataaata

SEQ ID NO: 47405 - DNA, 6 bp, Unknown
  misc_feature (1)..( 6): Matrix.002 file - promoters60/1379981
aatttt

SEQ ID NO: 47406 - DNA, 6 bp, Unknown
  misc_feature (1)..( 6): Matrix.002 file - promoters60/1379981
aaaaag

SEQ ID NO: 47407 - DNA, 7 bp, Unknown
  misc_feature (1)..( 7): Matrix.002 file - promoters60/1379981
aagatat

SEQ ID NO: 47408 - DNA, 7 bp, Unknown
  misc_feature (1)..( 7): Matrix.002 file - promoters60/1379981
aaaccac

SEQ ID NO: 47409 - DNA, 8 bp, Unknown
  misc_feature (1)..( 8): Matrix.002 file - promoters60/1379981
aaaataag

SEQ ID NO: 47410 - DNA, 8 bp, Unknown
  misc_feature (1)..( 8): Matrix.002 file - promoters60/1379981
taaattgt

SEQ ID NO: 47411 - DNA, 6 bp, Unknown
  misc_feature (1)..( 6): Matrix.002 file - promoters60/1379981
atagat

SEQ ID NO: 47412 - DNA, 7 bp, Unknown
  misc_feature (1)..( 7): Matrix.002 file - promoters60/1379981
agagata

SEQ ID NO: 47413 - DNA, 6 bp, Unknown
  misc_feature (1)..( 6): Matrix.002 file - promoters60/1379981
ttttgg

SEQ ID NO: 47414 - DNA, 6 bp, Unknown
  misc_feature (1)..( 6): Matrix.002 file - promoters60/1379981
taagat

SEQ ID NO: 47415 - DNA, 6 bp, Unknown
  misc_feature (1)..( 6): Matrix.002 file - promoters60/1379981
aaagaa

SEQ ID NO: 47416 - DNA, 12 bp, Unknown
  misc_feature (1)..( 12): Matrix.002 file - promoters60/1379981
aaaaacaaaaca

SEQ ID NO: 47417 - DNA, 6 bp, Unknown
  misc_feature (1)..( 6): Matrix.002 file - promoters60/1379981
aaaaat

SEQ ID NO: 47418 - DNA, 6 bp, Unknown
  misc_feature (1)..( 6): Matrix.002 file - promoters60/1379981
taaccc

SEQ ID NO: 47419 - DNA, 6 bp, Unknown
  misc_feature (1)..( 6): Matrix.002 file - promoters60/1379998
aacata

SEQ ID NO: 47420 - DNA, 6 bp, Unknown
  misc_feature (1)..( 6): Matrix.002 file - promoters60/1379998
gagata

SEQ ID NO: 47421 - DNA, 7 bp, Unknown
  misc_feature (1)..( 7): Matrix.002 file - promoters60/1379998
tttataa

SEQ ID NO: 47422 - DNA, 6 bp, Unknown
  misc_feature (1)..( 6): Matrix.002 file - promoters60/1379998
caaaaa

SEQ ID NO: 47423 - DNA, 8 bp, Unknown
  misc_feature (1)..( 8): Matrix.002 file - promoters60/1379998
gtcacaaa

SEQ ID NO: 47424 - DNA, 6 bp, Unknown
  misc_feature (1)..( 6): Matrix.002 file - promoters60/1379998
atattt

SEQ ID NO: 47425 - DNA, 7 bp, Unknown
  misc_feature (1)..( 7): Matrix.002 file - promoters60/1379998
aaaacaa

SEQ ID NO: 47426 - DNA, 6 bp, Unknown
  misc_feature (1)..( 6): Matrix.002 file - promoters60/1379998
agtaaa

SEQ ID NO: 47427 - DNA, 6 bp, Unknown
  misc_feature (1)..( 6): Matrix.002 file - promoters60/1379998
ttccaa

SEQ ID NO: 47428 - DNA, 6 bp, Unknown
  misc_feature (1)..( 6): Matrix.002 file - promoters60/1379998
gttttc

SEQ ID NO: 47429 - DNA, 7 bp, Unknown
  misc_feature (1)..( 7): Matrix.002 file - promoters60/1379998
tttcgaa

SEQ ID NO: 47430 - DNA, 8 bp, Unknown
  misc_feature (1)..( 8): Matrix.002 file - promoters60/1379998
ttttgttt

SEQ ID NO: 47431 - DNA, 6 bp, Unknown
  misc_feature (1)..( 6): Matrix.002 file - promoters60/1379998
tttgtt

SEQ ID NO: 47432 - DNA, 7 bp, Unknown
  misc_feature (1)..( 7): Matrix.002 file - promoters60/1379998
aaaactt

SEQ ID NO: 47433 - DNA, 7 bp, Unknown
  misc_feature (1)..( 7): Matrix.002 file - promoters60/1379998
attaaag

SEQ ID NO: 47434 - DNA, 6 bp, Unknown
  misc_feature (1)..( 6): Matrix.002 file - promoters60/1379998
agtaaa

SEQ ID NO: 47435 - DNA, 7 bp, Unknown
  misc_feature (1)..( 7): Matrix.002 file - promoters60/1379998
aatcggg

SEQ ID NO: 47436 - DNA, 8 bp, Unknown
  misc_feature (1)..( 8): Matrix.002 file - promoters60/1379998
gaaacaaa

SEQ ID NO: 47437 - DNA, 10 bp, Unknown
  misc_feature (1)..( 10): Matrix.002 file - promoters60/1379998
ggaaaagaaa

SEQ ID NO: 47438 - DNA, 7 bp, Unknown
  misc_feature (1)..( 7): Matrix.002 file - promoters60/1379998
cccacta

SEQ ID NO: 47439 - DNA, 9 bp, Unknown
  misc_feature (1)..( 9): Matrix.002 file - promoters60/1379998
aaagaaaag

SEQ ID NO: 47440 - DNA, 7 bp, Unknown
  misc_feature (1)..( 7): Matrix.002 file - promoters60/1379998
gtatata

SEQ ID NO: 47441 - DNA, 9 bp, Unknown
  misc_feature (1)..( 9): Matrix.002 file - promoters60/1380309
acaaatcta

SEQ ID NO: 47442 - DNA, 8 bp, Unknown
  misc_feature (1)..( 8): Matrix.002 file - promoters60/1380309
taaatata

SEQ ID NO: 47443 - DNA, 6 bp, Unknown
  misc_feature (1)..( 6): Matrix.002 file - promoters60/1380309
tataaa

SEQ ID NO: 47444 - DNA, 12 bp, Unknown
  misc_feature (1)..( 12): Matrix.002 file - promoters60/1380309
agtttaaaattt

SEQ ID NO: 47445 - DNA, 9 bp, Unknown
  misc_feature (1)..( 9): Matrix.002 file - promoters60/1380309
atcaatact

SEQ ID NO: 47446 - DNA, 7 bp, Unknown
  misc_feature (1)..( 7): Matrix.002 file - promoters60/1380309
tttaatt

SEQ ID NO: 47447 - DNA, 7 bp, Unknown
  misc_feature (1)..( 7): Matrix.002 file - promoters60/1380309
aaacagt

SEQ ID NO: 47448 - DNA, 6 bp, Unknown
  misc_feature (1)..( 6): Matrix.002 file - promoters60/1380309
aaaaat

SEQ ID NO: 47449 - DNA, 10 bp, Unknown
  misc_feature (1)..( 10): Matrix.002 file - promoters60/1380309
atggaacaaa

SEQ ID NO: 47450 - DNA, 10 bp, Unknown
  misc_feature (1)..( 10): Matrix.002 file - promoters60/1380309
aataattaaa

SEQ ID NO: 47451 - DNA, 7 bp, Unknown
  misc_feature (1)..( 7): Matrix.002 file - promoters60/1380309
attgaag

SEQ ID NO: 47452 - DNA, 7 bp, Unknown
  misc_feature (1)..( 7): Matrix.002 file - promoters60/1380309
tataaat

SEQ ID NO: 47453 - DNA, 8 bp, Unknown
  misc_feature (1)..( 8): Matrix.002 file - promoters60/1380309
tcttaaaa

SEQ ID NO: 47454 - DNA, 6 bp, Unknown
  misc_feature (1)..( 6): Matrix.002 file - promoters60/1380309
gtagtt

SEQ ID NO: 47455 - DNA, 6 bp, Unknown
  misc_feature (1)..( 6): Matrix.002 file - promoters60/1380309
gtatat

SEQ ID NO: 47456 - DNA, 7 bp, Unknown
  misc_feature (1)..( 7): Matrix.002 file - promoters60/1380309
taaacaa

SEQ ID NO: 47457 - DNA, 6 bp, Unknown
  misc_feature (1)..( 6): Matrix.002 file - promoters60/1380309
tggaag

SEQ ID NO: 47458 - DNA, 6 bp, Unknown
  misc_feature (1)..( 6): Matrix.002 file - promoters60/1380309
tttgtt

SEQ ID NO: 47459 - DNA, 6 bp, Unknown
  misc_feature (1)..( 6): Matrix.002 file - promoters60/1380309
ttttta

SEQ ID NO: 47460 - DNA, 12 bp, Unknown
  misc_feature (1)..( 12): Matrix.002 file - promoters60/1380385
tggaaacactgt

SEQ ID NO: 47461 - DNA, 8 bp, Unknown
  misc_feature (1)..( 8): Matrix.002 file - promoters60/1380385
tgtcattt

SEQ ID NO: 47462 - DNA, 6 bp, Unknown
  misc_feature (1)..( 6): Matrix.002 file - promoters60/1380385
agacag

SEQ ID NO: 47463 - DNA, 9 bp, Unknown
  misc_feature (1)..( 9): Matrix.002 file - promoters60/1380385
ggctgaatc

SEQ ID NO: 47464 - DNA, 6 bp, Unknown
  misc_feature (1)..( 6): Matrix.002 file - promoters60/1380385
tctgac

SEQ ID NO: 47465 - DNA, 6 bp, Unknown
  misc_feature (1)..( 6): Matrix.002 file - promoters60/1380385
ttgtgt

SEQ ID NO: 47466 - DNA, 8 bp, Unknown
  misc_feature (1)..( 8): Matrix.002 file - promoters60/1380385
attatcaa

SEQ ID NO: 47467 - DNA, 7 bp, Unknown
  misc_feature (1)..( 7): Matrix.002 file - promoters60/1380385
tttctct

SEQ ID NO: 47468 - DNA, 6 bp, Unknown
  misc_feature (1)..( 6): Matrix.002 file - promoters60/1380385
cttttt

SEQ ID NO: 47469 - DNA, 9 bp, Unknown
  misc_feature (1)..( 9): Matrix.002 file - promoters60/1380389
caaaaatat

SEQ ID NO: 47470 - DNA, 7 bp, Unknown
  misc_feature (1)..( 7): Matrix.002 file - promoters60/1380389
caagacg

SEQ ID NO: 47471 - DNA, 7 bp, Unknown
  misc_feature (1)..( 7): Matrix.002 file - promoters60/1380389
tttggtt

SEQ ID NO: 47472 - DNA, 8 bp, Unknown
  misc_feature (1)..( 8): Matrix.002 file - promoters60/1380389
taaattga

SEQ ID NO: 47473 - DNA, 9 bp, Unknown
  misc_feature (1)..( 9): Matrix.002 file - promoters60/1380389
aaaaacaat

SEQ ID NO: 47474 - DNA, 7 bp, Unknown
  misc_feature (1)..( 7): Matrix.002 file - promoters60/1380418
aagagat

SEQ ID NO: 47475 - DNA, 7 bp, Unknown
  misc_feature (1)..( 7): Matrix.002 file - promoters60/1380418
agtttct

SEQ ID NO: 47476 - DNA, 10 bp, Unknown
  misc_feature (1)..( 10): Matrix.002 file - promoters60/1380418
aaaaatggtt

SEQ ID NO: 47477 - DNA, 7 bp, Unknown
  misc_feature (1)..( 7): Matrix.002 file - promoters60/1380418
ttttgtt

SEQ ID NO: 47478 - DNA, 8 bp, Unknown
  misc_feature (1)..( 8): Matrix.002 file - promoters60/1380418
cagtgata

SEQ ID NO: 47479 - DNA, 10 bp, Unknown
  misc_feature (1)..( 10): Matrix.002 file - promoters60/1380418
agatgagttt

SEQ ID NO: 47480 - DNA, 7 bp, Unknown
  misc_feature (1)..( 7): Matrix.002 file - promoters60/1380418
caaaatg

SEQ ID NO: 47481 - DNA, 7 bp, Unknown
  misc_feature (1)..( 7): Matrix.002 file - promoters60/1380418
caaccaa

SEQ ID NO: 47482 - DNA, 7 bp, Unknown
  misc_feature (1)..( 7): Matrix.002 file - promoters60/1380418
acaagaa

SEQ ID NO: 47483 - DNA, 7 bp, Unknown
  misc_feature (1)..( 7): Matrix.002 file - promoters60/1380437
aacaatt

SEQ ID NO: 47484 - DNA, 11 bp, Unknown
  misc_feature (1)..( 11): Matrix.002 file - promoters60/1380437
tttcaaataaa

SEQ ID NO: 47485 - DNA, 7 bp, Unknown
  misc_feature (1)..( 7): Matrix.002 file - promoters60/1380437
tcaattt

SEQ ID NO: 47486 - DNA, 6 bp, Unknown
  misc_feature (1)..( 6): Matrix.002 file - promoters60/1380437
tttgta

SEQ ID NO: 47487 - DNA, 7 bp, Unknown
  misc_feature (1)..( 7): Matrix.002 file - promoters60/1380437
aacaaaa

SEQ ID NO: 47488 - DNA, 6 bp, Unknown
  misc_feature (1)..( 6): Matrix.002 file - promoters60/1380437
gatatt

SEQ ID NO: 47489 - DNA, 6 bp, Unknown
  misc_feature (1)..( 6): Matrix.002 file - promoters60/1380437
tattta

SEQ ID NO: 47490 - DNA, 12 bp, Unknown
  misc_feature (1)..( 12): Matrix.002 file - promoters60/1380437
aaaacaagataa

SEQ ID NO: 47491 - DNA, 11 bp, Unknown
  misc_feature (1)..( 11): Matrix.002 file - promoters60/1380437
aaaggggtaaa

SEQ ID NO: 47492 - DNA, 9 bp, Unknown
  misc_feature (1)..( 9): Matrix.002 file - promoters60/1380437
aaagaaaag

SEQ ID NO: 47493 - DNA, 6 bp, Unknown
  misc_feature (1)..( 6): Matrix.002 file - promoters60/1380437
aaatcg

SEQ ID NO: 47494 - DNA, 6 bp, Unknown
  misc_feature (1)..( 6): Matrix.002 file - promoters60/1380437
agagta

SEQ ID NO: 47495 - DNA, 6 bp, Unknown
  misc_feature (1)..( 6): Matrix.002 file - promoters60/1380437
taaaaa

SEQ ID NO: 47496 - DNA, 7 bp, Unknown
  misc_feature (1)..( 7): Matrix.002 file - promoters60/1380437
tttcttg

SEQ ID NO: 47497 - DNA, 7 bp, Unknown
  misc_feature (1)..( 7): Matrix.002 file - promoters60/1380437
ttgttat

SEQ ID NO: 47498 - DNA, 6 bp, Unknown
  misc_feature (1)..( 6): Matrix.002 file - promoters60/1380437
aatatc

SEQ ID NO: 47499 - DNA, 7 bp, Unknown
  misc_feature (1)..( 7): Matrix.002 file - promoters60/1380437
aaaacaa

SEQ ID NO: 47500 - DNA, 7 bp, Unknown
  misc_feature (1)..( 7): Matrix.002 file - promoters60/1380437
gtcaaaa

SEQ ID NO: 47501 - DNA, 6 bp, Unknown
  misc_feature (1)..( 6): Matrix.002 file - promoters60/1380437
agtaaa

SEQ ID NO: 47502 - DNA, 7 bp, Unknown
  misc_feature (1)..( 7): Matrix.002 file - promoters60/1380437
aatcggg

SEQ ID NO: 47503 - DNA, 8 bp, Unknown
  misc_feature (1)..( 8): Matrix.002 file - promoters60/1380437
gaaacaaa

SEQ ID NO: 47504 - DNA, 10 bp, Unknown
  misc_feature (1)..( 10): Matrix.002 file - promoters60/1380437
ggaaaagaaa

SEQ ID NO: 47505 - DNA, 7 bp, Unknown
  misc_feature (1)..( 7): Matrix.002 file - promoters60/1380437
cccacta

SEQ ID NO: 47506 - DNA, 7 bp, Unknown
  misc_feature (1)..( 7): Matrix.002 file - promoters60/1380437
gtatata

SEQ ID NO: 47507 - DNA, 6 bp, Unknown
  misc_feature (1)..( 6): Matrix.002 file - promoters60/1380478
ctgatg

SEQ ID NO: 47508 - DNA, 6 bp, Unknown
  misc_feature (1)..( 6): Matrix.002 file - promoters60/1380478
cattac

SEQ ID NO: 47509 - DNA, 6 bp, Unknown
  misc_feature (1)..( 6): Matrix.002 file - promoters60/1380478
catttt

SEQ ID NO: 47510 - DNA, 7 bp, Unknown
  misc_feature (1)..( 7): Matrix.002 file - promoters60/1380478
tatacaa

SEQ ID NO: 47511 - DNA, 8 bp, Unknown
  misc_feature (1)..( 8): Matrix.002 file - promoters60/1380478
ggtgggat

SEQ ID NO: 47512 - DNA, 6 bp, Unknown
  misc_feature (1)..( 6): Matrix.002 file - promoters60/1380478
tggaaa

SEQ ID NO: 47513 - DNA, 8 bp, Unknown
  misc_feature (1)..( 8): Matrix.002 file - promoters60/1380478
caacacca

SEQ ID NO: 47514 - DNA, 7 bp, Unknown
  misc_feature (1)..( 7): Matrix.002 file - promoters60/1380478
ttaattg

SEQ ID NO: 47515 - DNA, 8 bp, Unknown
  misc_feature (1)..( 8): Matrix.002 file - promoters60/1380478
acttcata

SEQ ID NO: 47516 - DNA, 7 bp, Unknown
  misc_feature (1)..( 7): Matrix.002 file - promoters60/1380478
catatcc

SEQ ID NO: 47517 - DNA, 9 bp, Unknown
  misc_feature (1)..( 9): Matrix.002 file - promoters60/1380519
tctcaaact

SEQ ID NO: 47518 - DNA, 8 bp, Unknown
  misc_feature (1)..( 8): Matrix.002 file - promoters60/1380519
gagcaaaa

SEQ ID NO: 47519 - DNA, 7 bp, Unknown
  misc_feature (1)..( 7): Matrix.002 file - promoters60/1380545
attgatt

SEQ ID NO: 47520 - DNA, 9 bp, Unknown
  misc_feature (1)..( 9): Matrix.002 file - promoters60/1380545
tgttcatac

SEQ ID NO: 47521 - DNA, 6 bp, Unknown
  misc_feature (1)..( 6): Matrix.002 file - promoters60/1380545
ataaac

SEQ ID NO: 47522 - DNA, 9 bp, Unknown
  misc_feature (1)..( 9): Matrix.002 file - promoters60/1380545
gttataaaa

SEQ ID NO: 47523 - DNA, 6 bp, Unknown
  misc_feature (1)..( 6): Matrix.002 file - promoters60/1380545
ttaacc

SEQ ID NO: 47524 - DNA, 8 bp, Unknown
  misc_feature (1)..( 8): Matrix.002 file - promoters60/1380545
acaaaatg

SEQ ID NO: 47525 - DNA, 9 bp, Unknown
  misc_feature (1)..( 9): Matrix.002 file - promoters60/1380545
caaaaaaac

SEQ ID NO: 47526 - DNA, 9 bp, Unknown
  misc_feature (1)..( 9): Matrix.002 file - promoters60/1380545
aatcataat

SEQ ID NO: 47527 - DNA, 7 bp, Unknown
  misc_feature (1)..( 7): Matrix.002 file - promoters60/1380545
tgaacag

SEQ ID NO: 47528 - DNA, 6 bp, Unknown
  misc_feature (1)..( 6): Matrix.002 file - promoters60/1380545
actcaa

SEQ ID NO: 47529 - DNA, 7 bp, Unknown
  misc_feature (1)..( 7): Matrix.002 file - promoters60/1380545
caacgta

SEQ ID NO: 47530 - DNA, 8 bp, Unknown
  misc_feature (1)..( 8): Matrix.002 file - promoters60/1380545
ttagacac

SEQ ID NO: 47531 - DNA, 11 bp, Unknown
  misc_feature (1)..( 11): Matrix.002 file - promoters60/1380708
taaaatttttt

SEQ ID NO: 47532 - DNA, 9 bp, Unknown
  misc_feature (1)..( 9): Matrix.002 file - promoters60/1380708
tttattcag

SEQ ID NO: 47533 - DNA, 6 bp, Unknown
  misc_feature (1)..( 6): Matrix.002 file - promoters60/1380708
tgcaat

SEQ ID NO: 47534 - DNA, 8 bp, Unknown
  misc_feature (1)..( 8): Matrix.002 file - promoters60/1380708
ttcattta

SEQ ID NO: 47535 - DNA, 6 bp, Unknown
  misc_feature (1)..( 6): Matrix.002 file - promoters60/1380708
tatttt

SEQ ID NO: 47536 - DNA, 6 bp, Unknown
  misc_feature (1)..( 6): Matrix.002 file - promoters60/1380708
taattt

SEQ ID NO: 47537 - DNA, 6 bp, Unknown
  misc_feature (1)..( 6): Matrix.002 file - promoters60/1380708
tttcac

SEQ ID NO: 47538 - DNA, 7 bp, Unknown
  misc_feature (1)..( 7): Matrix.002 file - promoters60/1380708
attctca

SEQ ID NO: 47539 - DNA, 7 bp, Unknown
  misc_feature (1)..( 7): Matrix.002 file - promoters60/1380708
atggtat

SEQ ID NO: 47540 - DNA, 6 bp, Unknown
  misc_feature (1)..( 6): Matrix.002 file - promoters60/1380708
aatatt

SEQ ID NO: 47541 - DNA, 6 bp, Unknown
  misc_feature (1)..( 6): Matrix.002 file - promoters60/1380708
gaaaat

SEQ ID NO: 47542 - DNA, 7 bp, Unknown
  misc_feature (1)..( 7): Matrix.002 file - promoters60/1380708
taaatct

SEQ ID NO: 47543 - DNA, 12 bp, Unknown
  misc_feature (1)..( 12): Matrix.002 file - promoters60/1380708
aaaaaatctctg

SEQ ID NO: 47544 - DNA, 7 bp, Unknown
  misc_feature (1)..( 7): Matrix.002 file - promoters60/1380708
aattttt

SEQ ID NO: 47545 - DNA, 7 bp, Unknown
  misc_feature (1)..( 7): Matrix.002 file - promoters60/1380708
ttaatgt

SEQ ID NO: 47546 - DNA, 6 bp, Unknown
  misc_feature (1)..( 6): Matrix.002 file - promoters60/1380708
aatttt

SEQ ID NO: 47547 - DNA, 6 bp, Unknown
  misc_feature (1)..( 6): Matrix.002 file - promoters60/1380708
tattcg

SEQ ID NO: 47548 - DNA, 6 bp, Unknown
  misc_feature (1)..( 6): Matrix.002 file - promoters60/1380708
acctat

SEQ ID NO: 47549 - DNA, 8 bp, Unknown
  misc_feature (1)..( 8): Matrix.002 file - promoters60/1380708
caaaactt

SEQ ID NO: 47550 - DNA, 7 bp, Unknown
  misc_feature (1)..( 7): Matrix.002 file - promoters60/1380708
gaaaaaa

SEQ ID NO: 47551 - DNA, 6 bp, Unknown
  misc_feature (1)..( 6): Matrix.002 file - promoters60/1380708
atttaa

SEQ ID NO: 47552 - DNA, 6 bp, Unknown
  misc_feature (1)..( 6): Matrix.002 file - promoters60/1380708
taaaat

SEQ ID NO: 47553 - DNA, 7 bp, Unknown
  misc_feature (1)..( 7): Matrix.002 file - promoters60/1380708
aaaatca

SEQ ID NO: 47554 - DNA, 6 bp, Unknown
  misc_feature (1)..( 6): Matrix.002 file - promoters60/1380708
tcacat

SEQ ID NO: 47555 - DNA, 6 bp, Unknown
  misc_feature (1)..( 6): Matrix.002 file - promoters60/1380708
aatcat

SEQ ID NO: 47556 - DNA, 6 bp, Unknown
  misc_feature (1)..( 6): Matrix.002 file - promoters60/1380708
tttgta

SEQ ID NO: 47557 - DNA, 9 bp, Unknown
  misc_feature (1)..( 9): Matrix.002 file - promoters60/1380738
tctaaatta

SEQ ID NO: 47558 - DNA, 7 bp, Unknown
  misc_feature (1)..( 7): Matrix.002 file - promoters60/1380738
tatctgt

SEQ ID NO: 47559 - DNA, 10 bp, Unknown
  misc_feature (1)..( 10): Matrix.002 file - promoters60/1380738
tgttcattta

SEQ ID NO: 47560 - DNA, 6 bp, Unknown
  misc_feature (1)..( 6): Matrix.002 file - promoters60/1380738
acgtgt

SEQ ID NO: 47561 - DNA, 7 bp, Unknown
  misc_feature (1)..( 7): Matrix.002 file - promoters60/1380738
ggcttaa

SEQ ID NO: 47562 - DNA, 8 bp, Unknown
  misc_feature (1)..( 8): Matrix.002 file - promoters60/1380738
ggtcaggg

SEQ ID NO: 47563 - DNA, 8 bp, Unknown
  misc_feature (1)..( 8): Matrix.002 file - promoters60/1380738
gacaagag

SEQ ID NO: 47564 - DNA, 6 bp, Unknown
  misc_feature (1)..( 6): Matrix.002 file - promoters60/1380738
ttttta

SEQ ID NO: 47565 - DNA, 7 bp, Unknown
  misc_feature (1)..( 7): Matrix.002 file - promoters60/1380738
aaaaaca

SEQ ID NO: 47566 - DNA, 6 bp, Unknown
  misc_feature (1)..( 6): Matrix.002 file - promoters60/1380738
aagaaa

SEQ ID NO: 47567 - DNA, 6 bp, Unknown
  misc_feature (1)..( 6): Matrix.002 file - promoters60/1380738
taattt

SEQ ID NO: 47568 - DNA, 6 bp, Unknown
  misc_feature (1)..( 6): Matrix.002 file - promoters60/1380738
tttacc

SEQ ID NO: 47569 - DNA, 6 bp, Unknown
  misc_feature (1)..( 6): Matrix.002 file - promoters60/1380738
ttattt

SEQ ID NO: 47570 - DNA, 8 bp, Unknown
  misc_feature (1)..( 8): Matrix.002 file - promoters60/1380738
tacaatat

SEQ ID NO: 47571 - DNA, 8 bp, Unknown
  misc_feature (1)..( 8): Matrix.002 file - promoters60/1380738
attacaaa

SEQ ID NO: 47572 - DNA, 8 bp, Unknown
  misc_feature (1)..( 8): Matrix.002 file - promoters60/1380738
taatcaaa

SEQ ID NO: 47573 - DNA, 7 bp, Unknown
  misc_feature (1)..( 7): Matrix.002 file - promoters60/1380738
acaaaac

SEQ ID NO: 47574 - DNA, 8 bp, Unknown
  misc_feature (1)..( 8): Matrix.002 file - promoters60/1380738
ctgacaag

SEQ ID NO: 47575 - DNA, 7 bp, Unknown
  misc_feature (1)..( 7): Matrix.002 file - promoters60/1380738
attaaaa

SEQ ID NO: 47576 - DNA, 6 bp, Unknown
  misc_feature (1)..( 6): Matrix.002 file - promoters60/1380738
aaaccc

SEQ ID NO: 47577 - DNA, 7 bp, Unknown
  misc_feature (1)..( 7): Matrix.002 file - promoters60/1380797
taaattt

SEQ ID NO: 47578 - DNA, 7 bp, Unknown
  misc_feature (1)..( 7): Matrix.002 file - promoters60/1380797
taaaaat

SEQ ID NO: 47579 - DNA, 7 bp, Unknown
  misc_feature (1)..( 7): Matrix.002 file - promoters60/1380797
tatcatt

SEQ ID NO: 47580 - DNA, 8 bp, Unknown
  misc_feature (1)..( 8): Matrix.002 file - promoters60/1380797
tctcatta

SEQ ID NO: 47581 - DNA, 8 bp, Unknown
  misc_feature (1)..( 8): Matrix.002 file - promoters60/1380797
aaaaaata

SEQ ID NO: 47582 - DNA, 7 bp, Unknown
  misc_feature (1)..( 7): Matrix.002 file - promoters60/1380797
ataatat

SEQ ID NO: 47583 - DNA, 7 bp, Unknown
  misc_feature (1)..( 7): Matrix.002 file - promoters60/1380797
atgtatt

SEQ ID NO: 47584 - DNA, 8 bp, Unknown
  misc_feature (1)..( 8): Matrix.002 file - promoters60/1380797
taatgaat

SEQ ID NO: 47585 - DNA, 12 bp, Unknown
  misc_feature (1)..( 12): Matrix.002 file - promoters60/1380797
taataaaaaaag

SEQ ID NO: 47586 - DNA, 7 bp, Unknown
  misc_feature (1)..( 7): Matrix.002 file - promoters60/1380797
aaaaagt

SEQ ID NO: 47587 - DNA, 6 bp, Unknown
  misc_feature (1)..( 6): Matrix.002 file - promoters60/1380797
tataaa

SEQ ID NO: 47588 - DNA, 7 bp, Unknown
  misc_feature (1)..( 7): Matrix.002 file - promoters60/1380797
tttggaa

SEQ ID NO: 47589 - DNA, 7 bp, Unknown
  misc_feature (1)..( 7): Matrix.002 file - promoters60/1380797
aaaggtt

SEQ ID NO: 47590 - DNA, 8 bp, Unknown
  misc_feature (1)..( 8): Matrix.002 file - promoters60/1380797
tgtaaatt

SEQ ID NO: 47591 - DNA, 8 bp, Unknown
  misc_feature (1)..( 8): Matrix.002 file - promoters60/1380797
taaaaaca

SEQ ID NO: 47592 - DNA, 7 bp, Unknown
  misc_feature (1)..( 7): Matrix.002 file - promoters60/1380797
caacaaa

SEQ ID NO: 47593 - DNA, 8 bp, Unknown
  misc_feature (1)..( 8): Matrix.002 file - promoters60/1380797
aaagaacg

SEQ ID NO: 47594 - DNA, 6 bp, Unknown
  misc_feature (1)..( 6): Matrix.002 file - promoters60/1380797
acaaat

SEQ ID NO: 47595 - DNA, 7 bp, Unknown
  misc_feature (1)..( 7): Matrix.002 file - promoters60/1380797
tttcttg

SEQ ID NO: 47596 - DNA, 6 bp, Unknown
  misc_feature (1)..( 6): Matrix.002 file - promoters60/1380797
taacaa

SEQ ID NO: 47597 - DNA, 7 bp, Unknown
  misc_feature (1)..( 7): Matrix.002 file - promoters60/1380797
ttatgga

SEQ ID NO: 47598 - DNA, 6 bp, Unknown
  misc_feature (1)..( 6): Matrix.002 file - promoters60/1380797
cgtttt

SEQ ID NO: 47599 - DNA, 6 bp, Unknown
  misc_feature (1)..( 6): Matrix.002 file - promoters60/1380797
aaatta

SEQ ID NO: 47600 - DNA, 6 bp, Unknown
  misc_feature (1)..( 6): Matrix.002 file - promoters60/1380797
agaaaa

SEQ ID NO: 47601 - DNA, 10 bp, Unknown
  misc_feature (1)..( 10): Matrix.002 file - promoters60/1380797
caaatggtta

SEQ ID NO: 47602 - DNA, 9 bp, Unknown
  misc_feature (1)..( 9): Matrix.002 file - promoters60/1380947
tggggttat

SEQ ID NO: 47603 - DNA, 7 bp, Unknown
  misc_feature (1)..( 7): Matrix.002 file - promoters60/1380947
atcactt

SEQ ID NO: 47604 - DNA, 6 bp, Unknown
  misc_feature (1)..( 6): Matrix.002 file - promoters60/1380947
tgaaaa

SEQ ID NO: 47605 - DNA, 8 bp, Unknown
  misc_feature (1)..( 8): Matrix.002 file - promoters60/1380947
aaaaacaa

SEQ ID NO: 47606 - DNA, 7 bp, Unknown
  misc_feature (1)..( 7): Matrix.002 file - promoters60/1380947
aataaca

SEQ ID NO: 47607 - DNA, 6 bp, Unknown
  misc_feature (1)..( 6): Matrix.002 file - promoters60/1380947
ttcttc

SEQ ID NO: 47608 - DNA, 8 bp, Unknown
  misc_feature (1)..( 8): Matrix.002 file - promoters60/1380947
ttaatact

SEQ ID NO: 47609 - DNA, 6 bp, Unknown
  misc_feature (1)..( 6): Matrix.002 file - promoters60/1380947
aaatat

SEQ ID NO: 47610 - DNA, 7 bp, Unknown
  misc_feature (1)..( 7): Matrix.002 file - promoters60/1380947
tattaaa

SEQ ID NO: 47611 - DNA, 7 bp, Unknown
  misc_feature (1)..( 7): Matrix.002 file - promoters60/1380947
gttaatt

SEQ ID NO: 47612 - DNA, 7 bp, Unknown
  misc_feature (1)..( 7): Matrix.002 file - promoters60/1380947
aaaaaca

SEQ ID NO: 47613 - DNA, 8 bp, Unknown
  misc_feature (1)..( 8): Matrix.002 file - promoters60/1380947
tataacaa

SEQ ID NO: 47614 - DNA, 7 bp, Unknown
  misc_feature (1)..( 7): Matrix.002 file - promoters60/1380947
aacactt

SEQ ID NO: 47615 - DNA, 6 bp, Unknown
  misc_feature (1)..( 6): Matrix.002 file - promoters60/1380947
atgtct

SEQ ID NO: 47616 - DNA, 7 bp, Unknown
  misc_feature (1)..( 7): Matrix.002 file - promoters60/1380947
ttggaga

SEQ ID NO: 47617 - DNA, 6 bp, Unknown
  misc_feature (1)..( 6): Matrix.002 file - promoters60/1380947
gaagat

SEQ ID NO: 47618 - DNA, 6 bp, Unknown
  misc_feature (1)..( 6): Matrix.002 file - promoters60/1380947
gatcga

SEQ ID NO: 47619 - DNA, 6 bp, Unknown
  misc_feature (1)..( 6): Matrix.002 file - promoters60/1380947
aaatgc

SEQ ID NO: 47620 - DNA, 8 bp, Unknown
  misc_feature (1)..( 8): Matrix.002 file - promoters60/1380947
ggacttgt

SEQ ID NO: 47621 - DNA, 7 bp, Unknown
  misc_feature (1)..( 7): Matrix.002 file - promoters60/1380963
atatata

SEQ ID NO: 47622 - DNA, 7 bp, Unknown
  misc_feature (1)..( 7): Matrix.002 file - promoters60/1380963
tgggtct

SEQ ID NO: 47623 - DNA, 10 bp, Unknown
  misc_feature (1)..( 10): Matrix.002 file - promoters60/1380963
tatactttta

SEQ ID NO: 47624 - DNA, 7 bp, Unknown
  misc_feature (1)..( 7): Matrix.002 file - promoters60/1380963
accaatt

SEQ ID NO: 47625 - DNA, 9 bp, Unknown
  misc_feature (1)..( 9): Matrix.002 file - promoters60/1380963
tatataaat

SEQ ID NO: 47626 - DNA, 6 bp, Unknown
  misc_feature (1)..( 6): Matrix.002 file - promoters60/1380963
taaaat

SEQ ID NO: 47627 - DNA, 7 bp, Unknown
  misc_feature (1)..( 7): Matrix.002 file - promoters60/1380963
aatttta

SEQ ID NO: 47628 - DNA, 6 bp, Unknown
  misc_feature (1)..( 6): Matrix.002 file - promoters60/1380963
atttct

SEQ ID NO: 47629 - DNA, 6 bp, Unknown
  misc_feature (1)..( 6): Matrix.002 file - promoters60/1380963
taatgt

SEQ ID NO: 47630 - DNA, 6 bp, Unknown
  misc_feature (1)..( 6): Matrix.002 file - promoters60/1380963
tatata

SEQ ID NO: 47631 - DNA, 7 bp, Unknown
  misc_feature (1)..( 7): Matrix.002 file - promoters60/1380963
aagaaaa

SEQ ID NO: 47632 - DNA, 7 bp, Unknown
  misc_feature (1)..( 7): Matrix.002 file - promoters60/1380963
atctttt

SEQ ID NO: 47633 - DNA, 9 bp, Unknown
  misc_feature (1)..( 9): Matrix.002 file - promoters60/1380963
tttaaggtt

SEQ ID NO: 47634 - DNA, 7 bp, Unknown
  misc_feature (1)..( 7): Matrix.002 file - promoters60/1380963
tatatgt

SEQ ID NO: 47635 - DNA, 7 bp, Unknown
  misc_feature (1)..( 7): Matrix.002 file - promoters60/1380963
taaaatt

SEQ ID NO: 47636 - DNA, 8 bp, Unknown
  misc_feature (1)..( 8): Matrix.002 file - promoters60/1380963
ttagttta

SEQ ID NO: 47637 - DNA, 6 bp, Unknown
  misc_feature (1)..( 6): Matrix.002 file - promoters60/1380963
ttaatg

SEQ ID NO: 47638 - DNA, 8 bp, Unknown
  misc_feature (1)..( 8): Matrix.002 file - promoters60/1380963
tatcatat

SEQ ID NO: 47639 - DNA, 8 bp, Unknown
  misc_feature (1)..( 8): Matrix.002 file - promoters60/1380963
tttactgt

SEQ ID NO: 47640 - DNA, 6 bp, Unknown
  misc_feature (1)..( 6): Matrix.002 file - promoters60/1380963
aaaaag

SEQ ID NO: 47641 - DNA, 7 bp, Unknown
  misc_feature (1)..( 7): Matrix.002 file - promoters60/1380963
gtacaat

SEQ ID NO: 47642 - DNA, 8 bp, Unknown
  misc_feature (1)..( 8): Matrix.002 file - promoters60/1380963
cttaacaa

SEQ ID NO: 47643 - DNA, 6 bp, Unknown
  misc_feature (1)..( 6): Matrix.002 file - promoters60/1380963
tatata

SEQ ID NO: 47644 - DNA, 7 bp, Unknown
  misc_feature (1)..( 7): Matrix.002 file - promoters60/1380963
aaaagaa

SEQ ID NO: 47645 - DNA, 6 bp, Unknown
  misc_feature (1)..( 6): Matrix.002 file - promoters60/1380963
gattag

SEQ ID NO: 47646 - DNA, 7 bp, Unknown
  misc_feature (1)..( 7): Matrix.002 file - promoters60/1380963
attatta

SEQ ID NO: 47647 - DNA, 11 bp, Unknown
  misc_feature (1)..( 11): Matrix.002 file - promoters60/1381002
aataaaaatta

SEQ ID NO: 47648 - DNA, 16 bp, Unknown
  misc_feature (1)..( 16): Matrix.002 file - promoters60/1381002
tataaaactttcttaa

SEQ ID NO: 47649 - DNA, 9 bp, Unknown
  misc_feature (1)..( 9): Matrix.002 file - promoters60/1381033
ataaatatg

SEQ ID NO: 47650 - DNA, 8 bp, Unknown
  misc_feature (1)..( 8): Matrix.002 file - promoters60/1381033
atatgaaa

SEQ ID NO: 47651 - DNA, 9 bp, Unknown
  misc_feature (1)..( 9): Matrix.002 file - promoters60/1381033
atatcattc

SEQ ID NO: 47652 - DNA, 7 bp, Unknown
  misc_feature (1)..( 7): Matrix.002 file - promoters60/1381033
tttattc

SEQ ID NO: 47653 - DNA, 6 bp, Unknown
  misc_feature (1)..( 6): Matrix.002 file - promoters60/1381033
atgacc

SEQ ID NO: 47654 - DNA, 11 bp, Unknown
  misc_feature (1)..( 11): Matrix.002 file - promoters60/1381033
agataatgatt

SEQ ID NO: 47655 - DNA, 8 bp, Unknown
  misc_feature (1)..( 8): Matrix.002 file - promoters60/1381033
gaaaaata

SEQ ID NO: 47656 - DNA, 8 bp, Unknown
  misc_feature (1)..( 8): Matrix.002 file - promoters60/1381033
aacacaca

SEQ ID NO: 47657 - DNA, 7 bp, Unknown
  misc_feature (1)..( 7): Matrix.002 file - promoters60/1381033
aaaaaaa

SEQ ID NO: 47658 - DNA, 6 bp, Unknown
  misc_feature (1)..( 6): Matrix.002 file - promoters60/1381033
aaatta

SEQ ID NO: 47659 - DNA, 8 bp, Unknown
  misc_feature (1)..( 8): Matrix.002 file - promoters60/1381033
actctaaa

SEQ ID NO: 47660 - DNA, 6 bp, Unknown
  misc_feature (1)..( 6): Matrix.002 file - promoters60/1381033
tatgtg

SEQ ID NO: 47661 - DNA, 11 bp, Unknown
  misc_feature (1)..( 11): Matrix.002 file - promoters60/1381033
ctttttttttt

SEQ ID NO: 47662 - DNA, 7 bp, Unknown
  misc_feature (1)..( 7): Matrix.002 file - promoters60/1381033
cacaaaa

SEQ ID NO: 47663 - DNA, 6 bp, Unknown
  misc_feature (1)..( 6): Matrix.002 file - promoters60/1381195
tattct

SEQ ID NO: 47664 - DNA, 7 bp, Unknown
  misc_feature (1)..( 7): Matrix.002 file - promoters60/1381195
taaatgg

SEQ ID NO: 47665 - DNA, 8 bp, Unknown
  misc_feature (1)..( 8): Matrix.002 file - promoters60/1381195
atatatgt

SEQ ID NO: 47666 - DNA, 8 bp, Unknown
  misc_feature (1)..( 8): Matrix.002 file - promoters60/1381195
tcaatatt

SEQ ID NO: 47667 - DNA, 7 bp, Unknown
  misc_feature (1)..( 7): Matrix.002 file - promoters60/1381195
aacatta

SEQ ID NO: 47668 - DNA, 6 bp, Unknown
  misc_feature (1)..( 6): Matrix.002 file - promoters60/1381195
ttttgt

SEQ ID NO: 47669 - DNA, 6 bp, Unknown
  misc_feature (1)..( 6): Matrix.002 file - promoters60/1381195
gcttaa

SEQ ID NO: 47670 - DNA, 7 bp, Unknown
  misc_feature (1)..( 7): Matrix.002 file - promoters60/1381195
aacacaa

SEQ ID NO: 47671 - DNA, 7 bp, Unknown
  misc_feature (1)..( 7): Matrix.002 file - promoters60/1381195
attgata

SEQ ID NO: 47672 - DNA, 6 bp, Unknown
  misc_feature (1)..( 6): Matrix.002 file - promoters60/1381195
taatta

SEQ ID NO: 47673 - DNA, 8 bp, Unknown
  misc_feature (1)..( 8): Matrix.002 file - promoters60/1381195
ttaactac

SEQ ID NO: 47674 - DNA, 6 bp, Unknown
  misc_feature (1)..( 6): Matrix.002 file - promoters60/1381195
gtaaat

SEQ ID NO: 47675 - DNA, 8 bp, Unknown
  misc_feature (1)..( 8): Matrix.002 file - promoters60/1381195
tttactat

SEQ ID NO: 47676 - DNA, 7 bp, Unknown
  misc_feature (1)..( 7): Matrix.002 file - promoters60/1381195
ctttatt

SEQ ID NO: 47677 - DNA, 10 bp, Unknown
  misc_feature (1)..( 10): Matrix.002 file - promoters60/1381195
tgtctagatt

SEQ ID NO: 47678 - DNA, 6 bp, Unknown
  misc_feature (1)..( 6): Matrix.002 file - promoters60/1381195
tatagt

SEQ ID NO: 47679 - DNA, 7 bp, Unknown
  misc_feature (1)..( 7): Matrix.002 file - promoters60/1381195
attgtaa

SEQ ID NO: 47680 - DNA, 6 bp, Unknown
  misc_feature (1)..( 6): Matrix.002 file - promoters60/1381195
tgattc

SEQ ID NO: 47681 - DNA, 10 bp, Unknown
  misc_feature (1)..( 10): Matrix.002 file - promoters60/1381457
ggcttttgaa

SEQ ID NO: 47682 - DNA, 9 bp, Unknown
  misc_feature (1)..( 9): Matrix.002 file - promoters60/1381494
tgtgttaat

SEQ ID NO: 47683 - DNA, 9 bp, Unknown
  misc_feature (1)..( 9): Matrix.002 file - promoters60/1381494
aaatgcttt

SEQ ID NO: 47684 - DNA, 7 bp, Unknown
  misc_feature (1)..( 7): Matrix.002 file - promoters60/1381494
ttctttg

SEQ ID NO: 47685 - DNA, 6 bp, Unknown
  misc_feature (1)..( 6): Matrix.002 file - promoters60/1381494
atttat

SEQ ID NO: 47686 - DNA, 8 bp, Unknown
  misc_feature (1)..( 8): Matrix.002 file - promoters60/1381494
ggggtaaa

SEQ ID NO: 47687 - DNA, 7 bp, Unknown
  misc_feature (1)..( 7): Matrix.002 file - promoters60/1381494
ttagatc

SEQ ID NO: 47688 - DNA, 8 bp, Unknown
  misc_feature (1)..( 8): Matrix.002 file - promoters60/1381494
aatccctg

SEQ ID NO: 47689 - DNA, 6 bp, Unknown
  misc_feature (1)..( 6): Matrix.002 file - promoters60/1381494
tccaaa

SEQ ID NO: 47690 - DNA, 8 bp, Unknown
  misc_feature (1)..( 8): Matrix.002 file - promoters60/1381494
tccaaaga

SEQ ID NO: 47691 - DNA, 9 bp, Unknown
  misc_feature (1)..( 9): Matrix.002 file - promoters60/1381494
aattaatgg

SEQ ID NO: 47692 - DNA, 7 bp, Unknown
  misc_feature (1)..( 7): Matrix.002 file - promoters60/1381494
attgtca

SEQ ID NO: 47693 - DNA, 6 bp, Unknown
  misc_feature (1)..( 6): Matrix.002 file - promoters60/1381494
agtaaa

SEQ ID NO: 47694 - DNA, 7 bp, Unknown
  misc_feature (1)..( 7): Matrix.002 file - promoters60/1381494
aatcggg

SEQ ID NO: 47695 - DNA, 8 bp, Unknown
  misc_feature (1)..( 8): Matrix.002 file - promoters60/1381494
gaaacaaa

SEQ ID NO: 47696 - DNA, 10 bp, Unknown
  misc_feature (1)..( 10): Matrix.002 file - promoters60/1381494
ggaaaagaaa

SEQ ID NO: 47697 - DNA, 7 bp, Unknown
  misc_feature (1)..( 7): Matrix.002 file - promoters60/1381494
cccacta

SEQ ID NO: 47698 - DNA, 9 bp, Unknown
  misc_feature (1)..( 9): Matrix.002 file - promoters60/1381494
aaagaaaag

SEQ ID NO: 47699 - DNA, 7 bp, Unknown
  misc_feature (1)..( 7): Matrix.002 file - promoters60/1381494
gtatata

SEQ ID NO: 47700 - DNA, 8 bp, Unknown
  misc_feature (1)..( 8): Matrix.002 file - promoters60/1381537
ggattctt

SEQ ID NO: 47701 - DNA, 8 bp, Unknown
  misc_feature (1)..( 8): Matrix.002 file - promoters60/1381537
agatagat

SEQ ID NO: 47702 - DNA, 7 bp, Unknown
  misc_feature (1)..( 7): Matrix.002 file - promoters60/1381537
catcttc

SEQ ID NO: 47703 - DNA, 7 bp, Unknown
  misc_feature (1)..( 7): Matrix.002 file - promoters60/1381537
tcacttt

SEQ ID NO: 47704 - DNA, 10 bp, Unknown
  misc_feature (1)..( 10): Matrix.002 file - promoters60/1381537
aaaatccttt

SEQ ID NO: 47705 - DNA, 9 bp, Unknown
  misc_feature (1)..( 9): Matrix.002 file - promoters60/1381537
taaaacaaa

SEQ ID NO: 47706 - DNA, 7 bp, Unknown
  misc_feature (1)..( 7): Matrix.002 file - promoters60/1381537
gaaaaat

SEQ ID NO: 47707 - DNA, 9 bp, Unknown
  misc_feature (1)..( 9): Matrix.002 file - promoters60/1381537
tcctaattt

SEQ ID NO: 47708 - DNA, 6 bp, Unknown
  misc_feature (1)..( 6): Matrix.002 file - promoters60/1381537
tttgtt

SEQ ID NO: 47709 - DNA, 6 bp, Unknown
  misc_feature (1)..( 6): Matrix.002 file - promoters60/1381537
taaagg

SEQ ID NO: 47710 - DNA, 6 bp, Unknown
  misc_feature (1)..( 6): Matrix.002 file - promoters60/1381537
ttagat

SEQ ID NO: 47711 - DNA, 7 bp, Unknown
  misc_feature (1)..( 7): Matrix.002 file - promoters60/1381537
ggttgaa

SEQ ID NO: 47712 - DNA, 6 bp, Unknown
  misc_feature (1)..( 6): Matrix.002 file - promoters60/1381537
tttaat

SEQ ID NO: 47713 - DNA, 8 bp, Unknown
  misc_feature (1)..( 8): Matrix.002 file - promoters60/1381537
agaaaaaa

SEQ ID NO: 47714 - DNA, 8 bp, Unknown
  misc_feature (1)..( 8): Matrix.002 file - promoters60/1381537
aaaaaaaa

SEQ ID NO: 47715 - DNA, 8 bp, Unknown
  misc_feature (1)..( 8): Matrix.002 file - promoters60/1381537
gcccatta

SEQ ID NO: 47716 - DNA, 6 bp, Unknown
  misc_feature (1)..( 6): Matrix.002 file - promoters60/1381537
agtaaa

SEQ ID NO: 47717 - DNA, 7 bp, Unknown
  misc_feature (1)..( 7): Matrix.002 file - promoters60/1381537
aatcggg

SEQ ID NO: 47718 - DNA, 8 bp, Unknown
  misc_feature (1)..( 8): Matrix.002 file - promoters60/1381537
gaaacaaa

SEQ ID NO: 47719 - DNA, 10 bp, Unknown
  misc_feature (1)..( 10): Matrix.002 file - promoters60/1381537
ggaaaagaaa

SEQ ID NO: 47720 - DNA, 7 bp, Unknown
  misc_feature (1)..( 7): Matrix.002 file - promoters60/1381537
cccacta

SEQ ID NO: 47721 - DNA, 9 bp, Unknown
  misc_feature (1)..( 9): Matrix.002 file - promoters60/1381537
aaagaaaag

SEQ ID NO: 47722 - DNA, 7 bp, Unknown
  misc_feature (1)..( 7): Matrix.002 file - promoters60/1381537
gtatata

SEQ ID NO: 47723 - DNA, 8 bp, Unknown
  misc_feature (1)..( 8): Matrix.002 file - promoters60/1381563
tgataaaa

SEQ ID NO: 47724 - DNA, 9 bp, Unknown
  misc_feature (1)..( 9): Matrix.002 file - promoters60/1381563
ttacaaaaa

SEQ ID NO: 47725 - DNA, 10 bp, Unknown
  misc_feature (1)..( 10): Matrix.002 file - promoters60/1381563
taaaaattga

SEQ ID NO: 47726 - DNA, 9 bp, Unknown
  misc_feature (1)..( 9): Matrix.002 file - promoters60/1381563
aaccattaa

SEQ ID NO: 47727 - DNA, 8 bp, Unknown
  misc_feature (1)..( 8): Matrix.002 file - promoters60/1381563
atctttaa

SEQ ID NO: 47728 - DNA, 9 bp, Unknown
  misc_feature (1)..( 9): Matrix.002 file - promoters60/1381566
tagaaaaac

SEQ ID NO: 47729 - DNA, 7 bp, Unknown
  misc_feature (1)..( 7): Matrix.002 file - promoters60/1381615
acaaagt

SEQ ID NO: 47730 - DNA, 6 bp, Unknown
  misc_feature (1)..( 6): Matrix.002 file - promoters60/1381615
taacaa

SEQ ID NO: 47731 - DNA, 6 bp, Unknown
  misc_feature (1)..( 6): Matrix.002 file - promoters60/1381615
atctga

SEQ ID NO: 47732 - DNA, 8 bp, Unknown
  misc_feature (1)..( 8): Matrix.002 file - promoters60/1381615
actcttca

SEQ ID NO: 47733 - DNA, 8 bp, Unknown
  misc_feature (1)..( 8): Matrix.002 file - promoters60/1381615
atgtatat

SEQ ID NO: 47734 - DNA, 6 bp, Unknown
  misc_feature (1)..( 6): Matrix.002 file - promoters60/1381615
ctgttt

SEQ ID NO: 47735 - DNA, 7 bp, Unknown
  misc_feature (1)..( 7): Matrix.002 file - promoters60/1381615
tcaacag

SEQ ID NO: 47736 - DNA, 7 bp, Unknown
  misc_feature (1)..( 7): Matrix.002 file - promoters60/1381615
ttacagg

SEQ ID NO: 47737 - DNA, 7 bp, Unknown
  misc_feature (1)..( 7): Matrix.002 file - promoters60/1381615
tacaact

SEQ ID NO: 47738 - DNA, 9 bp, Unknown
  misc_feature (1)..( 9): Matrix.002 file - promoters60/1381615
tttcatgat

SEQ ID NO: 47739 - DNA, 6 bp, Unknown
  misc_feature (1)..( 6): Matrix.002 file - promoters60/1381615
caacat

SEQ ID NO: 47740 - DNA, 6 bp, Unknown
  misc_feature (1)..( 6): Matrix.002 file - promoters60/1381647
aagtct

SEQ ID NO: 47741 - DNA, 10 bp, Unknown
  misc_feature (1)..( 10): Matrix.002 file - promoters60/1381647
aaaatgaaga

SEQ ID NO: 47742 - DNA, 10 bp, Unknown
  misc_feature (1)..( 10): Matrix.002 file - promoters60/1381647
atcttcttcc

SEQ ID NO: 47743 - DNA, 9 bp, Unknown
  misc_feature (1)..( 9): Matrix.002 file - promoters60/1381647
gttttcttt

SEQ ID NO: 47744 - DNA, 9 bp, Unknown
  misc_feature (1)..( 9): Matrix.002 file - promoters60/1381647
ataaatatg

SEQ ID NO: 47745 - DNA, 7 bp, Unknown
  misc_feature (1)..( 7): Matrix.002 file - promoters60/1381647
tttgttt

SEQ ID NO: 47746 - DNA, 9 bp, Unknown
  misc_feature (1)..( 9): Matrix.002 file - promoters60/1381704
gtttccttt

SEQ ID NO: 47747 - DNA, 8 bp, Unknown
  misc_feature (1)..( 8): Matrix.002 file - promoters60/1381704
aaccaata

SEQ ID NO: 47748 - DNA, 9 bp, Unknown
  misc_feature (1)..( 9): Matrix.002 file - promoters60/1381704
tttccttat

SEQ ID NO: 47749 - DNA, 9 bp, Unknown
  misc_feature (1)..( 9): Matrix.002 file - promoters60/1381818
taaaaattc

SEQ ID NO: 47750 - DNA, 9 bp, Unknown
  misc_feature (1)..( 9): Matrix.002 file - promoters60/1381818
taaaacaaa

SEQ ID NO: 47751 - DNA, 11 bp, Unknown
  misc_feature (1)..( 11): Matrix.002 file - promoters60/1381818
ccagtatatat

SEQ ID NO: 47752 - DNA, 11 bp, Unknown
  misc_feature (1)..( 11): Matrix.002 file - promoters60/1381818
gttttaaataa

SEQ ID NO: 47753 - DNA, 10 bp, Unknown
  misc_feature (1)..( 10): Matrix.002 file - promoters60/1381818
aaattatttt

SEQ ID NO: 47754 - DNA, 9 bp, Unknown
  misc_feature (1)..( 9): Matrix.002 file - promoters60/1381818
aaaaatata

SEQ ID NO: 47755 - DNA, 9 bp, Unknown
  misc_feature (1)..( 9): Matrix.002 file - promoters60/1381818
aaataaaat

SEQ ID NO: 47756 - DNA, 8 bp, Unknown
  misc_feature (1)..( 8): Matrix.002 file - promoters60/1381818
acttttgt

SEQ ID NO: 47757 - DNA, 8 bp, Unknown
  misc_feature (1)..( 8): Matrix.002 file - promoters60/1381896
ttggtttt

SEQ ID NO: 47758 - DNA, 6 bp, Unknown
  misc_feature (1)..( 6): Matrix.002 file - promoters60/1381896
ctgatg

SEQ ID NO: 47759 - DNA, 7 bp, Unknown
  misc_feature (1)..( 7): Matrix.002 file - promoters60/1381896
ttagaaa

SEQ ID NO: 47760 - DNA, 8 bp, Unknown
  misc_feature (1)..( 8): Matrix.002 file - promoters60/1381896
aaagacta

SEQ ID NO: 47761 - DNA, 8 bp, Unknown
  misc_feature (1)..( 8): Matrix.002 file - promoters60/1381896
ctcatgta

SEQ ID NO: 47762 - DNA, 7 bp, Unknown
  misc_feature (1)..( 7): Matrix.002 file - promoters60/1381896
ttaagaa

SEQ ID NO: 47763 - DNA, 10 bp, Unknown
  misc_feature (1)..( 10): Matrix.002 file - promoters60/1381896
agatatttat

SEQ ID NO: 47764 - DNA, 6 bp, Unknown
  misc_feature (1)..( 6): Matrix.002 file - promoters60/1381896
ttgaat

SEQ ID NO: 47765 - DNA, 7 bp, Unknown
  misc_feature (1)..( 7): Matrix.002 file - promoters60/1381896
ttctctt

SEQ ID NO: 47766 - DNA, 7 bp, Unknown
  misc_feature (1)..( 7): Matrix.002 file - promoters60/1381896
aaaatca

SEQ ID NO: 47767 - DNA, 6 bp, Unknown
  misc_feature (1)..( 6): Matrix.002 file - promoters60/1381896
atgtct

SEQ ID NO: 47768 - DNA, 7 bp, Unknown
  misc_feature (1)..( 7): Matrix.002 file - promoters60/1381896
tgtacaa

SEQ ID NO: 47769 - DNA, 7 bp, Unknown
  misc_feature (1)..( 7): Matrix.002 file - promoters60/1381896
accagac

SEQ ID NO: 47770 - DNA, 7 bp, Unknown
  misc_feature (1)..( 7): Matrix.002 file - promoters60/1381896
cttagga

SEQ ID NO: 47771 - DNA, 7 bp, Unknown
  misc_feature (1)..( 7): Matrix.002 file - promoters60/1381896
ctaccta

SEQ ID NO: 47772 - DNA, 8 bp, Unknown
  misc_feature (1)..( 8): Matrix.002 file - promoters60/1381896
ttgaagta

SEQ ID NO: 47773 - DNA, 17 bp, Unknown
  misc_feature (1)..( 17): Matrix.002 file - promoters60/1381926
gcccattaatgagtgca

SEQ ID NO: 47774 - DNA, 10 bp, Unknown
  misc_feature (1)..( 10): Matrix.002 file - promoters60/1381926
gaaatagatt

SEQ ID NO: 47775 - DNA, 15 bp, Unknown
  misc_feature (1)..( 15): Matrix.002 file - promoters60/1381926
gcccatataatttga

SEQ ID NO: 47776 - DNA, 7 bp, Unknown
  misc_feature (1)..( 7): Matrix.002 file - promoters60/1382119
gaggaga

SEQ ID NO: 47777 - DNA, 6 bp, Unknown
  misc_feature (1)..( 6): Matrix.002 file - promoters60/1382119
tttctt

SEQ ID NO: 47778 - DNA, 8 bp, Unknown
  misc_feature (1)..( 8): Matrix.002 file - promoters60/1382119
attcacca

SEQ ID NO: 47779 - DNA, 7 bp, Unknown
  misc_feature (1)..( 7): Matrix.002 file - promoters60/1382119
aatgaaa

SEQ ID NO: 47780 - DNA, 8 bp, Unknown
  misc_feature (1)..( 8): Matrix.002 file - promoters60/1382119
acaaagaa

SEQ ID NO: 47781 - DNA, 6 bp, Unknown
  misc_feature (1)..( 6): Matrix.002 file - promoters60/1382119
aaaata

SEQ ID NO: 47782 - DNA, 10 bp, Unknown
  misc_feature (1)..( 10): Matrix.002 file - promoters60/1382119
tataaataaa

SEQ ID NO: 47783 - DNA, 6 bp, Unknown
  misc_feature (1)..( 6): Matrix.002 file - promoters60/1382119
caaaag

SEQ ID NO: 47784 - DNA, 8 bp, Unknown
  misc_feature (1)..( 8): Matrix.002 file - promoters60/1382119
ttctctct

SEQ ID NO: 47785 - DNA, 8 bp, Unknown
  misc_feature (1)..( 8): Matrix.002 file - promoters60/1382119
tataacca

SEQ ID NO: 47786 - DNA, 8 bp, Unknown
  misc_feature (1)..( 8): Matrix.002 file - promoters60/1382119
gttatcgt

SEQ ID NO: 47787 - DNA, 8 bp, Unknown
  misc_feature (1)..( 8): Matrix.002 file - promoters60/1382119
aaaacaaa

SEQ ID NO: 47788 - DNA, 7 bp, Unknown
  misc_feature (1)..( 7): Matrix.002 file - promoters60/1382134
tgaaatt

SEQ ID NO: 47789 - DNA, 7 bp, Unknown
  misc_feature (1)..( 7): Matrix.002 file - promoters60/1382134
taaacat

SEQ ID NO: 47790 - DNA, 6 bp, Unknown
  misc_feature (1)..( 6): Matrix.002 file - promoters60/1382134
ttaact

SEQ ID NO: 47791 - DNA, 6 bp, Unknown
  misc_feature (1)..( 6): Matrix.002 file - promoters60/1382134
taaaat

SEQ ID NO: 47792 - DNA, 8 bp, Unknown
  misc_feature (1)..( 8): Matrix.002 file - promoters60/1382134
agatttta

SEQ ID NO: 47793 - DNA, 6 bp, Unknown
  misc_feature (1)..( 6): Matrix.002 file - promoters60/1382134
taataa

SEQ ID NO: 47794 - DNA, 7 bp, Unknown
  misc_feature (1)..( 7): Matrix.002 file - promoters60/1382134
aatatat

SEQ ID NO: 47795 - DNA, 7 bp, Unknown
  misc_feature (1)..( 7): Matrix.002 file - promoters60/1382134
taccaaa

SEQ ID NO: 47796 - DNA, 10 bp, Unknown
  misc_feature (1)..( 10): Matrix.002 file - promoters60/1382134
acaattttta

SEQ ID NO: 47797 - DNA, 6 bp, Unknown
  misc_feature (1)..( 6): Matrix.002 file - promoters60/1382134
cttcta

SEQ ID NO: 47798 - DNA, 7 bp, Unknown
  misc_feature (1)..( 7): Matrix.002 file - promoters60/1382134
cacgtga

SEQ ID NO: 47799 - DNA, 6 bp, Unknown
  misc_feature (1)..( 6): Matrix.002 file - promoters60/1382134
aaaaat

SEQ ID NO: 47800 - DNA, 6 bp, Unknown
  misc_feature (1)..( 6): Matrix.002 file - promoters60/1382134
gatgat

SEQ ID NO: 47801 - DNA, 13 bp, Unknown
  misc_feature (1)..( 13): Matrix.002 file - promoters60/1382134
ataatttaaaatt

SEQ ID NO: 47802 - DNA, 8 bp, Unknown
  misc_feature (1)..( 8): Matrix.002 file - promoters60/1382134
agacgtgt

SEQ ID NO: 47803 - DNA, 6 bp, Unknown
  misc_feature (1)..( 6): Matrix.002 file - promoters60/1382134
taaaat

SEQ ID NO: 47804 - DNA, 6 bp, Unknown
  misc_feature (1)..( 6): Matrix.002 file - promoters60/1382134
aatgtt

SEQ ID NO: 47805 - DNA, 6 bp, Unknown
  misc_feature (1)..( 6): Matrix.002 file - promoters60/1382134
ttaatt

SEQ ID NO: 47806 - DNA, 7 bp, Unknown
  misc_feature (1)..( 7): Matrix.002 file - promoters60/1382134
aatttaa

SEQ ID NO: 47807 - DNA, 6 bp, Unknown
  misc_feature (1)..( 6): Matrix.002 file - promoters60/1382134
ttttaa

SEQ ID NO: 47808 - DNA, 9 bp, Unknown
  misc_feature (1)..( 9): Matrix.002 file - promoters60/1382134
tcaaaataa

SEQ ID NO: 47809 - DNA, 7 bp, Unknown
  misc_feature (1)..( 7): Matrix.002 file - promoters60/1382134
ataaata

SEQ ID NO: 47810 - DNA, 9 bp, Unknown
  misc_feature (1)..( 9): Matrix.002 file - promoters60/1382281
attaaatga

SEQ ID NO: 47811 - DNA, 9 bp, Unknown
  misc_feature (1)..( 9): Matrix.002 file - promoters60/1382281
aaaataaat

SEQ ID NO: 47812 - DNA, 11 bp, Unknown
  misc_feature (1)..( 11): Matrix.002 file - promoters60/1382281
ttttcgaaaaa

SEQ ID NO: 47813 - DNA, 9 bp, Unknown
  misc_feature (1)..( 9): Matrix.002 file - promoters60/1382302
gtttgagtt

SEQ ID NO: 47814 - DNA, 10 bp, Unknown
  misc_feature (1)..( 10): Matrix.002 file - promoters60/1382302
aattatataa

SEQ ID NO: 47815 - DNA, 9 bp, Unknown
  misc_feature (1)..( 9): Matrix.002 file - promoters60/1382302
taatacagt

SEQ ID NO: 47816 - DNA, 11 bp, Unknown
  misc_feature (1)..( 11): Matrix.002 file - promoters60/1382302
ctatttgtctc

SEQ ID NO: 47817 - DNA, 10 bp, Unknown
  misc_feature (1)..( 10): Matrix.002 file - promoters60/1382302
attttataat

SEQ ID NO: 47818 - DNA, 7 bp, Unknown
  misc_feature (1)..( 7): Matrix.002 file - promoters60/1382302
aaaattg

SEQ ID NO: 47819 - DNA, 8 bp, Unknown
  misc_feature (1)..( 8): Matrix.002 file - promoters60/1382302
attttatt

SEQ ID NO: 47820 - DNA, 9 bp, Unknown
  misc_feature (1)..( 9): Matrix.002 file - promoters60/1382302
agattttat

SEQ ID NO: 47821 - DNA, 10 bp, Unknown
  misc_feature (1)..( 10): Matrix.002 file - promoters60/1382302
atacaattta

SEQ ID NO: 47822 - DNA, 6 bp, Unknown
  misc_feature (1)..( 6): Matrix.002 file - promoters60/1382302
ttttct

SEQ ID NO: 47823 - DNA, 8 bp, Unknown
  misc_feature (1)..( 8): Matrix.002 file - promoters60/1382713
atgactta

SEQ ID NO: 47824 - DNA, 7 bp, Unknown
  misc_feature (1)..( 7): Matrix.002 file - promoters60/1382713
attgtgt

SEQ ID NO: 47825 - DNA, 8 bp, Unknown
  misc_feature (1)..( 8): Matrix.002 file - promoters60/1382713
attattct

SEQ ID NO: 47826 - DNA, 8 bp, Unknown
  misc_feature (1)..( 8): Matrix.002 file - promoters60/1382713
tgaagaaa

SEQ ID NO: 47827 - DNA, 10 bp, Unknown
  misc_feature (1)..( 10): Matrix.002 file - promoters60/1382959
gtaaataaat

SEQ ID NO: 47828 - DNA, 10 bp, Unknown
  misc_feature (1)..( 10): Matrix.002 file - promoters60/1382959
gcaaataaat

SEQ ID NO: 47829 - DNA, 7 bp, Unknown
  misc_feature (1)..( 7): Matrix.002 file - promoters60/1383074
tagactt

SEQ ID NO: 47830 - DNA, 7 bp, Unknown
  misc_feature (1)..( 7): Matrix.002 file - promoters60/1383074
ggtattg

SEQ ID NO: 47831 - DNA, 10 bp, Unknown
  misc_feature (1)..( 10): Matrix.002 file - promoters60/1383074
atacatataa

SEQ ID NO: 47832 - DNA, 6 bp, Unknown
  misc_feature (1)..( 6): Matrix.002 file - promoters60/1383074
tatgaa

SEQ ID NO: 47833 - DNA, 10 bp, Unknown
  misc_feature (1)..( 10): Matrix.002 file - promoters60/1383074
aaatacaaag

SEQ ID NO: 47834 - DNA, 7 bp, Unknown
  misc_feature (1)..( 7): Matrix.002 file - promoters60/1383074
caataat

SEQ ID NO: 47835 - DNA, 7 bp, Unknown
  misc_feature (1)..( 7): Matrix.002 file - promoters60/1383074
aaaaaaa

SEQ ID NO: 47836 - DNA, 11 bp, Unknown
  misc_feature (1)..( 11): Matrix.002 file - promoters60/1383074
aaaaaaaattc

SEQ ID NO: 47837 - DNA, 7 bp, Unknown
  misc_feature (1)..( 7): Matrix.002 file - promoters60/1383074
ttgtttt

SEQ ID NO: 47838 - DNA, 7 bp, Unknown
  misc_feature (1)..( 7): Matrix.002 file - promoters60/1383074
tgacata

SEQ ID NO: 47839 - DNA, 7 bp, Unknown
  misc_feature (1)..( 7): Matrix.002 file - promoters60/1383074
atattgt

SEQ ID NO: 47840 - DNA, 7 bp, Unknown
  misc_feature (1)..( 7): Matrix.002 file - promoters60/1383074
cataaat

SEQ ID NO: 47841 - DNA, 8 bp, Unknown
  misc_feature (1)..( 8): Matrix.002 file - promoters60/1383074
gatcgaag

SEQ ID NO: 47842 - DNA, 7 bp, Unknown
  misc_feature (1)..( 7): Matrix.002 file - promoters60/1383074
aagaatg

SEQ ID NO: 47843 - DNA, 7 bp, Unknown
  misc_feature (1)..( 7): Matrix.002 file - promoters60/1383074
gtagctt

SEQ ID NO: 47844 - DNA, 9 bp, Unknown
  misc_feature (1)..( 9): Matrix.002 file - promoters60/1383074
aagtaaaca

SEQ ID NO: 47845 - DNA, 6 bp, Unknown
  misc_feature (1)..( 6): Matrix.002 file - promoters60/1383074
attata

SEQ ID NO: 47846 - DNA, 8 bp, Unknown
  misc_feature (1)..( 8): Matrix.002 file - promoters60/1383074
aaaaaaaa

SEQ ID NO: 47847 - DNA, 7 bp, Unknown
  misc_feature (1)..( 7): Matrix.002 file - promoters60/1383074
ttggttt

SEQ ID NO: 47848 - DNA, 6 bp, Unknown
  misc_feature (1)..( 6): Matrix.002 file - promoters60/1383214
cataat

SEQ ID NO: 47849 - DNA, 6 bp, Unknown
  misc_feature (1)..( 6): Matrix.002 file - promoters60/1383214
tggttt

SEQ ID NO: 47850 - DNA, 7 bp, Unknown
  misc_feature (1)..( 7): Matrix.002 file - promoters60/1383214
accagaa

SEQ ID NO: 47851 - DNA, 7 bp, Unknown
  misc_feature (1)..( 7): Matrix.002 file - promoters60/1383214
tcaaaac

SEQ ID NO: 47852 - DNA, 8 bp, Unknown
  misc_feature (1)..( 8): Matrix.002 file - promoters60/1383214
tttcattt

SEQ ID NO: 47853 - DNA, 7 bp, Unknown
  misc_feature (1)..( 7): Matrix.002 file - promoters60/1383214
aaaaatt

SEQ ID NO: 47854 - DNA, 8 bp, Unknown
  misc_feature (1)..( 8): Matrix.002 file - promoters60/1383214
ataaataa

SEQ ID NO: 47855 - DNA, 10 bp, Unknown
  misc_feature (1)..( 10): Matrix.002 file - promoters60/1383214
atatatataa

SEQ ID NO: 47856 - DNA, 9 bp, Unknown
  misc_feature (1)..( 9): Matrix.002 file - promoters60/1383214
tttaagttt

SEQ ID NO: 47857 - DNA, 9 bp, Unknown
  misc_feature (1)..( 9): Matrix.002 file - promoters60/1383214
acatggttt

SEQ ID NO: 47858 - DNA, 7 bp, Unknown
  misc_feature (1)..( 7): Matrix.002 file - promoters60/1383214
aaacata

SEQ ID NO: 47859 - DNA, 7 bp, Unknown
  misc_feature (1)..( 7): Matrix.002 file - promoters60/1383214
atataca

SEQ ID NO: 47860 - DNA, 7 bp, Unknown
  misc_feature (1)..( 7): Matrix.002 file - promoters60/1383214
ttaagtt

SEQ ID NO: 47861 - DNA, 7 bp, Unknown
  misc_feature (1)..( 7): Matrix.002 file - promoters60/1383214
taaaact

SEQ ID NO: 47862 - DNA, 7 bp, Unknown
  misc_feature (1)..( 7): Matrix.002 file - promoters60/1383214
aaaatca

SEQ ID NO: 47863 - DNA, 8 bp, Unknown
  misc_feature (1)..( 8): Matrix.002 file - promoters60/1383214
attcacat

SEQ ID NO: 47864 - DNA, 6 bp, Unknown
  misc_feature (1)..( 6): Matrix.002 file - promoters60/1383214
atattt

SEQ ID NO: 47865 - DNA, 7 bp, Unknown
  misc_feature (1)..( 7): Matrix.002 file - promoters60/1383214
tcaaaaa

SEQ ID NO: 47866 - DNA, 6 bp, Unknown
  misc_feature (1)..( 6): Matrix.002 file - promoters60/1383214
attgct

SEQ ID NO: 47867 - DNA, 6 bp, Unknown
  misc_feature (1)..( 6): Matrix.002 file - promoters60/1383214
atctaa

SEQ ID NO: 47868 - DNA, 7 bp, Unknown
  misc_feature (1)..( 7): Matrix.002 file - promoters60/1383214
aaccacc

SEQ ID NO: 47869 - DNA, 7 bp, Unknown
  misc_feature (1)..( 7): Matrix.002 file - promoters60/1383214
atggtca

SEQ ID NO: 47870 - DNA, 8 bp, Unknown
  misc_feature (1)..( 8): Matrix.002 file - promoters60/1383214
agaacaat

SEQ ID NO: 47871 - DNA, 10 bp, Unknown
  misc_feature (1)..( 10): Matrix.002 file - promoters60/1383312
tggaaacaat

SEQ ID NO: 47872 - DNA, 12 bp, Unknown
  misc_feature (1)..( 12): Matrix.002 file - promoters60/1383312
ctaatttcttgt

SEQ ID NO: 47873 - DNA, 8 bp, Unknown
  misc_feature (1)..( 8): Matrix.002 file - promoters60/1383312
tcaacttt

SEQ ID NO: 47874 - DNA, 11 bp, Unknown
  misc_feature (1)..( 11): Matrix.002 file - promoters60/1383341
aaataagaaat

SEQ ID NO: 47875 - DNA, 15 bp, Unknown
  misc_feature (1)..( 15): Matrix.002 file - promoters60/1383341
ctaaaaagtaaaaaa

SEQ ID NO: 47876 - DNA, 11 bp, Unknown
  misc_feature (1)..( 11): Matrix.002 file - promoters60/1383341
attttataata

SEQ ID NO: 47877 - DNA, 9 bp, Unknown
  misc_feature (1)..( 9): Matrix.002 file - promoters60/1383341
ctttaatgt

SEQ ID NO: 47878 - DNA, 9 bp, Unknown
  misc_feature (1)..( 9): Matrix.002 file - promoters60/1383341
aaatgaaaa

SEQ ID NO: 47879 - DNA, 8 bp, Unknown
  misc_feature (1)..( 8): Matrix.002 file - promoters60/1383341
ttaaaaat

SEQ ID NO: 47880 - DNA, 12 bp, Unknown
  misc_feature (1)..( 12): Matrix.002 file - promoters60/1383341
tttgaaatagta

SEQ ID NO: 47881 - DNA, 12 bp, Unknown
  misc_feature (1)..( 12): Matrix.002 file - promoters60/1383341
taacaaaaaaca

SEQ ID NO: 47882 - DNA, 11 bp, Unknown
  misc_feature (1)..( 11): Matrix.002 file - promoters60/1383485
acataattaag

SEQ ID NO: 47883 - DNA, 9 bp, Unknown
  misc_feature (1)..( 9): Matrix.002 file - promoters60/1383485
tgtaaaaaa

SEQ ID NO: 47884 - DNA, 10 bp, Unknown
  misc_feature (1)..( 10): Matrix.002 file - promoters60/1383514
aaatacattt

SEQ ID NO: 47885 - DNA, 10 bp, Unknown
  misc_feature (1)..( 10): Matrix.002 file - promoters60/1383514
caataaaata

SEQ ID NO: 47886 - DNA, 8 bp, Unknown
  misc_feature (1)..( 8): Matrix.002 file - promoters60/1383514
catctaaa

SEQ ID NO: 47887 - DNA, 8 bp, Unknown
  misc_feature (1)..( 8): Matrix.002 file - promoters60/1383514
taaaaaac

SEQ ID NO: 47888 - DNA, 8 bp, Unknown
  misc_feature (1)..( 8): Matrix.002 file - promoters60/1383514
ataaatac

SEQ ID NO: 47889 - DNA, 7 bp, Unknown
  misc_feature (1)..( 7): Matrix.002 file - promoters60/1383514
tttgtta

SEQ ID NO: 47890 - DNA, 8 bp, Unknown
  misc_feature (1)..( 8): Matrix.002 file - promoters60/1383514
atatctta

SEQ ID NO: 47891 - DNA, 7 bp, Unknown
  misc_feature (1)..( 7): Matrix.002 file - promoters60/1383514
aataaaa

SEQ ID NO: 47892 - DNA, 11 bp, Unknown
  misc_feature (1)..( 11): Matrix.002 file - promoters60/1383552
accaaaaaaca

SEQ ID NO: 47893 - DNA, 8 bp, Unknown
  misc_feature (1)..( 8): Matrix.002 file - promoters60/1383552
acacaaac

SEQ ID NO: 47894 - DNA, 8 bp, Unknown
  misc_feature (1)..( 8): Matrix.002 file - promoters60/1383569
attttaaa

SEQ ID NO: 47895 - DNA, 14 bp, Unknown
  misc_feature (1)..( 14): Matrix.002 file - promoters60/1383569
atattagctggtgc

SEQ ID NO: 47896 - DNA, 7 bp, Unknown
  misc_feature (1)..( 7): Matrix.002 file - promoters60/1383569
taagatg

SEQ ID NO: 47897 - DNA, 11 bp, Unknown
  misc_feature (1)..( 11): Matrix.002 file - promoters60/1383569
aatgaaatagt

SEQ ID NO: 47898 - DNA, 7 bp, Unknown
  misc_feature (1)..( 7): Matrix.002 file - promoters60/1383569
atttaaa

SEQ ID NO: 47899 - DNA, 10 bp, Unknown
  misc_feature (1)..( 10): Matrix.002 file - promoters60/1383569
aatttaaact

SEQ ID NO: 47900 - DNA, 13 bp, Unknown
  misc_feature (1)..( 13): Matrix.002 file - promoters60/1383569
aatattaaaataa

SEQ ID NO: 47901 - DNA, 7 bp, Unknown
  misc_feature (1)..( 7): Matrix.002 file - promoters60/1383569
gattgat

SEQ ID NO: 47902 - DNA, 11 bp, Unknown
  misc_feature (1)..( 11): Matrix.002 file - promoters60/1383661
agacctgaatc

SEQ ID NO: 47903 - DNA, 10 bp, Unknown
  misc_feature (1)..( 10): Matrix.002 file - promoters60/1384016
tgcaaaaaac

SEQ ID NO: 47904 - DNA, 7 bp, Unknown
  misc_feature (1)..( 7): Matrix.002 file - promoters60/1384161
aatgttg

SEQ ID NO: 47905 - DNA, 12 bp, Unknown
  misc_feature (1)..( 12): Matrix.002 file - promoters60/1384161
cctgctttaaat

SEQ ID NO: 47906 - DNA, 13 bp, Unknown
  misc_feature (1)..( 13): Matrix.002 file - promoters60/1384161
tctttttaatttt

SEQ ID NO: 47907 - DNA, 7 bp, Unknown
  misc_feature (1)..( 7): Matrix.002 file - promoters60/1384161
aatatct

SEQ ID NO: 47908 - DNA, 6 bp, Unknown
  misc_feature (1)..( 6): Matrix.002 file - promoters60/1384161
ctaaat

SEQ ID NO: 47909 - DNA, 7 bp, Unknown
  misc_feature (1)..( 7): Matrix.002 file - promoters60/1384161
ctgcaaa

SEQ ID NO: 47910 - DNA, 9 bp, Unknown
  misc_feature (1)..( 9): Matrix.002 file - promoters60/1384161
taaaaatgt

SEQ ID NO: 47911 - DNA, 6 bp, Unknown
  misc_feature (1)..( 6): Matrix.002 file - promoters60/1384161
tgttga

SEQ ID NO: 47912 - DNA, 8 bp, Unknown
  misc_feature (1)..( 8): Matrix.002 file - promoters60/1384161
tttgaact

SEQ ID NO: 47913 - DNA, 6 bp, Unknown
  misc_feature (1)..( 6): Matrix.002 file - promoters60/1384161
cagttg

SEQ ID NO: 47914 - DNA, 8 bp, Unknown
  misc_feature (1)..( 8): Matrix.002 file - promoters60/1384161
gtttatta

SEQ ID NO: 47915 - DNA, 7 bp, Unknown
  misc_feature (1)..( 7): Matrix.002 file - promoters60/1384161
tttagct

SEQ ID NO: 47916 - DNA, 6 bp, Unknown
  misc_feature (1)..( 6): Matrix.002 file - promoters60/1384161
tctata

SEQ ID NO: 47917 - DNA, 8 bp, Unknown
  misc_feature (1)..( 8): Matrix.002 file - promoters60/1384161
atagtttt

SEQ ID NO: 47918 - DNA, 9 bp, Unknown
  misc_feature (1)..( 9): Matrix.002 file - promoters60/1384161
tttccttag

SEQ ID NO: 47919 - DNA, 7 bp, Unknown
  misc_feature (1)..( 7): Matrix.002 file - promoters60/1384161
tatatgt

SEQ ID NO: 47920 - DNA, 8 bp, Unknown
  misc_feature (1)..( 8): Matrix.002 file - promoters60/1384161
attgattt

SEQ ID NO: 47921 - DNA, 15 bp, Unknown
  misc_feature (1)..( 15): Matrix.002 file - promoters60/1384169
cttatcaaaaaataa

SEQ ID NO: 47922 - DNA, 8 bp, Unknown
  misc_feature (1)..( 8): Matrix.002 file - promoters60/1384261
taatattt

SEQ ID NO: 47923 - DNA, 8 bp, Unknown
  misc_feature (1)..( 8): Matrix.002 file - promoters60/1384261
aaaaaaac

SEQ ID NO: 47924 - DNA, 6 bp, Unknown
  misc_feature (1)..( 6): Matrix.002 file - promoters60/1384261
aattta

SEQ ID NO: 47925 - DNA, 6 bp, Unknown
  misc_feature (1)..( 6): Matrix.002 file - promoters60/1384261
caaata

SEQ ID NO: 47926 - DNA, 8 bp, Unknown
  misc_feature (1)..( 8): Matrix.002 file - promoters60/1384261
ccaaaata

SEQ ID NO: 47927 - DNA, 6 bp, Unknown
  misc_feature (1)..( 6): Matrix.002 file - promoters60/1384261
aattta

SEQ ID NO: 47928 - DNA, 10 bp, Unknown
  misc_feature (1)..( 10): Matrix.002 file - promoters60/1384261
aaaaatataa

SEQ ID NO: 47929 - DNA, 6 bp, Unknown
  misc_feature (1)..( 6): Matrix.002 file - promoters60/1384261
taaaaa

SEQ ID NO: 47930 - DNA, 9 bp, Unknown
  misc_feature (1)..( 9): Matrix.002 file - promoters60/1384261
atttcattc

SEQ ID NO: 47931 - DNA, 7 bp, Unknown
  misc_feature (1)..( 7): Matrix.002 file - promoters60/1384261
attaacc

SEQ ID NO: 47932 - DNA, 7 bp, Unknown
  misc_feature (1)..( 7): Matrix.002 file - promoters60/1384261
aaacaga

SEQ ID NO: 47933 - DNA, 6 bp, Unknown
  misc_feature (1)..( 6): Matrix.002 file - promoters60/1384261
aaaatg

SEQ ID NO: 47934 - DNA, 7 bp, Unknown
  misc_feature (1)..( 7): Matrix.002 file - promoters60/1384261
aatcttt

SEQ ID NO: 47935 - DNA, 7 bp, Unknown
  misc_feature (1)..( 7): Matrix.002 file - promoters60/1384261
actaaaa

SEQ ID NO: 47936 - DNA, 6 bp, Unknown
  misc_feature (1)..( 6): Matrix.002 file - promoters60/1384261
aaaatt

SEQ ID NO: 47937 - DNA, 11 bp, Unknown
  misc_feature (1)..( 11): Matrix.002 file - promoters60/1384261
aaaatgaatat

SEQ ID NO: 47938 - DNA, 7 bp, Unknown
  misc_feature (1)..( 7): Matrix.002 file - promoters60/1384261
acagatc

SEQ ID NO: 47939 - DNA, 8 bp, Unknown
  misc_feature (1)..( 8): Matrix.002 file - promoters60/1384261
tatgaaat

SEQ ID NO: 47940 - DNA, 7 bp, Unknown
  misc_feature (1)..( 7): Matrix.002 file - promoters60/1384261
ctccctt

SEQ ID NO: 47941 - DNA, 7 bp, Unknown
  misc_feature (1)..( 7): Matrix.002 file - promoters60/1384261
aaaaagt

SEQ ID NO: 47942 - DNA, 9 bp, Unknown
  misc_feature (1)..( 9): Matrix.002 file - promoters60/1384329
gtatgaatc

SEQ ID NO: 47943 - DNA, 9 bp, Unknown
  misc_feature (1)..( 9): Matrix.002 file - promoters60/1384329
aataaaaca

SEQ ID NO: 47944 - DNA, 7 bp, Unknown
  misc_feature (1)..( 7): Matrix.002 file - promoters60/1384329
tgaccaa

SEQ ID NO: 47945 - DNA, 7 bp, Unknown
  misc_feature (1)..( 7): Matrix.002 file - promoters60/1384329
tgaccaa

SEQ ID NO: 47946 - DNA, 7 bp, Unknown
  misc_feature (1)..( 7): Matrix.002 file - promoters60/1384329
ggaaaaa

SEQ ID NO: 47947 - DNA, 11 bp, Unknown
  misc_feature (1)..( 11): Matrix.002 file - promoters60/1385347
aaaatatgata

SEQ ID NO: 47948 - DNA, 8 bp, Unknown
  misc_feature (1)..( 8): Matrix.002 file - promoters60/1385347
tttgtgat

SEQ ID NO: 47949 - DNA, 9 bp, Unknown
  misc_feature (1)..( 9): Matrix.002 file - promoters60/1385347
atgttttaa

SEQ ID NO: 47950 - DNA, 8 bp, Unknown
  misc_feature (1)..( 8): Matrix.002 file - promoters60/1385347
ctgaaatg

SEQ ID NO: 47951 - DNA, 9 bp, Unknown
  misc_feature (1)..( 9): Matrix.002 file - promoters60/1385347
ttttaatac

SEQ ID NO: 47952 - DNA, 7 bp, Unknown
  misc_feature (1)..( 7): Matrix.002 file - promoters60/1385376
attgttg

SEQ ID NO: 47953 - DNA, 9 bp, Unknown
  misc_feature (1)..( 9): Matrix.002 file - promoters60/1385376
taaaagatt

SEQ ID NO: 47954 - DNA, 7 bp, Unknown
  misc_feature (1)..( 7): Matrix.002 file - promoters60/1385376
ttggttt

SEQ ID NO: 47955 - DNA, 9 bp, Unknown
  misc_feature (1)..( 9): Matrix.002 file - promoters60/1385376
tttggtttt

SEQ ID NO: 47956 - DNA, 7 bp, Unknown
  misc_feature (1)..( 7): Matrix.002 file - promoters60/1385376
aaagaga

SEQ ID NO: 47957 - DNA, 8 bp, Unknown
  misc_feature (1)..( 8): Matrix.002 file - promoters60/1385376
taaatagt

SEQ ID NO: 47958 - DNA, 8 bp, Unknown
  misc_feature (1)..( 8): Matrix.002 file - promoters60/1385376
gaaacaat

SEQ ID NO: 47959 - DNA, 7 bp, Unknown
  misc_feature (1)..( 7): Matrix.002 file - promoters60/1385376
ataattg

SEQ ID NO: 47960 - DNA, 6 bp, Unknown
  misc_feature (1)..( 6): Matrix.002 file - promoters60/1385376
ttttga

SEQ ID NO: 47961 - DNA, 7 bp, Unknown
  misc_feature (1)..( 7): Matrix.002 file - promoters60/1385376
tgagatt

SEQ ID NO: 47962 - DNA, 6 bp, Unknown
  misc_feature (1)..( 6): Matrix.002 file - promoters60/1385376
ttggaa

SEQ ID NO: 47963 - DNA, 8 bp, Unknown
  misc_feature (1)..( 8): Matrix.002 file - promoters60/1385376
gaaaatga

SEQ ID NO: 47964 - DNA, 10 bp, Unknown
  misc_feature (1)..( 10): Matrix.002 file - promoters60/1385376
ttgaggttca

SEQ ID NO: 47965 - DNA, 9 bp, Unknown
  misc_feature (1)..( 9): Matrix.002 file - promoters60/1385376
agagagcaa

SEQ ID NO: 47966 - DNA, 7 bp, Unknown
  misc_feature (1)..( 7): Matrix.002 file - promoters60/1385376
ttgagaa

SEQ ID NO: 47967 - DNA, 6 bp, Unknown
  misc_feature (1)..( 6): Matrix.002 file - promoters60/1385376
tcttat

SEQ ID NO: 47968 - DNA, 7 bp, Unknown
  misc_feature (1)..( 7): Matrix.002 file - promoters60/1385376
aagctgt

SEQ ID NO: 47969 - DNA, 8 bp, Unknown
  misc_feature (1)..( 8): Matrix.002 file - promoters60/1385376
cctaagaa

SEQ ID NO: 47970 - DNA, 13 bp, Unknown
  misc_feature (1)..( 13): Matrix.002 file - promoters60/1385376
ttgaatcaaaatt

SEQ ID NO: 47971 - DNA, 7 bp, Unknown
  misc_feature (1)..( 7): Matrix.002 file - promoters60/1385376
tggattt

SEQ ID NO: 47972 - DNA, 6 bp, Unknown
  misc_feature (1)..( 6): Matrix.002 file - promoters60/1385376
ttaacc

SEQ ID NO: 47973 - DNA, 7 bp, Unknown
  misc_feature (1)..( 7): Matrix.002 file - promoters60/1385376
ctcactc

SEQ ID NO: 47974 - DNA, 6 bp, Unknown
  misc_feature (1)..( 6): Matrix.002 file - promoters60/1385376
atttct

SEQ ID NO: 47975 - DNA, 11 bp, Unknown
  misc_feature (1)..( 11): Matrix.002 file - promoters60/1386215
atcaaaatttg

SEQ ID NO: 47976 - DNA, 8 bp, Unknown
  misc_feature (1)..( 8): Matrix.002 file - promoters60/1386215
gctttatc

SEQ ID NO: 47977 - DNA, 9 bp, Unknown
  misc_feature (1)..( 9): Matrix.002 file - promoters60/1386215
tccaatttc

SEQ ID NO: 47978 - DNA, 10 bp, Unknown
  misc_feature (1)..( 10): Matrix.002 file - promoters60/1386215
aaaatgtgaa

SEQ ID NO: 47979 - DNA, 9 bp, Unknown
  misc_feature (1)..( 9): Matrix.002 file - promoters60/1386215
gatttgtaa

SEQ ID NO: 47980 - DNA, 10 bp, Unknown
  misc_feature (1)..( 10): Matrix.002 file - promoters60/1386215
aaaatgtgaa

SEQ ID NO: 47981 - DNA, 6 bp, Unknown
  misc_feature (1)..( 6): Matrix.002 file - promoters60/1386628
gaacat

SEQ ID NO: 47982 - DNA, 9 bp, Unknown
  misc_feature (1)..( 9): Matrix.002 file - promoters60/1386628
atttcttac

SEQ ID NO: 47983 - DNA, 9 bp, Unknown
  misc_feature (1)..( 9): Matrix.002 file - promoters60/1386628
aagatgcta

SEQ ID NO: 47984 - DNA, 6 bp, Unknown
  misc_feature (1)..( 6): Matrix.002 file - promoters60/1386778
tgtttt

SEQ ID NO: 47985 - DNA, 6 bp, Unknown
  misc_feature (1)..( 6): Matrix.002 file - promoters60/1386778
gtaatc

SEQ ID NO: 47986 - DNA, 7 bp, Unknown
  misc_feature (1)..( 7): Matrix.002 file - promoters60/1386778
aagaaat

SEQ ID NO: 47987 - DNA, 9 bp, Unknown
  misc_feature (1)..( 9): Matrix.002 file - promoters60/1386778
aaacaaaaa

SEQ ID NO: 47988 - DNA, 10 bp, Unknown
  misc_feature (1)..( 10): Matrix.002 file - promoters60/1386778
agaaaagaaa

SEQ ID NO: 47989 - DNA, 14 bp, Unknown
  misc_feature (1)..( 14): Matrix.002 file - promoters60/1386778
gtatataaaaaaaa

SEQ ID NO: 47990 - DNA, 7 bp, Unknown
  misc_feature (1)..( 7): Matrix.002 file - promoters60/1386778
tgagctt

SEQ ID NO: 47991 - DNA, 7 bp, Unknown
  misc_feature (1)..( 7): Matrix.002 file - promoters60/1386778
gaaagat

SEQ ID NO: 47992 - DNA, 6 bp, Unknown
  misc_feature (1)..( 6): Matrix.002 file - promoters60/1386778
ttttaa

SEQ ID NO: 47993 - DNA, 7 bp, Unknown
  misc_feature (1)..( 7): Matrix.002 file - promoters60/1386778
aaaaatt

SEQ ID NO: 47994 - DNA, 11 bp, Unknown
  misc_feature (1)..( 11): Matrix.002 file - promoters60/1386778
ccaatttgtta

SEQ ID NO: 47995 - DNA, 6 bp, Unknown
  misc_feature (1)..( 6): Matrix.002 file - promoters60/1386778
ataatt

SEQ ID NO: 47996 - DNA, 7 bp, Unknown
  misc_feature (1)..( 7): Matrix.002 file - promoters60/1386778
tttaggc

SEQ ID NO: 47997 - DNA, 6 bp, Unknown
  misc_feature (1)..( 6): Matrix.002 file - promoters60/1386778
agtaaa

SEQ ID NO: 47998 - DNA, 7 bp, Unknown
  misc_feature (1)..( 7): Matrix.002 file - promoters60/1386778
aatcggg

SEQ ID NO: 47999 - DNA, 7 bp, Unknown
  misc_feature (1)..( 7): Matrix.002 file - promoters60/1386778
cccacta

SEQ ID NO: 48000 - DNA, 9 bp, Unknown
  misc_feature (1)..( 9): Matrix.002 file - promoters60/1386778
aaagaaaag

SEQ ID NO: 48001 - DNA, 8 bp, Unknown
  misc_feature (1)..( 8): Matrix.002 file - promoters60/1386786
attcttta

SEQ ID NO: 48002 - DNA, 8 bp, Unknown
  misc_feature (1)..( 8): Matrix.002 file - promoters60/1386786
tttacttt

SEQ ID NO: 48003 - DNA, 8 bp, Unknown
  misc_feature (1)..( 8): Matrix.002 file - promoters60/1386786
ccgagctg

SEQ ID NO: 48004 - DNA, 6 bp, Unknown
  misc_feature (1)..( 6): Matrix.002 file - promoters60/1386786
attgtt

SEQ ID NO: 48005 - DNA, 6 bp, Unknown
  misc_feature (1)..( 6): Matrix.002 file - promoters60/1386786
agtttt

SEQ ID NO: 48006 - DNA, 8 bp, Unknown
  misc_feature (1)..( 8): Matrix.002 file - promoters60/1386786
ttttaatt

SEQ ID NO: 48007 - DNA, 6 bp, Unknown
  misc_feature (1)..( 6): Matrix.002 file - promoters60/1386786
actttt

SEQ ID NO: 48008 - DNA, 9 bp, Unknown
  misc_feature (1)..( 9): Matrix.002 file - promoters60/1386786
aaacgaatt

SEQ ID NO: 48009 - DNA, 9 bp, Unknown
  misc_feature (1)..( 9): Matrix.002 file - promoters60/1386786
aatcagagc

SEQ ID NO: 48010 - DNA, 7 bp, Unknown
  misc_feature (1)..( 7): Matrix.002 file - promoters60/1386786
cggagag

SEQ ID NO: 48011 - DNA, 6 bp, Unknown
  misc_feature (1)..( 6): Matrix.002 file - promoters60/1386786
ttatct

SEQ ID NO: 48012 - DNA, 6 bp, Unknown
  misc_feature (1)..( 6): Matrix.002 file - promoters60/1386786
gattaa

SEQ ID NO: 48013 - DNA, 6 bp, Unknown
  misc_feature (1)..( 6): Matrix.002 file - promoters60/1386861
gttata

SEQ ID NO: 48014 - DNA, 7 bp, Unknown
  misc_feature (1)..( 7): Matrix.002 file - promoters60/1386861
tttgttt

SEQ ID NO: 48015 - DNA, 9 bp, Unknown
  misc_feature (1)..( 9): Matrix.002 file - promoters60/1386861
tttattttc

SEQ ID NO: 48016 - DNA, 6 bp, Unknown
  misc_feature (1)..( 6): Matrix.002 file - promoters60/1386861
tataaa

SEQ ID NO: 48017 - DNA, 7 bp, Unknown
  misc_feature (1)..( 7): Matrix.002 file - promoters60/1386861
tgaattt

SEQ ID NO: 48018 - DNA, 7 bp, Unknown
  misc_feature (1)..( 7): Matrix.002 file - promoters60/1386861
catatga

SEQ ID NO: 48019 - DNA, 7 bp, Unknown
  misc_feature (1)..( 7): Matrix.002 file - promoters60/1386861
aacctta

SEQ ID NO: 48020 - DNA, 7 bp, Unknown
  misc_feature (1)..( 7): Matrix.002 file - promoters60/1386861
attgata

SEQ ID NO: 48021 - DNA, 6 bp, Unknown
  misc_feature (1)..( 6): Matrix.002 file - promoters60/1386861
cagaaa

SEQ ID NO: 48022 - DNA, 9 bp, Unknown
  misc_feature (1)..( 9): Matrix.002 file - promoters60/1386861
tcatcggtg

SEQ ID NO: 48023 - DNA, 7 bp, Unknown
  misc_feature (1)..( 7): Matrix.002 file - promoters60/1386861
gagatct

SEQ ID NO: 48024 - DNA, 6 bp, Unknown
  misc_feature (1)..( 6): Matrix.002 file - promoters60/1386861
tttcta

SEQ ID NO: 48025 - DNA, 6 bp, Unknown
  misc_feature (1)..( 6): Matrix.002 file - promoters60/1386861
tcttta

SEQ ID NO: 48026 - DNA, 6 bp, Unknown
  misc_feature (1)..( 6): Matrix.002 file - promoters60/1386861
taaaga

SEQ ID NO: 48027 - DNA, 7 bp, Unknown
  misc_feature (1)..( 7): Matrix.002 file - promoters60/1386861
aaggata

SEQ ID NO: 48028 - DNA, 9 bp, Unknown
  misc_feature (1)..( 9): Matrix.002 file - promoters60/1387072
aaagaaaaa

SEQ ID NO: 48029 - DNA, 9 bp, Unknown
  misc_feature (1)..( 9): Matrix.002 file - promoters60/1387072
ttatttgga

SEQ ID NO: 48030 - DNA, 7 bp, Unknown
  misc_feature (1)..( 7): Matrix.002 file - promoters60/1387072
tataaat

SEQ ID NO: 48031 - DNA, 11 bp, Unknown
  misc_feature (1)..( 11): Matrix.002 file - promoters60/1387123
tgtttgaacat

SEQ ID NO: 48032 - DNA, 8 bp, Unknown
  misc_feature (1)..( 8): Matrix.002 file - promoters60/1387123
caacgaaa

SEQ ID NO: 48033 - DNA, 10 bp, Unknown
  misc_feature (1)..( 10): Matrix.002 file - promoters60/1387123
aaatcatatt

SEQ ID NO: 48034 - DNA, 9 bp, Unknown
  misc_feature (1)..( 9): Matrix.002 file - promoters60/1387123
ataagaaaa

SEQ ID NO: 48035 - DNA, 9 bp, Unknown
  misc_feature (1)..( 9): Matrix.002 file - promoters60/1387123
tcaatcata

SEQ ID NO: 48036 - DNA, 8 bp, Unknown
  misc_feature (1)..( 8): Matrix.002 file - promoters60/1387123
taatttca

SEQ ID NO: 48037 - DNA, 9 bp, Unknown
  misc_feature (1)..( 9): Matrix.002 file - promoters60/1387123
ataataaaa

SEQ ID NO: 48038 - DNA, 8 bp, Unknown
  misc_feature (1)..( 8): Matrix.002 file - promoters60/1387123
aaatatct

SEQ ID NO: 48039 - DNA, 7 bp, Unknown
  misc_feature (1)..( 7): Matrix.002 file - promoters60/1387123
tatcata

SEQ ID NO: 48040 - DNA, 8 bp, Unknown
  misc_feature (1)..( 8): Matrix.002 file - promoters60/1387123
taataaag

SEQ ID NO: 48041 - DNA, 12 bp, Unknown
  misc_feature (1)..( 12): Matrix.002 file - promoters60/1387123
ataaattaatgt

SEQ ID NO: 48042 - DNA, 6 bp, Unknown
  misc_feature (1)..( 6): Matrix.002 file - promoters60/1387191
caaaaa

SEQ ID NO: 48043 - DNA, 6 bp, Unknown
  misc_feature (1)..( 6): Matrix.002 file - promoters60/1387191
caaaaa

SEQ ID NO: 48044 - DNA, 8 bp, Unknown
  misc_feature (1)..( 8): Matrix.002 file - promoters60/1387191
tactcaaa

SEQ ID NO: 48045 - DNA, 6 bp, Unknown
  misc_feature (1)..( 6): Matrix.002 file - promoters60/1387191
tttacc

SEQ ID NO: 48046 - DNA, 6 bp, Unknown
  misc_feature (1)..( 6): Matrix.002 file - promoters60/1387191
ctcaaa

SEQ ID NO: 48047 - DNA, 7 bp, Unknown
  misc_feature (1)..( 7): Matrix.002 file - promoters60/1387191
aatctgg

SEQ ID NO: 48048 - DNA, 6 bp, Unknown
  misc_feature (1)..( 6): Matrix.002 file - promoters60/1387191
aaaatt

SEQ ID NO: 48049 - DNA, 9 bp, Unknown
  misc_feature (1)..( 9): Matrix.002 file - promoters60/1387191
ggtctaaaa

SEQ ID NO: 48050 - DNA, 6 bp, Unknown
  misc_feature (1)..( 6): Matrix.002 file - promoters60/1387191
gaaccg

SEQ ID NO: 48051 - DNA, 7 bp, Unknown
  misc_feature (1)..( 7): Matrix.002 file - promoters60/1387191
cccgatt

SEQ ID NO: 48052 - DNA, 7 bp, Unknown
  misc_feature (1)..( 7): Matrix.002 file - promoters60/1387191
ttaaaaa

SEQ ID NO: 48053 - DNA, 10 bp, Unknown
  misc_feature (1)..( 10): Matrix.002 file - promoters60/1387191
gtaaacattt

SEQ ID NO: 48054 - DNA, 8 bp, Unknown
  misc_feature (1)..( 8): Matrix.002 file - promoters60/1387191
aaggatag

SEQ ID NO: 48055 - DNA, 6 bp, Unknown
  misc_feature (1)..( 6): Matrix.002 file - promoters60/1387211
tcatct

SEQ ID NO: 48056 - DNA, 7 bp, Unknown
  misc_feature (1)..( 7): Matrix.002 file - promoters60/1387211
attttaa

SEQ ID NO: 48057 - DNA, 9 bp, Unknown
  misc_feature (1)..( 9): Matrix.002 file - promoters60/1387211
tatgtatgt

SEQ ID NO: 48058 - DNA, 7 bp, Unknown
  misc_feature (1)..( 7): Matrix.002 file - promoters60/1387211
acaaaac

SEQ ID NO: 48059 - DNA, 7 bp, Unknown
  misc_feature (1)..( 7): Matrix.002 file - promoters60/1387211
aaacagt

SEQ ID NO: 48060 - DNA, 10 bp, Unknown
  misc_feature (1)..( 10): Matrix.002 file - promoters60/1387211
gctttagata

SEQ ID NO: 48061 - DNA, 7 bp, Unknown
  misc_feature (1)..( 7): Matrix.002 file - promoters60/1387211
ctgaata

SEQ ID NO: 48062 - DNA, 6 bp, Unknown
  misc_feature (1)..( 6): Matrix.002 file - promoters60/1387211
aaaaaa

SEQ ID NO: 48063 - DNA, 7 bp, Unknown
  misc_feature (1)..( 7): Matrix.002 file - promoters60/1387211
aaaatat

SEQ ID NO: 48064 - DNA, 9 bp, Unknown
  misc_feature (1)..( 9): Matrix.002 file - promoters60/1387211
aagacaaaa

SEQ ID NO: 48065 - DNA, 9 bp, Unknown
  misc_feature (1)..( 9): Matrix.002 file - promoters60/1387211
ctctctgtt

SEQ ID NO: 48066 - DNA, 9 bp, Unknown
  misc_feature (1)..( 9): Matrix.002 file - promoters60/1387211
aattaaact

SEQ ID NO: 48067 - DNA, 7 bp, Unknown
  misc_feature (1)..( 7): Matrix.002 file - promoters60/1387211
attatat

SEQ ID NO: 48068 - DNA, 7 bp, Unknown
  misc_feature (1)..( 7): Matrix.002 file - promoters60/1387211
attttca

SEQ ID NO: 48069 - DNA, 6 bp, Unknown
  misc_feature (1)..( 6): Matrix.002 file - promoters60/1387211
tcaatt

SEQ ID NO: 48070 - DNA, 9 bp, Unknown
  misc_feature (1)..( 9): Matrix.002 file - promoters60/1387211
aaaaagaaa

SEQ ID NO: 48071 - DNA, 13 bp, Unknown
  misc_feature (1)..( 13): Matrix.002 file - promoters60/1387349
aaacaaaccaaat

SEQ ID NO: 48072 - DNA, 10 bp, Unknown
  misc_feature (1)..( 10): Matrix.002 file - promoters60/1387349
acacaaaaac

SEQ ID NO: 48073 - DNA, 9 bp, Unknown
  misc_feature (1)..( 9): Matrix.002 file - promoters60/1387349
tcaaagatt

SEQ ID NO: 48074 - DNA, 12 bp, Unknown
  misc_feature (1)..( 12): Matrix.002 file - promoters60/1387349
aagaaaatgaac

SEQ ID NO: 48075 - DNA, 6 bp, Unknown
  misc_feature (1)..( 6): Matrix.002 file - promoters60/1387356
agttta

SEQ ID NO: 48076 - DNA, 7 bp, Unknown
  misc_feature (1)..( 7): Matrix.002 file - promoters60/1387356
aaaagtt

SEQ ID NO: 48077 - DNA, 6 bp, Unknown
  misc_feature (1)..( 6): Matrix.002 file - promoters60/1387356
ttaaaa

SEQ ID NO: 48078 - DNA, 6 bp, Unknown
  misc_feature (1)..( 6): Matrix.002 file - promoters60/1387356
caaaag

SEQ ID NO: 48079 - DNA, 9 bp, Unknown
  misc_feature (1)..( 9): Matrix.002 file - promoters60/1387356
aaacatctt

SEQ ID NO: 48080 - DNA, 6 bp, Unknown
  misc_feature (1)..( 6): Matrix.002 file - promoters60/1387356
caataa

SEQ ID NO: 48081 - DNA, 6 bp, Unknown
  misc_feature (1)..( 6): Matrix.002 file - promoters60/1387356
gatttt

SEQ ID NO: 48082 - DNA, 6 bp, Unknown
  misc_feature (1)..( 6): Matrix.002 file - promoters60/1387356
acacgt

SEQ ID NO: 48083 - DNA, 11 bp, Unknown
  misc_feature (1)..( 11): Matrix.002 file - promoters60/1387356
aaagtaaaaat

SEQ ID NO: 48084 - DNA, 6 bp, Unknown
  misc_feature (1)..( 6): Matrix.002 file - promoters60/1387356
aatgta

SEQ ID NO: 48085 - DNA, 7 bp, Unknown
  misc_feature (1)..( 7): Matrix.002 file - promoters60/1387356
catttaa

SEQ ID NO: 48086 - DNA, 10 bp, Unknown
  misc_feature (1)..( 10): Matrix.002 file - promoters60/1387356
taaaaatttt

SEQ ID NO: 48087 - DNA, 6 bp, Unknown
  misc_feature (1)..( 6): Matrix.002 file - promoters60/1387356
ataatt

SEQ ID NO: 48088 - DNA, 6 bp, Unknown
  misc_feature (1)..( 6): Matrix.002 file - promoters60/1387356
atacaa

SEQ ID NO: 48089 - DNA, 6 bp, Unknown
  misc_feature (1)..( 6): Matrix.002 file - promoters60/1387356
atattt

SEQ ID NO: 48090 - DNA, 13 bp, Unknown
  misc_feature (1)..( 13): Matrix.002 file - promoters60/1387356
aaagaaagaaaga

SEQ ID NO: 48091 - DNA, 7 bp, Unknown
  misc_feature (1)..( 7): Matrix.002 file - promoters60/1387356
ttataaa

SEQ ID NO: 48092 - DNA, 8 bp, Unknown
  misc_feature (1)..( 8): Matrix.002 file - promoters60/1387417
attttctg

SEQ ID NO: 48093 - DNA, 7 bp, Unknown
  misc_feature (1)..( 7): Matrix.002 file - promoters60/1387417
ttcttat

SEQ ID NO: 48094 - DNA, 9 bp, Unknown
  misc_feature (1)..( 9): Matrix.002 file - promoters60/1387417
aatgatttc

SEQ ID NO: 48095 - DNA, 8 bp, Unknown
  misc_feature (1)..( 8): Matrix.002 file - promoters60/1387417
tgtgatcg

SEQ ID NO: 48096 - DNA, 9 bp, Unknown
  misc_feature (1)..( 9): Matrix.002 file - promoters60/1387417
ttttgctaa

SEQ ID NO: 48097 - DNA, 8 bp, Unknown
  misc_feature (1)..( 8): Matrix.002 file - promoters60/1387429
gttctatt

SEQ ID NO: 48098 - DNA, 7 bp, Unknown
  misc_feature (1)..( 7): Matrix.002 file - promoters60/1387429
cctagtt

SEQ ID NO: 48099 - DNA, 8 bp, Unknown
  misc_feature (1)..( 8): Matrix.002 file - promoters60/1387429
caaattat

SEQ ID NO: 48100 - DNA, 7 bp, Unknown
  misc_feature (1)..( 7): Matrix.002 file - promoters60/1387429
actcaat

SEQ ID NO: 48101 - DNA, 8 bp, Unknown
  misc_feature (1)..( 8): Matrix.002 file - promoters60/1387429
tgtaactt

SEQ ID NO: 48102 - DNA, 9 bp, Unknown
  misc_feature (1)..( 9): Matrix.002 file - promoters60/1387429
aatgatttg

SEQ ID NO: 48103 - DNA, 6 bp, Unknown
  misc_feature (1)..( 6): Matrix.002 file - promoters60/1387429
aaaatt

SEQ ID NO: 48104 - DNA, 10 bp, Unknown
  misc_feature (1)..( 10): Matrix.002 file - promoters60/1387429
taatattaaa

SEQ ID NO: 48105 - DNA, 8 bp, Unknown
  misc_feature (1)..( 8): Matrix.002 file - promoters60/1387429
aaaaacct

SEQ ID NO: 48106 - DNA, 7 bp, Unknown
  misc_feature (1)..( 7): Matrix.002 file - promoters60/1387429
aaattgg

SEQ ID NO: 48107 - DNA, 7 bp, Unknown
  misc_feature (1)..( 7): Matrix.002 file - promoters60/1387429
tagaaaa

SEQ ID NO: 48108 - DNA, 7 bp, Unknown
  misc_feature (1)..( 7): Matrix.002 file - promoters60/1387429
accgcca

SEQ ID NO: 48109 - DNA, 6 bp, Unknown
  misc_feature (1)..( 6): Matrix.002 file - promoters60/1387429
cataaa

SEQ ID NO: 48110 - DNA, 8 bp, Unknown
  misc_feature (1)..( 8): Matrix.002 file - promoters60/1387429
agtaagaa

SEQ ID NO: 48111 - DNA, 6 bp, Unknown
  misc_feature (1)..( 6): Matrix.002 file - promoters60/1387429
taagag

SEQ ID NO: 48112 - DNA, 7 bp, Unknown
  misc_feature (1)..( 7): Matrix.002 file - promoters60/1387429
taaattc

SEQ ID NO: 48113 - DNA, 9 bp, Unknown
  misc_feature (1)..( 9): Matrix.002 file - promoters60/1387429
cgattaaat

SEQ ID NO: 48114 - DNA, 9 bp, Unknown
  misc_feature (1)..( 9): Matrix.002 file - promoters60/1387429
aatttgcga

SEQ ID NO: 48115 - DNA, 7 bp, Unknown
  misc_feature (1)..( 7): Matrix.002 file - promoters60/1387429
tttagaa

SEQ ID NO: 48116 - DNA, 8 bp, Unknown
  misc_feature (1)..( 8): Matrix.002 file - promoters60/1387429
atttaaat

SEQ ID NO: 48117 - DNA, 12 bp, Unknown
  misc_feature (1)..( 12): Matrix.002 file - promoters60/1387429
tgaaatagttaa

SEQ ID NO: 48118 - DNA, 6 bp, Unknown
  misc_feature (1)..( 6): Matrix.002 file - promoters60/1387429
caactt

SEQ ID NO: 48119 - DNA, 7 bp, Unknown
  misc_feature (1)..( 7): Matrix.002 file - promoters60/1387429
agattgg

SEQ ID NO: 48120 - DNA, 7 bp, Unknown
  misc_feature (1)..( 7): Matrix.002 file - promoters60/1387429
ttttctt

SEQ ID NO: 48121 - DNA, 6 bp, Unknown
  misc_feature (1)..( 6): Matrix.002 file - promoters60/1387429
aatgga

SEQ ID NO: 48122 - DNA, 8 bp, Unknown
  misc_feature (1)..( 8): Matrix.002 file - promoters60/1387429
gaaattag

SEQ ID NO: 48123 - DNA, 6 bp, Unknown
  misc_feature (1)..( 6): Matrix.002 file - promoters60/1387429
aaaaat

SEQ ID NO: 48124 - DNA, 6 bp, Unknown
  misc_feature (1)..( 6): Matrix.002 file - promoters60/1387429
atttta

SEQ ID NO: 48125 - DNA, 11 bp, Unknown
  misc_feature (1)..( 11): Matrix.002 file - promoters60/1387449
tatacttttta

SEQ ID NO: 48126 - DNA, 13 bp, Unknown
  misc_feature (1)..( 13): Matrix.002 file - promoters60/1387449
taatgtttttcta

SEQ ID NO: 48127 - DNA, 6 bp, Unknown
  misc_feature (1)..( 6): Matrix.002 file - promoters60/1387524
ttgtgg

SEQ ID NO: 48128 - DNA, 14 bp, Unknown
  misc_feature (1)..( 14): Matrix.002 file - promoters60/1387524
ctttattcttctaa

SEQ ID NO: 48129 - DNA, 8 bp, Unknown
  misc_feature (1)..( 8): Matrix.002 file - promoters60/1387524
tgtgccta

SEQ ID NO: 48130 - DNA, 8 bp, Unknown
  misc_feature (1)..( 8): Matrix.002 file - promoters60/1387524
agaaaaca

SEQ ID NO: 48131 - DNA, 6 bp, Unknown
  misc_feature (1)..( 6): Matrix.002 file - promoters60/1387524
gtaaaa

SEQ ID NO: 48132 - DNA, 7 bp, Unknown
  misc_feature (1)..( 7): Matrix.002 file - promoters60/1387524
aaaaaga

SEQ ID NO: 48133 - DNA, 10 bp, Unknown
  misc_feature (1)..( 10): Matrix.002 file - promoters60/1387524
agggataaaa

SEQ ID NO: 48134 - DNA, 7 bp, Unknown
  misc_feature (1)..( 7): Matrix.002 file - promoters60/1387524
tggccct

SEQ ID NO: 48135 - DNA, 6 bp, Unknown
  misc_feature (1)..( 6): Matrix.002 file - promoters60/1387524
gtcctt

SEQ ID NO: 48136 - DNA, 8 bp, Unknown
  misc_feature (1)..( 8): Matrix.002 file - promoters60/1387524
ttatctat

SEQ ID NO: 48137 - DNA, 6 bp, Unknown
  misc_feature (1)..( 6): Matrix.002 file - promoters60/1387524
gaaccc

SEQ ID NO: 48138 - DNA, 8 bp, Unknown
  misc_feature (1)..( 8): Matrix.002 file - promoters60/1387524
gtctaaat

SEQ ID NO: 48139 - DNA, 6 bp, Unknown
  misc_feature (1)..( 6): Matrix.002 file - promoters60/1387524
agtaaa

SEQ ID NO: 48140 - DNA, 7 bp, Unknown
  misc_feature (1)..( 7): Matrix.002 file - promoters60/1387524
aatcggg

SEQ ID NO: 48141 - DNA, 8 bp, Unknown
  misc_feature (1)..( 8): Matrix.002 file - promoters60/1387524
gaaacaaa

SEQ ID NO: 48142 - DNA, 10 bp, Unknown
  misc_feature (1)..( 10): Matrix.002 file - promoters60/1387524
ggaaaagaaa

SEQ ID NO: 48143 - DNA, 7 bp, Unknown
  misc_feature (1)..( 7): Matrix.002 file - promoters60/1387524
cccacta

SEQ ID NO: 48144 - DNA, 9 bp, Unknown
  misc_feature (1)..( 9): Matrix.002 file - promoters60/1387524
aaagaaaag

SEQ ID NO: 48145 - DNA, 7 bp, Unknown
  misc_feature (1)..( 7): Matrix.002 file - promoters60/1387524
gtatata

SEQ ID NO: 48146 - DNA, 9 bp, Unknown
  misc_feature (1)..( 9): Matrix.002 file - promoters60/1387601
ggtttgatg

SEQ ID NO: 48147 - DNA, 11 bp, Unknown
  misc_feature (1)..( 11): Matrix.002 file - promoters60/1387601
tccaaacagag

SEQ ID NO: 48148 - DNA, 8 bp, Unknown
  misc_feature (1)..( 8): Matrix.002 file - promoters60/1387616
aaaaataa

SEQ ID NO: 48149 - DNA, 7 bp, Unknown
  misc_feature (1)..( 7): Matrix.002 file - promoters60/1387616
aataaat

SEQ ID NO: 48150 - DNA, 10 bp, Unknown
  misc_feature (1)..( 10): Matrix.002 file - promoters60/1387616
atattattaa

SEQ ID NO: 48151 - DNA, 9 bp, Unknown
  misc_feature (1)..( 9): Matrix.002 file - promoters60/1387616
aataaaaaa

SEQ ID NO: 48152 - DNA, 10 bp, Unknown
  misc_feature (1)..( 10): Matrix.002 file - promoters60/1387616
taaaattaaa

SEQ ID NO: 48153 - DNA, 9 bp, Unknown
  misc_feature (1)..( 9): Matrix.002 file - promoters60/1387616
aaataaata

SEQ ID NO: 48154 - DNA, 12 bp, Unknown
  misc_feature (1)..( 12): Matrix.002 file - promoters60/1387616
gtataaacaaat

SEQ ID NO: 48155 - DNA, 8 bp, Unknown
  misc_feature (1)..( 8): Matrix.002 file - promoters60/1387616
aaaatata

SEQ ID NO: 48156 - DNA, 12 bp, Unknown
  misc_feature (1)..( 12): Matrix.002 file - promoters60/1387616
taatctatatat

SEQ ID NO: 48157 - DNA, 8 bp, Unknown
  misc_feature (1)..( 8): Matrix.002 file - promoters60/1387649
gctaggtt

SEQ ID NO: 48158 - DNA, 7 bp, Unknown
  misc_feature (1)..( 7): Matrix.002 file - promoters60/1387649
ttaaatt

SEQ ID NO: 48159 - DNA, 6 bp, Unknown
  misc_feature (1)..( 6): Matrix.002 file - promoters60/1387649
aaaatg

SEQ ID NO: 48160 - DNA, 7 bp, Unknown
  misc_feature (1)..( 7): Matrix.002 file - promoters60/1387649
aaaggtt

SEQ ID NO: 48161 - DNA, 6 bp, Unknown
  misc_feature (1)..( 6): Matrix.002 file - promoters60/1387649
taataa

SEQ ID NO: 48162 - DNA, 6 bp, Unknown
  misc_feature (1)..( 6): Matrix.002 file - promoters60/1387649
tgtcaa

SEQ ID NO: 48163 - DNA, 6 bp, Unknown
  misc_feature (1)..( 6): Matrix.002 file - promoters60/1387649
tcaatt

SEQ ID NO: 48164 - DNA, 7 bp, Unknown
  misc_feature (1)..( 7): Matrix.002 file - promoters60/1387649
taccata

SEQ ID NO: 48165 - DNA, 7 bp, Unknown
  misc_feature (1)..( 7): Matrix.002 file - promoters60/1387649
caaccac

SEQ ID NO: 48166 - DNA, 6 bp, Unknown
  misc_feature (1)..( 6): Matrix.002 file - promoters60/1387649
ggctga

SEQ ID NO: 48167 - DNA, 11 bp, Unknown
  misc_feature (1)..( 11): Matrix.002 file - promoters60/1387649
agggtctcaga

SEQ ID NO: 48168 - DNA, 6 bp, Unknown
  misc_feature (1)..( 6): Matrix.002 file - promoters60/1387649
agattt

SEQ ID NO: 48169 - DNA, 8 bp, Unknown
  misc_feature (1)..( 8): Matrix.002 file - promoters60/1387671
tatatata

SEQ ID NO: 48170 - DNA, 8 bp, Unknown
  misc_feature (1)..( 8): Matrix.002 file - promoters60/1387671
aatacatt

SEQ ID NO: 48171 - DNA, 6 bp, Unknown
  misc_feature (1)..( 6): Matrix.002 file - promoters60/1387793
ttttac

SEQ ID NO: 48172 - DNA, 6 bp, Unknown
  misc_feature (1)..( 6): Matrix.002 file - promoters60/1387793
aaaacc

SEQ ID NO: 48173 - DNA, 8 bp, Unknown
  misc_feature (1)..( 8): Matrix.002 file - promoters60/1387793
aaaaaaca

SEQ ID NO: 48174 - DNA, 8 bp, Unknown
  misc_feature (1)..( 8): Matrix.002 file - promoters60/1387793
caaaaaaa

SEQ ID NO: 48175 - DNA, 7 bp, Unknown
  misc_feature (1)..( 7): Matrix.002 file - promoters60/1387793
taaattt

SEQ ID NO: 48176 - DNA, 7 bp, Unknown
  misc_feature (1)..( 7): Matrix.002 file - promoters60/1387793
ttttgtt

SEQ ID NO: 48177 - DNA, 7 bp, Unknown
  misc_feature (1)..( 7): Matrix.002 file - promoters60/1387793
ttaaaat

SEQ ID NO: 48178 - DNA, 8 bp, Unknown
  misc_feature (1)..( 8): Matrix.002 file - promoters60/1387793
atataatt

SEQ ID NO: 48179 - DNA, 6 bp, Unknown
  misc_feature (1)..( 6): Matrix.002 file - promoters60/1387793
gaaaaa

SEQ ID NO: 48180 - DNA, 7 bp, Unknown
  misc_feature (1)..( 7): Matrix.002 file - promoters60/1387793
aaaatat

SEQ ID NO: 48181 - DNA, 6 bp, Unknown
  misc_feature (1)..( 6): Matrix.002 file - promoters60/1387793
aaaact

SEQ ID NO: 48182 - DNA, 11 bp, Unknown
  misc_feature (1)..( 11): Matrix.002 file - promoters60/1387793
ctttaaaaaaa

SEQ ID NO: 48183 - DNA, 7 bp, Unknown
  misc_feature (1)..( 7): Matrix.002 file - promoters60/1387793
aaaaatt

SEQ ID NO: 48184 - DNA, 6 bp, Unknown
  misc_feature (1)..( 6): Matrix.002 file - promoters60/1387793
gtgtac

SEQ ID NO: 48185 - DNA, 10 bp, Unknown
  misc_feature (1)..( 10): Matrix.002 file - promoters60/1387793
aaccgtcgga

SEQ ID NO: 48186 - DNA, 9 bp, Unknown
  misc_feature (1)..( 9): Matrix.002 file - promoters60/1387793
aaaagggca

SEQ ID NO: 48187 - DNA, 6 bp, Unknown
  misc_feature (1)..( 6): Matrix.002 file - promoters60/1387793
ttaaaa

SEQ ID NO: 48188 - DNA, 8 bp, Unknown
  misc_feature (1)..( 8): Matrix.002 file - promoters60/1387818
aacaaaaa

SEQ ID NO: 48189 - DNA, 9 bp, Unknown
  misc_feature (1)..( 9): Matrix.002 file - promoters60/1387818
tcaaagaaa

SEQ ID NO: 48190 - DNA, 9 bp, Unknown
  misc_feature (1)..( 9): Matrix.002 file - promoters60/1387818
actaaaaat

SEQ ID NO: 48191 - DNA, 8 bp, Unknown
  misc_feature (1)..( 8): Matrix.002 file - promoters60/1387818
aaagtttc

SEQ ID NO: 48192 - DNA, 7 bp, Unknown
  misc_feature (1)..( 7): Matrix.002 file - promoters60/1387818
gaagaat

SEQ ID NO: 48193 - DNA, 12 bp, Unknown
  misc_feature (1)..( 12): Matrix.002 file - promoters60/1387818
tttagtaaaatg

SEQ ID NO: 48194 - DNA, 10 bp, Unknown
  misc_feature (1)..( 10): Matrix.002 file - promoters60/1387906
tttgaaggtt

SEQ ID NO: 48195 - DNA, 7 bp, Unknown
  misc_feature (1)..( 7): Matrix.002 file - promoters60/1387906
gaaaata

SEQ ID NO: 48196 - DNA, 11 bp, Unknown
  misc_feature (1)..( 11): Matrix.002 file - promoters60/1387906
ttttaataaca

SEQ ID NO: 48197 - DNA, 10 bp, Unknown
  misc_feature (1)..( 10): Matrix.002 file - promoters60/1387906
aaaatctgtt

SEQ ID NO: 48198 - DNA, 10 bp, Unknown
  misc_feature (1)..( 10): Matrix.002 file - promoters60/1387906
actttataat

SEQ ID NO: 48199 - DNA, 10 bp, Unknown
  misc_feature (1)..( 10): Matrix.002 file - promoters60/1387947
ttttggaaga

SEQ ID NO: 48200 - DNA, 7 bp, Unknown
  misc_feature (1)..( 7): Matrix.002 file - promoters60/1387947
tgtagaa

SEQ ID NO: 48201 - DNA, 6 bp, Unknown
  misc_feature (1)..( 6): Matrix.002 file - promoters60/1387947
acaatt

SEQ ID NO: 48202 - DNA, 7 bp, Unknown
  misc_feature (1)..( 7): Matrix.002 file - promoters60/1387947
attttaa

SEQ ID NO: 48203 - DNA, 7 bp, Unknown
  misc_feature (1)..( 7): Matrix.002 file - promoters60/1387947
attaact

SEQ ID NO: 48204 - DNA, 8 bp, Unknown
  misc_feature (1)..( 8): Matrix.002 file - promoters60/1387947
tgggtcta

SEQ ID NO: 48205 - DNA, 6 bp, Unknown
  misc_feature (1)..( 6): Matrix.002 file - promoters60/1387947
aaaact

SEQ ID NO: 48206 - DNA, 6 bp, Unknown
  misc_feature (1)..( 6): Matrix.002 file - promoters60/1387947
gaaaaa

SEQ ID NO: 48207 - DNA, 7 bp, Unknown
  misc_feature (1)..( 7): Matrix.002 file - promoters60/1387947
aaaagaa

SEQ ID NO: 48208 - DNA, 9 bp, Unknown
  misc_feature (1)..( 9): Matrix.002 file - promoters60/1387947
agacagaaa

SEQ ID NO: 48209 - DNA, 7 bp, Unknown
  misc_feature (1)..( 7): Matrix.002 file - promoters60/1387947
gaaagaa

SEQ ID NO: 48210 - DNA, 8 bp, Unknown
  misc_feature (1)..( 8): Matrix.002 file - promoters60/1387947
gttactta

SEQ ID NO: 48211 - DNA, 6 bp, Unknown
  misc_feature (1)..( 6): Matrix.002 file - promoters60/1387947
accatt

SEQ ID NO: 48212 - DNA, 7 bp, Unknown
  misc_feature (1)..( 7): Matrix.002 file - promoters60/1387947
agaagtt

SEQ ID NO: 48213 - DNA, 7 bp, Unknown
  misc_feature (1)..( 7): Matrix.002 file - promoters60/1387947
aatatta

SEQ ID NO: 48214 - DNA, 7 bp, Unknown
  misc_feature (1)..( 7): Matrix.002 file - promoters60/1387947
aaaaaaa

SEQ ID NO: 48215 - DNA, 8 bp, Unknown
  misc_feature (1)..( 8): Matrix.002 file - promoters60/1387947
aaacgtta

SEQ ID NO: 48216 - DNA, 6 bp, Unknown
  misc_feature (1)..( 6): Matrix.002 file - promoters60/1387947
taaacg

SEQ ID NO: 48217 - DNA, 11 bp, Unknown
  misc_feature (1)..( 11): Matrix.002 file - promoters60/1388009
tattaaaatat

SEQ ID NO: 48218 - DNA, 7 bp, Unknown
  misc_feature (1)..( 7): Matrix.002 file - promoters60/1388009
atatttt

SEQ ID NO: 48219 - DNA, 7 bp, Unknown
  misc_feature (1)..( 7): Matrix.002 file - promoters60/1388009
attttac

SEQ ID NO: 48220 - DNA, 8 bp, Unknown
  misc_feature (1)..( 8): Matrix.002 file - promoters60/1388009
cttctgtt

SEQ ID NO: 48221 - DNA, 10 bp, Unknown
  misc_feature (1)..( 10): Matrix.002 file - promoters60/1388009
cgaaatcata

SEQ ID NO: 48222 - DNA, 6 bp, Unknown
  misc_feature (1)..( 6): Matrix.002 file - promoters60/1388009
gtaaca

SEQ ID NO: 48223 - DNA, 7 bp, Unknown
  misc_feature (1)..( 7): Matrix.002 file - promoters60/1388009
ctatatg

SEQ ID NO: 48224 - DNA, 9 bp, Unknown
  misc_feature (1)..( 9): Matrix.002 file - promoters60/1388009
aaattataa

SEQ ID NO: 48225 - DNA, 6 bp, Unknown
  misc_feature (1)..( 6): Matrix.002 file - promoters60/1388009
gtatat

SEQ ID NO: 48226 - DNA, 8 bp, Unknown
  misc_feature (1)..( 8): Matrix.002 file - promoters60/1388009
attttact

SEQ ID NO: 48227 - DNA, 8 bp, Unknown
  misc_feature (1)..( 8): Matrix.002 file - promoters60/1388009
tgctaacc

SEQ ID NO: 48228 - DNA, 7 bp, Unknown
  misc_feature (1)..( 7): Matrix.002 file - promoters60/1388009
ttactaa

SEQ ID NO: 48229 - DNA, 8 bp, Unknown
  misc_feature (1)..( 8): Matrix.002 file - promoters60/1388009
taatttta

SEQ ID NO: 48230 - DNA, 8 bp, Unknown
  misc_feature (1)..( 8): Matrix.002 file - promoters60/1388009
agtcggtc

SEQ ID NO: 48231 - DNA, 6 bp, Unknown
  misc_feature (1)..( 6): Matrix.002 file - promoters60/1388009
gaattc

SEQ ID NO: 48232 - DNA, 6 bp, Unknown
  misc_feature (1)..( 6): Matrix.002 file - promoters60/1388009
atattt

SEQ ID NO: 48233 - DNA, 6 bp, Unknown
  misc_feature (1)..( 6): Matrix.002 file - promoters60/1388009
taatat

SEQ ID NO: 48234 - DNA, 6 bp, Unknown
  misc_feature (1)..( 6): Matrix.002 file - promoters60/1388069
tattgt

SEQ ID NO: 48235 - DNA, 7 bp, Unknown
  misc_feature (1)..( 7): Matrix.002 file - promoters60/1388069
aaactta

SEQ ID NO: 48236 - DNA, 6 bp, Unknown
  misc_feature (1)..( 6): Matrix.002 file - promoters60/1388069
tagaaa

SEQ ID NO: 48237 - DNA, 10 bp, Unknown
  misc_feature (1)..( 10): Matrix.002 file - promoters60/1388069
caattaaaaa

SEQ ID NO: 48238 - DNA, 8 bp, Unknown
  misc_feature (1)..( 8): Matrix.002 file - promoters60/1388069
tttataat

SEQ ID NO: 48239 - DNA, 6 bp, Unknown
  misc_feature (1)..( 6): Matrix.002 file - promoters60/1388069
agatat

SEQ ID NO: 48240 - DNA, 6 bp, Unknown
  misc_feature (1)..( 6): Matrix.002 file - promoters60/1388069
aaagat

SEQ ID NO: 48241 - DNA, 6 bp, Unknown
  misc_feature (1)..( 6): Matrix.002 file - promoters60/1388069
tctaag

SEQ ID NO: 48242 - DNA, 6 bp, Unknown
  misc_feature (1)..( 6): Matrix.002 file - promoters60/1388069
aaaaat

SEQ ID NO: 48243 - DNA, 7 bp, Unknown
  misc_feature (1)..( 7): Matrix.002 file - promoters60/1388069
tttgaag

SEQ ID NO: 48244 - DNA, 8 bp, Unknown
  misc_feature (1)..( 8): Matrix.002 file - promoters60/1388069
aaaccaac

SEQ ID NO: 48245 - DNA, 7 bp, Unknown
  misc_feature (1)..( 7): Matrix.002 file - promoters60/1388069
cttcaag

SEQ ID NO: 48246 - DNA, 8 bp, Unknown
  misc_feature (1)..( 8): Matrix.002 file - promoters60/1388069
atcttcct

SEQ ID NO: 48247 - DNA, 8 bp, Unknown
  misc_feature (1)..( 8): Matrix.002 file - promoters60/1388545
aaagaaaa

SEQ ID NO: 48248 - DNA, 15 bp, Unknown
  misc_feature (1)..( 15): Matrix.002 file - promoters60/1388793
aacaaaaaaagttta

SEQ ID NO: 48249 - DNA, 15 bp, Unknown
  misc_feature (1)..( 15): Matrix.002 file - promoters60/1388793
atcactgatccaaca

SEQ ID NO: 48250 - DNA, 7 bp, Unknown
  misc_feature (1)..( 7): Matrix.002 file - promoters60/1388793
aattatc

SEQ ID NO: 48251 - DNA, 7 bp, Unknown
  misc_feature (1)..( 7): Matrix.002 file - promoters60/1388808
attttaa

SEQ ID NO: 48252 - DNA, 7 bp, Unknown
  misc_feature (1)..( 7): Matrix.002 file - promoters60/1388808
aatattg

SEQ ID NO: 48253 - DNA, 7 bp, Unknown
  misc_feature (1)..( 7): Matrix.002 file - promoters60/1388808
atcctac

SEQ ID NO: 48254 - DNA, 6 bp, Unknown
  misc_feature (1)..( 6): Matrix.002 file - promoters60/1388808
tttttt

SEQ ID NO: 48255 - DNA, 6 bp, Unknown
  misc_feature (1)..( 6): Matrix.002 file - promoters60/1388808
attttg

SEQ ID NO: 48256 - DNA, 6 bp, Unknown
  misc_feature (1)..( 6): Matrix.002 file - promoters60/1388808
atttgt

SEQ ID NO: 48257 - DNA, 7 bp, Unknown
  misc_feature (1)..( 7): Matrix.002 file - promoters60/1388808
atgattt

SEQ ID NO: 48258 - DNA, 7 bp, Unknown
  misc_feature (1)..( 7): Matrix.002 file - promoters60/1388808
tgttttg

SEQ ID NO: 48259 - DNA, 6 bp, Unknown
  misc_feature (1)..( 6): Matrix.002 file - promoters60/1388808
aaaatt

SEQ ID NO: 48260 - DNA, 6 bp, Unknown
  misc_feature (1)..( 6): Matrix.002 file - promoters60/1388808
tctcaa

SEQ ID NO: 48261 - DNA, 6 bp, Unknown
  misc_feature (1)..( 6): Matrix.002 file - promoters60/1388808
tagttt

SEQ ID NO: 48262 - DNA, 6 bp, Unknown
  misc_feature (1)..( 6): Matrix.002 file - promoters60/1388808
gtggat

SEQ ID NO: 48263 - DNA, 6 bp, Unknown
  misc_feature (1)..( 6): Matrix.002 file - promoters60/1388808
tttgca

SEQ ID NO: 48264 - DNA, 7 bp, Unknown
  misc_feature (1)..( 7): Matrix.002 file - promoters60/1388808
aaaagag

SEQ ID NO: 48265 - DNA, 6 bp, Unknown
  misc_feature (1)..( 6): Matrix.002 file - promoters60/1388808
aaaata

SEQ ID NO: 48266 - DNA, 8 bp, Unknown
  misc_feature (1)..( 8): Matrix.002 file - promoters60/1388808
ttagagat

SEQ ID NO: 48267 - DNA, 7 bp, Unknown
  misc_feature (1)..( 7): Matrix.002 file - promoters60/1388808
tttataa

SEQ ID NO: 48268 - DNA, 7 bp, Unknown
  misc_feature (1)..( 7): Matrix.002 file - promoters60/1388808
aacagtc

SEQ ID NO: 48269 - DNA, 7 bp, Unknown
  misc_feature (1)..( 7): Matrix.002 file - promoters60/1388808
ttaaaaa

SEQ ID NO: 48270 - DNA, 8 bp, Unknown
  misc_feature (1)..( 8): Matrix.002 file - promoters60/1388808
tcaaaaaa

SEQ ID NO: 48271 - DNA, 7 bp, Unknown
  misc_feature (1)..( 7): Matrix.002 file - promoters60/1388808
agtgcgg

SEQ ID NO: 48272 - DNA, 7 bp, Unknown
  misc_feature (1)..( 7): Matrix.002 file - promoters60/1388864
gttagaa

SEQ ID NO: 48273 - DNA, 7 bp, Unknown
  misc_feature (1)..( 7): Matrix.002 file - promoters60/1388864
aaattaa

SEQ ID NO: 48274 - DNA, 7 bp, Unknown
  misc_feature (1)..( 7): Matrix.002 file - promoters60/1388864
ctcagaa

SEQ ID NO: 48275 - DNA, 8 bp, Unknown
  misc_feature (1)..( 8): Matrix.002 file - promoters60/1388864
ttgaaaga

SEQ ID NO: 48276 - DNA, 8 bp, Unknown
  misc_feature (1)..( 8): Matrix.002 file - promoters60/1388864
agaaaaga

SEQ ID NO: 48277 - DNA, 7 bp, Unknown
  misc_feature (1)..( 7): Matrix.002 file - promoters60/1388864
aagaaac

SEQ ID NO: 48278 - DNA, 8 bp, Unknown
  misc_feature (1)..( 8): Matrix.002 file - promoters60/1388864
gaaaaagt

SEQ ID NO: 48279 - DNA, 6 bp, Unknown
  misc_feature (1)..( 6): Matrix.002 file - promoters60/1388864
gttgtg

SEQ ID NO: 48280 - DNA, 9 bp, Unknown
  misc_feature (1)..( 9): Matrix.002 file - promoters60/1388864
gatcaggaa

SEQ ID NO: 48281 - DNA, 8 bp, Unknown
  misc_feature (1)..( 8): Matrix.002 file - promoters60/1388864
atttggac

SEQ ID NO: 48282 - DNA, 11 bp, Unknown
  misc_feature (1)..( 11): Matrix.002 file - promoters60/1388872
ataacattttt

SEQ ID NO: 48283 - DNA, 8 bp, Unknown
  misc_feature (1)..( 8): Matrix.002 file - promoters60/1388872
aaaatatt

SEQ ID NO: 48284 - DNA, 9 bp, Unknown
  misc_feature (1)..( 9): Matrix.002 file - promoters60/1388872
ataacatta

SEQ ID NO: 48285 - DNA, 9 bp, Unknown
  misc_feature (1)..( 9): Matrix.002 file - promoters60/1388872
aatttggct

SEQ ID NO: 48286 - DNA, 7 bp, Unknown
  misc_feature (1)..( 7): Matrix.002 file - promoters60/1388872
aattttt

SEQ ID NO: 48287 - DNA, 8 bp, Unknown
  misc_feature (1)..( 8): Matrix.002 file - promoters60/1388872
gttattgt

SEQ ID NO: 48288 - DNA, 7 bp, Unknown
  misc_feature (1)..( 7): Matrix.002 file - promoters60/1388872
ataaaat

SEQ ID NO: 48289 - DNA, 9 bp, Unknown
  misc_feature (1)..( 9): Matrix.002 file - promoters60/1388872
caaatcttc

SEQ ID NO: 48290 - DNA, 9 bp, Unknown
  misc_feature (1)..( 9): Matrix.002 file - promoters60/1388872
tttattcag

SEQ ID NO: 48291 - DNA, 12 bp, Unknown
  misc_feature (1)..( 12): Matrix.002 file - promoters60/1388973
ttataaaaaatc

SEQ ID NO: 48292 - DNA, 12 bp, Unknown
  misc_feature (1)..( 12): Matrix.002 file - promoters60/1389243
tcatttaatata

SEQ ID NO: 48293 - DNA, 6 bp, Unknown
  misc_feature (1)..( 6): Matrix.002 file - promoters60/1389279
tctttt

SEQ ID NO: 48294 - DNA, 12 bp, Unknown
  misc_feature (1)..( 12): Matrix.002 file - promoters60/1389279
ttttcttacttt

SEQ ID NO: 48295 - DNA, 7 bp, Unknown
  misc_feature (1)..( 7): Matrix.002 file - promoters60/1389279
tggcata

SEQ ID NO: 48296 - DNA, 7 bp, Unknown
  misc_feature (1)..( 7): Matrix.002 file - promoters60/1389279
aattttg

SEQ ID NO: 48297 - DNA, 7 bp, Unknown
  misc_feature (1)..( 7): Matrix.002 file - promoters60/1389279
caatgtt

SEQ ID NO: 48298 - DNA, 8 bp, Unknown
  misc_feature (1)..( 8): Matrix.002 file - promoters60/1389279
agaaaaaa

SEQ ID NO: 48299 - DNA, 7 bp, Unknown
  misc_feature (1)..( 7): Matrix.002 file - promoters60/1389279
acaaaaa

SEQ ID NO: 48300 - DNA, 8 bp, Unknown
  misc_feature (1)..( 8): Matrix.002 file - promoters60/1389279
tatatata

SEQ ID NO: 48301 - DNA, 6 bp, Unknown
  misc_feature (1)..( 6): Matrix.002 file - promoters60/1389279
aaagaa

SEQ ID NO: 48302 - DNA, 9 bp, Unknown
  misc_feature (1)..( 9): Matrix.002 file - promoters60/1389279
atgttccag

SEQ ID NO: 48303 - DNA, 6 bp, Unknown
  misc_feature (1)..( 6): Matrix.002 file - promoters60/1389279
acaaga

SEQ ID NO: 48304 - DNA, 9 bp, Unknown
  misc_feature (1)..( 9): Matrix.002 file - promoters60/1389279
aaaacaagt

SEQ ID NO: 48305 - DNA, 6 bp, Unknown
  misc_feature (1)..( 6): Matrix.002 file - promoters60/1389279
aaaaaa

SEQ ID NO: 48306 - DNA, 6 bp, Unknown
  misc_feature (1)..( 6): Matrix.002 file - promoters60/1389279
aacaat

SEQ ID NO: 48307 - DNA, 8 bp, Unknown
  misc_feature (1)..( 8): Matrix.002 file - promoters60/1389330
taaaaaaa

SEQ ID NO: 48308 - DNA, 7 bp, Unknown
  misc_feature (1)..( 7): Matrix.002 file - promoters60/1389330
ataatct

SEQ ID NO: 48309 - DNA, 8 bp, Unknown
  misc_feature (1)..( 8): Matrix.002 file - promoters60/1389330
aaatattt

SEQ ID NO: 48310 - DNA, 6 bp, Unknown
  misc_feature (1)..( 6): Matrix.002 file - promoters60/1389330
tttaaa

SEQ ID NO: 48311 - DNA, 7 bp, Unknown
  misc_feature (1)..( 7): Matrix.002 file - promoters60/1389330
tgtaatg

SEQ ID NO: 48312 - DNA, 6 bp, Unknown
  misc_feature (1)..( 6): Matrix.002 file - promoters60/1389330
ccaaaa

SEQ ID NO: 48313 - DNA, 8 bp, Unknown
  misc_feature (1)..( 8): Matrix.002 file - promoters60/1389330
aaaatgaa

SEQ ID NO: 48314 - DNA, 10 bp, Unknown
  misc_feature (1)..( 10): Matrix.002 file - promoters60/1389330
acatatctca

SEQ ID NO: 48315 - DNA, 7 bp, Unknown
  misc_feature (1)..( 7): Matrix.002 file - promoters60/1389330
gaaaaat

SEQ ID NO: 48316 - DNA, 7 bp, Unknown
  misc_feature (1)..( 7): Matrix.002 file - promoters60/1389330
ttgacaa

SEQ ID NO: 48317 - DNA, 8 bp, Unknown
  misc_feature (1)..( 8): Matrix.002 file - promoters60/1389330
aacaataa

SEQ ID NO: 48318 - DNA, 10 bp, Unknown
  misc_feature (1)..( 10): Matrix.002 file - promoters60/1389330
gtaacaataa

SEQ ID NO: 48319 - DNA, 7 bp, Unknown
  misc_feature (1)..( 7): Matrix.002 file - promoters60/1389330
aaaatca

SEQ ID NO: 48320 - DNA, 7 bp, Unknown
  misc_feature (1)..( 7): Matrix.002 file - promoters60/1389330
ctcaaaa

SEQ ID NO: 48321 - DNA, 7 bp, Unknown
  misc_feature (1)..( 7): Matrix.002 file - promoters60/1389330
gacaaga

SEQ ID NO: 48322 - DNA, 8 bp, Unknown
  misc_feature (1)..( 8): Matrix.002 file - promoters60/1389330
tttattag

SEQ ID NO: 48323 - DNA, 10 bp, Unknown
  misc_feature (1)..( 10): Matrix.002 file - promoters60/1389330
ttttcttatt

SEQ ID NO: 48324 - DNA, 7 bp, Unknown
  misc_feature (1)..( 7): Matrix.002 file - promoters60/1389330
attaaat

SEQ ID NO: 48325 - DNA, 7 bp, Unknown
  misc_feature (1)..( 7): Matrix.002 file - promoters60/1389330
aaaaata

SEQ ID NO: 48326 - DNA, 6 bp, Unknown
  misc_feature (1)..( 6): Matrix.002 file - promoters60/1389330
caaaaa

SEQ ID NO: 48327 - DNA, 6 bp, Unknown
  misc_feature (1)..( 6): Matrix.002 file - promoters60/1389330
tagata

SEQ ID NO: 48328 - DNA, 7 bp, Unknown
  misc_feature (1)..( 7): Matrix.002 file - promoters60/1389330
aataaga

SEQ ID NO: 48329 - DNA, 10 bp, Unknown
  misc_feature (1)..( 10): Matrix.002 file - promoters60/1389330
ttaggcccat

SEQ ID NO: 48330 - DNA, 6 bp, Unknown
  misc_feature (1)..( 6): Matrix.002 file - promoters60/1389330
ggccca

SEQ ID NO: 48331 - DNA, 6 bp, Unknown
  misc_feature (1)..( 6): Matrix.002 file - promoters60/1389330
tctcat

SEQ ID NO: 48332 - DNA, 8 bp, Unknown
  misc_feature (1)..( 8): Matrix.002 file - promoters60/1389330
ttgtaacc

SEQ ID NO: 48333 - DNA, 9 bp, Unknown
  misc_feature (1)..( 9): Matrix.002 file - promoters60/1389330
tgtaacaaa

SEQ ID NO: 48334 - DNA, 6 bp, Unknown
  misc_feature (1)..( 6): Matrix.002 file - promoters60/1389330
tatttt

SEQ ID NO: 48335 - DNA, 7 bp, Unknown
  misc_feature (1)..( 7): Matrix.002 file - promoters60/1389330
aagatat

SEQ ID NO: 48336 - DNA, 6 bp, Unknown
  misc_feature (1)..( 6): Matrix.002 file - promoters60/1389330
catcat

SEQ ID NO: 48337 - DNA, 11 bp, Unknown
  misc_feature (1)..( 11): Matrix.002 file - promoters60/1390240
caaaaaaagtt

SEQ ID NO: 48338 - DNA, 7 bp, Unknown
  misc_feature (1)..( 7): Matrix.002 file - promoters60/1390376
ttccctt

SEQ ID NO: 48339 - DNA, 6 bp, Unknown
  misc_feature (1)..( 6): Matrix.002 file - promoters60/1390376
ctttct

SEQ ID NO: 48340 - DNA, 6 bp, Unknown
  misc_feature (1)..( 6): Matrix.002 file - promoters60/1390376
ttctct

SEQ ID NO: 48341 - DNA, 6 bp, Unknown
  misc_feature (1)..( 6): Matrix.002 file - promoters60/1390376
ttctat

SEQ ID NO: 48342 - DNA, 7 bp, Unknown
  misc_feature (1)..( 7): Matrix.002 file - promoters60/1390376
tatctat

SEQ ID NO: 48343 - DNA, 7 bp, Unknown
  misc_feature (1)..( 7): Matrix.002 file - promoters60/1390376
atagtgt

SEQ ID NO: 48344 - DNA, 6 bp, Unknown
  misc_feature (1)..( 6): Matrix.002 file - promoters60/1390376
aacttg

SEQ ID NO: 48345 - DNA, 6 bp, Unknown
  misc_feature (1)..( 6): Matrix.002 file - promoters60/1390376
tcatat

SEQ ID NO: 48346 - DNA, 7 bp, Unknown
  misc_feature (1)..( 7): Matrix.002 file - promoters60/1390376
ttacgta

SEQ ID NO: 48347 - DNA, 7 bp, Unknown
  misc_feature (1)..( 7): Matrix.002 file - promoters60/1390376
ctgatta

SEQ ID NO: 48348 - DNA, 6 bp, Unknown
  misc_feature (1)..( 6): Matrix.002 file - promoters60/1390376
atcatt

SEQ ID NO: 48349 - DNA, 11 bp, Unknown
  misc_feature (1)..( 11): Matrix.002 file - promoters60/1390376
ttactgaagtt

SEQ ID NO: 48350 - DNA, 7 bp, Unknown
  misc_feature (1)..( 7): Matrix.002 file - promoters60/1390376
tttccat

SEQ ID NO: 48351 - DNA, 8 bp, Unknown
  misc_feature (1)..( 8): Matrix.002 file - promoters60/1390376
atctcgtg

SEQ ID NO: 48352 - DNA, 6 bp, Unknown
  misc_feature (1)..( 6): Matrix.002 file - promoters60/1391420
aagaaa

SEQ ID NO: 48353 - DNA, 10 bp, Unknown
  misc_feature (1)..( 10): Matrix.002 file - promoters60/1391420
aagaaagatt

SEQ ID NO: 48354 - DNA, 13 bp, Unknown
  misc_feature (1)..( 13): Matrix.002 file - promoters60/1391420
attgggcttgact

SEQ ID NO: 48355 - DNA, 8 bp, Unknown
  misc_feature (1)..( 8): Matrix.002 file - promoters60/1391420
aatgggct

SEQ ID NO: 48356 - DNA, 9 bp, Unknown
  misc_feature (1)..( 9): Matrix.002 file - promoters60/1391420
agaagaaag

SEQ ID NO: 48357 - DNA, 5 bp, Unknown
  misc_feature (1)..( 5): Matrix.002 file - promoters60/1391420
gtaaa

SEQ ID NO: 48358 - DNA, 7 bp, Unknown
  misc_feature (1)..( 7): Matrix.002 file - promoters60/1393104
ttaccct

SEQ ID NO: 48359 - DNA, 6 bp, Unknown
  misc_feature (1)..( 6): Matrix.002 file - promoters60/1393104
taaccg

SEQ ID NO: 48360 - DNA, 6 bp, Unknown
  misc_feature (1)..( 6): Matrix.002 file - promoters60/1393104
gttaaa

SEQ ID NO: 48361 - DNA, 7 bp, Unknown
  misc_feature (1)..( 7): Matrix.002 file - promoters60/1393104
caaagtc

SEQ ID NO: 48362 - DNA, 8 bp, Unknown
  misc_feature (1)..( 8): Matrix.002 file - promoters60/1393104
atatcttc

SEQ ID NO: 48363 - DNA, 6 bp, Unknown
  misc_feature (1)..( 6): Matrix.002 file - promoters60/1393104
gagata

SEQ ID NO: 48364 - DNA, 7 bp, Unknown
  misc_feature (1)..( 7): Matrix.002 file - promoters60/1393104
atgtgga

SEQ ID NO: 48365 - DNA, 7 bp, Unknown
  misc_feature (1)..( 7): Matrix.002 file - promoters60/1393104
agcaaat

SEQ ID NO: 48366 - DNA, 6 bp, Unknown
  misc_feature (1)..( 6): Matrix.002 file - promoters60/1393104
aatgct

SEQ ID NO: 48367 - DNA, 7 bp, Unknown
  misc_feature (1)..( 7): Matrix.002 file - promoters60/1393104
caatcta

SEQ ID NO: 48368 - DNA, 8 bp, Unknown
  misc_feature (1)..( 8): Matrix.002 file - promoters60/1393104
atttcaaa

SEQ ID NO: 48369 - DNA, 8 bp, Unknown
  misc_feature (1)..( 8): Matrix.002 file - promoters60/1393104
tttgcgaa

SEQ ID NO: 48370 - DNA, 10 bp, Unknown
  misc_feature (1)..( 10): Matrix.002 file - promoters60/1393104
ttcaagaaga

SEQ ID NO: 48371 - DNA, 6 bp, Unknown
  misc_feature (1)..( 6): Matrix.002 file - promoters60/1393104
cgttga

SEQ ID NO: 48372 - DNA, 9 bp, Unknown
  misc_feature (1)..( 9): Matrix.002 file - promoters60/1393104
aataaagat

SEQ ID NO: 48373 - DNA, 9 bp, Unknown
  misc_feature (1)..( 9): Matrix.002 file - promoters60/1393139
aagatttga

SEQ ID NO: 48374 - DNA, 7 bp, Unknown
  misc_feature (1)..( 7): Matrix.002 file - promoters60/1393139
cttcatt

SEQ ID NO: 48375 - DNA, 13 bp, Unknown
  misc_feature (1)..( 13): Matrix.002 file - promoters60/1393139
tcaacttttgaga

SEQ ID NO: 48376 - DNA, 11 bp, Unknown
  misc_feature (1)..( 11): Matrix.002 file - promoters60/1393139
aataaaagacg

SEQ ID NO: 48377 - DNA, 12 bp, Unknown
  misc_feature (1)..( 12): Matrix.002 file - promoters60/1393139
tttatagaaaaa

SEQ ID NO: 48378 - DNA, 9 bp, Unknown
  misc_feature (1)..( 9): Matrix.002 file - promoters60/1393139
tgataataa

SEQ ID NO: 48379 - DNA, 8 bp, Unknown
  misc_feature (1)..( 8): Matrix.002 file - promoters60/1393181
taactaat

SEQ ID NO: 48380 - DNA, 16 bp, Unknown
  misc_feature (1)..( 16): Matrix.002 file - promoters60/1393181
attaaaaaaaaaatct

SEQ ID NO: 48381 - DNA, 8 bp, Unknown
  misc_feature (1)..( 8): Matrix.002 file - promoters60/1393181
aaatcttt

SEQ ID NO: 48382 - DNA, 9 bp, Unknown
  misc_feature (1)..( 9): Matrix.002 file - promoters60/1393181
tttttaaaa

SEQ ID NO: 48383 - DNA, 7 bp, Unknown
  misc_feature (1)..( 7): Matrix.002 file - promoters60/1393181
tataatt

SEQ ID NO: 48384 - DNA, 9 bp, Unknown
  misc_feature (1)..( 9): Matrix.002 file - promoters60/1393181
ttacccaaa

SEQ ID NO: 48385 - DNA, 7 bp, Unknown
  misc_feature (1)..( 7): Matrix.002 file - promoters60/1393181
ctatctt

SEQ ID NO: 48386 - DNA, 9 bp, Unknown
  misc_feature (1)..( 9): Matrix.002 file - promoters60/1393181
ttcttttta

SEQ ID NO: 48387 - DNA, 8 bp, Unknown
  misc_feature (1)..( 8): Matrix.002 file - promoters60/1393181
aaagatgt

SEQ ID NO: 48388 - DNA, 7 bp, Unknown
  misc_feature (1)..( 7): Matrix.002 file - promoters60/1393181
accagct

SEQ ID NO: 48389 - DNA, 11 bp, Unknown
  misc_feature (1)..( 11): Matrix.002 file - promoters60/1393181
tcaacctctct

SEQ ID NO: 48390 - DNA, 6 bp, Unknown
  misc_feature (1)..( 6): Matrix.002 file - promoters60/1393181
caatta

SEQ ID NO: 48391 - DNA, 6 bp, Unknown
  misc_feature (1)..( 6): Matrix.002 file - promoters60/1393181
ggtttt

SEQ ID NO: 48392 - DNA, 7 bp, Unknown
  misc_feature (1)..( 7): Matrix.002 file - promoters60/1393181
ttttgtc

SEQ ID NO: 48393 - DNA, 7 bp, Unknown
  misc_feature (1)..( 7): Matrix.002 file - promoters60/1393181
agaggat

SEQ ID NO: 48394 - DNA, 7 bp, Unknown
  misc_feature (1)..( 7): Matrix.002 file - promoters60/1393181
ttacaag

SEQ ID NO: 48395 - DNA, 8 bp, Unknown
  misc_feature (1)..( 8): Matrix.002 file - promoters60/1393181
caaaatta

SEQ ID NO: 48396 - DNA, 9 bp, Unknown
  misc_feature (1)..( 9): Matrix.002 file - promoters60/1393181
taaataaat

SEQ ID NO: 48397 - DNA, 15 bp, Unknown
  misc_feature (1)..( 15): Matrix.002 file - promoters60/1393187
taatgcatgtgatgc

SEQ ID NO: 48398 - DNA, 7 bp, Unknown
  misc_feature (1)..( 7): Matrix.002 file - promoters60/1393187
caacttt

SEQ ID NO: 48399 - DNA, 7 bp, Unknown
  misc_feature (1)..( 7): Matrix.002 file - promoters60/1393187
aattttg

SEQ ID NO: 48400 - DNA, 6 bp, Unknown
  misc_feature (1)..( 6): Matrix.002 file - promoters60/1393187
atcaac

SEQ ID NO: 48401 - DNA, 8 bp, Unknown
  misc_feature (1)..( 8): Matrix.002 file - promoters60/1393187
aataaatc

SEQ ID NO: 48402 - DNA, 7 bp, Unknown
  misc_feature (1)..( 7): Matrix.002 file - promoters60/1393187
aactaaa

SEQ ID NO: 48403 - DNA, 6 bp, Unknown
  misc_feature (1)..( 6): Matrix.002 file - promoters60/1393187
tttttt

SEQ ID NO: 48404 - DNA, 7 bp, Unknown
  misc_feature (1)..( 7): Matrix.002 file - promoters60/1393187
aattatt

SEQ ID NO: 48405 - DNA, 6 bp, Unknown
  misc_feature (1)..( 6): Matrix.002 file - promoters60/1393187
attatt

SEQ ID NO: 48406 - DNA, 9 bp, Unknown
  misc_feature (1)..( 9): Matrix.002 file - promoters60/1393187
attagtcga

SEQ ID NO: 48407 - DNA, 7 bp, Unknown
  misc_feature (1)..( 7): Matrix.002 file - promoters60/1393187
taaaaga

SEQ ID NO: 48408 - DNA, 10 bp, Unknown
  misc_feature (1)..( 10): Matrix.002 file - promoters60/1393187
aaaaaaagaa

SEQ ID NO: 48409 - DNA, 6 bp, Unknown
  misc_feature (1)..( 6): Matrix.002 file - promoters60/1393187
tggatt

SEQ ID NO: 48410 - DNA, 6 bp, Unknown
  misc_feature (1)..( 6): Matrix.002 file - promoters60/1393187
gatttt

SEQ ID NO: 48411 - DNA, 6 bp, Unknown
  misc_feature (1)..( 6): Matrix.002 file - promoters60/1393187
cacgtg

SEQ ID NO: 48412 - DNA, 7 bp, Unknown
  misc_feature (1)..( 7): Matrix.002 file - promoters60/1393187
aataaat

SEQ ID NO: 48413 - DNA, 8 bp, Unknown
  misc_feature (1)..( 8): Matrix.002 file - promoters60/1393187
atttgaat

SEQ ID NO: 48414 - DNA, 6 bp, Unknown
  misc_feature (1)..( 6): Matrix.002 file - promoters60/1393187
aaattt

SEQ ID NO: 48415 - DNA, 8 bp, Unknown
  misc_feature (1)..( 8): Matrix.002 file - promoters60/1393187
ggactaaa

SEQ ID NO: 48416 - DNA, 7 bp, Unknown
  misc_feature (1)..( 7): Matrix.002 file - promoters60/1393187
aaatttt

SEQ ID NO: 48417 - DNA, 7 bp, Unknown
  misc_feature (1)..( 7): Matrix.002 file - promoters60/1393187
ataaaag

SEQ ID NO: 48418 - DNA, 6 bp, Unknown
  misc_feature (1)..( 6): Matrix.002 file - promoters60/1393187
ctatta

SEQ ID NO: 48419 - DNA, 7 bp, Unknown
  misc_feature (1)..( 7): Matrix.002 file - promoters60/1393187
gacaaat

SEQ ID NO: 48420 - DNA, 9 bp, Unknown
  misc_feature (1)..( 9): Matrix.002 file - promoters60/1393187
gagaaaatt

SEQ ID NO: 48421 - DNA, 8 bp, Unknown
  misc_feature (1)..( 8): Matrix.002 file - promoters60/1393187
tctaacat

SEQ ID NO: 48422 - DNA, 9 bp, Unknown
  misc_feature (1)..( 9): Matrix.002 file - promoters60/1393290
gaacaactc

SEQ ID NO: 48423 - DNA, 10 bp, Unknown
  misc_feature (1)..( 10): Matrix.002 file - promoters60/1393290
aaggcccaat

SEQ ID NO: 48424 - DNA, 12 bp, Unknown
  misc_feature (1)..( 12): Matrix.002 file - promoters60/1393326
aattttctttat

SEQ ID NO: 48425 - DNA, 9 bp, Unknown
  misc_feature (1)..( 9): Matrix.002 file - promoters60/1393326
cttttaata

SEQ ID NO: 48426 - DNA, 11 bp, Unknown
  misc_feature (1)..( 11): Matrix.002 file - promoters60/1393326
agatttgttag

SEQ ID NO: 48427 - DNA, 7 bp, Unknown
  misc_feature (1)..( 7): Matrix.002 file - promoters60/1393326
gaaaaaa

SEQ ID NO: 48428 - DNA, 10 bp, Unknown
  misc_feature (1)..( 10): Matrix.002 file - promoters60/1393326
aaataaagtt

SEQ ID NO: 48429 - DNA, 8 bp, Unknown
  misc_feature (1)..( 8): Matrix.002 file - promoters60/1393326
aagaaaat

SEQ ID NO: 48430 - DNA, 10 bp, Unknown
  misc_feature (1)..( 10): Matrix.002 file - promoters60/1393383
atcgaaatta

SEQ ID NO: 48431 - DNA, 10 bp, Unknown
  misc_feature (1)..( 10): Matrix.002 file - promoters60/1393383
taaataaaat

SEQ ID NO: 48432 - DNA, 9 bp, Unknown
  misc_feature (1)..( 9): Matrix.002 file - promoters60/1393478
gttaataaa

SEQ ID NO: 48433 - DNA, 10 bp, Unknown
  misc_feature (1)..( 10): Matrix.002 file - promoters60/1393478
tgataaatat

SEQ ID NO: 48434 - DNA, 10 bp, Unknown
  misc_feature (1)..( 10): Matrix.002 file - promoters60/1393478
tacaatttat

SEQ ID NO: 48435 - DNA, 7 bp, Unknown
  misc_feature (1)..( 7): Matrix.002 file - promoters60/1393478
atttttt

SEQ ID NO: 48436 - DNA, 10 bp, Unknown
  misc_feature (1)..( 10): Matrix.002 file - promoters60/1393478
ttttttaata

SEQ ID NO: 48437 - DNA, 7 bp, Unknown
  misc_feature (1)..( 7): Matrix.002 file - promoters60/1393478
taaatgc

SEQ ID NO: 48438 - DNA, 8 bp, Unknown
  misc_feature (1)..( 8): Matrix.002 file - promoters60/1393478
ttgacttt

SEQ ID NO: 48439 - DNA, 8 bp, Unknown
  misc_feature (1)..( 8): Matrix.002 file - promoters60/1393478
attgtttt

SEQ ID NO: 48440 - DNA, 9 bp, Unknown
  misc_feature (1)..( 9): Matrix.002 file - promoters60/1393478
ttgtttgat

SEQ ID NO: 48441 - DNA, 9 bp, Unknown
  misc_feature (1)..( 9): Matrix.002 file - promoters60/1393478
ataaacaca

SEQ ID NO: 48442 - DNA, 8 bp, Unknown
  misc_feature (1)..( 8): Matrix.002 file - promoters60/1393478
atattatg

SEQ ID NO: 48443 - DNA, 8 bp, Unknown
  misc_feature (1)..( 8): Matrix.002 file - promoters60/1393478
aatcttat

SEQ ID NO: 48444 - DNA, 7 bp, Unknown
  misc_feature (1)..( 7): Matrix.002 file - promoters60/1393478
ttaataa

SEQ ID NO: 48445 - DNA, 7 bp, Unknown
  misc_feature (1)..( 7): Matrix.002 file - promoters60/1393478
taataac

SEQ ID NO: 48446 - DNA, 9 bp, Unknown
  misc_feature (1)..( 9): Matrix.002 file - promoters60/1393478
aaacacaca

SEQ ID NO: 48447 - DNA, 9 bp, Unknown
  misc_feature (1)..( 9): Matrix.002 file - promoters60/1393478
tttttatat

SEQ ID NO: 48448 - DNA, 12 bp, Unknown
  misc_feature (1)..( 12): Matrix.002 file - promoters60/1393492
ccttttcagaat

SEQ ID NO: 48449 - DNA, 8 bp, Unknown
  misc_feature (1)..( 8): Matrix.002 file - promoters60/1393492
caatataa

SEQ ID NO: 48450 - DNA, 14 bp, Unknown
  misc_feature (1)..( 14): Matrix.002 file - promoters60/1393492
ttaacattgtttat

SEQ ID NO: 48451 - DNA, 9 bp, Unknown
  misc_feature (1)..( 9): Matrix.002 file - promoters60/1393498
atgtcaaaa

SEQ ID NO: 48452 - DNA, 7 bp, Unknown
  misc_feature (1)..( 7): Matrix.002 file - promoters60/1393498
aaataat

SEQ ID NO: 48453 - DNA, 8 bp, Unknown
  misc_feature (1)..( 8): Matrix.002 file - promoters60/1393498
acaatttt

SEQ ID NO: 48454 - DNA, 10 bp, Unknown
  misc_feature (1)..( 10): Matrix.002 file - promoters60/1393498
atattaaatg

SEQ ID NO: 48455 - DNA, 6 bp, Unknown
  misc_feature (1)..( 6): Matrix.002 file - promoters60/1393498
aaattt

SEQ ID NO: 48456 - DNA, 7 bp, Unknown
  misc_feature (1)..( 7): Matrix.002 file - promoters60/1393498
gaaaatt

SEQ ID NO: 48457 - DNA, 7 bp, Unknown
  misc_feature (1)..( 7): Matrix.002 file - promoters60/1393498
aaactgt

SEQ ID NO: 48458 - DNA, 6 bp, Unknown
  misc_feature (1)..( 6): Matrix.002 file - promoters60/1393498
tttaga

SEQ ID NO: 48459 - DNA, 12 bp, Unknown
  misc_feature (1)..( 12): Matrix.002 file - promoters60/1393498
tttatacaacaa

SEQ ID NO: 48460 - DNA, 8 bp, Unknown
  misc_feature (1)..( 8): Matrix.002 file - promoters60/1393498
tctaaggc

SEQ ID NO: 48461 - DNA, 6 bp, Unknown
  misc_feature (1)..( 6): Matrix.002 file - promoters60/1393498
tttttt

SEQ ID NO: 48462 - DNA, 6 bp, Unknown
  misc_feature (1)..( 6): Matrix.002 file - promoters60/1393498
taagga

SEQ ID NO: 48463 - DNA, 8 bp, Unknown
  misc_feature (1)..( 8): Matrix.002 file - promoters60/1393498
ttaaaatt

SEQ ID NO: 48464 - DNA, 10 bp, Unknown
  misc_feature (1)..( 10): Matrix.002 file - promoters60/1393498
ttattaaatg

SEQ ID NO: 48465 - DNA, 7 bp, Unknown
  misc_feature (1)..( 7): Matrix.002 file - promoters60/1393498
actgtag

SEQ ID NO: 48466 - DNA, 7 bp, Unknown
  misc_feature (1)..( 7): Matrix.002 file - promoters60/1393498
gtgcatg

SEQ ID NO: 48467 - DNA, 14 bp, Unknown
  misc_feature (1)..( 14): Matrix.002 file - promoters60/1393498
taaaaacaggattt

SEQ ID NO: 48468 - DNA, 8 bp, Unknown
  misc_feature (1)..( 8): Matrix.002 file - promoters60/1393498
ttcagaga

SEQ ID NO: 48469 - DNA, 7 bp, Unknown
  misc_feature (1)..( 7): Matrix.002 file - promoters60/1393498
tcaaaat

SEQ ID NO: 48470 - DNA, 7 bp, Unknown
  misc_feature (1)..( 7): Matrix.002 file - promoters60/1393545
atcaaca

SEQ ID NO: 48471 - DNA, 6 bp, Unknown
  misc_feature (1)..( 6): Matrix.002 file - promoters60/1393545
aatcta

SEQ ID NO: 48472 - DNA, 6 bp, Unknown
  misc_feature (1)..( 6): Matrix.002 file - promoters60/1393545
tagctc

SEQ ID NO: 48473 - DNA, 8 bp, Unknown
  misc_feature (1)..( 8): Matrix.002 file - promoters60/1393545
attcgcta

SEQ ID NO: 48474 - DNA, 7 bp, Unknown
  misc_feature (1)..( 7): Matrix.002 file - promoters60/1393545
gcaaaag

SEQ ID NO: 48475 - DNA, 6 bp, Unknown
  misc_feature (1)..( 6): Matrix.002 file - promoters60/1393545
cattag

SEQ ID NO: 48476 - DNA, 8 bp, Unknown
  misc_feature (1)..( 8): Matrix.002 file - promoters60/1393545
tggctctg

SEQ ID NO: 48477 - DNA, 7 bp, Unknown
  misc_feature (1)..( 7): Matrix.002 file - promoters60/1393545
ctgagat

SEQ ID NO: 48478 - DNA, 8 bp, Unknown
  misc_feature (1)..( 8): Matrix.002 file - promoters60/1393545
ttttgttt

SEQ ID NO: 48479 - DNA, 8 bp, Unknown
  misc_feature (1)..( 8): Matrix.002 file - promoters60/1393545
ttgtatat

SEQ ID NO: 48480 - DNA, 6 bp, Unknown
  misc_feature (1)..( 6): Matrix.002 file - promoters60/1393545
tatatt

SEQ ID NO: 48481 - DNA, 6 bp, Unknown
  misc_feature (1)..( 6): Matrix.002 file - promoters60/1393545
tattat

SEQ ID NO: 48482 - DNA, 8 bp, Unknown
  misc_feature (1)..( 8): Matrix.002 file - promoters60/1393545
atttttca

SEQ ID NO: 48483 - DNA, 6 bp, Unknown
  misc_feature (1)..( 6): Matrix.002 file - promoters60/1393545
agctac

SEQ ID NO: 48484 - DNA, 9 bp, Unknown
  misc_feature (1)..( 9): Matrix.002 file - promoters60/1393596
attttattg

SEQ ID NO: 48485 - DNA, 6 bp, Unknown
  misc_feature (1)..( 6): Matrix.002 file - promoters60/1393596
ttcttg

SEQ ID NO: 48486 - DNA, 9 bp, Unknown
  misc_feature (1)..( 9): Matrix.002 file - promoters60/1393596
tgttttctc

SEQ ID NO: 48487 - DNA, 14 bp, Unknown
  misc_feature (1)..( 14): Matrix.002 file - promoters60/1393596
ataatcttttcttg

SEQ ID NO: 48488 - DNA, 7 bp, Unknown
  misc_feature (1)..( 7): Matrix.002 file - promoters60/1393596
aatatgt

SEQ ID NO: 48489 - DNA, 9 bp, Unknown
  misc_feature (1)..( 9): Matrix.002 file - promoters60/1393596
attatattg

SEQ ID NO: 48490 - DNA, 6 bp, Unknown
  misc_feature (1)..( 6): Matrix.002 file - promoters60/1393596
ccctct

SEQ ID NO: 48491 - DNA, 10 bp, Unknown
  misc_feature (1)..( 10): Matrix.002 file - promoters60/1393596
tttttttttt

SEQ ID NO: 48492 - DNA, 8 bp, Unknown
  misc_feature (1)..( 8): Matrix.002 file - promoters60/1393596
agaaaatc

SEQ ID NO: 48493 - DNA, 7 bp, Unknown
  misc_feature (1)..( 7): Matrix.002 file - promoters60/1393596
ttcagaa

SEQ ID NO: 48494 - DNA, 11 bp, Unknown
  misc_feature (1)..( 11): Matrix.002 file - promoters60/1393596
tttcataaaaa

SEQ ID NO: 48495 - DNA, 6 bp, Unknown
  misc_feature (1)..( 6): Matrix.002 file - promoters60/1393596
agtctc

SEQ ID NO: 48496 - DNA, 9 bp, Unknown
  misc_feature (1)..( 9): Matrix.002 file - promoters60/1393596
tattacaca

SEQ ID NO: 48497 - DNA, 13 bp, Unknown
  misc_feature (1)..( 13): Matrix.002 file - promoters60/1393596
actgtaaattacg

SEQ ID NO: 48498 - DNA, 6 bp, Unknown
  misc_feature (1)..( 6): Matrix.002 file - promoters60/1393596
gaaaat

SEQ ID NO: 48499 - DNA, 7 bp, Unknown
  misc_feature (1)..( 7): Matrix.002 file - promoters60/1393596
actgatt

SEQ ID NO: 48500 - DNA, 7 bp, Unknown
  misc_feature (1)..( 7): Matrix.002 file - promoters60/1393596
ttcttct

SEQ ID NO: 48501 - DNA, 6 bp, Unknown
  misc_feature (1)..( 6): Matrix.002 file - promoters60/1393596
aatctc

SEQ ID NO: 48502 - DNA, 6 bp, Unknown
  misc_feature (1)..( 6): Matrix.002 file - promoters60/1393651
tatatg

SEQ ID NO: 48503 - DNA, 6 bp, Unknown
  misc_feature (1)..( 6): Matrix.002 file - promoters60/1393651
gtttgg

SEQ ID NO: 48504 - DNA, 6 bp, Unknown
  misc_feature (1)..( 6): Matrix.002 file - promoters60/1393651
gccttt

SEQ ID NO: 48505 - DNA, 7 bp, Unknown
  misc_feature (1)..( 7): Matrix.002 file - promoters60/1393651
attattt

SEQ ID NO: 48506 - DNA, 7 bp, Unknown
  misc_feature (1)..( 7): Matrix.002 file - promoters60/1393651
aaccaaa

SEQ ID NO: 48507 - DNA, 8 bp, Unknown
  misc_feature (1)..( 8): Matrix.002 file - promoters60/1393651
aaataaaa

SEQ ID NO: 48508 - DNA, 6 bp, Unknown
  misc_feature (1)..( 6): Matrix.002 file - promoters60/1393651
aaataa

SEQ ID NO: 48509 - DNA, 8 bp, Unknown
  misc_feature (1)..( 8): Matrix.002 file - promoters60/1393651
aaattgga

SEQ ID NO: 48510 - DNA, 6 bp, Unknown
  misc_feature (1)..( 6): Matrix.002 file - promoters60/1393651
ggaaga

SEQ ID NO: 48511 - DNA, 6 bp, Unknown
  misc_feature (1)..( 6): Matrix.002 file - promoters60/1393651
catcac

SEQ ID NO: 48512 - DNA, 6 bp, Unknown
  misc_feature (1)..( 6): Matrix.002 file - promoters60/1393651
ttccat

SEQ ID NO: 48513 - DNA, 7 bp, Unknown
  misc_feature (1)..( 7): Matrix.002 file - promoters60/1393651
tatatta

SEQ ID NO: 48514 - DNA, 6 bp, Unknown
  misc_feature (1)..( 6): Matrix.002 file - promoters60/1393651
ataaaa

SEQ ID NO: 48515 - DNA, 9 bp, Unknown
  misc_feature (1)..( 9): Matrix.002 file - promoters60/1393651
atataacat

SEQ ID NO: 48516 - DNA, 6 bp, Unknown
  misc_feature (1)..( 6): Matrix.002 file - promoters60/1393651
aatctt

SEQ ID NO: 48517 - DNA, 8 bp, Unknown
  misc_feature (1)..( 8): Matrix.002 file - promoters60/1393651
attaaata

SEQ ID NO: 48518 - DNA, 12 bp, Unknown
  misc_feature (1)..( 12): Matrix.002 file - promoters60/1393684
ataatttaagtt

SEQ ID NO: 48519 - DNA, 8 bp, Unknown
  misc_feature (1)..( 8): Matrix.002 file - promoters60/1393684
aggaggaa

SEQ ID NO: 48520 - DNA, 6 bp, Unknown
  misc_feature (1)..( 6): Matrix.002 file - promoters60/1393684
gaaaat

SEQ ID NO: 48521 - DNA, 6 bp, Unknown
  misc_feature (1)..( 6): Matrix.002 file - promoters60/1393684
aggtct

SEQ ID NO: 48522 - DNA, 7 bp, Unknown
  misc_feature (1)..( 7): Matrix.002 file - promoters60/1393684
gttacaa

SEQ ID NO: 48523 - DNA, 7 bp, Unknown
  misc_feature (1)..( 7): Matrix.002 file - promoters60/1393684
taattaa

SEQ ID NO: 48524 - DNA, 12 bp, Unknown
  misc_feature (1)..( 12): Matrix.002 file - promoters60/1393684
taaaaagaaaaa

SEQ ID NO: 48525 - DNA, 9 bp, Unknown
  misc_feature (1)..( 9): Matrix.002 file - promoters60/1393684
acatggttt

SEQ ID NO: 48526 - DNA, 7 bp, Unknown
  misc_feature (1)..( 7): Matrix.002 file - promoters60/1393684
aaacata

SEQ ID NO: 48527 - DNA, 7 bp, Unknown
  misc_feature (1)..( 7): Matrix.002 file - promoters60/1393684
atataca

SEQ ID NO: 48528 - DNA, 7 bp, Unknown
  misc_feature (1)..( 7): Matrix.002 file - promoters60/1393684
ttaagtt

SEQ ID NO: 48529 - DNA, 7 bp, Unknown
  misc_feature (1)..( 7): Matrix.002 file - promoters60/1393684
taaaact

SEQ ID NO: 48530 - DNA, 12 bp, Unknown
  misc_feature (1)..( 12): Matrix.002 file - promoters60/1393684
atatatataaag

SEQ ID NO: 48531 - DNA, 10 bp, Unknown
  misc_feature (1)..( 10): Matrix.002 file - promoters60/1393684
acataagatt

SEQ ID NO: 48532 - DNA, 8 bp, Unknown
  misc_feature (1)..( 8): Matrix.002 file - promoters60/1393684
attcacat

SEQ ID NO: 48533 - DNA, 6 bp, Unknown
  misc_feature (1)..( 6): Matrix.002 file - promoters60/1393684
tttcaa

SEQ ID NO: 48534 - DNA, 7 bp, Unknown
  misc_feature (1)..( 7): Matrix.002 file - promoters60/1393684
attttag

SEQ ID NO: 48535 - DNA, 8 bp, Unknown
  misc_feature (1)..( 8): Matrix.002 file - promoters60/1393684
aagtgttt

SEQ ID NO: 48536 - DNA, 8 bp, Unknown
  misc_feature (1)..( 8): Matrix.002 file - promoters60/1393684
tttattta

SEQ ID NO: 48537 - DNA, 6 bp, Unknown
  misc_feature (1)..( 6): Matrix.002 file - promoters60/1393684
taaacg

SEQ ID NO: 48538 - DNA, 9 bp, Unknown
  misc_feature (1)..( 9): Matrix.002 file - promoters60/1393684
atattacca

SEQ ID NO: 48539 - DNA, 11 bp, Unknown
  misc_feature (1)..( 11): Matrix.002 file - promoters60/1393684
caaaatgtcaa

SEQ ID NO: 48540 - DNA, 6 bp, Unknown
  misc_feature (1)..( 6): Matrix.002 file - promoters60/1393684
aaacat

SEQ ID NO: 48541 - DNA, 9 bp, Unknown
  misc_feature (1)..( 9): Matrix.002 file - promoters60/1393684
caaaaccta

SEQ ID NO: 48542 - DNA, 12 bp, Unknown
  misc_feature (1)..( 12): Matrix.002 file - promoters60/1393751
tactaacataag

SEQ ID NO: 48543 - DNA, 6 bp, Unknown
  misc_feature (1)..( 6): Matrix.002 file - promoters60/1393761
tttttt

SEQ ID NO: 48544 - DNA, 9 bp, Unknown
  misc_feature (1)..( 9): Matrix.002 file - promoters60/1393761
aaatgaaat

SEQ ID NO: 48545 - DNA, 9 bp, Unknown
  misc_feature (1)..( 9): Matrix.002 file - promoters60/1393761
ttctgtttt

SEQ ID NO: 48546 - DNA, 9 bp, Unknown
  misc_feature (1)..( 9): Matrix.002 file - promoters60/1393761
aagttaata

SEQ ID NO: 48547 - DNA, 11 bp, Unknown
  misc_feature (1)..( 11): Matrix.002 file - promoters60/1393761
attttcataat

SEQ ID NO: 48548 - DNA, 10 bp, Unknown
  misc_feature (1)..( 10): Matrix.002 file - promoters60/1393761
ttttcttaat

SEQ ID NO: 48549 - DNA, 7 bp, Unknown
  misc_feature (1)..( 7): Matrix.002 file - promoters60/1393761
ttatttt

SEQ ID NO: 48550 - DNA, 12 bp, Unknown
  misc_feature (1)..( 12): Matrix.002 file - promoters60/1393777
atattttttata

SEQ ID NO: 48551 - DNA, 8 bp, Unknown
  misc_feature (1)..( 8): Matrix.002 file - promoters60/1393777
atttttaa

SEQ ID NO: 48552 - DNA, 7 bp, Unknown
  misc_feature (1)..( 7): Matrix.002 file - promoters60/1393777
tttatat

SEQ ID NO: 48553 - DNA, 9 bp, Unknown
  misc_feature (1)..( 9): Matrix.002 file - promoters60/1393777
agttttatt

SEQ ID NO: 48554 - DNA, 8 bp, Unknown
  misc_feature (1)..( 8): Matrix.002 file - promoters60/1393777
atttattt

SEQ ID NO: 48555 - DNA, 7 bp, Unknown
  misc_feature (1)..( 7): Matrix.002 file - promoters60/1393777
ttttttg

SEQ ID NO: 48556 - DNA, 7 bp, Unknown
  misc_feature (1)..( 7): Matrix.002 file - promoters60/1393777
attaaaa

SEQ ID NO: 48557 - DNA, 10 bp, Unknown
  misc_feature (1)..( 10): Matrix.002 file - promoters60/1393777
tattttattt

SEQ ID NO: 48558 - DNA, 10 bp, Unknown
  misc_feature (1)..( 10): Matrix.002 file - promoters60/1393777
aaaattgtta

SEQ ID NO: 48559 - DNA, 11 bp, Unknown
  misc_feature (1)..( 11): Matrix.002 file - promoters60/1393777
ttaaggattaa

SEQ ID NO: 48560 - DNA, 9 bp, Unknown
  misc_feature (1)..( 9): Matrix.002 file - promoters60/1393777
ccaatcagt

SEQ ID NO: 48561 - DNA, 9 bp, Unknown
  misc_feature (1)..( 9): Matrix.002 file - promoters60/1393777
attaaaaac

SEQ ID NO: 48562 - DNA, 7 bp, Unknown
  misc_feature (1)..( 7): Matrix.002 file - promoters60/1393777
aacaaat

SEQ ID NO: 48563 - DNA, 9 bp, Unknown
  misc_feature (1)..( 9): Matrix.002 file - promoters60/1393777
aatttataa

SEQ ID NO: 48564 - DNA, 9 bp, Unknown
  misc_feature (1)..( 9): Matrix.002 file - promoters60/1393787
aaaagttat

SEQ ID NO: 48565 - DNA, 7 bp, Unknown
  misc_feature (1)..( 7): Matrix.002 file - promoters60/1393802
gtcctca

SEQ ID NO: 48566 - DNA, 7 bp, Unknown
  misc_feature (1)..( 7): Matrix.002 file - promoters60/1393802
agagata

SEQ ID NO: 48567 - DNA, 9 bp, Unknown
  misc_feature (1)..( 9): Matrix.002 file - promoters60/1393802
ttttaattt

SEQ ID NO: 48568 - DNA, 9 bp, Unknown
  misc_feature (1)..( 9): Matrix.002 file - promoters60/1393802
aacagtttt

SEQ ID NO: 48569 - DNA, 6 bp, Unknown
  misc_feature (1)..( 6): Matrix.002 file - promoters60/1393802
ttttac

SEQ ID NO: 48570 - DNA, 6 bp, Unknown
  misc_feature (1)..( 6): Matrix.002 file - promoters60/1393802
caaaaa

SEQ ID NO: 48571 - DNA, 6 bp, Unknown
  misc_feature (1)..( 6): Matrix.002 file - promoters60/1393802
attttt

SEQ ID NO: 48572 - DNA, 11 bp, Unknown
  misc_feature (1)..( 11): Matrix.002 file - promoters60/1393802
taaccaaaaaa

SEQ ID NO: 48573 - DNA, 6 bp, Unknown
  misc_feature (1)..( 6): Matrix.002 file - promoters60/1393802
atgcac

SEQ ID NO: 48574 - DNA, 7 bp, Unknown
  misc_feature (1)..( 7): Matrix.002 file - promoters60/1393802
cttagaa

SEQ ID NO: 48575 - DNA, 8 bp, Unknown
  misc_feature (1)..( 8): Matrix.002 file - promoters60/1393802
gaaacctt

SEQ ID NO: 48576 - DNA, 9 bp, Unknown
  misc_feature (1)..( 9): Matrix.002 file - promoters60/1393802
aaacacaaa

SEQ ID NO: 48577 - DNA, 11 bp, Unknown
  misc_feature (1)..( 11): Matrix.002 file - promoters60/1393802
aaagttcatct

SEQ ID NO: 48578 - DNA, 6 bp, Unknown
  misc_feature (1)..( 6): Matrix.002 file - promoters60/1393802
atattt

SEQ ID NO: 48579 - DNA, 7 bp, Unknown
  misc_feature (1)..( 7): Matrix.002 file - promoters60/1393802
agaaaaa

SEQ ID NO: 48580 - DNA, 7 bp, Unknown
  misc_feature (1)..( 7): Matrix.002 file - promoters60/1393802
gttaaaa

SEQ ID NO: 48581 - DNA, 8 bp, Unknown
  misc_feature (1)..( 8): Matrix.002 file - promoters60/1393802
tgaatatt

SEQ ID NO: 48582 - DNA, 7 bp, Unknown
  misc_feature (1)..( 7): Matrix.002 file - promoters60/1393802
tatagtt

SEQ ID NO: 48583 - DNA, 7 bp, Unknown
  misc_feature (1)..( 7): Matrix.002 file - promoters60/1393802
tatatgt

SEQ ID NO: 48584 - DNA, 7 bp, Unknown
  misc_feature (1)..( 7): Matrix.002 file - promoters60/1393802
taagatt

SEQ ID NO: 48585 - DNA, 7 bp, Unknown
  misc_feature (1)..( 7): Matrix.002 file - promoters60/1393802
tggatat

SEQ ID NO: 48586 - DNA, 8 bp, Unknown
  misc_feature (1)..( 8): Matrix.002 file - promoters60/1393802
attgtttt

SEQ ID NO: 48587 - DNA, 8 bp, Unknown
  misc_feature (1)..( 8): Matrix.002 file - promoters60/1393805
attttact

SEQ ID NO: 48588 - DNA, 9 bp, Unknown
  misc_feature (1)..( 9): Matrix.002 file - promoters60/1393845
attaaaata

SEQ ID NO: 48589 - DNA, 10 bp, Unknown
  misc_feature (1)..( 10): Matrix.002 file - promoters60/1393845
attcaaaatg

SEQ ID NO: 48590 - DNA, 11 bp, Unknown
  misc_feature (1)..( 11): Matrix.002 file - promoters60/1393845
aattctaaaat

SEQ ID NO: 48591 - DNA, 11 bp, Unknown
  misc_feature (1)..( 11): Matrix.002 file - promoters60/1393845
aattattaaat

SEQ ID NO: 48592 - DNA, 6 bp, Unknown
  misc_feature (1)..( 6): Matrix.002 file - promoters60/1394110
tttaaa

SEQ ID NO: 48593 - DNA, 7 bp, Unknown
  misc_feature (1)..( 7): Matrix.002 file - promoters60/1394110
cacatat

SEQ ID NO: 48594 - DNA, 8 bp, Unknown
  misc_feature (1)..( 8): Matrix.002 file - promoters60/1394110
attaataa

SEQ ID NO: 48595 - DNA, 8 bp, Unknown
  misc_feature (1)..( 8): Matrix.002 file - promoters60/1394110
aaactaaa

SEQ ID NO: 48596 - DNA, 10 bp, Unknown
  misc_feature (1)..( 10): Matrix.002 file - promoters60/1394110
ttttcaaaaa

SEQ ID NO: 48597 - DNA, 8 bp, Unknown
  misc_feature (1)..( 8): Matrix.002 file - promoters60/1394110
taatgtaa

SEQ ID NO: 48598 - DNA, 6 bp, Unknown
  misc_feature (1)..( 6): Matrix.002 file - promoters60/1394110
aaacat

SEQ ID NO: 48599 - DNA, 7 bp, Unknown
  misc_feature (1)..( 7): Matrix.002 file - promoters60/1394110
taatata

SEQ ID NO: 48600 - DNA, 7 bp, Unknown
  misc_feature (1)..( 7): Matrix.002 file - promoters60/1394110
aagactc

SEQ ID NO: 48601 - DNA, 7 bp, Unknown
  misc_feature (1)..( 7): Matrix.002 file - promoters60/1394110
atactaa

SEQ ID NO: 48602 - DNA, 5 bp, Unknown
  misc_feature (1)..( 5): Matrix.002 file - promoters60/1394110
aaaag

SEQ ID NO: 48603 - DNA, 8 bp, Unknown
  misc_feature (1)..( 8): Matrix.002 file - promoters60/1394110
aaaaagac

SEQ ID NO: 48604 - DNA, 6 bp, Unknown
  misc_feature (1)..( 6): Matrix.002 file - promoters60/1394110
tcttgg

SEQ ID NO: 48605 - DNA, 7 bp, Unknown
  misc_feature (1)..( 7): Matrix.002 file - promoters60/1394110
cacttgt

SEQ ID NO: 48606 - DNA, 6 bp, Unknown
  misc_feature (1)..( 6): Matrix.002 file - promoters60/1394110
acattt

SEQ ID NO: 48607 - DNA, 7 bp, Unknown
  misc_feature (1)..( 7): Matrix.002 file - promoters60/1394110
tatgtgt

SEQ ID NO: 48608 - DNA, 8 bp, Unknown
  misc_feature (1)..( 8): Matrix.002 file - promoters60/1394110
gtttattt

SEQ ID NO: 48609 - DNA, 9 bp, Unknown
  misc_feature (1)..( 9): Matrix.002 file - promoters60/1394110
aaaatcaag

SEQ ID NO: 48610 - DNA, 8 bp, Unknown
  misc_feature (1)..( 8): Matrix.002 file - promoters60/1394110
cttaatat

SEQ ID NO: 48611 - DNA, 7 bp, Unknown
  misc_feature (1)..( 7): Matrix.002 file - promoters60/1394110
caaatac

SEQ ID NO: 48612 - DNA, 7 bp, Unknown
  misc_feature (1)..( 7): Matrix.002 file - promoters60/1394110
attatca

SEQ ID NO: 48613 - DNA, 6 bp, Unknown
  misc_feature (1)..( 6): Matrix.002 file - promoters60/1394110
aataaa

SEQ ID NO: 48614 - DNA, 7 bp, Unknown
  misc_feature (1)..( 7): Matrix.002 file - promoters60/1394110
aaacaaa

SEQ ID NO: 48615 - DNA, 6 bp, Unknown
  misc_feature (1)..( 6): Matrix.002 file - promoters60/1394110
aataaa

SEQ ID NO: 48616 - DNA, 6 bp, Unknown
  misc_feature (1)..( 6): Matrix.002 file - promoters60/1394110
agacaa

SEQ ID NO: 48617 - DNA, 9 bp, Unknown
  misc_feature (1)..( 9): Matrix.002 file - promoters60/1394110
gagaaaacc

SEQ ID NO: 48618 - DNA, 6 bp, Unknown
  misc_feature (1)..( 6): Matrix.002 file - promoters60/1394178
ttcaca

SEQ ID NO: 48619 - DNA, 8 bp, Unknown
  misc_feature (1)..( 8): Matrix.002 file - promoters60/1394178
tgaatgaa

SEQ ID NO: 48620 - DNA, 6 bp, Unknown
  misc_feature (1)..( 6): Matrix.002 file - promoters60/1394178
gccaag

SEQ ID NO: 48621 - DNA, 8 bp, Unknown
  misc_feature (1)..( 8): Matrix.002 file - promoters60/1394178
tggaaagg

SEQ ID NO: 48622 - DNA, 12 bp, Unknown
  misc_feature (1)..( 12): Matrix.002 file - promoters60/1394178
aaatctctcatt

SEQ ID NO: 48623 - DNA, 8 bp, Unknown
  misc_feature (1)..( 8): Matrix.002 file - promoters60/1394178
tttattaa

SEQ ID NO: 48624 - DNA, 9 bp, Unknown
  misc_feature (1)..( 9): Matrix.002 file - promoters60/1394178
ttttattct

SEQ ID NO: 48625 - DNA, 9 bp, Unknown
  misc_feature (1)..( 9): Matrix.002 file - promoters60/1394178
tttttctta

SEQ ID NO: 48626 - DNA, 7 bp, Unknown
  misc_feature (1)..( 7): Matrix.002 file - promoters60/1394178
aatataa

SEQ ID NO: 48627 - DNA, 7 bp, Unknown
  misc_feature (1)..( 7): Matrix.002 file - promoters60/1394178
gtatcaa

SEQ ID NO: 48628 - DNA, 9 bp, Unknown
  misc_feature (1)..( 9): Matrix.002 file - promoters60/1394178
aataaccaa

SEQ ID NO: 48629 - DNA, 8 bp, Unknown
  misc_feature (1)..( 8): Matrix.002 file - promoters60/1394178
cagctatt

SEQ ID NO: 48630 - DNA, 7 bp, Unknown
  misc_feature (1)..( 7): Matrix.002 file - promoters60/1394178
attgttg

SEQ ID NO: 48631 - DNA, 8 bp, Unknown
  misc_feature (1)..( 8): Matrix.002 file - promoters60/1394178
cataaaaa

SEQ ID NO: 48632 - DNA, 7 bp, Unknown
  misc_feature (1)..( 7): Matrix.002 file - promoters60/1394178
acagatt

SEQ ID NO: 48633 - DNA, 7 bp, Unknown
  misc_feature (1)..( 7): Matrix.002 file - promoters60/1394178
tttagtt

SEQ ID NO: 48634 - DNA, 8 bp, Unknown
  misc_feature (1)..( 8): Matrix.002 file - promoters60/1394178
ttcaaaaa

SEQ ID NO: 48635 - DNA, 8 bp, Unknown
  misc_feature (1)..( 8): Matrix.002 file - promoters60/1394302
ttgttaat

SEQ ID NO: 48636 - DNA, 17 bp, Unknown
  misc_feature (1)..( 17): Matrix.002 file - promoters60/1394302
actgtttaaaaaaaaaa

SEQ ID NO: 48637 - DNA, 9 bp, Unknown
  misc_feature (1)..( 9): Matrix.002 file - promoters60/1394327
caaaacttt

SEQ ID NO: 48638 - DNA, 6 bp, Unknown
  misc_feature (1)..( 6): Matrix.002 file - promoters60/1394327
ataatt

SEQ ID NO: 48639 - DNA, 6 bp, Unknown
  misc_feature (1)..( 6): Matrix.002 file - promoters60/1394327
tttctt

SEQ ID NO: 48640 - DNA, 7 bp, Unknown
  misc_feature (1)..( 7): Matrix.002 file - promoters60/1394327
ccaagct

SEQ ID NO: 48641 - DNA, 7 bp, Unknown
  misc_feature (1)..( 7): Matrix.002 file - promoters60/1394327
gctttta

SEQ ID NO: 48642 - DNA, 8 bp, Unknown
  misc_feature (1)..( 8): Matrix.002 file - promoters60/1394327
tgttatct

SEQ ID NO: 48643 - DNA, 7 bp, Unknown
  misc_feature (1)..( 7): Matrix.002 file - promoters60/1394327
tcacata

SEQ ID NO: 48644 - DNA, 7 bp, Unknown
  misc_feature (1)..( 7): Matrix.002 file - promoters60/1394327
ttttcaa

SEQ ID NO: 48645 - DNA, 6 bp, Unknown
  misc_feature (1)..( 6): Matrix.002 file - promoters60/1394327
ccatat

SEQ ID NO: 48646 - DNA, 6 bp, Unknown
  misc_feature (1)..( 6): Matrix.002 file - promoters60/1394327
aagtct

SEQ ID NO: 48647 - DNA, 6 bp, Unknown
  misc_feature (1)..( 6): Matrix.002 file - promoters60/1394327
tcttct

SEQ ID NO: 48648 - DNA, 7 bp, Unknown
  misc_feature (1)..( 7): Matrix.002 file - promoters60/1394327
agaattt

SEQ ID NO: 48649 - DNA, 7 bp, Unknown
  misc_feature (1)..( 7): Matrix.002 file - promoters60/1394327
caaacat

SEQ ID NO: 48650 - DNA, 7 bp, Unknown
  misc_feature (1)..( 7): Matrix.002 file - promoters60/1394327
tccaaat

SEQ ID NO: 48651 - DNA, 7 bp, Unknown
  misc_feature (1)..( 7): Matrix.002 file - promoters60/1394327
aaagatg

SEQ ID NO: 48652 - DNA, 6 bp, Unknown
  misc_feature (1)..( 6): Matrix.002 file - promoters60/1394327
gcaaaa

SEQ ID NO: 48653 - DNA, 7 bp, Unknown
  misc_feature (1)..( 7): Matrix.002 file - promoters60/1394327
ataggga

SEQ ID NO: 48654 - DNA, 9 bp, Unknown
  misc_feature (1)..( 9): Matrix.002 file - promoters60/1394465
atttgattt

SEQ ID NO: 48655 - DNA, 8 bp, Unknown
  misc_feature (1)..( 8): Matrix.002 file - promoters60/1394465
atttgata

SEQ ID NO: 48656 - DNA, 6 bp, Unknown
  misc_feature (1)..( 6): Matrix.002 file - promoters60/1394465
catctt

SEQ ID NO: 48657 - DNA, 9 bp, Unknown
  misc_feature (1)..( 9): Matrix.002 file - promoters60/1394480
aaaatttct

SEQ ID NO: 48658 - DNA, 8 bp, Unknown
  misc_feature (1)..( 8): Matrix.002 file - promoters60/1394480
tgtgaaac

SEQ ID NO: 48659 - DNA, 9 bp, Unknown
  misc_feature (1)..( 9): Matrix.002 file - promoters60/1394480
aaaatttct

SEQ ID NO: 48660 - DNA, 9 bp, Unknown
  misc_feature (1)..( 9): Matrix.002 file - promoters60/1394480
tttcaaaat

SEQ ID NO: 48661 - DNA, 6 bp, Unknown
  misc_feature (1)..( 6): Matrix.002 file - promoters60/1394480
taacat

SEQ ID NO: 48662 - DNA, 7 bp, Unknown
  misc_feature (1)..( 7): Matrix.002 file - promoters60/1394480
aaaatat

SEQ ID NO: 48663 - DNA, 8 bp, Unknown
  misc_feature (1)..( 8): Matrix.002 file - promoters60/1394480
taactaaa

SEQ ID NO: 48664 - DNA, 6 bp, Unknown
  misc_feature (1)..( 6): Matrix.002 file - promoters60/1394480
aatcaa

SEQ ID NO: 48665 - DNA, 14 bp, Unknown
  misc_feature (1)..( 14): Matrix.002 file - promoters60/1394480
tcaataaatacaca

SEQ ID NO: 48666 - DNA, 7 bp, Unknown
  misc_feature (1)..( 7): Matrix.002 file - promoters60/1394480
aaaaaaa

SEQ ID NO: 48667 - DNA, 9 bp, Unknown
  misc_feature (1)..( 9): Matrix.002 file - promoters60/1394480
ctgctttca

SEQ ID NO: 48668 - DNA, 7 bp, Unknown
  misc_feature (1)..( 7): Matrix.002 file - promoters60/1394480
attttgg

SEQ ID NO: 48669 - DNA, 8 bp, Unknown
  misc_feature (1)..( 8): Matrix.002 file - promoters60/1394480
tcaaattt

SEQ ID NO: 48670 - DNA, 7 bp, Unknown
  misc_feature (1)..( 7): Matrix.002 file - promoters60/1394480
gtaatgg

SEQ ID NO: 48671 - DNA, 6 bp, Unknown
  misc_feature (1)..( 6): Matrix.002 file - promoters60/1394480
aaaatg

SEQ ID NO: 48672 - DNA, 6 bp, Unknown
  misc_feature (1)..( 6): Matrix.002 file - promoters60/1394480
aagatt

SEQ ID NO: 48673 - DNA, 8 bp, Unknown
  misc_feature (1)..( 8): Matrix.002 file - promoters60/1394480
atgtaaac

SEQ ID NO: 48674 - DNA, 7 bp, Unknown
  misc_feature (1)..( 7): Matrix.002 file - promoters60/1394480
gaaaaat

SEQ ID NO: 48675 - DNA, 7 bp, Unknown
  misc_feature (1)..( 7): Matrix.002 file - promoters60/1394480
caaaatt

SEQ ID NO: 48676 - DNA, 7 bp, Unknown
  misc_feature (1)..( 7): Matrix.002 file - promoters60/1394480
acaactt

SEQ ID NO: 48677 - DNA, 7 bp, Unknown
  misc_feature (1)..( 7): Matrix.002 file - promoters60/1394480
tttattt

SEQ ID NO: 48678 - DNA, 6 bp, Unknown
  misc_feature (1)..( 6): Matrix.002 file - promoters60/1394480
ttggtt

SEQ ID NO: 48679 - DNA, 6 bp, Unknown
  misc_feature (1)..( 6): Matrix.002 file - promoters60/1394480
aaaagt

SEQ ID NO: 48680 - DNA, 12 bp, Unknown
  misc_feature (1)..( 12): Matrix.002 file - promoters60/1394510
ttaagatttttt

SEQ ID NO: 48681 - DNA, 14 bp, Unknown
  misc_feature (1)..( 14): Matrix.002 file - promoters60/1394510
acattaaactatat

SEQ ID NO: 48682 - DNA, 11 bp, Unknown
  misc_feature (1)..( 11): Matrix.002 file - promoters60/1394510
ttaacattttt

SEQ ID NO: 48683 - DNA, 9 bp, Unknown
  misc_feature (1)..( 9): Matrix.002 file - promoters60/1394510
aattttgct

SEQ ID NO: 48684 - DNA, 9 bp, Unknown
  misc_feature (1)..( 9): Matrix.002 file - promoters60/1394510
aaaattttt

SEQ ID NO: 48685 - DNA, 15 bp, Unknown
  misc_feature (1)..( 15): Matrix.002 file - promoters60/1394592
tgtaaaatttcaaaa

SEQ ID NO: 48686 - DNA, 17 bp, Unknown
  misc_feature (1)..( 17): Matrix.002 file - promoters60/1394592
agaattttttaaataac

SEQ ID NO: 48687 - DNA, 10 bp, Unknown
  misc_feature (1)..( 10): Matrix.002 file - promoters60/1394625
caaattaaaa

SEQ ID NO: 48688 - DNA, 8 bp, Unknown
  misc_feature (1)..( 8): Matrix.002 file - promoters60/1394625
ttttaatt

SEQ ID NO: 48689 - DNA, 7 bp, Unknown
  misc_feature (1)..( 7): Matrix.002 file - promoters60/1394625
taatttt

SEQ ID NO: 48690 - DNA, 6 bp, Unknown
  misc_feature (1)..( 6): Matrix.002 file - promoters60/1394625
ttggta

SEQ ID NO: 48691 - DNA, 11 bp, Unknown
  misc_feature (1)..( 11): Matrix.002 file - promoters60/1394625
atttaataaaa

SEQ ID NO: 48692 - DNA, 6 bp, Unknown
  misc_feature (1)..( 6): Matrix.002 file - promoters60/1394625
aaaacg

SEQ ID NO: 48693 - DNA, 6 bp, Unknown
  misc_feature (1)..( 6): Matrix.002 file - promoters60/1394625
tgggaa

SEQ ID NO: 48694 - DNA, 9 bp, Unknown
  misc_feature (1)..( 9): Matrix.002 file - promoters60/1394625
taaaccatt

SEQ ID NO: 48695 - DNA, 6 bp, Unknown
  misc_feature (1)..( 6): Matrix.002 file - promoters60/1394625
gaataa

SEQ ID NO: 48696 - DNA, 17 bp, Unknown
  misc_feature (1)..( 17): Matrix.002 file - promoters60/1394625
gattataaaaaaaatct

SEQ ID NO: 48697 - DNA, 9 bp, Unknown
  misc_feature (1)..( 9): Matrix.002 file - promoters60/1394625
tttcttata

SEQ ID NO: 48698 - DNA, 8 bp, Unknown
  misc_feature (1)..( 8): Matrix.002 file - promoters60/1394625
tataaatt

SEQ ID NO: 48699 - DNA, 7 bp, Unknown
  misc_feature (1)..( 7): Matrix.002 file - promoters60/1394625
attactt

SEQ ID NO: 48700 - DNA, 9 bp, Unknown
  misc_feature (1)..( 9): Matrix.002 file - promoters60/1394625
aaaatatat

SEQ ID NO: 48701 - DNA, 6 bp, Unknown
  misc_feature (1)..( 6): Matrix.002 file - promoters60/1394625
tatata

SEQ ID NO: 48702 - DNA, 6 bp, Unknown
  misc_feature (1)..( 6): Matrix.002 file - promoters60/1394625
aaattt

SEQ ID NO: 48703 - DNA, 8 bp, Unknown
  misc_feature (1)..( 8): Matrix.002 file - promoters60/1394625
aaaaaata

SEQ ID NO: 48704 - DNA, 7 bp, Unknown
  misc_feature (1)..( 7): Matrix.002 file - promoters60/1394625
taaataa

SEQ ID NO: 48705 - DNA, 11 bp, Unknown
  misc_feature (1)..( 11): Matrix.002 file - promoters60/1394625
ctcattccctt

SEQ ID NO: 48706 - DNA, 6 bp, Unknown
  misc_feature (1)..( 6): Matrix.002 file - promoters60/1394625
actaat

SEQ ID NO: 48707 - DNA, 7 bp, Unknown
  misc_feature (1)..( 7): Matrix.002 file - promoters60/1394625
tataatt

SEQ ID NO: 48708 - DNA, 9 bp, Unknown
  misc_feature (1)..( 9): Matrix.002 file - promoters60/1394625
ttacccaaa

SEQ ID NO: 48709 - DNA, 7 bp, Unknown
  misc_feature (1)..( 7): Matrix.002 file - promoters60/1394625
ctatctt

SEQ ID NO: 48710 - DNA, 9 bp, Unknown
  misc_feature (1)..( 9): Matrix.002 file - promoters60/1394625
ttcttttta

SEQ ID NO: 48711 - DNA, 7 bp, Unknown
  misc_feature (1)..( 7): Matrix.002 file - promoters60/1394625
accagct

SEQ ID NO: 48712 - DNA, 11 bp, Unknown
  misc_feature (1)..( 11): Matrix.002 file - promoters60/1394625
tcaacctctct

SEQ ID NO: 48713 - DNA, 12 bp, Unknown
  misc_feature (1)..( 12): Matrix.002 file - promoters60/1394643
gttatatatatt

SEQ ID NO: 48714 - DNA, 6 bp, Unknown
  misc_feature (1)..( 6): Matrix.002 file - promoters60/1394643
ttaata

SEQ ID NO: 48715 - DNA, 7 bp, Unknown
  misc_feature (1)..( 7): Matrix.002 file - promoters60/1394643
tttagtt

SEQ ID NO: 48716 - DNA, 8 bp, Unknown
  misc_feature (1)..( 8): Matrix.002 file - promoters60/1394643
tttgccgt

SEQ ID NO: 48717 - DNA, 9 bp, Unknown
  misc_feature (1)..( 9): Matrix.002 file - promoters60/1394643
tatttagga

SEQ ID NO: 48718 - DNA, 9 bp, Unknown
  misc_feature (1)..( 9): Matrix.002 file - promoters60/1394643
tgagtttct

SEQ ID NO: 48719 - DNA, 6 bp, Unknown
  misc_feature (1)..( 6): Matrix.002 file - promoters60/1394643
tttttc

SEQ ID NO: 48720 - DNA, 6 bp, Unknown
  misc_feature (1)..( 6): Matrix.002 file - promoters60/1394643
gggaaa

SEQ ID NO: 48721 - DNA, 6 bp, Unknown
  misc_feature (1)..( 6): Matrix.002 file - promoters60/1394643
tccatg

SEQ ID NO: 48722 - DNA, 8 bp, Unknown
  misc_feature (1)..( 8): Matrix.002 file - promoters60/1394643
tttcttct

SEQ ID NO: 48723 - DNA, 12 bp, Unknown
  misc_feature (1)..( 12): Matrix.002 file - promoters60/1394643
atgctattaaat

SEQ ID NO: 48724 - DNA, 6 bp, Unknown
  misc_feature (1)..( 6): Matrix.002 file - promoters60/1394643
aatatt

SEQ ID NO: 48725 - DNA, 6 bp, Unknown
  misc_feature (1)..( 6): Matrix.002 file - promoters60/1394643
acttat

SEQ ID NO: 48726 - DNA, 7 bp, Unknown
  misc_feature (1)..( 7): Matrix.002 file - promoters60/1394643
tacaaaa

SEQ ID NO: 48727 - DNA, 6 bp, Unknown
  misc_feature (1)..( 6): Matrix.002 file - promoters60/1394643
catcgt

SEQ ID NO: 48728 - DNA, 7 bp, Unknown
  misc_feature (1)..( 7): Matrix.002 file - promoters60/1394643
tcttatt

SEQ ID NO: 48729 - DNA, 7 bp, Unknown
  misc_feature (1)..( 7): Matrix.002 file - promoters60/1394676
tttctag

SEQ ID NO: 48730 - DNA, 6 bp, Unknown
  misc_feature (1)..( 6): Matrix.002 file - promoters60/1394676
attaag

SEQ ID NO: 48731 - DNA, 9 bp, Unknown
  misc_feature (1)..( 9): Matrix.002 file - promoters60/1394676
tttgattga

SEQ ID NO: 48732 - DNA, 7 bp, Unknown
  misc_feature (1)..( 7): Matrix.002 file - promoters60/1394676
ggctgaa

SEQ ID NO: 48733 - DNA, 7 bp, Unknown
  misc_feature (1)..( 7): Matrix.002 file - promoters60/1394676
aaaatta

SEQ ID NO: 48734 - DNA, 7 bp, Unknown
  misc_feature (1)..( 7): Matrix.002 file - promoters60/1394676
attaaaa

SEQ ID NO: 48735 - DNA, 7 bp, Unknown
  misc_feature (1)..( 7): Matrix.002 file - promoters60/1394676
attactg

SEQ ID NO: 48736 - DNA, 10 bp, Unknown
  misc_feature (1)..( 10): Matrix.002 file - promoters60/1394676
accaaactta

SEQ ID NO: 48737 - DNA, 8 bp, Unknown
  misc_feature (1)..( 8): Matrix.002 file - promoters60/1394676
ctgatttg

SEQ ID NO: 48738 - DNA, 7 bp, Unknown
  misc_feature (1)..( 7): Matrix.002 file - promoters60/1394676
tatcatt

SEQ ID NO: 48739 - DNA, 7 bp, Unknown
  misc_feature (1)..( 7): Matrix.002 file - promoters60/1394676
gaatttg

SEQ ID NO: 48740 - DNA, 7 bp, Unknown
  misc_feature (1)..( 7): Matrix.002 file - promoters60/1394676
ttagatc

SEQ ID NO: 48741 - DNA, 6 bp, Unknown
  misc_feature (1)..( 6): Matrix.002 file - promoters60/1394676
catttg

SEQ ID NO: 48742 - DNA, 11 bp, Unknown
  misc_feature (1)..( 11): Matrix.002 file - promoters60/1394697
gaaattaattt

SEQ ID NO: 48743 - DNA, 13 bp, Unknown
  misc_feature (1)..( 13): Matrix.002 file - promoters60/1394697
aaattttaaataa

SEQ ID NO: 48744 - DNA, 11 bp, Unknown
  misc_feature (1)..( 11): Matrix.002 file - promoters60/1394697
taagaaaaatc

SEQ ID NO: 48745 - DNA, 7 bp, Unknown
  misc_feature (1)..( 7): Matrix.002 file - promoters60/1394697
aaaactt

SEQ ID NO: 48746 - DNA, 12 bp, Unknown
  misc_feature (1)..( 12): Matrix.002 file - promoters60/1394697
ataattatttat

SEQ ID NO: 48747 - DNA, 10 bp, Unknown
  misc_feature (1)..( 10): Matrix.002 file - promoters60/1394697
tatttttatg

SEQ ID NO: 48748 - DNA, 9 bp, Unknown
  misc_feature (1)..( 9): Matrix.002 file - promoters60/1394697
tattattat

SEQ ID NO: 48749 - DNA, 7 bp, Unknown
  misc_feature (1)..( 7): Matrix.002 file - promoters60/1394795
attaact

SEQ ID NO: 48750 - DNA, 9 bp, Unknown
  misc_feature (1)..( 9): Matrix.002 file - promoters60/1394795
aaacttttt

SEQ ID NO: 48751 - DNA, 6 bp, Unknown
  misc_feature (1)..( 6): Matrix.002 file - promoters60/1394795
tttcta

SEQ ID NO: 48752 - DNA, 7 bp, Unknown
  misc_feature (1)..( 7): Matrix.002 file - promoters60/1394795
taaaaaa

SEQ ID NO: 48753 - DNA, 6 bp, Unknown
  misc_feature (1)..( 6): Matrix.002 file - promoters60/1394795
gcataa

SEQ ID NO: 48754 - DNA, 9 bp, Unknown
  misc_feature (1)..( 9): Matrix.002 file - promoters60/1394795
gaatctctt

SEQ ID NO: 48755 - DNA, 8 bp, Unknown
  misc_feature (1)..( 8): Matrix.002 file - promoters60/1394795
attttttt

SEQ ID NO: 48756 - DNA, 6 bp, Unknown
  misc_feature (1)..( 6): Matrix.002 file - promoters60/1394795
ttttct

SEQ ID NO: 48757 - DNA, 7 bp, Unknown
  misc_feature (1)..( 7): Matrix.002 file - promoters60/1394795
gataaaa

SEQ ID NO: 48758 - DNA, 8 bp, Unknown
  misc_feature (1)..( 8): Matrix.002 file - promoters60/1394795
tatatatt

SEQ ID NO: 48759 - DNA, 7 bp, Unknown
  misc_feature (1)..( 7): Matrix.002 file - promoters60/1394795
actatta

SEQ ID NO: 48760 - DNA, 9 bp, Unknown
  misc_feature (1)..( 9): Matrix.002 file - promoters60/1394795
tattttaaa

SEQ ID NO: 48761 - DNA, 6 bp, Unknown
  misc_feature (1)..( 6): Matrix.002 file - promoters60/1394795
ttttat

SEQ ID NO: 48762 - DNA, 6 bp, Unknown
  misc_feature (1)..( 6): Matrix.002 file - promoters60/1394795
attttt

SEQ ID NO: 48763 - DNA, 6 bp, Unknown
  misc_feature (1)..( 6): Matrix.002 file - promoters60/1394795
ttctgc

SEQ ID NO: 48764 - DNA, 8 bp, Unknown
  misc_feature (1)..( 8): Matrix.002 file - promoters60/1394795
tatataaa

SEQ ID NO: 48765 - DNA, 6 bp, Unknown
  misc_feature (1)..( 6): Matrix.002 file - promoters60/1394795
aacttt

SEQ ID NO: 48766 - DNA, 6 bp, Unknown
  misc_feature (1)..( 6): Matrix.002 file - promoters60/1394795
tataaa

SEQ ID NO: 48767 - DNA, 7 bp, Unknown
  misc_feature (1)..( 7): Matrix.002 file - promoters60/1394795
tcttttt

SEQ ID NO: 48768 - DNA, 8 bp, Unknown
  misc_feature (1)..( 8): Matrix.002 file - promoters60/1394795
tatgtttt

SEQ ID NO: 48769 - DNA, 7 bp, Unknown
  misc_feature (1)..( 7): Matrix.002 file - promoters60/1394795
tctagtt

SEQ ID NO: 48770 - DNA, 6 bp, Unknown
  misc_feature (1)..( 6): Matrix.002 file - promoters60/1394795
taaaat

SEQ ID NO: 48771 - DNA, 7 bp, Unknown
  misc_feature (1)..( 7): Matrix.002 file - promoters60/1394795
aaaatat

SEQ ID NO: 48772 - DNA, 6 bp, Unknown
  misc_feature (1)..( 6): Matrix.002 file - promoters60/1394795
ttttga

SEQ ID NO: 48773 - DNA, 6 bp, Unknown
  misc_feature (1)..( 6): Matrix.002 file - promoters60/1394795
ttttaa

SEQ ID NO: 48774 - DNA, 8 bp, Unknown
  misc_feature (1)..( 8): Matrix.002 file - promoters60/1394795
aacactag

SEQ ID NO: 48775 - DNA, 6 bp, Unknown
  misc_feature (1)..( 6): Matrix.002 file - promoters60/1394795
caaatg

SEQ ID NO: 48776 - DNA, 7 bp, Unknown
  misc_feature (1)..( 7): Matrix.002 file - promoters60/1394795
aagatca

SEQ ID NO: 48777 - DNA, 6 bp, Unknown
  misc_feature (1)..( 6): Matrix.002 file - promoters60/1394795
ctgaca

SEQ ID NO: 48778 - DNA, 16 bp, Unknown
  misc_feature (1)..( 16): Matrix.002 file - promoters60/1394836
gcccattaatgagttc

SEQ ID NO: 48779 - DNA, 9 bp, Unknown
  misc_feature (1)..( 9): Matrix.002 file - promoters60/1394884
aattttttt

SEQ ID NO: 48780 - DNA, 8 bp, Unknown
  misc_feature (1)..( 8): Matrix.002 file - promoters60/1394884
atttgttt

SEQ ID NO: 48781 - DNA, 9 bp, Unknown
  misc_feature (1)..( 9): Matrix.002 file - promoters60/1394884
taatcttag

SEQ ID NO: 48782 - DNA, 6 bp, Unknown
  misc_feature (1)..( 6): Matrix.002 file - promoters60/1394884
tataat

SEQ ID NO: 48783 - DNA, 11 bp, Unknown
  misc_feature (1)..( 11): Matrix.002 file - promoters60/1394884
aaatttatata

SEQ ID NO: 48784 - DNA, 6 bp, Unknown
  misc_feature (1)..( 6): Matrix.002 file - promoters60/1394884
atttaa

SEQ ID NO: 48785 - DNA, 10 bp, Unknown
  misc_feature (1)..( 10): Matrix.002 file - promoters60/1394884
gaattatatc

SEQ ID NO: 48786 - DNA, 9 bp, Unknown
  misc_feature (1)..( 9): Matrix.002 file - promoters60/1394884
atttgtata

SEQ ID NO: 48787 - DNA, 7 bp, Unknown
  misc_feature (1)..( 7): Matrix.002 file - promoters60/1394884
aatttaa

SEQ ID NO: 48788 - DNA, 8 bp, Unknown
  misc_feature (1)..( 8): Matrix.002 file - promoters60/1395001
ttgtattc

SEQ ID NO: 48789 - DNA, 7 bp, Unknown
  misc_feature (1)..( 7): Matrix.002 file - promoters60/1395027
ttaaata

SEQ ID NO: 48790 - DNA, 7 bp, Unknown
  misc_feature (1)..( 7): Matrix.002 file - promoters60/1395027
ccaattt

SEQ ID NO: 48791 - DNA, 7 bp, Unknown
  misc_feature (1)..( 7): Matrix.002 file - promoters60/1395027
tttctat

SEQ ID NO: 48792 - DNA, 8 bp, Unknown
  misc_feature (1)..( 8): Matrix.002 file - promoters60/1395027
aaaacaaa

SEQ ID NO: 48793 - DNA, 6 bp, Unknown
  misc_feature (1)..( 6): Matrix.002 file - promoters60/1395027
gatttt

SEQ ID NO: 48794 - DNA, 7 bp, Unknown
  misc_feature (1)..( 7): Matrix.002 file - promoters60/1395027
cattttt

SEQ ID NO: 48795 - DNA, 11 bp, Unknown
  misc_feature (1)..( 11): Matrix.002 file - promoters60/1395027
aataaaaaata

SEQ ID NO: 48796 - DNA, 7 bp, Unknown
  misc_feature (1)..( 7): Matrix.002 file - promoters60/1395027
agaaaat

SEQ ID NO: 48797 - DNA, 7 bp, Unknown
  misc_feature (1)..( 7): Matrix.002 file - promoters60/1395027
agcaaat

SEQ ID NO: 48798 - DNA, 7 bp, Unknown
  misc_feature (1)..( 7): Matrix.002 file - promoters60/1395027
ttaaagt

SEQ ID NO: 48799 - DNA, 9 bp, Unknown
  misc_feature (1)..( 9): Matrix.002 file - promoters60/1395027
taaactaat

SEQ ID NO: 48800 - DNA, 10 bp, Unknown
  misc_feature (1)..( 10): Matrix.002 file - promoters60/1395027
ataaataata

SEQ ID NO: 48801 - DNA, 7 bp, Unknown
  misc_feature (1)..( 7): Matrix.002 file - promoters60/1395027
ttggtct

SEQ ID NO: 48802 - DNA, 6 bp, Unknown
  misc_feature (1)..( 6): Matrix.002 file - promoters60/1395027
aaataa

SEQ ID NO: 48803 - DNA, 7 bp, Unknown
  misc_feature (1)..( 7): Matrix.002 file - promoters60/1395027
atacaaa

SEQ ID NO: 48804 - DNA, 7 bp, Unknown
  misc_feature (1)..( 7): Matrix.002 file - promoters60/1395027
tataatt

SEQ ID NO: 48805 - DNA, 8 bp, Unknown
  misc_feature (1)..( 8): Matrix.002 file - promoters60/1395027
acaaattg

SEQ ID NO: 48806 - DNA, 7 bp, Unknown
  misc_feature (1)..( 7): Matrix.002 file - promoters60/1395066
gcaatag

SEQ ID NO: 48807 - DNA, 7 bp, Unknown
  misc_feature (1)..( 7): Matrix.002 file - promoters60/1395066
aaactat

SEQ ID NO: 48808 - DNA, 6 bp, Unknown
  misc_feature (1)..( 6): Matrix.002 file - promoters60/1395066
aaaata

SEQ ID NO: 48809 - DNA, 11 bp, Unknown
  misc_feature (1)..( 11): Matrix.002 file - promoters60/1395066
aaaaagagacc

SEQ ID NO: 48810 - DNA, 6 bp, Unknown
  misc_feature (1)..( 6): Matrix.002 file - promoters60/1395066
gaattt

SEQ ID NO: 48811 - DNA, 8 bp, Unknown
  misc_feature (1)..( 8): Matrix.002 file - promoters60/1395066
aaagttga

SEQ ID NO: 48812 - DNA, 9 bp, Unknown
  misc_feature (1)..( 9): Matrix.002 file - promoters60/1395066
atttaatta

SEQ ID NO: 48813 - DNA, 7 bp, Unknown
  misc_feature (1)..( 7): Matrix.002 file - promoters60/1395066
actatag

SEQ ID NO: 48814 - DNA, 7 bp, Unknown
  misc_feature (1)..( 7): Matrix.002 file - promoters60/1395066
tattctt

SEQ ID NO: 48815 - DNA, 7 bp, Unknown
  misc_feature (1)..( 7): Matrix.002 file - promoters60/1395066
tgtgaaa

SEQ ID NO: 48816 - DNA, 9 bp, Unknown
  misc_feature (1)..( 9): Matrix.002 file - promoters60/1395066
tttattcaa

SEQ ID NO: 48817 - DNA, 6 bp, Unknown
  misc_feature (1)..( 6): Matrix.002 file - promoters60/1395066
ttatct

SEQ ID NO: 48818 - DNA, 9 bp, Unknown
  misc_feature (1)..( 9): Matrix.002 file - promoters60/1395066
gaaaactat

SEQ ID NO: 48819 - DNA, 10 bp, Unknown
  misc_feature (1)..( 10): Matrix.002 file - promoters60/1395066
ctagacatcc

SEQ ID NO: 48820 - DNA, 15 bp, Unknown
  misc_feature (1)..( 15): Matrix.002 file - promoters60/1395066
ttagcttattgacgt

SEQ ID NO: 48821 - DNA, 7 bp, Unknown
  misc_feature (1)..( 7): Matrix.002 file - promoters60/1395066
tagtttg

SEQ ID NO: 48822 - DNA, 15 bp, Unknown
  misc_feature (1)..( 15): Matrix.002 file - promoters60/1395066
tttgaaagatgcatc

SEQ ID NO: 48823 - DNA, 28 bp, Unknown
  misc_feature (1)..( 28): Matrix.002 file - promoters60/1395066
agaactactcagacaggtaaaagtagaa

SEQ ID NO: 48824 - DNA, 6 bp, Unknown
  misc_feature (1)..( 6): Matrix.002 file - promoters60/1395066
gtgtga

SEQ ID NO: 48825 - DNA, 11 bp, Unknown
  misc_feature (1)..( 11): Matrix.002 file - promoters60/1395066
attatatgtta

SEQ ID NO: 48826 - DNA, 6 bp, Unknown
  misc_feature (1)..( 6): Matrix.002 file - promoters60/1395066
taaact

SEQ ID NO: 48827 - DNA, 10 bp, Unknown
  misc_feature (1)..( 10): Matrix.002 file - promoters60/1395066
aagatatata

SEQ ID NO: 48828 - DNA, 16 bp, Unknown
  misc_feature (1)..( 16): Matrix.002 file - promoters60/1395066
aatggaagataaaaac

SEQ ID NO: 48829 - DNA, 8 bp, Unknown
  misc_feature (1)..( 8): Matrix.002 file - promoters60/1395066
ttagtctg

SEQ ID NO: 48830 - DNA, 14 bp, Unknown
  misc_feature (1)..( 14): Matrix.002 file - promoters60/1395066
tttggaaatgagta

SEQ ID NO: 48831 - DNA, 22 bp, Unknown
  misc_feature (1)..( 22): Matrix.002 file - promoters60/1395066
agatattggcatctagagttac

SEQ ID NO: 48832 - DNA, 9 bp, Unknown
  misc_feature (1)..( 9): Matrix.002 file - promoters60/1395066
taccatgga

SEQ ID NO: 48833 - DNA, 8 bp, Unknown
  misc_feature (1)..( 8): Matrix.002 file - promoters60/1395066
caaaagtc

SEQ ID NO: 48834 - DNA, 13 bp, Unknown
  misc_feature (1)..( 13): Matrix.002 file - promoters60/1395066
gtgaaaatgctac

SEQ ID NO: 48835 - DNA, 11 bp, Unknown
  misc_feature (1)..( 11): Matrix.002 file - promoters60/1395066
aagcatttaca

SEQ ID NO: 48836 - DNA, 10 bp, Unknown
  misc_feature (1)..( 10): Matrix.002 file - promoters60/1395066
cggtaaaaaa

SEQ ID NO: 48837 - DNA, 11 bp, Unknown
  misc_feature (1)..( 11): Matrix.002 file - promoters60/1395095
actactaaaaa

SEQ ID NO: 48838 - DNA, 10 bp, Unknown
  misc_feature (1)..( 10): Matrix.002 file - promoters60/1395095
taaaataaga

SEQ ID NO: 48839 - DNA, 7 bp, Unknown
  misc_feature (1)..( 7): Matrix.002 file - promoters60/1395095
aatagat

SEQ ID NO: 48840 - DNA, 9 bp, Unknown
  misc_feature (1)..( 9): Matrix.002 file - promoters60/1395095
ctttgtttc

SEQ ID NO: 48841 - DNA, 7 bp, Unknown
  misc_feature (1)..( 7): Matrix.002 file - promoters60/1395095
aaaaaaa

SEQ ID NO: 48842 - DNA, 11 bp, Unknown
  misc_feature (1)..( 11): Matrix.002 file - promoters60/1395095
caaattttttt

SEQ ID NO: 48843 - DNA, 8 bp, Unknown
  misc_feature (1)..( 8): Matrix.002 file - promoters60/1395095
aaagtctt

SEQ ID NO: 48844 - DNA, 8 bp, Unknown
  misc_feature (1)..( 8): Matrix.002 file - promoters60/1395095
catttttt

SEQ ID NO: 48845 - DNA, 8 bp, Unknown
  misc_feature (1)..( 8): Matrix.002 file - promoters60/1395095
aaaattct

SEQ ID NO: 48846 - DNA, 8 bp, Unknown
  misc_feature (1)..( 8): Matrix.002 file - promoters60/1395095
tataaata

SEQ ID NO: 48847 - DNA, 7 bp, Unknown
  misc_feature (1)..( 7): Matrix.002 file - promoters60/1395215
aatgaca

SEQ ID NO: 48848 - DNA, 6 bp, Unknown
  misc_feature (1)..( 6): Matrix.002 file - promoters60/1395215
attcaa

SEQ ID NO: 48849 - DNA, 7 bp, Unknown
  misc_feature (1)..( 7): Matrix.002 file - promoters60/1395215
aaaattg

SEQ ID NO: 48850 - DNA, 8 bp, Unknown
  misc_feature (1)..( 8): Matrix.002 file - promoters60/1395215
ttgttagt

SEQ ID NO: 48851 - DNA, 8 bp, Unknown
  misc_feature (1)..( 8): Matrix.002 file - promoters60/1395215
taatctcc

SEQ ID NO: 48852 - DNA, 8 bp, Unknown
  misc_feature (1)..( 8): Matrix.002 file - promoters60/1395215
taaaaaga

SEQ ID NO: 48853 - DNA, 6 bp, Unknown
  misc_feature (1)..( 6): Matrix.002 file - promoters60/1395215
gagaac

SEQ ID NO: 48854 - DNA, 8 bp, Unknown
  misc_feature (1)..( 8): Matrix.002 file - promoters60/1395215
gaaacaaa

SEQ ID NO: 48855 - DNA, 6 bp, Unknown
  misc_feature (1)..( 6): Matrix.002 file - promoters60/1395215
tattaa

SEQ ID NO: 48856 - DNA, 6 bp, Unknown
  misc_feature (1)..( 6): Matrix.002 file - promoters60/1395215
ttatct

SEQ ID NO: 48857 - DNA, 6 bp, Unknown
  misc_feature (1)..( 6): Matrix.002 file - promoters60/1395215
attgtg

SEQ ID NO: 48858 - DNA, 6 bp, Unknown
  misc_feature (1)..( 6): Matrix.002 file - promoters60/1395215
taataa

SEQ ID NO: 48859 - DNA, 6 bp, Unknown
  misc_feature (1)..( 6): Matrix.002 file - promoters60/1395215
agtaaa

SEQ ID NO: 48860 - DNA, 7 bp, Unknown
  misc_feature (1)..( 7): Matrix.002 file - promoters60/1395215
aatcggg

SEQ ID NO: 48861 - DNA, 10 bp, Unknown
  misc_feature (1)..( 10): Matrix.002 file - promoters60/1395215
ggaaaagaaa

SEQ ID NO: 48862 - DNA, 7 bp, Unknown
  misc_feature (1)..( 7): Matrix.002 file - promoters60/1395215
cccacta

SEQ ID NO: 48863 - DNA, 9 bp, Unknown
  misc_feature (1)..( 9): Matrix.002 file - promoters60/1395215
aaagaaaag

SEQ ID NO: 48864 - DNA, 7 bp, Unknown
  misc_feature (1)..( 7): Matrix.002 file - promoters60/1395215
gtatata

SEQ ID NO: 48865 - DNA, 7 bp, Unknown
  misc_feature (1)..( 7): Matrix.002 file - promoters60/1395254
ttaagaa

SEQ ID NO: 48866 - DNA, 7 bp, Unknown
  misc_feature (1)..( 7): Matrix.002 file - promoters60/1395254
tttgctt

SEQ ID NO: 48867 - DNA, 10 bp, Unknown
  misc_feature (1)..( 10): Matrix.002 file - promoters60/1395254
acttttgaaa

SEQ ID NO: 48868 - DNA, 8 bp, Unknown
  misc_feature (1)..( 8): Matrix.002 file - promoters60/1395254
attcttat

SEQ ID NO: 48869 - DNA, 9 bp, Unknown
  misc_feature (1)..( 9): Matrix.002 file - promoters60/1395254
ttttttatt

SEQ ID NO: 48870 - DNA, 8 bp, Unknown
  misc_feature (1)..( 8): Matrix.002 file - promoters60/1395254
tctcgtta

SEQ ID NO: 48871 - DNA, 6 bp, Unknown
  misc_feature (1)..( 6): Matrix.002 file - promoters60/1395254
atcttg

SEQ ID NO: 48872 - DNA, 7 bp, Unknown
  misc_feature (1)..( 7): Matrix.002 file - promoters60/1395254
ttgtttg

SEQ ID NO: 48873 - DNA, 8 bp, Unknown
  misc_feature (1)..( 8): Matrix.002 file - promoters60/1395254
gagatctc

SEQ ID NO: 48874 - DNA, 6 bp, Unknown
  misc_feature (1)..( 6): Matrix.002 file - promoters60/1395254
tttata

SEQ ID NO: 48875 - DNA, 7 bp, Unknown
  misc_feature (1)..( 7): Matrix.002 file - promoters60/1395254
taagtta

SEQ ID NO: 48876 - DNA, 7 bp, Unknown
  misc_feature (1)..( 7): Matrix.002 file - promoters60/1395254
gaaatga

SEQ ID NO: 48877 - DNA, 9 bp, Unknown
  misc_feature (1)..( 9): Matrix.002 file - promoters60/1395254
tctaattaa

SEQ ID NO: 48878 - DNA, 6 bp, Unknown
  misc_feature (1)..( 6): Matrix.002 file - promoters60/1395254
aaacag

SEQ ID NO: 48879 - DNA, 6 bp, Unknown
  misc_feature (1)..( 6): Matrix.002 file - promoters60/1395254
tccact

SEQ ID NO: 48880 - DNA, 8 bp, Unknown
  misc_feature (1)..( 8): Matrix.002 file - promoters60/1395254
attaatga

SEQ ID NO: 48881 - DNA, 7 bp, Unknown
  misc_feature (1)..( 7): Matrix.002 file - promoters60/1395254
taacaga

SEQ ID NO: 48882 - DNA, 6 bp, Unknown
  misc_feature (1)..( 6): Matrix.002 file - promoters60/1395254
cgggtc

SEQ ID NO: 48883 - DNA, 10 bp, Unknown
  misc_feature (1)..( 10): Matrix.002 file - promoters60/1395485
ataataattt

SEQ ID NO: 48884 - DNA, 12 bp, Unknown
  misc_feature (1)..( 12): Matrix.002 file - promoters60/1395485
taaactttttgt

SEQ ID NO: 48885 - DNA, 7 bp, Unknown
  misc_feature (1)..( 7): Matrix.002 file - promoters60/1395485
catagat

SEQ ID NO: 48886 - DNA, 7 bp, Unknown
  misc_feature (1)..( 7): Matrix.002 file - promoters60/1395485
atcattt

SEQ ID NO: 48887 - DNA, 8 bp, Unknown
  misc_feature (1)..( 8): Matrix.002 file - promoters60/1395485
actaaatt

SEQ ID NO: 48888 - DNA, 8 bp, Unknown
  misc_feature (1)..( 8): Matrix.002 file - promoters60/1395485
aggcactt

SEQ ID NO: 48889 - DNA, 7 bp, Unknown
  misc_feature (1)..( 7): Matrix.002 file - promoters60/1395485
gaaaaat

SEQ ID NO: 48890 - DNA, 8 bp, Unknown
  misc_feature (1)..( 8): Matrix.002 file - promoters60/1395485
tgtttact

SEQ ID NO: 48891 - DNA, 8 bp, Unknown
  misc_feature (1)..( 8): Matrix.002 file - promoters60/1395485
tgttaatc

SEQ ID NO: 48892 - DNA, 8 bp, Unknown
  misc_feature (1)..( 8): Matrix.002 file - promoters60/1395485
aaaatctc

SEQ ID NO: 48893 - DNA, 6 bp, Unknown
  misc_feature (1)..( 6): Matrix.002 file - promoters60/1395485
cttctt

SEQ ID NO: 48894 - DNA, 6 bp, Unknown
  misc_feature (1)..( 6): Matrix.002 file - promoters60/1395485
catctc

SEQ ID NO: 48895 - DNA, 6 bp, Unknown
  misc_feature (1)..( 6): Matrix.002 file - promoters60/1395485
agtttt

SEQ ID NO: 48896 - DNA, 7 bp, Unknown
  misc_feature (1)..( 7): Matrix.002 file - promoters60/1395485
acaaaaa

SEQ ID NO: 48897 - DNA, 7 bp, Unknown
  misc_feature (1)..( 7): Matrix.002 file - promoters60/1395568
gagaaat

SEQ ID NO: 48898 - DNA, 7 bp, Unknown
  misc_feature (1)..( 7): Matrix.002 file - promoters60/1395568
aaaagga

SEQ ID NO: 48899 - DNA, 9 bp, Unknown
  misc_feature (1)..( 9): Matrix.002 file - promoters60/1395568
tgtaaataa

SEQ ID NO: 48900 - DNA, 8 bp, Unknown
  misc_feature (1)..( 8): Matrix.002 file - promoters60/1395568
cagtataa

SEQ ID NO: 48901 - DNA, 6 bp, Unknown
  misc_feature (1)..( 6): Matrix.002 file - promoters60/1395568
aaatgt

SEQ ID NO: 48902 - DNA, 8 bp, Unknown
  misc_feature (1)..( 8): Matrix.002 file - promoters60/1395568
ggcggcga

SEQ ID NO: 48903 - DNA, 7 bp, Unknown
  misc_feature (1)..( 7): Matrix.002 file - promoters60/1395568
gagccaa

SEQ ID NO: 48904 - DNA, 8 bp, Unknown
  misc_feature (1)..( 8): Matrix.002 file - promoters60/1395568
atctatat

SEQ ID NO: 48905 - DNA, 6 bp, Unknown
  misc_feature (1)..( 6): Matrix.002 file - promoters60/1395568
gataat

SEQ ID NO: 48906 - DNA, 7 bp, Unknown
  misc_feature (1)..( 7): Matrix.002 file - promoters60/1395636
tttttac

SEQ ID NO: 48907 - DNA, 13 bp, Unknown
  misc_feature (1)..( 13): Matrix.002 file - promoters60/1395636
ctcgtataaattg

SEQ ID NO: 48908 - DNA, 11 bp, Unknown
  misc_feature (1)..( 11): Matrix.002 file - promoters60/1395636
aaataggaata

SEQ ID NO: 48909 - DNA, 8 bp, Unknown
  misc_feature (1)..( 8): Matrix.002 file - promoters60/1395781
taaaaaaa

SEQ ID NO: 48910 - DNA, 9 bp, Unknown
  misc_feature (1)..( 9): Matrix.002 file - promoters60/1395781
acaaaaatt

SEQ ID NO: 48911 - DNA, 9 bp, Unknown
  misc_feature (1)..( 9): Matrix.002 file - promoters60/1395781
catttttgt

SEQ ID NO: 48912 - DNA, 10 bp, Unknown
  misc_feature (1)..( 10): Matrix.002 file - promoters60/1395781
aaaatgttac

SEQ ID NO: 48913 - DNA, 9 bp, Unknown
  misc_feature (1)..( 9): Matrix.002 file - promoters60/1395781
tctataaaa

SEQ ID NO: 48914 - DNA, 12 bp, Unknown
  misc_feature (1)..( 12): Matrix.002 file - promoters60/1395781
ctggatgtacat

SEQ ID NO: 48915 - DNA, 14 bp, Unknown
  misc_feature (1)..( 14): Matrix.002 file - promoters60/1395824
aaaatattaaaaat

SEQ ID NO: 48916 - DNA, 10 bp, Unknown
  misc_feature (1)..( 10): Matrix.002 file - promoters60/1395824
tacaaacata

SEQ ID NO: 48917 - DNA, 12 bp, Unknown
  misc_feature (1)..( 12): Matrix.002 file - promoters60/1395824
aagcaataaacg

SEQ ID NO: 48918 - DNA, 9 bp, Unknown
  misc_feature (1)..( 9): Matrix.002 file - promoters60/1395824
ctagtcaca

SEQ ID NO: 48919 - DNA, 10 bp, Unknown
  misc_feature (1)..( 10): Matrix.002 file - promoters60/1395824
tacaaatata

SEQ ID NO: 48920 - DNA, 8 bp, Unknown
  misc_feature (1)..( 8): Matrix.002 file - promoters60/1395832
ttatataa

SEQ ID NO: 48921 - DNA, 12 bp, Unknown
  misc_feature (1)..( 12): Matrix.002 file - promoters60/1395832
tgaaaaagtaat

SEQ ID NO: 48922 - DNA, 7 bp, Unknown
  misc_feature (1)..( 7): Matrix.002 file - promoters60/1395832
tatttaa

SEQ ID NO: 48923 - DNA, 8 bp, Unknown
  misc_feature (1)..( 8): Matrix.002 file - promoters60/1395839
ggataaaa

SEQ ID NO: 48924 - DNA, 8 bp, Unknown
  misc_feature (1)..( 8): Matrix.002 file - promoters60/1395839
caaataaa

SEQ ID NO: 48925 - DNA, 9 bp, Unknown
  misc_feature (1)..( 9): Matrix.002 file - promoters60/1395839
taaataaaa

SEQ ID NO: 48926 - DNA, 11 bp, Unknown
  misc_feature (1)..( 11): Matrix.002 file - promoters60/1395839
atttttgtttg

SEQ ID NO: 48927 - DNA, 9 bp, Unknown
  misc_feature (1)..( 9): Matrix.002 file - promoters60/1395839
aaataactt

SEQ ID NO: 48928 - DNA, 6 bp, Unknown
  misc_feature (1)..( 6): Matrix.002 file - promoters60/1395958
accaaa

SEQ ID NO: 48929 - DNA, 7 bp, Unknown
  misc_feature (1)..( 7): Matrix.002 file - promoters60/1395958
taaaaat

SEQ ID NO: 48930 - DNA, 6 bp, Unknown
  misc_feature (1)..( 6): Matrix.002 file - promoters60/1395958
aaaaat

SEQ ID NO: 48931 - DNA, 7 bp, Unknown
  misc_feature (1)..( 7): Matrix.002 file - promoters60/1395958
attttaa

SEQ ID NO: 48932 - DNA, 6 bp, Unknown
  misc_feature (1)..( 6): Matrix.002 file - promoters60/1395958
gtaaaa

SEQ ID NO: 48933 - DNA, 6 bp, Unknown
  misc_feature (1)..( 6): Matrix.002 file - promoters60/1395958
cgaata

SEQ ID NO: 48934 - DNA, 6 bp, Unknown
  misc_feature (1)..( 6): Matrix.002 file - promoters60/1395958
ctgaaa

SEQ ID NO: 48935 - DNA, 6 bp, Unknown
  misc_feature (1)..( 6): Matrix.002 file - promoters60/1395958
tgttta

SEQ ID NO: 48936 - DNA, 11 bp, Unknown
  misc_feature (1)..( 11): Matrix.002 file - promoters60/1395958
gttaacaagtc

SEQ ID NO: 48937 - DNA, 6 bp, Unknown
  misc_feature (1)..( 6): Matrix.002 file - promoters60/1395958
agaaat

SEQ ID NO: 48938 - DNA, 9 bp, Unknown
  misc_feature (1)..( 9): Matrix.002 file - promoters60/1395958
taatcaaag

SEQ ID NO: 48939 - DNA, 7 bp, Unknown
  misc_feature (1)..( 7): Matrix.002 file - promoters60/1395958
ttaattt

SEQ ID NO: 48940 - DNA, 7 bp, Unknown
  misc_feature (1)..( 7): Matrix.002 file - promoters60/1395958
tttcaaa

SEQ ID NO: 48941 - DNA, 8 bp, Unknown
  misc_feature (1)..( 8): Matrix.002 file - promoters60/1395958
aaaggtga

SEQ ID NO: 48942 - DNA, 6 bp, Unknown
  misc_feature (1)..( 6): Matrix.002 file - promoters60/1395958
tttcga

SEQ ID NO: 48943 - DNA, 8 bp, Unknown
  misc_feature (1)..( 8): Matrix.002 file - promoters60/1395958
tagagaat

SEQ ID NO: 48944 - DNA, 8 bp, Unknown
  misc_feature (1)..( 8): Matrix.002 file - promoters60/1395958
aacaaaaa

SEQ ID NO: 48945 - DNA, 6 bp, Unknown
  misc_feature (1)..( 6): Matrix.002 file - promoters60/1395958
aaaaca

SEQ ID NO: 48946 - DNA, 7 bp, Unknown
  misc_feature (1)..( 7): Matrix.002 file - promoters60/1395958
gaaaaat

SEQ ID NO: 48947 - DNA, 7 bp, Unknown
  misc_feature (1)..( 7): Matrix.002 file - promoters60/1395958
attacag

SEQ ID NO: 48948 - DNA, 7 bp, Unknown
  misc_feature (1)..( 7): Matrix.002 file - promoters60/1395958
cgctgtt

SEQ ID NO: 48949 - DNA, 8 bp, Unknown
  misc_feature (1)..( 8): Matrix.002 file - promoters60/1395972
aattagta

SEQ ID NO: 48950 - DNA, 7 bp, Unknown
  misc_feature (1)..( 7): Matrix.002 file - promoters60/1395972
taaaata

SEQ ID NO: 48951 - DNA, 6 bp, Unknown
  misc_feature (1)..( 6): Matrix.002 file - promoters60/1395972
actaaa

SEQ ID NO: 48952 - DNA, 9 bp, Unknown
  misc_feature (1)..( 9): Matrix.002 file - promoters60/1395972
tcacgtaca

SEQ ID NO: 48953 - DNA, 11 bp, Unknown
  misc_feature (1)..( 11): Matrix.002 file - promoters60/1395972
ttcaaataaaa

SEQ ID NO: 48954 - DNA, 7 bp, Unknown
  misc_feature (1)..( 7): Matrix.002 file - promoters60/1395972
gcaaaac

SEQ ID NO: 48955 - DNA, 8 bp, Unknown
  misc_feature (1)..( 8): Matrix.002 file - promoters60/1395972
aaaataga

SEQ ID NO: 48956 - DNA, 6 bp, Unknown
  misc_feature (1)..( 6): Matrix.002 file - promoters60/1395972
ttatat

SEQ ID NO: 48957 - DNA, 6 bp, Unknown
  misc_feature (1)..( 6): Matrix.002 file - promoters60/1395972
ataaaa

SEQ ID NO: 48958 - DNA, 6 bp, Unknown
  misc_feature (1)..( 6): Matrix.002 file - promoters60/1395972
aagaaa

SEQ ID NO: 48959 - DNA, 9 bp, Unknown
  misc_feature (1)..( 9): Matrix.002 file - promoters60/1395972
aaaactcaa

SEQ ID NO: 48960 - DNA, 9 bp, Unknown
  misc_feature (1)..( 9): Matrix.002 file - promoters60/1395972
aaaaaaaaa

SEQ ID NO: 48961 - DNA, 9 bp, Unknown
  misc_feature (1)..( 9): Matrix.002 file - promoters60/1395972
catataact

SEQ ID NO: 48962 - DNA, 8 bp, Unknown
  misc_feature (1)..( 8): Matrix.002 file - promoters60/1395972
taaacatt

SEQ ID NO: 48963 - DNA, 6 bp, Unknown
  misc_feature (1)..( 6): Matrix.002 file - promoters60/1395972
attttc

SEQ ID NO: 48964 - DNA, 6 bp, Unknown
  misc_feature (1)..( 6): Matrix.002 file - promoters60/1395972
caaaat

SEQ ID NO: 48965 - DNA, 7 bp, Unknown
  misc_feature (1)..( 7): Matrix.002 file - promoters60/1395972
tatcttc

SEQ ID NO: 48966 - DNA, 8 bp, Unknown
  misc_feature (1)..( 8): Matrix.002 file - promoters60/1395972
ttgccaaa

SEQ ID NO: 48967 - DNA, 6 bp, Unknown
  misc_feature (1)..( 6): Matrix.002 file - promoters60/1395972
caaaat

SEQ ID NO: 48968 - DNA, 6 bp, Unknown
  misc_feature (1)..( 6): Matrix.002 file - promoters60/1395972
agacaa

SEQ ID NO: 48969 - DNA, 6 bp, Unknown
  misc_feature (1)..( 6): Matrix.002 file - promoters60/1395972
agctaa

SEQ ID NO: 48970 - DNA, 12 bp, Unknown
  misc_feature (1)..( 12): Matrix.002 file - promoters60/1395972
aaagaaagggaa

SEQ ID NO: 48971 - DNA, 9 bp, Unknown
  misc_feature (1)..( 9): Matrix.002 file - promoters60/1395972
acattttca

SEQ ID NO: 48972 - DNA, 6 bp, Unknown
  misc_feature (1)..( 6): Matrix.002 file - promoters60/1395972
tcttct

SEQ ID NO: 48973 - DNA, 6 bp, Unknown
  misc_feature (1)..( 6): Matrix.002 file - promoters60/1395972
tcaaaa

SEQ ID NO: 48974 - DNA, 6 bp, Unknown
  misc_feature (1)..( 6): Matrix.002 file - promoters60/1395972
agaaag

SEQ ID NO: 48975 - DNA, 7 bp, Unknown
  misc_feature (1)..( 7): Matrix.002 file - promoters60/1395972
aagaaaa

SEQ ID NO: 48976 - DNA, 7 bp, Unknown
  misc_feature (1)..( 7): Matrix.002 file - promoters60/1395972
aaataaa

SEQ ID NO: 48977 - DNA, 7 bp, Unknown
  misc_feature (1)..( 7): Matrix.002 file - promoters60/1395972
ataaatg

SEQ ID NO: 48978 - DNA, 9 bp, Unknown
  misc_feature (1)..( 9): Matrix.002 file - promoters60/1396038
cctctttat

SEQ ID NO: 48979 - DNA, 6 bp, Unknown
  misc_feature (1)..( 6): Matrix.002 file - promoters60/1396038
tataaa

SEQ ID NO: 48980 - DNA, 16 bp, Unknown
  misc_feature (1)..( 16): Matrix.002 file - promoters60/1396038
cattttattttagatt

SEQ ID NO: 48981 - DNA, 10 bp, Unknown
  misc_feature (1)..( 10): Matrix.002 file - promoters60/1396085
tcaaattttc

SEQ ID NO: 48982 - DNA, 4 bp, Unknown
  misc_feature (1)..( 4): Matrix.002 file - promoters60/1396085
aaac

SEQ ID NO: 48983 - DNA, 11 bp, Unknown
  misc_feature (1)..( 11): Matrix.002 file - promoters60/1396085
tttgtactgat

SEQ ID NO: 48984 - DNA, 5 bp, Unknown
  misc_feature (1)..( 5): Matrix.002 file - promoters60/1396085
ttttt

SEQ ID NO: 48985 - DNA, 8 bp, Unknown
  misc_feature (1)..( 8): Matrix.002 file - promoters60/1396085
ataatatt

SEQ ID NO: 48986 - DNA, 10 bp, Unknown
  misc_feature (1)..( 10): Matrix.002 file - promoters60/1396085
atttcttaat

SEQ ID NO: 48987 - DNA, 12 bp, Unknown
  misc_feature (1)..( 12): Matrix.002 file - promoters60/1396085
aaatttgtagta

SEQ ID NO: 48988 - DNA, 6 bp, Unknown
  misc_feature (1)..( 6): Matrix.002 file - promoters60/1396085
atattt

SEQ ID NO: 48989 - DNA, 11 bp, Unknown
  misc_feature (1)..( 11): Matrix.002 file - promoters60/1396085
cataattaaac

SEQ ID NO: 48990 - DNA, 11 bp, Unknown
  misc_feature (1)..( 11): Matrix.002 file - promoters60/1396085
ttaccatttct

SEQ ID NO: 48991 - DNA, 7 bp, Unknown
  misc_feature (1)..( 7): Matrix.002 file - promoters60/1396104
tatcaaa

SEQ ID NO: 48992 - DNA, 6 bp, Unknown
  misc_feature (1)..( 6): Matrix.002 file - promoters60/1396123
aatata

SEQ ID NO: 48993 - DNA, 7 bp, Unknown
  misc_feature (1)..( 7): Matrix.002 file - promoters60/1396123
ttaatat

SEQ ID NO: 48994 - DNA, 6 bp, Unknown
  misc_feature (1)..( 6): Matrix.002 file - promoters60/1396123
tattaa

SEQ ID NO: 48995 - DNA, 6 bp, Unknown
  misc_feature (1)..( 6): Matrix.002 file - promoters60/1396123
tatatt

SEQ ID NO: 48996 - DNA, 7 bp, Unknown
  misc_feature (1)..( 7): Matrix.002 file - promoters60/1396123
attatca

SEQ ID NO: 48997 - DNA, 6 bp, Unknown
  misc_feature (1)..( 6): Matrix.002 file - promoters60/1396123
aataaa

SEQ ID NO: 48998 - DNA, 11 bp, Unknown
  misc_feature (1)..( 11): Matrix.002 file - promoters60/1396123
ataaacgcaaa

SEQ ID NO: 48999 - DNA, 8 bp, Unknown
  misc_feature (1)..( 8): Matrix.002 file - promoters60/1396123
ctgaaata

SEQ ID NO: 49000 - DNA, 6 bp, Unknown
  misc_feature (1)..( 6): Matrix.002 file - promoters60/1396123
aaacct

SEQ ID NO: 49001 - DNA, 6 bp, Unknown
  misc_feature (1)..( 6): Matrix.002 file - promoters60/1396123
aaatag

SEQ ID NO: 49002 - DNA, 6 bp, Unknown
  misc_feature (1)..( 6): Matrix.002 file - promoters60/1396123
aacacg

SEQ ID NO: 49003 - DNA, 9 bp, Unknown
  misc_feature (1)..( 9): Matrix.002 file - promoters60/1396123
aatactttg

SEQ ID NO: 49004 - DNA, 7 bp, Unknown
  misc_feature (1)..( 7): Matrix.002 file - promoters60/1396123
acaaaaa

SEQ ID NO: 49005 - DNA, 8 bp, Unknown
  misc_feature (1)..( 8): Matrix.002 file - promoters60/1396123
aaaaaata

SEQ ID NO: 49006 - DNA, 7 bp, Unknown
  misc_feature (1)..( 7): Matrix.002 file - promoters60/1396123
atagagg

SEQ ID NO: 49007 - DNA, 6 bp, Unknown
  misc_feature (1)..( 6): Matrix.002 file - promoters60/1396123
tgaaga

SEQ ID NO: 49008 - DNA, 7 bp, Unknown
  misc_feature (1)..( 7): Matrix.002 file - promoters60/1396123
atcaaag

SEQ ID NO: 49009 - DNA, 7 bp, Unknown
  misc_feature (1)..( 7): Matrix.002 file - promoters60/1396123
acacatg

SEQ ID NO: 49010 - DNA, 7 bp, Unknown
  misc_feature (1)..( 7): Matrix.002 file - promoters60/1396123
ttagatc

SEQ ID NO: 49011 - DNA, 6 bp, Unknown
  misc_feature (1)..( 6): Matrix.002 file - promoters60/1396123
tgtttc

SEQ ID NO: 49012 - DNA, 6 bp, Unknown
  misc_feature (1)..( 6): Matrix.002 file - promoters60/1396123
ttcact

SEQ ID NO: 49013 - DNA, 9 bp, Unknown
  misc_feature (1)..( 9): Matrix.002 file - promoters60/1396123
ggaacactt

SEQ ID NO: 49014 - DNA, 9 bp, Unknown
  misc_feature (1)..( 9): Matrix.002 file - promoters60/1396127
ataaattaa

SEQ ID NO: 49015 - DNA, 8 bp, Unknown
  misc_feature (1)..( 8): Matrix.002 file - promoters60/1396127
aaatttgt

SEQ ID NO: 49016 - DNA, 12 bp, Unknown
  misc_feature (1)..( 12): Matrix.002 file - promoters60/1396147
atattaattata

SEQ ID NO: 49017 - DNA, 13 bp, Unknown
  misc_feature (1)..( 13): Matrix.002 file - promoters60/1396151
ttgaatcaaaatt

SEQ ID NO: 49018 - DNA, 7 bp, Unknown
  misc_feature (1)..( 7): Matrix.002 file - promoters60/1396151
tatccaa

SEQ ID NO: 49019 - DNA, 7 bp, Unknown
  misc_feature (1)..( 7): Matrix.002 file - promoters60/1396151
tttcatt

SEQ ID NO: 49020 - DNA, 8 bp, Unknown
  misc_feature (1)..( 8): Matrix.002 file - promoters60/1396151
aattaatg

SEQ ID NO: 49021 - DNA, 6 bp, Unknown
  misc_feature (1)..( 6): Matrix.002 file - promoters60/1396151
ggttat

SEQ ID NO: 49022 - DNA, 7 bp, Unknown
  misc_feature (1)..( 7): Matrix.002 file - promoters60/1396151
gatttcc

SEQ ID NO: 49023 - DNA, 9 bp, Unknown
  misc_feature (1)..( 9): Matrix.002 file - promoters60/1396151
ttcaaaatt

SEQ ID NO: 49024 - DNA, 7 bp, Unknown
  misc_feature (1)..( 7): Matrix.002 file - promoters60/1396151
agaactc

SEQ ID NO: 49025 - DNA, 7 bp, Unknown
  misc_feature (1)..( 7): Matrix.002 file - promoters60/1396151
tatttct

SEQ ID NO: 49026 - DNA, 6 bp, Unknown
  misc_feature (1)..( 6): Matrix.002 file - promoters60/1396151
ttaatt

SEQ ID NO: 49027 - DNA, 7 bp, Unknown
  misc_feature (1)..( 7): Matrix.002 file - promoters60/1396151
tggattt

SEQ ID NO: 49028 - DNA, 6 bp, Unknown
  misc_feature (1)..( 6): Matrix.002 file - promoters60/1396151
aagatt

SEQ ID NO: 49029 - DNA, 6 bp, Unknown
  misc_feature (1)..( 6): Matrix.002 file - promoters60/1396151
ttggtt

SEQ ID NO: 49030 - DNA, 6 bp, Unknown
  misc_feature (1)..( 6): Matrix.002 file - promoters60/1396151
ttaacc

SEQ ID NO: 49031 - DNA, 7 bp, Unknown
  misc_feature (1)..( 7): Matrix.002 file - promoters60/1396151
ctcactc

SEQ ID NO: 49032 - DNA, 7 bp, Unknown
  misc_feature (1)..( 7): Matrix.002 file - promoters60/1396182
ttttgct

SEQ ID NO: 49033 - DNA, 6 bp, Unknown
  misc_feature (1)..( 6): Matrix.002 file - promoters60/1396182
cttgtg

SEQ ID NO: 49034 - DNA, 9 bp, Unknown
  misc_feature (1)..( 9): Matrix.002 file - promoters60/1396182
aagaataag

SEQ ID NO: 49035 - DNA, 8 bp, Unknown
  misc_feature (1)..( 8): Matrix.002 file - promoters60/1396182
tttattct

SEQ ID NO: 49036 - DNA, 7 bp, Unknown
  misc_feature (1)..( 7): Matrix.002 file - promoters60/1396182
ttctaat

SEQ ID NO: 49037 - DNA, 7 bp, Unknown
  misc_feature (1)..( 7): Matrix.002 file - promoters60/1396182
aaaacaa

SEQ ID NO: 49038 - DNA, 7 bp, Unknown
  misc_feature (1)..( 7): Matrix.002 file - promoters60/1396182
actagat

SEQ ID NO: 49039 - DNA, 6 bp, Unknown
  misc_feature (1)..( 6): Matrix.002 file - promoters60/1396182
atattt

SEQ ID NO: 49040 - DNA, 7 bp, Unknown
  misc_feature (1)..( 7): Matrix.002 file - promoters60/1396182
ataactt

SEQ ID NO: 49041 - DNA, 6 bp, Unknown
  misc_feature (1)..( 6): Matrix.002 file - promoters60/1396182
tccaaa

SEQ ID NO: 49042 - DNA, 7 bp, Unknown
  misc_feature (1)..( 7): Matrix.002 file - promoters60/1396182
cttgaaa

SEQ ID NO: 49043 - DNA, 9 bp, Unknown
  misc_feature (1)..( 9): Matrix.002 file - promoters60/1396182
attgtgatt

SEQ ID NO: 49044 - DNA, 11 bp, Unknown
  misc_feature (1)..( 11): Matrix.002 file - promoters60/1396182
ggaaatgaaat

SEQ ID NO: 49045 - DNA, 7 bp, Unknown
  misc_feature (1)..( 7): Matrix.002 file - promoters60/1396182
tctattg

SEQ ID NO: 49046 - DNA, 8 bp, Unknown
  misc_feature (1)..( 8): Matrix.002 file - promoters60/1396182
aaaaagaa

SEQ ID NO: 49047 - DNA, 7 bp, Unknown
  misc_feature (1)..( 7): Matrix.002 file - promoters60/1396182
gtatata

SEQ ID NO: 49048 - DNA, 7 bp, Unknown
  misc_feature (1)..( 7): Matrix.002 file - promoters60/1396182
aatcggg

SEQ ID NO: 49049 - DNA, 7 bp, Unknown
  misc_feature (1)..( 7): Matrix.002 file - promoters60/1396182
cccacta

SEQ ID NO: 49050 - DNA, 9 bp, Unknown
  misc_feature (1)..( 9): Matrix.002 file - promoters60/1396182
aaagaaaag

SEQ ID NO: 49051 - DNA, 9 bp, Unknown
  misc_feature (1)..( 9): Matrix.002 file - promoters60/1396238
caaaatgac

SEQ ID NO: 49052 - DNA, 11 bp, Unknown
  misc_feature (1)..( 11): Matrix.002 file - promoters60/1396238
acagacataaa

SEQ ID NO: 49053 - DNA, 8 bp, Unknown
  misc_feature (1)..( 8): Matrix.002 file - promoters60/1396238
ataataag

SEQ ID NO: 49054 - DNA, 7 bp, Unknown
  misc_feature (1)..( 7): Matrix.002 file - promoters60/1396238
taaaggg

SEQ ID NO: 49055 - DNA, 9 bp, Unknown
  misc_feature (1)..( 9): Matrix.002 file - promoters60/1396238
aatgacaac

SEQ ID NO: 49056 - DNA, 9 bp, Unknown
  misc_feature (1)..( 9): Matrix.002 file - promoters60/1396238
tatttgtaa

SEQ ID NO: 49057 - DNA, 9 bp, Unknown
  misc_feature (1)..( 9): Matrix.002 file - promoters60/1396238
tatatacga

SEQ ID NO: 49058 - DNA, 10 bp, Unknown
  misc_feature (1)..( 10): Matrix.002 file - promoters60/1396256
aaatttaatt

SEQ ID NO: 49059 - DNA, 9 bp, Unknown
  misc_feature (1)..( 9): Matrix.002 file - promoters60/1396256
ttgttgttt

SEQ ID NO: 49060 - DNA, 12 bp, Unknown
  misc_feature (1)..( 12): Matrix.002 file - promoters60/1396256
tcctataaaaaa

SEQ ID NO: 49061 - DNA, 9 bp, Unknown
  misc_feature (1)..( 9): Matrix.002 file - promoters60/1396256
aattttatt

SEQ ID NO: 49062 - DNA, 10 bp, Unknown
  misc_feature (1)..( 10): Matrix.002 file - promoters60/1396256
taatgtctcg

SEQ ID NO: 49063 - DNA, 10 bp, Unknown
  misc_feature (1)..( 10): Matrix.002 file - promoters60/1396256
aatcttactc

SEQ ID NO: 49064 - DNA, 8 bp, Unknown
  misc_feature (1)..( 8): Matrix.002 file - promoters60/1396256
cacaaaaa

SEQ ID NO: 49065 - DNA, 8 bp, Unknown
  misc_feature (1)..( 8): Matrix.002 file - promoters60/1396256
caaaaaaa

SEQ ID NO: 49066 - DNA, 7 bp, Unknown
  misc_feature (1)..( 7): Matrix.002 file - promoters60/1396296
tatctaa

SEQ ID NO: 49067 - DNA, 7 bp, Unknown
  misc_feature (1)..( 7): Matrix.002 file - promoters60/1396296
atatttg

SEQ ID NO: 49068 - DNA, 7 bp, Unknown
  misc_feature (1)..( 7): Matrix.002 file - promoters60/1396296
tttgaag

SEQ ID NO: 49069 - DNA, 6 bp, Unknown
  misc_feature (1)..( 6): Matrix.002 file - promoters60/1396296
ttgttt

SEQ ID NO: 49070 - DNA, 11 bp, Unknown
  misc_feature (1)..( 11): Matrix.002 file - promoters60/1396296
agacagaaaga

SEQ ID NO: 49071 - DNA, 6 bp, Unknown
  misc_feature (1)..( 6): Matrix.002 file - promoters60/1396296
taataa

SEQ ID NO: 49072 - DNA, 9 bp, Unknown
  misc_feature (1)..( 9): Matrix.002 file - promoters60/1396296
ataaacgaa

SEQ ID NO: 49073 - DNA, 8 bp, Unknown
  misc_feature (1)..( 8): Matrix.002 file - promoters60/1396296
ctaatcac

SEQ ID NO: 49074 - DNA, 7 bp, Unknown
  misc_feature (1)..( 7): Matrix.002 file - promoters60/1396296
taaaggg

SEQ ID NO: 49075 - DNA, 6 bp, Unknown
  misc_feature (1)..( 6): Matrix.002 file - promoters60/1396296
tctctc

SEQ ID NO: 49076 - DNA, 6 bp, Unknown
  misc_feature (1)..( 6): Matrix.002 file - promoters60/1396296
tcatat

SEQ ID NO: 49077 - DNA, 6 bp, Unknown
  misc_feature (1)..( 6): Matrix.002 file - promoters60/1396296
acaatt

SEQ ID NO: 49078 - DNA, 6 bp, Unknown
  misc_feature (1)..( 6): Matrix.002 file - promoters60/1396296
atgatt

SEQ ID NO: 49079 - DNA, 8 bp, Unknown
  misc_feature (1)..( 8): Matrix.002 file - promoters60/1396296
ataaaagt

SEQ ID NO: 49080 - DNA, 8 bp, Unknown
  misc_feature (1)..( 8): Matrix.002 file - promoters60/1396296
ttttcttt

SEQ ID NO: 49081 - DNA, 6 bp, Unknown
  misc_feature (1)..( 6): Matrix.002 file - promoters60/1396296
aaataa

SEQ ID NO: 49082 - DNA, 6 bp, Unknown
  misc_feature (1)..( 6): Matrix.002 file - promoters60/1396296
aattta

SEQ ID NO: 49083 - DNA, 6 bp, Unknown
  misc_feature (1)..( 6): Matrix.002 file - promoters60/1396296
ttttct

SEQ ID NO: 49084 - DNA, 10 bp, Unknown
  misc_feature (1)..( 10): Matrix.002 file - promoters60/1396308
taaaaaggat

SEQ ID NO: 49085 - DNA, 14 bp, Unknown
  misc_feature (1)..( 14): Matrix.002 file - promoters60/1396308
acttataatataat

SEQ ID NO: 49086 - DNA, 9 bp, Unknown
  misc_feature (1)..( 9): Matrix.002 file - promoters60/1396308
atatataat

SEQ ID NO: 49087 - DNA, 9 bp, Unknown
  misc_feature (1)..( 9): Matrix.002 file - promoters60/1396308
aaaatatat

SEQ ID NO: 49088 - DNA, 11 bp, Unknown
  misc_feature (1)..( 11): Matrix.002 file - promoters60/1396308
agaaaatcaat

SEQ ID NO: 49089 - DNA, 11 bp, Unknown
  misc_feature (1)..( 11): Matrix.002 file - promoters60/1396308
tcctattatat

SEQ ID NO: 49090 - DNA, 8 bp, Unknown
  misc_feature (1)..( 8): Matrix.002 file - promoters60/1396308
ttgtatca

SEQ ID NO: 49091 - DNA, 11 bp, Unknown
  misc_feature (1)..( 11): Matrix.002 file - promoters60/1396308
tcaattcaaac

SEQ ID NO: 49092 - DNA, 8 bp, Unknown
  misc_feature (1)..( 8): Matrix.002 file - promoters60/1396308
atttgttt

SEQ ID NO: 49093 - DNA, 8 bp, Unknown
  misc_feature (1)..( 8): Matrix.002 file - promoters60/1396312
aaaaataa

SEQ ID NO: 49094 - DNA, 11 bp, Unknown
  misc_feature (1)..( 11): Matrix.002 file - promoters60/1396312
ttattaacatt

SEQ ID NO: 49095 - DNA, 6 bp, Unknown
  misc_feature (1)..( 6): Matrix.002 file - promoters60/1396312
gattga

SEQ ID NO: 49096 - DNA, 10 bp, Unknown
  misc_feature (1)..( 10): Matrix.002 file - promoters60/1396312
aaacaaaaaa

SEQ ID NO: 49097 - DNA, 10 bp, Unknown
  misc_feature (1)..( 10): Matrix.002 file - promoters60/1396312
aaagaaaata

SEQ ID NO: 49098 - DNA, 8 bp, Unknown
  misc_feature (1)..( 8): Matrix.002 file - promoters60/1396312
aaaaatga

SEQ ID NO: 49099 - DNA, 11 bp, Unknown
  misc_feature (1)..( 11): Matrix.002 file - promoters60/1396312
tatagaaaaaa

SEQ ID NO: 49100 - DNA, 8 bp, Unknown
  misc_feature (1)..( 8): Matrix.002 file - promoters60/1396312
ggaaaaag

SEQ ID NO: 49101 - DNA, 10 bp, Unknown
  misc_feature (1)..( 10): Matrix.002 file - promoters60/1396354
gctgtgtgtc

SEQ ID NO: 49102 - DNA, 9 bp, Unknown
  misc_feature (1)..( 9): Matrix.002 file - promoters60/1396354
actatataa

SEQ ID NO: 49103 - DNA, 9 bp, Unknown
  misc_feature (1)..( 9): Matrix.002 file - promoters60/1396364
attttagtt

SEQ ID NO: 49104 - DNA, 8 bp, Unknown
  misc_feature (1)..( 8): Matrix.002 file - promoters60/1396364
tattaatg

SEQ ID NO: 49105 - DNA, 7 bp, Unknown
  misc_feature (1)..( 7): Matrix.002 file - promoters60/1396364
aatattt

SEQ ID NO: 49106 - DNA, 8 bp, Unknown
  misc_feature (1)..( 8): Matrix.002 file - promoters60/1396364
tttagttt

SEQ ID NO: 49107 - DNA, 9 bp, Unknown
  misc_feature (1)..( 9): Matrix.002 file - promoters60/1396364
tgaaaccaa

SEQ ID NO: 49108 - DNA, 7 bp, Unknown
  misc_feature (1)..( 7): Matrix.002 file - promoters60/1396364
ttttgat

SEQ ID NO: 49109 - DNA, 9 bp, Unknown
  misc_feature (1)..( 9): Matrix.002 file - promoters60/1396364
aatttattt

SEQ ID NO: 49110 - DNA, 11 bp, Unknown
  misc_feature (1)..( 11): Matrix.002 file - promoters60/1396364
tacgtaacatg

SEQ ID NO: 49111 - DNA, 11 bp, Unknown
  misc_feature (1)..( 11): Matrix.002 file - promoters60/1396462
gaacaataaca

SEQ ID NO: 49112 - DNA, 10 bp, Unknown
  misc_feature (1)..( 10): Matrix.002 file - promoters60/1396462
taaaaagtaa

SEQ ID NO: 49113 - DNA, 7 bp, Unknown
  misc_feature (1)..( 7): Matrix.002 file - promoters60/1396462
ataaaac

SEQ ID NO: 49114 - DNA, 7 bp, Unknown
  misc_feature (1)..( 7): Matrix.002 file - promoters60/1396462
ttgtaac

SEQ ID NO: 49115 - DNA, 7 bp, Unknown
  misc_feature (1)..( 7): Matrix.002 file - promoters60/1396462
aaaacaa

SEQ ID NO: 49116 - DNA, 10 bp, Unknown
  misc_feature (1)..( 10): Matrix.002 file - promoters60/1396462
aaacaaattt

SEQ ID NO: 49117 - DNA, 9 bp, Unknown
  misc_feature (1)..( 9): Matrix.002 file - promoters60/1396462
ttttgaaaa

SEQ ID NO: 49118 - DNA, 10 bp, Unknown
  misc_feature (1)..( 10): Matrix.002 file - promoters60/1396462
ggaaaagaaa

SEQ ID NO: 49119 - DNA, 11 bp, Unknown
  misc_feature (1)..( 11): Matrix.002 file - promoters60/1396462
aaaataaaata

SEQ ID NO: 49120 - DNA, 13 bp, Unknown
  misc_feature (1)..( 13): Matrix.002 file - promoters60/1396462
aatattttctttg

SEQ ID NO: 49121 - DNA, 8 bp, Unknown
  misc_feature (1)..( 8): Matrix.002 file - promoters60/1396462
caaaataa

SEQ ID NO: 49122 - DNA, 6 bp, Unknown
  misc_feature (1)..( 6): Matrix.002 file - promoters60/1396462
gaaaaa

SEQ ID NO: 49123 - DNA, 9 bp, Unknown
  misc_feature (1)..( 9): Matrix.002 file - promoters60/1396462
aaaaggaaa

SEQ ID NO: 49124 - DNA, 7 bp, Unknown
  misc_feature (1)..( 7): Matrix.002 file - promoters60/1396462
ttgagaa

SEQ ID NO: 49125 - DNA, 8 bp, Unknown
  misc_feature (1)..( 8): Matrix.002 file - promoters60/1396462
tatctgag

SEQ ID NO: 49126 - DNA, 7 bp, Unknown
  misc_feature (1)..( 7): Matrix.002 file - promoters60/1396462
tttattt

SEQ ID NO: 49127 - DNA, 10 bp, Unknown
  misc_feature (1)..( 10): Matrix.002 file - promoters60/1396462
tttaattaat

SEQ ID NO: 49128 - DNA, 8 bp, Unknown
  misc_feature (1)..( 8): Matrix.002 file - promoters60/1396462
aatattgt

SEQ ID NO: 49129 - DNA, 7 bp, Unknown
  misc_feature (1)..( 7): Matrix.002 file - promoters60/1396462
aaaaaaa

SEQ ID NO: 49130 - DNA, 6 bp, Unknown
  misc_feature (1)..( 6): Matrix.002 file - promoters60/1396462
taataa

SEQ ID NO: 49131 - DNA, 7 bp, Unknown
  misc_feature (1)..( 7): Matrix.002 file - promoters60/1396462
aatcggg

SEQ ID NO: 49132 - DNA, 7 bp, Unknown
  misc_feature (1)..( 7): Matrix.002 file - promoters60/1396462
cccacta

SEQ ID NO: 49133 - DNA, 7 bp, Unknown
  misc_feature (1)..( 7): Matrix.002 file - promoters60/1396462
gtatata

SEQ ID NO: 49134 - DNA, 11 bp, Unknown
  misc_feature (1)..( 11): Matrix.002 file - promoters60/1396469
cattcttattt

SEQ ID NO: 49135 - DNA, 11 bp, Unknown
  misc_feature (1)..( 11): Matrix.002 file - promoters60/1396469
atacttacaaa

SEQ ID NO: 49136 - DNA, 11 bp, Unknown
  misc_feature (1)..( 11): Matrix.002 file - promoters60/1396469
tcatatatata

SEQ ID NO: 49137 - DNA, 12 bp, Unknown
  misc_feature (1)..( 12): Matrix.002 file - promoters60/1396469
aattttttttca

SEQ ID NO: 49138 - DNA, 14 bp, Unknown
  misc_feature (1)..( 14): Matrix.002 file - promoters60/1396469
ttagctataaatta

SEQ ID NO: 49139 - DNA, 7 bp, Unknown
  misc_feature (1)..( 7): Matrix.002 file - promoters60/1396469
aactaaa

SEQ ID NO: 49140 - DNA, 14 bp, Unknown
  misc_feature (1)..( 14): Matrix.002 file - promoters60/1396469
ttttatatagataa

SEQ ID NO: 49141 - DNA, 9 bp, Unknown
  misc_feature (1)..( 9): Matrix.002 file - promoters60/1396469
aactaaaca

SEQ ID NO: 49142 - DNA, 10 bp, Unknown
  misc_feature (1)..( 10): Matrix.002 file - promoters60/1396482
tttaaaaaat

SEQ ID NO: 49143 - DNA, 7 bp, Unknown
  misc_feature (1)..( 7): Matrix.002 file - promoters60/1396519
gttacaa

SEQ ID NO: 49144 - DNA, 7 bp, Unknown
  misc_feature (1)..( 7): Matrix.002 file - promoters60/1396519
aaaattt

SEQ ID NO: 49145 - DNA, 6 bp, Unknown
  misc_feature (1)..( 6): Matrix.002 file - promoters60/1396519
accaaa

SEQ ID NO: 49146 - DNA, 6 bp, Unknown
  misc_feature (1)..( 6): Matrix.002 file - promoters60/1396519
gaaaaa

SEQ ID NO: 49147 - DNA, 7 bp, Unknown
  misc_feature (1)..( 7): Matrix.002 file - promoters60/1396519
aaacaaa

SEQ ID NO: 49148 - DNA, 6 bp, Unknown
  misc_feature (1)..( 6): Matrix.002 file - promoters60/1396519
caaaaa

SEQ ID NO: 49149 - DNA, 8 bp, Unknown
  misc_feature (1)..( 8): Matrix.002 file - promoters60/1396519
agaataaa

SEQ ID NO: 49150 - DNA, 7 bp, Unknown
  misc_feature (1)..( 7): Matrix.002 file - promoters60/1396519
atataaa

SEQ ID NO: 49151 - DNA, 6 bp, Unknown
  misc_feature (1)..( 6): Matrix.002 file - promoters60/1396519
aaaaag

SEQ ID NO: 49152 - DNA, 7 bp, Unknown
  misc_feature (1)..( 7): Matrix.002 file - promoters60/1396519
aagaaat

SEQ ID NO: 49153 - DNA, 10 bp, Unknown
  misc_feature (1)..( 10): Matrix.002 file - promoters60/1396519
gaaaataaaa

SEQ ID NO: 49154 - DNA, 7 bp, Unknown
  misc_feature (1)..( 7): Matrix.002 file - promoters60/1396519
aaaataa

SEQ ID NO: 49155 - DNA, 8 bp, Unknown
  misc_feature (1)..( 8): Matrix.002 file - promoters60/1396519
tttgttta

SEQ ID NO: 49156 - DNA, 6 bp, Unknown
  misc_feature (1)..( 6): Matrix.002 file - promoters60/1396519
aagtta

SEQ ID NO: 49157 - DNA, 9 bp, Unknown
  misc_feature (1)..( 9): Matrix.002 file - promoters60/1396519
aagagtaaa

SEQ ID NO: 49158 - DNA, 11 bp, Unknown
  misc_feature (1)..( 11): Matrix.002 file - promoters60/1396519
aaacaagctaa

SEQ ID NO: 49159 - DNA, 8 bp, Unknown
  misc_feature (1)..( 8): Matrix.002 file - promoters60/1396519
agagatag

SEQ ID NO: 49160 - DNA, 13 bp, Unknown
  misc_feature (1)..( 13): Matrix.002 file - promoters60/1396519
acattttcagata

SEQ ID NO: 49161 - DNA, 8 bp, Unknown
  misc_feature (1)..( 8): Matrix.002 file - promoters60/1396519
tgcaggag

SEQ ID NO: 49162 - DNA, 7 bp, Unknown
  misc_feature (1)..( 7): Matrix.002 file - promoters60/1396519
attcatg

SEQ ID NO: 49163 - DNA, 7 bp, Unknown
  misc_feature (1)..( 7): Matrix.002 file - promoters60/1396519
cacgaga

SEQ ID NO: 49164 - DNA, 6 bp, Unknown
  misc_feature (1)..( 6): Matrix.002 file - promoters60/1396519
gctaag

SEQ ID NO: 49165 - DNA, 7 bp, Unknown
  misc_feature (1)..( 7): Matrix.002 file - promoters60/1396519
aaagaaa

SEQ ID NO: 49166 - DNA, 6 bp, Unknown
  misc_feature (1)..( 6): Matrix.002 file - promoters60/1396519
taaaaa

SEQ ID NO: 49167 - DNA, 7 bp, Unknown
  misc_feature (1)..( 7): Matrix.002 file - promoters60/1396519
agatttc

SEQ ID NO: 49168 - DNA, 7 bp, Unknown
  misc_feature (1)..( 7): Matrix.002 file - promoters60/1396767
atgtata

SEQ ID NO: 49169 - DNA, 7 bp, Unknown
  misc_feature (1)..( 7): Matrix.002 file - promoters60/1396767
tttacag

SEQ ID NO: 49170 - DNA, 7 bp, Unknown
  misc_feature (1)..( 7): Matrix.002 file - promoters60/1396767
tacgatt

SEQ ID NO: 49171 - DNA, 8 bp, Unknown
  misc_feature (1)..( 8): Matrix.002 file - promoters60/1396767
tttgattt

SEQ ID NO: 49172 - DNA, 7 bp, Unknown
  misc_feature (1)..( 7): Matrix.002 file - promoters60/1396767
aaaatac

SEQ ID NO: 49173 - DNA, 9 bp, Unknown
  misc_feature (1)..( 9): Matrix.002 file - promoters60/1396767
caaactaaa

SEQ ID NO: 49174 - DNA, 8 bp, Unknown
  misc_feature (1)..( 8): Matrix.002 file - promoters60/1396767
tgttgtaa

SEQ ID NO: 49175 - DNA, 7 bp, Unknown
  misc_feature (1)..( 7): Matrix.002 file - promoters60/1396767
aaaaaaa

SEQ ID NO: 49176 - DNA, 8 bp, Unknown
  misc_feature (1)..( 8): Matrix.002 file - promoters60/1396767
cttacaaa

SEQ ID NO: 49177 - DNA, 7 bp, Unknown
  misc_feature (1)..( 7): Matrix.002 file - promoters60/1396767
aagaaaa

SEQ ID NO: 49178 - DNA, 6 bp, Unknown
  misc_feature (1)..( 6): Matrix.002 file - promoters60/1396767
gccttg

SEQ ID NO: 49179 - DNA, 8 bp, Unknown
  misc_feature (1)..( 8): Matrix.002 file - promoters60/1396767
aaacttaa

SEQ ID NO: 49180 - DNA, 8 bp, Unknown
  misc_feature (1)..( 8): Matrix.002 file - promoters60/1396767
ttgatgaa

SEQ ID NO: 49181 - DNA, 8 bp, Unknown
  misc_feature (1)..( 8): Matrix.002 file - promoters60/1396767
agccttac

SEQ ID NO: 49182 - DNA, 6 bp, Unknown
  misc_feature (1)..( 6): Matrix.002 file - promoters60/1396767
ttgcaa

SEQ ID NO: 49183 - DNA, 6 bp, Unknown
  misc_feature (1)..( 6): Matrix.002 file - promoters60/1396767
ttttga

SEQ ID NO: 49184 - DNA, 8 bp, Unknown
  misc_feature (1)..( 8): Matrix.002 file - promoters60/1396767
agaaaaga

SEQ ID NO: 49185 - DNA, 9 bp, Unknown
  misc_feature (1)..( 9): Matrix.002 file - promoters60/1396816
agattagaa

SEQ ID NO: 49186 - DNA, 10 bp, Unknown
  misc_feature (1)..( 10): Matrix.002 file - promoters60/1396816
gatgacaaaa

SEQ ID NO: 49187 - DNA, 6 bp, Unknown
  misc_feature (1)..( 6): Matrix.002 file - promoters60/1396951
atttgc

SEQ ID NO: 49188 - DNA, 6 bp, Unknown
  misc_feature (1)..( 6): Matrix.002 file - promoters60/1396951
aaaaat

SEQ ID NO: 49189 - DNA, 6 bp, Unknown
  misc_feature (1)..( 6): Matrix.002 file - promoters60/1396951
ttcaaa

SEQ ID NO: 49190 - DNA, 7 bp, Unknown
  misc_feature (1)..( 7): Matrix.002 file - promoters60/1396951
aaacttc

SEQ ID NO: 49191 - DNA, 6 bp, Unknown
  misc_feature (1)..( 6): Matrix.002 file - promoters60/1396951
agaaga

SEQ ID NO: 49192 - DNA, 6 bp, Unknown
  misc_feature (1)..( 6): Matrix.002 file - promoters60/1396951
aaatgc

SEQ ID NO: 49193 - DNA, 8 bp, Unknown
  misc_feature (1)..( 8): Matrix.002 file - promoters60/1396951
aaaatgta

SEQ ID NO: 49194 - DNA, 7 bp, Unknown
  misc_feature (1)..( 7): Matrix.002 file - promoters60/1396951
acaatta

SEQ ID NO: 49195 - DNA, 8 bp, Unknown
  misc_feature (1)..( 8): Matrix.002 file - promoters60/1396951
tcttcttc

SEQ ID NO: 49196 - DNA, 6 bp, Unknown
  misc_feature (1)..( 6): Matrix.002 file - promoters60/1396951
aaaaat

SEQ ID NO: 49197 - DNA, 8 bp, Unknown
  misc_feature (1)..( 8): Matrix.002 file - promoters60/1396951
attaattt

SEQ ID NO: 49198 - DNA, 8 bp, Unknown
  misc_feature (1)..( 8): Matrix.002 file - promoters60/1396951
gttaggtt

SEQ ID NO: 49199 - DNA, 6 bp, Unknown
  misc_feature (1)..( 6): Matrix.002 file - promoters60/1396951
ttatat

SEQ ID NO: 49200 - DNA, 7 bp, Unknown
  misc_feature (1)..( 7): Matrix.002 file - promoters60/1396951
aaaagta

SEQ ID NO: 49201 - DNA, 7 bp, Unknown
  misc_feature (1)..( 7): Matrix.002 file - promoters60/1396951
gtaatat

SEQ ID NO: 49202 - DNA, 10 bp, Unknown
  misc_feature (1)..( 10): Matrix.002 file - promoters60/1396951
aaaatacaac

SEQ ID NO: 49203 - DNA, 7 bp, Unknown
  misc_feature (1)..( 7): Matrix.002 file - promoters60/1396951
attaaat

SEQ ID NO: 49204 - DNA, 10 bp, Unknown
  misc_feature (1)..( 10): Matrix.002 file - promoters60/1396951
taagaaataa

SEQ ID NO: 49205 - DNA, 6 bp, Unknown
  misc_feature (1)..( 6): Matrix.002 file - promoters60/1396951
aataat

SEQ ID NO: 49206 - DNA, 7 bp, Unknown
  misc_feature (1)..( 7): Matrix.002 file - promoters60/1396951
tttaata

SEQ ID NO: 49207 - DNA, 8 bp, Unknown
  misc_feature (1)..( 8): Matrix.002 file - promoters60/1396951
acttgatt

SEQ ID NO: 49208 - DNA, 11 bp, Unknown
  misc_feature (1)..( 11): Matrix.002 file - promoters60/1396951
ccaaaatcaca

SEQ ID NO: 49209 - DNA, 9 bp, Unknown
  misc_feature (1)..( 9): Matrix.002 file - promoters60/1397029
taatcgttt

SEQ ID NO: 49210 - DNA, 7 bp, Unknown
  misc_feature (1)..( 7): Matrix.002 file - promoters60/1397029
ttttagt

SEQ ID NO: 49211 - DNA, 12 bp, Unknown
  misc_feature (1)..( 12): Matrix.002 file - promoters60/1397029
aacctttatgta

SEQ ID NO: 49212 - DNA, 10 bp, Unknown
  misc_feature (1)..( 10): Matrix.002 file - promoters60/1397029
ttttgatttg

SEQ ID NO: 49213 - DNA, 12 bp, Unknown
  misc_feature (1)..( 12): Matrix.002 file - promoters60/1397029
aacttttaagta

SEQ ID NO: 49214 - DNA, 7 bp, Unknown
  misc_feature (1)..( 7): Matrix.002 file - promoters60/1397033
aacagag

SEQ ID NO: 49215 - DNA, 6 bp, Unknown
  misc_feature (1)..( 6): Matrix.002 file - promoters60/1397033
tttctc

SEQ ID NO: 49216 - DNA, 6 bp, Unknown
  misc_feature (1)..( 6): Matrix.002 file - promoters60/1397033
tttgtc

SEQ ID NO: 49217 - DNA, 7 bp, Unknown
  misc_feature (1)..( 7): Matrix.002 file - promoters60/1397033
agagtca

SEQ ID NO: 49218 - DNA, 7 bp, Unknown
  misc_feature (1)..( 7): Matrix.002 file - promoters60/1397033
aagcaaa

SEQ ID NO: 49219 - DNA, 7 bp, Unknown
  misc_feature (1)..( 7): Matrix.002 file - promoters60/1397033
aaaattc

SEQ ID NO: 49220 - DNA, 11 bp, Unknown
  misc_feature (1)..( 11): Matrix.002 file - promoters60/1397033
atagaaggaca

SEQ ID NO: 49221 - DNA, 8 bp, Unknown
  misc_feature (1)..( 8): Matrix.002 file - promoters60/1397033
atctggaa

SEQ ID NO: 49222 - DNA, 13 bp, Unknown
  misc_feature (1)..( 13): Matrix.002 file - promoters60/1397033
attctcgcacgaa

SEQ ID NO: 49223 - DNA, 6 bp, Unknown
  misc_feature (1)..( 6): Matrix.002 file - promoters60/1397033
ttctct

SEQ ID NO: 49224 - DNA, 6 bp, Unknown
  misc_feature (1)..( 6): Matrix.002 file - promoters60/1397033
aaataa

SEQ ID NO: 49225 - DNA, 7 bp, Unknown
  misc_feature (1)..( 7): Matrix.002 file - promoters60/1397033
atttttt

SEQ ID NO: 49226 - DNA, 6 bp, Unknown
  misc_feature (1)..( 6): Matrix.002 file - promoters60/1397033
ttcatt

SEQ ID NO: 49227 - DNA, 10 bp, Unknown
  misc_feature (1)..( 10): Matrix.002 file - promoters60/1397080
taaaaacaaa

SEQ ID NO: 49228 - DNA, 10 bp, Unknown
  misc_feature (1)..( 10): Matrix.002 file - promoters60/1397080
agaaaaacaa

SEQ ID NO: 49229 - DNA, 12 bp, Unknown
  misc_feature (1)..( 12): Matrix.002 file - promoters60/1397080
aaaaatataaga

SEQ ID NO: 49230 - DNA, 8 bp, Unknown
  misc_feature (1)..( 8): Matrix.002 file - promoters60/1397111
tttgtctt

SEQ ID NO: 49231 - DNA, 8 bp, Unknown
  misc_feature (1)..( 8): Matrix.002 file - promoters60/1397111
aaaatttc

SEQ ID NO: 49232 - DNA, 8 bp, Unknown
  misc_feature (1)..( 8): Matrix.002 file - promoters60/1397111
aataaaaa

SEQ ID NO: 49233 - DNA, 12 bp, Unknown
  misc_feature (1)..( 12): Matrix.002 file - promoters60/1397111
attaagttttat

SEQ ID NO: 49234 - DNA, 11 bp, Unknown
  misc_feature (1)..( 11): Matrix.002 file - promoters60/1397111
tttgatggtta

SEQ ID NO: 49235 - DNA, 8 bp, Unknown
  misc_feature (1)..( 8): Matrix.002 file - promoters60/1397111
ttgtttat

SEQ ID NO: 49236 - DNA, 8 bp, Unknown
  misc_feature (1)..( 8): Matrix.002 file - promoters60/1397125
taaaaaaa

SEQ ID NO: 49237 - DNA, 10 bp, Unknown
  misc_feature (1)..( 10): Matrix.002 file - promoters60/1397125
ccaaaaaaaa

SEQ ID NO: 49238 - DNA, 6 bp, Unknown
  misc_feature (1)..( 6): Matrix.002 file - promoters60/1397130
gagatt

SEQ ID NO: 49239 - DNA, 7 bp, Unknown
  misc_feature (1)..( 7): Matrix.002 file - promoters60/1397130
gagagaa

SEQ ID NO: 49240 - DNA, 6 bp, Unknown
  misc_feature (1)..( 6): Matrix.002 file - promoters60/1397130
tgatct

SEQ ID NO: 49241 - DNA, 10 bp, Unknown
  misc_feature (1)..( 10): Matrix.002 file - promoters60/1397130
aattaagggc

SEQ ID NO: 49242 - DNA, 7 bp, Unknown
  misc_feature (1)..( 7): Matrix.002 file - promoters60/1397130
agcacaa

SEQ ID NO: 49243 - DNA, 6 bp, Unknown
  misc_feature (1)..( 6): Matrix.002 file - promoters60/1397130
ttattt

SEQ ID NO: 49244 - DNA, 7 bp, Unknown
  misc_feature (1)..( 7): Matrix.002 file - promoters60/1397130
aatctaa

SEQ ID NO: 49245 - DNA, 8 bp, Unknown
  misc_feature (1)..( 8): Matrix.002 file - promoters60/1397130
tttccggt

SEQ ID NO: 49246 - DNA, 9 bp, Unknown
  misc_feature (1)..( 9): Matrix.002 file - promoters60/1397130
tatgtggtc

SEQ ID NO: 49247 - DNA, 7 bp, Unknown
  misc_feature (1)..( 7): Matrix.002 file - promoters60/1397130
tataaat

SEQ ID NO: 49248 - DNA, 6 bp, Unknown
  misc_feature (1)..( 6): Matrix.002 file - promoters60/1397130
gaagag

SEQ ID NO: 49249 - DNA, 8 bp, Unknown
  misc_feature (1)..( 8): Matrix.002 file - promoters60/1397130
tccggtgc

SEQ ID NO: 49250 - DNA, 7 bp, Unknown
  misc_feature (1)..( 7): Matrix.002 file - promoters60/1397130
acgaaaa

SEQ ID NO: 49251 - DNA, 6 bp, Unknown
  misc_feature (1)..( 6): Matrix.002 file - promoters60/1397130
agattt

SEQ ID NO: 49252 - DNA, 8 bp, Unknown
  misc_feature (1)..( 8): Matrix.002 file - promoters60/1397130
aaacagaa

SEQ ID NO: 49253 - DNA, 8 bp, Unknown
  misc_feature (1)..( 8): Matrix.002 file - promoters60/1397130
ataatttc

SEQ ID NO: 49254 - DNA, 7 bp, Unknown
  misc_feature (1)..( 7): Matrix.002 file - promoters60/1397178
tttatta

SEQ ID NO: 49255 - DNA, 8 bp, Unknown
  misc_feature (1)..( 8): Matrix.002 file - promoters60/1397178
tttatcta

SEQ ID NO: 49256 - DNA, 6 bp, Unknown
  misc_feature (1)..( 6): Matrix.002 file - promoters60/1397178
attttt

SEQ ID NO: 49257 - DNA, 8 bp, Unknown
  misc_feature (1)..( 8): Matrix.002 file - promoters60/1397178
aaagattt

SEQ ID NO: 49258 - DNA, 8 bp, Unknown
  misc_feature (1)..( 8): Matrix.002 file - promoters60/1397178
ggtatttg

SEQ ID NO: 49259 - DNA, 6 bp, Unknown
  misc_feature (1)..( 6): Matrix.002 file - promoters60/1397178
atgaat

SEQ ID NO: 49260 - DNA, 7 bp, Unknown
  misc_feature (1)..( 7): Matrix.002 file - promoters60/1397178
ttacaat

SEQ ID NO: 49261 - DNA, 9 bp, Unknown
  misc_feature (1)..( 9): Matrix.002 file - promoters60/1397178
aattttaac

SEQ ID NO: 49262 - DNA, 14 bp, Unknown
  misc_feature (1)..( 14): Matrix.002 file - promoters60/1397178
aatttctcccaaaa

SEQ ID NO: 49263 - DNA, 8 bp, Unknown
  misc_feature (1)..( 8): Matrix.002 file - promoters60/1397178
ttaacctt

SEQ ID NO: 49264 - DNA, 13 bp, Unknown
  misc_feature (1)..( 13): Matrix.002 file - promoters60/1397178
ttgaatcaaaatt

SEQ ID NO: 49265 - DNA, 7 bp, Unknown
  misc_feature (1)..( 7): Matrix.002 file - promoters60/1397178
tggattt

SEQ ID NO: 49266 - DNA, 6 bp, Unknown
  misc_feature (1)..( 6): Matrix.002 file - promoters60/1397178
ttggtt

SEQ ID NO: 49267 - DNA, 7 bp, Unknown
  misc_feature (1)..( 7): Matrix.002 file - promoters60/1397178
ctcactc

SEQ ID NO: 49268 - DNA, 15 bp, Unknown
  misc_feature (1)..( 15): Matrix.002 file - promoters60/1397203
gttaacattaaatat

SEQ ID NO: 49269 - DNA, 9 bp, Unknown
  misc_feature (1)..( 9): Matrix.002 file - promoters60/1397203
tataaaaaa

SEQ ID NO: 49270 - DNA, 11 bp, Unknown
  misc_feature (1)..( 11): Matrix.002 file - promoters60/1397203
aaaaaacaata

SEQ ID NO: 49271 - DNA, 14 bp, Unknown
  misc_feature (1)..( 14): Matrix.002 file - promoters60/1397203
ttcataaaatcaat

SEQ ID NO: 49272 - DNA, 7 bp, Unknown
  misc_feature (1)..( 7): Matrix.002 file - promoters60/1397332
aactcag

SEQ ID NO: 49273 - DNA, 6 bp, Unknown
  misc_feature (1)..( 6): Matrix.002 file - promoters60/1397332
tttcga

SEQ ID NO: 49274 - DNA, 7 bp, Unknown
  misc_feature (1)..( 7): Matrix.002 file - promoters60/1397332
caaaaac

SEQ ID NO: 49275 - DNA, 7 bp, Unknown
  misc_feature (1)..( 7): Matrix.002 file - promoters60/1397332
acattgt

SEQ ID NO: 49276 - DNA, 7 bp, Unknown
  misc_feature (1)..( 7): Matrix.002 file - promoters60/1397332
aaaccaa

SEQ ID NO: 49277 - DNA, 11 bp, Unknown
  misc_feature (1)..( 11): Matrix.002 file - promoters60/1397332
ccctctaaacc

SEQ ID NO: 49278 - DNA, 7 bp, Unknown
  misc_feature (1)..( 7): Matrix.002 file - promoters60/1397332
agaagag

SEQ ID NO: 49279 - DNA, 10 bp, Unknown
  misc_feature (1)..( 10): Matrix.002 file - promoters60/1397332
aaagaaaaaa

SEQ ID NO: 49280 - DNA, 6 bp, Unknown
  misc_feature (1)..( 6): Matrix.002 file - promoters60/1397332
gatgtt

SEQ ID NO: 49281 - DNA, 7 bp, Unknown
  misc_feature (1)..( 7): Matrix.002 file - promoters60/1397332
catcact

SEQ ID NO: 49282 - DNA, 9 bp, Unknown
  misc_feature (1)..( 9): Matrix.002 file - promoters60/1397332
tagcattgt

SEQ ID NO: 49283 - DNA, 7 bp, Unknown
  misc_feature (1)..( 7): Matrix.002 file - promoters60/1397332
tagggtt

SEQ ID NO: 49284 - DNA, 9 bp, Unknown
  misc_feature (1)..( 9): Matrix.002 file - promoters60/1397332
tttaattaa

SEQ ID NO: 49285 - DNA, 8 bp, Unknown
  misc_feature (1)..( 8): Matrix.002 file - promoters60/1397332
atttgtta

SEQ ID NO: 49286 - DNA, 6 bp, Unknown
  misc_feature (1)..( 6): Matrix.002 file - promoters60/1397332
gaaccc

SEQ ID NO: 49287 - DNA, 7 bp, Unknown
  misc_feature (1)..( 7): Matrix.002 file - promoters60/1397332
attaata

SEQ ID NO: 49288 - DNA, 13 bp, Unknown
  misc_feature (1)..( 13): Matrix.002 file - promoters60/1397350
gtctcatggattc

SEQ ID NO: 49289 - DNA, 7 bp, Unknown
  misc_feature (1)..( 7): Matrix.002 file - promoters60/1397350
aataaca

SEQ ID NO: 49290 - DNA, 7 bp, Unknown
  misc_feature (1)..( 7): Matrix.002 file - promoters60/1397350
aacaatt

SEQ ID NO: 49291 - DNA, 6 bp, Unknown
  misc_feature (1)..( 6): Matrix.002 file - promoters60/1397350
ttaaac

SEQ ID NO: 49292 - DNA, 7 bp, Unknown
  misc_feature (1)..( 7): Matrix.002 file - promoters60/1397350
aaacatt

SEQ ID NO: 49293 - DNA, 6 bp, Unknown
  misc_feature (1)..( 6): Matrix.002 file - promoters60/1397350
ttaata

SEQ ID NO: 49294 - DNA, 7 bp, Unknown
  misc_feature (1)..( 7): Matrix.002 file - promoters60/1397350
aaaacgt

SEQ ID NO: 49295 - DNA, 7 bp, Unknown
  misc_feature (1)..( 7): Matrix.002 file - promoters60/1397350
taaaatc

SEQ ID NO: 49296 - DNA, 7 bp, Unknown
  misc_feature (1)..( 7): Matrix.002 file - promoters60/1397350
aaaccaa

SEQ ID NO: 49297 - DNA, 6 bp, Unknown
  misc_feature (1)..( 6): Matrix.002 file - promoters60/1397350
aatgaa

SEQ ID NO: 49298 - DNA, 7 bp, Unknown
  misc_feature (1)..( 7): Matrix.002 file - promoters60/1397350
gttaaga

SEQ ID NO: 49299 - DNA, 6 bp, Unknown
  misc_feature (1)..( 6): Matrix.002 file - promoters60/1397350
aaaacc

SEQ ID NO: 49300 - DNA, 7 bp, Unknown
  misc_feature (1)..( 7): Matrix.002 file - promoters60/1397350
ttgcaag

SEQ ID NO: 49301 - DNA, 6 bp, Unknown
  misc_feature (1)..( 6): Matrix.002 file - promoters60/1397350
taaaaa

SEQ ID NO: 49302 - DNA, 7 bp, Unknown
  misc_feature (1)..( 7): Matrix.002 file - promoters60/1397350
aaaaaca

SEQ ID NO: 49303 - DNA, 7 bp, Unknown
  misc_feature (1)..( 7): Matrix.002 file - promoters60/1397350
gaaaaaa

SEQ ID NO: 49304 - DNA, 6 bp, Unknown
  misc_feature (1)..( 6): Matrix.002 file - promoters60/1397350
agtaaa

SEQ ID NO: 49305 - DNA, 7 bp, Unknown
  misc_feature (1)..( 7): Matrix.002 file - promoters60/1397350
aatcggg

SEQ ID NO: 49306 - DNA, 8 bp, Unknown
  misc_feature (1)..( 8): Matrix.002 file - promoters60/1397350
gaaacaaa

SEQ ID NO: 49307 - DNA, 10 bp, Unknown
  misc_feature (1)..( 10): Matrix.002 file - promoters60/1397350
ggaaaagaaa

SEQ ID NO: 49308 - DNA, 7 bp, Unknown
  misc_feature (1)..( 7): Matrix.002 file - promoters60/1397350
cccacta

SEQ ID NO: 49309 - DNA, 9 bp, Unknown
  misc_feature (1)..( 9): Matrix.002 file - promoters60/1397350
aaagaaaag

SEQ ID NO: 49310 - DNA, 7 bp, Unknown
  misc_feature (1)..( 7): Matrix.002 file - promoters60/1397350
gtatata

SEQ ID NO: 49311 - DNA, 8 bp, Unknown
  misc_feature (1)..( 8): Matrix.002 file - promoters60/1397425
tactaagg

SEQ ID NO: 49312 - DNA, 6 bp, Unknown
  misc_feature (1)..( 6): Matrix.002 file - promoters60/1397425
taattt

SEQ ID NO: 49313 - DNA, 8 bp, Unknown
  misc_feature (1)..( 8): Matrix.002 file - promoters60/1397425
atatgtaa

SEQ ID NO: 49314 - DNA, 7 bp, Unknown
  misc_feature (1)..( 7): Matrix.002 file - promoters60/1397425
ttaaaat

SEQ ID NO: 49315 - DNA, 8 bp, Unknown
  misc_feature (1)..( 8): Matrix.002 file - promoters60/1397425
tcataatt

SEQ ID NO: 49316 - DNA, 6 bp, Unknown
  misc_feature (1)..( 6): Matrix.002 file - promoters60/1397425
ttttct

SEQ ID NO: 49317 - DNA, 6 bp, Unknown
  misc_feature (1)..( 6): Matrix.002 file - promoters60/1397425
ttacct

SEQ ID NO: 49318 - DNA, 6 bp, Unknown
  misc_feature (1)..( 6): Matrix.002 file - promoters60/1397425
attgtt

SEQ ID NO: 49319 - DNA, 9 bp, Unknown
  misc_feature (1)..( 9): Matrix.002 file - promoters60/1397500
agtgccaat

SEQ ID NO: 49320 - DNA, 10 bp, Unknown
  misc_feature (1)..( 10): Matrix.002 file - promoters60/1397500
aattttttaa

SEQ ID NO: 49321 - DNA, 9 bp, Unknown
  misc_feature (1)..( 9): Matrix.002 file - promoters60/1397500
acaatcata

SEQ ID NO: 49322 - DNA, 12 bp, Unknown
  misc_feature (1)..( 12): Matrix.002 file - promoters60/1397500
acataaaaattt

SEQ ID NO: 49323 - DNA, 10 bp, Unknown
  misc_feature (1)..( 10): Matrix.002 file - promoters60/1397500
taaatcataa

SEQ ID NO: 49324 - DNA, 6 bp, Unknown
  misc_feature (1)..( 6): Matrix.002 file - promoters60/1397556
attcac

SEQ ID NO: 49325 - DNA, 6 bp, Unknown
  misc_feature (1)..( 6): Matrix.002 file - promoters60/1397556
caaata

SEQ ID NO: 49326 - DNA, 8 bp, Unknown
  misc_feature (1)..( 8): Matrix.002 file - promoters60/1397556
ataacaat

SEQ ID NO: 49327 - DNA, 6 bp, Unknown
  misc_feature (1)..( 6): Matrix.002 file - promoters60/1397556
ctttca

SEQ ID NO: 49328 - DNA, 6 bp, Unknown
  misc_feature (1)..( 6): Matrix.002 file - promoters60/1397556
aataac

SEQ ID NO: 49329 - DNA, 7 bp, Unknown
  misc_feature (1)..( 7): Matrix.002 file - promoters60/1397556
aaacaat

SEQ ID NO: 49330 - DNA, 11 bp, Unknown
  misc_feature (1)..( 11): Matrix.002 file - promoters60/1397556
agttattttgc

SEQ ID NO: 49331 - DNA, 7 bp, Unknown
  misc_feature (1)..( 7): Matrix.002 file - promoters60/1397556
tctgtga

SEQ ID NO: 49332 - DNA, 7 bp, Unknown
  misc_feature (1)..( 7): Matrix.002 file - promoters60/1397556
acgatta

SEQ ID NO: 49333 - DNA, 8 bp, Unknown
  misc_feature (1)..( 8): Matrix.002 file - promoters60/1397556
ataatttt

SEQ ID NO: 49334 - DNA, 8 bp, Unknown
  misc_feature (1)..( 8): Matrix.002 file - promoters60/1397556
ttttctgc

SEQ ID NO: 49335 - DNA, 6 bp, Unknown
  misc_feature (1)..( 6): Matrix.002 file - promoters60/1397556
ctcttc

SEQ ID NO: 49336 - DNA, 8 bp, Unknown
  misc_feature (1)..( 8): Matrix.002 file - promoters60/1397568
caatctaa

SEQ ID NO: 49337 - DNA, 6 bp, Unknown
  misc_feature (1)..( 6): Matrix.002 file - promoters60/1397568
taagtt

SEQ ID NO: 49338 - DNA, 9 bp, Unknown
  misc_feature (1)..( 9): Matrix.002 file - promoters60/1397568
aacaacaat

SEQ ID NO: 49339 - DNA, 6 bp, Unknown
  misc_feature (1)..( 6): Matrix.002 file - promoters60/1397568
caaatt

SEQ ID NO: 49340 - DNA, 7 bp, Unknown
  misc_feature (1)..( 7): Matrix.002 file - promoters60/1397568
atttgaa

SEQ ID NO: 49341 - DNA, 7 bp, Unknown
  misc_feature (1)..( 7): Matrix.002 file - promoters60/1397568
ttcaaat

SEQ ID NO: 49342 - DNA, 7 bp, Unknown
  misc_feature (1)..( 7): Matrix.002 file - promoters60/1397568
ttgagct

SEQ ID NO: 49343 - DNA, 8 bp, Unknown
  misc_feature (1)..( 8): Matrix.002 file - promoters60/1397568
aaaacata

SEQ ID NO: 49344 - DNA, 6 bp, Unknown
  misc_feature (1)..( 6): Matrix.002 file - promoters60/1397568
ataaat

SEQ ID NO: 49345 - DNA, 6 bp, Unknown
  misc_feature (1)..( 6): Matrix.002 file - promoters60/1397568
gatgac

SEQ ID NO: 49346 - DNA, 7 bp, Unknown
  misc_feature (1)..( 7): Matrix.002 file - promoters60/1397568
catttga

SEQ ID NO: 49347 - DNA, 6 bp, Unknown
  misc_feature (1)..( 6): Matrix.002 file - promoters60/1397568
tgacac

SEQ ID NO: 49348 - DNA, 9 bp, Unknown
  misc_feature (1)..( 9): Matrix.002 file - promoters60/1397568
actagattc

SEQ ID NO: 49349 - DNA, 7 bp, Unknown
  misc_feature (1)..( 7): Matrix.002 file - promoters60/1397568
aagccaa

SEQ ID NO: 49350 - DNA, 9 bp, Unknown
  misc_feature (1)..( 9): Matrix.002 file - promoters60/1397568
caagatcaa

SEQ ID NO: 49351 - DNA, 10 bp, Unknown
  misc_feature (1)..( 10): Matrix.002 file - promoters60/1397568
tttcaatttt

SEQ ID NO: 49352 - DNA, 10 bp, Unknown
  misc_feature (1)..( 10): Matrix.002 file - promoters60/1397568
aacttttgat

SEQ ID NO: 49353 - DNA, 6 bp, Unknown
  misc_feature (1)..( 6): Matrix.002 file - promoters60/1397568
tttata

SEQ ID NO: 49354 - DNA, 7 bp, Unknown
  misc_feature (1)..( 7): Matrix.002 file - promoters60/1397568
tttaaaa

SEQ ID NO: 49355 - DNA, 8 bp, Unknown
  misc_feature (1)..( 8): Matrix.002 file - promoters60/1397568
gattcaag

SEQ ID NO: 49356 - DNA, 8 bp, Unknown
  misc_feature (1)..( 8): Matrix.002 file - promoters60/1397568
aatcttct

SEQ ID NO: 49357 - DNA, 7 bp, Unknown
  misc_feature (1)..( 7): Matrix.002 file - promoters60/1397568
tatataa

SEQ ID NO: 49358 - DNA, 10 bp, Unknown
  misc_feature (1)..( 10): Matrix.002 file - promoters60/1397568
atttaacttt

SEQ ID NO: 49359 - DNA, 7 bp, Unknown
  misc_feature (1)..( 7): Matrix.002 file - promoters60/1397568
caaaaat

SEQ ID NO: 49360 - DNA, 9 bp, Unknown
  misc_feature (1)..( 9): Matrix.002 file - promoters60/1397568
tgacaattt

SEQ ID NO: 49361 - DNA, 8 bp, Unknown
  misc_feature (1)..( 8): Matrix.002 file - promoters60/1397568
taaactgt

SEQ ID NO: 49362 - DNA, 9 bp, Unknown
  misc_feature (1)..( 9): Matrix.002 file - promoters60/1397568
gcttattaa

SEQ ID NO: 49363 - DNA, 7 bp, Unknown
  misc_feature (1)..( 7): Matrix.002 file - promoters60/1397590
ttatttt

SEQ ID NO: 49364 - DNA, 6 bp, Unknown
  misc_feature (1)..( 6): Matrix.002 file - promoters60/1397590
taacaa

SEQ ID NO: 49365 - DNA, 8 bp, Unknown
  misc_feature (1)..( 8): Matrix.002 file - promoters60/1397590
atttaaaa

SEQ ID NO: 49366 - DNA, 6 bp, Unknown
  misc_feature (1)..( 6): Matrix.002 file - promoters60/1397590
taatta

SEQ ID NO: 49367 - DNA, 7 bp, Unknown
  misc_feature (1)..( 7): Matrix.002 file - promoters60/1397590
gataata

SEQ ID NO: 49368 - DNA, 7 bp, Unknown
  misc_feature (1)..( 7): Matrix.002 file - promoters60/1397590
ttaaaaa

SEQ ID NO: 49369 - DNA, 6 bp, Unknown
  misc_feature (1)..( 6): Matrix.002 file - promoters60/1397590
aataaa

SEQ ID NO: 49370 - DNA, 12 bp, Unknown
  misc_feature (1)..( 12): Matrix.002 file - promoters60/1397590
ctcctatatatt

SEQ ID NO: 49371 - DNA, 7 bp, Unknown
  misc_feature (1)..( 7): Matrix.002 file - promoters60/1397590
agcacat

SEQ ID NO: 49372 - DNA, 7 bp, Unknown
  misc_feature (1)..( 7): Matrix.002 file - promoters60/1397590
tatatct

SEQ ID NO: 49373 - DNA, 10 bp, Unknown
  misc_feature (1)..( 10): Matrix.002 file - promoters60/1397590
atagtttaac

SEQ ID NO: 49374 - DNA, 7 bp, Unknown
  misc_feature (1)..( 7): Matrix.002 file - promoters60/1397590
aaggaaa

SEQ ID NO: 49375 - DNA, 8 bp, Unknown
  misc_feature (1)..( 8): Matrix.002 file - promoters60/1397590
aactattt

SEQ ID NO: 49376 - DNA, 6 bp, Unknown
  misc_feature (1)..( 6): Matrix.002 file - promoters60/1397590
ttaggc

SEQ ID NO: 49377 - DNA, 12 bp, Unknown
  misc_feature (1)..( 12): Matrix.002 file - promoters60/1397590
ctcctatatatt

SEQ ID NO: 49378 - DNA, 6 bp, Unknown
  misc_feature (1)..( 6): Matrix.002 file - promoters60/1397590
ttttta

SEQ ID NO: 49379 - DNA, 7 bp, Unknown
  misc_feature (1)..( 7): Matrix.002 file - promoters60/1397590
atagatt

SEQ ID NO: 49380 - DNA, 7 bp, Unknown
  misc_feature (1)..( 7): Matrix.002 file - promoters60/1397590
attacca

SEQ ID NO: 49381 - DNA, 10 bp, Unknown
  misc_feature (1)..( 10): Matrix.002 file - promoters60/1397590
aagaaatatg

SEQ ID NO: 49382 - DNA, 7 bp, Unknown
  misc_feature (1)..( 7): Matrix.002 file - promoters60/1397590
ataggaa

SEQ ID NO: 49383 - DNA, 7 bp, Unknown
  misc_feature (1)..( 7): Matrix.002 file - promoters60/1397590
aaaacaa

SEQ ID NO: 49384 - DNA, 12 bp, Unknown
  misc_feature (1)..( 12): Matrix.002 file - promoters60/1397590
aaaagaagaaag

SEQ ID NO: 49385 - DNA, 8 bp, Unknown
  misc_feature (1)..( 8): Matrix.002 file - promoters60/1397594
gaacaatt

SEQ ID NO: 49386 - DNA, 8 bp, Unknown
  misc_feature (1)..( 8): Matrix.002 file - promoters60/1397594
ttgtggaa

SEQ ID NO: 49387 - DNA, 6 bp, Unknown
  misc_feature (1)..( 6): Matrix.002 file - promoters60/1397594
gttctt

SEQ ID NO: 49388 - DNA, 9 bp, Unknown
  misc_feature (1)..( 9): Matrix.002 file - promoters60/1397594
cctcgttgt

SEQ ID NO: 49389 - DNA, 7 bp, Unknown
  misc_feature (1)..( 7): Matrix.002 file - promoters60/1397594
tttcttt

SEQ ID NO: 49390 - DNA, 6 bp, Unknown
  misc_feature (1)..( 6): Matrix.002 file - promoters60/1397594
tcacaa

SEQ ID NO: 49391 - DNA, 6 bp, Unknown
  misc_feature (1)..( 6): Matrix.002 file - promoters60/1397594
ttgcca

SEQ ID NO: 49392 - DNA, 8 bp, Unknown
  misc_feature (1)..( 8): Matrix.002 file - promoters60/1397594
ccaaaatc

SEQ ID NO: 49393 - DNA, 6 bp, Unknown
  misc_feature (1)..( 6): Matrix.002 file - promoters60/1397594
tctttg

SEQ ID NO: 49394 - DNA, 9 bp, Unknown
  misc_feature (1)..( 9): Matrix.002 file - promoters60/1397594
tggattttg

SEQ ID NO: 49395 - DNA, 6 bp, Unknown
  misc_feature (1)..( 6): Matrix.002 file - promoters60/1397594
attctt

SEQ ID NO: 49396 - DNA, 8 bp, Unknown
  misc_feature (1)..( 8): Matrix.002 file - promoters60/1397594
tgtaatcg

SEQ ID NO: 49397 - DNA, 6 bp, Unknown
  misc_feature (1)..( 6): Matrix.002 file - promoters60/1397594
caggag

SEQ ID NO: 49398 - DNA, 6 bp, Unknown
  misc_feature (1)..( 6): Matrix.002 file - promoters60/1397594
tatgtt

SEQ ID NO: 49399 - DNA, 6 bp, Unknown
  misc_feature (1)..( 6): Matrix.002 file - promoters60/1397594
agggaa

SEQ ID NO: 49400 - DNA, 9 bp, Unknown
  misc_feature (1)..( 9): Matrix.002 file - promoters60/1397700
aattgtaat

SEQ ID NO: 49401 - DNA, 10 bp, Unknown
  misc_feature (1)..( 10): Matrix.002 file - promoters60/1397700
aaatttcaaa

SEQ ID NO: 49402 - DNA, 8 bp, Unknown
  misc_feature (1)..( 8): Matrix.002 file - promoters60/1397700
attcaaga

SEQ ID NO: 49403 - DNA, 8 bp, Unknown
  misc_feature (1)..( 8): Matrix.002 file - promoters60/1397700
gaaacaaa

SEQ ID NO: 49404 - DNA, 7 bp, Unknown
  misc_feature (1)..( 7): Matrix.002 file - promoters60/1397700
tttcttg

SEQ ID NO: 49405 - DNA, 8 bp, Unknown
  misc_feature (1)..( 8): Matrix.002 file - promoters60/1397700
attgaaat

SEQ ID NO: 49406 - DNA, 9 bp, Unknown
  misc_feature (1)..( 9): Matrix.002 file - promoters60/1397700
taatatata

SEQ ID NO: 49407 - DNA, 7 bp, Unknown
  misc_feature (1)..( 7): Matrix.002 file - promoters60/1397700
ttctctg

SEQ ID NO: 49408 - DNA, 9 bp, Unknown
  misc_feature (1)..( 9): Matrix.002 file - promoters60/1397700
caattaaat

SEQ ID NO: 49409 - DNA, 7 bp, Unknown
  misc_feature (1)..( 7): Matrix.002 file - promoters60/1397700
gtgtttg

SEQ ID NO: 49410 - DNA, 11 bp, Unknown
  misc_feature (1)..( 11): Matrix.002 file - promoters60/1397700
taaagtcaaaa

SEQ ID NO: 49411 - DNA, 10 bp, Unknown
  misc_feature (1)..( 10): Matrix.002 file - promoters60/1397700
aaagtcaaaa

SEQ ID NO: 49412 - DNA, 9 bp, Unknown
  misc_feature (1)..( 9): Matrix.002 file - promoters60/1397753
aataatttg

SEQ ID NO: 49413 - DNA, 10 bp, Unknown
  misc_feature (1)..( 10): Matrix.002 file - promoters60/1397753
aatattttga

SEQ ID NO: 49414 - DNA, 15 bp, Unknown
  misc_feature (1)..( 15): Matrix.002 file - promoters60/1397753
tttaggattttatta

SEQ ID NO: 49415 - DNA, 13 bp, Unknown
  misc_feature (1)..( 13): Matrix.002 file - promoters60/1397753
atactaaaataat

SEQ ID NO: 49416 - DNA, 10 bp, Unknown
  misc_feature (1)..( 10): Matrix.002 file - promoters60/1397821
gaattgatta

SEQ ID NO: 49417 - DNA, 10 bp, Unknown
  misc_feature (1)..( 10): Matrix.002 file - promoters60/1397821
gtcttttcaa

SEQ ID NO: 49418 - DNA, 11 bp, Unknown
  misc_feature (1)..( 11): Matrix.002 file - promoters60/1397821
acaagtttgat

SEQ ID NO: 49419 - DNA, 9 bp, Unknown
  misc_feature (1)..( 9): Matrix.002 file - promoters60/1397821
aaaacattg

SEQ ID NO: 49420 - DNA, 10 bp, Unknown
  misc_feature (1)..( 10): Matrix.002 file - promoters60/1397867
tatggtttct

SEQ ID NO: 49421 - DNA, 10 bp, Unknown
  misc_feature (1)..( 10): Matrix.002 file - promoters60/1397867
aattcatata

SEQ ID NO: 49422 - DNA, 8 bp, Unknown
  misc_feature (1)..( 8): Matrix.002 file - promoters60/1397898
ttgtgtat

SEQ ID NO: 49423 - DNA, 7 bp, Unknown
  misc_feature (1)..( 7): Matrix.002 file - promoters60/1397898
tgtagtt

SEQ ID NO: 49424 - DNA, 6 bp, Unknown
  misc_feature (1)..( 6): Matrix.002 file - promoters60/1397898
aattct

SEQ ID NO: 49425 - DNA, 6 bp, Unknown
  misc_feature (1)..( 6): Matrix.002 file - promoters60/1397898
tacata

SEQ ID NO: 49426 - DNA, 8 bp, Unknown
  misc_feature (1)..( 8): Matrix.002 file - promoters60/1397898
gaatgatt

SEQ ID NO: 49427 - DNA, 7 bp, Unknown
  misc_feature (1)..( 7): Matrix.002 file - promoters60/1397898
caacgag

SEQ ID NO: 49428 - DNA, 7 bp, Unknown
  misc_feature (1)..( 7): Matrix.002 file - promoters60/1397898
atggttg

SEQ ID NO: 49429 - DNA, 6 bp, Unknown
  misc_feature (1)..( 6): Matrix.002 file - promoters60/1397898
ttgctg

SEQ ID NO: 49430 - DNA, 7 bp, Unknown
  misc_feature (1)..( 7): Matrix.002 file - promoters60/1397898
tttaaca

SEQ ID NO: 49431 - DNA, 11 bp, Unknown
  misc_feature (1)..( 11): Matrix.002 file - promoters60/1397898
tccctttctgc

SEQ ID NO: 49432 - DNA, 9 bp, Unknown
  misc_feature (1)..( 9): Matrix.002 file - promoters60/1397919
aataacaag

SEQ ID NO: 49433 - DNA, 8 bp, Unknown
  misc_feature (1)..( 8): Matrix.002 file - promoters60/1397923
cttttttt

SEQ ID NO: 49434 - DNA, 8 bp, Unknown
  misc_feature (1)..( 8): Matrix.002 file - promoters60/1397923
tttataaa

SEQ ID NO: 49435 - DNA, 8 bp, Unknown
  misc_feature (1)..( 8): Matrix.002 file - promoters60/1397923
aaaatttt

SEQ ID NO: 49436 - DNA, 16 bp, Unknown
  misc_feature (1)..( 16): Matrix.002 file - promoters60/1397923
taacaaaaatgacatt

SEQ ID NO: 49437 - DNA, 7 bp, Unknown
  misc_feature (1)..( 7): Matrix.002 file - promoters60/1397923
aaaaaaa

SEQ ID NO: 49438 - DNA, 9 bp, Unknown
  misc_feature (1)..( 9): Matrix.002 file - promoters60/1397923
attttgttt

SEQ ID NO: 49439 - DNA, 9 bp, Unknown
  misc_feature (1)..( 9): Matrix.002 file - promoters60/1397923
aaacaaaaa

SEQ ID NO: 49440 - DNA, 9 bp, Unknown
  misc_feature (1)..( 9): Matrix.002 file - promoters60/1397923
tttaattat

SEQ ID NO: 49441 - DNA, 13 bp, Unknown
  misc_feature (1)..( 13): Matrix.002 file - promoters60/1397923
aaaaatttgtaaa

SEQ ID NO: 49442 - DNA, 11 bp, Unknown
  misc_feature (1)..( 11): Matrix.002 file - promoters60/1397923
aaatttgaaaa

SEQ ID NO: 49443 - DNA, 7 bp, Unknown
  misc_feature (1)..( 7): Matrix.002 file - promoters60/1397923
attttac

SEQ ID NO: 49444 - DNA, 8 bp, Unknown
  misc_feature (1)..( 8): Matrix.002 file - promoters60/1398081
ttatatca

SEQ ID NO: 49445 - DNA, 8 bp, Unknown
  misc_feature (1)..( 8): Matrix.002 file - promoters60/1398081
agataagt

SEQ ID NO: 49446 - DNA, 6 bp, Unknown
  misc_feature (1)..( 6): Matrix.002 file - promoters60/1398081
agtaaa

SEQ ID NO: 49447 - DNA, 13 bp, Unknown
  misc_feature (1)..( 13): Matrix.002 file - promoters60/1398081
caataaaatttgg

SEQ ID NO: 49448 - DNA, 13 bp, Unknown
  misc_feature (1)..( 13): Matrix.002 file - promoters60/1398081
ataggatatcttt

SEQ ID NO: 49449 - DNA, 9 bp, Unknown
  misc_feature (1)..( 9): Matrix.002 file - promoters60/1398081
ttaaataaa

SEQ ID NO: 49450 - DNA, 9 bp, Unknown
  misc_feature (1)..( 9): Matrix.002 file - promoters60/1398114
caaagaatt

SEQ ID NO: 49451 - DNA, 9 bp, Unknown
  misc_feature (1)..( 9): Matrix.002 file - promoters60/1398114
aaataactt

SEQ ID NO: 49452 - DNA, 14 bp, Unknown
  misc_feature (1)..( 14): Matrix.002 file - promoters60/1398114
tcagtggaaattat

SEQ ID NO: 49453 - DNA, 8 bp, Unknown
  misc_feature (1)..( 8): Matrix.002 file - promoters60/1398114
caaaacaa

SEQ ID NO: 49454 - DNA, 8 bp, Unknown
  misc_feature (1)..( 8): Matrix.002 file - promoters60/1398124
caaatatt

SEQ ID NO: 49455 - DNA, 10 bp, Unknown
  misc_feature (1)..( 10): Matrix.002 file - promoters60/1398124
acttatttta

SEQ ID NO: 49456 - DNA, 11 bp, Unknown
  misc_feature (1)..( 11): Matrix.002 file - promoters60/1398124
ttaagtagatt

SEQ ID NO: 49457 - DNA, 7 bp, Unknown
  misc_feature (1)..( 7): Matrix.002 file - promoters60/1398270
cgaattt

SEQ ID NO: 49458 - DNA, 7 bp, Unknown
  misc_feature (1)..( 7): Matrix.002 file - promoters60/1398270
tgcaaac

SEQ ID NO: 49459 - DNA, 9 bp, Unknown
  misc_feature (1)..( 9): Matrix.002 file - promoters60/1398270
tagaacgga

SEQ ID NO: 49460 - DNA, 7 bp, Unknown
  misc_feature (1)..( 7): Matrix.002 file - promoters60/1398270
aaacgat

SEQ ID NO: 49461 - DNA, 6 bp, Unknown
  misc_feature (1)..( 6): Matrix.002 file - promoters60/1398270
aaagag

SEQ ID NO: 49462 - DNA, 6 bp, Unknown
  misc_feature (1)..( 6): Matrix.002 file - promoters60/1398270
ctcagt

SEQ ID NO: 49463 - DNA, 6 bp, Unknown
  misc_feature (1)..( 6): Matrix.002 file - promoters60/1398270
ttttgt

SEQ ID NO: 49464 - DNA, 6 bp, Unknown
  misc_feature (1)..( 6): Matrix.002 file - promoters60/1398270
taacta

SEQ ID NO: 49465 - DNA, 6 bp, Unknown
  misc_feature (1)..( 6): Matrix.002 file - promoters60/1398270
tgactc

SEQ ID NO: 49466 - DNA, 7 bp, Unknown
  misc_feature (1)..( 7): Matrix.002 file - promoters60/1398270
aaaccaa

SEQ ID NO: 49467 - DNA, 6 bp, Unknown
  misc_feature (1)..( 6): Matrix.002 file - promoters60/1398270
gaaaaa

SEQ ID NO: 49468 - DNA, 9 bp, Unknown
  misc_feature (1)..( 9): Matrix.002 file - promoters60/1398270
agataataa

SEQ ID NO: 49469 - DNA, 7 bp, Unknown
  misc_feature (1)..( 7): Matrix.002 file - promoters60/1398270
ttaataa

SEQ ID NO: 49470 - DNA, 7 bp, Unknown
  misc_feature (1)..( 7): Matrix.002 file - promoters60/1398270
ttccaaa

SEQ ID NO: 49471 - DNA, 6 bp, Unknown
  misc_feature (1)..( 6): Matrix.002 file - promoters60/1398270
ccaaac

SEQ ID NO: 49472 - DNA, 6 bp, Unknown
  misc_feature (1)..( 6): Matrix.002 file - promoters60/1398270
ggtttt

SEQ ID NO: 49473 - DNA, 6 bp, Unknown
  misc_feature (1)..( 6): Matrix.002 file - promoters60/1398270
ttaatt

SEQ ID NO: 49474 - DNA, 8 bp, Unknown
  misc_feature (1)..( 8): Matrix.002 file - promoters60/1398270
gttagtat

SEQ ID NO: 49475 - DNA, 6 bp, Unknown
  misc_feature (1)..( 6): Matrix.002 file - promoters60/1398270
ttggcg

SEQ ID NO: 49476 - DNA, 7 bp, Unknown
  misc_feature (1)..( 7): Matrix.002 file - promoters60/1398270
atattta

SEQ ID NO: 49477 - DNA, 7 bp, Unknown
  misc_feature (1)..( 7): Matrix.002 file - promoters60/1398328
acgaagc

SEQ ID NO: 49478 - DNA, 7 bp, Unknown
  misc_feature (1)..( 7): Matrix.002 file - promoters60/1398328
caatttt

SEQ ID NO: 49479 - DNA, 6 bp, Unknown
  misc_feature (1)..( 6): Matrix.002 file - promoters60/1398328
gaaaaa

SEQ ID NO: 49480 - DNA, 6 bp, Unknown
  misc_feature (1)..( 6): Matrix.002 file - promoters60/1398328
taataa

SEQ ID NO: 49481 - DNA, 9 bp, Unknown
  misc_feature (1)..( 9): Matrix.002 file - promoters60/1398328
agaacccta

SEQ ID NO: 49482 - DNA, 6 bp, Unknown
  misc_feature (1)..( 6): Matrix.002 file - promoters60/1398328
attgag

SEQ ID NO: 49483 - DNA, 7 bp, Unknown
  misc_feature (1)..( 7): Matrix.002 file - promoters60/1398328
gataatt

SEQ ID NO: 49484 - DNA, 6 bp, Unknown
  misc_feature (1)..( 6): Matrix.002 file - promoters60/1398328
tccttg

SEQ ID NO: 49485 - DNA, 6 bp, Unknown
  misc_feature (1)..( 6): Matrix.002 file - promoters60/1398328
aattaa

SEQ ID NO: 49486 - DNA, 7 bp, Unknown
  misc_feature (1)..( 7): Matrix.002 file - promoters60/1398328
gataaca

SEQ ID NO: 49487 - DNA, 7 bp, Unknown
  misc_feature (1)..( 7): Matrix.002 file - promoters60/1398328
ttagttc

SEQ ID NO: 49488 - DNA, 6 bp, Unknown
  misc_feature (1)..( 6): Matrix.002 file - promoters60/1398328
ttatat

SEQ ID NO: 49489 - DNA, 7 bp, Unknown
  misc_feature (1)..( 7): Matrix.002 file - promoters60/1398328
aaaaatt

SEQ ID NO: 49490 - DNA, 9 bp, Unknown
  misc_feature (1)..( 9): Matrix.002 file - promoters60/1398328
ttgtataaa

SEQ ID NO: 49491 - DNA, 7 bp, Unknown
  misc_feature (1)..( 7): Matrix.002 file - promoters60/1398328
aatcgag

SEQ ID NO: 49492 - DNA, 6 bp, Unknown
  misc_feature (1)..( 6): Matrix.002 file - promoters60/1398337
taaaga

SEQ ID NO: 49493 - DNA, 7 bp, Unknown
  misc_feature (1)..( 7): Matrix.002 file - promoters60/1398337
attgttg

SEQ ID NO: 49494 - DNA, 6 bp, Unknown
  misc_feature (1)..( 6): Matrix.002 file - promoters60/1398337
agagag

SEQ ID NO: 49495 - DNA, 8 bp, Unknown
  misc_feature (1)..( 8): Matrix.002 file - promoters60/1398337
ttttaatt

SEQ ID NO: 49496 - DNA, 11 bp, Unknown
  misc_feature (1)..( 11): Matrix.002 file - promoters60/1398337
gaaacaaaaac

SEQ ID NO: 49497 - DNA, 6 bp, Unknown
  misc_feature (1)..( 6): Matrix.002 file - promoters60/1398337
aaccaa

SEQ ID NO: 49498 - DNA, 7 bp, Unknown
  misc_feature (1)..( 7): Matrix.002 file - promoters60/1398337
ttgactc

SEQ ID NO: 49499 - DNA, 6 bp, Unknown
  misc_feature (1)..( 6): Matrix.002 file - promoters60/1398337
aaagaa

SEQ ID NO: 49500 - DNA, 6 bp, Unknown
  misc_feature (1)..( 6): Matrix.002 file - promoters60/1398337
taattg

SEQ ID NO: 49501 - DNA, 6 bp, Unknown
  misc_feature (1)..( 6): Matrix.002 file - promoters60/1398337
aataaa

SEQ ID NO: 49502 - DNA, 6 bp, Unknown
  misc_feature (1)..( 6): Matrix.002 file - promoters60/1398337
agtaaa

SEQ ID NO: 49503 - DNA, 7 bp, Unknown
  misc_feature (1)..( 7): Matrix.002 file - promoters60/1398337
aatcggg

SEQ ID NO: 49504 - DNA, 10 bp, Unknown
  misc_feature (1)..( 10): Matrix.002 file - promoters60/1398337
ggaaaagaaa

SEQ ID NO: 49505 - DNA, 7 bp, Unknown
  misc_feature (1)..( 7): Matrix.002 file - promoters60/1398337
cccacta

SEQ ID NO: 49506 - DNA, 9 bp, Unknown
  misc_feature (1)..( 9): Matrix.002 file - promoters60/1398337
aaagaaaag

SEQ ID NO: 49507 - DNA, 7 bp, Unknown
  misc_feature (1)..( 7): Matrix.002 file - promoters60/1398337
gtatata

SEQ ID NO: 49508 - DNA, 8 bp, Unknown
  misc_feature (1)..( 8): Matrix.002 file - promoters60/1398345
gattggta

SEQ ID NO: 49509 - DNA, 8 bp, Unknown
  misc_feature (1)..( 8): Matrix.002 file - promoters60/1398345
aaaaatat

SEQ ID NO: 49510 - DNA, 6 bp, Unknown
  misc_feature (1)..( 6): Matrix.002 file - promoters60/1398345
tcatca

SEQ ID NO: 49511 - DNA, 7 bp, Unknown
  misc_feature (1)..( 7): Matrix.002 file - promoters60/1398345
cacccct

SEQ ID NO: 49512 - DNA, 7 bp, Unknown
  misc_feature (1)..( 7): Matrix.002 file - promoters60/1398345
ctataaa

SEQ ID NO: 49513 - DNA, 6 bp, Unknown
  misc_feature (1)..( 6): Matrix.002 file - promoters60/1398345
cggttt

SEQ ID NO: 49514 - DNA, 7 bp, Unknown
  misc_feature (1)..( 7): Matrix.002 file - promoters60/1398345
tttaagc

SEQ ID NO: 49515 - DNA, 6 bp, Unknown
  misc_feature (1)..( 6): Matrix.002 file - promoters60/1398345
gtttgg

SEQ ID NO: 49516 - DNA, 6 bp, Unknown
  misc_feature (1)..( 6): Matrix.002 file - promoters60/1398345
aagaaa

SEQ ID NO: 49517 - DNA, 10 bp, Unknown
  misc_feature (1)..( 10): Matrix.002 file - promoters60/1398401
tcatatgcat

SEQ ID NO: 49518 - DNA, 10 bp, Unknown
  misc_feature (1)..( 10): Matrix.002 file - promoters60/1398401
gtaaaatacg

SEQ ID NO: 49519 - DNA, 7 bp, Unknown
  misc_feature (1)..( 7): Matrix.002 file - promoters60/1398401
agaaagt

SEQ ID NO: 49520 - DNA, 8 bp, Unknown
  misc_feature (1)..( 8): Matrix.002 file - promoters60/1398401
atttgtat

SEQ ID NO: 49521 - DNA, 9 bp, Unknown
  misc_feature (1)..( 9): Matrix.002 file - promoters60/1398401
aggtacttt

SEQ ID NO: 49522 - DNA, 9 bp, Unknown
  misc_feature (1)..( 9): Matrix.002 file - promoters60/1398401
gaaatagtt

SEQ ID NO: 49523 - DNA, 9 bp, Unknown
  misc_feature (1)..( 9): Matrix.002 file - promoters60/1398401
ttaagaaga

SEQ ID NO: 49524 - DNA, 13 bp, Unknown
  misc_feature (1)..( 13): Matrix.002 file - promoters60/1398444
aaaaaaaataact

SEQ ID NO: 49525 - DNA, 9 bp, Unknown
  misc_feature (1)..( 9): Matrix.002 file - promoters60/1398444
attgaagct

SEQ ID NO: 49526 - DNA, 14 bp, Unknown
  misc_feature (1)..( 14): Matrix.002 file - promoters60/1398444
aatttaaaaaacaa

SEQ ID NO: 49527 - DNA, 7 bp, Unknown
  misc_feature (1)..( 7): Matrix.002 file - promoters60/1398444
ggattga

SEQ ID NO: 49528 - DNA, 7 bp, Unknown
  misc_feature (1)..( 7): Matrix.002 file - promoters60/1398444
tatgatt

SEQ ID NO: 49529 - DNA, 11 bp, Unknown
  misc_feature (1)..( 11): Matrix.002 file - promoters60/1398444
aaactataaat

SEQ ID NO: 49530 - DNA, 10 bp, Unknown
  misc_feature (1)..( 10): Matrix.002 file - promoters60/1398444
gattaaaatg

SEQ ID NO: 49531 - DNA, 8 bp, Unknown
  misc_feature (1)..( 8): Matrix.002 file - promoters60/1398444
tctaattt

SEQ ID NO: 49532 - DNA, 9 bp, Unknown
  misc_feature (1)..( 9): Matrix.002 file - promoters60/1398444
gaaacaaag

SEQ ID NO: 49533 - DNA, 8 bp, Unknown
  misc_feature (1)..( 8): Matrix.002 file - promoters60/1398558
ttatataa

SEQ ID NO: 49534 - DNA, 12 bp, Unknown
  misc_feature (1)..( 12): Matrix.002 file - promoters60/1398558
tgaaaaagtaat

SEQ ID NO: 49535 - DNA, 7 bp, Unknown
  misc_feature (1)..( 7): Matrix.002 file - promoters60/1398558
tatttaa

SEQ ID NO: 49536 - DNA, 11 bp, Unknown
  misc_feature (1)..( 11): Matrix.002 file - promoters60/1398565
tttgtatttta

SEQ ID NO: 49537 - DNA, 7 bp, Unknown
  misc_feature (1)..( 7): Matrix.002 file - promoters60/1398565
tatgtaa

SEQ ID NO: 49538 - DNA, 7 bp, Unknown
  misc_feature (1)..( 7): Matrix.002 file - promoters60/1398565
ttacttg

SEQ ID NO: 49539 - DNA, 7 bp, Unknown
  misc_feature (1)..( 7): Matrix.002 file - promoters60/1398565
tctaatt

SEQ ID NO: 49540 - DNA, 8 bp, Unknown
  misc_feature (1)..( 8): Matrix.002 file - promoters60/1398565
acaaacca

SEQ ID NO: 49541 - DNA, 7 bp, Unknown
  misc_feature (1)..( 7): Matrix.002 file - promoters60/1398565
aagcata

SEQ ID NO: 49542 - DNA, 13 bp, Unknown
  misc_feature (1)..( 13): Matrix.002 file - promoters60/1398565
aatataaaaatat

SEQ ID NO: 49543 - DNA, 7 bp, Unknown
  misc_feature (1)..( 7): Matrix.002 file - promoters60/1398565
tttcaaa

SEQ ID NO: 49544 - DNA, 8 bp, Unknown
  misc_feature (1)..( 8): Matrix.002 file - promoters60/1398565
atatatat

SEQ ID NO: 49545 - DNA, 7 bp, Unknown
  misc_feature (1)..( 7): Matrix.002 file - promoters60/1398565
aagaaaa

SEQ ID NO: 49546 - DNA, 6 bp, Unknown
  misc_feature (1)..( 6): Matrix.002 file - promoters60/1398565
caaaaa

SEQ ID NO: 49547 - DNA, 7 bp, Unknown
  misc_feature (1)..( 7): Matrix.002 file - promoters60/1398565
aaacaaa

SEQ ID NO: 49548 - DNA, 6 bp, Unknown
  misc_feature (1)..( 6): Matrix.002 file - promoters60/1398565
aatata

SEQ ID NO: 49549 - DNA, 7 bp, Unknown
  misc_feature (1)..( 7): Matrix.002 file - promoters60/1398565
aataaat

SEQ ID NO: 49550 - DNA, 6 bp, Unknown
  misc_feature (1)..( 6): Matrix.002 file - promoters60/1398565
gataga

SEQ ID NO: 49551 - DNA, 7 bp, Unknown
  misc_feature (1)..( 7): Matrix.002 file - promoters60/1398565
aaactca

SEQ ID NO: 49552 - DNA, 9 bp, Unknown
  misc_feature (1)..( 9): Matrix.002 file - promoters60/1398704
accgttcat

SEQ ID NO: 49553 - DNA, 6 bp, Unknown
  misc_feature (1)..( 6): Matrix.002 file - promoters60/1398704
tatatc

SEQ ID NO: 49554 - DNA, 7 bp, Unknown
  misc_feature (1)..( 7): Matrix.002 file - promoters60/1398704
ttagtgt

SEQ ID NO: 49555 - DNA, 7 bp, Unknown
  misc_feature (1)..( 7): Matrix.002 file - promoters60/1398704
tttccta

SEQ ID NO: 49556 - DNA, 6 bp, Unknown
  misc_feature (1)..( 6): Matrix.002 file - promoters60/1398704
gtcttc

SEQ ID NO: 49557 - DNA, 7 bp, Unknown
  misc_feature (1)..( 7): Matrix.002 file - promoters60/1398704
catacaa

SEQ ID NO: 49558 - DNA, 7 bp, Unknown
  misc_feature (1)..( 7): Matrix.002 file - promoters60/1398704
caaaaca

SEQ ID NO: 49559 - DNA, 7 bp, Unknown
  misc_feature (1)..( 7): Matrix.002 file - promoters60/1398704
aacacga

SEQ ID NO: 49560 - DNA, 7 bp, Unknown
  misc_feature (1)..( 7): Matrix.002 file - promoters60/1398704
ttcttct

SEQ ID NO: 49561 - DNA, 7 bp, Unknown
  misc_feature (1)..( 7): Matrix.002 file - promoters60/1398704
ccaatag

SEQ ID NO: 49562 - DNA, 6 bp, Unknown
  misc_feature (1)..( 6): Matrix.002 file - promoters60/1398704
tttttg

SEQ ID NO: 49563 - DNA, 11 bp, Unknown
  misc_feature (1)..( 11): Matrix.002 file - promoters60/1398704
attgttgtttt

SEQ ID NO: 49564 - DNA, 7 bp, Unknown
  misc_feature (1)..( 7): Matrix.002 file - promoters60/1398704
aaaaaag

SEQ ID NO: 49565 - DNA, 7 bp, Unknown
  misc_feature (1)..( 7): Matrix.002 file - promoters60/1398704
acaaaat

SEQ ID NO: 49566 - DNA, 8 bp, Unknown
  misc_feature (1)..( 8): Matrix.002 file - promoters60/1398704
aattttgg

SEQ ID NO: 49567 - DNA, 8 bp, Unknown
  misc_feature (1)..( 8): Matrix.002 file - promoters60/1398737
ttagattt

SEQ ID NO: 49568 - DNA, 10 bp, Unknown
  misc_feature (1)..( 10): Matrix.002 file - promoters60/1398737
ctataaaaag

SEQ ID NO: 49569 - DNA, 11 bp, Unknown
  misc_feature (1)..( 11): Matrix.002 file - promoters60/1398737
gccaataaaaa

SEQ ID NO: 49570 - DNA, 10 bp, Unknown
  misc_feature (1)..( 10): Matrix.002 file - promoters60/1398737
ccaaatttaa

SEQ ID NO: 49571 - DNA, 11 bp, Unknown
  misc_feature (1)..( 11): Matrix.002 file - promoters60/1398737
tttatagaaaa

SEQ ID NO: 49572 - DNA, 9 bp, Unknown
  misc_feature (1)..( 9): Matrix.002 file - promoters60/1398737
gattagttt

SEQ ID NO: 49573 - DNA, 8 bp, Unknown
  misc_feature (1)..( 8): Matrix.002 file - promoters60/1398784
aattaagt

SEQ ID NO: 49574 - DNA, 7 bp, Unknown
  misc_feature (1)..( 7): Matrix.002 file - promoters60/1398784
gaaacaa

SEQ ID NO: 49575 - DNA, 10 bp, Unknown
  misc_feature (1)..( 10): Matrix.002 file - promoters60/1398784
gaaaattaaa

SEQ ID NO: 49576 - DNA, 8 bp, Unknown
  misc_feature (1)..( 8): Matrix.002 file - promoters60/1398784
aaatcaat

SEQ ID NO: 49577 - DNA, 7 bp, Unknown
  misc_feature (1)..( 7): Matrix.002 file - promoters60/1398784
aaaattt

SEQ ID NO: 49578 - DNA, 9 bp, Unknown
  misc_feature (1)..( 9): Matrix.002 file - promoters60/1398784
aagaaaaaa

SEQ ID NO: 49579 - DNA, 6 bp, Unknown
  misc_feature (1)..( 6): Matrix.002 file - promoters60/1398784
tttttc

SEQ ID NO: 49580 - DNA, 6 bp, Unknown
  misc_feature (1)..( 6): Matrix.002 file - promoters60/1398784
ggaaat

SEQ ID NO: 49581 - DNA, 7 bp, Unknown
  misc_feature (1)..( 7): Matrix.002 file - promoters60/1398784
ataaaat

SEQ ID NO: 49582 - DNA, 6 bp, Unknown
  misc_feature (1)..( 6): Matrix.002 file - promoters60/1398784
ttaaga

SEQ ID NO: 49583 - DNA, 7 bp, Unknown
  misc_feature (1)..( 7): Matrix.002 file - promoters60/1398784
aaaattg

SEQ ID NO: 49584 - DNA, 6 bp, Unknown
  misc_feature (1)..( 6): Matrix.002 file - promoters60/1398784
ccaatt

SEQ ID NO: 49585 - DNA, 7 bp, Unknown
  misc_feature (1)..( 7): Matrix.002 file - promoters60/1398784
ttgaaat

SEQ ID NO: 49586 - DNA, 6 bp, Unknown
  misc_feature (1)..( 6): Matrix.002 file - promoters60/1398784
aatccg

SEQ ID NO: 49587 - DNA, 6 bp, Unknown
  misc_feature (1)..( 6): Matrix.002 file - promoters60/1398784
agaagt

SEQ ID NO: 49588 - DNA, 6 bp, Unknown
  misc_feature (1)..( 6): Matrix.002 file - promoters60/1398784
aaatga

SEQ ID NO: 49589 - DNA, 6 bp, Unknown
  misc_feature (1)..( 6): Matrix.002 file - promoters60/1398784
taaaaa

SEQ ID NO: 49590 - DNA, 6 bp, Unknown
  misc_feature (1)..( 6): Matrix.002 file - promoters60/1398784
aaaatt

SEQ ID NO: 49591 - DNA, 8 bp, Unknown
  misc_feature (1)..( 8): Matrix.002 file - promoters60/1398784
tttcaaat

SEQ ID NO: 49592 - DNA, 6 bp, Unknown
  misc_feature (1)..( 6): Matrix.002 file - promoters60/1398784
ttttcc

SEQ ID NO: 49593 - DNA, 6 bp, Unknown
  misc_feature (1)..( 6): Matrix.002 file - promoters60/1398799
tgttct

SEQ ID NO: 49594 - DNA, 7 bp, Unknown
  misc_feature (1)..( 7): Matrix.002 file - promoters60/1398799
agatata

SEQ ID NO: 49595 - DNA, 11 bp, Unknown
  misc_feature (1)..( 11): Matrix.002 file - promoters60/1398799
ataaacaagaa

SEQ ID NO: 49596 - DNA, 10 bp, Unknown
  misc_feature (1)..( 10): Matrix.002 file - promoters60/1398799
gagtcatttg

SEQ ID NO: 49597 - DNA, 8 bp, Unknown
  misc_feature (1)..( 8): Matrix.002 file - promoters60/1398799
attactac

SEQ ID NO: 49598 - DNA, 6 bp, Unknown
  misc_feature (1)..( 6): Matrix.002 file - promoters60/1398799
acataa

SEQ ID NO: 49599 - DNA, 9 bp, Unknown
  misc_feature (1)..( 9): Matrix.002 file - promoters60/1398799
ataaatacc

SEQ ID NO: 49600 - DNA, 7 bp, Unknown
  misc_feature (1)..( 7): Matrix.002 file - promoters60/1398799
gctgctg

SEQ ID NO: 49601 - DNA, 9 bp, Unknown
  misc_feature (1)..( 9): Matrix.002 file - promoters60/1398799
tttaactct

SEQ ID NO: 49602 - DNA, 8 bp, Unknown
  misc_feature (1)..( 8): Matrix.002 file - promoters60/1398799
gtctacga

SEQ ID NO: 49603 - DNA, 8 bp, Unknown
  misc_feature (1)..( 8): Matrix.002 file - promoters60/1398799
aatcaagt

SEQ ID NO: 49604 - DNA, 9 bp, Unknown
  misc_feature (1)..( 9): Matrix.002 file - promoters60/1398799
tgggcccat

SEQ ID NO: 49605 - DNA, 7 bp, Unknown
  misc_feature (1)..( 7): Matrix.002 file - promoters60/1398799
cctctgt

SEQ ID NO: 49606 - DNA, 8 bp, Unknown
  misc_feature (1)..( 8): Matrix.002 file - promoters60/1398799
accctttt

SEQ ID NO: 49607 - DNA, 7 bp, Unknown
  misc_feature (1)..( 7): Matrix.002 file - promoters60/1398799
gttatga

SEQ ID NO: 49608 - DNA, 8 bp, Unknown
  misc_feature (1)..( 8): Matrix.002 file - promoters60/1398799
cttcatta

SEQ ID NO: 49609 - DNA, 6 bp, Unknown
  misc_feature (1)..( 6): Matrix.002 file - promoters60/1398846
tttact

SEQ ID NO: 49610 - DNA, 6 bp, Unknown
  misc_feature (1)..( 6): Matrix.002 file - promoters60/1398846
gtttct

SEQ ID NO: 49611 - DNA, 7 bp, Unknown
  misc_feature (1)..( 7): Matrix.002 file - promoters60/1398846
tttgtta

SEQ ID NO: 49612 - DNA, 7 bp, Unknown
  misc_feature (1)..( 7): Matrix.002 file - promoters60/1398846
tatacca

SEQ ID NO: 49613 - DNA, 6 bp, Unknown
  misc_feature (1)..( 6): Matrix.002 file - promoters60/1398846
tcctat

SEQ ID NO: 49614 - DNA, 6 bp, Unknown
  misc_feature (1)..( 6): Matrix.002 file - promoters60/1398846
aaaaat

SEQ ID NO: 49615 - DNA, 6 bp, Unknown
  misc_feature (1)..( 6): Matrix.002 file - promoters60/1398846
taaact

SEQ ID NO: 49616 - DNA, 6 bp, Unknown
  misc_feature (1)..( 6): Matrix.002 file - promoters60/1398846
attaat

SEQ ID NO: 49617 - DNA, 9 bp, Unknown
  misc_feature (1)..( 9): Matrix.002 file - promoters60/1398846
ttaattaaa

SEQ ID NO: 49618 - DNA, 11 bp, Unknown
  misc_feature (1)..( 11): Matrix.002 file - promoters60/1398846
atatatataaa

SEQ ID NO: 49619 - DNA, 6 bp, Unknown
  misc_feature (1)..( 6): Matrix.002 file - promoters60/1398846
ttatta

SEQ ID NO: 49620 - DNA, 7 bp, Unknown
  misc_feature (1)..( 7): Matrix.002 file - promoters60/1398846
tctaatt

SEQ ID NO: 49621 - DNA, 7 bp, Unknown
  misc_feature (1)..( 7): Matrix.002 file - promoters60/1398846
aaaaaaa

SEQ ID NO: 49622 - DNA, 7 bp, Unknown
  misc_feature (1)..( 7): Matrix.002 file - promoters60/1398846
ctaaccc

SEQ ID NO: 49623 - DNA, 6 bp, Unknown
  misc_feature (1)..( 6): Matrix.002 file - promoters60/1398846
tcaccc

SEQ ID NO: 49624 - DNA, 6 bp, Unknown
  misc_feature (1)..( 6): Matrix.002 file - promoters60/1398846
attaaa

SEQ ID NO: 49625 - DNA, 6 bp, Unknown
  misc_feature (1)..( 6): Matrix.002 file - promoters60/1398846
gaaaaa

SEQ ID NO: 49626 - DNA, 8 bp, Unknown
  misc_feature (1)..( 8): Matrix.002 file - promoters60/1398846
ttagctta

SEQ ID NO: 49627 - DNA, 6 bp, Unknown
  misc_feature (1)..( 6): Matrix.002 file - promoters60/1398846
ttttca

SEQ ID NO: 49628 - DNA, 7 bp, Unknown
  misc_feature (1)..( 7): Matrix.002 file - promoters60/1398846
aagaaac

SEQ ID NO: 49629 - DNA, 14 bp, Unknown
  misc_feature (1)..( 14): Matrix.002 file - promoters60/1399037
aatatttgaactaa

SEQ ID NO: 49630 - DNA, 8 bp, Unknown
  misc_feature (1)..( 8): Matrix.002 file - promoters60/1399074
agtaaaga

SEQ ID NO: 49631 - DNA, 7 bp, Unknown
  misc_feature (1)..( 7): Matrix.002 file - promoters60/1399074
ttggaac

SEQ ID NO: 49632 - DNA, 10 bp, Unknown
  misc_feature (1)..( 10): Matrix.002 file - promoters60/1399074
gaaagaaagc

SEQ ID NO: 49633 - DNA, 10 bp, Unknown
  misc_feature (1)..( 10): Matrix.002 file - promoters60/1399074
ggaaaagaaa

SEQ ID NO: 49634 - DNA, 6 bp, Unknown
  misc_feature (1)..( 6): Matrix.002 file - promoters60/1399074
agggaa

SEQ ID NO: 49635 - DNA, 6 bp, Unknown
  misc_feature (1)..( 6): Matrix.002 file - promoters60/1399074
taaagg

SEQ ID NO: 49636 - DNA, 7 bp, Unknown
  misc_feature (1)..( 7): Matrix.002 file - promoters60/1399074
gatatgg

SEQ ID NO: 49637 - DNA, 7 bp, Unknown
  misc_feature (1)..( 7): Matrix.002 file - promoters60/1399074
ttgagtc

SEQ ID NO: 49638 - DNA, 6 bp, Unknown
  misc_feature (1)..( 6): Matrix.002 file - promoters60/1399074
ctgttc

SEQ ID NO: 49639 - DNA, 7 bp, Unknown
  misc_feature (1)..( 7): Matrix.002 file - promoters60/1399074
aatcggg

SEQ ID NO: 49640 - DNA, 7 bp, Unknown
  misc_feature (1)..( 7): Matrix.002 file - promoters60/1399074
cccacta

SEQ ID NO: 49641 - DNA, 9 bp, Unknown
  misc_feature (1)..( 9): Matrix.002 file - promoters60/1399074
aaagaaaag

SEQ ID NO: 49642 - DNA, 7 bp, Unknown
  misc_feature (1)..( 7): Matrix.002 file - promoters60/1399074
gtatata

SEQ ID NO: 49643 - DNA, 9 bp, Unknown
  misc_feature (1)..( 9): Matrix.002 file - promoters60/1399140
tttgttttc

SEQ ID NO: 49644 - DNA, 8 bp, Unknown
  misc_feature (1)..( 8): Matrix.002 file - promoters60/1399265
aatattta

SEQ ID NO: 49645 - DNA, 8 bp, Unknown
  misc_feature (1)..( 8): Matrix.002 file - promoters60/1399265
tttatata

SEQ ID NO: 49646 - DNA, 9 bp, Unknown
  misc_feature (1)..( 9): Matrix.002 file - promoters60/1399265
ttaaaaatt

SEQ ID NO: 49647 - DNA, 13 bp, Unknown
  misc_feature (1)..( 13): Matrix.002 file - promoters60/1399265
ctatttttattta

SEQ ID NO: 49648 - DNA, 11 bp, Unknown
  misc_feature (1)..( 11): Matrix.002 file - promoters60/1399265
aatgtgtttta

SEQ ID NO: 49649 - DNA, 9 bp, Unknown
  misc_feature (1)..( 9): Matrix.002 file - promoters60/1399265
tattatttt

SEQ ID NO: 49650 - DNA, 7 bp, Unknown
  misc_feature (1)..( 7): Matrix.002 file - promoters60/1399265
ttatttt

SEQ ID NO: 49651 - DNA, 8 bp, Unknown
  misc_feature (1)..( 8): Matrix.002 file - promoters60/1399265
attttttt

SEQ ID NO: 49652 - DNA, 7 bp, Unknown
  misc_feature (1)..( 7): Matrix.002 file - promoters60/1399265
tttataa

SEQ ID NO: 49653 - DNA, 12 bp, Unknown
  misc_feature (1)..( 12): Matrix.002 file - promoters60/1399265
ttttatttttgc

SEQ ID NO: 49654 - DNA, 7 bp, Unknown
  misc_feature (1)..( 7): Matrix.002 file - promoters60/1399265
ataaaaa

SEQ ID NO: 49655 - DNA, 12 bp, Unknown
  misc_feature (1)..( 12): Matrix.002 file - promoters60/1399265
aataaaataata

SEQ ID NO: 49656 - DNA, 8 bp, Unknown
  misc_feature (1)..( 8): Matrix.002 file - promoters60/1399265
tctgtttt

SEQ ID NO: 49657 - DNA, 9 bp, Unknown
  misc_feature (1)..( 9): Matrix.002 file - promoters60/1399265
tcagaaaaa

SEQ ID NO: 49658 - DNA, 7 bp, Unknown
  misc_feature (1)..( 7): Matrix.002 file - promoters60/1399277
aaaacaa

SEQ ID NO: 49659 - DNA, 6 bp, Unknown
  misc_feature (1)..( 6): Matrix.002 file - promoters60/1399277
attatt

SEQ ID NO: 49660 - DNA, 6 bp, Unknown
  misc_feature (1)..( 6): Matrix.002 file - promoters60/1399277
aataaa

SEQ ID NO: 49661 - DNA, 6 bp, Unknown
  misc_feature (1)..( 6): Matrix.002 file - promoters60/1399277
acaatt

SEQ ID NO: 49662 - DNA, 16 bp, Unknown
  misc_feature (1)..( 16): Matrix.002 file - promoters60/1399277
taaacacaaaaatttt

SEQ ID NO: 49663 - DNA, 8 bp, Unknown
  misc_feature (1)..( 8): Matrix.002 file - promoters60/1399277
ttacaaaa

SEQ ID NO: 49664 - DNA, 6 bp, Unknown
  misc_feature (1)..( 6): Matrix.002 file - promoters60/1399277
ttttat

SEQ ID NO: 49665 - DNA, 8 bp, Unknown
  misc_feature (1)..( 8): Matrix.002 file - promoters60/1399277
atttttta

SEQ ID NO: 49666 - DNA, 6 bp, Unknown
  misc_feature (1)..( 6): Matrix.002 file - promoters60/1399277
gataaa

SEQ ID NO: 49667 - DNA, 10 bp, Unknown
  misc_feature (1)..( 10): Matrix.002 file - promoters60/1399277
gaataaccac

SEQ ID NO: 49668 - DNA, 6 bp, Unknown
  misc_feature (1)..( 6): Matrix.002 file - promoters60/1399277
accaat

SEQ ID NO: 49669 - DNA, 7 bp, Unknown
  misc_feature (1)..( 7): Matrix.002 file - promoters60/1399277
aaacttt

SEQ ID NO: 49670 - DNA, 6 bp, Unknown
  misc_feature (1)..( 6): Matrix.002 file - promoters60/1399277
aaatca

SEQ ID NO: 49671 - DNA, 7 bp, Unknown
  misc_feature (1)..( 7): Matrix.002 file - promoters60/1399277
aagattt

SEQ ID NO: 49672 - DNA, 6 bp, Unknown
  misc_feature (1)..( 6): Matrix.002 file - promoters60/1399277
acatat

SEQ ID NO: 49673 - DNA, 9 bp, Unknown
  misc_feature (1)..( 9): Matrix.002 file - promoters60/1399277
tcaaagtga

SEQ ID NO: 49674 - DNA, 9 bp, Unknown
  misc_feature (1)..( 9): Matrix.002 file - promoters60/1399277
tttattaaa

SEQ ID NO: 49675 - DNA, 7 bp, Unknown
  misc_feature (1)..( 7): Matrix.002 file - promoters60/1399277
aaaagtt

SEQ ID NO: 49676 - DNA, 14 bp, Unknown
  misc_feature (1)..( 14): Matrix.002 file - promoters60/1399325
gataaattatctta

SEQ ID NO: 49677 - DNA, 7 bp, Unknown
  misc_feature (1)..( 7): Matrix.002 file - promoters60/1399417
cgattcc

SEQ ID NO: 49678 - DNA, 7 bp, Unknown
  misc_feature (1)..( 7): Matrix.002 file - promoters60/1399417
agaaaaa

SEQ ID NO: 49679 - DNA, 11 bp, Unknown
  misc_feature (1)..( 11): Matrix.002 file - promoters60/1399417
agctagagaga

SEQ ID NO: 49680 - DNA, 6 bp, Unknown
  misc_feature (1)..( 6): Matrix.002 file - promoters60/1399417
gttttg

SEQ ID NO: 49681 - DNA, 6 bp, Unknown
  misc_feature (1)..( 6): Matrix.002 file - promoters60/1399417
tcgaaa

SEQ ID NO: 49682 - DNA, 7 bp, Unknown
  misc_feature (1)..( 7): Matrix.002 file - promoters60/1399417
atctgag

SEQ ID NO: 49683 - DNA, 8 bp, Unknown
  misc_feature (1)..( 8): Matrix.002 file - promoters60/1399417
gaaacaaa

SEQ ID NO: 49684 - DNA, 6 bp, Unknown
  misc_feature (1)..( 6): Matrix.002 file - promoters60/1399417
attgtg

SEQ ID NO: 49685 - DNA, 6 bp, Unknown
  misc_feature (1)..( 6): Matrix.002 file - promoters60/1399417
tgttcg

SEQ ID NO: 49686 - DNA, 6 bp, Unknown
  misc_feature (1)..( 6): Matrix.002 file - promoters60/1399417
tctgtt

SEQ ID NO: 49687 - DNA, 7 bp, Unknown
  misc_feature (1)..( 7): Matrix.002 file - promoters60/1399417
ataaaaa

SEQ ID NO: 49688 - DNA, 6 bp, Unknown
  misc_feature (1)..( 6): Matrix.002 file - promoters60/1399417
atatat

SEQ ID NO: 49689 - DNA, 9 bp, Unknown
  misc_feature (1)..( 9): Matrix.002 file - promoters60/1399417
gagcctgat

SEQ ID NO: 49690 - DNA, 6 bp, Unknown
  misc_feature (1)..( 6): Matrix.002 file - promoters60/1399417
aattgc

SEQ ID NO: 49691 - DNA, 6 bp, Unknown
  misc_feature (1)..( 6): Matrix.002 file - promoters60/1399417
tccaaa

SEQ ID NO: 49692 - DNA, 6 bp, Unknown
  misc_feature (1)..( 6): Matrix.002 file - promoters60/1399417
aaacga

SEQ ID NO: 49693 - DNA, 6 bp, Unknown
  misc_feature (1)..( 6): Matrix.002 file - promoters60/1399417
tctaaa

SEQ ID NO: 49694 - DNA, 6 bp, Unknown
  misc_feature (1)..( 6): Matrix.002 file - promoters60/1399417
ttgact

SEQ ID NO: 49695 - DNA, 8 bp, Unknown
  misc_feature (1)..( 8): Matrix.002 file - promoters60/1399417
ccaagacg

SEQ ID NO: 49696 - DNA, 7 bp, Unknown
  misc_feature (1)..( 7): Matrix.002 file - promoters60/1399417
aggccca

SEQ ID NO: 49697 - DNA, 8 bp, Unknown
  misc_feature (1)..( 8): Matrix.002 file - promoters60/1399541
atttcttc

SEQ ID NO: 49698 - DNA, 7 bp, Unknown
  misc_feature (1)..( 7): Matrix.002 file - promoters60/1399541
tcaaatt

SEQ ID NO: 49699 - DNA, 8 bp, Unknown
  misc_feature (1)..( 8): Matrix.002 file - promoters60/1399541
ccagtatt

SEQ ID NO: 49700 - DNA, 6 bp, Unknown
  misc_feature (1)..( 6): Matrix.002 file - promoters60/1399541
tttttt

SEQ ID NO: 49701 - DNA, 7 bp, Unknown
  misc_feature (1)..( 7): Matrix.002 file - promoters60/1399541
ttctttt

SEQ ID NO: 49702 - DNA, 8 bp, Unknown
  misc_feature (1)..( 8): Matrix.002 file - promoters60/1399541
aggcaatt

SEQ ID NO: 49703 - DNA, 7 bp, Unknown
  misc_feature (1)..( 7): Matrix.002 file - promoters60/1399541
attagtt

SEQ ID NO: 49704 - DNA, 6 bp, Unknown
  misc_feature (1)..( 6): Matrix.002 file - promoters60/1399541
tgttgg

SEQ ID NO: 49705 - DNA, 6 bp, Unknown
  misc_feature (1)..( 6): Matrix.002 file - promoters60/1399541
actcct

SEQ ID NO: 49706 - DNA, 7 bp, Unknown
  misc_feature (1)..( 7): Matrix.002 file - promoters60/1399541
cctcttc

SEQ ID NO: 49707 - DNA, 7 bp, Unknown
  misc_feature (1)..( 7): Matrix.002 file - promoters60/1399541
cttttgt

SEQ ID NO: 49708 - DNA, 6 bp, Unknown
  misc_feature (1)..( 6): Matrix.002 file - promoters60/1399541
gaaaaa

SEQ ID NO: 49709 - DNA, 8 bp, Unknown
  misc_feature (1)..( 8): Matrix.002 file - promoters60/1399541
aaaccact

SEQ ID NO: 49710 - DNA, 8 bp, Unknown
  misc_feature (1)..( 8): Matrix.002 file - promoters60/1399634
tatacata

SEQ ID NO: 49711 - DNA, 9 bp, Unknown
  misc_feature (1)..( 9): Matrix.002 file - promoters60/1399634
tcgaaatag

SEQ ID NO: 49712 - DNA, 9 bp, Unknown
  misc_feature (1)..( 9): Matrix.002 file - promoters60/1399634
gcgcaatta

SEQ ID NO: 49713 - DNA, 6 bp, Unknown
  misc_feature (1)..( 6): Matrix.002 file - promoters60/1399634
taaaca

SEQ ID NO: 49714 - DNA, 8 bp, Unknown
  misc_feature (1)..( 8): Matrix.002 file - promoters60/1399634
attattta

SEQ ID NO: 49715 - DNA, 6 bp, Unknown
  misc_feature (1)..( 6): Matrix.002 file - promoters60/1399634
tttctc

SEQ ID NO: 49716 - DNA, 6 bp, Unknown
  misc_feature (1)..( 6): Matrix.002 file - promoters60/1399634
aatttt

SEQ ID NO: 49717 - DNA, 7 bp, Unknown
  misc_feature (1)..( 7): Matrix.002 file - promoters60/1399634
atacata

SEQ ID NO: 49718 - DNA, 8 bp, Unknown
  misc_feature (1)..( 8): Matrix.002 file - promoters60/1399634
acatacat

SEQ ID NO: 49719 - DNA, 7 bp, Unknown
  misc_feature (1)..( 7): Matrix.002 file - promoters60/1399634
atactag

SEQ ID NO: 49720 - DNA, 7 bp, Unknown
  misc_feature (1)..( 7): Matrix.002 file - promoters60/1399634
catctat

SEQ ID NO: 49721 - DNA, 7 bp, Unknown
  misc_feature (1)..( 7): Matrix.002 file - promoters60/1399634
acatttc

SEQ ID NO: 49722 - DNA, 7 bp, Unknown
  misc_feature (1)..( 7): Matrix.002 file - promoters60/1399634
tcacata

SEQ ID NO: 49723 - DNA, 6 bp, Unknown
  misc_feature (1)..( 6): Matrix.002 file - promoters60/1399634
atttat

SEQ ID NO: 49724 - DNA, 6 bp, Unknown
  misc_feature (1)..( 6): Matrix.002 file - promoters60/1399634
taataa

SEQ ID NO: 49725 - DNA, 6 bp, Unknown
  misc_feature (1)..( 6): Matrix.002 file - promoters60/1399634
tcgatc

SEQ ID NO: 49726 - DNA, 6 bp, Unknown
  misc_feature (1)..( 6): Matrix.002 file - promoters60/1399634
tagatt

SEQ ID NO: 49727 - DNA, 7 bp, Unknown
  misc_feature (1)..( 7): Matrix.002 file - promoters60/1399709
attaaga

SEQ ID NO: 49728 - DNA, 6 bp, Unknown
  misc_feature (1)..( 6): Matrix.002 file - promoters60/1399709
cttttt

SEQ ID NO: 49729 - DNA, 6 bp, Unknown
  misc_feature (1)..( 6): Matrix.002 file - promoters60/1399709
gacatc

SEQ ID NO: 49730 - DNA, 7 bp, Unknown
  misc_feature (1)..( 7): Matrix.002 file - promoters60/1399709
aaggaaa

SEQ ID NO: 49731 - DNA, 8 bp, Unknown
  misc_feature (1)..( 8): Matrix.002 file - promoters60/1399709
gaagatcg

SEQ ID NO: 49732 - DNA, 6 bp, Unknown
  misc_feature (1)..( 6): Matrix.002 file - promoters60/1399709
gtttcg

SEQ ID NO: 49733 - DNA, 6 bp, Unknown
  misc_feature (1)..( 6): Matrix.002 file - promoters60/1399709
aggcct

SEQ ID NO: 49734 - DNA, 7 bp, Unknown
  misc_feature (1)..( 7): Matrix.002 file - promoters60/1399709
tatcatt

SEQ ID NO: 49735 - DNA, 7 bp, Unknown
  misc_feature (1)..( 7): Matrix.002 file - promoters60/1399709
gaatttg

SEQ ID NO: 49736 - DNA, 7 bp, Unknown
  misc_feature (1)..( 7): Matrix.002 file - promoters60/1399709
tttgatt

SEQ ID NO: 49737 - DNA, 7 bp, Unknown
  misc_feature (1)..( 7): Matrix.002 file - promoters60/1399709
ttagatc

SEQ ID NO: 49738 - DNA, 6 bp, Unknown
  misc_feature (1)..( 6): Matrix.002 file - promoters60/1399709
catttg

SEQ ID NO: 49739 - DNA, 11 bp, Unknown
  misc_feature (1)..( 11): Matrix.002 file - promoters60/1399726
caattcattaa

SEQ ID NO: 49740 - DNA, 7 bp, Unknown
  misc_feature (1)..( 7): Matrix.002 file - promoters60/1399726
ctaattc

SEQ ID NO: 49741 - DNA, 12 bp, Unknown
  misc_feature (1)..( 12): Matrix.002 file - promoters60/1399726
aacaaattatga

SEQ ID NO: 49742 - DNA, 11 bp, Unknown
  misc_feature (1)..( 11): Matrix.002 file - promoters60/1399726
tagataaatta

SEQ ID NO: 49743 - DNA, 13 bp, Unknown
  misc_feature (1)..( 13): Matrix.002 file - promoters60/1399726
caaactaattctc

SEQ ID NO: 49744 - DNA, 12 bp, Unknown
  misc_feature (1)..( 12): Matrix.002 file - promoters60/1399726
tagacaaaattc

SEQ ID NO: 49745 - DNA, 8 bp, Unknown
  misc_feature (1)..( 8): Matrix.002 file - promoters60/1403210
aaaaaagt

SEQ ID NO: 49746 - DNA, 7 bp, Unknown
  misc_feature (1)..( 7): Matrix.002 file - promoters60/1403210
aagaaag

SEQ ID NO: 49747 - DNA, 10 bp, Unknown
  misc_feature (1)..( 10): Matrix.002 file - promoters60/1403210
tgagtaaaat

SEQ ID NO: 49748 - DNA, 7 bp, Unknown
  misc_feature (1)..( 7): Matrix.002 file - promoters60/1403210
ttgaaaa

SEQ ID NO: 49749 - DNA, 9 bp, Unknown
  misc_feature (1)..( 9): Matrix.002 file - promoters60/1403210
tggctttct

SEQ ID NO: 49750 - DNA, 7 bp, Unknown
  misc_feature (1)..( 7): Matrix.002 file - promoters60/1403210
aaaattt

SEQ ID NO: 49751 - DNA, 6 bp, Unknown
  misc_feature (1)..( 6): Matrix.002 file - promoters60/1403210
ttgaga

SEQ ID NO: 49752 - DNA, 7 bp, Unknown
  misc_feature (1)..( 7): Matrix.002 file - promoters60/1403210
tttaggg

SEQ ID NO: 49753 - DNA, 8 bp, Unknown
  misc_feature (1)..( 8): Matrix.002 file - promoters60/1403210
ttttcatt

SEQ ID NO: 49754 - DNA, 7 bp, Unknown
  misc_feature (1)..( 7): Matrix.002 file - promoters60/1403210
tgatgaa

SEQ ID NO: 49755 - DNA, 8 bp, Unknown
  misc_feature (1)..( 8): Matrix.002 file - promoters60/1403210
atcaactt

SEQ ID NO: 49756 - DNA, 10 bp, Unknown
  misc_feature (1)..( 10): Matrix.002 file - promoters60/1403210
tttttaattt

SEQ ID NO: 49757 - DNA, 9 bp, Unknown
  misc_feature (1)..( 9): Matrix.002 file - promoters60/1403210
atggatact

SEQ ID NO: 49758 - DNA, 7 bp, Unknown
  misc_feature (1)..( 7): Matrix.002 file - promoters60/1403210
tttactc

SEQ ID NO: 49759 - DNA, 8 bp, Unknown
  misc_feature (1)..( 8): Matrix.002 file - promoters60/1403210
ttctcttc

SEQ ID NO: 49760 - DNA, 6 bp, Unknown
  misc_feature (1)..( 6): Matrix.002 file - promoters60/1403210
tttctt

SEQ ID NO: 49761 - DNA, 7 bp, Unknown
  misc_feature (1)..( 7): Matrix.002 file - promoters60/1411578
atgagaa

SEQ ID NO: 49762 - DNA, 8 bp, Unknown
  misc_feature (1)..( 8): Matrix.002 file - promoters60/1411578
agaagatg

SEQ ID NO: 49763 - DNA, 9 bp, Unknown
  misc_feature (1)..( 9): Matrix.002 file - promoters60/1411578
acattgttt

SEQ ID NO: 49764 - DNA, 7 bp, Unknown
  misc_feature (1)..( 7): Matrix.002 file - promoters60/1411578
aaactta

SEQ ID NO: 49765 - DNA, 6 bp, Unknown
  misc_feature (1)..( 6): Matrix.002 file - promoters60/1411598
aaaaga

SEQ ID NO: 49766 - DNA, 7 bp, Unknown
  misc_feature (1)..( 7): Matrix.002 file - promoters60/1411598
acaaaaa

SEQ ID NO: 49767 - DNA, 6 bp, Unknown
  misc_feature (1)..( 6): Matrix.002 file - promoters60/1411598
cttgaa

SEQ ID NO: 49768 - DNA, 8 bp, Unknown
  misc_feature (1)..( 8): Matrix.002 file - promoters60/1411598
ttaaaaaa

SEQ ID NO: 49769 - DNA, 6 bp, Unknown
  misc_feature (1)..( 6): Matrix.002 file - promoters60/1411598
tacttt

SEQ ID NO: 49770 - DNA, 7 bp, Unknown
  misc_feature (1)..( 7): Matrix.002 file - promoters60/1411598
acataaa

SEQ ID NO: 49771 - DNA, 8 bp, Unknown
  misc_feature (1)..( 8): Matrix.002 file - promoters60/1411598
aggaagtt

SEQ ID NO: 49772 - DNA, 6 bp, Unknown
  misc_feature (1)..( 6): Matrix.002 file - promoters60/1411598
caaaat

SEQ ID NO: 49773 - DNA, 9 bp, Unknown
  misc_feature (1)..( 9): Matrix.002 file - promoters60/1411598
tacccaaat

SEQ ID NO: 49774 - DNA, 9 bp, Unknown
  misc_feature (1)..( 9): Matrix.002 file - promoters60/1411598
atatgattt

SEQ ID NO: 49775 - DNA, 8 bp, Unknown
  misc_feature (1)..( 8): Matrix.002 file - promoters60/1411598
ttctatct

SEQ ID NO: 49776 - DNA, 7 bp, Unknown
  misc_feature (1)..( 7): Matrix.002 file - promoters60/1411598
cttagaa

SEQ ID NO: 49777 - DNA, 7 bp, Unknown
  misc_feature (1)..( 7): Matrix.002 file - promoters60/1411598
gaaaaat

SEQ ID NO: 49778 - DNA, 6 bp, Unknown
  misc_feature (1)..( 6): Matrix.002 file - promoters60/1411598
attgga

SEQ ID NO: 49779 - DNA, 6 bp, Unknown
  misc_feature (1)..( 6): Matrix.002 file - promoters60/1411598
agttgg

SEQ ID NO: 49780 - DNA, 6 bp, Unknown
  misc_feature (1)..( 6): Matrix.002 file - promoters60/1411598
tttaat

SEQ ID NO: 49781 - DNA, 6 bp, Unknown
  misc_feature (1)..( 6): Matrix.002 file - promoters60/1411598
ttgatt

SEQ ID NO: 49782 - DNA, 9 bp, Unknown
  misc_feature (1)..( 9): Matrix.002 file - promoters60/1411616
tttagaaga

SEQ ID NO: 49783 - DNA, 6 bp, Unknown
  misc_feature (1)..( 6): Matrix.002 file - promoters60/1411616
aaaata

SEQ ID NO: 49784 - DNA, 7 bp, Unknown
  misc_feature (1)..( 7): Matrix.002 file - promoters60/1411616
aaaatca

SEQ ID NO: 49785 - DNA, 14 bp, Unknown
  misc_feature (1)..( 14): Matrix.002 file - promoters60/1411616
aaaaaacttgtttt

SEQ ID NO: 49786 - DNA, 9 bp, Unknown
  misc_feature (1)..( 9): Matrix.002 file - promoters60/1411616
attttaatt

SEQ ID NO: 49787 - DNA, 9 bp, Unknown
  misc_feature (1)..( 9): Matrix.002 file - promoters60/1411616
attttcatt

SEQ ID NO: 49788 - DNA, 8 bp, Unknown
  misc_feature (1)..( 8): Matrix.002 file - promoters60/1411616
agaaaata

SEQ ID NO: 49789 - DNA, 7 bp, Unknown
  misc_feature (1)..( 7): Matrix.002 file - promoters60/1411616
aaaaaaa

SEQ ID NO: 49790 - DNA, 8 bp, Unknown
  misc_feature (1)..( 8): Matrix.002 file - promoters60/1411616
tattattt

SEQ ID NO: 49791 - DNA, 8 bp, Unknown
  misc_feature (1)..( 8): Matrix.002 file - promoters60/1411616
tataaaga

SEQ ID NO: 49792 - DNA, 7 bp, Unknown
  misc_feature (1)..( 7): Matrix.002 file - promoters60/1413159
tttaggt

SEQ ID NO: 49793 - DNA, 7 bp, Unknown
  misc_feature (1)..( 7): Matrix.002 file - promoters60/1413159
acaaagg

SEQ ID NO: 49794 - DNA, 7 bp, Unknown
  misc_feature (1)..( 7): Matrix.002 file - promoters60/1413159
tttggtt

SEQ ID NO: 49795 - DNA, 7 bp, Unknown
  misc_feature (1)..( 7): Matrix.002 file - promoters60/1413159
ttgtgat

SEQ ID NO: 49796 - DNA, 7 bp, Unknown
  misc_feature (1)..( 7): Matrix.002 file - promoters60/1413159
aaaagat

SEQ ID NO: 49797 - DNA, 6 bp, Unknown
  misc_feature (1)..( 6): Matrix.002 file - promoters60/1413159
tggaga

SEQ ID NO: 49798 - DNA, 7 bp, Unknown
  misc_feature (1)..( 7): Matrix.002 file - promoters60/1413159
gaagcta

SEQ ID NO: 49799 - DNA, 6 bp, Unknown
  misc_feature (1)..( 6): Matrix.002 file - promoters60/1413159
atgaaa

SEQ ID NO: 49800 - DNA, 6 bp, Unknown
  misc_feature (1)..( 6): Matrix.002 file - promoters60/1413159
acactt

SEQ ID NO: 49801 - DNA, 7 bp, Unknown
  misc_feature (1)..( 7): Matrix.002 file - promoters60/1413159
tgtcttg

SEQ ID NO: 49802 - DNA, 8 bp, Unknown
  misc_feature (1)..( 8): Matrix.002 file - promoters60/1413159
ttacattt

SEQ ID NO: 49803 - DNA, 6 bp, Unknown
  misc_feature (1)..( 6): Matrix.002 file - promoters60/1413159
ttataa

SEQ ID NO: 49804 - DNA, 10 bp, Unknown
  misc_feature (1)..( 10): Matrix.002 file - promoters60/1413159
atacaacaaa

SEQ ID NO: 49805 - DNA, 11 bp, Unknown
  misc_feature (1)..( 11): Matrix.002 file - promoters60/1413191
tctattttgac

SEQ ID NO: 49806 - DNA, 9 bp, Unknown
  misc_feature (1)..( 9): Matrix.002 file - promoters60/1413191
gatttaaaa

SEQ ID NO: 49807 - DNA, 9 bp, Unknown
  misc_feature (1)..( 9): Matrix.002 file - promoters60/1413211
gtcagatca

SEQ ID NO: 49808 - DNA, 9 bp, Unknown
  misc_feature (1)..( 9): Matrix.002 file - promoters60/1413211
atagtcaac

SEQ ID NO: 49809 - DNA, 6 bp, Unknown
  misc_feature (1)..( 6): Matrix.002 file - promoters60/1413211
aataat

SEQ ID NO: 49810 - DNA, 7 bp, Unknown
  misc_feature (1)..( 7): Matrix.002 file - promoters60/1413211
tctaatt

SEQ ID NO: 49811 - DNA, 9 bp, Unknown
  misc_feature (1)..( 9): Matrix.002 file - promoters60/1413211
aaaaaagaa

SEQ ID NO: 49812 - DNA, 7 bp, Unknown
  misc_feature (1)..( 7): Matrix.002 file - promoters60/1413211
ccaacat

SEQ ID NO: 49813 - DNA, 6 bp, Unknown
  misc_feature (1)..( 6): Matrix.002 file - promoters60/1413211
taattt

SEQ ID NO: 49814 - DNA, 13 bp, Unknown
  misc_feature (1)..( 13): Matrix.002 file - promoters60/1413211
tgatgaaaatgat

SEQ ID NO: 49815 - DNA, 7 bp, Unknown
  misc_feature (1)..( 7): Matrix.002 file - promoters60/1413211
gacaaaa

SEQ ID NO: 49816 - DNA, 6 bp, Unknown
  misc_feature (1)..( 6): Matrix.002 file - promoters60/1413211
aaaagg

SEQ ID NO: 49817 - DNA, 6 bp, Unknown
  misc_feature (1)..( 6): Matrix.002 file - promoters60/1413211
ctactt

SEQ ID NO: 49818 - DNA, 7 bp, Unknown
  misc_feature (1)..( 7): Matrix.002 file - promoters60/1413211
ctctact

SEQ ID NO: 49819 - DNA, 6 bp, Unknown
  misc_feature (1)..( 6): Matrix.002 file - promoters60/1413211
atttaa

SEQ ID NO: 49820 - DNA, 7 bp, Unknown
  misc_feature (1)..( 7): Matrix.002 file - promoters60/1413211
ccaaatc

SEQ ID NO: 49821 - DNA, 8 bp, Unknown
  misc_feature (1)..( 8): Matrix.002 file - promoters60/1413211
tctggttt

SEQ ID NO: 49822 - DNA, 7 bp, Unknown
  misc_feature (1)..( 7): Matrix.002 file - promoters60/1413211
aaactat

SEQ ID NO: 49823 - DNA, 7 bp, Unknown
  misc_feature (1)..( 7): Matrix.002 file - promoters60/1413211
taaatta

SEQ ID NO: 49824 - DNA, 6 bp, Unknown
  misc_feature (1)..( 6): Matrix.002 file - promoters60/1420853
tttagt

SEQ ID NO: 49825 - DNA, 7 bp, Unknown
  misc_feature (1)..( 7): Matrix.002 file - promoters60/1420853
gaaaata

SEQ ID NO: 49826 - DNA, 8 bp, Unknown
  misc_feature (1)..( 8): Matrix.002 file - promoters60/1420853
ttcgacat

SEQ ID NO: 49827 - DNA, 8 bp, Unknown
  misc_feature (1)..( 8): Matrix.002 file - promoters60/1420853
tatggttt

SEQ ID NO: 49828 - DNA, 9 bp, Unknown
  misc_feature (1)..( 9): Matrix.002 file - promoters60/1420853
cgtatgtaa

SEQ ID NO: 49829 - DNA, 8 bp, Unknown
  misc_feature (1)..( 8): Matrix.002 file - promoters60/1420853
aatataat

SEQ ID NO: 49830 - DNA, 8 bp, Unknown
  misc_feature (1)..( 8): Matrix.002 file - promoters60/1420853
aggattta

SEQ ID NO: 49831 - DNA, 6 bp, Unknown
  misc_feature (1)..( 6): Matrix.002 file - promoters60/1420853
aaatat

SEQ ID NO: 49832 - DNA, 7 bp, Unknown
  misc_feature (1)..( 7): Matrix.002 file - promoters60/1420853
cagcctt

SEQ ID NO: 49833 - DNA, 6 bp, Unknown
  misc_feature (1)..( 6): Matrix.002 file - promoters60/1420853
tataca

SEQ ID NO: 49834 - DNA, 7 bp, Unknown
  misc_feature (1)..( 7): Matrix.002 file - promoters60/1420853
ttagatc

SEQ ID NO: 49835 - DNA, 8 bp, Unknown
  misc_feature (1)..( 8): Matrix.002 file - promoters60/1420853
taaatgta

SEQ ID NO: 49836 - DNA, 6 bp, Unknown
  misc_feature (1)..( 6): Matrix.002 file - promoters60/1420853
atgtct

SEQ ID NO: 49837 - DNA, 7 bp, Unknown
  misc_feature (1)..( 7): Matrix.002 file - promoters60/1420853
ttggaga

SEQ ID NO: 49838 - DNA, 6 bp, Unknown
  misc_feature (1)..( 6): Matrix.002 file - promoters60/1420853
gaagat

SEQ ID NO: 49839 - DNA, 6 bp, Unknown
  misc_feature (1)..( 6): Matrix.002 file - promoters60/1420853
gatcga

SEQ ID NO: 49840 - DNA, 6 bp, Unknown
  misc_feature (1)..( 6): Matrix.002 file - promoters60/1420853
aaatgc

SEQ ID NO: 49841 - DNA, 8 bp, Unknown
  misc_feature (1)..( 8): Matrix.002 file - promoters60/1420853
ggacttgt

SEQ ID NO: 49842 - DNA, 10 bp, Unknown
  misc_feature (1)..( 10): Matrix.002 file - promoters60/1440865
gaaaaataga

SEQ ID NO: 49843 - DNA, 6 bp, Unknown
  misc_feature (1)..( 6): Matrix.002 file - promoters60/1440865
agaaaa

SEQ ID NO: 49844 - DNA, 6 bp, Unknown
  misc_feature (1)..( 6): Matrix.002 file - promoters60/1440865
aacaga

SEQ ID NO: 49845 - DNA, 7 bp, Unknown
  misc_feature (1)..( 7): Matrix.002 file - promoters60/1440865
aataaaa

SEQ ID NO: 49846 - DNA, 7 bp, Unknown
  misc_feature (1)..( 7): Matrix.002 file - promoters60/1440865
accaaaa

SEQ ID NO: 49847 - DNA, 6 bp, Unknown
  misc_feature (1)..( 6): Matrix.002 file - promoters60/1440865
aaaaag

SEQ ID NO: 49848 - DNA, 7 bp, Unknown
  misc_feature (1)..( 7): Matrix.002 file - promoters60/1440865
attacgt

SEQ ID NO: 49849 - DNA, 9 bp, Unknown
  misc_feature (1)..( 9): Matrix.002 file - promoters60/1440865
aaaatgaat

SEQ ID NO: 49850 - DNA, 10 bp, Unknown
  misc_feature (1)..( 10): Matrix.002 file - promoters60/1440865
aatatgaaat

SEQ ID NO: 49851 - DNA, 12 bp, Unknown
  misc_feature (1)..( 12): Matrix.002 file - promoters60/1440865
tacaaaaaaaat

SEQ ID NO: 49852 - DNA, 6 bp, Unknown
  misc_feature (1)..( 6): Matrix.002 file - promoters60/1440865
aactaa

SEQ ID NO: 49853 - DNA, 7 bp, Unknown
  misc_feature (1)..( 7): Matrix.002 file - promoters60/1440865
agcaagt

SEQ ID NO: 49854 - DNA, 7 bp, Unknown
  misc_feature (1)..( 7): Matrix.002 file - promoters60/1440865
taacatt

SEQ ID NO: 49855 - DNA, 6 bp, Unknown
  misc_feature (1)..( 6): Matrix.002 file - promoters60/1440865
aaaaaa

SEQ ID NO: 49856 - DNA, 7 bp, Unknown
  misc_feature (1)..( 7): Matrix.002 file - promoters60/1440865
tcaaaag

SEQ ID NO: 49857 - DNA, 7 bp, Unknown
  misc_feature (1)..( 7): Matrix.002 file - promoters60/1440865
caaaaag

SEQ ID NO: 49858 - DNA, 6 bp, Unknown
  misc_feature (1)..( 6): Matrix.002 file - promoters60/1440865
aatata

SEQ ID NO: 49859 - DNA, 7 bp, Unknown
  misc_feature (1)..( 7): Matrix.002 file - promoters60/1440865
gacattt

SEQ ID NO: 49860 - DNA, 9 bp, Unknown
  misc_feature (1)..( 9): Matrix.002 file - promoters60/1440873
caaaaaaac

SEQ ID NO: 49861 - DNA, 10 bp, Unknown
  misc_feature (1)..( 10): Matrix.002 file - promoters60/1440873
aatcataata

SEQ ID NO: 49862 - DNA, 7 bp, Unknown
  misc_feature (1)..( 7): Matrix.002 file - promoters60/1440873
tgaacag

SEQ ID NO: 49863 - DNA, 6 bp, Unknown
  misc_feature (1)..( 6): Matrix.002 file - promoters60/1440873
actcaa

SEQ ID NO: 49864 - DNA, 7 bp, Unknown
  misc_feature (1)..( 7): Matrix.002 file - promoters60/1440873
caacgta

SEQ ID NO: 49865 - DNA, 8 bp, Unknown
  misc_feature (1)..( 8): Matrix.002 file - promoters60/1440873
ttagacac

SEQ ID NO: 49866 - DNA, 9 bp, Unknown
  misc_feature (1)..( 9): Matrix.002 file - promoters60/1440873
acagtttgt

SEQ ID NO: 49867 - DNA, 7 bp, Unknown
  misc_feature (1)..( 7): Matrix.002 file - promoters60/1440873
tcaacaa

SEQ ID NO: 49868 - DNA, 7 bp, Unknown
  misc_feature (1)..( 7): Matrix.002 file - promoters60/1440873
aaatttt

SEQ ID NO: 49869 - DNA, 6 bp, Unknown
  misc_feature (1)..( 6): Matrix.002 file - promoters60/1440873
tctttc

SEQ ID NO: 49870 - DNA, 7 bp, Unknown
  misc_feature (1)..( 7): Matrix.002 file - promoters60/1440873
taagaat

SEQ ID NO: 49871 - DNA, 8 bp, Unknown
  misc_feature (1)..( 8): Matrix.002 file - promoters60/1440873
caaactta

SEQ ID NO: 49872 - DNA, 8 bp, Unknown
  misc_feature (1)..( 8): Matrix.002 file - promoters60/1440920
ttgacata

SEQ ID NO: 49873 - DNA, 10 bp, Unknown
  misc_feature (1)..( 10): Matrix.002 file - promoters60/1440920
aaaattcttg

SEQ ID NO: 49874 - DNA, 6 bp, Unknown
  misc_feature (1)..( 6): Matrix.002 file - promoters60/1440920
aaacaa

SEQ ID NO: 49875 - DNA, 7 bp, Unknown
  misc_feature (1)..( 7): Matrix.002 file - promoters60/1440920
aaaaaat

SEQ ID NO: 49876 - DNA, 7 bp, Unknown
  misc_feature (1)..( 7): Matrix.002 file - promoters60/1440920
ataaaat

SEQ ID NO: 49877 - DNA, 8 bp, Unknown
  misc_feature (1)..( 8): Matrix.002 file - promoters60/1440920
aaacaaaa

SEQ ID NO: 49878 - DNA, 7 bp, Unknown
  misc_feature (1)..( 7): Matrix.002 file - promoters60/1440920
aaaaaga

SEQ ID NO: 49879 - DNA, 8 bp, Unknown
  misc_feature (1)..( 8): Matrix.002 file - promoters60/1440920
gtgaactt

SEQ ID NO: 49880 - DNA, 13 bp, Unknown
  misc_feature (1)..( 13): Matrix.002 file - promoters60/1440920
aaagtctccacat

SEQ ID NO: 49881 - DNA, 6 bp, Unknown
  misc_feature (1)..( 6): Matrix.002 file - promoters60/1440920
aatgct

SEQ ID NO: 49882 - DNA, 6 bp, Unknown
  misc_feature (1)..( 6): Matrix.002 file - promoters60/1440920
atttga

SEQ ID NO: 49883 - DNA, 12 bp, Unknown
  misc_feature (1)..( 12): Matrix.002 file - promoters60/1440967
attcaaaaaaaa

SEQ ID NO: 49884 - DNA, 9 bp, Unknown
  misc_feature (1)..( 9): Matrix.002 file - promoters60/1440967
aattaacat

SEQ ID NO: 49885 - DNA, 11 bp, Unknown
  misc_feature (1)..( 11): Matrix.002 file - promoters60/1441000
caaattgctaa

SEQ ID NO: 49886 - DNA, 9 bp, Unknown
  misc_feature (1)..( 9): Matrix.002 file - promoters60/1441000
acaaaacat

SEQ ID NO: 49887 - DNA, 7 bp, Unknown
  misc_feature (1)..( 7): Matrix.002 file - promoters60/1441020
tagaaag

SEQ ID NO: 49888 - DNA, 6 bp, Unknown
  misc_feature (1)..( 6): Matrix.002 file - promoters60/1441020
atcaaa

SEQ ID NO: 49889 - DNA, 6 bp, Unknown
  misc_feature (1)..( 6): Matrix.002 file - promoters60/1441020
atttgg

SEQ ID NO: 49890 - DNA, 6 bp, Unknown
  misc_feature (1)..( 6): Matrix.002 file - promoters60/1441020
atttga

SEQ ID NO: 49891 - DNA, 7 bp, Unknown
  misc_feature (1)..( 7): Matrix.002 file - promoters60/1441020
agaatga

SEQ ID NO: 49892 - DNA, 8 bp, Unknown
  misc_feature (1)..( 8): Matrix.002 file - promoters60/1441020
aattgaaa

SEQ ID NO: 49893 - DNA, 7 bp, Unknown
  misc_feature (1)..( 7): Matrix.002 file - promoters60/1441020
gcccaat

SEQ ID NO: 49894 - DNA, 6 bp, Unknown
  misc_feature (1)..( 6): Matrix.002 file - promoters60/1441020
actttt

SEQ ID NO: 49895 - DNA, 6 bp, Unknown
  misc_feature (1)..( 6): Matrix.002 file - promoters60/1441020
attctc

SEQ ID NO: 49896 - DNA, 6 bp, Unknown
  misc_feature (1)..( 6): Matrix.002 file - promoters60/1441020
aatttg

SEQ ID NO: 49897 - DNA, 9 bp, Unknown
  misc_feature (1)..( 9): Matrix.002 file - promoters60/1441020
gatggcaaa

SEQ ID NO: 49898 - DNA, 7 bp, Unknown
  misc_feature (1)..( 7): Matrix.002 file - promoters60/1441020
tgggctc

SEQ ID NO: 49899 - DNA, 6 bp, Unknown
  misc_feature (1)..( 6): Matrix.002 file - promoters60/1441020
gattca

SEQ ID NO: 49900 - DNA, 14 bp, Unknown
  misc_feature (1)..( 14): Matrix.002 file - promoters60/1441044
ttttatatagataa

SEQ ID NO: 49901 - DNA, 12 bp, Unknown
  misc_feature (1)..( 12): Matrix.002 file - promoters60/1441044
actcatatataa

SEQ ID NO: 49902 - DNA, 13 bp, Unknown
  misc_feature (1)..( 13): Matrix.002 file - promoters60/1441044
acaaacttttagt

SEQ ID NO: 49903 - DNA, 9 bp, Unknown
  misc_feature (1)..( 9): Matrix.002 file - promoters60/1441044
aactaaaca

SEQ ID NO: 49904 - DNA, 9 bp, Unknown
  misc_feature (1)..( 9): Matrix.002 file - promoters60/1441134
ttttccttt

SEQ ID NO: 49905 - DNA, 6 bp, Unknown
  misc_feature (1)..( 6): Matrix.002 file - promoters60/1441134
ctttca

SEQ ID NO: 49906 - DNA, 7 bp, Unknown
  misc_feature (1)..( 7): Matrix.002 file - promoters60/1441134
tgaactt

SEQ ID NO: 49907 - DNA, 8 bp, Unknown
  misc_feature (1)..( 8): Matrix.002 file - promoters60/1441134
tatataca

SEQ ID NO: 49908 - DNA, 6 bp, Unknown
  misc_feature (1)..( 6): Matrix.002 file - promoters60/1441134
atatta

SEQ ID NO: 49909 - DNA, 8 bp, Unknown
  misc_feature (1)..( 8): Matrix.002 file - promoters60/1441134
attaacaa

SEQ ID NO: 49910 - DNA, 6 bp, Unknown
  misc_feature (1)..( 6): Matrix.002 file - promoters60/1441134
aaattt

SEQ ID NO: 49911 - DNA, 6 bp, Unknown
  misc_feature (1)..( 6): Matrix.002 file - promoters60/1441134
ctttca

SEQ ID NO: 49912 - DNA, 9 bp, Unknown
  misc_feature (1)..( 9): Matrix.002 file - promoters60/1441134
aacacaatg

SEQ ID NO: 49913 - DNA, 6 bp, Unknown
  misc_feature (1)..( 6): Matrix.002 file - promoters60/1441134
caaaaa

SEQ ID NO: 49914 - DNA, 7 bp, Unknown
  misc_feature (1)..( 7): Matrix.002 file - promoters60/1441134
tctagtg

SEQ ID NO: 49915 - DNA, 7 bp, Unknown
  misc_feature (1)..( 7): Matrix.002 file - promoters60/1441134
aaaaata

SEQ ID NO: 49916 - DNA, 6 bp, Unknown
  misc_feature (1)..( 6): Matrix.002 file - promoters60/1441134
aacttt

SEQ ID NO: 49917 - DNA, 7 bp, Unknown
  misc_feature (1)..( 7): Matrix.002 file - promoters60/1441134
ttacaat

SEQ ID NO: 49918 - DNA, 9 bp, Unknown
  misc_feature (1)..( 9): Matrix.002 file - promoters60/1441170
tttttaaat

SEQ ID NO: 49919 - DNA, 12 bp, Unknown
  misc_feature (1)..( 12): Matrix.002 file - promoters60/1441170
tattagtcaatt

SEQ ID NO: 49920 - DNA, 6 bp, Unknown
  misc_feature (1)..( 6): Matrix.002 file - promoters60/1441170
aatttg

SEQ ID NO: 49921 - DNA, 6 bp, Unknown
  misc_feature (1)..( 6): Matrix.002 file - promoters60/1441170
tttaaa

SEQ ID NO: 49922 - DNA, 8 bp, Unknown
  misc_feature (1)..( 8): Matrix.002 file - promoters60/1441170
aaatcaaa

SEQ ID NO: 49923 - DNA, 7 bp, Unknown
  misc_feature (1)..( 7): Matrix.002 file - promoters60/1441170
gaacaaa

SEQ ID NO: 49924 - DNA, 8 bp, Unknown
  misc_feature (1)..( 8): Matrix.002 file - promoters60/1441170
aaacaata

SEQ ID NO: 49925 - DNA, 8 bp, Unknown
  misc_feature (1)..( 8): Matrix.002 file - promoters60/1441170
agtcttac

SEQ ID NO: 49926 - DNA, 6 bp, Unknown
  misc_feature (1)..( 6): Matrix.002 file - promoters60/1441170
taagag

SEQ ID NO: 49927 - DNA, 6 bp, Unknown
  misc_feature (1)..( 6): Matrix.002 file - promoters60/1441170
taaaag

SEQ ID NO: 49928 - DNA, 7 bp, Unknown
  misc_feature (1)..( 7): Matrix.002 file - promoters60/1441170
tttattt

SEQ ID NO: 49929 - DNA, 6 bp, Unknown
  misc_feature (1)..( 6): Matrix.002 file - promoters60/1441170
actttc

SEQ ID NO: 49930 - DNA, 9 bp, Unknown
  misc_feature (1)..( 9): Matrix.002 file - promoters60/1441170
ggataaaca

SEQ ID NO: 49931 - DNA, 10 bp, Unknown
  misc_feature (1)..( 10): Matrix.002 file - promoters60/1441184
aattgtgtgt

SEQ ID NO: 49932 - DNA, 10 bp, Unknown
  misc_feature (1)..( 10): Matrix.002 file - promoters60/1441184
gcataatttt

SEQ ID NO: 49933 - DNA, 10 bp, Unknown
  misc_feature (1)..( 10): Matrix.002 file - promoters60/1441184
catgtttaac

SEQ ID NO: 49934 - DNA, 8 bp, Unknown
  misc_feature (1)..( 8): Matrix.002 file - promoters60/1441184
tgtataaa

SEQ ID NO: 49935 - DNA, 7 bp, Unknown
  misc_feature (1)..( 7): Matrix.002 file - promoters60/1441190
catatat

SEQ ID NO: 49936 - DNA, 9 bp, Unknown
  misc_feature (1)..( 9): Matrix.002 file - promoters60/1441237
aataatttt

SEQ ID NO: 49937 - DNA, 9 bp, Unknown
  misc_feature (1)..( 9): Matrix.002 file - promoters60/1441237
attattttt

SEQ ID NO: 49938 - DNA, 9 bp, Unknown
  misc_feature (1)..( 9): Matrix.002 file - promoters60/1441237
tataaaaac

SEQ ID NO: 49939 - DNA, 10 bp, Unknown
  misc_feature (1)..( 10): Matrix.002 file - promoters60/1441237
tataaaaaca

SEQ ID NO: 49940 - DNA, 9 bp, Unknown
  misc_feature (1)..( 9): Matrix.002 file - promoters60/1441249
ttatacata

SEQ ID NO: 49941 - DNA, 6 bp, Unknown
  misc_feature (1)..( 6): Matrix.002 file - promoters60/1441249
tgatat

SEQ ID NO: 49942 - DNA, 6 bp, Unknown
  misc_feature (1)..( 6): Matrix.002 file - promoters60/1441249
aaatat

SEQ ID NO: 49943 - DNA, 7 bp, Unknown
  misc_feature (1)..( 7): Matrix.002 file - promoters60/1441249
ttcgtaa

SEQ ID NO: 49944 - DNA, 7 bp, Unknown
  misc_feature (1)..( 7): Matrix.002 file - promoters60/1441249
tgaccat

SEQ ID NO: 49945 - DNA, 10 bp, Unknown
  misc_feature (1)..( 10): Matrix.002 file - promoters60/1441249
ttttattttt

SEQ ID NO: 49946 - DNA, 7 bp, Unknown
  misc_feature (1)..( 7): Matrix.002 file - promoters60/1441249
tttaaga

SEQ ID NO: 49947 - DNA, 7 bp, Unknown
  misc_feature (1)..( 7): Matrix.002 file - promoters60/1441249
attcaag

SEQ ID NO: 49948 - DNA, 8 bp, Unknown
  misc_feature (1)..( 8): Matrix.002 file - promoters60/1441249
gtgtcttt

SEQ ID NO: 49949 - DNA, 6 bp, Unknown
  misc_feature (1)..( 6): Matrix.002 file - promoters60/1441249
cttcaa

SEQ ID NO: 49950 - DNA, 6 bp, Unknown
  misc_feature (1)..( 6): Matrix.002 file - promoters60/1441249
aatata

SEQ ID NO: 49951 - DNA, 7 bp, Unknown
  misc_feature (1)..( 7): Matrix.002 file - promoters60/1441249
aaattat

SEQ ID NO: 49952 - DNA, 8 bp, Unknown
  misc_feature (1)..( 8): Matrix.002 file - promoters60/1441249
actttaaa

SEQ ID NO: 49953 - DNA, 9 bp, Unknown
  misc_feature (1)..( 9): Matrix.002 file - promoters60/1441249
caataatcc

SEQ ID NO: 49954 - DNA, 7 bp, Unknown
  misc_feature (1)..( 7): Matrix.002 file - promoters60/1441249
aatcatg

SEQ ID NO: 49955 - DNA, 6 bp, Unknown
  misc_feature (1)..( 6): Matrix.002 file - promoters60/1441249
acataa

SEQ ID NO: 49956 - DNA, 6 bp, Unknown
  misc_feature (1)..( 6): Matrix.002 file - promoters60/1441249
caaaat

SEQ ID NO: 49957 - DNA, 8 bp, Unknown
  misc_feature (1)..( 8): Matrix.002 file - promoters60/1441249
aaagcaaa

SEQ ID NO: 49958 - DNA, 8 bp, Unknown
  misc_feature (1)..( 8): Matrix.002 file - promoters60/1441291
tatgatgg

SEQ ID NO: 49959 - DNA, 9 bp, Unknown
  misc_feature (1)..( 9): Matrix.002 file - promoters60/1441291
ataacctta

SEQ ID NO: 49960 - DNA, 8 bp, Unknown
  misc_feature (1)..( 8): Matrix.002 file - promoters60/1441291
agaaccaa

SEQ ID NO: 49961 - DNA, 6 bp, Unknown
  misc_feature (1)..( 6): Matrix.002 file - promoters60/1441291
ggctga

SEQ ID NO: 49962 - DNA, 11 bp, Unknown
  misc_feature (1)..( 11): Matrix.002 file - promoters60/1441291
agggtctcaga

SEQ ID NO: 49963 - DNA, 6 bp, Unknown
  misc_feature (1)..( 6): Matrix.002 file - promoters60/1441291
agattt

SEQ ID NO: 49964 - DNA, 9 bp, Unknown
  misc_feature (1)..( 9): Matrix.002 file - promoters60/1441395
atgttaaaa

SEQ ID NO: 49965 - DNA, 11 bp, Unknown
  misc_feature (1)..( 11): Matrix.002 file - promoters60/1441395
aaaaaatcaaa

SEQ ID NO: 49966 - DNA, 8 bp, Unknown
  misc_feature (1)..( 8): Matrix.002 file - promoters60/1441395
tatataaa

SEQ ID NO: 49967 - DNA, 7 bp, Unknown
  misc_feature (1)..( 7): Matrix.002 file - promoters60/1441395
aaatcaa

SEQ ID NO: 49968 - DNA, 6 bp, Unknown
  misc_feature (1)..( 6): Matrix.002 file - promoters60/1441460
agccag

SEQ ID NO: 49969 - DNA, 7 bp, Unknown
  misc_feature (1)..( 7): Matrix.002 file - promoters60/1441460
gaaacca

SEQ ID NO: 49970 - DNA, 7 bp, Unknown
  misc_feature (1)..( 7): Matrix.002 file - promoters60/1441460
ttaggat

SEQ ID NO: 49971 - DNA, 12 bp, Unknown
  misc_feature (1)..( 12): Matrix.002 file - promoters60/1441460
atattcatgatc

SEQ ID NO: 49972 - DNA, 10 bp, Unknown
  misc_feature (1)..( 10): Matrix.002 file - promoters60/1441460
gaaaaaatga

SEQ ID NO: 49973 - DNA, 6 bp, Unknown
  misc_feature (1)..( 6): Matrix.002 file - promoters60/1441460
aaacga

SEQ ID NO: 49974 - DNA, 9 bp, Unknown
  misc_feature (1)..( 9): Matrix.002 file - promoters60/1441460
aatgttttg

SEQ ID NO: 49975 - DNA, 8 bp, Unknown
  misc_feature (1)..( 8): Matrix.002 file - promoters60/1441460
gttttgtt

SEQ ID NO: 49976 - DNA, 8 bp, Unknown
  misc_feature (1)..( 8): Matrix.002 file - promoters60/1441460
atatcaga

SEQ ID NO: 49977 - DNA, 9 bp, Unknown
  misc_feature (1)..( 9): Matrix.002 file - promoters60/1441460
tttatttta

SEQ ID NO: 49978 - DNA, 8 bp, Unknown
  misc_feature (1)..( 8): Matrix.002 file - promoters60/1441460
accaaatt

SEQ ID NO: 49979 - DNA, 6 bp, Unknown
  misc_feature (1)..( 6): Matrix.002 file - promoters60/1441460
agagaa

SEQ ID NO: 49980 - DNA, 7 bp, Unknown
  misc_feature (1)..( 7): Matrix.002 file - promoters60/1441460
tttaagt

SEQ ID NO: 49981 - DNA, 8 bp, Unknown
  misc_feature (1)..( 8): Matrix.002 file - promoters60/1441460
tttcttgt

SEQ ID NO: 49982 - DNA, 7 bp, Unknown
  misc_feature (1)..( 7): Matrix.002 file - promoters60/1441460
gagaatt

SEQ ID NO: 49983 - DNA, 6 bp, Unknown
  misc_feature (1)..( 6): Matrix.002 file - promoters60/1441460
aagcaa

SEQ ID NO: 49984 - DNA, 6 bp, Unknown
  misc_feature (1)..( 6): Matrix.002 file - promoters60/1441460
aagggt

SEQ ID NO: 49985 - DNA, 7 bp, Unknown
  misc_feature (1)..( 7): Matrix.002 file - promoters60/1441465
agaaaaa

SEQ ID NO: 49986 - DNA, 6 bp, Unknown
  misc_feature (1)..( 6): Matrix.002 file - promoters60/1441465
tgcaaa

SEQ ID NO: 49987 - DNA, 6 bp, Unknown
  misc_feature (1)..( 6): Matrix.002 file - promoters60/1441465
ttatcg

SEQ ID NO: 49988 - DNA, 7 bp, Unknown
  misc_feature (1)..( 7): Matrix.002 file - promoters60/1441465
tataaaa

SEQ ID NO: 49989 - DNA, 12 bp, Unknown
  misc_feature (1)..( 12): Matrix.002 file - promoters60/1441465
aaaaaattcgtc

SEQ ID NO: 49990 - DNA, 6 bp, Unknown
  misc_feature (1)..( 6): Matrix.002 file - promoters60/1441465
agattt

SEQ ID NO: 49991 - DNA, 7 bp, Unknown
  misc_feature (1)..( 7): Matrix.002 file - promoters60/1441465
taaccga

SEQ ID NO: 49992 - DNA, 6 bp, Unknown
  misc_feature (1)..( 6): Matrix.002 file - promoters60/1441465
aaattt

SEQ ID NO: 49993 - DNA, 7 bp, Unknown
  misc_feature (1)..( 7): Matrix.002 file - promoters60/1441465
attttct

SEQ ID NO: 49994 - DNA, 8 bp, Unknown
  misc_feature (1)..( 8): Matrix.002 file - promoters60/1441465
aacacaaa

SEQ ID NO: 49995 - DNA, 7 bp, Unknown
  misc_feature (1)..( 7): Matrix.002 file - promoters60/1441465
caaacca

SEQ ID NO: 49996 - DNA, 6 bp, Unknown
  misc_feature (1)..( 6): Matrix.002 file - promoters60/1441465
catttt

SEQ ID NO: 49997 - DNA, 7 bp, Unknown
  misc_feature (1)..( 7): Matrix.002 file - promoters60/1441465
ttttcat

SEQ ID NO: 49998 - DNA, 8 bp, Unknown
  misc_feature (1)..( 8): Matrix.002 file - promoters60/1441465
tttcttta

SEQ ID NO: 49999 - DNA, 6 bp, Unknown
  misc_feature (1)..( 6): Matrix.002 file - promoters60/1441465
ttatac

SEQ ID NO: 50000 - DNA, 6 bp, Unknown
  misc_feature (1)..( 6): Matrix.002 file - promoters60/1441465
gtgata

SEQ ID NO: 50001 - DNA, 8 bp, Unknown
  misc_feature (1)..( 8): Matrix.002 file - promoters60/1441533
ttacatat

SEQ ID NO: 50002 - DNA, 7 bp, Unknown
  misc_feature (1)..( 7): Matrix.002 file - promoters60/1441533
acaattt

SEQ ID NO: 50003 - DNA, 7 bp, Unknown
  misc_feature (1)..( 7): Matrix.002 file - promoters60/1441533
ccaaaat

SEQ ID NO: 50004 - DNA, 6 bp, Unknown
  misc_feature (1)..( 6): Matrix.002 file - promoters60/1441533
ggtttt

SEQ ID NO: 50005 - DNA, 6 bp, Unknown
  misc_feature (1)..( 6): Matrix.002 file - promoters60/1441533
ttttga

SEQ ID NO: 50006 - DNA, 9 bp, Unknown
  misc_feature (1)..( 9): Matrix.002 file - promoters60/1441533
attattttt

SEQ ID NO: 50007 - DNA, 6 bp, Unknown
  misc_feature (1)..( 6): Matrix.002 file - promoters60/1441533
aaatga

SEQ ID NO: 50008 - DNA, 7 bp, Unknown
  misc_feature (1)..( 7): Matrix.002 file - promoters60/1441533
aagatgt

SEQ ID NO: 50009 - DNA, 7 bp, Unknown
  misc_feature (1)..( 7): Matrix.002 file - promoters60/1441533
acgagga

SEQ ID NO: 50010 - DNA, 9 bp, Unknown
  misc_feature (1)..( 9): Matrix.002 file - promoters60/1441533
atataaata

SEQ ID NO: 50011 - DNA, 8 bp, Unknown
  misc_feature (1)..( 8): Matrix.002 file - promoters60/1441533
ttttactt

SEQ ID NO: 50012 - DNA, 7 bp, Unknown
  misc_feature (1)..( 7): Matrix.002 file - promoters60/1441533
acgaact

SEQ ID NO: 50013 - DNA, 7 bp, Unknown
  misc_feature (1)..( 7): Matrix.002 file - promoters60/1441533
tatctcg

SEQ ID NO: 50014 - DNA, 8 bp, Unknown
  misc_feature (1)..( 8): Matrix.002 file - promoters60/1441533
atttgcac

SEQ ID NO: 50015 - DNA, 7 bp, Unknown
  misc_feature (1)..( 7): Matrix.002 file - promoters60/1441533
ttaatat

SEQ ID NO: 50016 - DNA, 6 bp, Unknown
  misc_feature (1)..( 6): Matrix.002 file - promoters60/1441533
aatata

SEQ ID NO: 50017 - DNA, 7 bp, Unknown
  misc_feature (1)..( 7): Matrix.002 file - promoters60/1441533
tgactaa

SEQ ID NO: 50018 - DNA, 6 bp, Unknown
  misc_feature (1)..( 6): Matrix.002 file - promoters60/1441533
tactcg

SEQ ID NO: 50019 - DNA, 6 bp, Unknown
  misc_feature (1)..( 6): Matrix.002 file - promoters60/1441533
tatact

SEQ ID NO: 50020 - DNA, 6 bp, Unknown
  misc_feature (1)..( 6): Matrix.002 file - promoters60/1441533
tttgtt

SEQ ID NO: 50021 - DNA, 7 bp, Unknown
  misc_feature (1)..( 7): Matrix.002 file - promoters60/1441533
aaaaaaa

SEQ ID NO: 50022 - DNA, 7 bp, Unknown
  misc_feature (1)..( 7): Matrix.002 file - promoters60/1441533
aacattt

SEQ ID NO: 50023 - DNA, 10 bp, Unknown
  misc_feature (1)..( 10): Matrix.002 file - promoters60/1441533
aaactaaaaa

SEQ ID NO: 50024 - DNA, 9 bp, Unknown
  misc_feature (1)..( 9): Matrix.002 file - promoters60/1441533
agaaaaaaa

SEQ ID NO: 50025 - DNA, 7 bp, Unknown
  misc_feature (1)..( 7): Matrix.002 file - promoters60/1441533
taggaaa

SEQ ID NO: 50026 - DNA, 6 bp, Unknown
  misc_feature (1)..( 6): Matrix.002 file - promoters60/1441539
tatata

SEQ ID NO: 50027 - DNA, 6 bp, Unknown
  misc_feature (1)..( 6): Matrix.002 file - promoters60/1441539
tttgac

SEQ ID NO: 50028 - DNA, 8 bp, Unknown
  misc_feature (1)..( 8): Matrix.002 file - promoters60/1441539
ttgggaaa

SEQ ID NO: 50029 - DNA, 7 bp, Unknown
  misc_feature (1)..( 7): Matrix.002 file - promoters60/1441539
tgaattg

SEQ ID NO: 50030 - DNA, 8 bp, Unknown
  misc_feature (1)..( 8): Matrix.002 file - promoters60/1441539
ttttcttt

SEQ ID NO: 50031 - DNA, 6 bp, Unknown
  misc_feature (1)..( 6): Matrix.002 file - promoters60/1441539
aacaaa

SEQ ID NO: 50032 - DNA, 7 bp, Unknown
  misc_feature (1)..( 7): Matrix.002 file - promoters60/1441539
aaacatt

SEQ ID NO: 50033 - DNA, 6 bp, Unknown
  misc_feature (1)..( 6): Matrix.002 file - promoters60/1441539
aaaaag

SEQ ID NO: 50034 - DNA, 7 bp, Unknown
  misc_feature (1)..( 7): Matrix.002 file - promoters60/1441539
aaaactt

SEQ ID NO: 50035 - DNA, 6 bp, Unknown
  misc_feature (1)..( 6): Matrix.002 file - promoters60/1441539
aaccct

SEQ ID NO: 50036 - DNA, 9 bp, Unknown
  misc_feature (1)..( 9): Matrix.002 file - promoters60/1441539
atggctgaa

SEQ ID NO: 50037 - DNA, 7 bp, Unknown
  misc_feature (1)..( 7): Matrix.002 file - promoters60/1441539
aagaaaa

SEQ ID NO: 50038 - DNA, 8 bp, Unknown
  misc_feature (1)..( 8): Matrix.002 file - promoters60/1441569
ttacatat

SEQ ID NO: 50039 - DNA, 7 bp, Unknown
  misc_feature (1)..( 7): Matrix.002 file - promoters60/1441569
acaattt

SEQ ID NO: 50040 - DNA, 7 bp, Unknown
  misc_feature (1)..( 7): Matrix.002 file - promoters60/1441569
ccaaaat

SEQ ID NO: 50041 - DNA, 6 bp, Unknown
  misc_feature (1)..( 6): Matrix.002 file - promoters60/1441569
ggtttt

SEQ ID NO: 50042 - DNA, 6 bp, Unknown
  misc_feature (1)..( 6): Matrix.002 file - promoters60/1441569
ttttga

SEQ ID NO: 50043 - DNA, 9 bp, Unknown
  misc_feature (1)..( 9): Matrix.002 file - promoters60/1441569
atttttttt

SEQ ID NO: 50044 - DNA, 6 bp, Unknown
  misc_feature (1)..( 6): Matrix.002 file - promoters60/1441569
aaatga

SEQ ID NO: 50045 - DNA, 7 bp, Unknown
  misc_feature (1)..( 7): Matrix.002 file - promoters60/1441569
aagatgt

SEQ ID NO: 50046 - DNA, 7 bp, Unknown
  misc_feature (1)..( 7): Matrix.002 file - promoters60/1441569
acgagga

SEQ ID NO: 50047 - DNA, 9 bp, Unknown
  misc_feature (1)..( 9): Matrix.002 file - promoters60/1441569
atataaata

SEQ ID NO: 50048 - DNA, 8 bp, Unknown
  misc_feature (1)..( 8): Matrix.002 file - promoters60/1441569
gaaactac

SEQ ID NO: 50049 - DNA, 8 bp, Unknown
  misc_feature (1)..( 8): Matrix.002 file - promoters60/1441569
aattttgt

SEQ ID NO: 50050 - DNA, 6 bp, Unknown
  misc_feature (1)..( 6): Matrix.002 file - promoters60/1441569
gttatt

SEQ ID NO: 50051 - DNA, 7 bp, Unknown
  misc_feature (1)..( 7): Matrix.002 file - promoters60/1441569
gaaaatt

SEQ ID NO: 50052 - DNA, 7 bp, Unknown
  misc_feature (1)..( 7): Matrix.002 file - promoters60/1441569
acgaata

SEQ ID NO: 50053 - DNA, 6 bp, Unknown
  misc_feature (1)..( 6): Matrix.002 file - promoters60/1441569
aaaaca

SEQ ID NO: 50054 - DNA, 6 bp, Unknown
  misc_feature (1)..( 6): Matrix.002 file - promoters60/1441569
gtaacc

SEQ ID NO: 50055 - DNA, 8 bp, Unknown
  misc_feature (1)..( 8): Matrix.002 file - promoters60/1441569
atagaaat

SEQ ID NO: 50056 - DNA, 11 bp, Unknown
  misc_feature (1)..( 11): Matrix.002 file - promoters60/1441569
aatcacaaaaa

SEQ ID NO: 50057 - DNA, 6 bp, Unknown
  misc_feature (1)..( 6): Matrix.002 file - promoters60/1441569
ctcagt

SEQ ID NO: 50058 - DNA, 7 bp, Unknown
  misc_feature (1)..( 7): Matrix.002 file - promoters60/1441569
tttctta

SEQ ID NO: 50059 - DNA, 6 bp, Unknown
  misc_feature (1)..( 6): Matrix.002 file - promoters60/1441569
tttcta

SEQ ID NO: 50060 - DNA, 7 bp, Unknown
  misc_feature (1)..( 7): Matrix.002 file - promoters60/1441569
caaataa

SEQ ID NO: 50061 - DNA, 9 bp, Unknown
  misc_feature (1)..( 9): Matrix.002 file - promoters60/1441569
cttgtacaa

SEQ ID NO: 50062 - DNA, 6 bp, Unknown
  misc_feature (1)..( 6): Matrix.002 file - promoters60/1441569
ttggtt

SEQ ID NO: 50063 - DNA, 6 bp, Unknown
  misc_feature (1)..( 6): Matrix.002 file - promoters60/1441569
cataaa

SEQ ID NO: 50064 - DNA, 6 bp, Unknown
  misc_feature (1)..( 6): Matrix.002 file - promoters60/1441569
ttttaa

SEQ ID NO: 50065 - DNA, 11 bp, Unknown
  misc_feature (1)..( 11): Matrix.002 file - promoters60/1441657
aacttctattt

SEQ ID NO: 50066 - DNA, 9 bp, Unknown
  misc_feature (1)..( 9): Matrix.002 file - promoters60/1441657
ccaaaccta

SEQ ID NO: 50067 - DNA, 7 bp, Unknown
  misc_feature (1)..( 7): Matrix.002 file - promoters60/1441657
ataattt

SEQ ID NO: 50068 - DNA, 7 bp, Unknown
  misc_feature (1)..( 7): Matrix.002 file - promoters60/1441665
aaacaaa

SEQ ID NO: 50069 - DNA, 12 bp, Unknown
  misc_feature (1)..( 12): Matrix.002 file - promoters60/1441665
aaaatgggccaa

SEQ ID NO: 50070 - DNA, 7 bp, Unknown
  misc_feature (1)..( 7): Matrix.002 file - promoters60/1441814
aatttta

SEQ ID NO: 50071 - DNA, 10 bp, Unknown
  misc_feature (1)..( 10): Matrix.002 file - promoters60/1441814
aaatatccta

SEQ ID NO: 50072 - DNA, 5 bp, Unknown
  misc_feature (1)..( 5): Matrix.002 file - promoters60/1441814
taatg

SEQ ID NO: 50073 - DNA, 7 bp, Unknown
  misc_feature (1)..( 7): Matrix.002 file - promoters60/1441814
tatttta

SEQ ID NO: 50074 - DNA, 14 bp, Unknown
  misc_feature (1)..( 14): Matrix.002 file - promoters60/1441814
atataattttataa

SEQ ID NO: 50075 - DNA, 10 bp, Unknown
  misc_feature (1)..( 10): Matrix.002 file - promoters60/1441814
ataaataatg

SEQ ID NO: 50076 - DNA, 10 bp, Unknown
  misc_feature (1)..( 10): Matrix.002 file - promoters60/1441814
aaattttgat

SEQ ID NO: 50077 - DNA, 10 bp, Unknown
  misc_feature (1)..( 10): Matrix.002 file - promoters60/1441814
taatattagt

SEQ ID NO: 50078 - DNA, 11 bp, Unknown
  misc_feature (1)..( 11): Matrix.002 file - promoters60/1441835
ctaatttacta

SEQ ID NO: 50079 - DNA, 12 bp, Unknown
  misc_feature (1)..( 12): Matrix.002 file - promoters60/1441841
tctcacacgaaa

SEQ ID NO: 50080 - DNA, 10 bp, Unknown
  misc_feature (1)..( 10): Matrix.002 file - promoters60/1441841
aaaatgtttt

SEQ ID NO: 50081 - DNA, 8 bp, Unknown
  misc_feature (1)..( 8): Matrix.002 file - promoters60/1441841
tttgtttc

SEQ ID NO: 50082 - DNA, 14 bp, Unknown
  misc_feature (1)..( 14): Matrix.002 file - promoters60/1441841
acatttgttaatat

SEQ ID NO: 50083 - DNA, 7 bp, Unknown
  misc_feature (1)..( 7): Matrix.002 file - promoters60/1441841
cttctaa

SEQ ID NO: 50084 - DNA, 8 bp, Unknown
  misc_feature (1)..( 8): Matrix.002 file - promoters60/1441841
ttttgttt

SEQ ID NO: 50085 - DNA, 6 bp, Unknown
  misc_feature (1)..( 6): Matrix.002 file - promoters60/1441851
ttgaga

SEQ ID NO: 50086 - DNA, 10 bp, Unknown
  misc_feature (1)..( 10): Matrix.002 file - promoters60/1441851
taacgtttaa

SEQ ID NO: 50087 - DNA, 6 bp, Unknown
  misc_feature (1)..( 6): Matrix.002 file - promoters60/1441851
aacatt

SEQ ID NO: 50088 - DNA, 7 bp, Unknown
  misc_feature (1)..( 7): Matrix.002 file - promoters60/1441851
ttcaaag

SEQ ID NO: 50089 - DNA, 7 bp, Unknown
  misc_feature (1)..( 7): Matrix.002 file - promoters60/1441851
aagaact

SEQ ID NO: 50090 - DNA, 7 bp, Unknown
  misc_feature (1)..( 7): Matrix.002 file - promoters60/1441851
agtaaac

SEQ ID NO: 50091 - DNA, 7 bp, Unknown
  misc_feature (1)..( 7): Matrix.002 file - promoters60/1441851
attcata

SEQ ID NO: 50092 - DNA, 6 bp, Unknown
  misc_feature (1)..( 6): Matrix.002 file - promoters60/1441851
taacat

SEQ ID NO: 50093 - DNA, 10 bp, Unknown
  misc_feature (1)..( 10): Matrix.002 file - promoters60/1441851
agtctaaaaa

SEQ ID NO: 50094 - DNA, 9 bp, Unknown
  misc_feature (1)..( 9): Matrix.002 file - promoters60/1441851
ataatgttt

SEQ ID NO: 50095 - DNA, 7 bp, Unknown
  misc_feature (1)..( 7): Matrix.002 file - promoters60/1441851
atagata

SEQ ID NO: 50096 - DNA, 7 bp, Unknown
  misc_feature (1)..( 7): Matrix.002 file - promoters60/1441851
atggaat

SEQ ID NO: 50097 - DNA, 7 bp, Unknown
  misc_feature (1)..( 7): Matrix.002 file - promoters60/1441851
accaaat

SEQ ID NO: 50098 - DNA, 6 bp, Unknown
  misc_feature (1)..( 6): Matrix.002 file - promoters60/1441851
tattat

SEQ ID NO: 50099 - DNA, 6 bp, Unknown
  misc_feature (1)..( 6): Matrix.002 file - promoters60/1441851
aaaaaa

SEQ ID NO: 50100 - DNA, 6 bp, Unknown
  misc_feature (1)..( 6): Matrix.002 file - promoters60/1441851
gtcaaa

SEQ ID NO: 50101 - DNA, 6 bp, Unknown
  misc_feature (1)..( 6): Matrix.002 file - promoters60/1441851
ggcgag

SEQ ID NO: 50102 - DNA, 8 bp, Unknown
  misc_feature (1)..( 8): Matrix.002 file - promoters60/1441859
tttagttt

SEQ ID NO: 50103 - DNA, 8 bp, Unknown
  misc_feature (1)..( 8): Matrix.002 file - promoters60/1441859
taaaaaaa

SEQ ID NO: 50104 - DNA, 9 bp, Unknown
  misc_feature (1)..( 9): Matrix.002 file - promoters60/1441859
attttgttt

SEQ ID NO: 50105 - DNA, 13 bp, Unknown
  misc_feature (1)..( 13): Matrix.002 file - promoters60/1441859
ataaaaaaagttt

SEQ ID NO: 50106 - DNA, 8 bp, Unknown
  misc_feature (1)..( 8): Matrix.002 file - promoters60/1441912
ataaatat

SEQ ID NO: 50107 - DNA, 6 bp, Unknown
  misc_feature (1)..( 6): Matrix.002 file - promoters60/1441912
ataata

SEQ ID NO: 50108 - DNA, 8 bp, Unknown
  misc_feature (1)..( 8): Matrix.002 file - promoters60/1441937
taaaaatc

SEQ ID NO: 50109 - DNA, 8 bp, Unknown
  misc_feature (1)..( 8): Matrix.002 file - promoters60/1441937
ctgtgttg

SEQ ID NO: 50110 - DNA, 8 bp, Unknown
  misc_feature (1)..( 8): Matrix.002 file - promoters60/1441937
tcttgttt

SEQ ID NO: 50111 - DNA, 8 bp, Unknown
  misc_feature (1)..( 8): Matrix.002 file - promoters60/1441937
caatttat

SEQ ID NO: 50112 - DNA, 8 bp, Unknown
  misc_feature (1)..( 8): Matrix.002 file - promoters60/1441985
ttacatat

SEQ ID NO: 50113 - DNA, 7 bp, Unknown
  misc_feature (1)..( 7): Matrix.002 file - promoters60/1441985
acaattt

SEQ ID NO: 50114 - DNA, 7 bp, Unknown
  misc_feature (1)..( 7): Matrix.002 file - promoters60/1441985
ccaaaat

SEQ ID NO: 50115 - DNA, 6 bp, Unknown
  misc_feature (1)..( 6): Matrix.002 file - promoters60/1441985
ggtttt

SEQ ID NO: 50116 - DNA, 6 bp, Unknown
  misc_feature (1)..( 6): Matrix.002 file - promoters60/1441985
ttttga

SEQ ID NO: 50117 - DNA, 9 bp, Unknown
  misc_feature (1)..( 9): Matrix.002 file - promoters60/1441985
atttttttt

SEQ ID NO: 50118 - DNA, 6 bp, Unknown
  misc_feature (1)..( 6): Matrix.002 file - promoters60/1441985
aaatga

SEQ ID NO: 50119 - DNA, 7 bp, Unknown
  misc_feature (1)..( 7): Matrix.002 file - promoters60/1441985
aagatgt

SEQ ID NO: 50120 - DNA, 7 bp, Unknown
  misc_feature (1)..( 7): Matrix.002 file - promoters60/1441985
acgagga

SEQ ID NO: 50121 - DNA, 9 bp, Unknown
  misc_feature (1)..( 9): Matrix.002 file - promoters60/1441985
atataaata

SEQ ID NO: 50122 - DNA, 8 bp, Unknown
  misc_feature (1)..( 8): Matrix.002 file - promoters60/1441985
gaaactac

SEQ ID NO: 50123 - DNA, 8 bp, Unknown
  misc_feature (1)..( 8): Matrix.002 file - promoters60/1441985
aattttgt

SEQ ID NO: 50124 - DNA, 6 bp, Unknown
  misc_feature (1)..( 6): Matrix.002 file - promoters60/1441985
gttatt

SEQ ID NO: 50125 - DNA, 7 bp, Unknown
  misc_feature (1)..( 7): Matrix.002 file - promoters60/1441985
gaaaatt

SEQ ID NO: 50126 - DNA, 7 bp, Unknown
  misc_feature (1)..( 7): Matrix.002 file - promoters60/1441985
acgaata

SEQ ID NO: 50127 - DNA, 6 bp, Unknown
  misc_feature (1)..( 6): Matrix.002 file - promoters60/1441985
aaaaca

SEQ ID NO: 50128 - DNA, 6 bp, Unknown
  misc_feature (1)..( 6): Matrix.002 file - promoters60/1441985
gtaacc

SEQ ID NO: 50129 - DNA, 8 bp, Unknown
  misc_feature (1)..( 8): Matrix.002 file - promoters60/1441985
atagaaat

SEQ ID NO: 50130 - DNA, 11 bp, Unknown
  misc_feature (1)..( 11): Matrix.002 file - promoters60/1441985
aatcacaaaaa

SEQ ID NO: 50131 - DNA, 6 bp, Unknown
  misc_feature (1)..( 6): Matrix.002 file - promoters60/1441985
ctcagt

SEQ ID NO: 50132 - DNA, 7 bp, Unknown
  misc_feature (1)..( 7): Matrix.002 file - promoters60/1441985
tttctta

SEQ ID NO: 50133 - DNA, 6 bp, Unknown
  misc_feature (1)..( 6): Matrix.002 file - promoters60/1441985
tttcta

SEQ ID NO: 50134 - DNA, 7 bp, Unknown
  misc_feature (1)..( 7): Matrix.002 file - promoters60/1441985
caaataa

SEQ ID NO: 50135 - DNA, 9 bp, Unknown
  misc_feature (1)..( 9): Matrix.002 file - promoters60/1441985
cttgtacaa

SEQ ID NO: 50136 - DNA, 6 bp, Unknown
  misc_feature (1)..( 6): Matrix.002 file - promoters60/1441985
ttggtt

SEQ ID NO: 50137 - DNA, 6 bp, Unknown
  misc_feature (1)..( 6): Matrix.002 file - promoters60/1441985
cataaa

SEQ ID NO: 50138 - DNA, 6 bp, Unknown
  misc_feature (1)..( 6): Matrix.002 file - promoters60/1441985
ttttaa

SEQ ID NO: 50139 - DNA, 10 bp, Unknown
  misc_feature (1)..( 10): Matrix.002 file - promoters60/1441990
ttatataaat

SEQ ID NO: 50140 - DNA, 13 bp, Unknown
  misc_feature (1)..( 13): Matrix.002 file - promoters60/1441990
cgagaataaataa

SEQ ID NO: 50141 - DNA, 17 bp, Unknown
  misc_feature (1)..( 17): Matrix.002 file - promoters60/1441990
aatacaaaaaaaaaaac

SEQ ID NO: 50142 - DNA, 7 bp, Unknown
  misc_feature (1)..( 7): Matrix.002 file - promoters60/1442104
actagat

SEQ ID NO: 50143 - DNA, 6 bp, Unknown
  misc_feature (1)..( 6): Matrix.002 file - promoters60/1442104
aataat

SEQ ID NO: 50144 - DNA, 6 bp, Unknown
  misc_feature (1)..( 6): Matrix.002 file - promoters60/1442104
ttgtgg

SEQ ID NO: 50145 - DNA, 7 bp, Unknown
  misc_feature (1)..( 7): Matrix.002 file - promoters60/1442104
tataaat

SEQ ID NO: 50146 - DNA, 13 bp, Unknown
  misc_feature (1)..( 13): Matrix.002 file - promoters60/1442104
attattcgacctt

SEQ ID NO: 50147 - DNA, 6 bp, Unknown
  misc_feature (1)..( 6): Matrix.002 file - promoters60/1442104
tttgaa

SEQ ID NO: 50148 - DNA, 6 bp, Unknown
  misc_feature (1)..( 6): Matrix.002 file - promoters60/1442104
taattt

SEQ ID NO: 50149 - DNA, 7 bp, Unknown
  misc_feature (1)..( 7): Matrix.002 file - promoters60/1442104
aaacaaa

SEQ ID NO: 50150 - DNA, 6 bp, Unknown
  misc_feature (1)..( 6): Matrix.002 file - promoters60/1442104
tttatc

SEQ ID NO: 50151 - DNA, 7 bp, Unknown
  misc_feature (1)..( 7): Matrix.002 file - promoters60/1442104
tctccca

SEQ ID NO: 50152 - DNA, 6 bp, Unknown
  misc_feature (1)..( 6): Matrix.002 file - promoters60/1442104
acaatt

SEQ ID NO: 50153 - DNA, 7 bp, Unknown
  misc_feature (1)..( 7): Matrix.002 file - promoters60/1442104
attactt

SEQ ID NO: 50154 - DNA, 6 bp, Unknown
  misc_feature (1)..( 6): Matrix.002 file - promoters60/1442104
ccgaca

SEQ ID NO: 50155 - DNA, 8 bp, Unknown
  misc_feature (1)..( 8): Matrix.002 file - promoters60/1442104
attgtgat

SEQ ID NO: 50156 - DNA, 6 bp, Unknown
  misc_feature (1)..( 6): Matrix.002 file - promoters60/1442104
ttttaa

SEQ ID NO: 50157 - DNA, 10 bp, Unknown
  misc_feature (1)..( 10): Matrix.002 file - promoters60/1442156
aaatagttaa

SEQ ID NO: 50158 - DNA, 15 bp, Unknown
  misc_feature (1)..( 15): Matrix.002 file - promoters60/1442156
attttatttcagcca

SEQ ID NO: 50159 - DNA, 7 bp, Unknown
  misc_feature (1)..( 7): Matrix.002 file - promoters60/1442156
ttcttct

SEQ ID NO: 50160 - DNA, 8 bp, Unknown
  misc_feature (1)..( 8): Matrix.002 file - promoters60/1442156
attttaaa

SEQ ID NO: 50161 - DNA, 9 bp, Unknown
  misc_feature (1)..( 9): Matrix.002 file - promoters60/1442156
aacaaataa

SEQ ID NO: 50162 - DNA, 11 bp, Unknown
  misc_feature (1)..( 11): Matrix.002 file - promoters60/1442156
tttttatccta

SEQ ID NO: 50163 - DNA, 11 bp, Unknown
  misc_feature (1)..( 11): Matrix.002 file - promoters60/1442156
gaaaaaaataa

SEQ ID NO: 50164 - DNA, 11 bp, Unknown
  misc_feature (1)..( 11): Matrix.002 file - promoters60/1442156
ttatctgaaat

SEQ ID NO: 50165 - DNA, 7 bp, Unknown
  misc_feature (1)..( 7): Matrix.002 file - promoters60/1442156
aaaataa

SEQ ID NO: 50166 - DNA, 7 bp, Unknown
  misc_feature (1)..( 7): Matrix.002 file - promoters60/1442156
cacgtgc

SEQ ID NO: 50167 - DNA, 7 bp, Unknown
  misc_feature (1)..( 7): Matrix.002 file - promoters60/1442179
tcaacaa

SEQ ID NO: 50168 - DNA, 7 bp, Unknown
  misc_feature (1)..( 7): Matrix.002 file - promoters60/1442179
gatcaag

SEQ ID NO: 50169 - DNA, 9 bp, Unknown
  misc_feature (1)..( 9): Matrix.002 file - promoters60/1442179
gagctcttg

SEQ ID NO: 50170 - DNA, 7 bp, Unknown
  misc_feature (1)..( 7): Matrix.002 file - promoters60/1442179
aatagta

SEQ ID NO: 50171 - DNA, 7 bp, Unknown
  misc_feature (1)..( 7): Matrix.002 file - promoters60/1442179
attattt

SEQ ID NO: 50172 - DNA, 6 bp, Unknown
  misc_feature (1)..( 6): Matrix.002 file - promoters60/1442179
ggatat

SEQ ID NO: 50173 - DNA, 7 bp, Unknown
  misc_feature (1)..( 7): Matrix.002 file - promoters60/1442179
tttttaa

SEQ ID NO: 50174 - DNA, 7 bp, Unknown
  misc_feature (1)..( 7): Matrix.002 file - promoters60/1442179
taaaaat

SEQ ID NO: 50175 - DNA, 6 bp, Unknown
  misc_feature (1)..( 6): Matrix.002 file - promoters60/1442179
cgagcc

SEQ ID NO: 50176 - DNA, 6 bp, Unknown
  misc_feature (1)..( 6): Matrix.002 file - promoters60/1442179
aaatcg

SEQ ID NO: 50177 - DNA, 9 bp, Unknown
  misc_feature (1)..( 9): Matrix.002 file - promoters60/1442179
gttggtgtt

SEQ ID NO: 50178 - DNA, 8 bp, Unknown
  misc_feature (1)..( 8): Matrix.002 file - promoters60/1442179
gtttaaga

SEQ ID NO: 50179 - DNA, 7 bp, Unknown
  misc_feature (1)..( 7): Matrix.002 file - promoters60/1442189
cttatta

SEQ ID NO: 50180 - DNA, 11 bp, Unknown
  misc_feature (1)..( 11): Matrix.002 file - promoters60/1442189
aaaaaatatca

SEQ ID NO: 50181 - DNA, 10 bp, Unknown
  misc_feature (1)..( 10): Matrix.002 file - promoters60/1442189
aaaaactaga

SEQ ID NO: 50182 - DNA, 7 bp, Unknown
  misc_feature (1)..( 7): Matrix.002 file - promoters60/1442189
caataaa

SEQ ID NO: 50183 - DNA, 6 bp, Unknown
  misc_feature (1)..( 6): Matrix.002 file - promoters60/1442189
aagata

SEQ ID NO: 50184 - DNA, 6 bp, Unknown
  misc_feature (1)..( 6): Matrix.002 file - promoters60/1442189
ttttcc

SEQ ID NO: 50185 - DNA, 6 bp, Unknown
  misc_feature (1)..( 6): Matrix.002 file - promoters60/1442189
ttaaaa

SEQ ID NO: 50186 - DNA, 6 bp, Unknown
  misc_feature (1)..( 6): Matrix.002 file - promoters60/1442189
atataa

SEQ ID NO: 50187 - DNA, 6 bp, Unknown
  misc_feature (1)..( 6): Matrix.002 file - promoters60/1442189
ataaac

SEQ ID NO: 50188 - DNA, 7 bp, Unknown
  misc_feature (1)..( 7): Matrix.002 file - promoters60/1442189
gtgggat

SEQ ID NO: 50189 - DNA, 6 bp, Unknown
  misc_feature (1)..( 6): Matrix.002 file - promoters60/1442189
aaaaat

SEQ ID NO: 50190 - DNA, 9 bp, Unknown
  misc_feature (1)..( 9): Matrix.002 file - promoters60/1442189
aaacgaaga

SEQ ID NO: 50191 - DNA, 7 bp, Unknown
  misc_feature (1)..( 7): Matrix.002 file - promoters60/1442189
attctaa

SEQ ID NO: 50192 - DNA, 6 bp, Unknown
  misc_feature (1)..( 6): Matrix.002 file - promoters60/1442189
aacgga

SEQ ID NO: 50193 - DNA, 8 bp, Unknown
  misc_feature (1)..( 8): Matrix.002 file - promoters60/1442189
aaaatata

SEQ ID NO: 50194 - DNA, 6 bp, Unknown
  misc_feature (1)..( 6): Matrix.002 file - promoters60/1442189
tttgaa

SEQ ID NO: 50195 - DNA, 7 bp, Unknown
  misc_feature (1)..( 7): Matrix.002 file - promoters60/1442189
tatcgca

SEQ ID NO: 50196 - DNA, 8 bp, Unknown
  misc_feature (1)..( 8): Matrix.002 file - promoters60/1442189
agatccac

SEQ ID NO: 50197 - DNA, 13 bp, Unknown
  misc_feature (1)..( 13): Matrix.002 file - promoters60/1442189
ttttctctcattc

SEQ ID NO: 50198 - DNA, 8 bp, Unknown
  misc_feature (1)..( 8): Matrix.002 file - promoters60/1442240
tgcataag

SEQ ID NO: 50199 - DNA, 10 bp, Unknown
  misc_feature (1)..( 10): Matrix.002 file - promoters60/1442240
tgaatctatt

SEQ ID NO: 50200 - DNA, 13 bp, Unknown
  misc_feature (1)..( 13): Matrix.002 file - promoters60/1442240
agattttcaaaac

SEQ ID NO: 50201 - DNA, 12 bp, Unknown
  misc_feature (1)..( 12): Matrix.002 file - promoters60/1442240
agtttttgatat

SEQ ID NO: 50202 - DNA, 9 bp, Unknown
  misc_feature (1)..( 9): Matrix.002 file - promoters60/1442240
agattttca

SEQ ID NO: 50203 - DNA, 10 bp, Unknown
  misc_feature (1)..( 10): Matrix.002 file - promoters60/1442240
acattttcaa

SEQ ID NO: 50204 - DNA, 9 bp, Unknown
  misc_feature (1)..( 9): Matrix.002 file - promoters60/1442240
atcaacaaa

SEQ ID NO: 50205 - DNA, 9 bp, Unknown
  misc_feature (1)..( 9): Matrix.002 file - promoters60/1442244
acatcttta

SEQ ID NO: 50206 - DNA, 12 bp, Unknown
  misc_feature (1)..( 12): Matrix.002 file - promoters60/1442244
gcagttacaaaa

SEQ ID NO: 50207 - DNA, 8 bp, Unknown
  misc_feature (1)..( 8): Matrix.002 file - promoters60/1442244
attaaaaa

SEQ ID NO: 50208 - DNA, 12 bp, Unknown
  misc_feature (1)..( 12): Matrix.002 file - promoters60/1442244
atgtaataacac

SEQ ID NO: 50209 - DNA, 8 bp, Unknown
  misc_feature (1)..( 8): Matrix.002 file - promoters60/1442244
tataaaaa

SEQ ID NO: 50210 - DNA, 12 bp, Unknown
  misc_feature (1)..( 12): Matrix.002 file - promoters60/1442244
aaaagaaaaaaa

SEQ ID NO: 50211 - DNA, 6 bp, Unknown
  misc_feature (1)..( 6): Matrix.002 file - promoters60/1442316
aaaaga

SEQ ID NO: 50212 - DNA, 7 bp, Unknown
  misc_feature (1)..( 7): Matrix.002 file - promoters60/1442316
attaaaa

SEQ ID NO: 50213 - DNA, 10 bp, Unknown
  misc_feature (1)..( 10): Matrix.002 file - promoters60/1442316
taacaaatta

SEQ ID NO: 50214 - DNA, 10 bp, Unknown
  misc_feature (1)..( 10): Matrix.002 file - promoters60/1442316
aattataatt

SEQ ID NO: 50215 - DNA, 11 bp, Unknown
  misc_feature (1)..( 11): Matrix.002 file - promoters60/1442326
gaaaaaggccc

SEQ ID NO: 50216 - DNA, 7 bp, Unknown
  misc_feature (1)..( 7): Matrix.002 file - promoters60/1442326
aaaaaag

SEQ ID NO: 50217 - DNA, 8 bp, Unknown
  misc_feature (1)..( 8): Matrix.002 file - promoters60/1442326
caaaaaaa

SEQ ID NO: 50218 - DNA, 8 bp, Unknown
  misc_feature (1)..( 8): Matrix.002 file - promoters60/1442326
caaaagac

SEQ ID NO: 50219 - DNA, 10 bp, Unknown
  misc_feature (1)..( 10): Matrix.002 file - promoters60/1442408
ataatattaa

SEQ ID NO: 50220 - DNA, 11 bp, Unknown
  misc_feature (1)..( 11): Matrix.002 file - promoters60/1442408
cataaatgtat

SEQ ID NO: 50221 - DNA, 8 bp, Unknown
  misc_feature (1)..( 8): Matrix.002 file - promoters60/1442408
ttaatatt

SEQ ID NO: 50222 - DNA, 9 bp, Unknown
  misc_feature (1)..( 9): Matrix.002 file - promoters60/1442408
tatatttaa

SEQ ID NO: 50223 - DNA, 10 bp, Unknown
  misc_feature (1)..( 10): Matrix.002 file - promoters60/1442408
aaatcaaatg

SEQ ID NO: 50224 - DNA, 7 bp, Unknown
  misc_feature (1)..( 7): Matrix.002 file - promoters60/1442427
gtcgaaa

SEQ ID NO: 50225 - DNA, 7 bp, Unknown
  misc_feature (1)..( 7): Matrix.002 file - promoters60/1442427
aaacatt

SEQ ID NO: 50226 - DNA, 10 bp, Unknown
  misc_feature (1)..( 10): Matrix.002 file - promoters60/1442427
taaatttgct

SEQ ID NO: 50227 - DNA, 9 bp, Unknown
  misc_feature (1)..( 9): Matrix.002 file - promoters60/1442427
tcagtaaga

SEQ ID NO: 50228 - DNA, 7 bp, Unknown
  misc_feature (1)..( 7): Matrix.002 file - promoters60/1442427
tttattg

SEQ ID NO: 50229 - DNA, 7 bp, Unknown
  misc_feature (1)..( 7): Matrix.002 file - promoters60/1442427
tgaaaaa

SEQ ID NO: 50230 - DNA, 6 bp, Unknown
  misc_feature (1)..( 6): Matrix.002 file - promoters60/1442427
aatatt

SEQ ID NO: 50231 - DNA, 12 bp, Unknown
  misc_feature (1)..( 12): Matrix.002 file - promoters60/1442427
ttagtttggtct

SEQ ID NO: 50232 - DNA, 6 bp, Unknown
  misc_feature (1)..( 6): Matrix.002 file - promoters60/1442427
ttttat

SEQ ID NO: 50233 - DNA, 9 bp, Unknown
  misc_feature (1)..( 9): Matrix.002 file - promoters60/1442427
attagaaga

SEQ ID NO: 50234 - DNA, 6 bp, Unknown
  misc_feature (1)..( 6): Matrix.002 file - promoters60/1442452
atgttt

SEQ ID NO: 50235 - DNA, 18 bp, Unknown
  misc_feature (1)..( 18): Matrix.002 file - promoters60/1442452
tttatattttagaaaaat

SEQ ID NO: 50236 - DNA, 11 bp, Unknown
  misc_feature (1)..( 11): Matrix.002 file - promoters60/1442452
ttttgaagaat

SEQ ID NO: 50237 - DNA, 11 bp, Unknown
  misc_feature (1)..( 11): Matrix.002 file - promoters60/1442452
atttccataaa

SEQ ID NO: 50238 - DNA, 10 bp, Unknown
  misc_feature (1)..( 10): Matrix.002 file - promoters60/1442452
aaaatgttag

SEQ ID NO: 50239 - DNA, 6 bp, Unknown
  misc_feature (1)..( 6): Matrix.002 file - promoters60/1442452
taaaat

SEQ ID NO: 50240 - DNA, 7 bp, Unknown
  misc_feature (1)..( 7): Matrix.002 file - promoters60/1442452
attaaag

SEQ ID NO: 50241 - DNA, 11 bp, Unknown
  misc_feature (1)..( 11): Matrix.002 file - promoters60/1442452
atccaacggca

SEQ ID NO: 50242 - DNA, 7 bp, Unknown
  misc_feature (1)..( 7): Matrix.002 file - promoters60/1442452
tccacgt

SEQ ID NO: 50243 - DNA, 8 bp, Unknown
  misc_feature (1)..( 8): Matrix.002 file - promoters60/1442452
tatataaa

SEQ ID NO: 50244 - DNA, 10 bp, Unknown
  misc_feature (1)..( 10): Matrix.002 file - promoters60/1442452
tataaacaaa

SEQ ID NO: 50245 - DNA, 6 bp, Unknown
  misc_feature (1)..( 6): Matrix.002 file - promoters60/1442452
aaattc

SEQ ID NO: 50246 - DNA, 7 bp, Unknown
  misc_feature (1)..( 7): Matrix.002 file - promoters60/1442452
tttgaaa

SEQ ID NO: 50247 - DNA, 7 bp, Unknown
  misc_feature (1)..( 7): Matrix.002 file - promoters60/1442452
actctgt

SEQ ID NO: 50248 - DNA, 6 bp, Unknown
  misc_feature (1)..( 6): Matrix.002 file - promoters60/1442452
atctcc

SEQ ID NO: 50249 - DNA, 8 bp, Unknown
  misc_feature (1)..( 8): Matrix.002 file - promoters60/1442452
atccgcgt

SEQ ID NO: 50250 - DNA, 14 bp, Unknown
  misc_feature (1)..( 14): Matrix.002 file - promoters60/1442452
taaccaatcagatc

SEQ ID NO: 50251 - DNA, 6 bp, Unknown
  misc_feature (1)..( 6): Matrix.002 file - promoters60/1442452
tattct

SEQ ID NO: 50252 - DNA, 9 bp, Unknown
  misc_feature (1)..( 9): Matrix.002 file - promoters60/1442452
aatacaaca

SEQ ID NO: 50253 - DNA, 7 bp, Unknown
  misc_feature (1)..( 7): Matrix.002 file - promoters60/1442452
atactat

SEQ ID NO: 50254 - DNA, 8 bp, Unknown
  misc_feature (1)..( 8): Matrix.002 file - promoters60/1442452
agatatgt

SEQ ID NO: 50255 - DNA, 15 bp, Unknown
  misc_feature (1)..( 15): Matrix.002 file - promoters60/1442452
ttataaaccgtcgat

SEQ ID NO: 50256 - DNA, 8 bp, Unknown
  misc_feature (1)..( 8): Matrix.002 file - promoters60/1442468
gttgtttc

SEQ ID NO: 50257 - DNA, 8 bp, Unknown
  misc_feature (1)..( 8): Matrix.002 file - promoters60/1442468
tttttttg

SEQ ID NO: 50258 - DNA, 12 bp, Unknown
  misc_feature (1)..( 12): Matrix.002 file - promoters60/1442468
tttcgtttttgt

SEQ ID NO: 50259 - DNA, 8 bp, Unknown
  misc_feature (1)..( 8): Matrix.002 file - promoters60/1442468
ctatttga

SEQ ID NO: 50260 - DNA, 10 bp, Unknown
  misc_feature (1)..( 10): Matrix.002 file - promoters60/1442468
aaattgtaaa

SEQ ID NO: 50261 - DNA, 8 bp, Unknown
  misc_feature (1)..( 8): Matrix.002 file - promoters60/1442468
ctaaacat

SEQ ID NO: 50262 - DNA, 14 bp, Unknown
  misc_feature (1)..( 14): Matrix.002 file - promoters60/1442468
attgccaaaaccaa

SEQ ID NO: 50263 - DNA, 7 bp, Unknown
  misc_feature (1)..( 7): Matrix.002 file - promoters60/1442468
gaaacag

SEQ ID NO: 50264 - DNA, 11 bp, Unknown
  misc_feature (1)..( 11): Matrix.002 file - promoters60/1442504
aacaaaaaaag

SEQ ID NO: 50265 - DNA, 12 bp, Unknown
  misc_feature (1)..( 12): Matrix.002 file - promoters60/1442649
tatcatttttag

SEQ ID NO: 50266 - DNA, 8 bp, Unknown
  misc_feature (1)..( 8): Matrix.002 file - promoters60/1442649
tttatttt

SEQ ID NO: 50267 - DNA, 8 bp, Unknown
  misc_feature (1)..( 8): Matrix.002 file - promoters60/1442649
aaacaaat

SEQ ID NO: 50268 - DNA, 8 bp, Unknown
  misc_feature (1)..( 8): Matrix.002 file - promoters60/1442777
atatcttt

SEQ ID NO: 50269 - DNA, 10 bp, Unknown
  misc_feature (1)..( 10): Matrix.002 file - promoters60/1442777
atatcaaaaa

SEQ ID NO: 50270 - DNA, 11 bp, Unknown
  misc_feature (1)..( 11): Matrix.002 file - promoters60/1442777
taatcccaacg

SEQ ID NO: 50271 - DNA, 9 bp, Unknown
  misc_feature (1)..( 9): Matrix.002 file - promoters60/1442777
gatgtataa

SEQ ID NO: 50272 - DNA, 16 bp, Unknown
  misc_feature (1)..( 16): Matrix.002 file - promoters60/1442777
attttgaaataaattt

SEQ ID NO: 50273 - DNA, 17 bp, Unknown
  misc_feature (1)..( 17): Matrix.002 file - promoters60/1442777
aattgttaattaaattt

SEQ ID NO: 50274 - DNA, 9 bp, Unknown
  misc_feature (1)..( 9): Matrix.002 file - promoters60/1442777
taatgtgac

SEQ ID NO: 50275 - DNA, 11 bp, Unknown
  misc_feature (1)..( 11): Matrix.002 file - promoters60/1442777
atgtataactt

SEQ ID NO: 50276 - DNA, 14 bp, Unknown
  misc_feature (1)..( 14): Matrix.002 file - promoters60/1442777
atgtataactttat

SEQ ID NO: 50277 - DNA, 9 bp, Unknown
  misc_feature (1)..( 9): Matrix.002 file - promoters60/1442777
tatataaat

SEQ ID NO: 50278 - DNA, 12 bp, Unknown
  misc_feature (1)..( 12): Matrix.002 file - promoters60/1442880
aaataattgtat

SEQ ID NO: 50279 - DNA, 10 bp, Unknown
  misc_feature (1)..( 10): Matrix.002 file - promoters60/1442880
gaaatagatt

SEQ ID NO: 50280 - DNA, 11 bp, Unknown
  misc_feature (1)..( 11): Matrix.002 file - promoters60/1442880
ttacttaaatt

SEQ ID NO: 50281 - DNA, 8 bp, Unknown
  misc_feature (1)..( 8): Matrix.002 file - promoters60/1442887
cataatta

SEQ ID NO: 50282 - DNA, 9 bp, Unknown
  misc_feature (1)..( 9): Matrix.002 file - promoters60/1442887
tcaatcact

SEQ ID NO: 50283 - DNA, 8 bp, Unknown
  misc_feature (1)..( 8): Matrix.002 file - promoters60/1442887
tttctttg

SEQ ID NO: 50284 - DNA, 9 bp, Unknown
  misc_feature (1)..( 9): Matrix.002 file - promoters60/1442887
gctaatcac

SEQ ID NO: 50285 - DNA, 6 bp, Unknown
  misc_feature (1)..( 6): Matrix.002 file - promoters60/1442887
aatgaa

SEQ ID NO: 50286 - DNA, 8 bp, Unknown
  misc_feature (1)..( 8): Matrix.002 file - promoters60/1442887
tattagtt

SEQ ID NO: 50287 - DNA, 7 bp, Unknown
  misc_feature (1)..( 7): Matrix.002 file - promoters60/1442887
ttagatc

SEQ ID NO: 50288 - DNA, 6 bp, Unknown
  misc_feature (1)..( 6): Matrix.002 file - promoters60/1442887
gaaatc

SEQ ID NO: 50289 - DNA, 6 bp, Unknown
  misc_feature (1)..( 6): Matrix.002 file - promoters60/1442887
ttgaac

SEQ ID NO: 50290 - DNA, 6 bp, Unknown
  misc_feature (1)..( 6): Matrix.002 file - promoters60/1442887
attttg

SEQ ID NO: 50291 - DNA, 6 bp, Unknown
  misc_feature (1)..( 6): Matrix.002 file - promoters60/1442887
ttgggt

SEQ ID NO: 50292 - DNA, 6 bp, Unknown
  misc_feature (1)..( 6): Matrix.002 file - promoters60/1442887
ttatta

SEQ ID NO: 50293 - DNA, 6 bp, Unknown
  misc_feature (1)..( 6): Matrix.002 file - promoters60/1442887
tttgtt

SEQ ID NO: 50294 - DNA, 6 bp, Unknown
  misc_feature (1)..( 6): Matrix.002 file - promoters60/1442887
agtaaa

SEQ ID NO: 50295 - DNA, 7 bp, Unknown
  misc_feature (1)..( 7): Matrix.002 file - promoters60/1442887
aatcggg

SEQ ID NO: 50296 - DNA, 8 bp, Unknown
  misc_feature (1)..( 8): Matrix.002 file - promoters60/1442887
gaaacaaa

SEQ ID NO: 50297 - DNA, 10 bp, Unknown
  misc_feature (1)..( 10): Matrix.002 file - promoters60/1442887
ggaaaagaaa

SEQ ID NO: 50298 - DNA, 7 bp, Unknown
  misc_feature (1)..( 7): Matrix.002 file - promoters60/1442887
cccacta

SEQ ID NO: 50299 - DNA, 9 bp, Unknown
  misc_feature (1)..( 9): Matrix.002 file - promoters60/1442887
aaagaaaag

SEQ ID NO: 50300 - DNA, 7 bp, Unknown
  misc_feature (1)..( 7): Matrix.002 file - promoters60/1442887
gtatata

SEQ ID NO: 50301 - DNA, 6 bp, Unknown
  misc_feature (1)..( 6): Matrix.002 file - promoters60/1442945
aaagaa

SEQ ID NO: 50302 - DNA, 8 bp, Unknown
  misc_feature (1)..( 8): Matrix.002 file - promoters60/1442945
attttaat

SEQ ID NO: 50303 - DNA, 6 bp, Unknown
  misc_feature (1)..( 6): Matrix.002 file - promoters60/1442945
aaccaa

SEQ ID NO: 50304 - DNA, 6 bp, Unknown
  misc_feature (1)..( 6): Matrix.002 file - promoters60/1442945
aaaatt

SEQ ID NO: 50305 - DNA, 9 bp, Unknown
  misc_feature (1)..( 9): Matrix.002 file - promoters60/1442945
ttcaaattc

SEQ ID NO: 50306 - DNA, 8 bp, Unknown
  misc_feature (1)..( 8): Matrix.002 file - promoters60/1442945
ttagctgg

SEQ ID NO: 50307 - DNA, 9 bp, Unknown
  misc_feature (1)..( 9): Matrix.002 file - promoters60/1442945
agtacaatg

SEQ ID NO: 50308 - DNA, 6 bp, Unknown
  misc_feature (1)..( 6): Matrix.002 file - promoters60/1442945
gaacat

SEQ ID NO: 50309 - DNA, 6 bp, Unknown
  misc_feature (1)..( 6): Matrix.002 file - promoters60/1442945
ttattt

SEQ ID NO: 50310 - DNA, 6 bp, Unknown
  misc_feature (1)..( 6): Matrix.002 file - promoters60/1442945
tctttt

SEQ ID NO: 50311 - DNA, 10 bp, Unknown
  misc_feature (1)..( 10): Matrix.002 file - promoters60/1442945
ttttaattaa

SEQ ID NO: 50312 - DNA, 6 bp, Unknown
  misc_feature (1)..( 6): Matrix.002 file - promoters60/1442945
aatttc

SEQ ID NO: 50313 - DNA, 8 bp, Unknown
  misc_feature (1)..( 8): Matrix.002 file - promoters60/1442945
aaaatttc

SEQ ID NO: 50314 - DNA, 7 bp, Unknown
  misc_feature (1)..( 7): Matrix.002 file - promoters60/1442945
tttaata

SEQ ID NO: 50315 - DNA, 7 bp, Unknown
  misc_feature (1)..( 7): Matrix.002 file - promoters60/1442945
caaaaac

SEQ ID NO: 50316 - DNA, 8 bp, Unknown
  misc_feature (1)..( 8): Matrix.002 file - promoters60/1442945
aaaagcgc

SEQ ID NO: 50317 - DNA, 8 bp, Unknown
  misc_feature (1)..( 8): Matrix.002 file - promoters60/1442945
tatacata

SEQ ID NO: 50318 - DNA, 7 bp, Unknown
  misc_feature (1)..( 7): Matrix.002 file - promoters60/1442945
aaccgaa

SEQ ID NO: 50319 - DNA, 6 bp, Unknown
  misc_feature (1)..( 6): Matrix.002 file - promoters60/1442945
aatttt

SEQ ID NO: 50320 - DNA, 7 bp, Unknown
  misc_feature (1)..( 7): Matrix.002 file - promoters60/1442945
cataaac

SEQ ID NO: 50321 - DNA, 6 bp, Unknown
  misc_feature (1)..( 6): Matrix.002 file - promoters60/1442945
ctcctt

SEQ ID NO: 50322 - DNA, 9 bp, Unknown
  misc_feature (1)..( 9): Matrix.002 file - promoters60/1442945
tttcaattt

SEQ ID NO: 50323 - DNA, 7 bp, Unknown
  misc_feature (1)..( 7): Matrix.002 file - promoters60/1442945
tttctct

SEQ ID NO: 50324 - DNA, 6 bp, Unknown
  misc_feature (1)..( 6): Matrix.002 file - promoters60/1442945
taacat

SEQ ID NO: 50325 - DNA, 6 bp, Unknown
  misc_feature (1)..( 6): Matrix.002 file - promoters60/1442945
ttttta

SEQ ID NO: 50326 - DNA, 6 bp, Unknown
  misc_feature (1)..( 6): Matrix.002 file - promoters60/1442945
ataata

SEQ ID NO: 50327 - DNA, 8 bp, Unknown
  misc_feature (1)..( 8): Matrix.002 file - promoters60/1442945
catatata

SEQ ID NO: 50328 - DNA, 9 bp, Unknown
  misc_feature (1)..( 9): Matrix.002 file - promoters60/1442953
aaaaaatct

SEQ ID NO: 50329 - DNA, 9 bp, Unknown
  misc_feature (1)..( 9): Matrix.002 file - promoters60/1442953
tcaaacaaa

SEQ ID NO: 50330 - DNA, 7 bp, Unknown
  misc_feature (1)..( 7): Matrix.002 file - promoters60/1442953
tagaaca

SEQ ID NO: 50331 - DNA, 11 bp, Unknown
  misc_feature (1)..( 11): Matrix.002 file - promoters60/1442953
tttagtcaaaa

SEQ ID NO: 50332 - DNA, 9 bp, Unknown
  misc_feature (1)..( 9): Matrix.002 file - promoters60/1442953
aaaagaaat

SEQ ID NO: 50333 - DNA, 8 bp, Unknown
  misc_feature (1)..( 8): Matrix.002 file - promoters60/1442967
acaataaa

SEQ ID NO: 50334 - DNA, 6 bp, Unknown
  misc_feature (1)..( 6): Matrix.002 file - promoters60/1442967
acaaaa

SEQ ID NO: 50335 - DNA, 6 bp, Unknown
  misc_feature (1)..( 6): Matrix.002 file - promoters60/1442967
tatata

SEQ ID NO: 50336 - DNA, 7 bp, Unknown
  misc_feature (1)..( 7): Matrix.002 file - promoters60/1442967
tatataa

SEQ ID NO: 50337 - DNA, 6 bp, Unknown
  misc_feature (1)..( 6): Matrix.002 file - promoters60/1442967
aaggtc

SEQ ID NO: 50338 - DNA, 10 bp, Unknown
  misc_feature (1)..( 10): Matrix.002 file - promoters60/1442967
aagtaggact

SEQ ID NO: 50339 - DNA, 8 bp, Unknown
  misc_feature (1)..( 8): Matrix.002 file - promoters60/1442967
aaagaaac

SEQ ID NO: 50340 - DNA, 6 bp, Unknown
  misc_feature (1)..( 6): Matrix.002 file - promoters60/1442967
caagaa

SEQ ID NO: 50341 - DNA, 6 bp, Unknown
  misc_feature (1)..( 6): Matrix.002 file - promoters60/1442967
tcttct

SEQ ID NO: 50342 - DNA, 8 bp, Unknown
  misc_feature (1)..( 8): Matrix.002 file - promoters60/1442967
aacacaaa

SEQ ID NO: 50343 - DNA, 6 bp, Unknown
  misc_feature (1)..( 6): Matrix.002 file - promoters60/1442967
tctcac

SEQ ID NO: 50344 - DNA, 6 bp, Unknown
  misc_feature (1)..( 6): Matrix.002 file - promoters60/1442967
tctcta

SEQ ID NO: 50345 - DNA, 6 bp, Unknown
  misc_feature (1)..( 6): Matrix.002 file - promoters60/1442967
attatc

SEQ ID NO: 50346 - DNA, 6 bp, Unknown
  misc_feature (1)..( 6): Matrix.002 file - promoters60/1442967
agaaat

SEQ ID NO: 50347 - DNA, 6 bp, Unknown
  misc_feature (1)..( 6): Matrix.002 file - promoters60/1442967
tcaaac

SEQ ID NO: 50348 - DNA, 6 bp, Unknown
  misc_feature (1)..( 6): Matrix.002 file - promoters60/1442967
caaagt

SEQ ID NO: 50349 - DNA, 9 bp, Unknown
  misc_feature (1)..( 9): Matrix.002 file - promoters60/1442967
aaaagtctc

SEQ ID NO: 50350 - DNA, 8 bp, Unknown
  misc_feature (1)..( 8): Matrix.002 file - promoters60/1442967
cttactat

SEQ ID NO: 50351 - DNA, 12 bp, Unknown
  misc_feature (1)..( 12): Matrix.002 file - promoters60/1442975
ctttttgtatat

SEQ ID NO: 50352 - DNA, 6 bp, Unknown
  misc_feature (1)..( 6): Matrix.002 file - promoters60/1442975
attgaa

SEQ ID NO: 50353 - DNA, 6 bp, Unknown
  misc_feature (1)..( 6): Matrix.002 file - promoters60/1442975
tgaaca

SEQ ID NO: 50354 - DNA, 7 bp, Unknown
  misc_feature (1)..( 7): Matrix.002 file - promoters60/1442975
tctacga

SEQ ID NO: 50355 - DNA, 7 bp, Unknown
  misc_feature (1)..( 7): Matrix.002 file - promoters60/1442975
aggattt

SEQ ID NO: 50356 - DNA, 10 bp, Unknown
  misc_feature (1)..( 10): Matrix.002 file - promoters60/1442975
gcaggagatg

SEQ ID NO: 50357 - DNA, 8 bp, Unknown
  misc_feature (1)..( 8): Matrix.002 file - promoters60/1442975
tctgaatt

SEQ ID NO: 50358 - DNA, 6 bp, Unknown
  misc_feature (1)..( 6): Matrix.002 file - promoters60/1442975
aatcta

SEQ ID NO: 50359 - DNA, 6 bp, Unknown
  misc_feature (1)..( 6): Matrix.002 file - promoters60/1442975
catcaa

SEQ ID NO: 50360 - DNA, 8 bp, Unknown
  misc_feature (1)..( 8): Matrix.002 file - promoters60/1442975
gattcgtg

SEQ ID NO: 50361 - DNA, 7 bp, Unknown
  misc_feature (1)..( 7): Matrix.002 file - promoters60/1442975
cacggtc

SEQ ID NO: 50362 - DNA, 6 bp, Unknown
  misc_feature (1)..( 6): Matrix.002 file - promoters60/1442975
ggttta

SEQ ID NO: 50363 - DNA, 6 bp, Unknown
  misc_feature (1)..( 6): Matrix.002 file - promoters60/1442975
ttgact

SEQ ID NO: 50364 - DNA, 6 bp, Unknown
  misc_feature (1)..( 6): Matrix.002 file - promoters60/1442975
ggctgt

SEQ ID NO: 50365 - DNA, 9 bp, Unknown
  misc_feature (1)..( 9): Matrix.002 file - promoters60/1442993
acctctttt

SEQ ID NO: 50366 - DNA, 8 bp, Unknown
  misc_feature (1)..( 8): Matrix.002 file - promoters60/1442993
aaatctac

SEQ ID NO: 50367 - DNA, 12 bp, Unknown
  misc_feature (1)..( 12): Matrix.002 file - promoters60/1442993
aaataattgtat

SEQ ID NO: 50368 - DNA, 10 bp, Unknown
  misc_feature (1)..( 10): Matrix.002 file - promoters60/1442993
gaaatagatt

SEQ ID NO: 50369 - DNA, 11 bp, Unknown
  misc_feature (1)..( 11): Matrix.002 file - promoters60/1442993
ttacttaaatt

SEQ ID NO: 50370 - DNA, 7 bp, Unknown
  misc_feature (1)..( 7): Matrix.002 file - promoters60/1442993
taattca

SEQ ID NO: 50371 - DNA, 7 bp, Unknown
  misc_feature (1)..( 7): Matrix.002 file - promoters60/1443011
ataagca

SEQ ID NO: 50372 - DNA, 7 bp, Unknown
  misc_feature (1)..( 7): Matrix.002 file - promoters60/1443011
aataata

SEQ ID NO: 50373 - DNA, 6 bp, Unknown
  misc_feature (1)..( 6): Matrix.002 file - promoters60/1443011
aatcaa

SEQ ID NO: 50374 - DNA, 8 bp, Unknown
  misc_feature (1)..( 8): Matrix.002 file - promoters60/1443011
aaaccgtc

SEQ ID NO: 50375 - DNA, 7 bp, Unknown
  misc_feature (1)..( 7): Matrix.002 file - promoters60/1443011
aataatt

SEQ ID NO: 50376 - DNA, 6 bp, Unknown
  misc_feature (1)..( 6): Matrix.002 file - promoters60/1443011
taatat

SEQ ID NO: 50377 - DNA, 6 bp, Unknown
  misc_feature (1)..( 6): Matrix.002 file - promoters60/1443011
tgattg

SEQ ID NO: 50378 - DNA, 7 bp, Unknown
  misc_feature (1)..( 7): Matrix.002 file - promoters60/1443011
tttcaag

SEQ ID NO: 50379 - DNA, 11 bp, Unknown
  misc_feature (1)..( 11): Matrix.002 file - promoters60/1443011
agacagaaaga

SEQ ID NO: 50380 - DNA, 9 bp, Unknown
  misc_feature (1)..( 9): Matrix.002 file - promoters60/1443011
ataaacgaa

SEQ ID NO: 50381 - DNA, 8 bp, Unknown
  misc_feature (1)..( 8): Matrix.002 file - promoters60/1443011
ctaatcac

SEQ ID NO: 50382 - DNA, 7 bp, Unknown
  misc_feature (1)..( 7): Matrix.002 file - promoters60/1443011
taaaggg

SEQ ID NO: 50383 - DNA, 6 bp, Unknown
  misc_feature (1)..( 6): Matrix.002 file - promoters60/1443011
tctctc

SEQ ID NO: 50384 - DNA, 6 bp, Unknown
  misc_feature (1)..( 6): Matrix.002 file - promoters60/1443011
gtaatc

SEQ ID NO: 50385 - DNA, 6 bp, Unknown
  misc_feature (1)..( 6): Matrix.002 file - promoters60/1443011
tatttt

SEQ ID NO: 50386 - DNA, 6 bp, Unknown
  misc_feature (1)..( 6): Matrix.002 file - promoters60/1443011
aaataa

SEQ ID NO: 50387 - DNA, 6 bp, Unknown
  misc_feature (1)..( 6): Matrix.002 file - promoters60/1443011
acaaaa

SEQ ID NO: 50388 - DNA, 6 bp, Unknown
  misc_feature (1)..( 6): Matrix.002 file - promoters60/1443011
gaaaaa

SEQ ID NO: 50389 - DNA, 12 bp, Unknown
  misc_feature (1)..( 12): Matrix.002 file - promoters60/1443021
tcaaaatttatc

SEQ ID NO: 50390 - DNA, 7 bp, Unknown
  misc_feature (1)..( 7): Matrix.002 file - promoters60/1443021
caacaaa

SEQ ID NO: 50391 - DNA, 8 bp, Unknown
  misc_feature (1)..( 8): Matrix.002 file - promoters60/1443021
atccaata

SEQ ID NO: 50392 - DNA, 6 bp, Unknown
  misc_feature (1)..( 6): Matrix.002 file - promoters60/1443021
tgttca

SEQ ID NO: 50393 - DNA, 8 bp, Unknown
  misc_feature (1)..( 8): Matrix.002 file - promoters60/1443021
gtcatttt

SEQ ID NO: 50394 - DNA, 8 bp, Unknown
  misc_feature (1)..( 8): Matrix.002 file - promoters60/1443021
tctggact

SEQ ID NO: 50395 - DNA, 6 bp, Unknown
  misc_feature (1)..( 6): Matrix.002 file - promoters60/1443021
tatagt

SEQ ID NO: 50396 - DNA, 7 bp, Unknown
  misc_feature (1)..( 7): Matrix.002 file - promoters60/1443021
aatatta

SEQ ID NO: 50397 - DNA, 6 bp, Unknown
  misc_feature (1)..( 6): Matrix.002 file - promoters60/1443021
tactgt

SEQ ID NO: 50398 - DNA, 6 bp, Unknown
  misc_feature (1)..( 6): Matrix.002 file - promoters60/1443021
ttgaaa

SEQ ID NO: 50399 - DNA, 7 bp, Unknown
  misc_feature (1)..( 7): Matrix.002 file - promoters60/1443021
cttctcc

SEQ ID NO: 50400 - DNA, 7 bp, Unknown
  misc_feature (1)..( 7): Matrix.002 file - promoters60/1443021
ttcatgt

SEQ ID NO: 50401 - DNA, 7 bp, Unknown
  misc_feature (1)..( 7): Matrix.002 file - promoters60/1443021
aagattt

SEQ ID NO: 50402 - DNA, 10 bp, Unknown
  misc_feature (1)..( 10): Matrix.002 file - promoters60/1443021
atattttttt

SEQ ID NO: 50403 - DNA, 7 bp, Unknown
  misc_feature (1)..( 7): Matrix.002 file - promoters60/1443021
tacctca

SEQ ID NO: 50404 - DNA, 7 bp, Unknown
  misc_feature (1)..( 7): Matrix.002 file - promoters60/1443021
tttgata

SEQ ID NO: 50405 - DNA, 9 bp, Unknown
  misc_feature (1)..( 9): Matrix.002 file - promoters60/1443021
catcattat

SEQ ID NO: 50406 - DNA, 11 bp, Unknown
  misc_feature (1)..( 11): Matrix.002 file - promoters60/1443029
agaattgacat

SEQ ID NO: 50407 - DNA, 6 bp, Unknown
  misc_feature (1)..( 6): Matrix.002 file - promoters60/1443075
aacgaa

SEQ ID NO: 50408 - DNA, 13 bp, Unknown
  misc_feature (1)..( 13): Matrix.002 file - promoters60/1443075
aaatcattttcaa

SEQ ID NO: 50409 - DNA, 8 bp, Unknown
  misc_feature (1)..( 8): Matrix.002 file - promoters60/1443075
gtgacaaa

SEQ ID NO: 50410 - DNA, 8 bp, Unknown
  misc_feature (1)..( 8): Matrix.002 file - promoters60/1443075
ataagaaa

SEQ ID NO: 50411 - DNA, 7 bp, Unknown
  misc_feature (1)..( 7): Matrix.002 file - promoters60/1443075
tgtgtga

SEQ ID NO: 50412 - DNA, 11 bp, Unknown
  misc_feature (1)..( 11): Matrix.002 file - promoters60/1443075
aaaaatgtcta

SEQ ID NO: 50413 - DNA, 6 bp, Unknown
  misc_feature (1)..( 6): Matrix.002 file - promoters60/1443075
ttaaaa

SEQ ID NO: 50414 - DNA, 8 bp, Unknown
  misc_feature (1)..( 8): Matrix.002 file - promoters60/1443075
aactgaca

SEQ ID NO: 50415 - DNA, 9 bp, Unknown
  misc_feature (1)..( 9): Matrix.002 file - promoters60/1443075
ctaaaatat

SEQ ID NO: 50416 - DNA, 10 bp, Unknown
  misc_feature (1)..( 10): Matrix.002 file - promoters60/1443075
aaaaagaaaa

SEQ ID NO: 50417 - DNA, 6 bp, Unknown
  misc_feature (1)..( 6): Matrix.002 file - promoters60/1443075
aagaaa

SEQ ID NO: 50418 - DNA, 6 bp, Unknown
  misc_feature (1)..( 6): Matrix.002 file - promoters60/1443075
aaaaaa

SEQ ID NO: 50419 - DNA, 6 bp, Unknown
  misc_feature (1)..( 6): Matrix.002 file - promoters60/1443075
taaaaa

SEQ ID NO: 50420 - DNA, 6 bp, Unknown
  misc_feature (1)..( 6): Matrix.002 file - promoters60/1443075
taaata

SEQ ID NO: 50421 - DNA, 11 bp, Unknown
  misc_feature (1)..( 11): Matrix.002 file - promoters60/1443075
taaaaaaaatt

SEQ ID NO: 50422 - DNA, 7 bp, Unknown
  misc_feature (1)..( 7): Matrix.002 file - promoters60/1443075
ttcgttc

SEQ ID NO: 50423 - DNA, 8 bp, Unknown
  misc_feature (1)..( 8): Matrix.002 file - promoters60/1443075
cattaatt

SEQ ID NO: 50424 - DNA, 6 bp, Unknown
  misc_feature (1)..( 6): Matrix.002 file - promoters60/1443075
agaaaa

SEQ ID NO: 50425 - DNA, 6 bp, Unknown
  misc_feature (1)..( 6): Matrix.002 file - promoters60/1443075
aaaaac

SEQ ID NO: 50426 - DNA, 11 bp, Unknown
  misc_feature (1)..( 11): Matrix.002 file - promoters60/1443083
atgttaaacat

SEQ ID NO: 50427 - DNA, 13 bp, Unknown
  misc_feature (1)..( 13): Matrix.002 file - promoters60/1443083
cagtaaatcatta

SEQ ID NO: 50428 - DNA, 10 bp, Unknown
  misc_feature (1)..( 10): Matrix.002 file - promoters60/1443114
attgtctttt

SEQ ID NO: 50429 - DNA, 7 bp, Unknown
  misc_feature (1)..( 7): Matrix.002 file - promoters60/1443114
gaaaaaa

SEQ ID NO: 50430 - DNA, 9 bp, Unknown
  misc_feature (1)..( 9): Matrix.002 file - promoters60/1443114
tctaagaat

SEQ ID NO: 50431 - DNA, 12 bp, Unknown
  misc_feature (1)..( 12): Matrix.002 file - promoters60/1443114
aaaactaagaat

SEQ ID NO: 50432 - DNA, 11 bp, Unknown
  misc_feature (1)..( 11): Matrix.002 file - promoters60/1443114
gcatttaaatt

SEQ ID NO: 50433 - DNA, 9 bp, Unknown
  misc_feature (1)..( 9): Matrix.002 file - promoters60/1443114
catttatca

SEQ ID NO: 50434 - DNA, 12 bp, Unknown
  misc_feature (1)..( 12): Matrix.002 file - promoters60/1443114
agaaaaaagtaa

SEQ ID NO: 50435 - DNA, 12 bp, Unknown
  misc_feature (1)..( 12): Matrix.002 file - promoters60/1443114
aaaaataaatat

SEQ ID NO: 50436 - DNA, 11 bp, Unknown
  misc_feature (1)..( 11): Matrix.002 file - promoters60/1443184
ataatttgagt

SEQ ID NO: 50437 - DNA, 8 bp, Unknown
  misc_feature (1)..( 8): Matrix.002 file - promoters60/1443184
aggaggaa

SEQ ID NO: 50438 - DNA, 8 bp, Unknown
  misc_feature (1)..( 8): Matrix.002 file - promoters60/1443184
gttacaac

SEQ ID NO: 50439 - DNA, 10 bp, Unknown
  misc_feature (1)..( 10): Matrix.002 file - promoters60/1443184
aatttataaa

SEQ ID NO: 50440 - DNA, 10 bp, Unknown
  misc_feature (1)..( 10): Matrix.002 file - promoters60/1443184
agaaaaaaga

SEQ ID NO: 50441 - DNA, 9 bp, Unknown
  misc_feature (1)..( 9): Matrix.002 file - promoters60/1443184
acttataaa

SEQ ID NO: 50442 - DNA, 18 bp, Unknown
  misc_feature (1)..( 18): Matrix.002 file - promoters60/1443192
aaaaattattaaataaaa

SEQ ID NO: 50443 - DNA, 9 bp, Unknown
  misc_feature (1)..( 9): Matrix.002 file - promoters60/1443192
atactaata

SEQ ID NO: 50444 - DNA, 13 bp, Unknown
  misc_feature (1)..( 13): Matrix.002 file - promoters60/1443192
ataatttttagtt

SEQ ID NO: 50445 - DNA, 7 bp, Unknown
  misc_feature (1)..( 7): Matrix.002 file - promoters60/1443192
attttac

SEQ ID NO: 50446 - DNA, 10 bp, Unknown
  misc_feature (1)..( 10): Matrix.002 file - promoters60/1443192
ctatataaat

SEQ ID NO: 50447 - DNA, 7 bp, Unknown
  misc_feature (1)..( 7): Matrix.002 file - promoters60/1443192
aatttta

SEQ ID NO: 50448 - DNA, 8 bp, Unknown
  misc_feature (1)..( 8): Matrix.002 file - promoters60/1443192
taattgaa

SEQ ID NO: 50449 - DNA, 7 bp, Unknown
  misc_feature (1)..( 7): Matrix.002 file - promoters60/1443192
gaaaaat

SEQ ID NO: 50450 - DNA, 9 bp, Unknown
  misc_feature (1)..( 9): Matrix.002 file - promoters60/1443256
aattattga

SEQ ID NO: 50451 - DNA, 10 bp, Unknown
  misc_feature (1)..( 10): Matrix.002 file - promoters60/1443271
aaaatatata

SEQ ID NO: 50452 - DNA, 9 bp, Unknown
  misc_feature (1)..( 9): Matrix.002 file - promoters60/1443271
ccataaaaa

SEQ ID NO: 50453 - DNA, 7 bp, Unknown
  misc_feature (1)..( 7): Matrix.002 file - promoters60/1443271
aaaatat

SEQ ID NO: 50454 - DNA, 8 bp, Unknown
  misc_feature (1)..( 8): Matrix.002 file - promoters60/1443271
atttcttt

SEQ ID NO: 50455 - DNA, 8 bp, Unknown
  misc_feature (1)..( 8): Matrix.002 file - promoters60/1443271
tgtttttc

SEQ ID NO: 50456 - DNA, 7 bp, Unknown
  misc_feature (1)..( 7): Matrix.002 file - promoters60/1443271
tttaaag

SEQ ID NO: 50457 - DNA, 6 bp, Unknown
  misc_feature (1)..( 6): Matrix.002 file - promoters60/1443271
aaacca

SEQ ID NO: 50458 - DNA, 7 bp, Unknown
  misc_feature (1)..( 7): Matrix.002 file - promoters60/1443271
tttattg

SEQ ID NO: 50459 - DNA, 9 bp, Unknown
  misc_feature (1)..( 9): Matrix.002 file - promoters60/1443271
tgtataagc

SEQ ID NO: 50460 - DNA, 8 bp, Unknown
  misc_feature (1)..( 8): Matrix.002 file - promoters60/1443271
aaaaatta

SEQ ID NO: 50461 - DNA, 6 bp, Unknown
  misc_feature (1)..( 6): Matrix.002 file - promoters60/1443271
gttaaa

SEQ ID NO: 50462 - DNA, 6 bp, Unknown
  misc_feature (1)..( 6): Matrix.002 file - promoters60/1443271
tgaaat

SEQ ID NO: 50463 - DNA, 8 bp, Unknown
  misc_feature (1)..( 8): Matrix.002 file - promoters60/1443271
ttttattt

SEQ ID NO: 50464 - DNA, 6 bp, Unknown
  misc_feature (1)..( 6): Matrix.002 file - promoters60/1443271
tttaaa

SEQ ID NO: 50465 - DNA, 7 bp, Unknown
  misc_feature (1)..( 7): Matrix.002 file - promoters60/1443271
tctcaat

SEQ ID NO: 50466 - DNA, 9 bp, Unknown
  misc_feature (1)..( 9): Matrix.002 file - promoters60/1443271
gtttaattt

SEQ ID NO: 50467 - DNA, 6 bp, Unknown
  misc_feature (1)..( 6): Matrix.002 file - promoters60/1443271
ttaatt

SEQ ID NO: 50468 - DNA, 6 bp, Unknown
  misc_feature (1)..( 6): Matrix.002 file - promoters60/1443271
atcact

SEQ ID NO: 50469 - DNA, 9 bp, Unknown
  misc_feature (1)..( 9): Matrix.002 file - promoters60/1443271
caaatatat

SEQ ID NO: 50470 - DNA, 7 bp, Unknown
  misc_feature (1)..( 7): Matrix.002 file - promoters60/1443271
tgtagat

SEQ ID NO: 50471 - DNA, 8 bp, Unknown
  misc_feature (1)..( 8): Matrix.002 file - promoters60/1443271
aatcttat

SEQ ID NO: 50472 - DNA, 6 bp, Unknown
  misc_feature (1)..( 6): Matrix.002 file - promoters60/1443271
ctatta

SEQ ID NO: 50473 - DNA, 9 bp, Unknown
  misc_feature (1)..( 9): Matrix.002 file - promoters60/1443271
ccatatata

SEQ ID NO: 50474 - DNA, 9 bp, Unknown
  misc_feature (1)..( 9): Matrix.002 file - promoters60/1443276
aatttaata

SEQ ID NO: 50475 - DNA, 7 bp, Unknown
  misc_feature (1)..( 7): Matrix.002 file - promoters60/1443276
atgaacg

SEQ ID NO: 50476 - DNA, 6 bp, Unknown
  misc_feature (1)..( 6): Matrix.002 file - promoters60/1443276
caacga

SEQ ID NO: 50477 - DNA, 6 bp, Unknown
  misc_feature (1)..( 6): Matrix.002 file - promoters60/1443276
ttgata

SEQ ID NO: 50478 - DNA, 8 bp, Unknown
  misc_feature (1)..( 8): Matrix.002 file - promoters60/1443276
aaaaggaa

SEQ ID NO: 50479 - DNA, 7 bp, Unknown
  misc_feature (1)..( 7): Matrix.002 file - promoters60/1443276
tttgtgt

SEQ ID NO: 50480 - DNA, 10 bp, Unknown
  misc_feature (1)..( 10): Matrix.002 file - promoters60/1443276
aaatattatt

SEQ ID NO: 50481 - DNA, 7 bp, Unknown
  misc_feature (1)..( 7): Matrix.002 file - promoters60/1443276
cgaattg

SEQ ID NO: 50482 - DNA, 7 bp, Unknown
  misc_feature (1)..( 7): Matrix.002 file - promoters60/1443276
ataaaac

SEQ ID NO: 50483 - DNA, 6 bp, Unknown
  misc_feature (1)..( 6): Matrix.002 file - promoters60/1443276
accaaa

SEQ ID NO: 50484 - DNA, 9 bp, Unknown
  misc_feature (1)..( 9): Matrix.002 file - promoters60/1443276
gactaaaag

SEQ ID NO: 50485 - DNA, 6 bp, Unknown
  misc_feature (1)..( 6): Matrix.002 file - promoters60/1443276
aagtct

SEQ ID NO: 50486 - DNA, 8 bp, Unknown
  misc_feature (1)..( 8): Matrix.002 file - promoters60/1443276
tcaataaa

SEQ ID NO: 50487 - DNA, 6 bp, Unknown
  misc_feature (1)..( 6): Matrix.002 file - promoters60/1443276
aaaaaa

SEQ ID NO: 50488 - DNA, 6 bp, Unknown
  misc_feature (1)..( 6): Matrix.002 file - promoters60/1443276
aaaaat

SEQ ID NO: 50489 - DNA, 6 bp, Unknown
  misc_feature (1)..( 6): Matrix.002 file - promoters60/1443276
gaagac

SEQ ID NO: 50490 - DNA, 6 bp, Unknown
  misc_feature (1)..( 6): Matrix.002 file - promoters60/1443276
aaataa

SEQ ID NO: 50491 - DNA, 9 bp, Unknown
  misc_feature (1)..( 9): Matrix.002 file - promoters60/1443276
agcatttaa

SEQ ID NO: 50492 - DNA, 8 bp, Unknown
  misc_feature (1)..( 8): Matrix.002 file - promoters60/1443276
tataaaaa

SEQ ID NO: 50493 - DNA, 8 bp, Unknown
  misc_feature (1)..( 8): Matrix.002 file - promoters60/1443306
tttgtaat

SEQ ID NO: 50494 - DNA, 12 bp, Unknown
  misc_feature (1)..( 12): Matrix.002 file - promoters60/1443306
taaaatattttt

SEQ ID NO: 50495 - DNA, 7 bp, Unknown
  misc_feature (1)..( 7): Matrix.002 file - promoters60/1443306
tttattt

SEQ ID NO: 50496 - DNA, 7 bp, Unknown
  misc_feature (1)..( 7): Matrix.002 file - promoters60/1443306
cataaac

SEQ ID NO: 50497 - DNA, 11 bp, Unknown
  misc_feature (1)..( 11): Matrix.002 file - promoters60/1443306
tatatataaat

SEQ ID NO: 50498 - DNA, 10 bp, Unknown
  misc_feature (1)..( 10): Matrix.002 file - promoters60/1443306
ttaattttac

SEQ ID NO: 50499 - DNA, 9 bp, Unknown
  misc_feature (1)..( 9): Matrix.002 file - promoters60/1443338
tcttataat

SEQ ID NO: 50500 - DNA, 7 bp, Unknown
  misc_feature (1)..( 7): Matrix.002 file - promoters60/1443338
acaccaa

SEQ ID NO: 50501 - DNA, 8 bp, Unknown
  misc_feature (1)..( 8): Matrix.002 file - promoters60/1443338
tcttataa

SEQ ID NO: 50502 - DNA, 8 bp, Unknown
  misc_feature (1)..( 8): Matrix.002 file - promoters60/1443338
aaaacaca

SEQ ID NO: 50503 - DNA, 8 bp, Unknown
  misc_feature (1)..( 8): Matrix.002 file - promoters60/1443338
caaacttt

SEQ ID NO: 50504 - DNA, 6 bp, Unknown
  misc_feature (1)..( 6): Matrix.002 file - promoters60/1443338
aatatt

SEQ ID NO: 50505 - DNA, 6 bp, Unknown
  misc_feature (1)..( 6): Matrix.002 file - promoters60/1443338
atcaaa

SEQ ID NO: 50506 - DNA, 7 bp, Unknown
  misc_feature (1)..( 7): Matrix.002 file - promoters60/1443338
caaatcc

SEQ ID NO: 50507 - DNA, 7 bp, Unknown
  misc_feature (1)..( 7): Matrix.002 file - promoters60/1443338
cacaaga

SEQ ID NO: 50508 - DNA, 8 bp, Unknown
  misc_feature (1)..( 8): Matrix.002 file - promoters60/1443338
ctcgcttc

SEQ ID NO: 50509 - DNA, 8 bp, Unknown
  misc_feature (1)..( 8): Matrix.002 file - promoters60/1443338
cttctcga

SEQ ID NO: 50510 - DNA, 14 bp, Unknown
  misc_feature (1)..( 14): Matrix.002 file - promoters60/1443349
taaatttgttaaaa

SEQ ID NO: 50511 - DNA, 11 bp, Unknown
  misc_feature (1)..( 11): Matrix.002 file - promoters60/1443349
ttttgatgaat

SEQ ID NO: 50512 - DNA, 18 bp, Unknown
  misc_feature (1)..( 18): Matrix.002 file - promoters60/1443349
atttcataaaaaatagat

SEQ ID NO: 50513 - DNA, 10 bp, Unknown
  misc_feature (1)..( 10): Matrix.002 file - promoters60/1443349
gataagaaaa

SEQ ID NO: 50514 - DNA, 13 bp, Unknown
  misc_feature (1)..( 13): Matrix.002 file - promoters60/1443349
ctagtatatataa

SEQ ID NO: 50515 - DNA, 15 bp, Unknown
  misc_feature (1)..( 15): Matrix.002 file - promoters60/1443349
atataaatttgaaaa

SEQ ID NO: 50516 - DNA, 9 bp, Unknown
  misc_feature (1)..( 9): Matrix.002 file - promoters60/1443349
aattaatac

SEQ ID NO: 50517 - DNA, 12 bp, Unknown
  misc_feature (1)..( 12): Matrix.002 file - promoters60/1443349
tataaaaaccaa

SEQ ID NO: 50518 - DNA, 10 bp, Unknown
  misc_feature (1)..( 10): Matrix.002 file - promoters60/1443349
aattagttta

SEQ ID NO: 50519 - DNA, 8 bp, Unknown
  misc_feature (1)..( 8): Matrix.002 file - promoters60/1443356
actaattt

SEQ ID NO: 50520 - DNA, 6 bp, Unknown
  misc_feature (1)..( 6): Matrix.002 file - promoters60/1443356
attact

SEQ ID NO: 50521 - DNA, 6 bp, Unknown
  misc_feature (1)..( 6): Matrix.002 file - promoters60/1443356
taataa

SEQ ID NO: 50522 - DNA, 6 bp, Unknown
  misc_feature (1)..( 6): Matrix.002 file - promoters60/1443356
atattt

SEQ ID NO: 50523 - DNA, 8 bp, Unknown
  misc_feature (1)..( 8): Matrix.002 file - promoters60/1443356
ttaaaaga

SEQ ID NO: 50524 - DNA, 6 bp, Unknown
  misc_feature (1)..( 6): Matrix.002 file - promoters60/1443356
tacaat

SEQ ID NO: 50525 - DNA, 7 bp, Unknown
  misc_feature (1)..( 7): Matrix.002 file - promoters60/1443356
tttattt

SEQ ID NO: 50526 - DNA, 7 bp, Unknown
  misc_feature (1)..( 7): Matrix.002 file - promoters60/1443356
aatatat

SEQ ID NO: 50527 - DNA, 7 bp, Unknown
  misc_feature (1)..( 7): Matrix.002 file - promoters60/1443356
tatacct

SEQ ID NO: 50528 - DNA, 7 bp, Unknown
  misc_feature (1)..( 7): Matrix.002 file - promoters60/1443356
caggtat

SEQ ID NO: 50529 - DNA, 7 bp, Unknown
  misc_feature (1)..( 7): Matrix.002 file - promoters60/1443356
tgacaat

SEQ ID NO: 50530 - DNA, 7 bp, Unknown
  misc_feature (1)..( 7): Matrix.002 file - promoters60/1443356
atcggcc

SEQ ID NO: 50531 - DNA, 6 bp, Unknown
  misc_feature (1)..( 6): Matrix.002 file - promoters60/1443356
aggttt

SEQ ID NO: 50532 - DNA, 6 bp, Unknown
  misc_feature (1)..( 6): Matrix.002 file - promoters60/1443356
ggtaat

SEQ ID NO: 50533 - DNA, 7 bp, Unknown
  misc_feature (1)..( 7): Matrix.002 file - promoters60/1443356
aatctat

SEQ ID NO: 50534 - DNA, 7 bp, Unknown
  misc_feature (1)..( 7): Matrix.002 file - promoters60/1443356
atgcgga

SEQ ID NO: 50535 - DNA, 7 bp, Unknown
  misc_feature (1)..( 7): Matrix.002 file - promoters60/1443356
cttggct

SEQ ID NO: 50536 - DNA, 6 bp, Unknown
  misc_feature (1)..( 6): Matrix.002 file - promoters60/1443356
atttaa

SEQ ID NO: 50537 - DNA, 8 bp, Unknown
  misc_feature (1)..( 8): Matrix.002 file - promoters60/1443356
attcttac

SEQ ID NO: 50538 - DNA, 6 bp, Unknown
  misc_feature (1)..( 6): Matrix.002 file - promoters60/1443356
aaatgt

SEQ ID NO: 50539 - DNA, 7 bp, Unknown
  misc_feature (1)..( 7): Matrix.002 file - promoters60/1443356
atttttg

SEQ ID NO: 50540 - DNA, 6 bp, Unknown
  misc_feature (1)..( 6): Matrix.002 file - promoters60/1443356
gtcaat

SEQ ID NO: 50541 - DNA, 6 bp, Unknown
  misc_feature (1)..( 6): Matrix.002 file - promoters60/1443356
aattca

SEQ ID NO: 50542 - DNA, 7 bp, Unknown
  misc_feature (1)..( 7): Matrix.002 file - promoters60/1443356
aatctct

SEQ ID NO: 50543 - DNA, 6 bp, Unknown
  misc_feature (1)..( 6): Matrix.002 file - promoters60/1443356
tttgtt

SEQ ID NO: 50544 - DNA, 6 bp, Unknown
  misc_feature (1)..( 6): Matrix.002 file - promoters60/1443387
ggtaga

SEQ ID NO: 50545 - DNA, 7 bp, Unknown
  misc_feature (1)..( 7): Matrix.002 file - promoters60/1443387
aagaaaa

SEQ ID NO: 50546 - DNA, 6 bp, Unknown
  misc_feature (1)..( 6): Matrix.002 file - promoters60/1443387
ccatat

SEQ ID NO: 50547 - DNA, 6 bp, Unknown
  misc_feature (1)..( 6): Matrix.002 file - promoters60/1443387
tataaa

SEQ ID NO: 50548 - DNA, 6 bp, Unknown
  misc_feature (1)..( 6): Matrix.002 file - promoters60/1443387
gttttg

SEQ ID NO: 50549 - DNA, 8 bp, Unknown
  misc_feature (1)..( 8): Matrix.002 file - promoters60/1443387
ctttaaaa

SEQ ID NO: 50550 - DNA, 7 bp, Unknown
  misc_feature (1)..( 7): Matrix.002 file - promoters60/1443387
tcagaaa

SEQ ID NO: 50551 - DNA, 8 bp, Unknown
  misc_feature (1)..( 8): Matrix.002 file - promoters60/1443387
aaaagggc

SEQ ID NO: 50552 - DNA, 8 bp, Unknown
  misc_feature (1)..( 8): Matrix.002 file - promoters60/1443387
aaaaaaac

SEQ ID NO: 50553 - DNA, 11 bp, Unknown
  misc_feature (1)..( 11): Matrix.002 file - promoters60/1443387
atcaaatgcaa

SEQ ID NO: 50554 - DNA, 7 bp, Unknown
  misc_feature (1)..( 7): Matrix.002 file - promoters60/1443387
aaaattg

SEQ ID NO: 50555 - DNA, 11 bp, Unknown
  misc_feature (1)..( 11): Matrix.002 file - promoters60/1443418
gtgtaaaaatt

SEQ ID NO: 50556 - DNA, 10 bp, Unknown
  misc_feature (1)..( 10): Matrix.002 file - promoters60/1443418
taaaaaaata

SEQ ID NO: 50557 - DNA, 9 bp, Unknown
  misc_feature (1)..( 9): Matrix.002 file - promoters60/1443418
ttattattt

SEQ ID NO: 50558 - DNA, 18 bp, Unknown
  misc_feature (1)..( 18): Matrix.002 file - promoters60/1443418
gtaaattattcatacaat

SEQ ID NO: 50559 - DNA, 14 bp, Unknown
  misc_feature (1)..( 14): Matrix.002 file - promoters60/1443418
taattttaaactaa

SEQ ID NO: 50560 - DNA, 11 bp, Unknown
  misc_feature (1)..( 11): Matrix.002 file - promoters60/1443418
aatgatattca

SEQ ID NO: 50561 - DNA, 10 bp, Unknown
  misc_feature (1)..( 10): Matrix.002 file - promoters60/1443418
tttcaaataa

SEQ ID NO: 50562 - DNA, 12 bp, Unknown
  misc_feature (1)..( 12): Matrix.002 file - promoters60/1443433
ctattatatata

SEQ ID NO: 50563 - DNA, 11 bp, Unknown
  misc_feature (1)..( 11): Matrix.002 file - promoters60/1443433
tactaacatta

SEQ ID NO: 50564 - DNA, 6 bp, Unknown
  misc_feature (1)..( 6): Matrix.002 file - promoters60/1443475
ttgaat

SEQ ID NO: 50565 - DNA, 8 bp, Unknown
  misc_feature (1)..( 8): Matrix.002 file - promoters60/1443475
caagtttt

SEQ ID NO: 50566 - DNA, 6 bp, Unknown
  misc_feature (1)..( 6): Matrix.002 file - promoters60/1443475
tatgta

SEQ ID NO: 50567 - DNA, 7 bp, Unknown
  misc_feature (1)..( 7): Matrix.002 file - promoters60/1443475
ttttctc

SEQ ID NO: 50568 - DNA, 8 bp, Unknown
  misc_feature (1)..( 8): Matrix.002 file - promoters60/1443475
ttatcaat

SEQ ID NO: 50569 - DNA, 6 bp, Unknown
  misc_feature (1)..( 6): Matrix.002 file - promoters60/1443475
gttaaa

SEQ ID NO: 50570 - DNA, 7 bp, Unknown
  misc_feature (1)..( 7): Matrix.002 file - promoters60/1443475
attagtt

SEQ ID NO: 50571 - DNA, 6 bp, Unknown
  misc_feature (1)..( 6): Matrix.002 file - promoters60/1443475
atcaga

SEQ ID NO: 50572 - DNA, 7 bp, Unknown
  misc_feature (1)..( 7): Matrix.002 file - promoters60/1443475
ttttttc

SEQ ID NO: 50573 - DNA, 6 bp, Unknown
  misc_feature (1)..( 6): Matrix.002 file - promoters60/1443475
taaatc

SEQ ID NO: 50574 - DNA, 6 bp, Unknown
  misc_feature (1)..( 6): Matrix.002 file - promoters60/1443475
actatt

SEQ ID NO: 50575 - DNA, 6 bp, Unknown
  misc_feature (1)..( 6): Matrix.002 file - promoters60/1443475
cgaaac

SEQ ID NO: 50576 - DNA, 6 bp, Unknown
  misc_feature (1)..( 6): Matrix.002 file - promoters60/1443475
gaaaga

SEQ ID NO: 50577 - DNA, 6 bp, Unknown
  misc_feature (1)..( 6): Matrix.002 file - promoters60/1443475
aagaaa

SEQ ID NO: 50578 - DNA, 8 bp, Unknown
  misc_feature (1)..( 8): Matrix.002 file - promoters60/1443475
aaaggtct

SEQ ID NO: 50579 - DNA, 6 bp, Unknown
  misc_feature (1)..( 6): Matrix.002 file - promoters60/1443475
aaaata

SEQ ID NO: 50580 - DNA, 7 bp, Unknown
  misc_feature (1)..( 7): Matrix.002 file - promoters60/1443475
gtgaaga

SEQ ID NO: 50581 - DNA, 10 bp, Unknown
  misc_feature (1)..( 10): Matrix.002 file - promoters60/1443512
gccttcactt

SEQ ID NO: 50582 - DNA, 11 bp, Unknown
  misc_feature (1)..( 11): Matrix.002 file - promoters60/1443512
ggatccataac

SEQ ID NO: 50583 - DNA, 8 bp, Unknown
  misc_feature (1)..( 8): Matrix.002 file - promoters60/1443633
ggttcttt

SEQ ID NO: 50584 - DNA, 10 bp, Unknown
  misc_feature (1)..( 10): Matrix.002 file - promoters60/1443633
aaaaagaaca

SEQ ID NO: 50585 - DNA, 12 bp, Unknown
  misc_feature (1)..( 12): Matrix.002 file - promoters60/1443640
attgagattggg

SEQ ID NO: 50586 - DNA, 13 bp, Unknown
  misc_feature (1)..( 13): Matrix.002 file - promoters60/1443674
aatttatccaaaa

SEQ ID NO: 50587 - DNA, 9 bp, Unknown
  misc_feature (1)..( 9): Matrix.002 file - promoters60/1443674
aaataaaat

SEQ ID NO: 50588 - DNA, 8 bp, Unknown
  misc_feature (1)..( 8): Matrix.002 file - promoters60/1443674
aaaaaaaa

SEQ ID NO: 50589 - DNA, 8 bp, Unknown
  misc_feature (1)..( 8): Matrix.002 file - promoters60/1443674
acatatta

SEQ ID NO: 50590 - DNA, 8 bp, Unknown
  misc_feature (1)..( 8): Matrix.002 file - promoters60/1443687
aaacactt

SEQ ID NO: 50591 - DNA, 6 bp, Unknown
  misc_feature (1)..( 6): Matrix.002 file - promoters60/1443687
atattt

SEQ ID NO: 50592 - DNA, 7 bp, Unknown
  misc_feature (1)..( 7): Matrix.002 file - promoters60/1443687
aaaattt

SEQ ID NO: 50593 - DNA, 7 bp, Unknown
  misc_feature (1)..( 7): Matrix.002 file - promoters60/1443687
gaacaaa

SEQ ID NO: 50594 - DNA, 6 bp, Unknown
  misc_feature (1)..( 6): Matrix.002 file - promoters60/1443687
agttta

SEQ ID NO: 50595 - DNA, 9 bp, Unknown
  misc_feature (1)..( 9): Matrix.002 file - promoters60/1443687
tattttgaa

SEQ ID NO: 50596 - DNA, 6 bp, Unknown
  misc_feature (1)..( 6): Matrix.002 file - promoters60/1443687
tgaaaa

SEQ ID NO: 50597 - DNA, 7 bp, Unknown
  misc_feature (1)..( 7): Matrix.002 file - promoters60/1443687
tcacttt

SEQ ID NO: 50598 - DNA, 9 bp, Unknown
  misc_feature (1)..( 9): Matrix.002 file - promoters60/1443687
ttttgttat

SEQ ID NO: 50599 - DNA, 6 bp, Unknown
  misc_feature (1)..( 6): Matrix.002 file - promoters60/1443687
tatttt

SEQ ID NO: 50600 - DNA, 7 bp, Unknown
  misc_feature (1)..( 7): Matrix.002 file - promoters60/1443687
taaaata

SEQ ID NO: 50601 - DNA, 6 bp, Unknown
  misc_feature (1)..( 6): Matrix.002 file - promoters60/1443687
atcaaa

SEQ ID NO: 50602 - DNA, 10 bp, Unknown
  misc_feature (1)..( 10): Matrix.002 file - promoters60/1443687
gaatattttt

SEQ ID NO: 50603 - DNA, 7 bp, Unknown
  misc_feature (1)..( 7): Matrix.002 file - promoters60/1443687
attattt

SEQ ID NO: 50604 - DNA, 6 bp, Unknown
  misc_feature (1)..( 6): Matrix.002 file - promoters60/1443687
atttgg

SEQ ID NO: 50605 - DNA, 6 bp, Unknown
  misc_feature (1)..( 6): Matrix.002 file - promoters60/1443687
tttggt

SEQ ID NO: 50606 - DNA, 8 bp, Unknown
  misc_feature (1)..( 8): Matrix.002 file - promoters60/1443687
aaaacccc

SEQ ID NO: 50607 - DNA, 7 bp, Unknown
  misc_feature (1)..( 7): Matrix.002 file - promoters60/1443687
taattca

SEQ ID NO: 50608 - DNA, 8 bp, Unknown
  misc_feature (1)..( 8): Matrix.002 file - promoters60/1443687
aaacttat

SEQ ID NO: 50609 - DNA, 7 bp, Unknown
  misc_feature (1)..( 7): Matrix.002 file - promoters60/1443687
tttaaca

SEQ ID NO: 50610 - DNA, 7 bp, Unknown
  misc_feature (1)..( 7): Matrix.002 file - promoters60/1443687
ataccac

SEQ ID NO: 50611 - DNA, 7 bp, Unknown
  misc_feature (1)..( 7): Matrix.002 file - promoters60/1443687
tattttt

SEQ ID NO: 50612 - DNA, 6 bp, Unknown
  misc_feature (1)..( 6): Matrix.002 file - promoters60/1443687
acttgt

SEQ ID NO: 50613 - DNA, 6 bp, Unknown
  misc_feature (1)..( 6): Matrix.002 file - promoters60/1444100
ttatca

SEQ ID NO: 50614 - DNA, 8 bp, Unknown
  misc_feature (1)..( 8): Matrix.002 file - promoters60/1444100
ttttattt

SEQ ID NO: 50615 - DNA, 8 bp, Unknown
  misc_feature (1)..( 8): Matrix.002 file - promoters60/1444100
cctacttt

SEQ ID NO: 50616 - DNA, 7 bp, Unknown
  misc_feature (1)..( 7): Matrix.002 file - promoters60/1444100
tttggtt

SEQ ID NO: 50617 - DNA, 7 bp, Unknown
  misc_feature (1)..( 7): Matrix.002 file - promoters60/1444100
tttctct

SEQ ID NO: 50618 - DNA, 6 bp, Unknown
  misc_feature (1)..( 6): Matrix.002 file - promoters60/1444100
cactta

SEQ ID NO: 50619 - DNA, 6 bp, Unknown
  misc_feature (1)..( 6): Matrix.002 file - promoters60/1444100
gaaagt

SEQ ID NO: 50620 - DNA, 9 bp, Unknown
  misc_feature (1)..( 9): Matrix.002 file - promoters60/1444100
ttgggatcc

SEQ ID NO: 50621 - DNA, 8 bp, Unknown
  misc_feature (1)..( 8): Matrix.002 file - promoters60/1444100
tatgtgtg

SEQ ID NO: 50622 - DNA, 6 bp, Unknown
  misc_feature (1)..( 6): Matrix.002 file - promoters60/1444100
ttttca

SEQ ID NO: 50623 - DNA, 7 bp, Unknown
  misc_feature (1)..( 7): Matrix.002 file - promoters60/1444100
gttcaaa

SEQ ID NO: 50624 - DNA, 7 bp, Unknown
  misc_feature (1)..( 7): Matrix.002 file - promoters60/1444100
gcaatga

SEQ ID NO: 50625 - DNA, 6 bp, Unknown
  misc_feature (1)..( 6): Matrix.002 file - promoters60/1444100
tgtttt

SEQ ID NO: 50626 - DNA, 6 bp, Unknown
  misc_feature (1)..( 6): Matrix.002 file - promoters60/1444100
accttc

SEQ ID NO: 50627 - DNA, 6 bp, Unknown
  misc_feature (1)..( 6): Matrix.002 file - promoters60/1444100
tctttt

SEQ ID NO: 50628 - DNA, 7 bp, Unknown
  misc_feature (1)..( 7): Matrix.002 file - promoters60/1444100
cttgatt

SEQ ID NO: 50629 - DNA, 7 bp, Unknown
  misc_feature (1)..( 7): Matrix.002 file - promoters60/1444100
aatataa

SEQ ID NO: 50630 - DNA, 7 bp, Unknown
  misc_feature (1)..( 7): Matrix.002 file - promoters60/1444100
tatcttt

SEQ ID NO: 50631 - DNA, 7 bp, Unknown
  misc_feature (1)..( 7): Matrix.002 file - promoters60/1444100
tttcttt

SEQ ID NO: 50632 - DNA, 7 bp, Unknown
  misc_feature (1)..( 7): Matrix.002 file - promoters60/1444100
aataaac

SEQ ID NO: 50633 - DNA, 8 bp, Unknown
  misc_feature (1)..( 8): Matrix.002 file - promoters60/1444100
ccgtgtta

SEQ ID NO: 50634 - DNA, 14 bp, Unknown
  misc_feature (1)..( 14): Matrix.002 file - promoters60/1444131
tgaaaaaaataaac

SEQ ID NO: 50635 - DNA, 11 bp, Unknown
  misc_feature (1)..( 11): Matrix.002 file - promoters60/1444131
gacattataaa

SEQ ID NO: 50636 - DNA, 8 bp, Unknown
  misc_feature (1)..( 8): Matrix.002 file - promoters60/1444131
ttattttg

SEQ ID NO: 50637 - DNA, 7 bp, Unknown
  misc_feature (1)..( 7): Matrix.002 file - promoters60/1444131
atttttt

SEQ ID NO: 50638 - DNA, 9 bp, Unknown
  misc_feature (1)..( 9): Matrix.002 file - promoters60/1444131
tcaatattt

SEQ ID NO: 50639 - DNA, 7 bp, Unknown
  misc_feature (1)..( 7): Matrix.002 file - promoters60/1444131
taaacaa

SEQ ID NO: 50640 - DNA, 5 bp, Unknown
  misc_feature (1)..( 5): Matrix.002 file - promoters60/1444131
agtta

SEQ ID NO: 50641 - DNA, 10 bp, Unknown
  misc_feature (1)..( 10): Matrix.002 file - promoters60/1444131
aaatcaaatg

SEQ ID NO: 50642 - DNA, 10 bp, Unknown
  misc_feature (1)..( 10): Matrix.002 file - promoters60/1444131
gaaaaaaaaa

SEQ ID NO: 50643 - DNA, 10 bp, Unknown
  misc_feature (1)..( 10): Matrix.002 file - promoters60/1444137
gataaaggtc

SEQ ID NO: 50644 - DNA, 11 bp, Unknown
  misc_feature (1)..( 11): Matrix.002 file - promoters60/1444137
aaagtatgact

SEQ ID NO: 50645 - DNA, 8 bp, Unknown
  misc_feature (1)..( 8): Matrix.002 file - promoters60/1444137
aaagaaac

SEQ ID NO: 50646 - DNA, 10 bp, Unknown
  misc_feature (1)..( 10): Matrix.002 file - promoters60/1444137
tcagtagtta

SEQ ID NO: 50647 - DNA, 9 bp, Unknown
  misc_feature (1)..( 9): Matrix.002 file - promoters60/1444137
tctccattc

SEQ ID NO: 50648 - DNA, 7 bp, Unknown
  misc_feature (1)..( 7): Matrix.002 file - promoters60/1444137
tctctaa

SEQ ID NO: 50649 - DNA, 6 bp, Unknown
  misc_feature (1)..( 6): Matrix.002 file - promoters60/1444149
atttga

SEQ ID NO: 50650 - DNA, 6 bp, Unknown
  misc_feature (1)..( 6): Matrix.002 file - promoters60/1444149
gacact

SEQ ID NO: 50651 - DNA, 8 bp, Unknown
  misc_feature (1)..( 8): Matrix.002 file - promoters60/1444149
cggagatg

SEQ ID NO: 50652 - DNA, 8 bp, Unknown
  misc_feature (1)..( 8): Matrix.002 file - promoters60/1444149
ttgtaaca

SEQ ID NO: 50653 - DNA, 8 bp, Unknown
  misc_feature (1)..( 8): Matrix.002 file - promoters60/1444149
ttgtgatg

SEQ ID NO: 50654 - DNA, 9 bp, Unknown
  misc_feature (1)..( 9): Matrix.002 file - promoters60/1444149
ccgacagac

SEQ ID NO: 50655 - DNA, 6 bp, Unknown
  misc_feature (1)..( 6): Matrix.002 file - promoters60/1444149
tatttt

SEQ ID NO: 50656 - DNA, 9 bp, Unknown
  misc_feature (1)..( 9): Matrix.002 file - promoters60/1444149
caacatttt

SEQ ID NO: 50657 - DNA, 7 bp, Unknown
  misc_feature (1)..( 7): Matrix.002 file - promoters60/1444149
tttattt

SEQ ID NO: 50658 - DNA, 9 bp, Unknown
  misc_feature (1)..( 9): Matrix.002 file - promoters60/1444149
aaaagtaat

SEQ ID NO: 50659 - DNA, 6 bp, Unknown
  misc_feature (1)..( 6): Matrix.002 file - promoters60/1444149
ttagtt

SEQ ID NO: 50660 - DNA, 6 bp, Unknown
  misc_feature (1)..( 6): Matrix.002 file - promoters60/1444149
aagatt

SEQ ID NO: 50661 - DNA, 6 bp, Unknown
  misc_feature (1)..( 6): Matrix.002 file - promoters60/1444149
atttga

SEQ ID NO: 50662 - DNA, 8 bp, Unknown
  misc_feature (1)..( 8): Matrix.002 file - promoters60/1444149
tgacaatt

SEQ ID NO: 50663 - DNA, 8 bp, Unknown
  misc_feature (1)..( 8): Matrix.002 file - promoters60/1444149
aattttct

SEQ ID NO: 50664 - DNA, 8 bp, Unknown
  misc_feature (1)..( 8): Matrix.002 file - promoters60/1444156
aatcaaaa

SEQ ID NO: 50665 - DNA, 7 bp, Unknown
  misc_feature (1)..( 7): Matrix.002 file - promoters60/1444156
tttaata

SEQ ID NO: 50666 - DNA, 6 bp, Unknown
  misc_feature (1)..( 6): Matrix.002 file - promoters60/1444156
gaaaat

SEQ ID NO: 50667 - DNA, 7 bp, Unknown
  misc_feature (1)..( 7): Matrix.002 file - promoters60/1444156
ttggtaa

SEQ ID NO: 50668 - DNA, 9 bp, Unknown
  misc_feature (1)..( 9): Matrix.002 file - promoters60/1444156
taaaaacta

SEQ ID NO: 50669 - DNA, 6 bp, Unknown
  misc_feature (1)..( 6): Matrix.002 file - promoters60/1444156
ttaaac

SEQ ID NO: 50670 - DNA, 6 bp, Unknown
  misc_feature (1)..( 6): Matrix.002 file - promoters60/1444156
tcaaca

SEQ ID NO: 50671 - DNA, 6 bp, Unknown
  misc_feature (1)..( 6): Matrix.002 file - promoters60/1444156
ttttca

SEQ ID NO: 50672 - DNA, 8 bp, Unknown
  misc_feature (1)..( 8): Matrix.002 file - promoters60/1444156
tcaaaaag

SEQ ID NO: 50673 - DNA, 9 bp, Unknown
  misc_feature (1)..( 9): Matrix.002 file - promoters60/1444156
aaaataaaa

SEQ ID NO: 50674 - DNA, 6 bp, Unknown
  misc_feature (1)..( 6): Matrix.002 file - promoters60/1444156
aaaaga

SEQ ID NO: 50675 - DNA, 7 bp, Unknown
  misc_feature (1)..( 7): Matrix.002 file - promoters60/1444156
aaaaaaa

SEQ ID NO: 50676 - DNA, 7 bp, Unknown
  misc_feature (1)..( 7): Matrix.002 file - promoters60/1444156
atgaaga

SEQ ID NO: 50677 - DNA, 13 bp, Unknown
  misc_feature (1)..( 13): Matrix.002 file - promoters60/1444156
atttgtttattta

SEQ ID NO: 50678 - DNA, 6 bp, Unknown
  misc_feature (1)..( 6): Matrix.002 file - promoters60/1444180
tcatat

SEQ ID NO: 50679 - DNA, 7 bp, Unknown
  misc_feature (1)..( 7): Matrix.002 file - promoters60/1444180
aaaagct

SEQ ID NO: 50680 - DNA, 7 bp, Unknown
  misc_feature (1)..( 7): Matrix.002 file - promoters60/1444180
ccaaaat

SEQ ID NO: 50681 - DNA, 7 bp, Unknown
  misc_feature (1)..( 7): Matrix.002 file - promoters60/1444180
gaaatca

SEQ ID NO: 50682 - DNA, 6 bp, Unknown
  misc_feature (1)..( 6): Matrix.002 file - promoters60/1444180
atatct

SEQ ID NO: 50683 - DNA, 7 bp, Unknown
  misc_feature (1)..( 7): Matrix.002 file - promoters60/1444180
gtcaaaa

SEQ ID NO: 50684 - DNA, 6 bp, Unknown
  misc_feature (1)..( 6): Matrix.002 file - promoters60/1444180
aatggg

SEQ ID NO: 50685 - DNA, 9 bp, Unknown
  misc_feature (1)..( 9): Matrix.002 file - promoters60/1444180
gaaacaaaa

SEQ ID NO: 50686 - DNA, 6 bp, Unknown
  misc_feature (1)..( 6): Matrix.002 file - promoters60/1444180
ttaaag

SEQ ID NO: 50687 - DNA, 6 bp, Unknown
  misc_feature (1)..( 6): Matrix.002 file - promoters60/1444180
agtaaa

SEQ ID NO: 50688 - DNA, 7 bp, Unknown
  misc_feature (1)..( 7): Matrix.002 file - promoters60/1444180
aatcggg

SEQ ID NO: 50689 - DNA, 10 bp, Unknown
  misc_feature (1)..( 10): Matrix.002 file - promoters60/1444180
ggaaaagaaa

SEQ ID NO: 50690 - DNA, 7 bp, Unknown
  misc_feature (1)..( 7): Matrix.002 file - promoters60/1444180
cccacta

SEQ ID NO: 50691 - DNA, 9 bp, Unknown
  misc_feature (1)..( 9): Matrix.002 file - promoters60/1444180
aaagaaaag

SEQ ID NO: 50692 - DNA, 7 bp, Unknown
  misc_feature (1)..( 7): Matrix.002 file - promoters60/1444180
gtatata

SEQ ID NO: 50693 - DNA, 6 bp, Unknown
  misc_feature (1)..( 6): Matrix.002 file - promoters60/1444400
acaaac

SEQ ID NO: 50694 - DNA, 8 bp, Unknown
  misc_feature (1)..( 8): Matrix.002 file - promoters60/1444400
caaaagta

SEQ ID NO: 50695 - DNA, 6 bp, Unknown
  misc_feature (1)..( 6): Matrix.002 file - promoters60/1444400
aattaa

SEQ ID NO: 50696 - DNA, 7 bp, Unknown
  misc_feature (1)..( 7): Matrix.002 file - promoters60/1444400
aataaac

SEQ ID NO: 50697 - DNA, 7 bp, Unknown
  misc_feature (1)..( 7): Matrix.002 file - promoters60/1444400
atatata

SEQ ID NO: 50698 - DNA, 6 bp, Unknown
  misc_feature (1)..( 6): Matrix.002 file - promoters60/1444400
atatat

SEQ ID NO: 50699 - DNA, 14 bp, Unknown
  misc_feature (1)..( 14): Matrix.002 file - promoters60/1444400
tgtgttcgtttggt

SEQ ID NO: 50700 - DNA, 7 bp, Unknown
  misc_feature (1)..( 7): Matrix.002 file - promoters60/1444400
tggacgc

SEQ ID NO: 50701 - DNA, 7 bp, Unknown
  misc_feature (1)..( 7): Matrix.002 file - promoters60/1444400
caaacgc

SEQ ID NO: 50702 - DNA, 7 bp, Unknown
  misc_feature (1)..( 7): Matrix.002 file - promoters60/1444400
gcgacaa

SEQ ID NO: 50703 - DNA, 7 bp, Unknown
  misc_feature (1)..( 7): Matrix.002 file - promoters60/1444400
tttttca

SEQ ID NO: 50704 - DNA, 6 bp, Unknown
  misc_feature (1)..( 6): Matrix.002 file - promoters60/1444400
cccaat

SEQ ID NO: 50705 - DNA, 6 bp, Unknown
  misc_feature (1)..( 6): Matrix.002 file - promoters60/1444400
tatgtg

SEQ ID NO: 50706 - DNA, 8 bp, Unknown
  misc_feature (1)..( 8): Matrix.002 file - promoters60/1444400
tataatta

SEQ ID NO: 50707 - DNA, 9 bp, Unknown
  misc_feature (1)..( 9): Matrix.002 file - promoters60/1444400
ttgctaata

SEQ ID NO: 50708 - DNA, 8 bp, Unknown
  misc_feature (1)..( 8): Matrix.002 file - promoters60/1444400
acgaacat

SEQ ID NO: 50709 - DNA, 8 bp, Unknown
  misc_feature (1)..( 8): Matrix.002 file - promoters60/1444400
attatatc

SEQ ID NO: 50710 - DNA, 12 bp, Unknown
  misc_feature (1)..( 12): Matrix.002 file - promoters60/1444400
aaacatttgatt

SEQ ID NO: 50711 - DNA, 6 bp, Unknown
  misc_feature (1)..( 6): Matrix.002 file - promoters60/1444400
ctacaa

SEQ ID NO: 50712 - DNA, 8 bp, Unknown
  misc_feature (1)..( 8): Matrix.002 file - promoters60/1444400
aaaaccta

SEQ ID NO: 50713 - DNA, 7 bp, Unknown
  misc_feature (1)..( 7): Matrix.002 file - promoters60/1444448
tgtttta

SEQ ID NO: 50714 - DNA, 6 bp, Unknown
  misc_feature (1)..( 6): Matrix.002 file - promoters60/1444448
agaagt

SEQ ID NO: 50715 - DNA, 6 bp, Unknown
  misc_feature (1)..( 6): Matrix.002 file - promoters60/1444448
tttaaa

SEQ ID NO: 50716 - DNA, 8 bp, Unknown
  misc_feature (1)..( 8): Matrix.002 file - promoters60/1444448
ataaataa

SEQ ID NO: 50717 - DNA, 8 bp, Unknown
  misc_feature (1)..( 8): Matrix.002 file - promoters60/1444448
ttaaattc

SEQ ID NO: 50718 - DNA, 7 bp, Unknown
  misc_feature (1)..( 7): Matrix.002 file - promoters60/1444448
tttttga

SEQ ID NO: 50719 - DNA, 8 bp, Unknown
  misc_feature (1)..( 8): Matrix.002 file - promoters60/1444448
gtacaatt

SEQ ID NO: 50720 - DNA, 7 bp, Unknown
  misc_feature (1)..( 7): Matrix.002 file - promoters60/1444448
ttcggtt

SEQ ID NO: 50721 - DNA, 6 bp, Unknown
  misc_feature (1)..( 6): Matrix.002 file - promoters60/1444448
tttcaa

SEQ ID NO: 50722 - DNA, 6 bp, Unknown
  misc_feature (1)..( 6): Matrix.002 file - promoters60/1444448
ccaata

SEQ ID NO: 50723 - DNA, 9 bp, Unknown
  misc_feature (1)..( 9): Matrix.002 file - promoters60/1444448
cattgctta

SEQ ID NO: 50724 - DNA, 7 bp, Unknown
  misc_feature (1)..( 7): Matrix.002 file - promoters60/1444448
gttctaa

SEQ ID NO: 50725 - DNA, 6 bp, Unknown
  misc_feature (1)..( 6): Matrix.002 file - promoters60/1444448
taaaat

SEQ ID NO: 50726 - DNA, 7 bp, Unknown
  misc_feature (1)..( 7): Matrix.002 file - promoters60/1444448
gaagaat

SEQ ID NO: 50727 - DNA, 7 bp, Unknown
  misc_feature (1)..( 7): Matrix.002 file - promoters60/1444448
gatgaat

SEQ ID NO: 50728 - DNA, 11 bp, Unknown
  misc_feature (1)..( 11): Matrix.002 file - promoters60/1444460
aaatttcttca

SEQ ID NO: 50729 - DNA, 8 bp, Unknown
  misc_feature (1)..( 8): Matrix.002 file - promoters60/1444460
caaaagag

SEQ ID NO: 50730 - DNA, 12 bp, Unknown
  misc_feature (1)..( 12): Matrix.002 file - promoters60/1444473
cttcttattggt

SEQ ID NO: 50731 - DNA, 11 bp, Unknown
  misc_feature (1)..( 11): Matrix.002 file - promoters60/1444473
caaagaattta

SEQ ID NO: 50732 - DNA, 18 bp, Unknown
  misc_feature (1)..( 18): Matrix.002 file - promoters60/1444479
aaaaattattaaataaaa

SEQ ID NO: 50733 - DNA, 10 bp, Unknown
  misc_feature (1)..( 10): Matrix.002 file - promoters60/1444479
tttactaatc

SEQ ID NO: 50734 - DNA, 11 bp, Unknown
  misc_feature (1)..( 11): Matrix.002 file - promoters60/1444479
ataatttttaa

SEQ ID NO: 50735 - DNA, 8 bp, Unknown
  misc_feature (1)..( 8): Matrix.002 file - promoters60/1444479
tattttac

SEQ ID NO: 50736 - DNA, 10 bp, Unknown
  misc_feature (1)..( 10): Matrix.002 file - promoters60/1444479
ctatatatat

SEQ ID NO: 50737 - DNA, 9 bp, Unknown
  misc_feature (1)..( 9): Matrix.002 file - promoters60/1444479
ctaatttta

SEQ ID NO: 50738 - DNA, 11 bp, Unknown
  misc_feature (1)..( 11): Matrix.002 file - promoters60/1444479
aaaaaaatcat

SEQ ID NO: 50739 - DNA, 7 bp, Unknown
  misc_feature (1)..( 7): Matrix.002 file - promoters60/1444479
aattttg

SEQ ID NO: 50740 - DNA, 9 bp, Unknown
  misc_feature (1)..( 9): Matrix.002 file - promoters60/1444502
tttgtttgt

SEQ ID NO: 50741 - DNA, 7 bp, Unknown
  misc_feature (1)..( 7): Matrix.002 file - promoters60/1444502
gacacgt

SEQ ID NO: 50742 - DNA, 6 bp, Unknown
  misc_feature (1)..( 6): Matrix.002 file - promoters60/1444502
ggcttt

SEQ ID NO: 50743 - DNA, 7 bp, Unknown
  misc_feature (1)..( 7): Matrix.002 file - promoters60/1444502
gaatata

SEQ ID NO: 50744 - DNA, 7 bp, Unknown
  misc_feature (1)..( 7): Matrix.002 file - promoters60/1444502
attcttt

SEQ ID NO: 50745 - DNA, 7 bp, Unknown
  misc_feature (1)..( 7): Matrix.002 file - promoters60/1444502
aagaaga

SEQ ID NO: 50746 - DNA, 9 bp, Unknown
  misc_feature (1)..( 9): Matrix.002 file - promoters60/1444502
agttgaaaa

SEQ ID NO: 50747 - DNA, 7 bp, Unknown
  misc_feature (1)..( 7): Matrix.002 file - promoters60/1444502
aggccca

SEQ ID NO: 50748 - DNA, 6 bp, Unknown
  misc_feature (1)..( 6): Matrix.002 file - promoters60/1444502
aaagga

SEQ ID NO: 50749 - DNA, 7 bp, Unknown
  misc_feature (1)..( 7): Matrix.002 file - promoters60/1444502
tcacttt

SEQ ID NO: 50750 - DNA, 8 bp, Unknown
  misc_feature (1)..( 8): Matrix.002 file - promoters60/1444502
aaaaaaaa

SEQ ID NO: 50751 - DNA, 15 bp, Unknown
  misc_feature (1)..( 15): Matrix.002 file - promoters60/1444506
aaaaattattaaatt

SEQ ID NO: 50752 - DNA, 10 bp, Unknown
  misc_feature (1)..( 10): Matrix.002 file - promoters60/1444506
tttactaaaa

SEQ ID NO: 50753 - DNA, 8 bp, Unknown
  misc_feature (1)..( 8): Matrix.002 file - promoters60/1444506
ataatttt

SEQ ID NO: 50754 - DNA, 7 bp, Unknown
  misc_feature (1)..( 7): Matrix.002 file - promoters60/1444506
tatttta

SEQ ID NO: 50755 - DNA, 10 bp, Unknown
  misc_feature (1)..( 10): Matrix.002 file - promoters60/1444506
ctatatatat

SEQ ID NO: 50756 - DNA, 9 bp, Unknown
  misc_feature (1)..( 9): Matrix.002 file - promoters60/1444506
ctaatttta

SEQ ID NO: 50757 - DNA, 8 bp, Unknown
  misc_feature (1)..( 8): Matrix.002 file - promoters60/1444506
ttttgtta

SEQ ID NO: 50758 - DNA, 8 bp, Unknown
  misc_feature (1)..( 8): Matrix.002 file - promoters60/1444506
acaaaaaa

SEQ ID NO: 50759 - DNA, 10 bp, Unknown
  misc_feature (1)..( 10): Matrix.002 file - promoters60/1444506
aaaaaataat

SEQ ID NO: 50760 - DNA, 8 bp, Unknown
  misc_feature (1)..( 8): Matrix.002 file - promoters60/1444506
taattgaa

SEQ ID NO: 50761 - DNA, 9 bp, Unknown
  misc_feature (1)..( 9): Matrix.002 file - promoters60/1444506
aaaatattt

SEQ ID NO: 50762 - DNA, 7 bp, Unknown
  misc_feature (1)..( 7): Matrix.002 file - promoters60/1444506
attttgt

SEQ ID NO: 50763 - DNA, 8 bp, Unknown
  misc_feature (1)..( 8): Matrix.002 file - promoters60/1444506
aaaaaaat

SEQ ID NO: 50764 - DNA, 18 bp, Unknown
  misc_feature (1)..( 18): Matrix.002 file - promoters60/1444514
aaaaattattgaaagtat

SEQ ID NO: 50765 - DNA, 10 bp, Unknown
  misc_feature (1)..( 10): Matrix.002 file - promoters60/1444514
tttactaaaa

SEQ ID NO: 50766 - DNA, 12 bp, Unknown
  misc_feature (1)..( 12): Matrix.002 file - promoters60/1444514
ccctatatatat

SEQ ID NO: 50767 - DNA, 10 bp, Unknown
  misc_feature (1)..( 10): Matrix.002 file - promoters60/1444514
ttttaatttt

SEQ ID NO: 50768 - DNA, 8 bp, Unknown
  misc_feature (1)..( 8): Matrix.002 file - promoters60/1444514
atttgtta

SEQ ID NO: 50769 - DNA, 10 bp, Unknown
  misc_feature (1)..( 10): Matrix.002 file - promoters60/1444514
attttgtaat

SEQ ID NO: 50770 - DNA, 8 bp, Unknown
  misc_feature (1)..( 8): Matrix.002 file - promoters60/1444629
gattctta

SEQ ID NO: 50771 - DNA, 10 bp, Unknown
  misc_feature (1)..( 10): Matrix.002 file - promoters60/1444629
accttatcca

SEQ ID NO: 50772 - DNA, 6 bp, Unknown
  misc_feature (1)..( 6): Matrix.002 file - promoters60/1444629
attatc

SEQ ID NO: 50773 - DNA, 7 bp, Unknown
  misc_feature (1)..( 7): Matrix.002 file - promoters60/1444629
attatca

SEQ ID NO: 50774 - DNA, 7 bp, Unknown
  misc_feature (1)..( 7): Matrix.002 file - promoters60/1446456
aaataaa

SEQ ID NO: 50775 - DNA, 8 bp, Unknown
  misc_feature (1)..( 8): Matrix.002 file - promoters60/1446456
ctttttat

SEQ ID NO: 50776 - DNA, 11 bp, Unknown
  misc_feature (1)..( 11): Matrix.002 file - promoters60/1446456
tttctaactcc

SEQ ID NO: 50777 - DNA, 8 bp, Unknown
  misc_feature (1)..( 8): Matrix.002 file - promoters60/1446456
aagaataa

SEQ ID NO: 50778 - DNA, 9 bp, Unknown
  misc_feature (1)..( 9): Matrix.002 file - promoters60/1446456
atacttttt

SEQ ID NO: 50779 - DNA, 10 bp, Unknown
  misc_feature (1)..( 10): Matrix.002 file - promoters60/1446456
actttttctg

SEQ ID NO: 50780 - DNA, 8 bp, Unknown
  misc_feature (1)..( 8): Matrix.002 file - promoters60/1446456
aagaaatt

SEQ ID NO: 50781 - DNA, 12 bp, Unknown
  misc_feature (1)..( 12): Matrix.002 file - promoters60/1446636
actattaataaa

SEQ ID NO: 50782 - DNA, 6 bp, Unknown
  misc_feature (1)..( 6): Matrix.002 file - promoters60/1446636
attaat

SEQ ID NO: 50783 - DNA, 12 bp, Unknown
  misc_feature (1)..( 12): Matrix.002 file - promoters60/1446636
ctttttttgttt

SEQ ID NO: 50784 - DNA, 10 bp, Unknown
  misc_feature (1)..( 10): Matrix.002 file - promoters60/1446975
gataacctta

SEQ ID NO: 50785 - DNA, 9 bp, Unknown
  misc_feature (1)..( 9): Matrix.002 file - promoters60/1446975
aacattttg

SEQ ID NO: 50786 - DNA, 6 bp, Unknown
  misc_feature (1)..( 6): Matrix.002 file - promoters60/1446975
ctgatt

SEQ ID NO: 50787 - DNA, 6 bp, Unknown
  misc_feature (1)..( 6): Matrix.002 file - promoters60/1446975
gatcta

SEQ ID NO: 50788 - DNA, 7 bp, Unknown
  misc_feature (1)..( 7): Matrix.002 file - promoters60/1446975
agaaaga

SEQ ID NO: 50789 - DNA, 7 bp, Unknown
  misc_feature (1)..( 7): Matrix.002 file - promoters60/1446975
tcataat

SEQ ID NO: 50790 - DNA, 6 bp, Unknown
  misc_feature (1)..( 6): Matrix.002 file - promoters60/1446975
attgtt

SEQ ID NO: 50791 - DNA, 6 bp, Unknown
  misc_feature (1)..( 6): Matrix.002 file - promoters60/1447064
agagca

SEQ ID NO: 50792 - DNA, 6 bp, Unknown
  misc_feature (1)..( 6): Matrix.002 file - promoters60/1447064
atagag

SEQ ID NO: 50793 - DNA, 7 bp, Unknown
  misc_feature (1)..( 7): Matrix.002 file - promoters60/1447064
tatattg

SEQ ID NO: 50794 - DNA, 6 bp, Unknown
  misc_feature (1)..( 6): Matrix.002 file - promoters60/1447064
aaagac

SEQ ID NO: 50795 - DNA, 7 bp, Unknown
  misc_feature (1)..( 7): Matrix.002 file - promoters60/1447064
taaaaaa

SEQ ID NO: 50796 - DNA, 6 bp, Unknown
  misc_feature (1)..( 6): Matrix.002 file - promoters60/1447064
taaaaa

SEQ ID NO: 50797 - DNA, 6 bp, Unknown
  misc_feature (1)..( 6): Matrix.002 file - promoters60/1447064
cttcta

SEQ ID NO: 50798 - DNA, 7 bp, Unknown
  misc_feature (1)..( 7): Matrix.002 file - promoters60/1447064
tttctat

SEQ ID NO: 50799 - DNA, 7 bp, Unknown
  misc_feature (1)..( 7): Matrix.002 file - promoters60/1447064
tatattg

SEQ ID NO: 50800 - DNA, 8 bp, Unknown
  misc_feature (1)..( 8): Matrix.002 file - promoters60/1447064
tgttaaaa

SEQ ID NO: 50801 - DNA, 8 bp, Unknown
  misc_feature (1)..( 8): Matrix.002 file - promoters60/1447064
cattaaac

SEQ ID NO: 50802 - DNA, 6 bp, Unknown
  misc_feature (1)..( 6): Matrix.002 file - promoters60/1447064
tctcca

SEQ ID NO: 50803 - DNA, 7 bp, Unknown
  misc_feature (1)..( 7): Matrix.002 file - promoters60/1447064
ccatttt

SEQ ID NO: 50804 - DNA, 6 bp, Unknown
  misc_feature (1)..( 6): Matrix.002 file - promoters60/1447064
ttttca

SEQ ID NO: 50805 - DNA, 6 bp, Unknown
  misc_feature (1)..( 6): Matrix.002 file - promoters60/1447064
tgtctt

SEQ ID NO: 50806 - DNA, 6 bp, Unknown
  misc_feature (1)..( 6): Matrix.002 file - promoters60/1447064
caagct

SEQ ID NO: 50807 - DNA, 7 bp, Unknown
  misc_feature (1)..( 7): Matrix.002 file - promoters60/1447064
ataaata

SEQ ID NO: 50808 - DNA, 12 bp, Unknown
  misc_feature (1)..( 12): Matrix.002 file - promoters60/1447217
gaaaaaaaaaaa

SEQ ID NO: 50809 - DNA, 10 bp, Unknown
  misc_feature (1)..( 10): Matrix.002 file - promoters60/1447217
tttattatgt

SEQ ID NO: 50810 - DNA, 8 bp, Unknown
  misc_feature (1)..( 8): Matrix.002 file - promoters60/1447217
agaataaa

SEQ ID NO: 50811 - DNA, 9 bp, Unknown
  misc_feature (1)..( 9): Matrix.002 file - promoters60/1447217
aaaataaaa

SEQ ID NO: 50812 - DNA, 10 bp, Unknown
  misc_feature (1)..( 10): Matrix.002 file - promoters60/1447217
aaaaaagagt

SEQ ID NO: 50813 - DNA, 8 bp, Unknown
  misc_feature (1)..( 8): Matrix.002 file - promoters60/1447217
ataaataa

SEQ ID NO: 50814 - DNA, 9 bp, Unknown
  misc_feature (1)..( 9): Matrix.002 file - promoters60/1447217
ttttgaacg

SEQ ID NO: 50815 - DNA, 9 bp, Unknown
  misc_feature (1)..( 9): Matrix.002 file - promoters60/1447217
gaaatacaa

SEQ ID NO: 50816 - DNA, 10 bp, Unknown
  misc_feature (1)..( 10): Matrix.002 file - promoters60/1447217
caaaacaaaa

SEQ ID NO: 50817 - DNA, 14 bp, Unknown
  misc_feature (1)..( 14): Matrix.002 file - promoters60/1447217
gaaatattttaaac

SEQ ID NO: 50818 - DNA, 7 bp, Unknown
  misc_feature (1)..( 7): Matrix.002 file - promoters60/1447217
tataatt

SEQ ID NO: 50819 - DNA, 8 bp, Unknown
  misc_feature (1)..( 8): Matrix.002 file - promoters60/1447321
ttttgaat

SEQ ID NO: 50820 - DNA, 9 bp, Unknown
  misc_feature (1)..( 9): Matrix.002 file - promoters60/1447321
tataataca

SEQ ID NO: 50821 - DNA, 11 bp, Unknown
  misc_feature (1)..( 11): Matrix.002 file - promoters60/1447321
aaaatgtgaaa

SEQ ID NO: 50822 - DNA, 7 bp, Unknown
  misc_feature (1)..( 7): Matrix.002 file - promoters60/1447321
aatctaa

SEQ ID NO: 50823 - DNA, 8 bp, Unknown
  misc_feature (1)..( 8): Matrix.002 file - promoters60/1447321
ccaaattt

SEQ ID NO: 50824 - DNA, 6 bp, Unknown
  misc_feature (1)..( 6): Matrix.002 file - promoters60/1447321
aatatt

SEQ ID NO: 50825 - DNA, 9 bp, Unknown
  misc_feature (1)..( 9): Matrix.002 file - promoters60/1447321
tataaaata

SEQ ID NO: 50826 - DNA, 8 bp, Unknown
  misc_feature (1)..( 8): Matrix.002 file - promoters60/1447321
agcccaaa

SEQ ID NO: 50827 - DNA, 7 bp, Unknown
  misc_feature (1)..( 7): Matrix.002 file - promoters60/1447321
aatcttc

SEQ ID NO: 50828 - DNA, 7 bp, Unknown
  misc_feature (1)..( 7): Matrix.002 file - promoters60/1447321
tgaattt

SEQ ID NO: 50829 - DNA, 9 bp, Unknown
  misc_feature (1)..( 9): Matrix.002 file - promoters60/1447321
aaagaacat

SEQ ID NO: 50830 - DNA, 6 bp, Unknown
  misc_feature (1)..( 6): Matrix.002 file - promoters60/1447321
actaaa

SEQ ID NO: 50831 - DNA, 6 bp, Unknown
  misc_feature (1)..( 6): Matrix.002 file - promoters60/1447321
ttttgt

SEQ ID NO: 50832 - DNA, 6 bp, Unknown
  misc_feature (1)..( 6): Matrix.002 file - promoters60/1447321
tttaga

SEQ ID NO: 50833 - DNA, 6 bp, Unknown
  misc_feature (1)..( 6): Matrix.002 file - promoters60/1447321
ctttta

SEQ ID NO: 50834 - DNA, 6 bp, Unknown
  misc_feature (1)..( 6): Matrix.002 file - promoters60/1447321
aatttg

SEQ ID NO: 50835 - DNA, 9 bp, Unknown
  misc_feature (1)..( 9): Matrix.002 file - promoters60/1447321
tgtaatatt

SEQ ID NO: 50836 - DNA, 6 bp, Unknown
  misc_feature (1)..( 6): Matrix.002 file - promoters60/1447321
ctacat

SEQ ID NO: 50837 - DNA, 7 bp, Unknown
  misc_feature (1)..( 7): Matrix.002 file - promoters60/1447321
aatatat

SEQ ID NO: 50838 - DNA, 6 bp, Unknown
  misc_feature (1)..( 6): Matrix.002 file - promoters60/1447321
tttaat

SEQ ID NO: 50839 - DNA, 10 bp, Unknown
  misc_feature (1)..( 10): Matrix.002 file - promoters60/1447321
aaatgtttgt

SEQ ID NO: 50840 - DNA, 7 bp, Unknown
  misc_feature (1)..( 7): Matrix.002 file - promoters60/1447321
cctcttc

SEQ ID NO: 50841 - DNA, 7 bp, Unknown
  misc_feature (1)..( 7): Matrix.002 file - promoters60/1447352
gaattca

SEQ ID NO: 50842 - DNA, 10 bp, Unknown
  misc_feature (1)..( 10): Matrix.002 file - promoters60/1447352
tttgcgaatt

SEQ ID NO: 50843 - DNA, 9 bp, Unknown
  misc_feature (1)..( 9): Matrix.002 file - promoters60/1447352
ttttgattt

SEQ ID NO: 50844 - DNA, 7 bp, Unknown
  misc_feature (1)..( 7): Matrix.002 file - promoters60/1447352
aagattt

SEQ ID NO: 50845 - DNA, 6 bp, Unknown
  misc_feature (1)..( 6): Matrix.002 file - promoters60/1447352
aaaatt

SEQ ID NO: 50846 - DNA, 7 bp, Unknown
  misc_feature (1)..( 7): Matrix.002 file - promoters60/1447352
ttgcttt

SEQ ID NO: 50847 - DNA, 7 bp, Unknown
  misc_feature (1)..( 7): Matrix.002 file - promoters60/1447352
gaagctt

SEQ ID NO: 50848 - DNA, 6 bp, Unknown
  misc_feature (1)..( 6): Matrix.002 file - promoters60/1447352
atggcg

SEQ ID NO: 50849 - DNA, 9 bp, Unknown
  misc_feature (1)..( 9): Matrix.002 file - promoters60/1447352
ataatcatc

SEQ ID NO: 50850 - DNA, 6 bp, Unknown
  misc_feature (1)..( 6): Matrix.002 file - promoters60/1447352
ttgaat

SEQ ID NO: 50851 - DNA, 11 bp, Unknown
  misc_feature (1)..( 11): Matrix.002 file - promoters60/1447352
attgatttcgt

SEQ ID NO: 50852 - DNA, 8 bp, Unknown
  misc_feature (1)..( 8): Matrix.002 file - promoters60/1447352
aaaaattg

SEQ ID NO: 50853 - DNA, 6 bp, Unknown
  misc_feature (1)..( 6): Matrix.002 file - promoters60/1447352
tcttgt

SEQ ID NO: 50854 - DNA, 8 bp, Unknown
  misc_feature (1)..( 8): Matrix.002 file - promoters60/1447352
atgaccag

SEQ ID NO: 50855 - DNA, 6 bp, Unknown
  misc_feature (1)..( 6): Matrix.002 file - promoters60/1447352
taatat

SEQ ID NO: 50856 - DNA, 7 bp, Unknown
  misc_feature (1)..( 7): Matrix.002 file - promoters60/1447352
ataatgc

SEQ ID NO: 50857 - DNA, 6 bp, Unknown
  misc_feature (1)..( 6): Matrix.002 file - promoters60/1447352
tcatcc

SEQ ID NO: 50858 - DNA, 10 bp, Unknown
  misc_feature (1)..( 10): Matrix.002 file - promoters60/1447352
tccctcgtga

SEQ ID NO: 50859 - DNA, 6 bp, Unknown
  misc_feature (1)..( 6): Matrix.002 file - promoters60/1447352
aaaacc

SEQ ID NO: 50860 - DNA, 6 bp, Unknown
  misc_feature (1)..( 6): Matrix.002 file - promoters60/1447425
tcaatg

SEQ ID NO: 50861 - DNA, 6 bp, Unknown
  misc_feature (1)..( 6): Matrix.002 file - promoters60/1447425
aaaaga

SEQ ID NO: 50862 - DNA, 6 bp, Unknown
  misc_feature (1)..( 6): Matrix.002 file - promoters60/1447425
aatcaa

SEQ ID NO: 50863 - DNA, 7 bp, Unknown
  misc_feature (1)..( 7): Matrix.002 file - promoters60/1447425
atcataa

SEQ ID NO: 50864 - DNA, 8 bp, Unknown
  misc_feature (1)..( 8): Matrix.002 file - promoters60/1447425
ggatgtta

SEQ ID NO: 50865 - DNA, 6 bp, Unknown
  misc_feature (1)..( 6): Matrix.002 file - promoters60/1447425
ctaatg

SEQ ID NO: 50866 - DNA, 10 bp, Unknown
  misc_feature (1)..( 10): Matrix.002 file - promoters60/1447425
aatttgatag

SEQ ID NO: 50867 - DNA, 7 bp, Unknown
  misc_feature (1)..( 7): Matrix.002 file - promoters60/1447425
gatacag

SEQ ID NO: 50868 - DNA, 6 bp, Unknown
  misc_feature (1)..( 6): Matrix.002 file - promoters60/1447425
attcca

SEQ ID NO: 50869 - DNA, 7 bp, Unknown
  misc_feature (1)..( 7): Matrix.002 file - promoters60/1447425
aaacctg

SEQ ID NO: 50870 - DNA, 6 bp, Unknown
  misc_feature (1)..( 6): Matrix.002 file - promoters60/1447425
tttgac

SEQ ID NO: 50871 - DNA, 6 bp, Unknown
  misc_feature (1)..( 6): Matrix.002 file - promoters60/1447425
acggta

SEQ ID NO: 50872 - DNA, 7 bp, Unknown
  misc_feature (1)..( 7): Matrix.002 file - promoters60/1447425
tcaagtt

SEQ ID NO: 50873 - DNA, 6 bp, Unknown
  misc_feature (1)..( 6): Matrix.002 file - promoters60/1447591
tttgat

SEQ ID NO: 50874 - DNA, 10 bp, Unknown
  misc_feature (1)..( 10): Matrix.002 file - promoters60/1447591
acaaacaaaa

SEQ ID NO: 50875 - DNA, 11 bp, Unknown
  misc_feature (1)..( 11): Matrix.002 file - promoters60/1447591
acagacaaaac

SEQ ID NO: 50876 - DNA, 7 bp, Unknown
  misc_feature (1)..( 7): Matrix.002 file - promoters60/1447591
acaaaaa

SEQ ID NO: 50877 - DNA, 12 bp, Unknown
  misc_feature (1)..( 12): Matrix.002 file - promoters60/1447646
taaagaagaaga

SEQ ID NO: 50878 - DNA, 6 bp, Unknown
  misc_feature (1)..( 6): Matrix.002 file - promoters60/1447686
acaaac

SEQ ID NO: 50879 - DNA, 6 bp, Unknown
  misc_feature (1)..( 6): Matrix.002 file - promoters60/1447686
tttgta

SEQ ID NO: 50880 - DNA, 6 bp, Unknown
  misc_feature (1)..( 6): Matrix.002 file - promoters60/1447686
atttta

SEQ ID NO: 50881 - DNA, 7 bp, Unknown
  misc_feature (1)..( 7): Matrix.002 file - promoters60/1447686
agtgctt

SEQ ID NO: 50882 - DNA, 7 bp, Unknown
  misc_feature (1)..( 7): Matrix.002 file - promoters60/1447686
ttaaaaa

SEQ ID NO: 50883 - DNA, 7 bp, Unknown
  misc_feature (1)..( 7): Matrix.002 file - promoters60/1447686
ataaaca

SEQ ID NO: 50884 - DNA, 9 bp, Unknown
  misc_feature (1)..( 9): Matrix.002 file - promoters60/1447686
aatatatgt

SEQ ID NO: 50885 - DNA, 6 bp, Unknown
  misc_feature (1)..( 6): Matrix.002 file - promoters60/1447686
agaatc

SEQ ID NO: 50886 - DNA, 7 bp, Unknown
  misc_feature (1)..( 7): Matrix.002 file - promoters60/1447686
aattaag

SEQ ID NO: 50887 - DNA, 13 bp, Unknown
  misc_feature (1)..( 13): Matrix.002 file - promoters60/1447953
caatctttgtatt

SEQ ID NO: 50888 - DNA, 9 bp, Unknown
  misc_feature (1)..( 9): Matrix.002 file - promoters60/1447953
tattttaga

SEQ ID NO: 50889 - DNA, 9 bp, Unknown
  misc_feature (1)..( 9): Matrix.002 file - promoters60/1447953
attctacat

SEQ ID NO: 50890 - DNA, 8 bp, Unknown
  misc_feature (1)..( 8): Matrix.002 file - promoters60/1447953
aaaaagct

SEQ ID NO: 50891 - DNA, 8 bp, Unknown
  misc_feature (1)..( 8): Matrix.002 file - promoters60/1447953
ttcccttc

SEQ ID NO: 50892 - DNA, 5 bp, Unknown
  misc_feature (1)..( 5): Matrix.002 file - promoters60/1447953
ttata

SEQ ID NO: 50893 - DNA, 10 bp, Unknown
  misc_feature (1)..( 10): Matrix.002 file - promoters60/1447953
tataaaaacc

SEQ ID NO: 50894 - DNA, 9 bp, Unknown
  misc_feature (1)..( 9): Matrix.002 file - promoters60/1447953
atataattt

SEQ ID NO: 50895 - DNA, 13 bp, Unknown
  misc_feature (1)..( 13): Matrix.002 file - promoters60/1448022
aataaaaaaatat

SEQ ID NO: 50896 - DNA, 10 bp, Unknown
  misc_feature (1)..( 10): Matrix.002 file - promoters60/1448022
aacaatgtaa

SEQ ID NO: 50897 - DNA, 10 bp, Unknown
  misc_feature (1)..( 10): Matrix.002 file - promoters60/1448022
atatcaatat

SEQ ID NO: 50898 - DNA, 10 bp, Unknown
  misc_feature (1)..( 10): Matrix.002 file - promoters60/1448022
aattttatat

SEQ ID NO: 50899 - DNA, 9 bp, Unknown
  misc_feature (1)..( 9): Matrix.002 file - promoters60/1448022
aatatgtaa

SEQ ID NO: 50900 - DNA, 12 bp, Unknown
  misc_feature (1)..( 12): Matrix.002 file - promoters60/1448022
tgattaaaaata

SEQ ID NO: 50901 - DNA, 14 bp, Unknown
  misc_feature (1)..( 14): Matrix.002 file - promoters60/1448022
attaagaaaaaaaa

SEQ ID NO: 50902 - DNA, 8 bp, Unknown
  misc_feature (1)..( 8): Matrix.002 file - promoters60/1448022
attgtaat

SEQ ID NO: 50903 - DNA, 8 bp, Unknown
  misc_feature (1)..( 8): Matrix.002 file - promoters60/1448022
atagattt

SEQ ID NO: 50904 - DNA, 9 bp, Unknown
  misc_feature (1)..( 9): Matrix.002 file - promoters60/1448022
caatcacaa

SEQ ID NO: 50905 - DNA, 13 bp, Unknown
  misc_feature (1)..( 13): Matrix.002 file - promoters60/1448022
ctattatttagaa

SEQ ID NO: 50906 - DNA, 15 bp, Unknown
  misc_feature (1)..( 15): Matrix.002 file - promoters60/1448022
aaaaattatttttaa

SEQ ID NO: 50907 - DNA, 7 bp, Unknown
  misc_feature (1)..( 7): Matrix.002 file - promoters60/1448078
tttcttc

SEQ ID NO: 50908 - DNA, 8 bp, Unknown
  misc_feature (1)..( 8): Matrix.002 file - promoters60/1448078
aattagtc

SEQ ID NO: 50909 - DNA, 7 bp, Unknown
  misc_feature (1)..( 7): Matrix.002 file - promoters60/1448078
cataaaa

SEQ ID NO: 50910 - DNA, 6 bp, Unknown
  misc_feature (1)..( 6): Matrix.002 file - promoters60/1448078
aagaag

SEQ ID NO: 50911 - DNA, 6 bp, Unknown
  misc_feature (1)..( 6): Matrix.002 file - promoters60/1448078
ccatct

SEQ ID NO: 50912 - DNA, 6 bp, Unknown
  misc_feature (1)..( 6): Matrix.002 file - promoters60/1448078
tcactt

SEQ ID NO: 50913 - DNA, 6 bp, Unknown
  misc_feature (1)..( 6): Matrix.002 file - promoters60/1448078
tttgat

SEQ ID NO: 50914 - DNA, 6 bp, Unknown
  misc_feature (1)..( 6): Matrix.002 file - promoters60/1448078
ttctct

SEQ ID NO: 50915 - DNA, 6 bp, Unknown
  misc_feature (1)..( 6): Matrix.002 file - promoters60/1448078
ctcttt

SEQ ID NO: 50916 - DNA, 8 bp, Unknown
  misc_feature (1)..( 8): Matrix.002 file - promoters60/1448078
ctctcttt

SEQ ID NO: 50917 - DNA, 5 bp, Unknown
  misc_feature (1)..( 5): Matrix.002 file - promoters60/1448078
ttttg

SEQ ID NO: 50918 - DNA, 6 bp, Unknown
  misc_feature (1)..( 6): Matrix.002 file - promoters60/1448078
tttcca

SEQ ID NO: 50919 - DNA, 6 bp, Unknown
  misc_feature (1)..( 6): Matrix.002 file - promoters60/1448078
aaagat

SEQ ID NO: 50920 - DNA, 6 bp, Unknown
  misc_feature (1)..( 6): Matrix.002 file - promoters60/1448078
ctttaa

SEQ ID NO: 50921 - DNA, 8 bp, Unknown
  misc_feature (1)..( 8): Matrix.002 file - promoters60/1448078
tttcattt

SEQ ID NO: 50922 - DNA, 6 bp, Unknown
  misc_feature (1)..( 6): Matrix.002 file - promoters60/1448078
tcttct

SEQ ID NO: 50923 - DNA, 8 bp, Unknown
  misc_feature (1)..( 8): Matrix.002 file - promoters60/1448078
tttattaa

SEQ ID NO: 50924 - DNA, 10 bp, Unknown
  misc_feature (1)..( 10): Matrix.002 file - promoters60/1448078
aactttactt

SEQ ID NO: 50925 - DNA, 7 bp, Unknown
  misc_feature (1)..( 7): Matrix.002 file - promoters60/1448078
aaaaaaa

SEQ ID NO: 50926 - DNA, 7 bp, Unknown
  misc_feature (1)..( 7): Matrix.002 file - promoters60/1448078
acacaaa

SEQ ID NO: 50927 - DNA, 6 bp, Unknown
  misc_feature (1)..( 6): Matrix.002 file - promoters60/1448078
aaaaat

SEQ ID NO: 50928 - DNA, 9 bp, Unknown
  misc_feature (1)..( 9): Matrix.002 file - promoters60/1448078
aaagaaaaa

SEQ ID NO: 50929 - DNA, 8 bp, Unknown
  misc_feature (1)..( 8): Matrix.002 file - promoters60/1448078
attagata

SEQ ID NO: 50930 - DNA, 7 bp, Unknown
  misc_feature (1)..( 7): Matrix.002 file - promoters60/1448078
attaccc

SEQ ID NO: 50931 - DNA, 6 bp, Unknown
  misc_feature (1)..( 6): Matrix.002 file - promoters60/1448078
aagaga

SEQ ID NO: 50932 - DNA, 8 bp, Unknown
  misc_feature (1)..( 8): Matrix.002 file - promoters60/1448105
ataaataa

SEQ ID NO: 50933 - DNA, 6 bp, Unknown
  misc_feature (1)..( 6): Matrix.002 file - promoters60/1448105
aattat

SEQ ID NO: 50934 - DNA, 6 bp, Unknown
  misc_feature (1)..( 6): Matrix.002 file - promoters60/1448105
tttgtt

SEQ ID NO: 50935 - DNA, 6 bp, Unknown
  misc_feature (1)..( 6): Matrix.002 file - promoters60/1448105
aaattg

SEQ ID NO: 50936 - DNA, 7 bp, Unknown
  misc_feature (1)..( 7): Matrix.002 file - promoters60/1448105
aaaaatt

SEQ ID NO: 50937 - DNA, 6 bp, Unknown
  misc_feature (1)..( 6): Matrix.002 file - promoters60/1448105
tttgat

SEQ ID NO: 50938 - DNA, 6 bp, Unknown
  misc_feature (1)..( 6): Matrix.002 file - promoters60/1448105
tcaaat

SEQ ID NO: 50939 - DNA, 9 bp, Unknown
  misc_feature (1)..( 9): Matrix.002 file - promoters60/1448105
taaatatga

SEQ ID NO: 50940 - DNA, 7 bp, Unknown
  misc_feature (1)..( 7): Matrix.002 file - promoters60/1448105
aatactt

SEQ ID NO: 50941 - DNA, 7 bp, Unknown
  misc_feature (1)..( 7): Matrix.002 file - promoters60/1448105
aaactct

SEQ ID NO: 50942 - DNA, 6 bp, Unknown
  misc_feature (1)..( 6): Matrix.002 file - promoters60/1448105
gttttt

SEQ ID NO: 50943 - DNA, 8 bp, Unknown
  misc_feature (1)..( 8): Matrix.002 file - promoters60/1448105
gaaacaga

SEQ ID NO: 50944 - DNA, 7 bp, Unknown
  misc_feature (1)..( 7): Matrix.002 file - promoters60/1448105
aaagctt

SEQ ID NO: 50945 - DNA, 8 bp, Unknown
  misc_feature (1)..( 8): Matrix.002 file - promoters60/1448105
aatatgat

SEQ ID NO: 50946 - DNA, 7 bp, Unknown
  misc_feature (1)..( 7): Matrix.002 file - promoters60/1448105
ctcaaca

SEQ ID NO: 50947 - DNA, 8 bp, Unknown
  misc_feature (1)..( 8): Matrix.002 file - promoters60/1448105
ataaaaca

SEQ ID NO: 50948 - DNA, 8 bp, Unknown
  misc_feature (1)..( 8): Matrix.002 file - promoters60/1448105
tatatttt

SEQ ID NO: 50949 - DNA, 6 bp, Unknown
  misc_feature (1)..( 6): Matrix.002 file - promoters60/1448105
tatttc

SEQ ID NO: 50950 - DNA, 8 bp, Unknown
  misc_feature (1)..( 8): Matrix.002 file - promoters60/1448105
atcaggaa

SEQ ID NO: 50951 - DNA, 8 bp, Unknown
  misc_feature (1)..( 8): Matrix.002 file - promoters60/1448105
tttaaaag

SEQ ID NO: 50952 - DNA, 6 bp, Unknown
  misc_feature (1)..( 6): Matrix.002 file - promoters60/1448105
aggttt

SEQ ID NO: 50953 - DNA, 9 bp, Unknown
  misc_feature (1)..( 9): Matrix.002 file - promoters60/1448135
aatcctcca

SEQ ID NO: 50954 - DNA, 9 bp, Unknown
  misc_feature (1)..( 9): Matrix.002 file - promoters60/1448135
tgaatgata

SEQ ID NO: 50955 - DNA, 9 bp, Unknown
  misc_feature (1)..( 9): Matrix.002 file - promoters60/1448135
aagaataaa

SEQ ID NO: 50956 - DNA, 9 bp, Unknown
  misc_feature (1)..( 9): Matrix.002 file - promoters60/1448135
tatttaaag

SEQ ID NO: 50957 - DNA, 10 bp, Unknown
  misc_feature (1)..( 10): Matrix.002 file - promoters60/1448185
aaggttggat

SEQ ID NO: 50958 - DNA, 6 bp, Unknown
  misc_feature (1)..( 6): Matrix.002 file - promoters60/1448185
ggataa

SEQ ID NO: 50959 - DNA, 7 bp, Unknown
  misc_feature (1)..( 7): Matrix.002 file - promoters60/1448185
gtaataa

SEQ ID NO: 50960 - DNA, 7 bp, Unknown
  misc_feature (1)..( 7): Matrix.002 file - promoters60/1448185
gatcctc

SEQ ID NO: 50961 - DNA, 9 bp, Unknown
  misc_feature (1)..( 9): Matrix.002 file - promoters60/1448185
atctcgatt

SEQ ID NO: 50962 - DNA, 7 bp, Unknown
  misc_feature (1)..( 7): Matrix.002 file - promoters60/1448185
aaagctt

SEQ ID NO: 50963 - DNA, 6 bp, Unknown
  misc_feature (1)..( 6): Matrix.002 file - promoters60/1448185
atctac

SEQ ID NO: 50964 - DNA, 7 bp, Unknown
  misc_feature (1)..( 7): Matrix.002 file - promoters60/1448185
tcataat

SEQ ID NO: 50965 - DNA, 6 bp, Unknown
  misc_feature (1)..( 6): Matrix.002 file - promoters60/1448185
attgtt

SEQ ID NO: 50966 - DNA, 9 bp, Unknown
  misc_feature (1)..( 9): Matrix.002 file - promoters60/1448231
tcaaatttg

SEQ ID NO: 50967 - DNA, 7 bp, Unknown
  misc_feature (1)..( 7): Matrix.002 file - promoters60/1448231
aaatcag

SEQ ID NO: 50968 - DNA, 9 bp, Unknown
  misc_feature (1)..( 9): Matrix.002 file - promoters60/1448231
attctaaac

SEQ ID NO: 50969 - DNA, 10 bp, Unknown
  misc_feature (1)..( 10): Matrix.002 file - promoters60/1448231
taaaagaatc

SEQ ID NO: 50970 - DNA, 13 bp, Unknown
  misc_feature (1)..( 13): Matrix.002 file - promoters60/1448231
tatgaatcagcta

SEQ ID NO: 50971 - DNA, 8 bp, Unknown
  misc_feature (1)..( 8): Matrix.002 file - promoters60/1448231
caaaagag

SEQ ID NO: 50972 - DNA, 10 bp, Unknown
  misc_feature (1)..( 10): Matrix.002 file - promoters60/1448231
tgtttgattt

SEQ ID NO: 50973 - DNA, 11 bp, Unknown
  misc_feature (1)..( 11): Matrix.002 file - promoters60/1448231
ttttgctaaaa

SEQ ID NO: 50974 - DNA, 10 bp, Unknown
  misc_feature (1)..( 10): Matrix.002 file - promoters60/1448231
aacagagtaa

SEQ ID NO: 50975 - DNA, 9 bp, Unknown
  misc_feature (1)..( 9): Matrix.002 file - promoters60/1448235
cttctgttt

SEQ ID NO: 50976 - DNA, 12 bp, Unknown
  misc_feature (1)..( 12): Matrix.002 file - promoters60/1448235
tttcatctatct

SEQ ID NO: 50977 - DNA, 11 bp, Unknown
  misc_feature (1)..( 11): Matrix.002 file - promoters60/1448235
caattcgatat

SEQ ID NO: 50978 - DNA, 6 bp, Unknown
  misc_feature (1)..( 6): Matrix.002 file - promoters60/1448235
gttttt

SEQ ID NO: 50979 - DNA, 6 bp, Unknown
  misc_feature (1)..( 6): Matrix.002 file - promoters60/1448235
tataaa

SEQ ID NO: 50980 - DNA, 13 bp, Unknown
  misc_feature (1)..( 13): Matrix.002 file - promoters60/1448235
aaattaaaactta

SEQ ID NO: 50981 - DNA, 6 bp, Unknown
  misc_feature (1)..( 6): Matrix.002 file - promoters60/1448235
tttttt

SEQ ID NO: 50982 - DNA, 8 bp, Unknown
  misc_feature (1)..( 8): Matrix.002 file - promoters60/1448235
acaaataa

SEQ ID NO: 50983 - DNA, 7 bp, Unknown
  misc_feature (1)..( 7): Matrix.002 file - promoters60/1448235
tttgacc

SEQ ID NO: 50984 - DNA, 8 bp, Unknown
  misc_feature (1)..( 8): Matrix.002 file - promoters60/1448235
tcaaatct

SEQ ID NO: 50985 - DNA, 8 bp, Unknown
  misc_feature (1)..( 8): Matrix.002 file - promoters60/1448235
atctaaag

SEQ ID NO: 50986 - DNA, 6 bp, Unknown
  misc_feature (1)..( 6): Matrix.002 file - promoters60/1448235
caatct

SEQ ID NO: 50987 - DNA, 8 bp, Unknown
  misc_feature (1)..( 8): Matrix.002 file - promoters60/1448235
agacgaag

SEQ ID NO: 50988 - DNA, 6 bp, Unknown
  misc_feature (1)..( 6): Matrix.002 file - promoters60/1448235
atctac

SEQ ID NO: 50989 - DNA, 7 bp, Unknown
  misc_feature (1)..( 7): Matrix.002 file - promoters60/1448235
ttttttt

SEQ ID NO: 50990 - DNA, 9 bp, Unknown
  misc_feature (1)..( 9): Matrix.002 file - promoters60/1448251
aaaataatc

SEQ ID NO: 50991 - DNA, 9 bp, Unknown
  misc_feature (1)..( 9): Matrix.002 file - promoters60/1448251
ctaagtttt

SEQ ID NO: 50992 - DNA, 10 bp, Unknown
  misc_feature (1)..( 10): Matrix.002 file - promoters60/1448251
aaaaaaaaat

SEQ ID NO: 50993 - DNA, 7 bp, Unknown
  misc_feature (1)..( 7): Matrix.002 file - promoters60/1448251
agtatat

SEQ ID NO: 50994 - DNA, 7 bp, Unknown
  misc_feature (1)..( 7): Matrix.002 file - promoters60/1448251
agacaaa

SEQ ID NO: 50995 - DNA, 8 bp, Unknown
  misc_feature (1)..( 8): Matrix.002 file - promoters60/1448251
aaaaaatt

SEQ ID NO: 50996 - DNA, 9 bp, Unknown
  misc_feature (1)..( 9): Matrix.002 file - promoters60/1448251
tattattag

SEQ ID NO: 50997 - DNA, 8 bp, Unknown
  misc_feature (1)..( 8): Matrix.002 file - promoters60/1448251
tttagatg

SEQ ID NO: 50998 - DNA, 7 bp, Unknown
  misc_feature (1)..( 7): Matrix.002 file - promoters60/1448251
ggaataa

SEQ ID NO: 50999 - DNA, 7 bp, Unknown
  misc_feature (1)..( 7): Matrix.002 file - promoters60/1448251
ataatta

SEQ ID NO: 51000 - DNA, 11 bp, Unknown
  misc_feature (1)..( 11): Matrix.002 file - promoters60/1448251
ataaactaaaa

SEQ ID NO: 51001 - DNA, 9 bp, Unknown
  misc_feature (1)..( 9): Matrix.002 file - promoters60/1448251
aaaaaacat

SEQ ID NO: 51002 - DNA, 6 bp, Unknown
  misc_feature (1)..( 6): Matrix.002 file - promoters60/1448251
atttta

SEQ ID NO: 51003 - DNA, 6 bp, Unknown
  misc_feature (1)..( 6): Matrix.002 file - promoters60/1448251
ttttat

SEQ ID NO: 51004 - DNA, 7 bp, Unknown
  misc_feature (1)..( 7): Matrix.002 file - promoters60/1448251
tcactta

SEQ ID NO: 51005 - DNA, 6 bp, Unknown
  misc_feature (1)..( 6): Matrix.002 file - promoters60/1448251
aaattt

SEQ ID NO: 51006 - DNA, 7 bp, Unknown
  misc_feature (1)..( 7): Matrix.002 file - promoters60/1448251
attttaa

SEQ ID NO: 51007 - DNA, 10 bp, Unknown
  misc_feature (1)..( 10): Matrix.002 file - promoters60/1448251
ttaaataaaa

SEQ ID NO: 51008 - DNA, 6 bp, Unknown
  misc_feature (1)..( 6): Matrix.002 file - promoters60/1448251
tggatt

SEQ ID NO: 51009 - DNA, 6 bp, Unknown
  misc_feature (1)..( 6): Matrix.002 file - promoters60/1448251
tttgtt

SEQ ID NO: 51010 - DNA, 6 bp, Unknown
  misc_feature (1)..( 6): Matrix.002 file - promoters60/1448251
aaaaat

SEQ ID NO: 51011 - DNA, 6 bp, Unknown
  misc_feature (1)..( 6): Matrix.002 file - promoters60/1448251
aagaga

SEQ ID NO: 51012 - DNA, 6 bp, Unknown
  misc_feature (1)..( 6): Matrix.002 file - promoters60/1448251
tttttt

SEQ ID NO: 51013 - DNA, 7 bp, Unknown
  misc_feature (1)..( 7): Matrix.002 file - promoters60/1448251
aaaccca

SEQ ID NO: 51014 - DNA, 7 bp, Unknown
  misc_feature (1)..( 7): Matrix.002 file - promoters60/1448251
ataaata

SEQ ID NO: 51015 - DNA, 14 bp, Unknown
  misc_feature (1)..( 14): Matrix.002 file - promoters60/1450099
tcacatttaatgaa

SEQ ID NO: 51016 - DNA, 10 bp, Unknown
  misc_feature (1)..( 10): Matrix.002 file - promoters60/1450137
ttaaattttg

SEQ ID NO: 51017 - DNA, 11 bp, Unknown
  misc_feature (1)..( 11): Matrix.002 file - promoters60/1450137
cactttttaaa

SEQ ID NO: 51018 - DNA, 8 bp, Unknown
  misc_feature (1)..( 8): Matrix.002 file - promoters60/1450204
caaagctc

SEQ ID NO: 51019 - DNA, 13 bp, Unknown
  misc_feature (1)..( 13): Matrix.002 file - promoters60/1450204
catttgaatgcta

SEQ ID NO: 51020 - DNA, 8 bp, Unknown
  misc_feature (1)..( 8): Matrix.002 file - promoters60/1450224
gtaaacat

SEQ ID NO: 51021 - DNA, 6 bp, Unknown
  misc_feature (1)..( 6): Matrix.002 file - promoters60/1450224
acatat

SEQ ID NO: 51022 - DNA, 7 bp, Unknown
  misc_feature (1)..( 7): Matrix.002 file - promoters60/1450224
ttttcta

SEQ ID NO: 51023 - DNA, 7 bp, Unknown
  misc_feature (1)..( 7): Matrix.002 file - promoters60/1450224
ccaattc

SEQ ID NO: 51024 - DNA, 8 bp, Unknown
  misc_feature (1)..( 8): Matrix.002 file - promoters60/1450224
aaaagaaa

SEQ ID NO: 51025 - DNA, 7 bp, Unknown
  misc_feature (1)..( 7): Matrix.002 file - promoters60/1450224
tatttta

SEQ ID NO: 51026 - DNA, 7 bp, Unknown
  misc_feature (1)..( 7): Matrix.002 file - promoters60/1450224
taaaata

SEQ ID NO: 51027 - DNA, 6 bp, Unknown
  misc_feature (1)..( 6): Matrix.002 file - promoters60/1450224
aagtta

SEQ ID NO: 51028 - DNA, 9 bp, Unknown
  misc_feature (1)..( 9): Matrix.002 file - promoters60/1450224
atttttaat

SEQ ID NO: 51029 - DNA, 8 bp, Unknown
  misc_feature (1)..( 8): Matrix.002 file - promoters60/1450224
aaaaaaag

SEQ ID NO: 51030 - DNA, 9 bp, Unknown
  misc_feature (1)..( 9): Matrix.002 file - promoters60/1450224
aaaataatc

SEQ ID NO: 51031 - DNA, 7 bp, Unknown
  misc_feature (1)..( 7): Matrix.002 file - promoters60/1450224
aatagat

SEQ ID NO: 51032 - DNA, 8 bp, Unknown
  misc_feature (1)..( 8): Matrix.002 file - promoters60/1450224
gaaaacaa

SEQ ID NO: 51033 - DNA, 7 bp, Unknown
  misc_feature (1)..( 7): Matrix.002 file - promoters60/1450224
aaaccaa

SEQ ID NO: 51034 - DNA, 8 bp, Unknown
  misc_feature (1)..( 8): Matrix.002 file - promoters60/1450224
tttcagta

SEQ ID NO: 51035 - DNA, 7 bp, Unknown
  misc_feature (1)..( 7): Matrix.002 file - promoters60/1450224
aaagtct

SEQ ID NO: 51036 - DNA, 6 bp, Unknown
  misc_feature (1)..( 6): Matrix.002 file - promoters60/1450224
aaaatc

SEQ ID NO: 51037 - DNA, 7 bp, Unknown
  misc_feature (1)..( 7): Matrix.002 file - promoters60/1450224
cttgcta

SEQ ID NO: 51038 - DNA, 7 bp, Unknown
  misc_feature (1)..( 7): Matrix.002 file - promoters60/1450224
ataaaaa

SEQ ID NO: 51039 - DNA, 8 bp, Unknown
  misc_feature (1)..( 8): Matrix.002 file - promoters60/1450309
aaagaaag

SEQ ID NO: 51040 - DNA, 6 bp, Unknown
  misc_feature (1)..( 6): Matrix.002 file - promoters60/1450309
ttgttt

SEQ ID NO: 51041 - DNA, 6 bp, Unknown
  misc_feature (1)..( 6): Matrix.002 file - promoters60/1450309
aagtcc

SEQ ID NO: 51042 - DNA, 7 bp, Unknown
  misc_feature (1)..( 7): Matrix.002 file - promoters60/1450309
aagtctt

SEQ ID NO: 51043 - DNA, 6 bp, Unknown
  misc_feature (1)..( 6): Matrix.002 file - promoters60/1450309
tcttca

SEQ ID NO: 51044 - DNA, 6 bp, Unknown
  misc_feature (1)..( 6): Matrix.002 file - promoters60/1450309
tcctgg

SEQ ID NO: 51045 - DNA, 8 bp, Unknown
  misc_feature (1)..( 8): Matrix.002 file - promoters60/1450309
ctagaaag

SEQ ID NO: 51046 - DNA, 6 bp, Unknown
  misc_feature (1)..( 6): Matrix.002 file - promoters60/1450309
gagata

SEQ ID NO: 51047 - DNA, 6 bp, Unknown
  misc_feature (1)..( 6): Matrix.002 file - promoters60/1450309
caagac

SEQ ID NO: 51048 - DNA, 7 bp, Unknown
  misc_feature (1)..( 7): Matrix.002 file - promoters60/1450309
taatatt

SEQ ID NO: 51049 - DNA, 8 bp, Unknown
  misc_feature (1)..( 8): Matrix.002 file - promoters60/1450309
ttttgagt

SEQ ID NO: 51050 - DNA, 7 bp, Unknown
  misc_feature (1)..( 7): Matrix.002 file - promoters60/1450309
tattttt

SEQ ID NO: 51051 - DNA, 6 bp, Unknown
  misc_feature (1)..( 6): Matrix.002 file - promoters60/1450309
agattt

SEQ ID NO: 51052 - DNA, 9 bp, Unknown
  misc_feature (1)..( 9): Matrix.002 file - promoters60/1450309
attataata

SEQ ID NO: 51053 - DNA, 6 bp, Unknown
  misc_feature (1)..( 6): Matrix.002 file - promoters60/1450309
cattaa

SEQ ID NO: 51054 - DNA, 8 bp, Unknown
  misc_feature (1)..( 8): Matrix.002 file - promoters60/1450309
aatgatct

SEQ ID NO: 51055 - DNA, 7 bp, Unknown
  misc_feature (1)..( 7): Matrix.002 file - promoters60/1450309
tttacca

SEQ ID NO: 51056 - DNA, 7 bp, Unknown
  misc_feature (1)..( 7): Matrix.002 file - promoters60/1450309
tcaactc

SEQ ID NO: 51057 - DNA, 9 bp, Unknown
  misc_feature (1)..( 9): Matrix.002 file - promoters60/1450309
attaaccga

SEQ ID NO: 51058 - DNA, 6 bp, Unknown
  misc_feature (1)..( 6): Matrix.002 file - promoters60/1450309
tttttt

SEQ ID NO: 51059 - DNA, 7 bp, Unknown
  misc_feature (1)..( 7): Matrix.002 file - promoters60/1450309
tatttct

SEQ ID NO: 51060 - DNA, 6 bp, Unknown
  misc_feature (1)..( 6): Matrix.002 file - promoters60/1450309
tgactt

SEQ ID NO: 51061 - DNA, 7 bp, Unknown
  misc_feature (1)..( 7): Matrix.002 file - promoters60/1450321
gtaaagt

SEQ ID NO: 51062 - DNA, 6 bp, Unknown
  misc_feature (1)..( 6): Matrix.002 file - promoters60/1450321
ttttga

SEQ ID NO: 51063 - DNA, 8 bp, Unknown
  misc_feature (1)..( 8): Matrix.002 file - promoters60/1450321
atttgtag

SEQ ID NO: 51064 - DNA, 7 bp, Unknown
  misc_feature (1)..( 7): Matrix.002 file - promoters60/1450321
ttaattt

SEQ ID NO: 51065 - DNA, 7 bp, Unknown
  misc_feature (1)..( 7): Matrix.002 file - promoters60/1450321
gacctct

SEQ ID NO: 51066 - DNA, 6 bp, Unknown
  misc_feature (1)..( 6): Matrix.002 file - promoters60/1450321
tgagct

SEQ ID NO: 51067 - DNA, 8 bp, Unknown
  misc_feature (1)..( 8): Matrix.002 file - promoters60/1450321
gcttactc

SEQ ID NO: 51068 - DNA, 8 bp, Unknown
  misc_feature (1)..( 8): Matrix.002 file - promoters60/1450321
ttagctca

SEQ ID NO: 51069 - DNA, 7 bp, Unknown
  misc_feature (1)..( 7): Matrix.002 file - promoters60/1450321
actcgta

SEQ ID NO: 51070 - DNA, 9 bp, Unknown
  misc_feature (1)..( 9): Matrix.002 file - promoters60/1450321
tgaaaaact

SEQ ID NO: 51071 - DNA, 8 bp, Unknown
  misc_feature (1)..( 8): Matrix.002 file - promoters60/1450321
aatcaagt

SEQ ID NO: 51072 - DNA, 7 bp, Unknown
  misc_feature (1)..( 7): Matrix.002 file - promoters60/1450321
caaaaaa

SEQ ID NO: 51073 - DNA, 6 bp, Unknown
  misc_feature (1)..( 6): Matrix.002 file - promoters60/1450357
aatact

SEQ ID NO: 51074 - DNA, 8 bp, Unknown
  misc_feature (1)..( 8): Matrix.002 file - promoters60/1450357
atatataa

SEQ ID NO: 51075 - DNA, 11 bp, Unknown
  misc_feature (1)..( 11): Matrix.002 file - promoters60/1450357
tttctttattt

SEQ ID NO: 51076 - DNA, 7 bp, Unknown
  misc_feature (1)..( 7): Matrix.002 file - promoters60/1450357
attatca

SEQ ID NO: 51077 - DNA, 7 bp, Unknown
  misc_feature (1)..( 7): Matrix.002 file - promoters60/1450357
tagaaaa

SEQ ID NO: 51078 - DNA, 7 bp, Unknown
  misc_feature (1)..( 7): Matrix.002 file - promoters60/1450357
atggatg

SEQ ID NO: 51079 - DNA, 12 bp, Unknown
  misc_feature (1)..( 12): Matrix.002 file - promoters60/1450357
taaggcaaattt

SEQ ID NO: 51080 - DNA, 8 bp, Unknown
  misc_feature (1)..( 8): Matrix.002 file - promoters60/1450357
tattaaaa

SEQ ID NO: 51081 - DNA, 10 bp, Unknown
  misc_feature (1)..( 10): Matrix.002 file - promoters60/1450357
tttatacaat

SEQ ID NO: 51082 - DNA, 6 bp, Unknown
  misc_feature (1)..( 6): Matrix.002 file - promoters60/1450357
agaaaa

SEQ ID NO: 51083 - DNA, 8 bp, Unknown
  misc_feature (1)..( 8): Matrix.002 file - promoters60/1450357
aaaaaata

SEQ ID NO: 51084 - DNA, 6 bp, Unknown
  misc_feature (1)..( 6): Matrix.002 file - promoters60/1450357
ctaaac

SEQ ID NO: 51085 - DNA, 6 bp, Unknown
  misc_feature (1)..( 6): Matrix.002 file - promoters60/1450357
caaaat

SEQ ID NO: 51086 - DNA, 6 bp, Unknown
  misc_feature (1)..( 6): Matrix.002 file - promoters60/1450357
ccatac

SEQ ID NO: 51087 - DNA, 6 bp, Unknown
  misc_feature (1)..( 6): Matrix.002 file - promoters60/1450357
cacgtg

SEQ ID NO: 51088 - DNA, 8 bp, Unknown
  misc_feature (1)..( 8): Matrix.002 file - promoters60/1450357
atgccagc

SEQ ID NO: 51089 - DNA, 7 bp, Unknown
  misc_feature (1)..( 7): Matrix.002 file - promoters60/1450357
gtgagat

SEQ ID NO: 51090 - DNA, 7 bp, Unknown
  misc_feature (1)..( 7): Matrix.002 file - promoters60/1450357
gaagaga

SEQ ID NO: 51091 - DNA, 7 bp, Unknown
  misc_feature (1)..( 7): Matrix.002 file - promoters60/1450473
aacattc

SEQ ID NO: 51092 - DNA, 8 bp, Unknown
  misc_feature (1)..( 8): Matrix.002 file - promoters60/1450473
aaaaaaaa

SEQ ID NO: 51093 - DNA, 8 bp, Unknown
  misc_feature (1)..( 8): Matrix.002 file - promoters60/1450473
gaacaaca

SEQ ID NO: 51094 - DNA, 6 bp, Unknown
  misc_feature (1)..( 6): Matrix.002 file - promoters60/1450473
gaagaa

SEQ ID NO: 51095 - DNA, 8 bp, Unknown
  misc_feature (1)..( 8): Matrix.002 file - promoters60/1450473
agagtttg

SEQ ID NO: 51096 - DNA, 7 bp, Unknown
  misc_feature (1)..( 7): Matrix.002 file - promoters60/1450473
aaaatgt

SEQ ID NO: 51097 - DNA, 8 bp, Unknown
  misc_feature (1)..( 8): Matrix.002 file - promoters60/1450473
aatctgct

SEQ ID NO: 51098 - DNA, 6 bp, Unknown
  misc_feature (1)..( 6): Matrix.002 file - promoters60/1450473
aatatt

SEQ ID NO: 51099 - DNA, 7 bp, Unknown
  misc_feature (1)..( 7): Matrix.002 file - promoters60/1450473
aatgaga

SEQ ID NO: 51100 - DNA, 7 bp, Unknown
  misc_feature (1)..( 7): Matrix.002 file - promoters60/1450473
gaacaaa

SEQ ID NO: 51101 - DNA, 6 bp, Unknown
  misc_feature (1)..( 6): Matrix.002 file - promoters60/1450473
aaatca

SEQ ID NO: 51102 - DNA, 7 bp, Unknown
  misc_feature (1)..( 7): Matrix.002 file - promoters60/1450473
cagaact

SEQ ID NO: 51103 - DNA, 7 bp, Unknown
  misc_feature (1)..( 7): Matrix.002 file - promoters60/1450477
aatgaaa

SEQ ID NO: 51104 - DNA, 9 bp, Unknown
  misc_feature (1)..( 9): Matrix.002 file - promoters60/1450477
aagcactta

SEQ ID NO: 51105 - DNA, 9 bp, Unknown
  misc_feature (1)..( 9): Matrix.002 file - promoters60/1450477
atctctatt

SEQ ID NO: 51106 - DNA, 6 bp, Unknown
  misc_feature (1)..( 6): Matrix.002 file - promoters60/1450477
caaaag

SEQ ID NO: 51107 - DNA, 7 bp, Unknown
  misc_feature (1)..( 7): Matrix.002 file - promoters60/1450477
ttaaaat

SEQ ID NO: 51108 - DNA, 6 bp, Unknown
  misc_feature (1)..( 6): Matrix.002 file - promoters60/1450477
tatata

SEQ ID NO: 51109 - DNA, 7 bp, Unknown
  misc_feature (1)..( 7): Matrix.002 file - promoters60/1450477
aaagtgt

SEQ ID NO: 51110 - DNA, 7 bp, Unknown
  misc_feature (1)..( 7): Matrix.002 file - promoters60/1450477
tccatta

SEQ ID NO: 51111 - DNA, 9 bp, Unknown
  misc_feature (1)..( 9): Matrix.002 file - promoters60/1450477
taattgaag

SEQ ID NO: 51112 - DNA, 6 bp, Unknown
  misc_feature (1)..( 6): Matrix.002 file - promoters60/1450477
aaagaa

SEQ ID NO: 51113 - DNA, 7 bp, Unknown
  misc_feature (1)..( 7): Matrix.002 file - promoters60/1450477
tagagaa

SEQ ID NO: 51114 - DNA, 7 bp, Unknown
  misc_feature (1)..( 7): Matrix.002 file - promoters60/1450477
aaggaga

SEQ ID NO: 51115 - DNA, 7 bp, Unknown
  misc_feature (1)..( 7): Matrix.002 file - promoters60/1450477
aaagaag

SEQ ID NO: 51116 - DNA, 6 bp, Unknown
  misc_feature (1)..( 6): Matrix.002 file - promoters60/1450477
caaaag

SEQ ID NO: 51117 - DNA, 6 bp, Unknown
  misc_feature (1)..( 6): Matrix.002 file - promoters60/1450477
caacac

SEQ ID NO: 51118 - DNA, 8 bp, Unknown
  misc_feature (1)..( 8): Matrix.002 file - promoters60/1450610
ataatata

SEQ ID NO: 51119 - DNA, 8 bp, Unknown
  misc_feature (1)..( 8): Matrix.002 file - promoters60/1450610
tatagaat

SEQ ID NO: 51120 - DNA, 10 bp, Unknown
  misc_feature (1)..( 10): Matrix.002 file - promoters60/1450610
aatctgattc

SEQ ID NO: 51121 - DNA, 12 bp, Unknown
  misc_feature (1)..( 12): Matrix.002 file - promoters60/1450610
ttatcaaaatta

SEQ ID NO: 51122 - DNA, 9 bp, Unknown
  misc_feature (1)..( 9): Matrix.002 file - promoters60/1450610
taaacatat

SEQ ID NO: 51123 - DNA, 9 bp, Unknown
  misc_feature (1)..( 9): Matrix.002 file - promoters60/1450610
aatcataaa

SEQ ID NO: 51124 - DNA, 10 bp, Unknown
  misc_feature (1)..( 10): Matrix.002 file - promoters60/1450610
aatcataaaa

SEQ ID NO: 51125 - DNA, 10 bp, Unknown
  misc_feature (1)..( 10): Matrix.002 file - promoters60/1450610
aaaaaaaata

SEQ ID NO: 51126 - DNA, 11 bp, Unknown
  misc_feature (1)..( 11): Matrix.002 file - promoters60/1450625
aattttgataa

SEQ ID NO: 51127 - DNA, 8 bp, Unknown
  misc_feature (1)..( 8): Matrix.002 file - promoters60/1450625
atatatct

SEQ ID NO: 51128 - DNA, 11 bp, Unknown
  misc_feature (1)..( 11): Matrix.002 file - promoters60/1450625
tttattcagct

SEQ ID NO: 51129 - DNA, 8 bp, Unknown
  misc_feature (1)..( 8): Matrix.002 file - promoters60/1450682
tcacattt

SEQ ID NO: 51130 - DNA, 6 bp, Unknown
  misc_feature (1)..( 6): Matrix.002 file - promoters60/1450682
aaaaaa

SEQ ID NO: 51131 - DNA, 8 bp, Unknown
  misc_feature (1)..( 8): Matrix.002 file - promoters60/1450682
aaatagta

SEQ ID NO: 51132 - DNA, 8 bp, Unknown
  misc_feature (1)..( 8): Matrix.002 file - promoters60/1450682
atatatac

SEQ ID NO: 51133 - DNA, 10 bp, Unknown
  misc_feature (1)..( 10): Matrix.002 file - promoters60/1450682
ataattaaaa

SEQ ID NO: 51134 - DNA, 6 bp, Unknown
  misc_feature (1)..( 6): Matrix.002 file - promoters60/1450682
aaacac

SEQ ID NO: 51135 - DNA, 7 bp, Unknown
  misc_feature (1)..( 7): Matrix.002 file - promoters60/1450682
ataaaat

SEQ ID NO: 51136 - DNA, 6 bp, Unknown
  misc_feature (1)..( 6): Matrix.002 file - promoters60/1450682
tagttt

SEQ ID NO: 51137 - DNA, 8 bp, Unknown
  misc_feature (1)..( 8): Matrix.002 file - promoters60/1450682
taaatttt

SEQ ID NO: 51138 - DNA, 8 bp, Unknown
  misc_feature (1)..( 8): Matrix.002 file - promoters60/1450682
tttttaat

SEQ ID NO: 51139 - DNA, 6 bp, Unknown
  misc_feature (1)..( 6): Matrix.002 file - promoters60/1450682
tcatat

SEQ ID NO: 51140 - DNA, 7 bp, Unknown
  misc_feature (1)..( 7): Matrix.002 file - promoters60/1450682
ttaggtg

SEQ ID NO: 51141 - DNA, 6 bp, Unknown
  misc_feature (1)..( 6): Matrix.002 file - promoters60/1450682
ttcaaa

SEQ ID NO: 51142 - DNA, 6 bp, Unknown
  misc_feature (1)..( 6): Matrix.002 file - promoters60/1450792
gttttt

SEQ ID NO: 51143 - DNA, 11 bp, Unknown
  misc_feature (1)..( 11): Matrix.002 file - promoters60/1450792
aactacaattt

SEQ ID NO: 51144 - DNA, 6 bp, Unknown
  misc_feature (1)..( 6): Matrix.002 file - promoters60/1450792
tctttt

SEQ ID NO: 51145 - DNA, 7 bp, Unknown
  misc_feature (1)..( 7): Matrix.002 file - promoters60/1450792
aacaatc

SEQ ID NO: 51146 - DNA, 8 bp, Unknown
  misc_feature (1)..( 8): Matrix.002 file - promoters60/1450792
aataccaa

SEQ ID NO: 51147 - DNA, 6 bp, Unknown
  misc_feature (1)..( 6): Matrix.002 file - promoters60/1450792
tttttt

SEQ ID NO: 51148 - DNA, 6 bp, Unknown
  misc_feature (1)..( 6): Matrix.002 file - promoters60/1450792
tttctt

SEQ ID NO: 51149 - DNA, 8 bp, Unknown
  misc_feature (1)..( 8): Matrix.002 file - promoters60/1450792
aataactt

SEQ ID NO: 51150 - DNA, 6 bp, Unknown
  misc_feature (1)..( 6): Matrix.002 file - promoters60/1450792
tctttt

SEQ ID NO: 51151 - DNA, 8 bp, Unknown
  misc_feature (1)..( 8): Matrix.002 file - promoters60/1450792
tgagcttt

SEQ ID NO: 51152 - DNA, 7 bp, Unknown
  misc_feature (1)..( 7): Matrix.002 file - promoters60/1450792
ccaaatt

SEQ ID NO: 51153 - DNA, 7 bp, Unknown
  misc_feature (1)..( 7): Matrix.002 file - promoters60/1450792
tttatat

SEQ ID NO: 51154 - DNA, 8 bp, Unknown
  misc_feature (1)..( 8): Matrix.002 file - promoters60/1450792
aaaaagaa

SEQ ID NO: 51155 - DNA, 6 bp, Unknown
  misc_feature (1)..( 6): Matrix.002 file - promoters60/1450792
agggtc

SEQ ID NO: 51156 - DNA, 6 bp, Unknown
  misc_feature (1)..( 6): Matrix.002 file - promoters60/1450792
tgcttt

SEQ ID NO: 51157 - DNA, 6 bp, Unknown
  misc_feature (1)..( 6): Matrix.002 file - promoters60/1450792
tttatt

SEQ ID NO: 51158 - DNA, 6 bp, Unknown
  misc_feature (1)..( 6): Matrix.002 file - promoters60/1450792
caacaa

SEQ ID NO: 51159 - DNA, 6 bp, Unknown
  misc_feature (1)..( 6): Matrix.002 file - promoters60/1450792
gaaaca

SEQ ID NO: 51160 - DNA, 8 bp, Unknown
  misc_feature (1)..( 8): Matrix.002 file - promoters60/1450792
aaaataag

SEQ ID NO: 51161 - DNA, 8 bp, Unknown
  misc_feature (1)..( 8): Matrix.002 file - promoters60/1450807
taaaaaca

SEQ ID NO: 51162 - DNA, 10 bp, Unknown
  misc_feature (1)..( 10): Matrix.002 file - promoters60/1450807
aaacgaatca

SEQ ID NO: 51163 - DNA, 9 bp, Unknown
  misc_feature (1)..( 9): Matrix.002 file - promoters60/1450811
aaagattgt

SEQ ID NO: 51164 - DNA, 8 bp, Unknown
  misc_feature (1)..( 8): Matrix.002 file - promoters60/1450811
ttacaaaa

SEQ ID NO: 51165 - DNA, 9 bp, Unknown
  misc_feature (1)..( 9): Matrix.002 file - promoters60/1450811
agatactta

SEQ ID NO: 51166 - DNA, 8 bp, Unknown
  misc_feature (1)..( 8): Matrix.002 file - promoters60/1450811
ccattaat

SEQ ID NO: 51167 - DNA, 8 bp, Unknown
  misc_feature (1)..( 8): Matrix.002 file - promoters60/1450811
tagttttg

SEQ ID NO: 51168 - DNA, 10 bp, Unknown
  misc_feature (1)..( 10): Matrix.002 file - promoters60/1450811
tcttaatatg

SEQ ID NO: 51169 - DNA, 12 bp, Unknown
  misc_feature (1)..( 12): Matrix.002 file - promoters60/1450863
atggacttgtta

SEQ ID NO: 51170 - DNA, 7 bp, Unknown
  misc_feature (1)..( 7): Matrix.002 file - promoters60/1450863
actatgt

SEQ ID NO: 51171 - DNA, 6 bp, Unknown
  misc_feature (1)..( 6): Matrix.002 file - promoters60/1450863
tgagga

SEQ ID NO: 51172 - DNA, 7 bp, Unknown
  misc_feature (1)..( 7): Matrix.002 file - promoters60/1450863
attagtt

SEQ ID NO: 51173 - DNA, 8 bp, Unknown
  misc_feature (1)..( 8): Matrix.002 file - promoters60/1450863
ttagtgat

SEQ ID NO: 51174 - DNA, 7 bp, Unknown
  misc_feature (1)..( 7): Matrix.002 file - promoters60/1450863
tcaaact

SEQ ID NO: 51175 - DNA, 9 bp, Unknown
  misc_feature (1)..( 9): Matrix.002 file - promoters60/1450863
tgtggtttc

SEQ ID NO: 51176 - DNA, 7 bp, Unknown
  misc_feature (1)..( 7): Matrix.002 file - promoters60/1450863
aatgttc

SEQ ID NO: 51177 - DNA, 7 bp, Unknown
  misc_feature (1)..( 7): Matrix.002 file - promoters60/1450863
gaaaaag

SEQ ID NO: 51178 - DNA, 6 bp, Unknown
  misc_feature (1)..( 6): Matrix.002 file - promoters60/1455879
attaca

SEQ ID NO: 51179 - DNA, 6 bp, Unknown
  misc_feature (1)..( 6): Matrix.002 file - promoters60/1455879
tgatta

SEQ ID NO: 51180 - DNA, 6 bp, Unknown
  misc_feature (1)..( 6): Matrix.002 file - promoters60/1455879
aaagtt

SEQ ID NO: 51181 - DNA, 8 bp, Unknown
  misc_feature (1)..( 8): Matrix.002 file - promoters60/1455879
agaagatt

SEQ ID NO: 51182 - DNA, 8 bp, Unknown
  misc_feature (1)..( 8): Matrix.002 file - promoters60/1455879
tcacaaaa

SEQ ID NO: 51183 - DNA, 11 bp, Unknown
  misc_feature (1)..( 11): Matrix.002 file - promoters60/1455879
aaaaaaatgaa

SEQ ID NO: 51184 - DNA, 9 bp, Unknown
  misc_feature (1)..( 9): Matrix.002 file - promoters60/1455879
gaaattatg

SEQ ID NO: 51185 - DNA, 7 bp, Unknown
  misc_feature (1)..( 7): Matrix.002 file - promoters60/1455879
tttattt

SEQ ID NO: 51186 - DNA, 6 bp, Unknown
  misc_feature (1)..( 6): Matrix.002 file - promoters60/1455879
tattta

SEQ ID NO: 51187 - DNA, 6 bp, Unknown
  misc_feature (1)..( 6): Matrix.002 file - promoters60/1455879
aaacga

SEQ ID NO: 51188 - DNA, 7 bp, Unknown
  misc_feature (1)..( 7): Matrix.002 file - promoters60/1455879
agacatg

SEQ ID NO: 51189 - DNA, 6 bp, Unknown
  misc_feature (1)..( 6): Matrix.002 file - promoters60/1455879
agtaaa

SEQ ID NO: 51190 - DNA, 7 bp, Unknown
  misc_feature (1)..( 7): Matrix.002 file - promoters60/1455879
aatcggg

SEQ ID NO: 51191 - DNA, 8 bp, Unknown
  misc_feature (1)..( 8): Matrix.002 file - promoters60/1455879
gaaacaaa

SEQ ID NO: 51192 - DNA, 10 bp, Unknown
  misc_feature (1)..( 10): Matrix.002 file - promoters60/1455879
ggaaaagaaa

SEQ ID NO: 51193 - DNA, 7 bp, Unknown
  misc_feature (1)..( 7): Matrix.002 file - promoters60/1455879
cccacta

SEQ ID NO: 51194 - DNA, 9 bp, Unknown
  misc_feature (1)..( 9): Matrix.002 file - promoters60/1455879
aaagaaaag

SEQ ID NO: 51195 - DNA, 7 bp, Unknown
  misc_feature (1)..( 7): Matrix.002 file - promoters60/1455879
gtatata

SEQ ID NO: 51196 - DNA, 7 bp, Unknown
  misc_feature (1)..( 7): Matrix.002 file - promoters60/1455908
aagatta

SEQ ID NO: 51197 - DNA, 9 bp, Unknown
  misc_feature (1)..( 9): Matrix.002 file - promoters60/1455908
tatttgttc

SEQ ID NO: 51198 - DNA, 8 bp, Unknown
  misc_feature (1)..( 8): Matrix.002 file - promoters60/1455908
atgaatca

SEQ ID NO: 51199 - DNA, 6 bp, Unknown
  misc_feature (1)..( 6): Matrix.002 file - promoters60/1455908
aagaaa

SEQ ID NO: 51200 - DNA, 9 bp, Unknown
  misc_feature (1)..( 9): Matrix.002 file - promoters60/1455908
tttaataat

SEQ ID NO: 51201 - DNA, 6 bp, Unknown
  misc_feature (1)..( 6): Matrix.002 file - promoters60/1455908
tataat

SEQ ID NO: 51202 - DNA, 12 bp, Unknown
  misc_feature (1)..( 12): Matrix.002 file - promoters60/1455908
taatctaagaag

SEQ ID NO: 51203 - DNA, 7 bp, Unknown
  misc_feature (1)..( 7): Matrix.002 file - promoters60/1455908
attctat

SEQ ID NO: 51204 - DNA, 7 bp, Unknown
  misc_feature (1)..( 7): Matrix.002 file - promoters60/1455908
ataatag

SEQ ID NO: 51205 - DNA, 8 bp, Unknown
  misc_feature (1)..( 8): Matrix.002 file - promoters60/1455908
tataatat

SEQ ID NO: 51206 - DNA, 6 bp, Unknown
  misc_feature (1)..( 6): Matrix.002 file - promoters60/1455908
attttt

SEQ ID NO: 51207 - DNA, 6 bp, Unknown
  misc_feature (1)..( 6): Matrix.002 file - promoters60/1455908
catgaa

SEQ ID NO: 51208 - DNA, 7 bp, Unknown
  misc_feature (1)..( 7): Matrix.002 file - promoters60/1455908
tatcctc

SEQ ID NO: 51209 - DNA, 9 bp, Unknown
  misc_feature (1)..( 9): Matrix.002 file - promoters60/1455908
atttaacaa

SEQ ID NO: 51210 - DNA, 12 bp, Unknown
  misc_feature (1)..( 12): Matrix.002 file - promoters60/1455908
tagaattactaa

SEQ ID NO: 51211 - DNA, 6 bp, Unknown
  misc_feature (1)..( 6): Matrix.002 file - promoters60/1455908
aatttt

SEQ ID NO: 51212 - DNA, 6 bp, Unknown
  misc_feature (1)..( 6): Matrix.002 file - promoters60/1455908
atattt

SEQ ID NO: 51213 - DNA, 7 bp, Unknown
  misc_feature (1)..( 7): Matrix.002 file - promoters60/1455908
tatacaa

SEQ ID NO: 51214 - DNA, 11 bp, Unknown
  misc_feature (1)..( 11): Matrix.002 file - promoters60/1455908
ttttctaaaat

SEQ ID NO: 51215 - DNA, 7 bp, Unknown
  misc_feature (1)..( 7): Matrix.002 file - promoters60/1455908
tataatt

SEQ ID NO: 51216 - DNA, 6 bp, Unknown
  misc_feature (1)..( 6): Matrix.002 file - promoters60/1455908
aaaaaa

SEQ ID NO: 51217 - DNA, 8 bp, Unknown
  misc_feature (1)..( 8): Matrix.002 file - promoters60/1455908
taaatttc

SEQ ID NO: 51218 - DNA, 7 bp, Unknown
  misc_feature (1)..( 7): Matrix.002 file - promoters60/1455908
aagagaa

SEQ ID NO: 51219 - DNA, 8 bp, Unknown
  misc_feature (1)..( 8): Matrix.002 file - promoters60/1455908
atggcttg

SEQ ID NO: 51220 - DNA, 11 bp, Unknown
  misc_feature (1)..( 11): Matrix.002 file - promoters60/1455928
tcacaaataca

SEQ ID NO: 51221 - DNA, 12 bp, Unknown
  misc_feature (1)..( 12): Matrix.002 file - promoters60/1455928
tatataaacaga

SEQ ID NO: 51222 - DNA, 8 bp, Unknown
  misc_feature (1)..( 8): Matrix.002 file - promoters60/1455928
atgtattt

SEQ ID NO: 51223 - DNA, 8 bp, Unknown
  misc_feature (1)..( 8): Matrix.002 file - promoters60/1455932
aataatat

SEQ ID NO: 51224 - DNA, 9 bp, Unknown
  misc_feature (1)..( 9): Matrix.002 file - promoters60/1455932
atgtttttg

SEQ ID NO: 51225 - DNA, 10 bp, Unknown
  misc_feature (1)..( 10): Matrix.002 file - promoters60/1455932
atgtcttttg

SEQ ID NO: 51226 - DNA, 8 bp, Unknown
  misc_feature (1)..( 8): Matrix.002 file - promoters60/1455932
atttgtat

SEQ ID NO: 51227 - DNA, 8 bp, Unknown
  misc_feature (1)..( 8): Matrix.002 file - promoters60/1455932
aaaaacaa

SEQ ID NO: 51228 - DNA, 7 bp, Unknown
  misc_feature (1)..( 7): Matrix.002 file - promoters60/1455936
ttagtta

SEQ ID NO: 51229 - DNA, 8 bp, Unknown
  misc_feature (1)..( 8): Matrix.002 file - promoters60/1455936
aatataaa

SEQ ID NO: 51230 - DNA, 9 bp, Unknown
  misc_feature (1)..( 9): Matrix.002 file - promoters60/1455936
aaaagctaa

SEQ ID NO: 51231 - DNA, 7 bp, Unknown
  misc_feature (1)..( 7): Matrix.002 file - promoters60/1455936
aatttag

SEQ ID NO: 51232 - DNA, 8 bp, Unknown
  misc_feature (1)..( 8): Matrix.002 file - promoters60/1455936
aaaaataa

SEQ ID NO: 51233 - DNA, 8 bp, Unknown
  misc_feature (1)..( 8): Matrix.002 file - promoters60/1455936
atgaaaag

SEQ ID NO: 51234 - DNA, 11 bp, Unknown
  misc_feature (1)..( 11): Matrix.002 file - promoters60/1455944
aaataaaattg

SEQ ID NO: 51235 - DNA, 11 bp, Unknown
  misc_feature (1)..( 11): Matrix.002 file - promoters60/1455944
aaaaaaagaat

SEQ ID NO: 51236 - DNA, 11 bp, Unknown
  misc_feature (1)..( 11): Matrix.002 file - promoters60/1455944
aaacaaagaaa

SEQ ID NO: 51237 - DNA, 7 bp, Unknown
  misc_feature (1)..( 7): Matrix.002 file - promoters60/1455944
aaattaa

SEQ ID NO: 51238 - DNA, 8 bp, Unknown
  misc_feature (1)..( 8): Matrix.002 file - promoters60/1455944
tgaacaaa

SEQ ID NO: 51239 - DNA, 11 bp, Unknown
  misc_feature (1)..( 11): Matrix.002 file - promoters60/1455944
caatcactctc

SEQ ID NO: 51240 - DNA, 10 bp, Unknown
  misc_feature (1)..( 10): Matrix.002 file - promoters60/1455944
tatataaaac

SEQ ID NO: 51241 - DNA, 9 bp, Unknown
  misc_feature (1)..( 9): Matrix.002 file - promoters60/1455944
ttgaccaaa

SEQ ID NO: 51242 - DNA, 9 bp, Unknown
  misc_feature (1)..( 9): Matrix.002 file - promoters60/1455956
ttgattaga

SEQ ID NO: 51243 - DNA, 7 bp, Unknown
  misc_feature (1)..( 7): Matrix.002 file - promoters60/1455972
aaaatga

SEQ ID NO: 51244 - DNA, 10 bp, Unknown
  misc_feature (1)..( 10): Matrix.002 file - promoters60/1455972
atagattttt

SEQ ID NO: 51245 - DNA, 11 bp, Unknown
  misc_feature (1)..( 11): Matrix.002 file - promoters60/1455972
gacgactagtg

SEQ ID NO: 51246 - DNA, 10 bp, Unknown
  misc_feature (1)..( 10): Matrix.002 file - promoters60/1455972
aacaaacata

SEQ ID NO: 51247 - DNA, 12 bp, Unknown
  misc_feature (1)..( 12): Matrix.002 file - promoters60/1455972
aagcaataaacg

SEQ ID NO: 51248 - DNA, 9 bp, Unknown
  misc_feature (1)..( 9): Matrix.002 file - promoters60/1455972
ctagttaca

SEQ ID NO: 51249 - DNA, 7 bp, Unknown
  misc_feature (1)..( 7): Matrix.002 file - promoters60/1455972
gacaaac

SEQ ID NO: 51250 - DNA, 9 bp, Unknown
  misc_feature (1)..( 9): Matrix.002 file - promoters60/1455972
ataataagc

SEQ ID NO: 51251 - DNA, 9 bp, Unknown
  misc_feature (1)..( 9): Matrix.002 file - promoters60/1455972
caaaatgac

SEQ ID NO: 51252 - DNA, 11 bp, Unknown
  misc_feature (1)..( 11): Matrix.002 file - promoters60/1456000
aacaaaaaaaa

SEQ ID NO: 51253 - DNA, 7 bp, Unknown
  misc_feature (1)..( 7): Matrix.002 file - promoters60/1456000
tggacaa

SEQ ID NO: 51254 - DNA, 8 bp, Unknown
  misc_feature (1)..( 8): Matrix.002 file - promoters60/1456000
caacagaa

SEQ ID NO: 51255 - DNA, 7 bp, Unknown
  misc_feature (1)..( 7): Matrix.002 file - promoters60/1456000
aaccaaa

SEQ ID NO: 51256 - DNA, 8 bp, Unknown
  misc_feature (1)..( 8): Matrix.002 file - promoters60/1456000
aaaaaaat

SEQ ID NO: 51257 - DNA, 9 bp, Unknown
  misc_feature (1)..( 9): Matrix.002 file - promoters60/1456000
aaaaaaaga

SEQ ID NO: 51258 - DNA, 6 bp, Unknown
  misc_feature (1)..( 6): Matrix.002 file - promoters60/1456000
attaaa

SEQ ID NO: 51259 - DNA, 6 bp, Unknown
  misc_feature (1)..( 6): Matrix.002 file - promoters60/1456000
gagaaa

SEQ ID NO: 51260 - DNA, 9 bp, Unknown
  misc_feature (1)..( 9): Matrix.002 file - promoters60/1456000
tggagacaa

SEQ ID NO: 51261 - DNA, 6 bp, Unknown
  misc_feature (1)..( 6): Matrix.002 file - promoters60/1456000
ttaaaa

SEQ ID NO: 51262 - DNA, 6 bp, Unknown
  misc_feature (1)..( 6): Matrix.002 file - promoters60/1456000
ccaaaa

SEQ ID NO: 51263 - DNA, 15 bp, Unknown
  misc_feature (1)..( 15): Matrix.002 file - promoters60/1456000
aaagaaaaatcccaa

SEQ ID NO: 51264 - DNA, 13 bp, Unknown
  misc_feature (1)..( 13): Matrix.002 file - promoters60/1456000
caaaaaaaacaaa

SEQ ID NO: 51265 - DNA, 7 bp, Unknown
  misc_feature (1)..( 7): Matrix.002 file - promoters60/1456000
aacaaaa

SEQ ID NO: 51266 - DNA, 8 bp, Unknown
  misc_feature (1)..( 8): Matrix.002 file - promoters60/1456000
aaaaaaaa

SEQ ID NO: 51267 - DNA, 6 bp, Unknown
  misc_feature (1)..( 6): Matrix.002 file - promoters60/1456000
acggaa

SEQ ID NO: 51268 - DNA, 6 bp, Unknown
  misc_feature (1)..( 6): Matrix.002 file - promoters60/1456000
ttctgg

SEQ ID NO: 51269 - DNA, 7 bp, Unknown
  misc_feature (1)..( 7): Matrix.002 file - promoters60/1456000
acaatag

SEQ ID NO: 51270 - DNA, 9 bp, Unknown
  misc_feature (1)..( 9): Matrix.002 file - promoters60/1456000
aaagtattg

SEQ ID NO: 51271 - DNA, 6 bp, Unknown
  misc_feature (1)..( 6): Matrix.002 file - promoters60/1456000
gaaaaa

SEQ ID NO: 51272 - DNA, 7 bp, Unknown
  misc_feature (1)..( 7): Matrix.002 file - promoters60/1456083
tatatat

SEQ ID NO: 51273 - DNA, 7 bp, Unknown
  misc_feature (1)..( 7): Matrix.002 file - promoters60/1456128
aaacagt

SEQ ID NO: 51274 - DNA, 14 bp, Unknown
  misc_feature (1)..( 14): Matrix.002 file - promoters60/1456128
taagattttattat

SEQ ID NO: 51275 - DNA, 9 bp, Unknown
  misc_feature (1)..( 9): Matrix.002 file - promoters60/1456128
tatatagat

SEQ ID NO: 51276 - DNA, 10 bp, Unknown
  misc_feature (1)..( 10): Matrix.002 file - promoters60/1456128
atttttttct

SEQ ID NO: 51277 - DNA, 6 bp, Unknown
  misc_feature (1)..( 6): Matrix.002 file - promoters60/1456128
aataaa

SEQ ID NO: 51278 - DNA, 7 bp, Unknown
  misc_feature (1)..( 7): Matrix.002 file - promoters60/1456128
aaagaaa

SEQ ID NO: 51279 - DNA, 7 bp, Unknown
  misc_feature (1)..( 7): Matrix.002 file - promoters60/1456128
gaaaaaa

SEQ ID NO: 51280 - DNA, 6 bp, Unknown
  misc_feature (1)..( 6): Matrix.002 file - promoters60/1456128
gaaaaa

SEQ ID NO: 51281 - DNA, 7 bp, Unknown
  misc_feature (1)..( 7): Matrix.002 file - promoters60/1456128
taaatta

SEQ ID NO: 51282 - DNA, 9 bp, Unknown
  misc_feature (1)..( 9): Matrix.002 file - promoters60/1456128
tttattaaa

SEQ ID NO: 51283 - DNA, 7 bp, Unknown
  misc_feature (1)..( 7): Matrix.002 file - promoters60/1456128
agaaaaa

SEQ ID NO: 51284 - DNA, 8 bp, Unknown
  misc_feature (1)..( 8): Matrix.002 file - promoters60/1456128
gaaaaaaa

SEQ ID NO: 51285 - DNA, 6 bp, Unknown
  misc_feature (1)..( 6): Matrix.002 file - promoters60/1456128
aacaaa

SEQ ID NO: 51286 - DNA, 9 bp, Unknown
  misc_feature (1)..( 9): Matrix.002 file - promoters60/1456128
ctttattaa

SEQ ID NO: 51287 - DNA, 7 bp, Unknown
  misc_feature (1)..( 7): Matrix.002 file - promoters60/1456128
taaaaac

SEQ ID NO: 51288 - DNA, 6 bp, Unknown
  misc_feature (1)..( 6): Matrix.002 file - promoters60/1456128
atttat

SEQ ID NO: 51289 - DNA, 6 bp, Unknown
  misc_feature (1)..( 6): Matrix.002 file - promoters60/1456128
aattat

SEQ ID NO: 51290 - DNA, 6 bp, Unknown
  misc_feature (1)..( 6): Matrix.002 file - promoters60/1456128
tcaaaa

SEQ ID NO: 51291 - DNA, 6 bp, Unknown
  misc_feature (1)..( 6): Matrix.002 file - promoters60/1456128
gtataa

SEQ ID NO: 51292 - DNA, 9 bp, Unknown
  misc_feature (1)..( 9): Matrix.002 file - promoters60/1456128
aaagagtta

SEQ ID NO: 51293 - DNA, 6 bp, Unknown
  misc_feature (1)..( 6): Matrix.002 file - promoters60/1456128
aaaaag

SEQ ID NO: 51294 - DNA, 7 bp, Unknown
  misc_feature (1)..( 7): Matrix.002 file - promoters60/1456128
agtcttt

SEQ ID NO: 51295 - DNA, 8 bp, Unknown
  misc_feature (1)..( 8): Matrix.002 file - promoters60/1456228
atgattaa

SEQ ID NO: 51296 - DNA, 8 bp, Unknown
  misc_feature (1)..( 8): Matrix.002 file - promoters60/1456228
atagagag

SEQ ID NO: 51297 - DNA, 8 bp, Unknown
  misc_feature (1)..( 8): Matrix.002 file - promoters60/1456228
tgttaata

SEQ ID NO: 51298 - DNA, 6 bp, Unknown
  misc_feature (1)..( 6): Matrix.002 file - promoters60/1456228
aaaaag

SEQ ID NO: 51299 - DNA, 7 bp, Unknown
  misc_feature (1)..( 7): Matrix.002 file - promoters60/1456228
aaaataa

SEQ ID NO: 51300 - DNA, 8 bp, Unknown
  misc_feature (1)..( 8): Matrix.002 file - promoters60/1456228
tgaagaat

SEQ ID NO: 51301 - DNA, 7 bp, Unknown
  misc_feature (1)..( 7): Matrix.002 file - promoters60/1456228
tttccca

SEQ ID NO: 51302 - DNA, 6 bp, Unknown
  misc_feature (1)..( 6): Matrix.002 file - promoters60/1456228
gtttat

SEQ ID NO: 51303 - DNA, 10 bp, Unknown
  misc_feature (1)..( 10): Matrix.002 file - promoters60/1456228
aaagaaaacc

SEQ ID NO: 51304 - DNA, 8 bp, Unknown
  misc_feature (1)..( 8): Matrix.002 file - promoters60/1456228
tatttaaa

SEQ ID NO: 51305 - DNA, 6 bp, Unknown
  misc_feature (1)..( 6): Matrix.002 file - promoters60/1456228
atggat

SEQ ID NO: 51306 - DNA, 8 bp, Unknown
  misc_feature (1)..( 8): Matrix.002 file - promoters60/1456228
gataactt

SEQ ID NO: 51307 - DNA, 8 bp, Unknown
  misc_feature (1)..( 8): Matrix.002 file - promoters60/1456228
gattccaa

SEQ ID NO: 51308 - DNA, 6 bp, Unknown
  misc_feature (1)..( 6): Matrix.002 file - promoters60/1456228
tctaaa

SEQ ID NO: 51309 - DNA, 7 bp, Unknown
  misc_feature (1)..( 7): Matrix.002 file - promoters60/1456228
taattaa

SEQ ID NO: 51310 - DNA, 6 bp, Unknown
  misc_feature (1)..( 6): Matrix.002 file - promoters60/1456228
caaaaa

SEQ ID NO: 51311 - DNA, 10 bp, Unknown
  misc_feature (1)..( 10): Matrix.002 file - promoters60/1456228
aaatataata

SEQ ID NO: 51312 - DNA, 7 bp, Unknown
  misc_feature (1)..( 7): Matrix.002 file - promoters60/1456228
ttaaata

SEQ ID NO: 51313 - DNA, 7 bp, Unknown
  misc_feature (1)..( 7): Matrix.002 file - promoters60/1456228
gtcgcct

SEQ ID NO: 51314 - DNA, 6 bp, Unknown
  misc_feature (1)..( 6): Matrix.002 file - promoters60/1456228
agtaaa

SEQ ID NO: 51315 - DNA, 7 bp, Unknown
  misc_feature (1)..( 7): Matrix.002 file - promoters60/1456228
aatcggg

SEQ ID NO: 51316 - DNA, 8 bp, Unknown
  misc_feature (1)..( 8): Matrix.002 file - promoters60/1456228
gaaacaaa

SEQ ID NO: 51317 - DNA, 10 bp, Unknown
  misc_feature (1)..( 10): Matrix.002 file - promoters60/1456228
ggaaaagaaa

SEQ ID NO: 51318 - DNA, 7 bp, Unknown
  misc_feature (1)..( 7): Matrix.002 file - promoters60/1456228
cccacta

SEQ ID NO: 51319 - DNA, 9 bp, Unknown
  misc_feature (1)..( 9): Matrix.002 file - promoters60/1456228
aaagaaaag

SEQ ID NO: 51320 - DNA, 10 bp, Unknown
  misc_feature (1)..( 10): Matrix.002 file - promoters60/1458991
taatcattga

SEQ ID NO: 51321 - DNA, 12 bp, Unknown
  misc_feature (1)..( 12): Matrix.002 file - promoters60/1458991
ttgaagtttttt

SEQ ID NO: 51322 - DNA, 10 bp, Unknown
  misc_feature (1)..( 10): Matrix.002 file - promoters60/1459039
aatataaatt

SEQ ID NO: 51323 - DNA, 9 bp, Unknown
  misc_feature (1)..( 9): Matrix.002 file - promoters60/1459039
tttggttta

SEQ ID NO: 51324 - DNA, 8 bp, Unknown
  misc_feature (1)..( 8): Matrix.002 file - promoters60/1459039
taaaaaaa

SEQ ID NO: 51325 - DNA, 7 bp, Unknown
  misc_feature (1)..( 7): Matrix.002 file - promoters60/1459199
agatttt

SEQ ID NO: 51326 - DNA, 7 bp, Unknown
  misc_feature (1)..( 7): Matrix.002 file - promoters60/1459199
tttattt

SEQ ID NO: 51327 - DNA, 8 bp, Unknown
  misc_feature (1)..( 8): Matrix.002 file - promoters60/1459199
tttacttg

SEQ ID NO: 51328 - DNA, 6 bp, Unknown
  misc_feature (1)..( 6): Matrix.002 file - promoters60/1459199
tctcgt

SEQ ID NO: 51329 - DNA, 7 bp, Unknown
  misc_feature (1)..( 7): Matrix.002 file - promoters60/1459199
ttaatcg

SEQ ID NO: 51330 - DNA, 7 bp, Unknown
  misc_feature (1)..( 7): Matrix.002 file - promoters60/1459199
actaggg

SEQ ID NO: 51331 - DNA, 6 bp, Unknown
  misc_feature (1)..( 6): Matrix.002 file - promoters60/1459199
gtacta

SEQ ID NO: 51332 - DNA, 7 bp, Unknown
  misc_feature (1)..( 7): Matrix.002 file - promoters60/1459199
taccacc

SEQ ID NO: 51333 - DNA, 8 bp, Unknown
  misc_feature (1)..( 8): Matrix.002 file - promoters60/1459199
accaagta

SEQ ID NO: 51334 - DNA, 9 bp, Unknown
  misc_feature (1)..( 9): Matrix.002 file - promoters60/1459199
aatccatga

SEQ ID NO: 51335 - DNA, 7 bp, Unknown
  misc_feature (1)..( 7): Matrix.002 file - promoters60/1459199
tttcatt

SEQ ID NO: 51336 - DNA, 6 bp, Unknown
  misc_feature (1)..( 6): Matrix.002 file - promoters60/1459199
ttactc

SEQ ID NO: 51337 - DNA, 7 bp, Unknown
  misc_feature (1)..( 7): Matrix.002 file - promoters60/1459199
aaagctt

SEQ ID NO: 51338 - DNA, 9 bp, Unknown
  misc_feature (1)..( 9): Matrix.002 file - promoters60/1459199
tttgactag

SEQ ID NO: 51339 - DNA, 8 bp, Unknown
  misc_feature (1)..( 8): Matrix.002 file - promoters60/1459199
tctgatat

SEQ ID NO: 51340 - DNA, 6 bp, Unknown
  misc_feature (1)..( 6): Matrix.002 file - promoters60/1459223
aaatat

SEQ ID NO: 51341 - DNA, 9 bp, Unknown
  misc_feature (1)..( 9): Matrix.002 file - promoters60/1459223
aaaatattt

SEQ ID NO: 51342 - DNA, 12 bp, Unknown
  misc_feature (1)..( 12): Matrix.002 file - promoters60/1459223
ttttttcttctc

SEQ ID NO: 51343 - DNA, 6 bp, Unknown
  misc_feature (1)..( 6): Matrix.002 file - promoters60/1460386
acattt

SEQ ID NO: 51344 - DNA, 11 bp, Unknown
  misc_feature (1)..( 11): Matrix.002 file - promoters60/1460386
ttttactttat

SEQ ID NO: 51345 - DNA, 16 bp, Unknown
  misc_feature (1)..( 16): Matrix.002 file - promoters60/1460386
agaaagattttgaaaa

SEQ ID NO: 51346 - DNA, 19 bp, Unknown
  misc_feature (1)..( 19): Matrix.002 file - promoters60/1460386
agaaagatttgaaaaaatt

SEQ ID NO: 51347 - DNA, 7 bp, Unknown
  misc_feature (1)..( 7): Matrix.002 file - promoters60/1460386
agtgtta

SEQ ID NO: 51348 - DNA, 7 bp, Unknown
  misc_feature (1)..( 7): Matrix.002 file - promoters60/1460386
tattctt

SEQ ID NO: 51349 - DNA, 6 bp, Unknown
  misc_feature (1)..( 6): Matrix.002 file - promoters60/1460386
cggctt

SEQ ID NO: 51350 - DNA, 6 bp, Unknown
  misc_feature (1)..( 6): Matrix.002 file - promoters60/1460386
taatat

SEQ ID NO: 51351 - DNA, 7 bp, Unknown
  misc_feature (1)..( 7): Matrix.002 file - promoters60/1460386
agaaaga

SEQ ID NO: 51352 - DNA, 6 bp, Unknown
  misc_feature (1)..( 6): Matrix.002 file - promoters60/1460386
aagatt

SEQ ID NO: 51353 - DNA, 7 bp, Unknown
  misc_feature (1)..( 7): Matrix.002 file - promoters60/1460386
aaaaaca

SEQ ID NO: 51354 - DNA, 6 bp, Unknown
  misc_feature (1)..( 6): Matrix.002 file - promoters60/1460386
ttgcag

SEQ ID NO: 51355 - DNA, 7 bp, Unknown
  misc_feature (1)..( 7): Matrix.002 file - promoters60/1460386
aaaagtt

SEQ ID NO: 51356 - DNA, 8 bp, Unknown
  misc_feature (1)..( 8): Matrix.002 file - promoters60/1460386
aaaataaa

SEQ ID NO: 51357 - DNA, 7 bp, Unknown
  misc_feature (1)..( 7): Matrix.002 file - promoters60/1460386
aaaagaa

SEQ ID NO: 51358 - DNA, 7 bp, Unknown
  misc_feature (1)..( 7): Matrix.002 file - promoters60/1460386
aataaat

SEQ ID NO: 51359 - DNA, 7 bp, Unknown
  misc_feature (1)..( 7): Matrix.002 file - promoters60/1460386
tttgcta

SEQ ID NO: 51360 - DNA, 8 bp, Unknown
  misc_feature (1)..( 8): Matrix.002 file - promoters60/1460386
aaaacaaa

SEQ ID NO: 51361 - DNA, 7 bp, Unknown
  misc_feature (1)..( 7): Matrix.002 file - promoters60/1460386
tttattt

SEQ ID NO: 51362 - DNA, 6 bp, Unknown
  misc_feature (1)..( 6): Matrix.002 file - promoters60/1460386
attttt

SEQ ID NO: 51363 - DNA, 6 bp, Unknown
  misc_feature (1)..( 6): Matrix.002 file - promoters60/1460386
aaaaga

SEQ ID NO: 51364 - DNA, 7 bp, Unknown
  misc_feature (1)..( 7): Matrix.002 file - promoters60/1461720
aaatata

SEQ ID NO: 51365 - DNA, 10 bp, Unknown
  misc_feature (1)..( 10): Matrix.002 file - promoters60/1461720
ataaacgaca

SEQ ID NO: 51366 - DNA, 7 bp, Unknown
  misc_feature (1)..( 7): Matrix.002 file - promoters60/1461720
aatcgaa

SEQ ID NO: 51367 - DNA, 10 bp, Unknown
  misc_feature (1)..( 10): Matrix.002 file - promoters60/1461720
atttatttga

SEQ ID NO: 51368 - DNA, 6 bp, Unknown
  misc_feature (1)..( 6): Matrix.002 file - promoters60/1461720
atttgt

SEQ ID NO: 51369 - DNA, 6 bp, Unknown
  misc_feature (1)..( 6): Matrix.002 file - promoters60/1461720
gctctg

SEQ ID NO: 51370 - DNA, 6 bp, Unknown
  misc_feature (1)..( 6): Matrix.002 file - promoters60/1461720
taataa

SEQ ID NO: 51371 - DNA, 7 bp, Unknown
  misc_feature (1)..( 7): Matrix.002 file - promoters60/1461720
taagtta

SEQ ID NO: 51372 - DNA, 7 bp, Unknown
  misc_feature (1)..( 7): Matrix.002 file - promoters60/1461720
attaatt

SEQ ID NO: 51373 - DNA, 10 bp, Unknown
  misc_feature (1)..( 10): Matrix.002 file - promoters60/1461720
attagtaatt

SEQ ID NO: 51374 - DNA, 7 bp, Unknown
  misc_feature (1)..( 7): Matrix.002 file - promoters60/1461720
tgaaaaa

SEQ ID NO: 51375 - DNA, 6 bp, Unknown
  misc_feature (1)..( 6): Matrix.002 file - promoters60/1461720
tatcaa

SEQ ID NO: 51376 - DNA, 7 bp, Unknown
  misc_feature (1)..( 7): Matrix.002 file - promoters60/1461720
taatttt

SEQ ID NO: 51377 - DNA, 6 bp, Unknown
  misc_feature (1)..( 6): Matrix.002 file - promoters60/1461720
ttagaa

SEQ ID NO: 51378 - DNA, 6 bp, Unknown
  misc_feature (1)..( 6): Matrix.002 file - promoters60/1461720
atattt

SEQ ID NO: 51379 - DNA, 8 bp, Unknown
  misc_feature (1)..( 8): Matrix.002 file - promoters60/1461720
tagaagta

SEQ ID NO: 51380 - DNA, 6 bp, Unknown
  misc_feature (1)..( 6): Matrix.002 file - promoters60/1461720
taatct

SEQ ID NO: 51381 - DNA, 10 bp, Unknown
  misc_feature (1)..( 10): Matrix.002 file - promoters60/1461720
gaaatatata

SEQ ID NO: 51382 - DNA, 6 bp, Unknown
  misc_feature (1)..( 6): Matrix.002 file - promoters60/1461720
aaacat

SEQ ID NO: 51383 - DNA, 7 bp, Unknown
  misc_feature (1)..( 7): Matrix.002 file - promoters60/1461720
ataattt

SEQ ID NO: 51384 - DNA, 10 bp, Unknown
  misc_feature (1)..( 10): Matrix.002 file - promoters60/1461720
agatatattt

SEQ ID NO: 51385 - DNA, 7 bp, Unknown
  misc_feature (1)..( 7): Matrix.002 file - promoters60/1461756
agaagaa

SEQ ID NO: 51386 - DNA, 6 bp, Unknown
  misc_feature (1)..( 6): Matrix.002 file - promoters60/1461756
ttgaaa

SEQ ID NO: 51387 - DNA, 6 bp, Unknown
  misc_feature (1)..( 6): Matrix.002 file - promoters60/1461756
tggtta

SEQ ID NO: 51388 - DNA, 8 bp, Unknown
  misc_feature (1)..( 8): Matrix.002 file - promoters60/1461756
atcgagaa

SEQ ID NO: 51389 - DNA, 6 bp, Unknown
  misc_feature (1)..( 6): Matrix.002 file - promoters60/1461756
cgattc

SEQ ID NO: 51390 - DNA, 7 bp, Unknown
  misc_feature (1)..( 7): Matrix.002 file - promoters60/1461756
tccaaag

SEQ ID NO: 51391 - DNA, 7 bp, Unknown
  misc_feature (1)..( 7): Matrix.002 file - promoters60/1461756
aaaacaa

SEQ ID NO: 51392 - DNA, 6 bp, Unknown
  misc_feature (1)..( 6): Matrix.002 file - promoters60/1461756
tggata

SEQ ID NO: 51393 - DNA, 6 bp, Unknown
  misc_feature (1)..( 6): Matrix.002 file - promoters60/1461756
agaact

SEQ ID NO: 51394 - DNA, 6 bp, Unknown
  misc_feature (1)..( 6): Matrix.002 file - promoters60/1461756
tctgaa

SEQ ID NO: 51395 - DNA, 7 bp, Unknown
  misc_feature (1)..( 7): Matrix.002 file - promoters60/1461756
tgttatt

SEQ ID NO: 51396 - DNA, 6 bp, Unknown
  misc_feature (1)..( 6): Matrix.002 file - promoters60/1461756
gggaaa

SEQ ID NO: 51397 - DNA, 6 bp, Unknown
  misc_feature (1)..( 6): Matrix.002 file - promoters60/1461756
aaatga

SEQ ID NO: 51398 - DNA, 7 bp, Unknown
  misc_feature (1)..( 7): Matrix.002 file - promoters60/1461756
attatct

SEQ ID NO: 51399 - DNA, 12 bp, Unknown
  misc_feature (1)..( 12): Matrix.002 file - promoters60/1461756
gtccccttctat

SEQ ID NO: 51400 - DNA, 9 bp, Unknown
  misc_feature (1)..( 9): Matrix.002 file - promoters60/1461768
caaaaaaaa

SEQ ID NO: 51401 - DNA, 6 bp, Unknown
  misc_feature (1)..( 6): Matrix.002 file - promoters60/1461768
tctatt

SEQ ID NO: 51402 - DNA, 10 bp, Unknown
  misc_feature (1)..( 10): Matrix.002 file - promoters60/1461776
agaaaatttg

SEQ ID NO: 51403 - DNA, 10 bp, Unknown
  misc_feature (1)..( 10): Matrix.002 file - promoters60/1461776
ctcttatata

SEQ ID NO: 51404 - DNA, 11 bp, Unknown
  misc_feature (1)..( 11): Matrix.002 file - promoters60/1461776
cattttttgtt

SEQ ID NO: 51405 - DNA, 7 bp, Unknown
  misc_feature (1)..( 7): Matrix.002 file - promoters60/1461780
aaaagag

SEQ ID NO: 51406 - DNA, 8 bp, Unknown
  misc_feature (1)..( 8): Matrix.002 file - promoters60/1461780
attctcac

SEQ ID NO: 51407 - DNA, 11 bp, Unknown
  misc_feature (1)..( 11): Matrix.002 file - promoters60/1461780
tttactcaatt

SEQ ID NO: 51408 - DNA, 12 bp, Unknown
  misc_feature (1)..( 12): Matrix.002 file - promoters60/1461780
aaccctaaaaaa

SEQ ID NO: 51409 - DNA, 11 bp, Unknown
  misc_feature (1)..( 11): Matrix.002 file - promoters60/1461780
aaaattaaata

SEQ ID NO: 51410 - DNA, 7 bp, Unknown
  misc_feature (1)..( 7): Matrix.002 file - promoters60/1461780
cattttt

SEQ ID NO: 51411 - DNA, 8 bp, Unknown
  misc_feature (1)..( 8): Matrix.002 file - promoters60/1461780
taatcttc

SEQ ID NO: 51412 - DNA, 6 bp, Unknown
  misc_feature (1)..( 6): Matrix.002 file - promoters60/1461780
tttcct

SEQ ID NO: 51413 - DNA, 8 bp, Unknown
  misc_feature (1)..( 8): Matrix.002 file - promoters60/1461780
ttcacttt

SEQ ID NO: 51414 - DNA, 7 bp, Unknown
  misc_feature (1)..( 7): Matrix.002 file - promoters60/1461780
ctcaatt

SEQ ID NO: 51415 - DNA, 7 bp, Unknown
  misc_feature (1)..( 7): Matrix.002 file - promoters60/1461780
gagcaaa

SEQ ID NO: 51416 - DNA, 7 bp, Unknown
  misc_feature (1)..( 7): Matrix.002 file - promoters60/1461780
aaaaaaa

SEQ ID NO: 51417 - DNA, 6 bp, Unknown
  misc_feature (1)..( 6): Matrix.002 file - promoters60/1461780
atcttt

SEQ ID NO: 51418 - DNA, 8 bp, Unknown
  misc_feature (1)..( 8): Matrix.002 file - promoters60/1461780
catcacat

SEQ ID NO: 51419 - DNA, 6 bp, Unknown
  misc_feature (1)..( 6): Matrix.002 file - promoters60/1461780
aagaaa

SEQ ID NO: 51420 - DNA, 7 bp, Unknown
  misc_feature (1)..( 7): Matrix.002 file - promoters60/1461780
agaaagt

SEQ ID NO: 51421 - DNA, 6 bp, Unknown
  misc_feature (1)..( 6): Matrix.002 file - promoters60/1461780
aaatgc

SEQ ID NO: 51422 - DNA, 7 bp, Unknown
  misc_feature (1)..( 7): Matrix.002 file - promoters60/1461780
ttaaaat

SEQ ID NO: 51423 - DNA, 9 bp, Unknown
  misc_feature (1)..( 9): Matrix.002 file - promoters60/1461791
actcttttc

SEQ ID NO: 51424 - DNA, 10 bp, Unknown
  misc_feature (1)..( 10): Matrix.002 file - promoters60/1461791
ggaatataaa

SEQ ID NO: 51425 - DNA, 11 bp, Unknown
  misc_feature (1)..( 11): Matrix.002 file - promoters60/1461791
gaagttgtaat

SEQ ID NO: 51426 - DNA, 9 bp, Unknown
  misc_feature (1)..( 9): Matrix.002 file - promoters60/1461791
tttgtttta

SEQ ID NO: 51427 - DNA, 8 bp, Unknown
  misc_feature (1)..( 8): Matrix.002 file - promoters60/1461791
tgaaacaa

SEQ ID NO: 51428 - DNA, 8 bp, Unknown
  misc_feature (1)..( 8): Matrix.002 file - promoters60/1461795
ttaaatgg

SEQ ID NO: 51429 - DNA, 12 bp, Unknown
  misc_feature (1)..( 12): Matrix.002 file - promoters60/1461795
actatttgactt

SEQ ID NO: 51430 - DNA, 7 bp, Unknown
  misc_feature (1)..( 7): Matrix.002 file - promoters60/1461799
agaagca

SEQ ID NO: 51431 - DNA, 8 bp, Unknown
  misc_feature (1)..( 8): Matrix.002 file - promoters60/1461799
tttgattt

SEQ ID NO: 51432 - DNA, 9 bp, Unknown
  misc_feature (1)..( 9): Matrix.002 file - promoters60/1461799
agttccata

SEQ ID NO: 51433 - DNA, 7 bp, Unknown
  misc_feature (1)..( 7): Matrix.002 file - promoters60/1461799
tctttta

SEQ ID NO: 51434 - DNA, 9 bp, Unknown
  misc_feature (1)..( 9): Matrix.002 file - promoters60/1461799
tctctcgtg

SEQ ID NO: 51435 - DNA, 6 bp, Unknown
  misc_feature (1)..( 6): Matrix.002 file - promoters60/1461799
tagact

SEQ ID NO: 51436 - DNA, 6 bp, Unknown
  misc_feature (1)..( 6): Matrix.002 file - promoters60/1461799
atgttg

SEQ ID NO: 51437 - DNA, 6 bp, Unknown
  misc_feature (1)..( 6): Matrix.002 file - promoters60/1461799
gtggtt

SEQ ID NO: 51438 - DNA, 6 bp, Unknown
  misc_feature (1)..( 6): Matrix.002 file - promoters60/1461799
tacaga

SEQ ID NO: 51439 - DNA, 7 bp, Unknown
  misc_feature (1)..( 7): Matrix.002 file - promoters60/1461799
ataaact

SEQ ID NO: 51440 - DNA, 7 bp, Unknown
  misc_feature (1)..( 7): Matrix.002 file - promoters60/1461799
gagaaga

SEQ ID NO: 51441 - DNA, 7 bp, Unknown
  misc_feature (1)..( 7): Matrix.002 file - promoters60/1461799
aaacagc

SEQ ID NO: 51442 - DNA, 7 bp, Unknown
  misc_feature (1)..( 7): Matrix.002 file - promoters60/1461799
ttctttg

SEQ ID NO: 51443 - DNA, 7 bp, Unknown
  misc_feature (1)..( 7): Matrix.002 file - promoters60/1461799
actaatt

SEQ ID NO: 51444 - DNA, 6 bp, Unknown
  misc_feature (1)..( 6): Matrix.002 file - promoters60/1461799
tcgttt

SEQ ID NO: 51445 - DNA, 8 bp, Unknown
  misc_feature (1)..( 8): Matrix.002 file - promoters60/1461803
attcttat

SEQ ID NO: 51446 - DNA, 8 bp, Unknown
  misc_feature (1)..( 8): Matrix.002 file - promoters60/1461803
aagcaaaa

SEQ ID NO: 51447 - DNA, 15 bp, Unknown
  misc_feature (1)..( 15): Matrix.002 file - promoters60/1461803
actacatttaattat

SEQ ID NO: 51448 - DNA, 12 bp, Unknown
  misc_feature (1)..( 12): Matrix.002 file - promoters60/1461803
accaagaaaaga

SEQ ID NO: 51449 - DNA, 9 bp, Unknown
  misc_feature (1)..( 9): Matrix.002 file - promoters60/1461803
aataatttt

SEQ ID NO: 51450 - DNA, 10 bp, Unknown
  misc_feature (1)..( 10): Matrix.002 file - promoters60/1461803
accaagaaaa

SEQ ID NO: 51451 - DNA, 8 bp, Unknown
  misc_feature (1)..( 8): Matrix.002 file - promoters60/1461803
gattattt

SEQ ID NO: 51452 - DNA, 8 bp, Unknown
  misc_feature (1)..( 8): Matrix.002 file - promoters60/1461837
tggattca

SEQ ID NO: 51453 - DNA, 9 bp, Unknown
  misc_feature (1)..( 9): Matrix.002 file - promoters60/1461837
ttttgttat

SEQ ID NO: 51454 - DNA, 7 bp, Unknown
  misc_feature (1)..( 7): Matrix.002 file - promoters60/1461837
gataaat

SEQ ID NO: 51455 - DNA, 6 bp, Unknown
  misc_feature (1)..( 6): Matrix.002 file - promoters60/1461837
aaacaa

SEQ ID NO: 51456 - DNA, 6 bp, Unknown
  misc_feature (1)..( 6): Matrix.002 file - promoters60/1461837
agctta

SEQ ID NO: 51457 - DNA, 8 bp, Unknown
  misc_feature (1)..( 8): Matrix.002 file - promoters60/1461837
ttgataaa

SEQ ID NO: 51458 - DNA, 6 bp, Unknown
  misc_feature (1)..( 6): Matrix.002 file - promoters60/1461837
aaatat

SEQ ID NO: 51459 - DNA, 9 bp, Unknown
  misc_feature (1)..( 9): Matrix.002 file - promoters60/1461837
tcgggggat

SEQ ID NO: 51460 - DNA, 7 bp, Unknown
  misc_feature (1)..( 7): Matrix.002 file - promoters60/1461837
ttccttc

SEQ ID NO: 51461 - DNA, 7 bp, Unknown
  misc_feature (1)..( 7): Matrix.002 file - promoters60/1461837
agagggg

SEQ ID NO: 51462 - DNA, 7 bp, Unknown
  misc_feature (1)..( 7): Matrix.002 file - promoters60/1461837
ataaatt

SEQ ID NO: 51463 - DNA, 8 bp, Unknown
  misc_feature (1)..( 8): Matrix.002 file - promoters60/1461837
tatccaaa

SEQ ID NO: 51464 - DNA, 6 bp, Unknown
  misc_feature (1)..( 6): Matrix.002 file - promoters60/1461837
ctttga

SEQ ID NO: 51465 - DNA, 6 bp, Unknown
  misc_feature (1)..( 6): Matrix.002 file - promoters60/1461837
aggtaa

SEQ ID NO: 51466 - DNA, 6 bp, Unknown
  misc_feature (1)..( 6): Matrix.002 file - promoters60/1461837
tgaaag

SEQ ID NO: 51467 - DNA, 10 bp, Unknown
  misc_feature (1)..( 10): Matrix.002 file - promoters60/1461837
aaaaaagttg

SEQ ID NO: 51468 - DNA, 8 bp, Unknown
  misc_feature (1)..( 8): Matrix.002 file - promoters60/1461837
aaaaaagt

SEQ ID NO: 51469 - DNA, 7 bp, Unknown
  misc_feature (1)..( 7): Matrix.002 file - promoters60/1461837
actagga

SEQ ID NO: 51470 - DNA, 6 bp, Unknown
  misc_feature (1)..( 6): Matrix.002 file - promoters60/1461837
acgaag

SEQ ID NO: 51471 - DNA, 6 bp, Unknown
  misc_feature (1)..( 6): Matrix.002 file - promoters60/1461837
aaaaat

SEQ ID NO: 51472 - DNA, 6 bp, Unknown
  misc_feature (1)..( 6): Matrix.002 file - promoters60/1461837
aagaga

SEQ ID NO: 51473 - DNA, 6 bp, Unknown
  misc_feature (1)..( 6): Matrix.002 file - promoters60/1461837
tttttt

SEQ ID NO: 51474 - DNA, 7 bp, Unknown
  misc_feature (1)..( 7): Matrix.002 file - promoters60/1461837
aaaccca

SEQ ID NO: 51475 - DNA, 7 bp, Unknown
  misc_feature (1)..( 7): Matrix.002 file - promoters60/1461837
ttaaata

SEQ ID NO: 51476 - DNA, 7 bp, Unknown
  misc_feature (1)..( 7): Matrix.002 file - promoters60/1461837
ataaata

SEQ ID NO: 51477 - DNA, 7 bp, Unknown
  misc_feature (1)..( 7): Matrix.002 file - promoters60/1465863
tcgcttt

SEQ ID NO: 51478 - DNA, 9 bp, Unknown
  misc_feature (1)..( 9): Matrix.002 file - promoters60/1465863
ttcttagct

SEQ ID NO: 51479 - DNA, 9 bp, Unknown
  misc_feature (1)..( 9): Matrix.002 file - promoters60/1465863
agaaagcaa

SEQ ID NO: 51480 - DNA, 8 bp, Unknown
  misc_feature (1)..( 8): Matrix.002 file - promoters60/1465863
gaaagatt

SEQ ID NO: 51481 - DNA, 8 bp, Unknown
  misc_feature (1)..( 8): Matrix.002 file - promoters60/1465863
tccaaagg

SEQ ID NO: 51482 - DNA, 9 bp, Unknown
  misc_feature (1)..( 9): Matrix.002 file - promoters60/1465863
ctagggttt

SEQ ID NO: 51483 - DNA, 8 bp, Unknown
  misc_feature (1)..( 8): Matrix.002 file - promoters60/1465863
agtttaat

SEQ ID NO: 51484 - DNA, 8 bp, Unknown
  misc_feature (1)..( 8): Matrix.002 file - promoters60/1465863
atattttt

SEQ ID NO: 51485 - DNA, 9 bp, Unknown
  misc_feature (1)..( 9): Matrix.002 file - promoters60/1465943
attggcaac

SEQ ID NO: 51486 - DNA, 6 bp, Unknown
  misc_feature (1)..( 6): Matrix.002 file - promoters60/1465943
atttct

SEQ ID NO: 51487 - DNA, 6 bp, Unknown
  misc_feature (1)..( 6): Matrix.002 file - promoters60/1465943
aagaga

SEQ ID NO: 51488 - DNA, 8 bp, Unknown
  misc_feature (1)..( 8): Matrix.002 file - promoters60/1465943
gcaaaatt

SEQ ID NO: 51489 - DNA, 8 bp, Unknown
  misc_feature (1)..( 8): Matrix.002 file - promoters60/1465943
aaacctga

SEQ ID NO: 51490 - DNA, 10 bp, Unknown
  misc_feature (1)..( 10): Matrix.002 file - promoters60/1465943
actcttcata

SEQ ID NO: 51491 - DNA, 6 bp, Unknown
  misc_feature (1)..( 6): Matrix.002 file - promoters60/1465943
ctctcc

SEQ ID NO: 51492 - DNA, 11 bp, Unknown
  misc_feature (1)..( 11): Matrix.002 file - promoters60/1465943
aaactaaacaa

SEQ ID NO: 51493 - DNA, 8 bp, Unknown
  misc_feature (1)..( 8): Matrix.002 file - promoters60/1465943
tgcaaaaa

SEQ ID NO: 51494 - DNA, 9 bp, Unknown
  misc_feature (1)..( 9): Matrix.002 file - promoters60/1465943
atgaaaatt

SEQ ID NO: 51495 - DNA, 6 bp, Unknown
  misc_feature (1)..( 6): Matrix.002 file - promoters60/1470582
taaaaa

SEQ ID NO: 51496 - DNA, 7 bp, Unknown
  misc_feature (1)..( 7): Matrix.002 file - promoters60/1470582
aacaaaa

SEQ ID NO: 51497 - DNA, 6 bp, Unknown
  misc_feature (1)..( 6): Matrix.002 file - promoters60/1470582
tcaaaa

SEQ ID NO: 51498 - DNA, 8 bp, Unknown
  misc_feature (1)..( 8): Matrix.002 file - promoters60/1470582
aaacattc

SEQ ID NO: 51499 - DNA, 9 bp, Unknown
  misc_feature (1)..( 9): Matrix.002 file - promoters60/1470582
gtttggatt

SEQ ID NO: 51500 - DNA, 6 bp, Unknown
  misc_feature (1)..( 6): Matrix.002 file - promoters60/1470582
tttaca

SEQ ID NO: 51501 - DNA, 8 bp, Unknown
  misc_feature (1)..( 8): Matrix.002 file - promoters60/1470582
atcaaatt

SEQ ID NO: 51502 - DNA, 6 bp, Unknown
  misc_feature (1)..( 6): Matrix.002 file - promoters60/1470582
aagata

SEQ ID NO: 51503 - DNA, 15 bp, Unknown
  misc_feature (1)..( 15): Matrix.002 file - promoters60/1470903
cccatagctccttaa

SEQ ID NO: 51504 - DNA, 7 bp, Unknown
  misc_feature (1)..( 7): Matrix.002 file - promoters60/1470903
tttggtt

SEQ ID NO: 51505 - DNA, 8 bp, Unknown
  misc_feature (1)..( 8): Matrix.002 file - promoters60/1470903
gaagagaa

SEQ ID NO: 51506 - DNA, 14 bp, Unknown
  misc_feature (1)..( 14): Matrix.002 file - promoters60/1470903
ttagcttcagcttc

SEQ ID NO: 51507 - DNA, 13 bp, Unknown
  misc_feature (1)..( 13): Matrix.002 file - promoters60/1470903
agagagagagaga

SEQ ID NO: 51508 - DNA, 7 bp, Unknown
  misc_feature (1)..( 7): Matrix.002 file - promoters60/1470903
agagaag

SEQ ID NO: 51509 - DNA, 7 bp, Unknown
  misc_feature (1)..( 7): Matrix.002 file - promoters60/1470903
ggatcaa

SEQ ID NO: 51510 - DNA, 11 bp, Unknown
  misc_feature (1)..( 11): Matrix.002 file - promoters60/1470903
attcagggttt

SEQ ID NO: 51511 - DNA, 8 bp, Unknown
  misc_feature (1)..( 8): Matrix.002 file - promoters60/1470903
aaacaatt

SEQ ID NO: 51512 - DNA, 7 bp, Unknown
  misc_feature (1)..( 7): Matrix.002 file - promoters60/1470903
aacgcga

SEQ ID NO: 51513 - DNA, 8 bp, Unknown
  misc_feature (1)..( 8): Matrix.002 file - promoters60/1470903
aaagagaa

SEQ ID NO: 51514 - DNA, 8 bp, Unknown
  misc_feature (1)..( 8): Matrix.002 file - promoters60/1470903
aacgcgaa

SEQ ID NO: 51515 - DNA, 6 bp, Unknown
  misc_feature (1)..( 6): Matrix.002 file - promoters60/1470903
ttatat

SEQ ID NO: 51516 - DNA, 7 bp, Unknown
  misc_feature (1)..( 7): Matrix.002 file - promoters60/1470903
tttggtt

SEQ ID NO: 51517 - DNA, 6 bp, Unknown
  misc_feature (1)..( 6): Matrix.002 file - promoters60/1470903
tagctt

SEQ ID NO: 51518 - DNA, 7 bp, Unknown
  misc_feature (1)..( 7): Matrix.002 file - promoters60/1470903
aacgcga

SEQ ID NO: 51519 - DNA, 11 bp, Unknown
  misc_feature (1)..( 11): Matrix.002 file - promoters60/1470993
gtagatattta

SEQ ID NO: 51520 - DNA, 8 bp, Unknown
  misc_feature (1)..( 8): Matrix.002 file - promoters60/1470993
tgatgaat

SEQ ID NO: 51521 - DNA, 10 bp, Unknown
  misc_feature (1)..( 10): Matrix.002 file - promoters60/1470993
ttagaaaaaa

SEQ ID NO: 51522 - DNA, 11 bp, Unknown
  misc_feature (1)..( 11): Matrix.002 file - promoters60/1470993
cggtacacgtg

SEQ ID NO: 51523 - DNA, 9 bp, Unknown
  misc_feature (1)..( 9): Matrix.002 file - promoters60/1470993
taaaaattg

SEQ ID NO: 51524 - DNA, 9 bp, Unknown
  misc_feature (1)..( 9): Matrix.002 file - promoters60/1470993
aaccattaa

SEQ ID NO: 51525 - DNA, 8 bp, Unknown
  misc_feature (1)..( 8): Matrix.002 file - promoters60/1470993
tagttttg

SEQ ID NO: 51526 - DNA, 14 bp, Unknown
  misc_feature (1)..( 14): Matrix.002 file - promoters60/1470993
tttaaatttgatga

SEQ ID NO: 51527 - DNA, 9 bp, Unknown
  misc_feature (1)..( 9): Matrix.002 file - promoters60/1471001
ctatacata

SEQ ID NO: 51528 - DNA, 11 bp, Unknown
  misc_feature (1)..( 11): Matrix.002 file - promoters60/1471001
tataaaaacaa

SEQ ID NO: 51529 - DNA, 7 bp, Unknown
  misc_feature (1)..( 7): Matrix.002 file - promoters60/1471001
tcatgat

SEQ ID NO: 51530 - DNA, 6 bp, Unknown
  misc_feature (1)..( 6): Matrix.002 file - promoters60/1471001
aaatat

SEQ ID NO: 51531 - DNA, 7 bp, Unknown
  misc_feature (1)..( 7): Matrix.002 file - promoters60/1471001
ctatatt

SEQ ID NO: 51532 - DNA, 6 bp, Unknown
  misc_feature (1)..( 6): Matrix.002 file - promoters60/1471001
tttttt

SEQ ID NO: 51533 - DNA, 6 bp, Unknown
  misc_feature (1)..( 6): Matrix.002 file - promoters60/1471001
tttcca

SEQ ID NO: 51534 - DNA, 7 bp, Unknown
  misc_feature (1)..( 7): Matrix.002 file - promoters60/1471001
aaactaa

SEQ ID NO: 51535 - DNA, 8 bp, Unknown
  misc_feature (1)..( 8): Matrix.002 file - promoters60/1471001
aaataata

SEQ ID NO: 51536 - DNA, 7 bp, Unknown
  misc_feature (1)..( 7): Matrix.002 file - promoters60/1471001
aatcttg

SEQ ID NO: 51537 - DNA, 7 bp, Unknown
  misc_feature (1)..( 7): Matrix.002 file - promoters60/1471001
ttaattt

SEQ ID NO: 51538 - DNA, 6 bp, Unknown
  misc_feature (1)..( 6): Matrix.002 file - promoters60/1471001
attttt

SEQ ID NO: 51539 - DNA, 8 bp, Unknown
  misc_feature (1)..( 8): Matrix.002 file - promoters60/1471001
gatatgta

SEQ ID NO: 51540 - DNA, 6 bp, Unknown
  misc_feature (1)..( 6): Matrix.002 file - promoters60/1471001
atgaga

SEQ ID NO: 51541 - DNA, 8 bp, Unknown
  misc_feature (1)..( 8): Matrix.002 file - promoters60/1471001
tgtgtcaa

SEQ ID NO: 51542 - DNA, 8 bp, Unknown
  misc_feature (1)..( 8): Matrix.002 file - promoters60/1471001
caaattaa

SEQ ID NO: 51543 - DNA, 8 bp, Unknown
  misc_feature (1)..( 8): Matrix.002 file - promoters60/1471001
atataatt

SEQ ID NO: 51544 - DNA, 9 bp, Unknown
  misc_feature (1)..( 9): Matrix.002 file - promoters60/1471001
atataatta

SEQ ID NO: 51545 - DNA, 6 bp, Unknown
  misc_feature (1)..( 6): Matrix.002 file - promoters60/1471001
aggaaa

SEQ ID NO: 51546 - DNA, 7 bp, Unknown
  misc_feature (1)..( 7): Matrix.002 file - promoters60/1471001
cttttct

SEQ ID NO: 51547 - DNA, 8 bp, Unknown
  misc_feature (1)..( 8): Matrix.002 file - promoters60/1471001
aaagaaaa

SEQ ID NO: 51548 - DNA, 6 bp, Unknown
  misc_feature (1)..( 6): Matrix.002 file - promoters60/1471001
tataaa

SEQ ID NO: 51549 - DNA, 6 bp, Unknown
  misc_feature (1)..( 6): Matrix.002 file - promoters60/1471001
gaaaca

SEQ ID NO: 51550 - DNA, 6 bp, Unknown
  misc_feature (1)..( 6): Matrix.002 file - promoters60/1471001
tcaaaa

SEQ ID NO: 51551 - DNA, 8 bp, Unknown
  misc_feature (1)..( 8): Matrix.002 file - promoters60/1471009
aattaaaa

SEQ ID NO: 51552 - DNA, 8 bp, Unknown
  misc_feature (1)..( 8): Matrix.002 file - promoters60/1471009
tttaaaaa

SEQ ID NO: 51553 - DNA, 7 bp, Unknown
  misc_feature (1)..( 7): Matrix.002 file - promoters60/1471009
aataaac

SEQ ID NO: 51554 - DNA, 7 bp, Unknown
  misc_feature (1)..( 7): Matrix.002 file - promoters60/1471009
tcctata

SEQ ID NO: 51555 - DNA, 10 bp, Unknown
  misc_feature (1)..( 10): Matrix.002 file - promoters60/1471009
caagatttta

SEQ ID NO: 51556 - DNA, 8 bp, Unknown
  misc_feature (1)..( 8): Matrix.002 file - promoters60/1471041
attaattt

SEQ ID NO: 51557 - DNA, 8 bp, Unknown
  misc_feature (1)..( 8): Matrix.002 file - promoters60/1471041
aaaataaa

SEQ ID NO: 51558 - DNA, 11 bp, Unknown
  misc_feature (1)..( 11): Matrix.002 file - promoters60/1471041
caaaaaagaaa

SEQ ID NO: 51559 - DNA, 7 bp, Unknown
  misc_feature (1)..( 7): Matrix.002 file - promoters60/1471073
tttctta

SEQ ID NO: 51560 - DNA, 6 bp, Unknown
  misc_feature (1)..( 6): Matrix.002 file - promoters60/1471073
attttt

SEQ ID NO: 51561 - DNA, 8 bp, Unknown
  misc_feature (1)..( 8): Matrix.002 file - promoters60/1471073
aaaaaata

SEQ ID NO: 51562 - DNA, 7 bp, Unknown
  misc_feature (1)..( 7): Matrix.002 file - promoters60/1471073
aataaaa

SEQ ID NO: 51563 - DNA, 8 bp, Unknown
  misc_feature (1)..( 8): Matrix.002 file - promoters60/1471073
ataaaata

SEQ ID NO: 51564 - DNA, 11 bp, Unknown
  misc_feature (1)..( 11): Matrix.002 file - promoters60/1471073
tgataaatgaa

SEQ ID NO: 51565 - DNA, 6 bp, Unknown
  misc_feature (1)..( 6): Matrix.002 file - promoters60/1471073
tgaata

SEQ ID NO: 51566 - DNA, 7 bp, Unknown
  misc_feature (1)..( 7): Matrix.002 file - promoters60/1471073
attatat

SEQ ID NO: 51567 - DNA, 8 bp, Unknown
  misc_feature (1)..( 8): Matrix.002 file - promoters60/1471073
aaatataa

SEQ ID NO: 51568 - DNA, 6 bp, Unknown
  misc_feature (1)..( 6): Matrix.002 file - promoters60/1471073
atttaa

SEQ ID NO: 51569 - DNA, 6 bp, Unknown
  misc_feature (1)..( 6): Matrix.002 file - promoters60/1471073
ttctca

SEQ ID NO: 51570 - DNA, 6 bp, Unknown
  misc_feature (1)..( 6): Matrix.002 file - promoters60/1471073
aaatca

SEQ ID NO: 51571 - DNA, 10 bp, Unknown
  misc_feature (1)..( 10): Matrix.002 file - promoters60/1471073
ataaaatcat

SEQ ID NO: 51572 - DNA, 6 bp, Unknown
  misc_feature (1)..( 6): Matrix.002 file - promoters60/1471073
tattaa

SEQ ID NO: 51573 - DNA, 6 bp, Unknown
  misc_feature (1)..( 6): Matrix.002 file - promoters60/1471073
aattta

SEQ ID NO: 51574 - DNA, 10 bp, Unknown
  misc_feature (1)..( 10): Matrix.002 file - promoters60/1471073
aattatttgc

SEQ ID NO: 51575 - DNA, 7 bp, Unknown
  misc_feature (1)..( 7): Matrix.002 file - promoters60/1471073
aaaagtc

SEQ ID NO: 51576 - DNA, 9 bp, Unknown
  misc_feature (1)..( 9): Matrix.002 file - promoters60/1471073
agtaaccat

SEQ ID NO: 51577 - DNA, 8 bp, Unknown
  misc_feature (1)..( 8): Matrix.002 file - promoters60/1471073
ataatttt

SEQ ID NO: 51578 - DNA, 7 bp, Unknown
  misc_feature (1)..( 7): Matrix.002 file - promoters60/1471073
tacctta

SEQ ID NO: 51579 - DNA, 6 bp, Unknown
  misc_feature (1)..( 6): Matrix.002 file - promoters60/1471073
aaaaag

SEQ ID NO: 51580 - DNA, 7 bp, Unknown
  misc_feature (1)..( 7): Matrix.002 file - promoters60/1471073
aagaaaa

SEQ ID NO: 51581 - DNA, 7 bp, Unknown
  misc_feature (1)..( 7): Matrix.002 file - promoters60/1471073
aaagaat

SEQ ID NO: 51582 - DNA, 9 bp, Unknown
  misc_feature (1)..( 9): Matrix.002 file - promoters60/1471073
attaaaaat

SEQ ID NO: 51583 - DNA, 7 bp, Unknown
  misc_feature (1)..( 7): Matrix.002 file - promoters60/1471073
attaaac

SEQ ID NO: 51584 - DNA, 6 bp, Unknown
  misc_feature (1)..( 6): Matrix.002 file - promoters60/1471073
atgttt

SEQ ID NO: 51585 - DNA, 8 bp, Unknown
  misc_feature (1)..( 8): Matrix.002 file - promoters60/1471073
aaagtaaa

SEQ ID NO: 51586 - DNA, 7 bp, Unknown
  misc_feature (1)..( 7): Matrix.002 file - promoters60/1471073
atcatca

SEQ ID NO: 51587 - DNA, 6 bp, Unknown
  misc_feature (1)..( 6): Matrix.002 file - promoters60/1471106
atgtca

SEQ ID NO: 51588 - DNA, 6 bp, Unknown
  misc_feature (1)..( 6): Matrix.002 file - promoters60/1471106
aaactt

SEQ ID NO: 51589 - DNA, 7 bp, Unknown
  misc_feature (1)..( 7): Matrix.002 file - promoters60/1471106
ttataaa

SEQ ID NO: 51590 - DNA, 6 bp, Unknown
  misc_feature (1)..( 6): Matrix.002 file - promoters60/1471106
atgatg

SEQ ID NO: 51591 - DNA, 9 bp, Unknown
  misc_feature (1)..( 9): Matrix.002 file - promoters60/1471106
agaagctaa

SEQ ID NO: 51592 - DNA, 6 bp, Unknown
  misc_feature (1)..( 6): Matrix.002 file - promoters60/1471106
tcagca

SEQ ID NO: 51593 - DNA, 6 bp, Unknown
  misc_feature (1)..( 6): Matrix.002 file - promoters60/1471106
aatttg

SEQ ID NO: 51594 - DNA, 8 bp, Unknown
  misc_feature (1)..( 8): Matrix.002 file - promoters60/1471106
tttctttt

SEQ ID NO: 51595 - DNA, 6 bp, Unknown
  misc_feature (1)..( 6): Matrix.002 file - promoters60/1471106
taaaac

SEQ ID NO: 51596 - DNA, 8 bp, Unknown
  misc_feature (1)..( 8): Matrix.002 file - promoters60/1471106
taaaaccc

SEQ ID NO: 51597 - DNA, 7 bp, Unknown
  misc_feature (1)..( 7): Matrix.002 file - promoters60/1471106
aacacaa

SEQ ID NO: 51598 - DNA, 8 bp, Unknown
  misc_feature (1)..( 8): Matrix.002 file - promoters60/1471106
acaagctt

SEQ ID NO: 51599 - DNA, 8 bp, Unknown
  misc_feature (1)..( 8): Matrix.002 file - promoters60/1471106
tcaagaat

SEQ ID NO: 51600 - DNA, 8 bp, Unknown
  misc_feature (1)..( 8): Matrix.002 file - promoters60/1471106
aacaaaat

SEQ ID NO: 51601 - DNA, 6 bp, Unknown
  misc_feature (1)..( 6): Matrix.002 file - promoters60/1471106
tttaca

SEQ ID NO: 51602 - DNA, 6 bp, Unknown
  misc_feature (1)..( 6): Matrix.002 file - promoters60/1471106
acattt

SEQ ID NO: 51603 - DNA, 6 bp, Unknown
  misc_feature (1)..( 6): Matrix.002 file - promoters60/1471106
tttgct

SEQ ID NO: 51604 - DNA, 8 bp, Unknown
  misc_feature (1)..( 8): Matrix.002 file - promoters60/1471106
agtgaaac

SEQ ID NO: 51605 - DNA, 6 bp, Unknown
  misc_feature (1)..( 6): Matrix.002 file - promoters60/1471106
cccata

SEQ ID NO: 51606 - DNA, 8 bp, Unknown
  misc_feature (1)..( 8): Matrix.002 file - promoters60/1471140
atacaaaa

SEQ ID NO: 51607 - DNA, 8 bp, Unknown
  misc_feature (1)..( 8): Matrix.002 file - promoters60/1471140
ataaaata

SEQ ID NO: 51608 - DNA, 9 bp, Unknown
  misc_feature (1)..( 9): Matrix.002 file - promoters60/1471140
aaacaaaaa

SEQ ID NO: 51609 - DNA, 8 bp, Unknown
  misc_feature (1)..( 8): Matrix.002 file - promoters60/1471140
aaatttat

SEQ ID NO: 51610 - DNA, 11 bp, Unknown
  misc_feature (1)..( 11): Matrix.002 file - promoters60/1471140
gaaatttcaac

SEQ ID NO: 51611 - DNA, 11 bp, Unknown
  misc_feature (1)..( 11): Matrix.002 file - promoters60/1472778
taaaaaagaaa

SEQ ID NO: 51612 - DNA, 6 bp, Unknown
  misc_feature (1)..( 6): Matrix.002 file - promoters60/1472778
atttta

SEQ ID NO: 51613 - DNA, 7 bp, Unknown
  misc_feature (1)..( 7): Matrix.002 file - promoters60/1472778
ttaaatt

SEQ ID NO: 51614 - DNA, 12 bp, Unknown
  misc_feature (1)..( 12): Matrix.002 file - promoters60/1472778
tataaataacac

SEQ ID NO: 51615 - DNA, 11 bp, Unknown
  misc_feature (1)..( 11): Matrix.002 file - promoters60/1472778
gatacacttat

SEQ ID NO: 51616 - DNA, 8 bp, Unknown
  misc_feature (1)..( 8): Matrix.002 file - promoters60/1472799
atcatatt

SEQ ID NO: 51617 - DNA, 9 bp, Unknown
  misc_feature (1)..( 9): Matrix.002 file - promoters60/1472799
tttgtagtg

SEQ ID NO: 51618 - DNA, 8 bp, Unknown
  misc_feature (1)..( 8): Matrix.002 file - promoters60/1472799
tgatttgt

SEQ ID NO: 51619 - DNA, 6 bp, Unknown
  misc_feature (1)..( 6): Matrix.002 file - promoters60/1472799
atattt

SEQ ID NO: 51620 - DNA, 7 bp, Unknown
  misc_feature (1)..( 7): Matrix.002 file - promoters60/1472799
gtttgtt

SEQ ID NO: 51621 - DNA, 6 bp, Unknown
  misc_feature (1)..( 6): Matrix.002 file - promoters60/1472799
tgatgt

SEQ ID NO: 51622 - DNA, 8 bp, Unknown
  misc_feature (1)..( 8): Matrix.002 file - promoters60/1472799
gatttgtt

SEQ ID NO: 51623 - DNA, 7 bp, Unknown
  misc_feature (1)..( 7): Matrix.002 file - promoters60/1472799
gttttgt

SEQ ID NO: 51624 - DNA, 7 bp, Unknown
  misc_feature (1)..( 7): Matrix.002 file - promoters60/1472799
aagaaca

SEQ ID NO: 51625 - DNA, 6 bp, Unknown
  misc_feature (1)..( 6): Matrix.002 file - promoters60/1472799
tgtgat

SEQ ID NO: 51626 - DNA, 8 bp, Unknown
  misc_feature (1)..( 8): Matrix.002 file - promoters60/1472799
ataatttg

SEQ ID NO: 51627 - DNA, 8 bp, Unknown
  misc_feature (1)..( 8): Matrix.002 file - promoters60/1472799
agtatgtt

SEQ ID NO: 51628 - DNA, 6 bp, Unknown
  misc_feature (1)..( 6): Matrix.002 file - promoters60/1472799
tgtttg

SEQ ID NO: 51629 - DNA, 6 bp, Unknown
  misc_feature (1)..( 6): Matrix.002 file - promoters60/1472799
gagttt

SEQ ID NO: 51630 - DNA, 6 bp, Unknown
  misc_feature (1)..( 6): Matrix.002 file - promoters60/1472799
ctgatt

SEQ ID NO: 51631 - DNA, 6 bp, Unknown
  misc_feature (1)..( 6): Matrix.002 file - promoters60/1472799
ttagtt

SEQ ID NO: 51632 - DNA, 9 bp, Unknown
  misc_feature (1)..( 9): Matrix.002 file - promoters60/1473014
atatataac

SEQ ID NO: 51633 - DNA, 13 bp, Unknown
  misc_feature (1)..( 13): Matrix.002 file - promoters60/1473014
gcttattcactct

SEQ ID NO: 51634 - DNA, 8 bp, Unknown
  misc_feature (1)..( 8): Matrix.002 file - promoters60/1473014
atttagtt

SEQ ID NO: 51635 - DNA, 7 bp, Unknown
  misc_feature (1)..( 7): Matrix.002 file - promoters60/1473014
ataatat

SEQ ID NO: 51636 - DNA, 6 bp, Unknown
  misc_feature (1)..( 6): Matrix.002 file - promoters60/1473014
aataat

SEQ ID NO: 51637 - DNA, 10 bp, Unknown
  misc_feature (1)..( 10): Matrix.002 file - promoters60/1473014
ttaaaaccct

SEQ ID NO: 51638 - DNA, 6 bp, Unknown
  misc_feature (1)..( 6): Matrix.002 file - promoters60/1473014
aagtca

SEQ ID NO: 51639 - DNA, 13 bp, Unknown
  misc_feature (1)..( 13): Matrix.002 file - promoters60/1473014
acccattttctgc

SEQ ID NO: 51640 - DNA, 6 bp, Unknown
  misc_feature (1)..( 6): Matrix.002 file - promoters60/1473014
agaaga

SEQ ID NO: 51641 - DNA, 6 bp, Unknown
  misc_feature (1)..( 6): Matrix.002 file - promoters60/1473014
atatta

SEQ ID NO: 51642 - DNA, 7 bp, Unknown
  misc_feature (1)..( 7): Matrix.002 file - promoters60/1473014
gtataaa

SEQ ID NO: 51643 - DNA, 7 bp, Unknown
  misc_feature (1)..( 7): Matrix.002 file - promoters60/1473014
cataaac

SEQ ID NO: 51644 - DNA, 7 bp, Unknown
  misc_feature (1)..( 7): Matrix.002 file - promoters60/1473014
gcgagtt

SEQ ID NO: 51645 - DNA, 12 bp, Unknown
  misc_feature (1)..( 12): Matrix.002 file - promoters60/1481334
ctggagaggaga

SEQ ID NO: 51646 - DNA, 8 bp, Unknown
  misc_feature (1)..( 8): Matrix.002 file - promoters60/1481334
agagagga

SEQ ID NO: 51647 - DNA, 14 bp, Unknown
  misc_feature (1)..( 14): Matrix.002 file - promoters60/1481334
agaaataaaagaaa

SEQ ID NO: 51648 - DNA, 12 bp, Unknown
  misc_feature (1)..( 12): Matrix.002 file - promoters60/1481334
agagaatattta

SEQ ID NO: 51649 - DNA, 6 bp, Unknown
  misc_feature (1)..( 6): Matrix.002 file - promoters60/1481568
caatta

SEQ ID NO: 51650 - DNA, 7 bp, Unknown
  misc_feature (1)..( 7): Matrix.002 file - promoters60/1481568
atacaga

SEQ ID NO: 51651 - DNA, 7 bp, Unknown
  misc_feature (1)..( 7): Matrix.002 file - promoters60/1481568
aagacat

SEQ ID NO: 51652 - DNA, 8 bp, Unknown
  misc_feature (1)..( 8): Matrix.002 file - promoters60/1481568
agacaaaa

SEQ ID NO: 51653 - DNA, 7 bp, Unknown
  misc_feature (1)..( 7): Matrix.002 file - promoters60/1481568
tgaagaa

SEQ ID NO: 51654 - DNA, 6 bp, Unknown
  misc_feature (1)..( 6): Matrix.002 file - promoters60/1481568
gctagt

SEQ ID NO: 51655 - DNA, 8 bp, Unknown
  misc_feature (1)..( 8): Matrix.002 file - promoters60/1481568
agaaaacc

SEQ ID NO: 51656 - DNA, 10 bp, Unknown
  misc_feature (1)..( 10): Matrix.002 file - promoters60/1481568
aacgcgtttt

SEQ ID NO: 51657 - DNA, 6 bp, Unknown
  misc_feature (1)..( 6): Matrix.002 file - promoters60/1481568
aaaaat

SEQ ID NO: 51658 - DNA, 9 bp, Unknown
  misc_feature (1)..( 9): Matrix.002 file - promoters60/1481568
aagagtaaa

SEQ ID NO: 51659 - DNA, 8 bp, Unknown
  misc_feature (1)..( 8): Matrix.002 file - promoters60/1481568
cattgtta

SEQ ID NO: 51660 - DNA, 10 bp, Unknown
  misc_feature (1)..( 10): Matrix.002 file - promoters60/1481568
ggaaatgaaa

SEQ ID NO: 51661 - DNA, 7 bp, Unknown
  misc_feature (1)..( 7): Matrix.002 file - promoters60/1481568
aaaccaa

SEQ ID NO: 51662 - DNA, 7 bp, Unknown
  misc_feature (1)..( 7): Matrix.002 file - promoters60/1481568
cgaaccc

SEQ ID NO: 51663 - DNA, 7 bp, Unknown
  misc_feature (1)..( 7): Matrix.002 file - promoters60/1481568
aatcggg

SEQ ID NO: 51664 - DNA, 8 bp, Unknown
  misc_feature (1)..( 8): Matrix.002 file - promoters60/1481568
gaaacaaa

SEQ ID NO: 51665 - DNA, 7 bp, Unknown
  misc_feature (1)..( 7): Matrix.002 file - promoters60/1481568
cccacta

SEQ ID NO: 51666 - DNA, 9 bp, Unknown
  misc_feature (1)..( 9): Matrix.002 file - promoters60/1481568
aaagaaaag

SEQ ID NO: 51667 - DNA, 7 bp, Unknown
  misc_feature (1)..( 7): Matrix.002 file - promoters60/1481568
gtatata

SEQ ID NO: 51668 - DNA, 10 bp, Unknown
  misc_feature (1)..( 10): Matrix.002 file - promoters60/1481696
agtgattaat

SEQ ID NO: 51669 - DNA, 12 bp, Unknown
  misc_feature (1)..( 12): Matrix.002 file - promoters60/1481696
aaatcaaagttt

SEQ ID NO: 51670 - DNA, 6 bp, Unknown
  misc_feature (1)..( 6): Matrix.002 file - promoters60/1482017
atttat

SEQ ID NO: 51671 - DNA, 10 bp, Unknown
  misc_feature (1)..( 10): Matrix.002 file - promoters60/1482017
gatgatactc

SEQ ID NO: 51672 - DNA, 8 bp, Unknown
  misc_feature (1)..( 8): Matrix.002 file - promoters60/1482017
ataaaata

SEQ ID NO: 51673 - DNA, 7 bp, Unknown
  misc_feature (1)..( 7): Matrix.002 file - promoters60/1482017
tctatat

SEQ ID NO: 51674 - DNA, 11 bp, Unknown
  misc_feature (1)..( 11): Matrix.002 file - promoters60/1482017
tttttgttaac

SEQ ID NO: 51675 - DNA, 9 bp, Unknown
  misc_feature (1)..( 9): Matrix.002 file - promoters60/1482017
ttttttttt

SEQ ID NO: 51676 - DNA, 6 bp, Unknown
  misc_feature (1)..( 6): Matrix.002 file - promoters60/1482201
atccaa

SEQ ID NO: 51677 - DNA, 7 bp, Unknown
  misc_feature (1)..( 7): Matrix.002 file - promoters60/1482448
ccctaac

SEQ ID NO: 51678 - DNA, 8 bp, Unknown
  misc_feature (1)..( 8): Matrix.002 file - promoters60/1482448
actatata

SEQ ID NO: 51679 - DNA, 9 bp, Unknown
  misc_feature (1)..( 9): Matrix.002 file - promoters60/1482448
aggaaaaaa

SEQ ID NO: 51680 - DNA, 8 bp, Unknown
  misc_feature (1)..( 8): Matrix.002 file - promoters60/1482448
tgtaaaac

SEQ ID NO: 51681 - DNA, 6 bp, Unknown
  misc_feature (1)..( 6): Matrix.002 file - promoters60/1482448
attgat

SEQ ID NO: 51682 - DNA, 6 bp, Unknown
  misc_feature (1)..( 6): Matrix.002 file - promoters60/1482448
attcat

SEQ ID NO: 51683 - DNA, 6 bp, Unknown
  misc_feature (1)..( 6): Matrix.002 file - promoters60/1482448
atataa

SEQ ID NO: 51684 - DNA, 8 bp, Unknown
  misc_feature (1)..( 8): Matrix.002 file - promoters60/1482448
tggaaata

SEQ ID NO: 51685 - DNA, 7 bp, Unknown
  misc_feature (1)..( 7): Matrix.002 file - promoters60/1482448
taatttg

SEQ ID NO: 51686 - DNA, 6 bp, Unknown
  misc_feature (1)..( 6): Matrix.002 file - promoters60/1482448
aatcaa

SEQ ID NO: 51687 - DNA, 8 bp, Unknown
  misc_feature (1)..( 8): Matrix.002 file - promoters60/1482448
catttttt

SEQ ID NO: 51688 - DNA, 8 bp, Unknown
  misc_feature (1)..( 8): Matrix.002 file - promoters60/1482448
attttaaa

SEQ ID NO: 51689 - DNA, 8 bp, Unknown
  misc_feature (1)..( 8): Matrix.002 file - promoters60/1482448
gtagttaa

SEQ ID NO: 51690 - DNA, 6 bp, Unknown
  misc_feature (1)..( 6): Matrix.002 file - promoters60/1482448
ttttta

SEQ ID NO: 51691 - DNA, 6 bp, Unknown
  misc_feature (1)..( 6): Matrix.002 file - promoters60/1482448
aacgta

SEQ ID NO: 51692 - DNA, 6 bp, Unknown
  misc_feature (1)..( 6): Matrix.002 file - promoters60/1482448
atttag

SEQ ID NO: 51693 - DNA, 7 bp, Unknown
  misc_feature (1)..( 7): Matrix.002 file - promoters60/1482448
atccaaa

SEQ ID NO: 51694 - DNA, 9 bp, Unknown
  misc_feature (1)..( 9): Matrix.002 file - promoters60/1482527
aatttttgg

SEQ ID NO: 51695 - DNA, 11 bp, Unknown
  misc_feature (1)..( 11): Matrix.002 file - promoters60/1482527
ctcttaaatat

SEQ ID NO: 51696 - DNA, 9 bp, Unknown
  misc_feature (1)..( 9): Matrix.002 file - promoters60/1482527
aattggtta

SEQ ID NO: 51697 - DNA, 8 bp, Unknown
  misc_feature (1)..( 8): Matrix.002 file - promoters60/1482527
cttcatct

SEQ ID NO: 51698 - DNA, 8 bp, Unknown
  misc_feature (1)..( 8): Matrix.002 file - promoters60/1482527
aaaaattc

SEQ ID NO: 51699 - DNA, 6 bp, Unknown
  misc_feature (1)..( 6): Matrix.002 file - promoters60/1482546
accgac

SEQ ID NO: 51700 - DNA, 7 bp, Unknown
  misc_feature (1)..( 7): Matrix.002 file - promoters60/1482546
acaaatt

SEQ ID NO: 51701 - DNA, 7 bp, Unknown
  misc_feature (1)..( 7): Matrix.002 file - promoters60/1482546
gtcggat

SEQ ID NO: 51702 - DNA, 12 bp, Unknown
  misc_feature (1)..( 12): Matrix.002 file - promoters60/1482546
ctgaagaagaaa

SEQ ID NO: 51703 - DNA, 9 bp, Unknown
  misc_feature (1)..( 9): Matrix.002 file - promoters60/1482546
caaaagctt

SEQ ID NO: 51704 - DNA, 7 bp, Unknown
  misc_feature (1)..( 7): Matrix.002 file - promoters60/1482546
tgataac

SEQ ID NO: 51705 - DNA, 10 bp, Unknown
  misc_feature (1)..( 10): Matrix.002 file - promoters60/1482546
gagagtgaaa

SEQ ID NO: 51706 - DNA, 7 bp, Unknown
  misc_feature (1)..( 7): Matrix.002 file - promoters60/1482546
gagaaag

SEQ ID NO: 51707 - DNA, 7 bp, Unknown
  misc_feature (1)..( 7): Matrix.002 file - promoters60/1482546
tcaaaga

SEQ ID NO: 51708 - DNA, 7 bp, Unknown
  misc_feature (1)..( 7): Matrix.002 file - promoters60/1482546
aaaagct

SEQ ID NO: 51709 - DNA, 11 bp, Unknown
  misc_feature (1)..( 11): Matrix.002 file - promoters60/1532660
ttaatcaaaaa

SEQ ID NO: 51710 - DNA, 12 bp, Unknown
  misc_feature (1)..( 12): Matrix.002 file - promoters60/1532821
tactaacatatg

SEQ ID NO: 51711 - DNA, 7 bp, Unknown
  misc_feature (1)..( 7): Matrix.002 file - promoters60/1532821
aaatatt

SEQ ID NO: 51712 - DNA, 12 bp, Unknown
  misc_feature (1)..( 12): Matrix.002 file - promoters60/1532821
ccaccacttttt

SEQ ID NO: 51713 - DNA, 7 bp, Unknown
  misc_feature (1)..( 7): Matrix.002 file - promoters60/1532925
aaagaag

SEQ ID NO: 51714 - DNA, 7 bp, Unknown
  misc_feature (1)..( 7): Matrix.002 file - promoters60/1532925
gatcaaa

SEQ ID NO: 51715 - DNA, 7 bp, Unknown
  misc_feature (1)..( 7): Matrix.002 file - promoters60/1532925
attgatc

SEQ ID NO: 51716 - DNA, 9 bp, Unknown
  misc_feature (1)..( 9): Matrix.002 file - promoters60/1532925
tttcttatt

SEQ ID NO: 51717 - DNA, 6 bp, Unknown
  misc_feature (1)..( 6): Matrix.002 file - promoters60/1532925
ttcgtg

SEQ ID NO: 51718 - DNA, 8 bp, Unknown
  misc_feature (1)..( 8): Matrix.002 file - promoters60/1532925
ttttttat

SEQ ID NO: 51719 - DNA, 7 bp, Unknown
  misc_feature (1)..( 7): Matrix.002 file - promoters60/1532925
ggaaaaa

SEQ ID NO: 51720 - DNA, 6 bp, Unknown
  misc_feature (1)..( 6): Matrix.002 file - promoters60/1532925
ttttag

SEQ ID NO: 51721 - DNA, 7 bp, Unknown
  misc_feature (1)..( 7): Matrix.002 file - promoters60/1532925
caaactt

SEQ ID NO: 51722 - DNA, 6 bp, Unknown
  misc_feature (1)..( 6): Matrix.002 file - promoters60/1532925
gtgaaa

SEQ ID NO: 51723 - DNA, 7 bp, Unknown
  misc_feature (1)..( 7): Matrix.002 file - promoters60/1532925
gaatgat

SEQ ID NO: 51724 - DNA, 7 bp, Unknown
  misc_feature (1)..( 7): Matrix.002 file - promoters60/1532925
tgatgtt

SEQ ID NO: 51725 - DNA, 6 bp, Unknown
  misc_feature (1)..( 6): Matrix.002 file - promoters60/1532925
aataaa

SEQ ID NO: 51726 - DNA, 8 bp, Unknown
  misc_feature (1)..( 8): Matrix.002 file - promoters60/1532925
tattttgt

SEQ ID NO: 51727 - DNA, 8 bp, Unknown
  misc_feature (1)..( 8): Matrix.002 file - promoters60/1532925
catgatgt

SEQ ID NO: 51728 - DNA, 11 bp, Unknown
  misc_feature (1)..( 11): Matrix.002 file - promoters60/1532925
ttagtatacaa

SEQ ID NO: 51729 - DNA, 6 bp, Unknown
  misc_feature (1)..( 6): Matrix.002 file - promoters60/1532925
attata

SEQ ID NO: 51730 - DNA, 6 bp, Unknown
  misc_feature (1)..( 6): Matrix.002 file - promoters60/1532925
attttt

SEQ ID NO: 51731 - DNA, 6 bp, Unknown
  misc_feature (1)..( 6): Matrix.002 file - promoters60/1532925
tcaact

SEQ ID NO: 51732 - DNA, 9 bp, Unknown
  misc_feature (1)..( 9): Matrix.002 file - promoters60/1532925
agaaaaaaa

SEQ ID NO: 51733 - DNA, 7 bp, Unknown
  misc_feature (1)..( 7): Matrix.002 file - promoters60/1532925
aaaacaa

SEQ ID NO: 51734 - DNA, 7 bp, Unknown
  misc_feature (1)..( 7): Matrix.002 file - promoters60/1532925
gagaaaa

SEQ ID NO: 51735 - DNA, 10 bp, Unknown
  misc_feature (1)..( 10): Matrix.002 file - promoters60/1532925
gtttaatata

SEQ ID NO: 51736 - DNA, 6 bp, Unknown
  misc_feature (1)..( 6): Matrix.002 file - promoters60/1532929
tatcct

SEQ ID NO: 51737 - DNA, 9 bp, Unknown
  misc_feature (1)..( 9): Matrix.002 file - promoters60/1532929
cctacattg

SEQ ID NO: 51738 - DNA, 9 bp, Unknown
  misc_feature (1)..( 9): Matrix.002 file - promoters60/1532929
ttagattat

SEQ ID NO: 51739 - DNA, 6 bp, Unknown
  misc_feature (1)..( 6): Matrix.002 file - promoters60/1532929
tgatct

SEQ ID NO: 51740 - DNA, 9 bp, Unknown
  misc_feature (1)..( 9): Matrix.002 file - promoters60/1532929
ttgtatcta

SEQ ID NO: 51741 - DNA, 7 bp, Unknown
  misc_feature (1)..( 7): Matrix.002 file - promoters60/1532929
tctattc

SEQ ID NO: 51742 - DNA, 7 bp, Unknown
  misc_feature (1)..( 7): Matrix.002 file - promoters60/1532929
tcaatat

SEQ ID NO: 51743 - DNA, 7 bp, Unknown
  misc_feature (1)..( 7): Matrix.002 file - promoters60/1532929
agctctc

SEQ ID NO: 51744 - DNA, 7 bp, Unknown
  misc_feature (1)..( 7): Matrix.002 file - promoters60/1532929
gctagtc

SEQ ID NO: 51745 - DNA, 6 bp, Unknown
  misc_feature (1)..( 6): Matrix.002 file - promoters60/1532929
ggaatc

SEQ ID NO: 51746 - DNA, 6 bp, Unknown
  misc_feature (1)..( 6): Matrix.002 file - promoters60/1532929
tgtttt

SEQ ID NO: 51747 - DNA, 6 bp, Unknown
  misc_feature (1)..( 6): Matrix.002 file - promoters60/1532929
tggtaa

SEQ ID NO: 51748 - DNA, 13 bp, Unknown
  misc_feature (1)..( 13): Matrix.002 file - promoters60/1532929
tctgggaaatcgg

SEQ ID NO: 51749 - DNA, 7 bp, Unknown
  misc_feature (1)..( 7): Matrix.002 file - promoters60/1532929
atgttat

SEQ ID NO: 51750 - DNA, 6 bp, Unknown
  misc_feature (1)..( 6): Matrix.002 file - promoters60/1532929
ttctct

SEQ ID NO: 51751 - DNA, 11 bp, Unknown
  misc_feature (1)..( 11): Matrix.002 file - promoters60/1532937
aaagaaaaaat

SEQ ID NO: 51752 - DNA, 8 bp, Unknown
  misc_feature (1)..( 8): Matrix.002 file - promoters60/1532948
attccatt

SEQ ID NO: 51753 - DNA, 8 bp, Unknown
  misc_feature (1)..( 8): Matrix.002 file - promoters60/1532948
tttgtaat

SEQ ID NO: 51754 - DNA, 12 bp, Unknown
  misc_feature (1)..( 12): Matrix.002 file - promoters60/1532948
aaaagaaattaa

SEQ ID NO: 51755 - DNA, 12 bp, Unknown
  misc_feature (1)..( 12): Matrix.002 file - promoters60/1532948
ttgagacaaaaa

SEQ ID NO: 51756 - DNA, 7 bp, Unknown
  misc_feature (1)..( 7): Matrix.002 file - promoters60/1532948
ggagaaa

SEQ ID NO: 51757 - DNA, 8 bp, Unknown
  misc_feature (1)..( 8): Matrix.002 file - promoters60/1532948
cccactaa

SEQ ID NO: 51758 - DNA, 9 bp, Unknown
  misc_feature (1)..( 9): Matrix.002 file - promoters60/1532948
taacaagta

SEQ ID NO: 51759 - DNA, 7 bp, Unknown
  misc_feature (1)..( 7): Matrix.002 file - promoters60/1532975
ttcatct

SEQ ID NO: 51760 - DNA, 6 bp, Unknown
  misc_feature (1)..( 6): Matrix.002 file - promoters60/1532975
ataaat

SEQ ID NO: 51761 - DNA, 7 bp, Unknown
  misc_feature (1)..( 7): Matrix.002 file - promoters60/1532975
aaaacaa

SEQ ID NO: 51762 - DNA, 10 bp, Unknown
  misc_feature (1)..( 10): Matrix.002 file - promoters60/1532975
aaaaagaaag

SEQ ID NO: 51763 - DNA, 6 bp, Unknown
  misc_feature (1)..( 6): Matrix.002 file - promoters60/1532975
taactt

SEQ ID NO: 51764 - DNA, 6 bp, Unknown
  misc_feature (1)..( 6): Matrix.002 file - promoters60/1532975
ttgcaa

SEQ ID NO: 51765 - DNA, 7 bp, Unknown
  misc_feature (1)..( 7): Matrix.002 file - promoters60/1532975
taaataa

SEQ ID NO: 51766 - DNA, 6 bp, Unknown
  misc_feature (1)..( 6): Matrix.002 file - promoters60/1532975
tctaaa

SEQ ID NO: 51767 - DNA, 6 bp, Unknown
  misc_feature (1)..( 6): Matrix.002 file - promoters60/1532975
agtaaa

SEQ ID NO: 51768 - DNA, 7 bp, Unknown
  misc_feature (1)..( 7): Matrix.002 file - promoters60/1532975
aatcggg

SEQ ID NO: 51769 - DNA, 8 bp, Unknown
  misc_feature (1)..( 8): Matrix.002 file - promoters60/1532975
gaaacaaa

SEQ ID NO: 51770 - DNA, 10 bp, Unknown
  misc_feature (1)..( 10): Matrix.002 file - promoters60/1532975
ggaaaagaaa

SEQ ID NO: 51771 - DNA, 7 bp, Unknown
  misc_feature (1)..( 7): Matrix.002 file - promoters60/1532975
cccacta

SEQ ID NO: 51772 - DNA, 9 bp, Unknown
  misc_feature (1)..( 9): Matrix.002 file - promoters60/1532975
aaagaaaag

SEQ ID NO: 51773 - DNA, 7 bp, Unknown
  misc_feature (1)..( 7): Matrix.002 file - promoters60/1532975
gtatata

SEQ ID NO: 51774 - DNA, 7 bp, Unknown
  misc_feature (1)..( 7): Matrix.002 file - promoters60/1533121
tttattt

SEQ ID NO: 51775 - DNA, 8 bp, Unknown
  misc_feature (1)..( 8): Matrix.002 file - promoters60/1533121
tttctaac

SEQ ID NO: 51776 - DNA, 6 bp, Unknown
  misc_feature (1)..( 6): Matrix.002 file - promoters60/1533121
agttaa

SEQ ID NO: 51777 - DNA, 6 bp, Unknown
  misc_feature (1)..( 6): Matrix.002 file - promoters60/1533121
ttttgg

SEQ ID NO: 51778 - DNA, 6 bp, Unknown
  misc_feature (1)..( 6): Matrix.002 file - promoters60/1533121
aataat

SEQ ID NO: 51779 - DNA, 7 bp, Unknown
  misc_feature (1)..( 7): Matrix.002 file - promoters60/1533121
taaatta

SEQ ID NO: 51780 - DNA, 11 bp, Unknown
  misc_feature (1)..( 11): Matrix.002 file - promoters60/1533121
caaaaacatat

SEQ ID NO: 51781 - DNA, 6 bp, Unknown
  misc_feature (1)..( 6): Matrix.002 file - promoters60/1533121
acagtt

SEQ ID NO: 51782 - DNA, 7 bp, Unknown
  misc_feature (1)..( 7): Matrix.002 file - promoters60/1533121
acaatta

SEQ ID NO: 51783 - DNA, 6 bp, Unknown
  misc_feature (1)..( 6): Matrix.002 file - promoters60/1533121
tatgca

SEQ ID NO: 51784 - DNA, 8 bp, Unknown
  misc_feature (1)..( 8): Matrix.002 file - promoters60/1533121
cttaataa

SEQ ID NO: 51785 - DNA, 6 bp, Unknown
  misc_feature (1)..( 6): Matrix.002 file - promoters60/1533121
aaaggg

SEQ ID NO: 51786 - DNA, 8 bp, Unknown
  misc_feature (1)..( 8): Matrix.002 file - promoters60/1533121
tggaagaa

SEQ ID NO: 51787 - DNA, 7 bp, Unknown
  misc_feature (1)..( 7): Matrix.002 file - promoters60/1533159
tcataaa

SEQ ID NO: 51788 - DNA, 15 bp, Unknown
  misc_feature (1)..( 15): Matrix.002 file - promoters60/1533159
aaattattttaaaaa

SEQ ID NO: 51789 - DNA, 13 bp, Unknown
  misc_feature (1)..( 13): Matrix.002 file - promoters60/1533159
aaatatttttaaa

SEQ ID NO: 51790 - DNA, 3 bp, Unknown
  misc_feature (1)..( 3): Matrix.002 file - promoters60/1533159
gaa

SEQ ID NO: 51791 - DNA, 11 bp, Unknown
  misc_feature (1)..( 11): Matrix.002 file - promoters60/1533159
cttctatttag

SEQ ID NO: 51792 - DNA, 9 bp, Unknown
  misc_feature (1)..( 9): Matrix.002 file - promoters60/1533420
taaagattg

SEQ ID NO: 51793 - DNA, 8 bp, Unknown
  misc_feature (1)..( 8): Matrix.002 file - promoters60/1533420
acattagg

SEQ ID NO: 51794 - DNA, 8 bp, Unknown
  misc_feature (1)..( 8): Matrix.002 file - promoters60/1533420
ttaaattt

SEQ ID NO: 51795 - DNA, 9 bp, Unknown
  misc_feature (1)..( 9): Matrix.002 file - promoters60/1533420
ttgttgtat

SEQ ID NO: 51796 - DNA, 9 bp, Unknown
  misc_feature (1)..( 9): Matrix.002 file - promoters60/1533533
aaaaacaaa

SEQ ID NO: 51797 - DNA, 14 bp, Unknown
  misc_feature (1)..( 14): Matrix.002 file - promoters60/1533533
atattaaaatttat

SEQ ID NO: 51798 - DNA, 10 bp, Unknown
  misc_feature (1)..( 10): Matrix.002 file - promoters60/1533533
aaataatcaa

SEQ ID NO: 51799 - DNA, 7 bp, Unknown
  misc_feature (1)..( 7): Matrix.002 file - promoters60/1533750
tttaagg

SEQ ID NO: 51800 - DNA, 8 bp, Unknown
  misc_feature (1)..( 8): Matrix.002 file - promoters60/1533750
taaatagt

SEQ ID NO: 51801 - DNA, 7 bp, Unknown
  misc_feature (1)..( 7): Matrix.002 file - promoters60/1533750
aatgcag

SEQ ID NO: 51802 - DNA, 8 bp, Unknown
  misc_feature (1)..( 8): Matrix.002 file - promoters60/1533750
gagacaag

SEQ ID NO: 51803 - DNA, 6 bp, Unknown
  misc_feature (1)..( 6): Matrix.002 file - promoters60/1533750
gagtaa

SEQ ID NO: 51804 - DNA, 9 bp, Unknown
  misc_feature (1)..( 9): Matrix.002 file - promoters60/1533750
ttagctata

SEQ ID NO: 51805 - DNA, 6 bp, Unknown
  misc_feature (1)..( 6): Matrix.002 file - promoters60/1533750
ttctct

SEQ ID NO: 51806 - DNA, 6 bp, Unknown
  misc_feature (1)..( 6): Matrix.002 file - promoters60/1533750
acattc

SEQ ID NO: 51807 - DNA, 7 bp, Unknown
  misc_feature (1)..( 7): Matrix.002 file - promoters60/1533750
cagaaga

SEQ ID NO: 51808 - DNA, 7 bp, Unknown
  misc_feature (1)..( 7): Matrix.002 file - promoters60/1533750
tataatc

SEQ ID NO: 51809 - DNA, 7 bp, Unknown
  misc_feature (1)..( 7): Matrix.002 file - promoters60/1533750
tttcaaa

SEQ ID NO: 51810 - DNA, 7 bp, Unknown
  misc_feature (1)..( 7): Matrix.002 file - promoters60/1533750
aagaaat

SEQ ID NO: 51811 - DNA, 7 bp, Unknown
  misc_feature (1)..( 7): Matrix.002 file - promoters60/1533750
ccaaaaa

SEQ ID NO: 51812 - DNA, 7 bp, Unknown
  misc_feature (1)..( 7): Matrix.002 file - promoters60/1533871
ccaactg

SEQ ID NO: 51813 - DNA, 8 bp, Unknown
  misc_feature (1)..( 8): Matrix.002 file - promoters60/1533871
aaaattta

SEQ ID NO: 51814 - DNA, 8 bp, Unknown
  misc_feature (1)..( 8): Matrix.002 file - promoters60/1533871
ctcagctg

SEQ ID NO: 51815 - DNA, 6 bp, Unknown
  misc_feature (1)..( 6): Matrix.002 file - promoters60/1533871
catttc

SEQ ID NO: 51816 - DNA, 7 bp, Unknown
  misc_feature (1)..( 7): Matrix.002 file - promoters60/1533871
ttggctt

SEQ ID NO: 51817 - DNA, 6 bp, Unknown
  misc_feature (1)..( 6): Matrix.002 file - promoters60/1533871
tctttt

SEQ ID NO: 51818 - DNA, 8 bp, Unknown
  misc_feature (1)..( 8): Matrix.002 file - promoters60/1533871
aagtgtga

SEQ ID NO: 51819 - DNA, 6 bp, Unknown
  misc_feature (1)..( 6): Matrix.002 file - promoters60/1533871
attatt

SEQ ID NO: 51820 - DNA, 7 bp, Unknown
  misc_feature (1)..( 7): Matrix.002 file - promoters60/1533871
tgaccaa

SEQ ID NO: 51821 - DNA, 7 bp, Unknown
  misc_feature (1)..( 7): Matrix.002 file - promoters60/1533871
ttaagga

SEQ ID NO: 51822 - DNA, 6 bp, Unknown
  misc_feature (1)..( 6): Matrix.002 file - promoters60/1533871
tgattt

SEQ ID NO: 51823 - DNA, 6 bp, Unknown
  misc_feature (1)..( 6): Matrix.002 file - promoters60/1533871
ttctgt

SEQ ID NO: 51824 - DNA, 6 bp, Unknown
  misc_feature (1)..( 6): Matrix.002 file - promoters60/1533871
tttcta

SEQ ID NO: 51825 - DNA, 6 bp, Unknown
  misc_feature (1)..( 6): Matrix.002 file - promoters60/1533871
agttga

SEQ ID NO: 51826 - DNA, 6 bp, Unknown
  misc_feature (1)..( 6): Matrix.002 file - promoters60/1533871
tggttt

SEQ ID NO: 51827 - DNA, 8 bp, Unknown
  misc_feature (1)..( 8): Matrix.002 file - promoters60/1533912
aaaataga

SEQ ID NO: 51828 - DNA, 11 bp, Unknown
  misc_feature (1)..( 11): Matrix.002 file - promoters60/1533912
ctatataaaca

SEQ ID NO: 51829 - DNA, 7 bp, Unknown
  misc_feature (1)..( 7): Matrix.002 file - promoters60/1534151
aaacgag

SEQ ID NO: 51830 - DNA, 7 bp, Unknown
  misc_feature (1)..( 7): Matrix.002 file - promoters60/1534151
tgattaa

SEQ ID NO: 51831 - DNA, 8 bp, Unknown
  misc_feature (1)..( 8): Matrix.002 file - promoters60/1534151
tttattta

SEQ ID NO: 51832 - DNA, 8 bp, Unknown
  misc_feature (1)..( 8): Matrix.002 file - promoters60/1534151
gaaacaaa

SEQ ID NO: 51833 - DNA, 6 bp, Unknown
  misc_feature (1)..( 6): Matrix.002 file - promoters60/1534228
attata

SEQ ID NO: 51834 - DNA, 9 bp, Unknown
  misc_feature (1)..( 9): Matrix.002 file - promoters60/1534228
aaaactatt

SEQ ID NO: 51835 - DNA, 11 bp, Unknown
  misc_feature (1)..( 11): Matrix.002 file - promoters60/1534228
aattaacattt

SEQ ID NO: 51836 - DNA, 7 bp, Unknown
  misc_feature (1)..( 7): Matrix.002 file - promoters60/1534228
aacaagg

SEQ ID NO: 51837 - DNA, 7 bp, Unknown
  misc_feature (1)..( 7): Matrix.002 file - promoters60/1534228
tacaaaa

SEQ ID NO: 51838 - DNA, 7 bp, Unknown
  misc_feature (1)..( 7): Matrix.002 file - promoters60/1534228
taattta

SEQ ID NO: 51839 - DNA, 7 bp, Unknown
  misc_feature (1)..( 7): Matrix.002 file - promoters60/1534228
ataaatt

SEQ ID NO: 51840 - DNA, 7 bp, Unknown
  misc_feature (1)..( 7): Matrix.002 file - promoters60/1534228
aaaccaa

SEQ ID NO: 51841 - DNA, 6 bp, Unknown
  misc_feature (1)..( 6): Matrix.002 file - promoters60/1534228
taattt

SEQ ID NO: 51842 - DNA, 7 bp, Unknown
  misc_feature (1)..( 7): Matrix.002 file - promoters60/1534228
tatcatt

SEQ ID NO: 51843 - DNA, 7 bp, Unknown
  misc_feature (1)..( 7): Matrix.002 file - promoters60/1534228
aaaatgt

SEQ ID NO: 51844 - DNA, 8 bp, Unknown
  misc_feature (1)..( 8): Matrix.002 file - promoters60/1534228
ttctgatt

SEQ ID NO: 51845 - DNA, 8 bp, Unknown
  misc_feature (1)..( 8): Matrix.002 file - promoters60/1534228
atagattc

SEQ ID NO: 51846 - DNA, 6 bp, Unknown
  misc_feature (1)..( 6): Matrix.002 file - promoters60/1534228
tttgta

SEQ ID NO: 51847 - DNA, 6 bp, Unknown
  misc_feature (1)..( 6): Matrix.002 file - promoters60/1534228
attatt

SEQ ID NO: 51848 - DNA, 6 bp, Unknown
  misc_feature (1)..( 6): Matrix.002 file - promoters60/1534228
gtcaaa

SEQ ID NO: 51849 - DNA, 8 bp, Unknown
  misc_feature (1)..( 8): Matrix.002 file - promoters60/1534228
ttgaactt

SEQ ID NO: 51850 - DNA, 8 bp, Unknown
  misc_feature (1)..( 8): Matrix.002 file - promoters60/1534228
ttagtaat

SEQ ID NO: 51851 - DNA, 7 bp, Unknown
  misc_feature (1)..( 7): Matrix.002 file - promoters60/1534228
tatataa

SEQ ID NO: 51852 - DNA, 6 bp, Unknown
  misc_feature (1)..( 6): Matrix.002 file - promoters60/1534269
tcaaat

SEQ ID NO: 51853 - DNA, 8 bp, Unknown
  misc_feature (1)..( 8): Matrix.002 file - promoters60/1534269
actaatta

SEQ ID NO: 51854 - DNA, 6 bp, Unknown
  misc_feature (1)..( 6): Matrix.002 file - promoters60/1534269
ttctct

SEQ ID NO: 51855 - DNA, 6 bp, Unknown
  misc_feature (1)..( 6): Matrix.002 file - promoters60/1534269
tttgtt

SEQ ID NO: 51856 - DNA, 6 bp, Unknown
  misc_feature (1)..( 6): Matrix.002 file - promoters60/1534269
gttgat

SEQ ID NO: 51857 - DNA, 6 bp, Unknown
  misc_feature (1)..( 6): Matrix.002 file - promoters60/1534269
ggttgt

SEQ ID NO: 51858 - DNA, 8 bp, Unknown
  misc_feature (1)..( 8): Matrix.002 file - promoters60/1534269
tatcttct

SEQ ID NO: 51859 - DNA, 6 bp, Unknown
  misc_feature (1)..( 6): Matrix.002 file - promoters60/1534269
atcttt

SEQ ID NO: 51860 - DNA, 6 bp, Unknown
  misc_feature (1)..( 6): Matrix.002 file - promoters60/1534269
aaagtt

SEQ ID NO: 51861 - DNA, 7 bp, Unknown
  misc_feature (1)..( 7): Matrix.002 file - promoters60/1534269
ttagtaa

SEQ ID NO: 51862 - DNA, 7 bp, Unknown
  misc_feature (1)..( 7): Matrix.002 file - promoters60/1534269
tttatcc

SEQ ID NO: 51863 - DNA, 6 bp, Unknown
  misc_feature (1)..( 6): Matrix.002 file - promoters60/1534269
ctcatt

SEQ ID NO: 51864 - DNA, 8 bp, Unknown
  misc_feature (1)..( 8): Matrix.002 file - promoters60/1534269
gattcttg

SEQ ID NO: 51865 - DNA, 6 bp, Unknown
  misc_feature (1)..( 6): Matrix.002 file - promoters60/1534269
gtttac

SEQ ID NO: 51866 - DNA, 7 bp, Unknown
  misc_feature (1)..( 7): Matrix.002 file - promoters60/1534269
agacatt

SEQ ID NO: 51867 - DNA, 8 bp, Unknown
  misc_feature (1)..( 8): Matrix.002 file - promoters60/1534269
tttagctt

SEQ ID NO: 51868 - DNA, 6 bp, Unknown
  misc_feature (1)..( 6): Matrix.002 file - promoters60/1534269
gaatta

SEQ ID NO: 51869 - DNA, 6 bp, Unknown
  misc_feature (1)..( 6): Matrix.002 file - promoters60/1534269
gcggaa

SEQ ID NO: 51870 - DNA, 6 bp, Unknown
  misc_feature (1)..( 6): Matrix.002 file - promoters60/1534269
aaagaa

SEQ ID NO: 51871 - DNA, 6 bp, Unknown
  misc_feature (1)..( 6): Matrix.002 file - promoters60/1534269
tccttg

SEQ ID NO: 51872 - DNA, 7 bp, Unknown
  misc_feature (1)..( 7): Matrix.002 file - promoters60/1534269
gatatat

SEQ ID NO: 51873 - DNA, 8 bp, Unknown
  misc_feature (1)..( 8): Matrix.002 file - promoters60/1534338
catcatat

SEQ ID NO: 51874 - DNA, 10 bp, Unknown
  misc_feature (1)..( 10): Matrix.002 file - promoters60/1534338
agttttctcc

SEQ ID NO: 51875 - DNA, 8 bp, Unknown
  misc_feature (1)..( 8): Matrix.002 file - promoters60/1534338
taacaaca

SEQ ID NO: 51876 - DNA, 9 bp, Unknown
  misc_feature (1)..( 9): Matrix.002 file - promoters60/1534378
aatggattt

SEQ ID NO: 51877 - DNA, 8 bp, Unknown
  misc_feature (1)..( 8): Matrix.002 file - promoters60/1534435
ttttttaa

SEQ ID NO: 51878 - DNA, 14 bp, Unknown
  misc_feature (1)..( 14): Matrix.002 file - promoters60/1534435
ttgtttaatgtttt

SEQ ID NO: 51879 - DNA, 9 bp, Unknown
  misc_feature (1)..( 9): Matrix.002 file - promoters60/1534435
atagagttt

SEQ ID NO: 51880 - DNA, 8 bp, Unknown
  misc_feature (1)..( 8): Matrix.002 file - promoters60/1534435
tttggtct

SEQ ID NO: 51881 - DNA, 6 bp, Unknown
  misc_feature (1)..( 6): Matrix.002 file - promoters60/1534435
agaaaa

SEQ ID NO: 51882 - DNA, 10 bp, Unknown
  misc_feature (1)..( 10): Matrix.002 file - promoters60/1534435
tattaaaata

SEQ ID NO: 51883 - DNA, 7 bp, Unknown
  misc_feature (1)..( 7): Matrix.002 file - promoters60/1534435
gttcaat

SEQ ID NO: 51884 - DNA, 9 bp, Unknown
  misc_feature (1)..( 9): Matrix.002 file - promoters60/1534435
cttaattac

SEQ ID NO: 51885 - DNA, 17 bp, Unknown
  misc_feature (1)..( 17): Matrix.002 file - promoters60/1534435
tagttgttcaatatttt

SEQ ID NO: 51886 - DNA, 7 bp, Unknown
  misc_feature (1)..( 7): Matrix.002 file - promoters60/1534435
tttggtg

SEQ ID NO: 51887 - DNA, 6 bp, Unknown
  misc_feature (1)..( 6): Matrix.002 file - promoters60/1534435
tcttta

SEQ ID NO: 51888 - DNA, 6 bp, Unknown
  misc_feature (1)..( 6): Matrix.002 file - promoters60/1534435
atcaag

SEQ ID NO: 51889 - DNA, 6 bp, Unknown
  misc_feature (1)..( 6): Matrix.002 file - promoters60/1534435
atattt

SEQ ID NO: 51890 - DNA, 6 bp, Unknown
  misc_feature (1)..( 6): Matrix.002 file - promoters60/1534435
ttctaa

SEQ ID NO: 51891 - DNA, 7 bp, Unknown
  misc_feature (1)..( 7): Matrix.002 file - promoters60/1534435
cagcaag

SEQ ID NO: 51892 - DNA, 12 bp, Unknown
  misc_feature (1)..( 12): Matrix.002 file - promoters60/1534455
tcttattaggat

SEQ ID NO: 51893 - DNA, 6 bp, Unknown
  misc_feature (1)..( 6): Matrix.002 file - promoters60/1534455
atttgt

SEQ ID NO: 51894 - DNA, 8 bp, Unknown
  misc_feature (1)..( 8): Matrix.002 file - promoters60/1534455
ttagccat

SEQ ID NO: 51895 - DNA, 8 bp, Unknown
  misc_feature (1)..( 8): Matrix.002 file - promoters60/1534455
aacattag

SEQ ID NO: 51896 - DNA, 6 bp, Unknown
  misc_feature (1)..( 6): Matrix.002 file - promoters60/1534455
catata

SEQ ID NO: 51897 - DNA, 7 bp, Unknown
  misc_feature (1)..( 7): Matrix.002 file - promoters60/1534455
acgattt

SEQ ID NO: 51898 - DNA, 9 bp, Unknown
  misc_feature (1)..( 9): Matrix.002 file - promoters60/1534455
gattttgag

SEQ ID NO: 51899 - DNA, 7 bp, Unknown
  misc_feature (1)..( 7): Matrix.002 file - promoters60/1534455
ttagttt

SEQ ID NO: 51900 - DNA, 9 bp, Unknown
  misc_feature (1)..( 9): Matrix.002 file - promoters60/1534455
aatatcaaa

SEQ ID NO: 51901 - DNA, 6 bp, Unknown
  misc_feature (1)..( 6): Matrix.002 file - promoters60/1534455
atcaaa

SEQ ID NO: 51902 - DNA, 8 bp, Unknown
  misc_feature (1)..( 8): Matrix.002 file - promoters60/1534455
ttttttat

SEQ ID NO: 51903 - DNA, 8 bp, Unknown
  misc_feature (1)..( 8): Matrix.002 file - promoters60/1534455
aaataata

SEQ ID NO: 51904 - DNA, 7 bp, Unknown
  misc_feature (1)..( 7): Matrix.002 file - promoters60/1534455
taacaaa

SEQ ID NO: 51905 - DNA, 7 bp, Unknown
  misc_feature (1)..( 7): Matrix.002 file - promoters60/1534455
agaatct

SEQ ID NO: 51906 - DNA, 6 bp, Unknown
  misc_feature (1)..( 6): Matrix.002 file - promoters60/1534455
aaacga

SEQ ID NO: 51907 - DNA, 8 bp, Unknown
  misc_feature (1)..( 8): Matrix.002 file - promoters60/1534455
ttaaaaat

SEQ ID NO: 51908 - DNA, 7 bp, Unknown
  misc_feature (1)..( 7): Matrix.002 file - promoters60/1534455
atgatga

SEQ ID NO: 51909 - DNA, 8 bp, Unknown
  misc_feature (1)..( 8): Matrix.002 file - promoters60/1534455
attgtttt

SEQ ID NO: 51910 - DNA, 8 bp, Unknown
  misc_feature (1)..( 8): Matrix.002 file - promoters60/1534455
tgagtatt

SEQ ID NO: 51911 - DNA, 8 bp, Unknown
  misc_feature (1)..( 8): Matrix.002 file - promoters60/1534455
aagaggat

SEQ ID NO: 51912 - DNA, 7 bp, Unknown
  misc_feature (1)..( 7): Matrix.002 file - promoters60/1534455
tctaaaa

SEQ ID NO: 51913 - DNA, 7 bp, Unknown
  misc_feature (1)..( 7): Matrix.002 file - promoters60/1534501
aaaaaaa

SEQ ID NO: 51914 - DNA, 11 bp, Unknown
  misc_feature (1)..( 11): Matrix.002 file - promoters60/1534501
aaaattaattg

SEQ ID NO: 51915 - DNA, 9 bp, Unknown
  misc_feature (1)..( 9): Matrix.002 file - promoters60/1534501
aatttattt

SEQ ID NO: 51916 - DNA, 7 bp, Unknown
  misc_feature (1)..( 7): Matrix.002 file - promoters60/1534501
agatcaa

SEQ ID NO: 51917 - DNA, 7 bp, Unknown
  misc_feature (1)..( 7): Matrix.002 file - promoters60/1534524
tttacta

SEQ ID NO: 51918 - DNA, 8 bp, Unknown
  misc_feature (1)..( 8): Matrix.002 file - promoters60/1534524
taaactct

SEQ ID NO: 51919 - DNA, 9 bp, Unknown
  misc_feature (1)..( 9): Matrix.002 file - promoters60/1534524
attgaacaa

SEQ ID NO: 51920 - DNA, 6 bp, Unknown
  misc_feature (1)..( 6): Matrix.002 file - promoters60/1534524
ataaga

SEQ ID NO: 51921 - DNA, 8 bp, Unknown
  misc_feature (1)..( 8): Matrix.002 file - promoters60/1534524
aaataatt

SEQ ID NO: 51922 - DNA, 7 bp, Unknown
  misc_feature (1)..( 7): Matrix.002 file - promoters60/1534524
tttactt

SEQ ID NO: 51923 - DNA, 8 bp, Unknown
  misc_feature (1)..( 8): Matrix.002 file - promoters60/1534524
gaaaattt

SEQ ID NO: 51924 - DNA, 7 bp, Unknown
  misc_feature (1)..( 7): Matrix.002 file - promoters60/1534524
accgaga

SEQ ID NO: 51925 - DNA, 13 bp, Unknown
  misc_feature (1)..( 13): Matrix.002 file - promoters60/1534524
ctcgtgtatatat

SEQ ID NO: 51926 - DNA, 6 bp, Unknown
  misc_feature (1)..( 6): Matrix.002 file - promoters60/1534524
taaatt

SEQ ID NO: 51927 - DNA, 6 bp, Unknown
  misc_feature (1)..( 6): Matrix.002 file - promoters60/1534524
aaatat

SEQ ID NO: 51928 - DNA, 8 bp, Unknown
  misc_feature (1)..( 8): Matrix.002 file - promoters60/1534524
tataacaa

SEQ ID NO: 51929 - DNA, 7 bp, Unknown
  misc_feature (1)..( 7): Matrix.002 file - promoters60/1534524
aagaaat

SEQ ID NO: 51930 - DNA, 9 bp, Unknown
  misc_feature (1)..( 9): Matrix.002 file - promoters60/1534524
ttgtagaaa

SEQ ID NO: 51931 - DNA, 7 bp, Unknown
  misc_feature (1)..( 7): Matrix.002 file - promoters60/1534524
gtcaatt

SEQ ID NO: 51932 - DNA, 6 bp, Unknown
  misc_feature (1)..( 6): Matrix.002 file - promoters60/1534524
aaccaa

SEQ ID NO: 51933 - DNA, 8 bp, Unknown
  misc_feature (1)..( 8): Matrix.002 file - promoters60/1534524
aaaatcat

SEQ ID NO: 51934 - DNA, 7 bp, Unknown
  misc_feature (1)..( 7): Matrix.002 file - promoters60/1534524
ggttatt

SEQ ID NO: 51935 - DNA, 9 bp, Unknown
  misc_feature (1)..( 9): Matrix.002 file - promoters60/1534528
aatgacaac

SEQ ID NO: 51936 - DNA, 9 bp, Unknown
  misc_feature (1)..( 9): Matrix.002 file - promoters60/1534528
tatttgtaa

SEQ ID NO: 51937 - DNA, 8 bp, Unknown
  misc_feature (1)..( 8): Matrix.002 file - promoters60/1534528
taataagc

SEQ ID NO: 51938 - DNA, 10 bp, Unknown
  misc_feature (1)..( 10): Matrix.002 file - promoters60/1534528
gtatatatac

SEQ ID NO: 51939 - DNA, 10 bp, Unknown
  misc_feature (1)..( 10): Matrix.002 file - promoters60/1534528
ggaaaagaaa

SEQ ID NO: 51940 - DNA, 11 bp, Unknown
  misc_feature (1)..( 11): Matrix.002 file - promoters60/1534528
aattgggtttt

SEQ ID NO: 51941 - DNA, 8 bp, Unknown
  misc_feature (1)..( 8): Matrix.002 file - promoters60/1534528
gtatataa

SEQ ID NO: 51942 - DNA, 7 bp, Unknown
  misc_feature (1)..( 7): Matrix.002 file - promoters60/1534591
ttcttat

SEQ ID NO: 51943 - DNA, 8 bp, Unknown
  misc_feature (1)..( 8): Matrix.002 file - promoters60/1534591
tatataat

SEQ ID NO: 51944 - DNA, 11 bp, Unknown
  misc_feature (1)..( 11): Matrix.002 file - promoters60/1534591
attattaaaca

SEQ ID NO: 51945 - DNA, 6 bp, Unknown
  misc_feature (1)..( 6): Matrix.002 file - promoters60/1534591
tatagt

SEQ ID NO: 51946 - DNA, 7 bp, Unknown
  misc_feature (1)..( 7): Matrix.002 file - promoters60/1534591
ttaaata

SEQ ID NO: 51947 - DNA, 6 bp, Unknown
  misc_feature (1)..( 6): Matrix.002 file - promoters60/1534591
atgaaa

SEQ ID NO: 51948 - DNA, 6 bp, Unknown
  misc_feature (1)..( 6): Matrix.002 file - promoters60/1534591
ttaata

SEQ ID NO: 51949 - DNA, 7 bp, Unknown
  misc_feature (1)..( 7): Matrix.002 file - promoters60/1534591
ttaatta

SEQ ID NO: 51950 - DNA, 8 bp, Unknown
  misc_feature (1)..( 8): Matrix.002 file - promoters60/1534591
ctctagta

SEQ ID NO: 51951 - DNA, 9 bp, Unknown
  misc_feature (1)..( 9): Matrix.002 file - promoters60/1534591
aagaaataa

SEQ ID NO: 51952 - DNA, 8 bp, Unknown
  misc_feature (1)..( 8): Matrix.002 file - promoters60/1534591
ataaatta

SEQ ID NO: 51953 - DNA, 8 bp, Unknown
  misc_feature (1)..( 8): Matrix.002 file - promoters60/1534591
aatagaaa

SEQ ID NO: 51954 - DNA, 6 bp, Unknown
  misc_feature (1)..( 6): Matrix.002 file - promoters60/1534591
agtttt

SEQ ID NO: 51955 - DNA, 6 bp, Unknown
  misc_feature (1)..( 6): Matrix.002 file - promoters60/1534591
tttctt

SEQ ID NO: 51956 - DNA, 6 bp, Unknown
  misc_feature (1)..( 6): Matrix.002 file - promoters60/1534591
aataaa

SEQ ID NO: 51957 - DNA, 6 bp, Unknown
  misc_feature (1)..( 6): Matrix.002 file - promoters60/1534591
attcga

SEQ ID NO: 51958 - DNA, 6 bp, Unknown
  misc_feature (1)..( 6): Matrix.002 file - promoters60/1534591
cacaaa

SEQ ID NO: 51959 - DNA, 7 bp, Unknown
  misc_feature (1)..( 7): Matrix.002 file - promoters60/1534591
acaattt

SEQ ID NO: 51960 - DNA, 11 bp, Unknown
  misc_feature (1)..( 11): Matrix.002 file - promoters60/1534615
aagttataaat

SEQ ID NO: 51961 - DNA, 10 bp, Unknown
  misc_feature (1)..( 10): Matrix.002 file - promoters60/1534615
tttagtttat

SEQ ID NO: 51962 - DNA, 12 bp, Unknown
  misc_feature (1)..( 12): Matrix.002 file - promoters60/1534615
aaaattcaatat

SEQ ID NO: 51963 - DNA, 6 bp, Unknown
  misc_feature (1)..( 6): Matrix.002 file - promoters60/1534615
caaatt

SEQ ID NO: 51964 - DNA, 8 bp, Unknown
  misc_feature (1)..( 8): Matrix.002 file - promoters60/1534615
tcaaagaa

SEQ ID NO: 51965 - DNA, 6 bp, Unknown
  misc_feature (1)..( 6): Matrix.002 file - promoters60/1534629
ttcgtt

SEQ ID NO: 51966 - DNA, 7 bp, Unknown
  misc_feature (1)..( 7): Matrix.002 file - promoters60/1534629
gatgctc

SEQ ID NO: 51967 - DNA, 10 bp, Unknown
  misc_feature (1)..( 10): Matrix.002 file - promoters60/1534629
ttttatcaac

SEQ ID NO: 51968 - DNA, 8 bp, Unknown
  misc_feature (1)..( 8): Matrix.002 file - promoters60/1534629
taaaaaaa

SEQ ID NO: 51969 - DNA, 6 bp, Unknown
  misc_feature (1)..( 6): Matrix.002 file - promoters60/1534629
aaacaa

SEQ ID NO: 51970 - DNA, 6 bp, Unknown
  misc_feature (1)..( 6): Matrix.002 file - promoters60/1534629
agtagt

SEQ ID NO: 51971 - DNA, 8 bp, Unknown
  misc_feature (1)..( 8): Matrix.002 file - promoters60/1534629
acaacatt

SEQ ID NO: 51972 - DNA, 7 bp, Unknown
  misc_feature (1)..( 7): Matrix.002 file - promoters60/1534629
tacgtga

SEQ ID NO: 51973 - DNA, 7 bp, Unknown
  misc_feature (1)..( 7): Matrix.002 file - promoters60/1534629
aacatgt

SEQ ID NO: 51974 - DNA, 7 bp, Unknown
  misc_feature (1)..( 7): Matrix.002 file - promoters60/1534629
tttcggt

SEQ ID NO: 51975 - DNA, 11 bp, Unknown
  misc_feature (1)..( 11): Matrix.002 file - promoters60/1534629
gtttaactacg

SEQ ID NO: 51976 - DNA, 6 bp, Unknown
  misc_feature (1)..( 6): Matrix.002 file - promoters60/1534629
gtttca

SEQ ID NO: 51977 - DNA, 9 bp, Unknown
  misc_feature (1)..( 9): Matrix.002 file - promoters60/1534629
atgatcttg

SEQ ID NO: 51978 - DNA, 8 bp, Unknown
  misc_feature (1)..( 8): Matrix.002 file - promoters60/1534629
gatgattt

SEQ ID NO: 51979 - DNA, 6 bp, Unknown
  misc_feature (1)..( 6): Matrix.002 file - promoters60/1534629
tctatg

SEQ ID NO: 51980 - DNA, 6 bp, Unknown
  misc_feature (1)..( 6): Matrix.002 file - promoters60/1534629
ggaagc

SEQ ID NO: 51981 - DNA, 8 bp, Unknown
  misc_feature (1)..( 8): Matrix.002 file - promoters60/1534629
ttagtagt

SEQ ID NO: 51982 - DNA, 10 bp, Unknown
  misc_feature (1)..( 10): Matrix.002 file - promoters60/1534629
gttagaagaa

SEQ ID NO: 51983 - DNA, 7 bp, Unknown
  misc_feature (1)..( 7): Matrix.002 file - promoters60/1534629
aataagg

SEQ ID NO: 51984 - DNA, 12 bp, Unknown
  misc_feature (1)..( 12): Matrix.002 file - promoters60/1534671
tctttagagctt

SEQ ID NO: 51985 - DNA, 8 bp, Unknown
  misc_feature (1)..( 8): Matrix.002 file - promoters60/1534671
gaagatga

SEQ ID NO: 51986 - DNA, 8 bp, Unknown
  misc_feature (1)..( 8): Matrix.002 file - promoters60/1534671
agaacttt

SEQ ID NO: 51987 - DNA, 8 bp, Unknown
  misc_feature (1)..( 8): Matrix.002 file - promoters60/1534671
aacatctc

SEQ ID NO: 51988 - DNA, 11 bp, Unknown
  misc_feature (1)..( 11): Matrix.002 file - promoters60/1534671
aatttaaagct

SEQ ID NO: 51989 - DNA, 9 bp, Unknown
  misc_feature (1)..( 9): Matrix.002 file - promoters60/1534671
caaaatgag

SEQ ID NO: 51990 - DNA, 6 bp, Unknown
  misc_feature (1)..( 6): Matrix.002 file - promoters60/1534671
tgttaa

SEQ ID NO: 51991 - DNA, 7 bp, Unknown
  misc_feature (1)..( 7): Matrix.002 file - promoters60/1535197
atggaga

SEQ ID NO: 51992 - DNA, 7 bp, Unknown
  misc_feature (1)..( 7): Matrix.002 file - promoters60/1535197
tttggat

SEQ ID NO: 51993 - DNA, 8 bp, Unknown
  misc_feature (1)..( 8): Matrix.002 file - promoters60/1535197
actaactt

SEQ ID NO: 51994 - DNA, 7 bp, Unknown
  misc_feature (1)..( 7): Matrix.002 file - promoters60/1535197
gaacatg

SEQ ID NO: 51995 - DNA, 7 bp, Unknown
  misc_feature (1)..( 7): Matrix.002 file - promoters60/1535197
gatgaat

SEQ ID NO: 51996 - DNA, 8 bp, Unknown
  misc_feature (1)..( 8): Matrix.002 file - promoters60/1535197
cacacaaa

SEQ ID NO: 51997 - DNA, 6 bp, Unknown
  misc_feature (1)..( 6): Matrix.002 file - promoters60/1535197
gaagtt

SEQ ID NO: 51998 - DNA, 7 bp, Unknown
  misc_feature (1)..( 7): Matrix.002 file - promoters60/1535197
cacaaag

SEQ ID NO: 51999 - DNA, 6 bp, Unknown
  misc_feature (1)..( 6): Matrix.002 file - promoters60/1535197
cttttt

SEQ ID NO: 52000 - DNA, 6 bp, Unknown
  misc_feature (1)..( 6): Matrix.002 file - promoters60/1535197
tttctt

SEQ ID NO: 52001 - DNA, 7 bp, Unknown
  misc_feature (1)..( 7): Matrix.002 file - promoters60/1535197
acaaact

SEQ ID NO: 52002 - DNA, 7 bp, Unknown
  misc_feature (1)..( 7): Matrix.002 file - promoters60/1535197
ataaatt

SEQ ID NO: 52003 - DNA, 7 bp, Unknown
  misc_feature (1)..( 7): Matrix.002 file - promoters60/1535197
tttagtt

SEQ ID NO: 52004 - DNA, 6 bp, Unknown
  misc_feature (1)..( 6): Matrix.002 file - promoters60/1535197
gaatca

SEQ ID NO: 52005 - DNA, 7 bp, Unknown
  misc_feature (1)..( 7): Matrix.002 file - promoters60/1535197
tccagtt

SEQ ID NO: 52006 - DNA, 6 bp, Unknown
  misc_feature (1)..( 6): Matrix.002 file - promoters60/1535197
tttccg

SEQ ID NO: 52007 - DNA, 6 bp, Unknown
  misc_feature (1)..( 6): Matrix.002 file - promoters60/1535197
aaccct

SEQ ID NO: 52008 - DNA, 12 bp, Unknown
  misc_feature (1)..( 12): Matrix.002 file - promoters60/1537314
ttgatttttgtt

SEQ ID NO: 52009 - DNA, 7 bp, Unknown
  misc_feature (1)..( 7): Matrix.002 file - promoters60/1537314
aaaatgg

SEQ ID NO: 52010 - DNA, 12 bp, Unknown
  misc_feature (1)..( 12): Matrix.002 file - promoters60/1537336
atttattcaaca

SEQ ID NO: 52011 - DNA, 8 bp, Unknown
  misc_feature (1)..( 8): Matrix.002 file - promoters60/1537336
ctatatat

SEQ ID NO: 52012 - DNA, 7 bp, Unknown
  misc_feature (1)..( 7): Matrix.002 file - promoters60/1537456
aaagttt

SEQ ID NO: 52013 - DNA, 7 bp, Unknown
  misc_feature (1)..( 7): Matrix.002 file - promoters60/1537456
aaaaata

SEQ ID NO: 52014 - DNA, 6 bp, Unknown
  misc_feature (1)..( 6): Matrix.002 file - promoters60/1537456
aaaaat

SEQ ID NO: 52015 - DNA, 9 bp, Unknown
  misc_feature (1)..( 9): Matrix.002 file - promoters60/1537456
ataaattta

SEQ ID NO: 52016 - DNA, 6 bp, Unknown
  misc_feature (1)..( 6): Matrix.002 file - promoters60/1537456
tattta

SEQ ID NO: 52017 - DNA, 7 bp, Unknown
  misc_feature (1)..( 7): Matrix.002 file - promoters60/1537456
attaatg

SEQ ID NO: 52018 - DNA, 8 bp, Unknown
  misc_feature (1)..( 8): Matrix.002 file - promoters60/1537456
ctttcttt

SEQ ID NO: 52019 - DNA, 10 bp, Unknown
  misc_feature (1)..( 10): Matrix.002 file - promoters60/1537456
gttccttctt

SEQ ID NO: 52020 - DNA, 7 bp, Unknown
  misc_feature (1)..( 7): Matrix.002 file - promoters60/1537456
gttgttc

SEQ ID NO: 52021 - DNA, 6 bp, Unknown
  misc_feature (1)..( 6): Matrix.002 file - promoters60/1537456
gattaa

SEQ ID NO: 52022 - DNA, 7 bp, Unknown
  misc_feature (1)..( 7): Matrix.002 file - promoters60/1537456
aaaaaca

SEQ ID NO: 52023 - DNA, 6 bp, Unknown
  misc_feature (1)..( 6): Matrix.002 file - promoters60/1537456
tccatt

SEQ ID NO: 52024 - DNA, 7 bp, Unknown
  misc_feature (1)..( 7): Matrix.002 file - promoters60/1537456
ttttatg

SEQ ID NO: 52025 - DNA, 7 bp, Unknown
  misc_feature (1)..( 7): Matrix.002 file - promoters60/1537456
tttcaaa

SEQ ID NO: 52026 - DNA, 7 bp, Unknown
  misc_feature (1)..( 7): Matrix.002 file - promoters60/1537456
aaaatgt

SEQ ID NO: 52027 - DNA, 6 bp, Unknown
  misc_feature (1)..( 6): Matrix.002 file - promoters60/1537456
tgaaaa

SEQ ID NO: 52028 - DNA, 7 bp, Unknown
  misc_feature (1)..( 7): Matrix.002 file - promoters60/1537456
ataagtt

SEQ ID NO: 52029 - DNA, 7 bp, Unknown
  misc_feature (1)..( 7): Matrix.002 file - promoters60/1537456
ctcatct

SEQ ID NO: 52030 - DNA, 9 bp, Unknown
  misc_feature (1)..( 9): Matrix.002 file - promoters60/1537617
tgtatgcat

SEQ ID NO: 52031 - DNA, 10 bp, Unknown
  misc_feature (1)..( 10): Matrix.002 file - promoters60/1537617
tcaattttat

SEQ ID NO: 52032 - DNA, 8 bp, Unknown
  misc_feature (1)..( 8): Matrix.002 file - promoters60/1537617
ttattaat

SEQ ID NO: 52033 - DNA, 10 bp, Unknown
  misc_feature (1)..( 10): Matrix.002 file - promoters60/1537617
tcaattttat

SEQ ID NO: 52034 - DNA, 7 bp, Unknown
  misc_feature (1)..( 7): Matrix.002 file - promoters60/1537617
attattt

SEQ ID NO: 52035 - DNA, 8 bp, Unknown
  misc_feature (1)..( 8): Matrix.002 file - promoters60/1537617
tatcttaa

SEQ ID NO: 52036 - DNA, 9 bp, Unknown
  misc_feature (1)..( 9): Matrix.002 file - promoters60/1537617
aataaatag

SEQ ID NO: 52037 - DNA, 7 bp, Unknown
  misc_feature (1)..( 7): Matrix.002 file - promoters60/1537617
taaaatt

SEQ ID NO: 52038 - DNA, 12 bp, Unknown
  misc_feature (1)..( 12): Matrix.002 file - promoters60/1538143
ttttcaaaaccg

SEQ ID NO: 52039 - DNA, 9 bp, Unknown
  misc_feature (1)..( 9): Matrix.002 file - promoters60/1538143
tttcttcat

SEQ ID NO: 52040 - DNA, 9 bp, Unknown
  misc_feature (1)..( 9): Matrix.002 file - promoters60/1538143
gaattacaa

SEQ ID NO: 52041 - DNA, 9 bp, Unknown
  misc_feature (1)..( 9): Matrix.002 file - promoters60/1538143
acgtcaaac

SEQ ID NO: 52042 - DNA, 8 bp, Unknown
  misc_feature (1)..( 8): Matrix.002 file - promoters60/1538143
aaggaaaa

SEQ ID NO: 52043 - DNA, 6 bp, Unknown
  misc_feature (1)..( 6): Matrix.002 file - promoters60/1538143
ttttat

SEQ ID NO: 52044 - DNA, 8 bp, Unknown
  misc_feature (1)..( 8): Matrix.002 file - promoters60/1538143
tcaaactt

SEQ ID NO: 52045 - DNA, 10 bp, Unknown
  misc_feature (1)..( 10): Matrix.002 file - promoters60/1538641
gaacaaataa

SEQ ID NO: 52046 - DNA, 11 bp, Unknown
  misc_feature (1)..( 11): Matrix.002 file - promoters60/1538641
actatcaacat

SEQ ID NO: 52047 - DNA, 6 bp, Unknown
  misc_feature (1)..( 6): Matrix.002 file - promoters60/1538641
caataa

SEQ ID NO: 52048 - DNA, 6 bp, Unknown
  misc_feature (1)..( 6): Matrix.002 file - promoters60/1538641
taaaat

SEQ ID NO: 52049 - DNA, 8 bp, Unknown
  misc_feature (1)..( 8): Matrix.002 file - promoters60/1538641
ggaaaaat

SEQ ID NO: 52050 - DNA, 7 bp, Unknown
  misc_feature (1)..( 7): Matrix.002 file - promoters60/1538641
aaaccaa

SEQ ID NO: 52051 - DNA, 6 bp, Unknown
  misc_feature (1)..( 6): Matrix.002 file - promoters60/1538641
aaaaag

SEQ ID NO: 52052 - DNA, 6 bp, Unknown
  misc_feature (1)..( 6): Matrix.002 file - promoters60/1538641
aagtga

SEQ ID NO: 52053 - DNA, 7 bp, Unknown
  misc_feature (1)..( 7): Matrix.002 file - promoters60/1538641
taaaccc

SEQ ID NO: 52054 - DNA, 7 bp, Unknown
  misc_feature (1)..( 7): Matrix.002 file - promoters60/1538641
tttactt

SEQ ID NO: 52055 - DNA, 10 bp, Unknown
  misc_feature (1)..( 10): Matrix.002 file - promoters60/1538641
cttttttttt

SEQ ID NO: 52056 - DNA, 8 bp, Unknown
  misc_feature (1)..( 8): Matrix.002 file - promoters60/1538641
tataatat

SEQ ID NO: 52057 - DNA, 7 bp, Unknown
  misc_feature (1)..( 7): Matrix.002 file - promoters60/1538641
aaaacaa

SEQ ID NO: 52058 - DNA, 9 bp, Unknown
  misc_feature (1)..( 9): Matrix.002 file - promoters60/1538641
atctatttt

SEQ ID NO: 52059 - DNA, 6 bp, Unknown
  misc_feature (1)..( 6): Matrix.002 file - promoters60/1538641
cacaca

SEQ ID NO: 52060 - DNA, 7 bp, Unknown
  misc_feature (1)..( 7): Matrix.002 file - promoters60/1538641
agaaaga

SEQ ID NO: 52061 - DNA, 7 bp, Unknown
  misc_feature (1)..( 7): Matrix.002 file - promoters60/1538641
gagagta

SEQ ID NO: 52062 - DNA, 8 bp, Unknown
  misc_feature (1)..( 8): Matrix.002 file - promoters60/1538641
aaaaggag

SEQ ID NO: 52063 - DNA, 6 bp, Unknown
  misc_feature (1)..( 6): Matrix.002 file - promoters60/1538641
ttgtat

SEQ ID NO: 52064 - DNA, 8 bp, Unknown
  misc_feature (1)..( 8): Matrix.002 file - promoters60/1538641
ttgcttac

SEQ ID NO: 52065 - DNA, 7 bp, Unknown
  misc_feature (1)..( 7): Matrix.002 file - promoters60/1538641
ataacta

SEQ ID NO: 52066 - DNA, 6 bp, Unknown
  misc_feature (1)..( 6): Matrix.002 file - promoters60/1538641
taaaac

SEQ ID NO: 52067 - DNA, 6 bp, Unknown
  misc_feature (1)..( 6): Matrix.002 file - promoters60/1538738
gttctg

SEQ ID NO: 52068 - DNA, 6 bp, Unknown
  misc_feature (1)..( 6): Matrix.002 file - promoters60/1538738
aaatga

SEQ ID NO: 52069 - DNA, 8 bp, Unknown
  misc_feature (1)..( 8): Matrix.002 file - promoters60/1538738
tccagata

SEQ ID NO: 52070 - DNA, 10 bp, Unknown
  misc_feature (1)..( 10): Matrix.002 file - promoters60/1538738
ttgcagatgt

SEQ ID NO: 52071 - DNA, 8 bp, Unknown
  misc_feature (1)..( 8): Matrix.002 file - promoters60/1538738
ctcaactt

SEQ ID NO: 52072 - DNA, 7 bp, Unknown
  misc_feature (1)..( 7): Matrix.002 file - promoters60/1538738
tagatat

SEQ ID NO: 52073 - DNA, 7 bp, Unknown
  misc_feature (1)..( 7): Matrix.002 file - promoters60/1538738
atcatat

SEQ ID NO: 52074 - DNA, 7 bp, Unknown
  misc_feature (1)..( 7): Matrix.002 file - promoters60/1538738
atacata

SEQ ID NO: 52075 - DNA, 6 bp, Unknown
  misc_feature (1)..( 6): Matrix.002 file - promoters60/1538738
cttcat

SEQ ID NO: 52076 - DNA, 7 bp, Unknown
  misc_feature (1)..( 7): Matrix.002 file - promoters60/1538738
tttctat

SEQ ID NO: 52077 - DNA, 6 bp, Unknown
  misc_feature (1)..( 6): Matrix.002 file - promoters60/1538738
aaaatc

SEQ ID NO: 52078 - DNA, 7 bp, Unknown
  misc_feature (1)..( 7): Matrix.002 file - promoters60/1538804
agcatta

SEQ ID NO: 52079 - DNA, 7 bp, Unknown
  misc_feature (1)..( 7): Matrix.002 file - promoters60/1538804
ttaaatt

SEQ ID NO: 52080 - DNA, 7 bp, Unknown
  misc_feature (1)..( 7): Matrix.002 file - promoters60/1538804
gttagag

SEQ ID NO: 52081 - DNA, 6 bp, Unknown
  misc_feature (1)..( 6): Matrix.002 file - promoters60/1538804
ccaatc

SEQ ID NO: 52082 - DNA, 6 bp, Unknown
  misc_feature (1)..( 6): Matrix.002 file - promoters60/1538804
atcatt

SEQ ID NO: 52083 - DNA, 7 bp, Unknown
  misc_feature (1)..( 7): Matrix.002 file - promoters60/1538804
cttgtgt

SEQ ID NO: 52084 - DNA, 12 bp, Unknown
  misc_feature (1)..( 12): Matrix.002 file - promoters60/1538804
tttatataaaca

SEQ ID NO: 52085 - DNA, 8 bp, Unknown
  misc_feature (1)..( 8): Matrix.002 file - promoters60/1538804
acggattt

SEQ ID NO: 52086 - DNA, 9 bp, Unknown
  misc_feature (1)..( 9): Matrix.002 file - promoters60/1538804
atatgattt

SEQ ID NO: 52087 - DNA, 8 bp, Unknown
  misc_feature (1)..( 8): Matrix.002 file - promoters60/1538804
ttctatct

SEQ ID NO: 52088 - DNA, 7 bp, Unknown
  misc_feature (1)..( 7): Matrix.002 file - promoters60/1538804
cttagaa

SEQ ID NO: 52089 - DNA, 6 bp, Unknown
  misc_feature (1)..( 6): Matrix.002 file - promoters60/1538804
cataaa

SEQ ID NO: 52090 - DNA, 7 bp, Unknown
  misc_feature (1)..( 7): Matrix.002 file - promoters60/1538804
gaaaaat

SEQ ID NO: 52091 - DNA, 6 bp, Unknown
  misc_feature (1)..( 6): Matrix.002 file - promoters60/1538804
attgga

SEQ ID NO: 52092 - DNA, 6 bp, Unknown
  misc_feature (1)..( 6): Matrix.002 file - promoters60/1538804
tttaat

SEQ ID NO: 52093 - DNA, 6 bp, Unknown
  misc_feature (1)..( 6): Matrix.002 file - promoters60/1538804
ttgatt

SEQ ID NO: 52094 - DNA, 7 bp, Unknown
  misc_feature (1)..( 7): Matrix.002 file - promoters60/1557475
ttacata

SEQ ID NO: 52095 - DNA, 10 bp, Unknown
  misc_feature (1)..( 10): Matrix.002 file - promoters60/1557475
caaatttttt

SEQ ID NO: 52096 - DNA, 8 bp, Unknown
  misc_feature (1)..( 8): Matrix.002 file - promoters60/1557475
aaaatcaa

SEQ ID NO: 52097 - DNA, 8 bp, Unknown
  misc_feature (1)..( 8): Matrix.002 file - promoters60/1557475
atataaat

SEQ ID NO: 52098 - DNA, 9 bp, Unknown
  misc_feature (1)..( 9): Matrix.002 file - promoters60/1557475
taaataatc

SEQ ID NO: 52099 - DNA, 8 bp, Unknown
  misc_feature (1)..( 8): Matrix.002 file - promoters60/1557475
atcaatca

SEQ ID NO: 52100 - DNA, 6 bp, Unknown
  misc_feature (1)..( 6): Matrix.002 file - promoters60/1557475
aaatac

SEQ ID NO: 52101 - DNA, 10 bp, Unknown
  misc_feature (1)..( 10): Matrix.002 file - promoters60/1557475
caaaagcggt

SEQ ID NO: 52102 - DNA, 8 bp, Unknown
  misc_feature (1)..( 8): Matrix.002 file - promoters60/1557475
gatctgaa

SEQ ID NO: 52103 - DNA, 7 bp, Unknown
  misc_feature (1)..( 7): Matrix.002 file - promoters60/1557475
tacaatt

SEQ ID NO: 52104 - DNA, 6 bp, Unknown
  misc_feature (1)..( 6): Matrix.002 file - promoters60/1557475
tctcta

SEQ ID NO: 52105 - DNA, 6 bp, Unknown
  misc_feature (1)..( 6): Matrix.002 file - promoters60/1557475
tataag

SEQ ID NO: 52106 - DNA, 6 bp, Unknown
  misc_feature (1)..( 6): Matrix.002 file - promoters60/1557475
atattt

SEQ ID NO: 52107 - DNA, 14 bp, Unknown
  misc_feature (1)..( 14): Matrix.002 file - promoters60/1557475
cgaaaaaacaaaaa

SEQ ID NO: 52108 - DNA, 7 bp, Unknown
  misc_feature (1)..( 7): Matrix.002 file - promoters60/1557475
aaaataa

SEQ ID NO: 52109 - DNA, 6 bp, Unknown
  misc_feature (1)..( 6): Matrix.002 file - promoters60/1557475
atttta

SEQ ID NO: 52110 - DNA, 6 bp, Unknown
  misc_feature (1)..( 6): Matrix.002 file - promoters60/1557475
taaaaa

SEQ ID NO: 52111 - DNA, 7 bp, Unknown
  misc_feature (1)..( 7): Matrix.002 file - promoters60/1557475
tttaaaa

SEQ ID NO: 52112 - DNA, 6 bp, Unknown
  misc_feature (1)..( 6): Matrix.002 file - promoters60/1557475
ttcttc

SEQ ID NO: 52113 - DNA, 6 bp, Unknown
  misc_feature (1)..( 6): Matrix.002 file - promoters60/1557475
aattac

SEQ ID NO: 52114 - DNA, 6 bp, Unknown
  misc_feature (1)..( 6): Matrix.002 file - promoters60/1557475
aatttg

SEQ ID NO: 52115 - DNA, 7 bp, Unknown
  misc_feature (1)..( 7): Matrix.002 file - promoters60/1557475
aaactaa

SEQ ID NO: 52116 - DNA, 9 bp, Unknown
  misc_feature (1)..( 9): Matrix.002 file - promoters60/1557475
atccatata

SEQ ID NO: 52117 - DNA, 6 bp, Unknown
  misc_feature (1)..( 6): Matrix.002 file - promoters60/1557475
tcaacg

SEQ ID NO: 52118 - DNA, 11 bp, Unknown
  misc_feature (1)..( 11): Matrix.002 file - promoters60/1557501
tgaatatcaaa

SEQ ID NO: 52119 - DNA, 11 bp, Unknown
  misc_feature (1)..( 11): Matrix.002 file - promoters60/1557501
atcttcatgtt

SEQ ID NO: 52120 - DNA, 8 bp, Unknown
  misc_feature (1)..( 8): Matrix.002 file - promoters60/1557501
tatcttca

SEQ ID NO: 52121 - DNA, 11 bp, Unknown
  misc_feature (1)..( 11): Matrix.002 file - promoters60/1557501
tatttatgaat

SEQ ID NO: 52122 - DNA, 9 bp, Unknown
  misc_feature (1)..( 9): Matrix.002 file - promoters60/1557501
aatcttcat

SEQ ID NO: 52123 - DNA, 10 bp, Unknown
  misc_feature (1)..( 10): Matrix.002 file - promoters60/1557501
gtttaacaaa

SEQ ID NO: 52124 - DNA, 12 bp, Unknown
  misc_feature (1)..( 12): Matrix.002 file - promoters60/1557565
aaattaattata

SEQ ID NO: 52125 - DNA, 7 bp, Unknown
  misc_feature (1)..( 7): Matrix.002 file - promoters60/1557573
tcagagc

SEQ ID NO: 52126 - DNA, 8 bp, Unknown
  misc_feature (1)..( 8): Matrix.002 file - promoters60/1557573
agtatatt

SEQ ID NO: 52127 - DNA, 7 bp, Unknown
  misc_feature (1)..( 7): Matrix.002 file - promoters60/1557573
ttaaaaa

SEQ ID NO: 52128 - DNA, 8 bp, Unknown
  misc_feature (1)..( 8): Matrix.002 file - promoters60/1557573
taacaaaa

SEQ ID NO: 52129 - DNA, 6 bp, Unknown
  misc_feature (1)..( 6): Matrix.002 file - promoters60/1557573
ttatca

SEQ ID NO: 52130 - DNA, 7 bp, Unknown
  misc_feature (1)..( 7): Matrix.002 file - promoters60/1557573
tttatta

SEQ ID NO: 52131 - DNA, 7 bp, Unknown
  misc_feature (1)..( 7): Matrix.002 file - promoters60/1557573
gtagatt

SEQ ID NO: 52132 - DNA, 7 bp, Unknown
  misc_feature (1)..( 7): Matrix.002 file - promoters60/1557573
ttccaaa

SEQ ID NO: 52133 - DNA, 7 bp, Unknown
  misc_feature (1)..( 7): Matrix.002 file - promoters60/1557573
tttgatt

SEQ ID NO: 52134 - DNA, 6 bp, Unknown
  misc_feature (1)..( 6): Matrix.002 file - promoters60/1557573
gtctcc

SEQ ID NO: 52135 - DNA, 11 bp, Unknown
  misc_feature (1)..( 11): Matrix.002 file - promoters60/1557573
accctagattt

SEQ ID NO: 52136 - DNA, 8 bp, Unknown
  misc_feature (1)..( 8): Matrix.002 file - promoters60/1557648
aaaaaaaa

SEQ ID NO: 52137 - DNA, 10 bp, Unknown
  misc_feature (1)..( 10): Matrix.002 file - promoters60/1557648
aaattggtag

SEQ ID NO: 52138 - DNA, 7 bp, Unknown
  misc_feature (1)..( 7): Matrix.002 file - promoters60/1557648
tacaaat

SEQ ID NO: 52139 - DNA, 9 bp, Unknown
  misc_feature (1)..( 9): Matrix.002 file - promoters60/1557648
aattttgaa

SEQ ID NO: 52140 - DNA, 6 bp, Unknown
  misc_feature (1)..( 6): Matrix.002 file - promoters60/1557648
tgttta

SEQ ID NO: 52141 - DNA, 6 bp, Unknown
  misc_feature (1)..( 6): Matrix.002 file - promoters60/1557648
ttttaa

SEQ ID NO: 52142 - DNA, 6 bp, Unknown
  misc_feature (1)..( 6): Matrix.002 file - promoters60/1557648
agaaaa

SEQ ID NO: 52143 - DNA, 8 bp, Unknown
  misc_feature (1)..( 8): Matrix.002 file - promoters60/1557648
aaaacatt

SEQ ID NO: 52144 - DNA, 6 bp, Unknown
  misc_feature (1)..( 6): Matrix.002 file - promoters60/1557648
atagaa

SEQ ID NO: 52145 - DNA, 7 bp, Unknown
  misc_feature (1)..( 7): Matrix.002 file - promoters60/1557648
cataatt

SEQ ID NO: 52146 - DNA, 8 bp, Unknown
  misc_feature (1)..( 8): Matrix.002 file - promoters60/1557648
aaatttga

SEQ ID NO: 52147 - DNA, 7 bp, Unknown
  misc_feature (1)..( 7): Matrix.002 file - promoters60/1557648
aaaaaaa

SEQ ID NO: 52148 - DNA, 6 bp, Unknown
  misc_feature (1)..( 6): Matrix.002 file - promoters60/1557648
acatct

SEQ ID NO: 52149 - DNA, 7 bp, Unknown
  misc_feature (1)..( 7): Matrix.002 file - promoters60/1557648
gtacaat

SEQ ID NO: 52150 - DNA, 7 bp, Unknown
  misc_feature (1)..( 7): Matrix.002 file - promoters60/1557648
aaaagtt

SEQ ID NO: 52151 - DNA, 6 bp, Unknown
  misc_feature (1)..( 6): Matrix.002 file - promoters60/1557648
caaatt

SEQ ID NO: 52152 - DNA, 7 bp, Unknown
  misc_feature (1)..( 7): Matrix.002 file - promoters60/1557648
cagcaaa

SEQ ID NO: 52153 - DNA, 8 bp, Unknown
  misc_feature (1)..( 8): Matrix.002 file - promoters60/1557648
aatctcac

SEQ ID NO: 52154 - DNA, 9 bp, Unknown
  misc_feature (1)..( 9): Matrix.002 file - promoters60/1557648
caacaaaat

SEQ ID NO: 52155 - DNA, 8 bp, Unknown
  misc_feature (1)..( 8): Matrix.002 file - promoters60/1557648
acacacac

SEQ ID NO: 52156 - DNA, 7 bp, Unknown
  misc_feature (1)..( 7): Matrix.002 file - promoters60/1557648
aatttga

SEQ ID NO: 52157 - DNA, 7 bp, Unknown
  misc_feature (1)..( 7): Matrix.002 file - promoters60/1557648
aaaatga

SEQ ID NO: 52158 - DNA, 7 bp, Unknown
  misc_feature (1)..( 7): Matrix.002 file - promoters60/1557648
tgaagga

SEQ ID NO: 52159 - DNA, 6 bp, Unknown
  misc_feature (1)..( 6): Matrix.002 file - promoters60/1557712
ttccga

SEQ ID NO: 52160 - DNA, 6 bp, Unknown
  misc_feature (1)..( 6): Matrix.002 file - promoters60/1557712
aagctc

SEQ ID NO: 52161 - DNA, 7 bp, Unknown
  misc_feature (1)..( 7): Matrix.002 file - promoters60/1557712
tttaaag

SEQ ID NO: 52162 - DNA, 8 bp, Unknown
  misc_feature (1)..( 8): Matrix.002 file - promoters60/1557712
taaaaaaa

SEQ ID NO: 52163 - DNA, 7 bp, Unknown
  misc_feature (1)..( 7): Matrix.002 file - promoters60/1557712
caacttc

SEQ ID NO: 52164 - DNA, 6 bp, Unknown
  misc_feature (1)..( 6): Matrix.002 file - promoters60/1557712
tgattc

SEQ ID NO: 52165 - DNA, 6 bp, Unknown
  misc_feature (1)..( 6): Matrix.002 file - promoters60/1557712
aaaaac

SEQ ID NO: 52166 - DNA, 6 bp, Unknown
  misc_feature (1)..( 6): Matrix.002 file - promoters60/1557712
tttatt

SEQ ID NO: 52167 - DNA, 8 bp, Unknown
  misc_feature (1)..( 8): Matrix.002 file - promoters60/1557712
tttccata

SEQ ID NO: 52168 - DNA, 7 bp, Unknown
  misc_feature (1)..( 7): Matrix.002 file - promoters60/1557712
tatcttg

SEQ ID NO: 52169 - DNA, 8 bp, Unknown
  misc_feature (1)..( 8): Matrix.002 file - promoters60/1557712
ttagtgtt

SEQ ID NO: 52170 - DNA, 7 bp, Unknown
  misc_feature (1)..( 7): Matrix.002 file - promoters60/1557730
gccaatt

SEQ ID NO: 52171 - DNA, 9 bp, Unknown
  misc_feature (1)..( 9): Matrix.002 file - promoters60/1557730
aatgtgtta

SEQ ID NO: 52172 - DNA, 8 bp, Unknown
  misc_feature (1)..( 8): Matrix.002 file - promoters60/1557730
ttaattat

SEQ ID NO: 52173 - DNA, 7 bp, Unknown
  misc_feature (1)..( 7): Matrix.002 file - promoters60/1557730
tatatta

SEQ ID NO: 52174 - DNA, 7 bp, Unknown
  misc_feature (1)..( 7): Matrix.002 file - promoters60/1557730
taagaaa

SEQ ID NO: 52175 - DNA, 6 bp, Unknown
  misc_feature (1)..( 6): Matrix.002 file - promoters60/1557730
ttgtct

SEQ ID NO: 52176 - DNA, 7 bp, Unknown
  misc_feature (1)..( 7): Matrix.002 file - promoters60/1557730
agatacg

SEQ ID NO: 52177 - DNA, 6 bp, Unknown
  misc_feature (1)..( 6): Matrix.002 file - promoters60/1557730
acaaga

SEQ ID NO: 52178 - DNA, 6 bp, Unknown
  misc_feature (1)..( 6): Matrix.002 file - promoters60/1557730
aattaa

SEQ ID NO: 52179 - DNA, 8 bp, Unknown
  misc_feature (1)..( 8): Matrix.002 file - promoters60/1557730
ttagttga

SEQ ID NO: 52180 - DNA, 7 bp, Unknown
  misc_feature (1)..( 7): Matrix.002 file - promoters60/1557730
tttcttt

SEQ ID NO: 52181 - DNA, 7 bp, Unknown
  misc_feature (1)..( 7): Matrix.002 file - promoters60/1557730
ttaattt

SEQ ID NO: 52182 - DNA, 7 bp, Unknown
  misc_feature (1)..( 7): Matrix.002 file - promoters60/1557730
atgaata

SEQ ID NO: 52183 - DNA, 9 bp, Unknown
  misc_feature (1)..( 9): Matrix.002 file - promoters60/1557730
atcaaatta

SEQ ID NO: 52184 - DNA, 8 bp, Unknown
  misc_feature (1)..( 8): Matrix.002 file - promoters60/1557730
taaaaaaa

SEQ ID NO: 52185 - DNA, 7 bp, Unknown
  misc_feature (1)..( 7): Matrix.002 file - promoters60/1557730
acaaaaa

SEQ ID NO: 52186 - DNA, 6 bp, Unknown
  misc_feature (1)..( 6): Matrix.002 file - promoters60/1557730
cacctt

SEQ ID NO: 52187 - DNA, 8 bp, Unknown
  misc_feature (1)..( 8): Matrix.002 file - promoters60/1557730
caccatca

SEQ ID NO: 52188 - DNA, 7 bp, Unknown
  misc_feature (1)..( 7): Matrix.002 file - promoters60/1557730
atgaaaa

SEQ ID NO: 52189 - DNA, 6 bp, Unknown
  misc_feature (1)..( 6): Matrix.002 file - promoters60/1557730
ccatcc

SEQ ID NO: 52190 - DNA, 7 bp, Unknown
  misc_feature (1)..( 7): Matrix.002 file - promoters60/1557775
tttgttc

SEQ ID NO: 52191 - DNA, 7 bp, Unknown
  misc_feature (1)..( 7): Matrix.002 file - promoters60/1557775
attatat

SEQ ID NO: 52192 - DNA, 6 bp, Unknown
  misc_feature (1)..( 6): Matrix.002 file - promoters60/1557775
aaaaga

SEQ ID NO: 52193 - DNA, 6 bp, Unknown
  misc_feature (1)..( 6): Matrix.002 file - promoters60/1557775
ttcggt

SEQ ID NO: 52194 - DNA, 8 bp, Unknown
  misc_feature (1)..( 8): Matrix.002 file - promoters60/1557775
cacacaaa

SEQ ID NO: 52195 - DNA, 7 bp, Unknown
  misc_feature (1)..( 7): Matrix.002 file - promoters60/1557775
ggattcg

SEQ ID NO: 52196 - DNA, 6 bp, Unknown
  misc_feature (1)..( 6): Matrix.002 file - promoters60/1557775
gaaacg

SEQ ID NO: 52197 - DNA, 7 bp, Unknown
  misc_feature (1)..( 7): Matrix.002 file - promoters60/1557775
agtttct

SEQ ID NO: 52198 - DNA, 10 bp, Unknown
  misc_feature (1)..( 10): Matrix.002 file - promoters60/1557775
aacaacaagt

SEQ ID NO: 52199 - DNA, 6 bp, Unknown
  misc_feature (1)..( 6): Matrix.002 file - promoters60/1557775
ttgact

SEQ ID NO: 52200 - DNA, 6 bp, Unknown
  misc_feature (1)..( 6): Matrix.002 file - promoters60/1557775
tataaa

SEQ ID NO: 52201 - DNA, 8 bp, Unknown
  misc_feature (1)..( 8): Matrix.002 file - promoters60/1557775
ggccaagt

SEQ ID NO: 52202 - DNA, 6 bp, Unknown
  misc_feature (1)..( 6): Matrix.002 file - promoters60/1557775
aagaaa

SEQ ID NO: 52203 - DNA, 6 bp, Unknown
  misc_feature (1)..( 6): Matrix.002 file - promoters60/1557775
gaatca

SEQ ID NO: 52204 - DNA, 7 bp, Unknown
  misc_feature (1)..( 7): Matrix.002 file - promoters60/1557775
tccagtt

SEQ ID NO: 52205 - DNA, 6 bp, Unknown
  misc_feature (1)..( 6): Matrix.002 file - promoters60/1557775
tttccg

SEQ ID NO: 52206 - DNA, 6 bp, Unknown
  misc_feature (1)..( 6): Matrix.002 file - promoters60/1557775
ataaat

SEQ ID NO: 52207 - DNA, 6 bp, Unknown
  misc_feature (1)..( 6): Matrix.002 file - promoters60/1557775
aaccct

SEQ ID NO: 52208 - DNA, 6 bp, Unknown
  misc_feature (1)..( 6): Matrix.002 file - promoters60/1557783
aagtgt

SEQ ID NO: 52209 - DNA, 11 bp, Unknown
  misc_feature (1)..( 11): Matrix.002 file - promoters60/1557783
aaaacaaatat

SEQ ID NO: 52210 - DNA, 11 bp, Unknown
  misc_feature (1)..( 11): Matrix.002 file - promoters60/1557783
atgtgtttcta

SEQ ID NO: 52211 - DNA, 7 bp, Unknown
  misc_feature (1)..( 7): Matrix.002 file - promoters60/1557783
gtgtatg

SEQ ID NO: 52212 - DNA, 12 bp, Unknown
  misc_feature (1)..( 12): Matrix.002 file - promoters60/1557783
acaagtagatga

SEQ ID NO: 52213 - DNA, 8 bp, Unknown
  misc_feature (1)..( 8): Matrix.002 file - promoters60/1557783
attgtaaa

SEQ ID NO: 52214 - DNA, 7 bp, Unknown
  misc_feature (1)..( 7): Matrix.002 file - promoters60/1557806
ggaagaa

SEQ ID NO: 52215 - DNA, 6 bp, Unknown
  misc_feature (1)..( 6): Matrix.002 file - promoters60/1557806
agaaga

SEQ ID NO: 52216 - DNA, 6 bp, Unknown
  misc_feature (1)..( 6): Matrix.002 file - promoters60/1557806
gaagaa

SEQ ID NO: 52217 - DNA, 9 bp, Unknown
  misc_feature (1)..( 9): Matrix.002 file - promoters60/1557806
tcttagcaa

SEQ ID NO: 52218 - DNA, 10 bp, Unknown
  misc_feature (1)..( 10): Matrix.002 file - promoters60/1557806
gataatttgt

SEQ ID NO: 52219 - DNA, 8 bp, Unknown
  misc_feature (1)..( 8): Matrix.002 file - promoters60/1557806
tataaatt

SEQ ID NO: 52220 - DNA, 8 bp, Unknown
  misc_feature (1)..( 8): Matrix.002 file - promoters60/1557806
tttaattt

SEQ ID NO: 52221 - DNA, 7 bp, Unknown
  misc_feature (1)..( 7): Matrix.002 file - promoters60/1557806
aaaccaa

SEQ ID NO: 52222 - DNA, 6 bp, Unknown
  misc_feature (1)..( 6): Matrix.002 file - promoters60/1557806
aaccga

SEQ ID NO: 52223 - DNA, 6 bp, Unknown
  misc_feature (1)..( 6): Matrix.002 file - promoters60/1557806
caagtt

SEQ ID NO: 52224 - DNA, 6 bp, Unknown
  misc_feature (1)..( 6): Matrix.002 file - promoters60/1557806
acagtg

SEQ ID NO: 52225 - DNA, 6 bp, Unknown
  misc_feature (1)..( 6): Matrix.002 file - promoters60/1557806
gaactt

SEQ ID NO: 52226 - DNA, 8 bp, Unknown
  misc_feature (1)..( 8): Matrix.002 file - promoters60/1557806
aattgatt

SEQ ID NO: 52227 - DNA, 6 bp, Unknown
  misc_feature (1)..( 6): Matrix.002 file - promoters60/1557806
aaaatt

SEQ ID NO: 52228 - DNA, 10 bp, Unknown
  misc_feature (1)..( 10): Matrix.002 file - promoters60/1557806
tatgctttgg

SEQ ID NO: 52229 - DNA, 8 bp, Unknown
  misc_feature (1)..( 8): Matrix.002 file - promoters60/1557806
ttcacaga

SEQ ID NO: 52230 - DNA, 6 bp, Unknown
  misc_feature (1)..( 6): Matrix.002 file - promoters60/1557806
tcttgt

SEQ ID NO: 52231 - DNA, 6 bp, Unknown
  misc_feature (1)..( 6): Matrix.002 file - promoters60/1557806
gtgtgc

SEQ ID NO: 52232 - DNA, 12 bp, Unknown
  misc_feature (1)..( 12): Matrix.002 file - promoters60/1565965
agaaaattggat

SEQ ID NO: 52233 - DNA, 9 bp, Unknown
  misc_feature (1)..( 9): Matrix.002 file - promoters60/1565965
ttttatagt

SEQ ID NO: 52234 - DNA, 8 bp, Unknown
  misc_feature (1)..( 8): Matrix.002 file - promoters60/1565965
attgttcg

SEQ ID NO: 52235 - DNA, 15 bp, Unknown
  misc_feature (1)..( 15): Matrix.002 file - promoters60/1565965
taaatagtaacggga

SEQ ID NO: 52236 - DNA, 8 bp, Unknown
  misc_feature (1)..( 8): Matrix.002 file - promoters60/1565965
ttgtactt

SEQ ID NO: 52237 - DNA, 7 bp, Unknown
  misc_feature (1)..( 7): Matrix.002 file - promoters60/1566253
tgggttt

SEQ ID NO: 52238 - DNA, 6 bp, Unknown
  misc_feature (1)..( 6): Matrix.002 file - promoters60/1566253
ttgttg

SEQ ID NO: 52239 - DNA, 6 bp, Unknown
  misc_feature (1)..( 6): Matrix.002 file - promoters60/1566253
agtaaa

SEQ ID NO: 52240 - DNA, 7 bp, Unknown
  misc_feature (1)..( 7): Matrix.002 file - promoters60/1566253
aagaaaa

SEQ ID NO: 52241 - DNA, 9 bp, Unknown
  misc_feature (1)..( 9): Matrix.002 file - promoters60/1566253
gagcctgat

SEQ ID NO: 52242 - DNA, 6 bp, Unknown
  misc_feature (1)..( 6): Matrix.002 file - promoters60/1566253
aattgc

SEQ ID NO: 52243 - DNA, 6 bp, Unknown
  misc_feature (1)..( 6): Matrix.002 file - promoters60/1566253
tccaaa

SEQ ID NO: 52244 - DNA, 6 bp, Unknown
  misc_feature (1)..( 6): Matrix.002 file - promoters60/1566253
aaacga

SEQ ID NO: 52245 - DNA, 6 bp, Unknown
  misc_feature (1)..( 6): Matrix.002 file - promoters60/1566253
tctaaa

SEQ ID NO: 52246 - DNA, 8 bp, Unknown
  misc_feature (1)..( 8): Matrix.002 file - promoters60/1566253
aacaaaaa

SEQ ID NO: 52247 - DNA, 6 bp, Unknown
  misc_feature (1)..( 6): Matrix.002 file - promoters60/1566253
ttgact

SEQ ID NO: 52248 - DNA, 8 bp, Unknown
  misc_feature (1)..( 8): Matrix.002 file - promoters60/1566253
ccaagacg

SEQ ID NO: 52249 - DNA, 7 bp, Unknown
  misc_feature (1)..( 7): Matrix.002 file - promoters60/1566253
aggccca

SEQ ID NO: 52250 - DNA, 6 bp, Unknown
  misc_feature (1)..( 6): Matrix.002 file - promoters60/1566423
tcaaaa

SEQ ID NO: 52251 - DNA, 8 bp, Unknown
  misc_feature (1)..( 8): Matrix.002 file - promoters60/1566423
aaataata

SEQ ID NO: 52252 - DNA, 7 bp, Unknown
  misc_feature (1)..( 7): Matrix.002 file - promoters60/1566423
tagataa

SEQ ID NO: 52253 - DNA, 12 bp, Unknown
  misc_feature (1)..( 12): Matrix.002 file - promoters60/1566423
ctgaaataaatt

SEQ ID NO: 52254 - DNA, 6 bp, Unknown
  misc_feature (1)..( 6): Matrix.002 file - promoters60/1566423
ttatgt

SEQ ID NO: 52255 - DNA, 11 bp, Unknown
  misc_feature (1)..( 11): Matrix.002 file - promoters60/1566423
tttgtaaacaa

SEQ ID NO: 52256 - DNA, 9 bp, Unknown
  misc_feature (1)..( 9): Matrix.002 file - promoters60/1566423
tatattatt

SEQ ID NO: 52257 - DNA, 9 bp, Unknown
  misc_feature (1)..( 9): Matrix.002 file - promoters60/1566423
attaaaatt

SEQ ID NO: 52258 - DNA, 7 bp, Unknown
  misc_feature (1)..( 7): Matrix.002 file - promoters60/1566423
gacaaaa

SEQ ID NO: 52259 - DNA, 7 bp, Unknown
  misc_feature (1)..( 7): Matrix.002 file - promoters60/1566423
ttcaata

SEQ ID NO: 52260 - DNA, 8 bp, Unknown
  misc_feature (1)..( 8): Matrix.002 file - promoters60/1566423
atttcaca

SEQ ID NO: 52261 - DNA, 6 bp, Unknown
  misc_feature (1)..( 6): Matrix.002 file - promoters60/1566423
tattta

SEQ ID NO: 52262 - DNA, 6 bp, Unknown
  misc_feature (1)..( 6): Matrix.002 file - promoters60/1566423
taaaac

SEQ ID NO: 52263 - DNA, 6 bp, Unknown
  misc_feature (1)..( 6): Matrix.002 file - promoters60/1566423
cccaat

SEQ ID NO: 52264 - DNA, 11 bp, Unknown
  misc_feature (1)..( 11): Matrix.002 file - promoters60/1566423
aagcaaacagg

SEQ ID NO: 52265 - DNA, 6 bp, Unknown
  misc_feature (1)..( 6): Matrix.002 file - promoters60/1566715
tcaaaa

SEQ ID NO: 52266 - DNA, 8 bp, Unknown
  misc_feature (1)..( 8): Matrix.002 file - promoters60/1566715
aaataata

SEQ ID NO: 52267 - DNA, 7 bp, Unknown
  misc_feature (1)..( 7): Matrix.002 file - promoters60/1566715
tagataa

SEQ ID NO: 52268 - DNA, 12 bp, Unknown
  misc_feature (1)..( 12): Matrix.002 file - promoters60/1566715
ctgaaataaatt

SEQ ID NO: 52269 - DNA, 6 bp, Unknown
  misc_feature (1)..( 6): Matrix.002 file - promoters60/1566715
ttatgt

SEQ ID NO: 52270 - DNA, 11 bp, Unknown
  misc_feature (1)..( 11): Matrix.002 file - promoters60/1566715
tttgtaaacaa

SEQ ID NO: 52271 - DNA, 9 bp, Unknown
  misc_feature (1)..( 9): Matrix.002 file - promoters60/1566715
tatattatt

SEQ ID NO: 52272 - DNA, 9 bp, Unknown
  misc_feature (1)..( 9): Matrix.002 file - promoters60/1566715
attaaaatt

SEQ ID NO: 52273 - DNA, 7 bp, Unknown
  misc_feature (1)..( 7): Matrix.002 file - promoters60/1566715
gacaaaa

SEQ ID NO: 52274 - DNA, 7 bp, Unknown
  misc_feature (1)..( 7): Matrix.002 file - promoters60/1566715
ttcaata

SEQ ID NO: 52275 - DNA, 8 bp, Unknown
  misc_feature (1)..( 8): Matrix.002 file - promoters60/1566715
atttcaca

SEQ ID NO: 52276 - DNA, 6 bp, Unknown
  misc_feature (1)..( 6): Matrix.002 file - promoters60/1566715
tattta

SEQ ID NO: 52277 - DNA, 6 bp, Unknown
  misc_feature (1)..( 6): Matrix.002 file - promoters60/1566715
taaaac

SEQ ID NO: 52278 - DNA, 6 bp, Unknown
  misc_feature (1)..( 6): Matrix.002 file - promoters60/1566715
cccaat

SEQ ID NO: 52279 - DNA, 11 bp, Unknown
  misc_feature (1)..( 11): Matrix.002 file - promoters60/1566715
aagcaaacagg

SEQ ID NO: 52280 - DNA, 6 bp, Unknown
  misc_feature (1)..( 6): Matrix.002 file - promoters60/1566797
aaaaac

SEQ ID NO: 52281 - DNA, 6 bp, Unknown
  misc_feature (1)..( 6): Matrix.002 file - promoters60/1566797
ttaaat

SEQ ID NO: 52282 - DNA, 6 bp, Unknown
  misc_feature (1)..( 6): Matrix.002 file - promoters60/1566797
taaaat

SEQ ID NO: 52283 - DNA, 10 bp, Unknown
  misc_feature (1)..( 10): Matrix.002 file - promoters60/1566797
ttcgtttctt

SEQ ID NO: 52284 - DNA, 6 bp, Unknown
  misc_feature (1)..( 6): Matrix.002 file - promoters60/1566797
aatgct

SEQ ID NO: 52285 - DNA, 8 bp, Unknown
  misc_feature (1)..( 8): Matrix.002 file - promoters60/1566797
tttggtta

SEQ ID NO: 52286 - DNA, 7 bp, Unknown
  misc_feature (1)..( 7): Matrix.002 file - promoters60/1566797
aaagata

SEQ ID NO: 52287 - DNA, 6 bp, Unknown
  misc_feature (1)..( 6): Matrix.002 file - promoters60/1566797
cacata

SEQ ID NO: 52288 - DNA, 7 bp, Unknown
  misc_feature (1)..( 7): Matrix.002 file - promoters60/1566797
aaccttt

SEQ ID NO: 52289 - DNA, 6 bp, Unknown
  misc_feature (1)..( 6): Matrix.002 file - promoters60/1566797
ttaaac

SEQ ID NO: 52290 - DNA, 7 bp, Unknown
  misc_feature (1)..( 7): Matrix.002 file - promoters60/1566797
aatgaat

SEQ ID NO: 52291 - DNA, 8 bp, Unknown
  misc_feature (1)..( 8): Matrix.002 file - promoters60/1566797
acataacg

SEQ ID NO: 52292 - DNA, 7 bp, Unknown
  misc_feature (1)..( 7): Matrix.002 file - promoters60/1566797
cattttt

SEQ ID NO: 52293 - DNA, 13 bp, Unknown
  misc_feature (1)..( 13): Matrix.002 file - promoters60/1566948
ttgaatcaaaatt

SEQ ID NO: 52294 - DNA, 6 bp, Unknown
  misc_feature (1)..( 6): Matrix.002 file - promoters60/1566948
tggatt

SEQ ID NO: 52295 - DNA, 13 bp, Unknown
  misc_feature (1)..( 13): Matrix.002 file - promoters60/1566948
ttgaatcaaaatt

SEQ ID NO: 52296 - DNA, 7 bp, Unknown
  misc_feature (1)..( 7): Matrix.002 file - promoters60/1567007
aaaagaa

SEQ ID NO: 52297 - DNA, 9 bp, Unknown
  misc_feature (1)..( 9): Matrix.002 file - promoters60/1567007
aaatattaa

SEQ ID NO: 52298 - DNA, 8 bp, Unknown
  misc_feature (1)..( 8): Matrix.002 file - promoters60/1567007
caaaatca

SEQ ID NO: 52299 - DNA, 8 bp, Unknown
  misc_feature (1)..( 8): Matrix.002 file - promoters60/1567007
ttaaaaaa

SEQ ID NO: 52300 - DNA, 8 bp, Unknown
  misc_feature (1)..( 8): Matrix.002 file - promoters60/1567007
ctaaaaaa

SEQ ID NO: 52301 - DNA, 8 bp, Unknown
  misc_feature (1)..( 8): Matrix.002 file - promoters60/1567007
taaaaaaa

SEQ ID NO: 52302 - DNA, 10 bp, Unknown
  misc_feature (1)..( 10): Matrix.002 file - promoters60/1567092
catgtttaaa

SEQ ID NO: 52303 - DNA, 12 bp, Unknown
  misc_feature (1)..( 12): Matrix.002 file - promoters60/1567092
aatcataatttt

SEQ ID NO: 52304 - DNA, 11 bp, Unknown
  misc_feature (1)..( 11): Matrix.002 file - promoters60/1567092
caataatttac

SEQ ID NO: 52305 - DNA, 11 bp, Unknown
  misc_feature (1)..( 11): Matrix.002 file - promoters60/1567949
aaaatcaattg

SEQ ID NO: 52306 - DNA, 6 bp, Unknown
  misc_feature (1)..( 6): Matrix.002 file - promoters60/1567957
ccataa

SEQ ID NO: 52307 - DNA, 10 bp, Unknown
  misc_feature (1)..( 10): Matrix.002 file - promoters60/1567957
atattttatt

SEQ ID NO: 52308 - DNA, 13 bp, Unknown
  misc_feature (1)..( 13): Matrix.002 file - promoters60/1567957
actattttaaaca

SEQ ID NO: 52309 - DNA, 9 bp, Unknown
  misc_feature (1)..( 9): Matrix.002 file - promoters60/1567957
acccaaata

SEQ ID NO: 52310 - DNA, 6 bp, Unknown
  misc_feature (1)..( 6): Matrix.002 file - promoters60/1568230
gattga

SEQ ID NO: 52311 - DNA, 8 bp, Unknown
  misc_feature (1)..( 8): Matrix.002 file - promoters60/1568230
tcgatttt

SEQ ID NO: 52312 - DNA, 6 bp, Unknown
  misc_feature (1)..( 6): Matrix.002 file - promoters60/1568230
atttta

SEQ ID NO: 52313 - DNA, 10 bp, Unknown
  misc_feature (1)..( 10): Matrix.002 file - promoters60/1568230
ttaatataaa

SEQ ID NO: 52314 - DNA, 6 bp, Unknown
  misc_feature (1)..( 6): Matrix.002 file - promoters60/1568230
aaccgt

SEQ ID NO: 52315 - DNA, 7 bp, Unknown
  misc_feature (1)..( 7): Matrix.002 file - promoters60/1568230
taaacta

SEQ ID NO: 52316 - DNA, 6 bp, Unknown
  misc_feature (1)..( 6): Matrix.002 file - promoters60/1568230
aatatt

SEQ ID NO: 52317 - DNA, 7 bp, Unknown
  misc_feature (1)..( 7): Matrix.002 file - promoters60/1568230
attataa

SEQ ID NO: 52318 - DNA, 8 bp, Unknown
  misc_feature (1)..( 8): Matrix.002 file - promoters60/1568230
tattataa

SEQ ID NO: 52319 - DNA, 8 bp, Unknown
  misc_feature (1)..( 8): Matrix.002 file - promoters60/1568230
tttatggt

SEQ ID NO: 52320 - DNA, 7 bp, Unknown
  misc_feature (1)..( 7): Matrix.002 file - promoters60/1568230
aataaaa

SEQ ID NO: 52321 - DNA, 7 bp, Unknown
  misc_feature (1)..( 7): Matrix.002 file - promoters60/1568230
acaaatt

SEQ ID NO: 52322 - DNA, 6 bp, Unknown
  misc_feature (1)..( 6): Matrix.002 file - promoters60/1568230
agaaaa

SEQ ID NO: 52323 - DNA, 6 bp, Unknown
  misc_feature (1)..( 6): Matrix.002 file - promoters60/1568230
taataa

SEQ ID NO: 52324 - DNA, 7 bp, Unknown
  misc_feature (1)..( 7): Matrix.002 file - promoters60/1568230
tgtgtga

SEQ ID NO: 52325 - DNA, 6 bp, Unknown
  misc_feature (1)..( 6): Matrix.002 file - promoters60/1568230
taaaca

SEQ ID NO: 52326 - DNA, 7 bp, Unknown
  misc_feature (1)..( 7): Matrix.002 file - promoters60/1568230
acaaaat

SEQ ID NO: 52327 - DNA, 8 bp, Unknown
  misc_feature (1)..( 8): Matrix.002 file - promoters60/1568230
gttaaata

SEQ ID NO: 52328 - DNA, 6 bp, Unknown
  misc_feature (1)..( 6): Matrix.002 file - promoters60/1568230
aaacct

SEQ ID NO: 52329 - DNA, 14 bp, Unknown
  misc_feature (1)..( 14): Matrix.002 file - promoters60/1568386
tttaaaatttttaa

SEQ ID NO: 52330 - DNA, 9 bp, Unknown
  misc_feature (1)..( 9): Matrix.002 file - promoters60/1568386
ttttaaata

SEQ ID NO: 52331 - DNA, 8 bp, Unknown
  misc_feature (1)..( 8): Matrix.002 file - promoters60/1568386
tttaattt

SEQ ID NO: 52332 - DNA, 11 bp, Unknown
  misc_feature (1)..( 11): Matrix.002 file - promoters60/1568386
aaaaatttaat

SEQ ID NO: 52333 - DNA, 13 bp, Unknown
  misc_feature (1)..( 13): Matrix.002 file - promoters60/1568386
taaattgtactta

SEQ ID NO: 52334 - DNA, 11 bp, Unknown
  misc_feature (1)..( 11): Matrix.002 file - promoters60/1568386
attaaaatttt

SEQ ID NO: 52335 - DNA, 7 bp, Unknown
  misc_feature (1)..( 7): Matrix.002 file - promoters60/1568386
tttattt

SEQ ID NO: 52336 - DNA, 11 bp, Unknown
  misc_feature (1)..( 11): Matrix.002 file - promoters60/1568386
caatttaatta

SEQ ID NO: 52337 - DNA, 8 bp, Unknown
  misc_feature (1)..( 8): Matrix.002 file - promoters60/1568405
tttaataa

SEQ ID NO: 52338 - DNA, 7 bp, Unknown
  misc_feature (1)..( 7): Matrix.002 file - promoters60/1568405
ataaaaa

SEQ ID NO: 52339 - DNA, 7 bp, Unknown
  misc_feature (1)..( 7): Matrix.002 file - promoters60/1568405
tttctga

SEQ ID NO: 52340 - DNA, 7 bp, Unknown
  misc_feature (1)..( 7): Matrix.002 file - promoters60/1568405
aacaaaa

SEQ ID NO: 52341 - DNA, 8 bp, Unknown
  misc_feature (1)..( 8): Matrix.002 file - promoters60/1568405
aaaattat

SEQ ID NO: 52342 - DNA, 6 bp, Unknown
  misc_feature (1)..( 6): Matrix.002 file - promoters60/1568405
aggaag

SEQ ID NO: 52343 - DNA, 10 bp, Unknown
  misc_feature (1)..( 10): Matrix.002 file - promoters60/1568405
acttttcctt

SEQ ID NO: 52344 - DNA, 8 bp, Unknown
  misc_feature (1)..( 8): Matrix.002 file - promoters60/1568405
tccaataa

SEQ ID NO: 52345 - DNA, 11 bp, Unknown
  misc_feature (1)..( 11): Matrix.002 file - promoters60/1568405
tttatcattgt

SEQ ID NO: 52346 - DNA, 7 bp, Unknown
  misc_feature (1)..( 7): Matrix.002 file - promoters60/1568405
aaaaaag

SEQ ID NO: 52347 - DNA, 6 bp, Unknown
  misc_feature (1)..( 6): Matrix.002 file - promoters60/1568405
gaaact

SEQ ID NO: 52348 - DNA, 6 bp, Unknown
  misc_feature (1)..( 6): Matrix.002 file - promoters60/1568405
tgagag

SEQ ID NO: 52349 - DNA, 7 bp, Unknown
  misc_feature (1)..( 7): Matrix.002 file - promoters60/1568405
tttgatt

SEQ ID NO: 52350 - DNA, 7 bp, Unknown
  misc_feature (1)..( 7): Matrix.002 file - promoters60/1568405
ttactct

SEQ ID NO: 52351 - DNA, 6 bp, Unknown
  misc_feature (1)..( 6): Matrix.002 file - promoters60/1568405
gaatct

SEQ ID NO: 52352 - DNA, 6 bp, Unknown
  misc_feature (1)..( 6): Matrix.002 file - promoters60/1568405
tttgta

SEQ ID NO: 52353 - DNA, 8 bp, Unknown
  misc_feature (1)..( 8): Matrix.002 file - promoters60/1568405
ccaatggg

SEQ ID NO: 52354 - DNA, 7 bp, Unknown
  misc_feature (1)..( 7): Matrix.002 file - promoters60/1568409
attatat

SEQ ID NO: 52355 - DNA, 9 bp, Unknown
  misc_feature (1)..( 9): Matrix.002 file - promoters60/1568409
tgtcaatct

SEQ ID NO: 52356 - DNA, 7 bp, Unknown
  misc_feature (1)..( 7): Matrix.002 file - promoters60/1568409
acgatta

SEQ ID NO: 52357 - DNA, 9 bp, Unknown
  misc_feature (1)..( 9): Matrix.002 file - promoters60/1568409
caatctttc

SEQ ID NO: 52358 - DNA, 8 bp, Unknown
  misc_feature (1)..( 8): Matrix.002 file - promoters60/1568409
aaagtctt

SEQ ID NO: 52359 - DNA, 6 bp, Unknown
  misc_feature (1)..( 6): Matrix.002 file - promoters60/1568409
catatt

SEQ ID NO: 52360 - DNA, 7 bp, Unknown
  misc_feature (1)..( 7): Matrix.002 file - promoters60/1568409
atttgat

SEQ ID NO: 52361 - DNA, 11 bp, Unknown
  misc_feature (1)..( 11): Matrix.002 file - promoters60/1568409
tgtattcgatt

SEQ ID NO: 52362 - DNA, 7 bp, Unknown
  misc_feature (1)..( 7): Matrix.002 file - promoters60/1568409
ttcgttt

SEQ ID NO: 52363 - DNA, 6 bp, Unknown
  misc_feature (1)..( 6): Matrix.002 file - promoters60/1568409
gtttgg

SEQ ID NO: 52364 - DNA, 6 bp, Unknown
  misc_feature (1)..( 6): Matrix.002 file - promoters60/1568409
cttttt

SEQ ID NO: 52365 - DNA, 7 bp, Unknown
  misc_feature (1)..( 7): Matrix.002 file - promoters60/1568409
cttgatt

SEQ ID NO: 52366 - DNA, 7 bp, Unknown
  misc_feature (1)..( 7): Matrix.002 file - promoters60/1568409
tacattt

SEQ ID NO: 52367 - DNA, 14 bp, Unknown
  misc_feature (1)..( 14): Matrix.002 file - promoters60/1568409
ttattaacttccta

SEQ ID NO: 52368 - DNA, 7 bp, Unknown
  misc_feature (1)..( 7): Matrix.002 file - promoters60/1568409
agagaag

SEQ ID NO: 52369 - DNA, 7 bp, Unknown
  misc_feature (1)..( 7): Matrix.002 file - promoters60/1568409
gagcaaa

SEQ ID NO: 52370 - DNA, 6 bp, Unknown
  misc_feature (1)..( 6): Matrix.002 file - promoters60/1568409
ttattg

SEQ ID NO: 52371 - DNA, 7 bp, Unknown
  misc_feature (1)..( 7): Matrix.002 file - promoters60/1568409
tgacaaa

SEQ ID NO: 52372 - DNA, 8 bp, Unknown
  misc_feature (1)..( 8): Matrix.002 file - promoters60/1568409
tgtcactc

SEQ ID NO: 52373 - DNA, 7 bp, Unknown
  misc_feature (1)..( 7): Matrix.002 file - promoters60/1568409
tataaaa

SEQ ID NO: 52374 - DNA, 9 bp, Unknown
  misc_feature (1)..( 9): Matrix.002 file - promoters60/1568508
tcttataat

SEQ ID NO: 52375 - DNA, 7 bp, Unknown
  misc_feature (1)..( 7): Matrix.002 file - promoters60/1568508
acaccaa

SEQ ID NO: 52376 - DNA, 8 bp, Unknown
  misc_feature (1)..( 8): Matrix.002 file - promoters60/1568508
tcttataa

SEQ ID NO: 52377 - DNA, 8 bp, Unknown
  misc_feature (1)..( 8): Matrix.002 file - promoters60/1568508
aaaacaca

SEQ ID NO: 52378 - DNA, 8 bp, Unknown
  misc_feature (1)..( 8): Matrix.002 file - promoters60/1568508
caaacttt

SEQ ID NO: 52379 - DNA, 6 bp, Unknown
  misc_feature (1)..( 6): Matrix.002 file - promoters60/1568508
aatatt

SEQ ID NO: 52380 - DNA, 6 bp, Unknown
  misc_feature (1)..( 6): Matrix.002 file - promoters60/1568508
atcaaa

SEQ ID NO: 52381 - DNA, 7 bp, Unknown
  misc_feature (1)..( 7): Matrix.002 file - promoters60/1568508
caaatcc

SEQ ID NO: 52382 - DNA, 7 bp, Unknown
  misc_feature (1)..( 7): Matrix.002 file - promoters60/1568508
cacaaga

SEQ ID NO: 52383 - DNA, 8 bp, Unknown
  misc_feature (1)..( 8): Matrix.002 file - promoters60/1568508
ctcgcttc

SEQ ID NO: 52384 - DNA, 8 bp, Unknown
  misc_feature (1)..( 8): Matrix.002 file - promoters60/1568508
cttctcga

SEQ ID NO: 52385 - DNA, 8 bp, Unknown
  misc_feature (1)..( 8): Matrix.002 file - promoters60/1569568
aaaataaa

SEQ ID NO: 52386 - DNA, 8 bp, Unknown
  misc_feature (1)..( 8): Matrix.002 file - promoters60/1569568
taaaataa

SEQ ID NO: 52387 - DNA, 7 bp, Unknown
  misc_feature (1)..( 7): Matrix.002 file - promoters60/1569568
aaataaa

SEQ ID NO: 52388 - DNA, 10 bp, Unknown
  misc_feature (1)..( 10): Matrix.002 file - promoters60/1569568
tttatttaat

SEQ ID NO: 52389 - DNA, 9 bp, Unknown
  misc_feature (1)..( 9): Matrix.002 file - promoters60/1569568
aaacttaat

SEQ ID NO: 52390 - DNA, 15 bp, Unknown
  misc_feature (1)..( 15): Matrix.002 file - promoters60/1569568
ttttactaaaaaaga

SEQ ID NO: 52391 - DNA, 11 bp, Unknown
  misc_feature (1)..( 11): Matrix.002 file - promoters60/1569568
taatgtctcat

SEQ ID NO: 52392 - DNA, 12 bp, Unknown
  misc_feature (1)..( 12): Matrix.002 file - promoters60/1569568
aattttatttat

SEQ ID NO: 52393 - DNA, 11 bp, Unknown
  misc_feature (1)..( 11): Matrix.002 file - promoters60/1569568
tataaccaaaa

SEQ ID NO: 52394 - DNA, 10 bp, Unknown
  misc_feature (1)..( 10): Matrix.002 file - promoters60/1569721
atataattaa

SEQ ID NO: 52395 - DNA, 9 bp, Unknown
  misc_feature (1)..( 9): Matrix.002 file - promoters60/1569721
tatttattt

SEQ ID NO: 52396 - DNA, 9 bp, Unknown
  misc_feature (1)..( 9): Matrix.002 file - promoters60/1569721
aataaaaaa

SEQ ID NO: 52397 - DNA, 9 bp, Unknown
  misc_feature (1)..( 9): Matrix.002 file - promoters60/1569721
taaaaataa

SEQ ID NO: 52398 - DNA, 8 bp, Unknown
  misc_feature (1)..( 8): Matrix.002 file - promoters60/1569721
ttataaat

SEQ ID NO: 52399 - DNA, 8 bp, Unknown
  misc_feature (1)..( 8): Matrix.002 file - promoters60/1569763
acaagaac

SEQ ID NO: 52400 - DNA, 6 bp, Unknown
  misc_feature (1)..( 6): Matrix.002 file - promoters60/1570085
tattat

SEQ ID NO: 52401 - DNA, 7 bp, Unknown
  misc_feature (1)..( 7): Matrix.002 file - promoters60/1570085
tttattt

SEQ ID NO: 52402 - DNA, 8 bp, Unknown
  misc_feature (1)..( 8): Matrix.002 file - promoters60/1570085
tttggaat

SEQ ID NO: 52403 - DNA, 8 bp, Unknown
  misc_feature (1)..( 8): Matrix.002 file - promoters60/1570085
taggccaa

SEQ ID NO: 52404 - DNA, 9 bp, Unknown
  misc_feature (1)..( 9): Matrix.002 file - promoters60/1570085
aaagctata

SEQ ID NO: 52405 - DNA, 7 bp, Unknown
  misc_feature (1)..( 7): Matrix.002 file - promoters60/1570085
tctcata

SEQ ID NO: 52406 - DNA, 8 bp, Unknown
  misc_feature (1)..( 8): Matrix.002 file - promoters60/1570085
ttgctaac

SEQ ID NO: 52407 - DNA, 6 bp, Unknown
  misc_feature (1)..( 6): Matrix.002 file - promoters60/1570085
tatcat

SEQ ID NO: 52408 - DNA, 10 bp, Unknown
  misc_feature (1)..( 10): Matrix.002 file - promoters60/1570085
tctatatata

SEQ ID NO: 52409 - DNA, 6 bp, Unknown
  misc_feature (1)..( 6): Matrix.002 file - promoters60/1570085
catttt

SEQ ID NO: 52410 - DNA, 6 bp, Unknown
  misc_feature (1)..( 6): Matrix.002 file - promoters60/1570085
ttttat

SEQ ID NO: 52411 - DNA, 6 bp, Unknown
  misc_feature (1)..( 6): Matrix.002 file - promoters60/1570085
ttattt

SEQ ID NO: 52412 - DNA, 6 bp, Unknown
  misc_feature (1)..( 6): Matrix.002 file - promoters60/1570085
cattta

SEQ ID NO: 52413 - DNA, 6 bp, Unknown
  misc_feature (1)..( 6): Matrix.002 file - promoters60/1570085
gttgca

SEQ ID NO: 52414 - DNA, 8 bp, Unknown
  misc_feature (1)..( 8): Matrix.002 file - promoters60/1570085
aataatta

SEQ ID NO: 52415 - DNA, 8 bp, Unknown
  misc_feature (1)..( 8): Matrix.002 file - promoters60/1570085
atatatac

SEQ ID NO: 52416 - DNA, 7 bp, Unknown
  misc_feature (1)..( 7): Matrix.002 file - promoters60/1570085
ttagaaa

SEQ ID NO: 52417 - DNA, 7 bp, Unknown
  misc_feature (1)..( 7): Matrix.002 file - promoters60/1570085
tcaaata

SEQ ID NO: 52418 - DNA, 7 bp, Unknown
  misc_feature (1)..( 7): Matrix.002 file - promoters60/1570085
aaaaaag

SEQ ID NO: 52419 - DNA, 7 bp, Unknown
  misc_feature (1)..( 7): Matrix.002 file - promoters60/1570085
agaatta

SEQ ID NO: 52420 - DNA, 7 bp, Unknown
  misc_feature (1)..( 7): Matrix.002 file - promoters60/1570085
ataattt

SEQ ID NO: 52421 - DNA, 7 bp, Unknown
  misc_feature (1)..( 7): Matrix.002 file - promoters60/1570085
aacaatt

SEQ ID NO: 52422 - DNA, 9 bp, Unknown
  misc_feature (1)..( 9): Matrix.002 file - promoters60/1570085
atcacatga

SEQ ID NO: 52423 - DNA, 8 bp, Unknown
  misc_feature (1)..( 8): Matrix.002 file - promoters60/1570085
aaccattc

SEQ ID NO: 52424 - DNA, 8 bp, Unknown
  misc_feature (1)..( 8): Matrix.002 file - promoters60/1570107
tcaacaac

SEQ ID NO: 52425 - DNA, 6 bp, Unknown
  misc_feature (1)..( 6): Matrix.002 file - promoters60/1570107
tttaaa

SEQ ID NO: 52426 - DNA, 7 bp, Unknown
  misc_feature (1)..( 7): Matrix.002 file - promoters60/1570107
aattaag

SEQ ID NO: 52427 - DNA, 8 bp, Unknown
  misc_feature (1)..( 8): Matrix.002 file - promoters60/1570107
atgtagtg

SEQ ID NO: 52428 - DNA, 8 bp, Unknown
  misc_feature (1)..( 8): Matrix.002 file - promoters60/1570107
agaaaaaa

SEQ ID NO: 52429 - DNA, 8 bp, Unknown
  misc_feature (1)..( 8): Matrix.002 file - promoters60/1570107
aaaaaatc

SEQ ID NO: 52430 - DNA, 15 bp, Unknown
  misc_feature (1)..( 15): Matrix.002 file - promoters60/1570107
caataaccataataa

SEQ ID NO: 52431 - DNA, 7 bp, Unknown
  misc_feature (1)..( 7): Matrix.002 file - promoters60/1570107
aaaaaga

SEQ ID NO: 52432 - DNA, 6 bp, Unknown
  misc_feature (1)..( 6): Matrix.002 file - promoters60/1570107
accaaa

SEQ ID NO: 52433 - DNA, 8 bp, Unknown
  misc_feature (1)..( 8): Matrix.002 file - promoters60/1570107
tataattt

SEQ ID NO: 52434 - DNA, 7 bp, Unknown
  misc_feature (1)..( 7): Matrix.002 file - promoters60/1570107
ttcaaac

SEQ ID NO: 52435 - DNA, 6 bp, Unknown
  misc_feature (1)..( 6): Matrix.002 file - promoters60/1570107
gaaatg

SEQ ID NO: 52436 - DNA, 6 bp, Unknown
  misc_feature (1)..( 6): Matrix.002 file - promoters60/1570107
aagcag

SEQ ID NO: 52437 - DNA, 6 bp, Unknown
  misc_feature (1)..( 6): Matrix.002 file - promoters60/1570107
gccgac

SEQ ID NO: 52438 - DNA, 9 bp, Unknown
  misc_feature (1)..( 9): Matrix.002 file - promoters60/1570107
caaaaaaaa

SEQ ID NO: 52439 - DNA, 6 bp, Unknown
  misc_feature (1)..( 6): Matrix.002 file - promoters60/1570107
tctctc

SEQ ID NO: 52440 - DNA, 11 bp, Unknown
  misc_feature (1)..( 11): Matrix.002 file - promoters60/1570107
agagattcgta

SEQ ID NO: 52441 - DNA, 6 bp, Unknown
  misc_feature (1)..( 6): Matrix.002 file - promoters60/1570107
tatttt

SEQ ID NO: 52442 - DNA, 6 bp, Unknown
  misc_feature (1)..( 6): Matrix.002 file - promoters60/1570107
tattat

SEQ ID NO: 52443 - DNA, 8 bp, Unknown
  misc_feature (1)..( 8): Matrix.002 file - promoters60/1570107
aattcttc

SEQ ID NO: 52444 - DNA, 8 bp, Unknown
  misc_feature (1)..( 8): Matrix.002 file - promoters60/1570107
tttacaaa

SEQ ID NO: 52445 - DNA, 8 bp, Unknown
  misc_feature (1)..( 8): Matrix.002 file - promoters60/1570107
taaaaaaa

SEQ ID NO: 52446 - DNA, 6 bp, Unknown
  misc_feature (1)..( 6): Matrix.002 file - promoters60/1570107
aaaaat

SEQ ID NO: 52447 - DNA, 7 bp, Unknown
  misc_feature (1)..( 7): Matrix.002 file - promoters60/1570107
ctttttt

SEQ ID NO: 52448 - DNA, 9 bp, Unknown
  misc_feature (1)..( 9): Matrix.002 file - promoters60/1570116
aataaatat

SEQ ID NO: 52449 - DNA, 6 bp, Unknown
  misc_feature (1)..( 6): Matrix.002 file - promoters60/1570293
cttttt

SEQ ID NO: 52450 - DNA, 6 bp, Unknown
  misc_feature (1)..( 6): Matrix.002 file - promoters60/1570293
ttttaa

SEQ ID NO: 52451 - DNA, 6 bp, Unknown
  misc_feature (1)..( 6): Matrix.002 file - promoters60/1570293
aacaga

SEQ ID NO: 52452 - DNA, 7 bp, Unknown
  misc_feature (1)..( 7): Matrix.002 file - promoters60/1570293
cacaaca

SEQ ID NO: 52453 - DNA, 6 bp, Unknown
  misc_feature (1)..( 6): Matrix.002 file - promoters60/1570293
acaaaa

SEQ ID NO: 52454 - DNA, 8 bp, Unknown
  misc_feature (1)..( 8): Matrix.002 file - promoters60/1570293
aaaatttt

SEQ ID NO: 52455 - DNA, 6 bp, Unknown
  misc_feature (1)..( 6): Matrix.002 file - promoters60/1570293
gaataa

SEQ ID NO: 52456 - DNA, 8 bp, Unknown
  misc_feature (1)..( 8): Matrix.002 file - promoters60/1570293
ttttattc

SEQ ID NO: 52457 - DNA, 8 bp, Unknown
  misc_feature (1)..( 8): Matrix.002 file - promoters60/1570293
gaaattgt

SEQ ID NO: 52458 - DNA, 8 bp, Unknown
  misc_feature (1)..( 8): Matrix.002 file - promoters60/1570293
ggaaagtg

SEQ ID NO: 52459 - DNA, 6 bp, Unknown
  misc_feature (1)..( 6): Matrix.002 file - promoters60/1570293
cacaca

SEQ ID NO: 52460 - DNA, 6 bp, Unknown
  misc_feature (1)..( 6): Matrix.002 file - promoters60/1570293
aaggta

SEQ ID NO: 52461 - DNA, 7 bp, Unknown
  misc_feature (1)..( 7): Matrix.002 file - promoters60/1570293
tataatt

SEQ ID NO: 52462 - DNA, 6 bp, Unknown
  misc_feature (1)..( 6): Matrix.002 file - promoters60/1570293
tcgtta

SEQ ID NO: 52463 - DNA, 7 bp, Unknown
  misc_feature (1)..( 7): Matrix.002 file - promoters60/1570293
aaaatga

SEQ ID NO: 52464 - DNA, 8 bp, Unknown
  misc_feature (1)..( 8): Matrix.002 file - promoters60/1570293
cgggaaaa

SEQ ID NO: 52465 - DNA, 7 bp, Unknown
  misc_feature (1)..( 7): Matrix.002 file - promoters60/1570293
ggaatat

SEQ ID NO: 52466 - DNA, 7 bp, Unknown
  misc_feature (1)..( 7): Matrix.002 file - promoters60/1570293
gaaaaaa

SEQ ID NO: 52467 - DNA, 7 bp, Unknown
  misc_feature (1)..( 7): Matrix.002 file - promoters60/1570293
aaaaaaa

SEQ ID NO: 52468 - DNA, 7 bp, Unknown
  misc_feature (1)..( 7): Matrix.002 file - promoters60/1570293
acaaaat

SEQ ID NO: 52469 - DNA, 7 bp, Unknown
  misc_feature (1)..( 7): Matrix.002 file - promoters60/1570293
ggtttgg

SEQ ID NO: 52470 - DNA, 9 bp, Unknown
  misc_feature (1)..( 9): Matrix.002 file - promoters60/1570474
tttttataa

SEQ ID NO: 52471 - DNA, 8 bp, Unknown
  misc_feature (1)..( 8): Matrix.002 file - promoters60/1570474
atattttt

SEQ ID NO: 52472 - DNA, 12 bp, Unknown
  misc_feature (1)..( 12): Matrix.002 file - promoters60/1570474
taataaattcat

SEQ ID NO: 52473 - DNA, 11 bp, Unknown
  misc_feature (1)..( 11): Matrix.002 file - promoters60/1570622
aaatctccaat

SEQ ID NO: 52474 - DNA, 3 bp, Unknown
  misc_feature (1)..( 3): Matrix.002 file - promoters60/1570860
aat

SEQ ID NO: 52475 - DNA, 10 bp, Unknown
  misc_feature (1)..( 10): Matrix.002 file - promoters60/1570860
ataaaaaatt

SEQ ID NO: 52476 - DNA, 13 bp, Unknown
  misc_feature (1)..( 13): Matrix.002 file - promoters60/1570860
aaactaaaaaaat

SEQ ID NO: 52477 - DNA, 14 bp, Unknown
  misc_feature (1)..( 14): Matrix.002 file - promoters60/1570869
taaatttgttaaaa

SEQ ID NO: 52478 - DNA, 14 bp, Unknown
  misc_feature (1)..( 14): Matrix.002 file - promoters60/1570869
attagaaattttaa

SEQ ID NO: 52479 - DNA, 8 bp, Unknown
  misc_feature (1)..( 8): Matrix.002 file - promoters60/1570869
ttttgaag

SEQ ID NO: 52480 - DNA, 13 bp, Unknown
  misc_feature (1)..( 13): Matrix.002 file - promoters60/1570869
atgttaaatttgt

SEQ ID NO: 52481 - DNA, 10 bp, Unknown
  misc_feature (1)..( 10): Matrix.002 file - promoters60/1570869
tatatataaa

SEQ ID NO: 52482 - DNA, 12 bp, Unknown
  misc_feature (1)..( 12): Matrix.002 file - promoters60/1570869
tatataaaataa

SEQ ID NO: 52483 - DNA, 10 bp, Unknown
  misc_feature (1)..( 10): Matrix.002 file - promoters60/1570869
caattagttt

SEQ ID NO: 52484 - DNA, 10 bp, Unknown
  misc_feature (1)..( 10): Matrix.002 file - promoters60/1570869
atattatttt

SEQ ID NO: 52485 - DNA, 9 bp, Unknown
  misc_feature (1)..( 9): Matrix.002 file - promoters60/1570966
taaaaatat

SEQ ID NO: 52486 - DNA, 9 bp, Unknown
  misc_feature (1)..( 9): Matrix.002 file - promoters60/1570966
aaacaaatt

SEQ ID NO: 52487 - DNA, 13 bp, Unknown
  misc_feature (1)..( 13): Matrix.002 file - promoters60/1570966
caactatataaaa

SEQ ID NO: 52488 - DNA, 9 bp, Unknown
  misc_feature (1)..( 9): Matrix.002 file - promoters60/1570966
tatttaatt

SEQ ID NO: 52489 - DNA, 15 bp, Unknown
  misc_feature (1)..( 15): Matrix.002 file - promoters60/1570966
atatttctttaaaaa

SEQ ID NO: 52490 - DNA, 11 bp, Unknown
  misc_feature (1)..( 11): Matrix.002 file - promoters60/1570966
gtttcaaatag

SEQ ID NO: 52491 - DNA, 11 bp, Unknown
  misc_feature (1)..( 11): Matrix.002 file - promoters60/1570966
ttgagtttaaa

SEQ ID NO: 52492 - DNA, 9 bp, Unknown
  misc_feature (1)..( 9): Matrix.002 file - promoters60/1570966
aaaaataaa

SEQ ID NO: 52493 - DNA, 10 bp, Unknown
  misc_feature (1)..( 10): Matrix.002 file - promoters60/1570966
atattattaa

SEQ ID NO: 52494 - DNA, 10 bp, Unknown
  misc_feature (1)..( 10): Matrix.002 file - promoters60/1571014
tccaatattt

SEQ ID NO: 52495 - DNA, 11 bp, Unknown
  misc_feature (1)..( 11): Matrix.002 file - promoters60/1571422
actaattagta

SEQ ID NO: 52496 - DNA, 11 bp, Unknown
  misc_feature (1)..( 11): Matrix.002 file - promoters60/1571422
ataaattaaat

SEQ ID NO: 52497 - DNA, 7 bp, Unknown
  misc_feature (1)..( 7): Matrix.002 file - promoters60/1571422
aaaaaaa

SEQ ID NO: 52498 - DNA, 9 bp, Unknown
  misc_feature (1)..( 9): Matrix.002 file - promoters60/1571422
ttattttat

SEQ ID NO: 52499 - DNA, 8 bp, Unknown
  misc_feature (1)..( 8): Matrix.002 file - promoters60/1571422
aaataaag

SEQ ID NO: 52500 - DNA, 9 bp, Unknown
  misc_feature (1)..( 9): Matrix.002 file - promoters60/1571422
actatcata

SEQ ID NO: 52501 - DNA, 8 bp, Unknown
  misc_feature (1)..( 8): Matrix.002 file - promoters60/1571422
aatttcat

SEQ ID NO: 52502 - DNA, 9 bp, Unknown
  misc_feature (1)..( 9): Matrix.002 file - promoters60/1571422
cataataaa

SEQ ID NO: 52503 - DNA, 8 bp, Unknown
  misc_feature (1)..( 8): Matrix.002 file - promoters60/1571422
gttttaaa

SEQ ID NO: 52504 - DNA, 8 bp, Unknown
  misc_feature (1)..( 8): Matrix.002 file - promoters60/1572151
attattaa

SEQ ID NO: 52505 - DNA, 11 bp, Unknown
  misc_feature (1)..( 11): Matrix.002 file - promoters60/1572151
taattttaaag

SEQ ID NO: 52506 - DNA, 12 bp, Unknown
  misc_feature (1)..( 12): Matrix.002 file - promoters60/1572151
catctatatata

SEQ ID NO: 52507 - DNA, 9 bp, Unknown
  misc_feature (1)..( 9): Matrix.002 file - promoters60/1572151
taatcaaat

SEQ ID NO: 52508 - DNA, 11 bp, Unknown
  misc_feature (1)..( 11): Matrix.002 file - promoters60/1572151
aaaaacattaa

SEQ ID NO: 52509 - DNA, 9 bp, Unknown
  misc_feature (1)..( 9): Matrix.002 file - promoters60/1572151
attactttt

SEQ ID NO: 52510 - DNA, 9 bp, Unknown
  misc_feature (1)..( 9): Matrix.002 file - promoters60/1572151
attttggtc

SEQ ID NO: 52511 - DNA, 8 bp, Unknown
  misc_feature (1)..( 8): Matrix.002 file - promoters60/1572151
tatttcaa

SEQ ID NO: 52512 - DNA, 8 bp, Unknown
  misc_feature (1)..( 8): Matrix.002 file - promoters60/1572151
ttcaaata

SEQ ID NO: 52513 - DNA, 8 bp, Unknown
  misc_feature (1)..( 8): Matrix.002 file - promoters60/1572151
ataaaaga

SEQ ID NO: 52514 - DNA, 8 bp, Unknown
  misc_feature (1)..( 8): Matrix.002 file - promoters60/1572151
ttagtttg

SEQ ID NO: 52515 - DNA, 8 bp, Unknown
  misc_feature (1)..( 8): Matrix.002 file - promoters60/1572151
atttcaaa

SEQ ID NO: 52516 - DNA, 8 bp, Unknown
  misc_feature (1)..( 8): Matrix.002 file - promoters60/1572151
tgtaaccc

SEQ ID NO: 52517 - DNA, 8 bp, Unknown
  misc_feature (1)..( 8): Matrix.002 file - promoters60/1572404
gttaagct

SEQ ID NO: 52518 - DNA, 8 bp, Unknown
  misc_feature (1)..( 8): Matrix.002 file - promoters60/1572404
gaaaaaaa

SEQ ID NO: 52519 - DNA, 7 bp, Unknown
  misc_feature (1)..( 7): Matrix.002 file - promoters60/1572404
gtcaaaa

SEQ ID NO: 52520 - DNA, 7 bp, Unknown
  misc_feature (1)..( 7): Matrix.002 file - promoters60/1572404
agaaaat

SEQ ID NO: 52521 - DNA, 8 bp, Unknown
  misc_feature (1)..( 8): Matrix.002 file - promoters60/1572404
aattgttt

SEQ ID NO: 52522 - DNA, 8 bp, Unknown
  misc_feature (1)..( 8): Matrix.002 file - promoters60/1572404
ttttttta

SEQ ID NO: 52523 - DNA, 6 bp, Unknown
  misc_feature (1)..( 6): Matrix.002 file - promoters60/1572404
attata

SEQ ID NO: 52524 - DNA, 7 bp, Unknown
  misc_feature (1)..( 7): Matrix.002 file - promoters60/1572404
aaacatc

SEQ ID NO: 52525 - DNA, 8 bp, Unknown
  misc_feature (1)..( 8): Matrix.002 file - promoters60/1572404
tagacctc

SEQ ID NO: 52526 - DNA, 6 bp, Unknown
  misc_feature (1)..( 6): Matrix.002 file - promoters60/1572404
acttat

SEQ ID NO: 52527 - DNA, 9 bp, Unknown
  misc_feature (1)..( 9): Matrix.002 file - promoters60/1572796
tccagaagg

SEQ ID NO: 52528 - DNA, 6 bp, Unknown
  misc_feature (1)..( 6): Matrix.002 file - promoters60/1572796
agtaca

SEQ ID NO: 52529 - DNA, 6 bp, Unknown
  misc_feature (1)..( 6): Matrix.002 file - promoters60/1572796
agctca

SEQ ID NO: 52530 - DNA, 8 bp, Unknown
  misc_feature (1)..( 8): Matrix.002 file - promoters60/1572796
aacacaaa

SEQ ID NO: 52531 - DNA, 8 bp, Unknown
  misc_feature (1)..( 8): Matrix.002 file - promoters60/1572796
acaaaacg

SEQ ID NO: 52532 - DNA, 6 bp, Unknown
  misc_feature (1)..( 6): Matrix.002 file - promoters60/1572796
gtagag

SEQ ID NO: 52533 - DNA, 6 bp, Unknown
  misc_feature (1)..( 6): Matrix.002 file - promoters60/1572796
aacctg

SEQ ID NO: 52534 - DNA, 7 bp, Unknown
  misc_feature (1)..( 7): Matrix.002 file - promoters60/1572796
aatttca

SEQ ID NO: 52535 - DNA, 8 bp, Unknown
  misc_feature (1)..( 8): Matrix.002 file - promoters60/1572796
ttaattaa

SEQ ID NO: 52536 - DNA, 6 bp, Unknown
  misc_feature (1)..( 6): Matrix.002 file - promoters60/1572796
attgta

SEQ ID NO: 52537 - DNA, 6 bp, Unknown
  misc_feature (1)..( 6): Matrix.002 file - promoters60/1572796
gtgaat

SEQ ID NO: 52538 - DNA, 7 bp, Unknown
  misc_feature (1)..( 7): Matrix.002 file - promoters60/1572796
tacagta

SEQ ID NO: 52539 - DNA, 6 bp, Unknown
  misc_feature (1)..( 6): Matrix.002 file - promoters60/1572796
caatat

SEQ ID NO: 52540 - DNA, 8 bp, Unknown
  misc_feature (1)..( 8): Matrix.002 file - promoters60/1572796
aaaaaaat

SEQ ID NO: 52541 - DNA, 13 bp, Unknown
  misc_feature (1)..( 13): Matrix.002 file - promoters60/1573594
caacaatttacaa

SEQ ID NO: 52542 - DNA, 6 bp, Unknown
  misc_feature (1)..( 6): Matrix.002 file - promoters60/1573651
aatcgt

SEQ ID NO: 52543 - DNA, 9 bp, Unknown
  misc_feature (1)..( 9): Matrix.002 file - promoters60/1573651
taagattgg

SEQ ID NO: 52544 - DNA, 7 bp, Unknown
  misc_feature (1)..( 7): Matrix.002 file - promoters60/1573651
ataaaaa

SEQ ID NO: 52545 - DNA, 7 bp, Unknown
  misc_feature (1)..( 7): Matrix.002 file - promoters60/1573651
agaagct

SEQ ID NO: 52546 - DNA, 15 bp, Unknown
  misc_feature (1)..( 15): Matrix.002 file - promoters60/1573651
ttaatatatattact

SEQ ID NO: 52547 - DNA, 6 bp, Unknown
  misc_feature (1)..( 6): Matrix.002 file - promoters60/1573651
ttttaa

SEQ ID NO: 52548 - DNA, 7 bp, Unknown
  misc_feature (1)..( 7): Matrix.002 file - promoters60/1573651
actcaaa

SEQ ID NO: 52549 - DNA, 7 bp, Unknown
  misc_feature (1)..( 7): Matrix.002 file - promoters60/1573651
tttagtt

SEQ ID NO: 52550 - DNA, 9 bp, Unknown
  misc_feature (1)..( 9): Matrix.002 file - promoters60/1573651
agcccaata

SEQ ID NO: 52551 - DNA, 6 bp, Unknown
  misc_feature (1)..( 6): Matrix.002 file - promoters60/1573651
agccca

SEQ ID NO: 52552 - DNA, 8 bp, Unknown
  misc_feature (1)..( 8): Matrix.002 file - promoters60/1573651
tcatcatc

SEQ ID NO: 52553 - DNA, 8 bp, Unknown
  misc_feature (1)..( 8): Matrix.002 file - promoters60/1573651
aagtggta

SEQ ID NO: 52554 - DNA, 7 bp, Unknown
  misc_feature (1)..( 7): Matrix.002 file - promoters60/1573651
gctcatt

SEQ ID NO: 52555 - DNA, 7 bp, Unknown
  misc_feature (1)..( 7): Matrix.002 file - promoters60/1573713
aaatata

SEQ ID NO: 52556 - DNA, 10 bp, Unknown
  misc_feature (1)..( 10): Matrix.002 file - promoters60/1573713
ataaacgaca

SEQ ID NO: 52557 - DNA, 7 bp, Unknown
  misc_feature (1)..( 7): Matrix.002 file - promoters60/1573713
aatcgaa

SEQ ID NO: 52558 - DNA, 10 bp, Unknown
  misc_feature (1)..( 10): Matrix.002 file - promoters60/1573713
atttatttga

SEQ ID NO: 52559 - DNA, 6 bp, Unknown
  misc_feature (1)..( 6): Matrix.002 file - promoters60/1573713
atttgt

SEQ ID NO: 52560 - DNA, 6 bp, Unknown
  misc_feature (1)..( 6): Matrix.002 file - promoters60/1573713
gctctg

SEQ ID NO: 52561 - DNA, 6 bp, Unknown
  misc_feature (1)..( 6): Matrix.002 file - promoters60/1573713
taataa

SEQ ID NO: 52562 - DNA, 7 bp, Unknown
  misc_feature (1)..( 7): Matrix.002 file - promoters60/1573713
taagtta

SEQ ID NO: 52563 - DNA, 7 bp, Unknown
  misc_feature (1)..( 7): Matrix.002 file - promoters60/1573713
attaatt

SEQ ID NO: 52564 - DNA, 10 bp, Unknown
  misc_feature (1)..( 10): Matrix.002 file - promoters60/1573713
attagtaatt

SEQ ID NO: 52565 - DNA, 7 bp, Unknown
  misc_feature (1)..( 7): Matrix.002 file - promoters60/1573713
tgaaaaa

SEQ ID NO: 52566 - DNA, 6 bp, Unknown
  misc_feature (1)..( 6): Matrix.002 file - promoters60/1573713
tatcaa

SEQ ID NO: 52567 - DNA, 7 bp, Unknown
  misc_feature (1)..( 7): Matrix.002 file - promoters60/1573713
taatttt

SEQ ID NO: 52568 - DNA, 6 bp, Unknown
  misc_feature (1)..( 6): Matrix.002 file - promoters60/1573713
ttagaa

SEQ ID NO: 52569 - DNA, 6 bp, Unknown
  misc_feature (1)..( 6): Matrix.002 file - promoters60/1573713
atattt

SEQ ID NO: 52570 - DNA, 8 bp, Unknown
  misc_feature (1)..( 8): Matrix.002 file - promoters60/1573713
tagaagta

SEQ ID NO: 52571 - DNA, 6 bp, Unknown
  misc_feature (1)..( 6): Matrix.002 file - promoters60/1573713
taatct

SEQ ID NO: 52572 - DNA, 10 bp, Unknown
  misc_feature (1)..( 10): Matrix.002 file - promoters60/1573713
gaaatatata

SEQ ID NO: 52573 - DNA, 6 bp, Unknown
  misc_feature (1)..( 6): Matrix.002 file - promoters60/1573713
aaacat

SEQ ID NO: 52574 - DNA, 7 bp, Unknown
  misc_feature (1)..( 7): Matrix.002 file - promoters60/1573713
ataattt

SEQ ID NO: 52575 - DNA, 10 bp, Unknown
  misc_feature (1)..( 10): Matrix.002 file - promoters60/1573713
agatatattt

SEQ ID NO: 52576 - DNA, 8 bp, Unknown
  misc_feature (1)..( 8): Matrix.002 file - promoters60/1573941
ctggcaat

SEQ ID NO: 52577 - DNA, 8 bp, Unknown
  misc_feature (1)..( 8): Matrix.002 file - promoters60/1573941
aaaaatag

SEQ ID NO: 52578 - DNA, 6 bp, Unknown
  misc_feature (1)..( 6): Matrix.002 file - promoters60/1573941
aaaaag

SEQ ID NO: 52579 - DNA, 6 bp, Unknown
  misc_feature (1)..( 6): Matrix.002 file - promoters60/1573941
tgcatt

SEQ ID NO: 52580 - DNA, 7 bp, Unknown
  misc_feature (1)..( 7): Matrix.002 file - promoters60/1573941
agcgttg

SEQ ID NO: 52581 - DNA, 6 bp, Unknown
  misc_feature (1)..( 6): Matrix.002 file - promoters60/1573941
gaggat

SEQ ID NO: 52582 - DNA, 8 bp, Unknown
  misc_feature (1)..( 8): Matrix.002 file - promoters60/1573941
aaaactgc

SEQ ID NO: 52583 - DNA, 6 bp, Unknown
  misc_feature (1)..( 6): Matrix.002 file - promoters60/1573941
aaacca

SEQ ID NO: 52584 - DNA, 7 bp, Unknown
  misc_feature (1)..( 7): Matrix.002 file - promoters60/1573945
cagaaga

SEQ ID NO: 52585 - DNA, 7 bp, Unknown
  misc_feature (1)..( 7): Matrix.002 file - promoters60/1573945
aatctct

SEQ ID NO: 52586 - DNA, 10 bp, Unknown
  misc_feature (1)..( 10): Matrix.002 file - promoters60/1573945
aaagatttct

SEQ ID NO: 52587 - DNA, 6 bp, Unknown
  misc_feature (1)..( 6): Matrix.002 file - promoters60/1573945
actttg

SEQ ID NO: 52588 - DNA, 6 bp, Unknown
  misc_feature (1)..( 6): Matrix.002 file - promoters60/1573945
tttatt

SEQ ID NO: 52589 - DNA, 8 bp, Unknown
  misc_feature (1)..( 8): Matrix.002 file - promoters60/1573945
tattgtaa

SEQ ID NO: 52590 - DNA, 10 bp, Unknown
  misc_feature (1)..( 10): Matrix.002 file - promoters60/1573945
tttaaaattt

SEQ ID NO: 52591 - DNA, 6 bp, Unknown
  misc_feature (1)..( 6): Matrix.002 file - promoters60/1573945
gtatca

SEQ ID NO: 52592 - DNA, 6 bp, Unknown
  misc_feature (1)..( 6): Matrix.002 file - promoters60/1573945
tgagag

SEQ ID NO: 52593 - DNA, 6 bp, Unknown
  misc_feature (1)..( 6): Matrix.002 file - promoters60/1573945
tttatt

SEQ ID NO: 52594 - DNA, 7 bp, Unknown
  misc_feature (1)..( 7): Matrix.002 file - promoters60/1573945
cgacgag

SEQ ID NO: 52595 - DNA, 6 bp, Unknown
  misc_feature (1)..( 6): Matrix.002 file - promoters60/1573945
tctagg

SEQ ID NO: 52596 - DNA, 7 bp, Unknown
  misc_feature (1)..( 7): Matrix.002 file - promoters60/1573945
aaaatta

SEQ ID NO: 52597 - DNA, 7 bp, Unknown
  misc_feature (1)..( 7): Matrix.002 file - promoters60/1573945
taaaccg

SEQ ID NO: 52598 - DNA, 7 bp, Unknown
  misc_feature (1)..( 7): Matrix.002 file - promoters60/1574029
ttaccct

SEQ ID NO: 52599 - DNA, 6 bp, Unknown
  misc_feature (1)..( 6): Matrix.002 file - promoters60/1574029
taaccg

SEQ ID NO: 52600 - DNA, 6 bp, Unknown
  misc_feature (1)..( 6): Matrix.002 file - promoters60/1574029
gttaaa

SEQ ID NO: 52601 - DNA, 7 bp, Unknown
  misc_feature (1)..( 7): Matrix.002 file - promoters60/1574029
caaagtc

SEQ ID NO: 52602 - DNA, 8 bp, Unknown
  misc_feature (1)..( 8): Matrix.002 file - promoters60/1574029
atatcttc

SEQ ID NO: 52603 - DNA, 6 bp, Unknown
  misc_feature (1)..( 6): Matrix.002 file - promoters60/1574029
gagata

SEQ ID NO: 52604 - DNA, 7 bp, Unknown
  misc_feature (1)..( 7): Matrix.002 file - promoters60/1574029
atgtgga

SEQ ID NO: 52605 - DNA, 7 bp, Unknown
  misc_feature (1)..( 7): Matrix.002 file - promoters60/1574029
agcaaat

SEQ ID NO: 52606 - DNA, 6 bp, Unknown
  misc_feature (1)..( 6): Matrix.002 file - promoters60/1574029
aatgct

SEQ ID NO: 52607 - DNA, 7 bp, Unknown
  misc_feature (1)..( 7): Matrix.002 file - promoters60/1574029
caatcta

SEQ ID NO: 52608 - DNA, 8 bp, Unknown
  misc_feature (1)..( 8): Matrix.002 file - promoters60/1574029
atttcaaa

SEQ ID NO: 52609 - DNA, 8 bp, Unknown
  misc_feature (1)..( 8): Matrix.002 file - promoters60/1574029
tttgcgaa

SEQ ID NO: 52610 - DNA, 10 bp, Unknown
  misc_feature (1)..( 10): Matrix.002 file - promoters60/1574029
ttcaagaaga

SEQ ID NO: 52611 - DNA, 6 bp, Unknown
  misc_feature (1)..( 6): Matrix.002 file - promoters60/1574029
cgttga

SEQ ID NO: 52612 - DNA, 9 bp, Unknown
  misc_feature (1)..( 9): Matrix.002 file - promoters60/1574029
aataaagat

SEQ ID NO: 52613 - DNA, 6 bp, Unknown
  misc_feature (1)..( 6): Matrix.002 file - promoters60/1574059
caagga

SEQ ID NO: 52614 - DNA, 6 bp, Unknown
  misc_feature (1)..( 6): Matrix.002 file - promoters60/1574059
gtttca

SEQ ID NO: 52615 - DNA, 7 bp, Unknown
  misc_feature (1)..( 7): Matrix.002 file - promoters60/1574059
ttcatca

SEQ ID NO: 52616 - DNA, 6 bp, Unknown
  misc_feature (1)..( 6): Matrix.002 file - promoters60/1574059
gtgtta

SEQ ID NO: 52617 - DNA, 8 bp, Unknown
  misc_feature (1)..( 8): Matrix.002 file - promoters60/1574059
ttgtaatc

SEQ ID NO: 52618 - DNA, 8 bp, Unknown
  misc_feature (1)..( 8): Matrix.002 file - promoters60/1574059
atgaagaa

SEQ ID NO: 52619 - DNA, 6 bp, Unknown
  misc_feature (1)..( 6): Matrix.002 file - promoters60/1574059
ttatgt

SEQ ID NO: 52620 - DNA, 8 bp, Unknown
  misc_feature (1)..( 8): Matrix.002 file - promoters60/1574059
tttagttt

SEQ ID NO: 52621 - DNA, 7 bp, Unknown
  misc_feature (1)..( 7): Matrix.002 file - promoters60/1574059
gtaaaac

SEQ ID NO: 52622 - DNA, 8 bp, Unknown
  misc_feature (1)..( 8): Matrix.002 file - promoters60/1574059
agacgaac

SEQ ID NO: 52623 - DNA, 6 bp, Unknown
  misc_feature (1)..( 6): Matrix.002 file - promoters60/1574059
gaagaa

SEQ ID NO: 52624 - DNA, 6 bp, Unknown
  misc_feature (1)..( 6): Matrix.002 file - promoters60/1574059
tggaga

SEQ ID NO: 52625 - DNA, 8 bp, Unknown
  misc_feature (1)..( 8): Matrix.002 file - promoters60/1574059
aatgcttt

SEQ ID NO: 52626 - DNA, 7 bp, Unknown
  misc_feature (1)..( 7): Matrix.002 file - promoters60/1574059
atatttt

SEQ ID NO: 52627 - DNA, 7 bp, Unknown
  misc_feature (1)..( 7): Matrix.002 file - promoters60/1574059
aaataaa

SEQ ID NO: 52628 - DNA, 6 bp, Unknown
  misc_feature (1)..( 6): Matrix.002 file - promoters60/1574059
caaagg

SEQ ID NO: 52629 - DNA, 7 bp, Unknown
  misc_feature (1)..( 7): Matrix.002 file - promoters60/1580171
aatcgta

SEQ ID NO: 52630 - DNA, 7 bp, Unknown
  misc_feature (1)..( 7): Matrix.002 file - promoters60/1580171
agaaaaa

SEQ ID NO: 52631 - DNA, 7 bp, Unknown
  misc_feature (1)..( 7): Matrix.002 file - promoters60/1580171
attatct

SEQ ID NO: 52632 - DNA, 6 bp, Unknown
  misc_feature (1)..( 6): Matrix.002 file - promoters60/1580171
atgaaa

SEQ ID NO: 52633 - DNA, 8 bp, Unknown
  misc_feature (1)..( 8): Matrix.002 file - promoters60/1580171
attggtaa

SEQ ID NO: 52634 - DNA, 8 bp, Unknown
  misc_feature (1)..( 8): Matrix.002 file - promoters60/1580171
ttgaattt

SEQ ID NO: 52635 - DNA, 8 bp, Unknown
  misc_feature (1)..( 8): Matrix.002 file - promoters60/1580171
aactaaaa

SEQ ID NO: 52636 - DNA, 7 bp, Unknown
  misc_feature (1)..( 7): Matrix.002 file - promoters60/1580171
cttcttc

SEQ ID NO: 52637 - DNA, 7 bp, Unknown
  misc_feature (1)..( 7): Matrix.002 file - promoters60/1580171
taaaaaa

SEQ ID NO: 52638 - DNA, 7 bp, Unknown
  misc_feature (1)..( 7): Matrix.002 file - promoters60/1580171
aaaattc

SEQ ID NO: 52639 - DNA, 9 bp, Unknown
  misc_feature (1)..( 9): Matrix.002 file - promoters60/1580171
tttataaac

SEQ ID NO: 52640 - DNA, 6 bp, Unknown
  misc_feature (1)..( 6): Matrix.002 file - promoters60/1580171
atgcat

SEQ ID NO: 52641 - DNA, 8 bp, Unknown
  misc_feature (1)..( 8): Matrix.002 file - promoters60/1580171
aaaatctt

SEQ ID NO: 52642 - DNA, 7 bp, Unknown
  misc_feature (1)..( 7): Matrix.002 file - promoters60/1580171
aagatgt

SEQ ID NO: 52643 - DNA, 7 bp, Unknown
  misc_feature (1)..( 7): Matrix.002 file - promoters60/1580171
ttgaaga

SEQ ID NO: 52644 - DNA, 6 bp, Unknown
  misc_feature (1)..( 6): Matrix.002 file - promoters60/1580171
attttt

SEQ ID NO: 52645 - DNA, 7 bp, Unknown
  misc_feature (1)..( 7): Matrix.002 file - promoters60/1580171
taaattt

SEQ ID NO: 52646 - DNA, 6 bp, Unknown
  misc_feature (1)..( 6): Matrix.002 file - promoters60/1580171
atgatt

SEQ ID NO: 52647 - DNA, 7 bp, Unknown
  misc_feature (1)..( 7): Matrix.002 file - promoters60/1580171
tttataa

SEQ ID NO: 52648 - DNA, 7 bp, Unknown
  misc_feature (1)..( 7): Matrix.002 file - promoters60/1580171
aaattta

SEQ ID NO: 52649 - DNA, 6 bp, Unknown
  misc_feature (1)..( 6): Matrix.002 file - promoters60/1580171
aaataa

SEQ ID NO: 52650 - DNA, 8 bp, Unknown
  misc_feature (1)..( 8): Matrix.002 file - promoters60/1580171
aaaaaaaa

SEQ ID NO: 52651 - DNA, 8 bp, Unknown
  misc_feature (1)..( 8): Matrix.002 file - promoters60/1580171
attatttt

SEQ ID NO: 52652 - DNA, 9 bp, Unknown
  misc_feature (1)..( 9): Matrix.002 file - promoters60/1580171
ttaatattt

SEQ ID NO: 52653 - DNA, 9 bp, Unknown
  misc_feature (1)..( 9): Matrix.002 file - promoters60/1580500
aattttgac

SEQ ID NO: 52654 - DNA, 11 bp, Unknown
  misc_feature (1)..( 11): Matrix.002 file - promoters60/1580500
atgttaaacat

SEQ ID NO: 52655 - DNA, 4 bp, Unknown
  misc_feature (1)..( 4): Matrix.002 file - promoters60/1580500
tatt

SEQ ID NO: 52656 - DNA, 12 bp, Unknown
  misc_feature (1)..( 12): Matrix.002 file - promoters60/1580870
taattttaattt

SEQ ID NO: 52657 - DNA, 8 bp, Unknown
  misc_feature (1)..( 8): Matrix.002 file - promoters60/1580870
atttaaaa

SEQ ID NO: 52658 - DNA, 8 bp, Unknown
  misc_feature (1)..( 8): Matrix.002 file - promoters60/1580870
atatttgt

SEQ ID NO: 52659 - DNA, 8 bp, Unknown
  misc_feature (1)..( 8): Matrix.002 file - promoters60/1580870
tttctaaa

SEQ ID NO: 52660 - DNA, 7 bp, Unknown
  misc_feature (1)..( 7): Matrix.002 file - promoters60/1580870
atttaat

SEQ ID NO: 52661 - DNA, 9 bp, Unknown
  misc_feature (1)..( 9): Matrix.002 file - promoters60/1580870
tatatttaa

SEQ ID NO: 52662 - DNA, 7 bp, Unknown
  misc_feature (1)..( 7): Matrix.002 file - promoters60/1580870
tgtatat

SEQ ID NO: 52663 - DNA, 14 bp, Unknown
  misc_feature (1)..( 14): Matrix.002 file - promoters60/1580932
cacaaaactaaaaa

SEQ ID NO: 52664 - DNA, 11 bp, Unknown
  misc_feature (1)..( 11): Matrix.002 file - promoters60/1580932
atactaaattg

SEQ ID NO: 52665 - DNA, 8 bp, Unknown
  misc_feature (1)..( 8): Matrix.002 file - promoters60/1580932
aaaaatca

SEQ ID NO: 52666 - DNA, 7 bp, Unknown
  misc_feature (1)..( 7): Matrix.002 file - promoters60/1580983
aattttt

SEQ ID NO: 52667 - DNA, 6 bp, Unknown
  misc_feature (1)..( 6): Matrix.002 file - promoters60/1580983
tttact

SEQ ID NO: 52668 - DNA, 7 bp, Unknown
  misc_feature (1)..( 7): Matrix.002 file - promoters60/1580983
cctcaga

SEQ ID NO: 52669 - DNA, 8 bp, Unknown
  misc_feature (1)..( 8): Matrix.002 file - promoters60/1580983
aaaaaatc

SEQ ID NO: 52670 - DNA, 11 bp, Unknown
  misc_feature (1)..( 11): Matrix.002 file - promoters60/1580983
taaatgagatt

SEQ ID NO: 52671 - DNA, 7 bp, Unknown
  misc_feature (1)..( 7): Matrix.002 file - promoters60/1580983
gaaaggg

SEQ ID NO: 52672 - DNA, 7 bp, Unknown
  misc_feature (1)..( 7): Matrix.002 file - promoters60/1580983
atacaaa

SEQ ID NO: 52673 - DNA, 6 bp, Unknown
  misc_feature (1)..( 6): Matrix.002 file - promoters60/1580983
agagaa

SEQ ID NO: 52674 - DNA, 6 bp, Unknown
  misc_feature (1)..( 6): Matrix.002 file - promoters60/1580983
taaaat

SEQ ID NO: 52675 - DNA, 7 bp, Unknown
  misc_feature (1)..( 7): Matrix.002 file - promoters60/1580983
attaatt

SEQ ID NO: 52676 - DNA, 6 bp, Unknown
  misc_feature (1)..( 6): Matrix.002 file - promoters60/1580983
aaaatc

SEQ ID NO: 52677 - DNA, 10 bp, Unknown
  misc_feature (1)..( 10): Matrix.002 file - promoters60/1581038
atttttttca

SEQ ID NO: 52678 - DNA, 8 bp, Unknown
  misc_feature (1)..( 8): Matrix.002 file - promoters60/1581038
attttaca

SEQ ID NO: 52679 - DNA, 10 bp, Unknown
  misc_feature (1)..( 10): Matrix.002 file - promoters60/1581038
atttattttg

SEQ ID NO: 52680 - DNA, 10 bp, Unknown
  misc_feature (1)..( 10): Matrix.002 file - promoters60/1581038
tttttatttt

SEQ ID NO: 52681 - DNA, 8 bp, Unknown
  misc_feature (1)..( 8): Matrix.002 file - promoters60/1581038
catttttc

SEQ ID NO: 52682 - DNA, 10 bp, Unknown
  misc_feature (1)..( 10): Matrix.002 file - promoters60/1581038
aaatattaga

SEQ ID NO: 52683 - DNA, 8 bp, Unknown
  misc_feature (1)..( 8): Matrix.002 file - promoters60/1581038
tatatata

SEQ ID NO: 52684 - DNA, 7 bp, Unknown
  misc_feature (1)..( 7): Matrix.002 file - promoters60/1581038
tataaat

SEQ ID NO: 52685 - DNA, 8 bp, Unknown
  misc_feature (1)..( 8): Matrix.002 file - promoters60/1581038
aaatttta

SEQ ID NO: 52686 - DNA, 8 bp, Unknown
  misc_feature (1)..( 8): Matrix.002 file - promoters60/1581038
tatttttt

SEQ ID NO: 52687 - DNA, 7 bp, Unknown
  misc_feature (1)..( 7): Matrix.002 file - promoters60/1581038
aaaaaat

SEQ ID NO: 52688 - DNA, 8 bp, Unknown
  misc_feature (1)..( 8): Matrix.002 file - promoters60/1581038
tctctctt

SEQ ID NO: 52689 - DNA, 7 bp, Unknown
  misc_feature (1)..( 7): Matrix.002 file - promoters60/1581038
ctctctt

SEQ ID NO: 52690 - DNA, 8 bp, Unknown
  misc_feature (1)..( 8): Matrix.002 file - promoters60/1581038
caatattg

SEQ ID NO: 52691 - DNA, 10 bp, Unknown
  misc_feature (1)..( 10): Matrix.002 file - promoters60/1581038
aattttattt

SEQ ID NO: 52692 - DNA, 9 bp, Unknown
  misc_feature (1)..( 9): Matrix.002 file - promoters60/1581987
gtggctttg

SEQ ID NO: 52693 - DNA, 10 bp, Unknown
  misc_feature (1)..( 10): Matrix.002 file - promoters60/1581987
tttatgaata

SEQ ID NO: 52694 - DNA, 6 bp, Unknown
  misc_feature (1)..( 6): Matrix.002 file - promoters60/1582293
taacca

SEQ ID NO: 52695 - DNA, 11 bp, Unknown
  misc_feature (1)..( 11): Matrix.002 file - promoters60/1582293
atattacaata

SEQ ID NO: 52696 - DNA, 9 bp, Unknown
  misc_feature (1)..( 9): Matrix.002 file - promoters60/1582293
aataatgat

SEQ ID NO: 52697 - DNA, 7 bp, Unknown
  misc_feature (1)..( 7): Matrix.002 file - promoters60/1582293
ggtttaa

SEQ ID NO: 52698 - DNA, 7 bp, Unknown
  misc_feature (1)..( 7): Matrix.002 file - promoters60/1582293
tttcttt

SEQ ID NO: 52699 - DNA, 7 bp, Unknown
  misc_feature (1)..( 7): Matrix.002 file - promoters60/1582293
ccatttt

SEQ ID NO: 52700 - DNA, 6 bp, Unknown
  misc_feature (1)..( 6): Matrix.002 file - promoters60/1582293
acataa

SEQ ID NO: 52701 - DNA, 10 bp, Unknown
  misc_feature (1)..( 10): Matrix.002 file - promoters60/1582293
atataaatta

SEQ ID NO: 52702 - DNA, 7 bp, Unknown
  misc_feature (1)..( 7): Matrix.002 file - promoters60/1582293
atattat

SEQ ID NO: 52703 - DNA, 11 bp, Unknown
  misc_feature (1)..( 11): Matrix.002 file - promoters60/1582293
tagattttttt

SEQ ID NO: 52704 - DNA, 6 bp, Unknown
  misc_feature (1)..( 6): Matrix.002 file - promoters60/1582293
taaaaa

SEQ ID NO: 52705 - DNA, 6 bp, Unknown
  misc_feature (1)..( 6): Matrix.002 file - promoters60/1582293
aaaaca

SEQ ID NO: 52706 - DNA, 11 bp, Unknown
  misc_feature (1)..( 11): Matrix.002 file - promoters60/1582293
aaaaggcccaa

SEQ ID NO: 52707 - DNA, 6 bp, Unknown
  misc_feature (1)..( 6): Matrix.002 file - promoters60/1582293
atcaaa

SEQ ID NO: 52708 - DNA, 6 bp, Unknown
  misc_feature (1)..( 6): Matrix.002 file - promoters60/1582293
tacaac

SEQ ID NO: 52709 - DNA, 7 bp, Unknown
  misc_feature (1)..( 7): Matrix.002 file - promoters60/1582293
taacatc

SEQ ID NO: 52710 - DNA, 8 bp, Unknown
  misc_feature (1)..( 8): Matrix.002 file - promoters60/1582293
atagcaca

SEQ ID NO: 52711 - DNA, 8 bp, Unknown
  misc_feature (1)..( 8): Matrix.002 file - promoters60/1582293
atcaaata

SEQ ID NO: 52712 - DNA, 6 bp, Unknown
  misc_feature (1)..( 6): Matrix.002 file - promoters60/1582293
taaaaa

SEQ ID NO: 52713 - DNA, 7 bp, Unknown
  misc_feature (1)..( 7): Matrix.002 file - promoters60/1582293
aaaatat

SEQ ID NO: 52714 - DNA, 7 bp, Unknown
  misc_feature (1)..( 7): Matrix.002 file - promoters60/1582293
aaaaaag

SEQ ID NO: 52715 - DNA, 8 bp, Unknown
  misc_feature (1)..( 8): Matrix.002 file - promoters60/1582293
aaacatag

SEQ ID NO: 52716 - DNA, 9 bp, Unknown
  misc_feature (1)..( 9): Matrix.002 file - promoters60/1582322
tctatttat

SEQ ID NO: 52717 - DNA, 6 bp, Unknown
  misc_feature (1)..( 6): Matrix.002 file - promoters60/1582322
gcacaa

SEQ ID NO: 52718 - DNA, 7 bp, Unknown
  misc_feature (1)..( 7): Matrix.002 file - promoters60/1582322
tcagaat

SEQ ID NO: 52719 - DNA, 7 bp, Unknown
  misc_feature (1)..( 7): Matrix.002 file - promoters60/1582322
gaactta

SEQ ID NO: 52720 - DNA, 6 bp, Unknown
  misc_feature (1)..( 6): Matrix.002 file - promoters60/1582322
gttttg

SEQ ID NO: 52721 - DNA, 6 bp, Unknown
  misc_feature (1)..( 6): Matrix.002 file - promoters60/1582322
atctta

SEQ ID NO: 52722 - DNA, 7 bp, Unknown
  misc_feature (1)..( 7): Matrix.002 file - promoters60/1582322
aatcaaa

SEQ ID NO: 52723 - DNA, 7 bp, Unknown
  misc_feature (1)..( 7): Matrix.002 file - promoters60/1582322
ttccctt

SEQ ID NO: 52724 - DNA, 7 bp, Unknown
  misc_feature (1)..( 7): Matrix.002 file - promoters60/1582322
tttatta

SEQ ID NO: 52725 - DNA, 8 bp, Unknown
  misc_feature (1)..( 8): Matrix.002 file - promoters60/1582322
tttatcta

SEQ ID NO: 52726 - DNA, 6 bp, Unknown
  misc_feature (1)..( 6): Matrix.002 file - promoters60/1582322
attttt

SEQ ID NO: 52727 - DNA, 8 bp, Unknown
  misc_feature (1)..( 8): Matrix.002 file - promoters60/1582322
aaagattt

SEQ ID NO: 52728 - DNA, 8 bp, Unknown
  misc_feature (1)..( 8): Matrix.002 file - promoters60/1582322
ggtatttg

SEQ ID NO: 52729 - DNA, 6 bp, Unknown
  misc_feature (1)..( 6): Matrix.002 file - promoters60/1582322
atgaat

SEQ ID NO: 52730 - DNA, 7 bp, Unknown
  misc_feature (1)..( 7): Matrix.002 file - promoters60/1582322
ttacaat

SEQ ID NO: 52731 - DNA, 8 bp, Unknown
  misc_feature (1)..( 8): Matrix.002 file - promoters60/1582322
aattataa

SEQ ID NO: 52732 - DNA, 14 bp, Unknown
  misc_feature (1)..( 14): Matrix.002 file - promoters60/1582322
aatttctcccaaaa

SEQ ID NO: 52733 - DNA, 8 bp, Unknown
  misc_feature (1)..( 8): Matrix.002 file - promoters60/1582322
aatcaata

SEQ ID NO: 52734 - DNA, 6 bp, Unknown
  misc_feature (1)..( 6): Matrix.002 file - promoters60/1582322
ttttct

SEQ ID NO: 52735 - DNA, 8 bp, Unknown
  misc_feature (1)..( 8): Matrix.002 file - promoters60/1582322
gaagaaat

SEQ ID NO: 52736 - DNA, 7 bp, Unknown
  misc_feature (1)..( 7): Matrix.002 file - promoters60/1582322
aagcttc

SEQ ID NO: 52737 - DNA, 7 bp, Unknown
  misc_feature (1)..( 7): Matrix.002 file - promoters60/1582576
tatttag

SEQ ID NO: 52738 - DNA, 11 bp, Unknown
  misc_feature (1)..( 11): Matrix.002 file - promoters60/1582576
aaaaaatatat

SEQ ID NO: 52739 - DNA, 8 bp, Unknown
  misc_feature (1)..( 8): Matrix.002 file - promoters60/1582576
taaaataa

SEQ ID NO: 52740 - DNA, 8 bp, Unknown
  misc_feature (1)..( 8): Matrix.002 file - promoters60/1582576
taattaat

SEQ ID NO: 52741 - DNA, 7 bp, Unknown
  misc_feature (1)..( 7): Matrix.002 file - promoters60/1582576
aaataat

SEQ ID NO: 52742 - DNA, 7 bp, Unknown
  misc_feature (1)..( 7): Matrix.002 file - promoters60/1582576
aataaaa

SEQ ID NO: 52743 - DNA, 7 bp, Unknown
  misc_feature (1)..( 7): Matrix.002 file - promoters60/1582576
ctaaaat

SEQ ID NO: 52744 - DNA, 7 bp, Unknown
  misc_feature (1)..( 7): Matrix.002 file - promoters60/1582576
aaaagac

SEQ ID NO: 52745 - DNA, 8 bp, Unknown
  misc_feature (1)..( 8): Matrix.002 file - promoters60/1582576
aaaataaa

SEQ ID NO: 52746 - DNA, 7 bp, Unknown
  misc_feature (1)..( 7): Matrix.002 file - promoters60/1582658
tttcttt

SEQ ID NO: 52747 - DNA, 7 bp, Unknown
  misc_feature (1)..( 7): Matrix.002 file - promoters60/1582658
ttttaat

SEQ ID NO: 52748 - DNA, 9 bp, Unknown
  misc_feature (1)..( 9): Matrix.002 file - promoters60/1582658
attttttag

SEQ ID NO: 52749 - DNA, 7 bp, Unknown
  misc_feature (1)..( 7): Matrix.002 file - promoters60/1582658
gaagttt

SEQ ID NO: 52750 - DNA, 8 bp, Unknown
  misc_feature (1)..( 8): Matrix.002 file - promoters60/1582658
aaatgttt

SEQ ID NO: 52751 - DNA, 7 bp, Unknown
  misc_feature (1)..( 7): Matrix.002 file - promoters60/1582658
atcattt

SEQ ID NO: 52752 - DNA, 8 bp, Unknown
  misc_feature (1)..( 8): Matrix.002 file - promoters60/1582658
atttcatc

SEQ ID NO: 52753 - DNA, 9 bp, Unknown
  misc_feature (1)..( 9): Matrix.002 file - promoters60/1583044
attcataat

SEQ ID NO: 52754 - DNA, 7 bp, Unknown
  misc_feature (1)..( 7): Matrix.002 file - promoters60/1595585
tagctct

SEQ ID NO: 52755 - DNA, 8 bp, Unknown
  misc_feature (1)..( 8): Matrix.002 file - promoters60/1595585
ttcttaac

SEQ ID NO: 52756 - DNA, 6 bp, Unknown
  misc_feature (1)..( 6): Matrix.002 file - promoters60/1595585
aatgaa

SEQ ID NO: 52757 - DNA, 6 bp, Unknown
  misc_feature (1)..( 6): Matrix.002 file - promoters60/1595585
aaactc

SEQ ID NO: 52758 - DNA, 6 bp, Unknown
  misc_feature (1)..( 6): Matrix.002 file - promoters60/1595585
aaaata

SEQ ID NO: 52759 - DNA, 7 bp, Unknown
  misc_feature (1)..( 7): Matrix.002 file - promoters60/1595585
ctaaatt

SEQ ID NO: 52760 - DNA, 7 bp, Unknown
  misc_feature (1)..( 7): Matrix.002 file - promoters60/1595585
aaaaaat

SEQ ID NO: 52761 - DNA, 6 bp, Unknown
  misc_feature (1)..( 6): Matrix.002 file - promoters60/1595585
gacccg

SEQ ID NO: 52762 - DNA, 9 bp, Unknown
  misc_feature (1)..( 9): Matrix.002 file - promoters60/1595585
attatatcc

SEQ ID NO: 52763 - DNA, 7 bp, Unknown
  misc_feature (1)..( 7): Matrix.002 file - promoters60/1595585
ctgatct

SEQ ID NO: 52764 - DNA, 6 bp, Unknown
  misc_feature (1)..( 6): Matrix.002 file - promoters60/1595585
accact

SEQ ID NO: 52765 - DNA, 10 bp, Unknown
  misc_feature (1)..( 10): Matrix.002 file - promoters60/1595585
cactcggttt

SEQ ID NO: 52766 - DNA, 7 bp, Unknown
  misc_feature (1)..( 7): Matrix.002 file - promoters60/1595585
ttttcat

SEQ ID NO: 52767 - DNA, 8 bp, Unknown
  misc_feature (1)..( 8): Matrix.002 file - promoters60/1595651
aaagaaat

SEQ ID NO: 52768 - DNA, 9 bp, Unknown
  misc_feature (1)..( 9): Matrix.002 file - promoters60/1595651
aatatccat

SEQ ID NO: 52769 - DNA, 7 bp, Unknown
  misc_feature (1)..( 7): Matrix.002 file - promoters60/1595651
taacttg

SEQ ID NO: 52770 - DNA, 7 bp, Unknown
  misc_feature (1)..( 7): Matrix.002 file - promoters60/1595651
tcaaatt

SEQ ID NO: 52771 - DNA, 8 bp, Unknown
  misc_feature (1)..( 8): Matrix.002 file - promoters60/1595651
aacaaaaa

SEQ ID NO: 52772 - DNA, 6 bp, Unknown
  misc_feature (1)..( 6): Matrix.002 file - promoters60/1595651
acattt

SEQ ID NO: 52773 - DNA, 10 bp, Unknown
  misc_feature (1)..( 10): Matrix.002 file - promoters60/1595651
aagaaaacaa

SEQ ID NO: 52774 - DNA, 6 bp, Unknown
  misc_feature (1)..( 6): Matrix.002 file - promoters60/1595651
caaaaa

SEQ ID NO: 52775 - DNA, 10 bp, Unknown
  misc_feature (1)..( 10): Matrix.002 file - promoters60/1595651
ctaaacgggc

SEQ ID NO: 52776 - DNA, 7 bp, Unknown
  misc_feature (1)..( 7): Matrix.002 file - promoters60/1595651
gtcatat

SEQ ID NO: 52777 - DNA, 7 bp, Unknown
  misc_feature (1)..( 7): Matrix.002 file - promoters60/1595651
tccattg

SEQ ID NO: 52778 - DNA, 7 bp, Unknown
  misc_feature (1)..( 7): Matrix.002 file - promoters60/1595651
taactaa

SEQ ID NO: 52779 - DNA, 6 bp, Unknown
  misc_feature (1)..( 6): Matrix.002 file - promoters60/1595651
ttcaga

SEQ ID NO: 52780 - DNA, 6 bp, Unknown
  misc_feature (1)..( 6): Matrix.002 file - promoters60/1595651
aaatgt

SEQ ID NO: 52781 - DNA, 7 bp, Unknown
  misc_feature (1)..( 7): Matrix.002 file - promoters60/1595651
ttttaaa

SEQ ID NO: 52782 - DNA, 9 bp, Unknown
  misc_feature (1)..( 9): Matrix.002 file - promoters60/1595651
attcattgt

SEQ ID NO: 52783 - DNA, 7 bp, Unknown
  misc_feature (1)..( 7): Matrix.002 file - promoters60/1595651
ttgagac

SEQ ID NO: 52784 - DNA, 9 bp, Unknown
  misc_feature (1)..( 9): Matrix.002 file - promoters60/1595707
attttattc

SEQ ID NO: 52785 - DNA, 10 bp, Unknown
  misc_feature (1)..( 10): Matrix.002 file - promoters60/1595707
gactggccct

SEQ ID NO: 52786 - DNA, 10 bp, Unknown
  misc_feature (1)..( 10): Matrix.002 file - promoters60/1595707
acttgttaat

SEQ ID NO: 52787 - DNA, 11 bp, Unknown
  misc_feature (1)..( 11): Matrix.002 file - promoters60/1595707
aatacaaatca

SEQ ID NO: 52788 - DNA, 12 bp, Unknown
  misc_feature (1)..( 12): Matrix.002 file - promoters60/1595741
aatttcaataag

SEQ ID NO: 52789 - DNA, 9 bp, Unknown
  misc_feature (1)..( 9): Matrix.002 file - promoters60/1595752
atcagaatc

SEQ ID NO: 52790 - DNA, 10 bp, Unknown
  misc_feature (1)..( 10): Matrix.002 file - promoters60/1595752
aaaatttctt

SEQ ID NO: 52791 - DNA, 9 bp, Unknown
  misc_feature (1)..( 9): Matrix.002 file - promoters60/1595752
ccaaacaat

SEQ ID NO: 52792 - DNA, 7 bp, Unknown
  misc_feature (1)..( 7): Matrix.002 file - promoters60/1595752
agaacaa

SEQ ID NO: 52793 - DNA, 7 bp, Unknown
  misc_feature (1)..( 7): Matrix.002 file - promoters60/1595752
aaccacc

SEQ ID NO: 52794 - DNA, 6 bp, Unknown
  misc_feature (1)..( 6): Matrix.002 file - promoters60/1595752
ataacc

SEQ ID NO: 52795 - DNA, 7 bp, Unknown
  misc_feature (1)..( 7): Matrix.002 file - promoters60/1595752
acctaat

SEQ ID NO: 52796 - DNA, 8 bp, Unknown
  misc_feature (1)..( 8): Matrix.002 file - promoters60/1595752
tatatata

SEQ ID NO: 52797 - DNA, 7 bp, Unknown
  misc_feature (1)..( 7): Matrix.002 file - promoters60/1595752
aaaatca

SEQ ID NO: 52798 - DNA, 8 bp, Unknown
  misc_feature (1)..( 8): Matrix.002 file - promoters60/1595752
attcacat

SEQ ID NO: 52799 - DNA, 5 bp, Unknown
  misc_feature (1)..( 5): Matrix.002 file - promoters60/1595752
atatt

SEQ ID NO: 52800 - DNA, 7 bp, Unknown
  misc_feature (1)..( 7): Matrix.002 file - promoters60/1595752
tcaaaaa

SEQ ID NO: 52801 - DNA, 6 bp, Unknown
  misc_feature (1)..( 6): Matrix.002 file - promoters60/1595752
attgct

SEQ ID NO: 52802 - DNA, 8 bp, Unknown
  misc_feature (1)..( 8): Matrix.002 file - promoters60/1595752
aaatctaa

SEQ ID NO: 52803 - DNA, 7 bp, Unknown
  misc_feature (1)..( 7): Matrix.002 file - promoters60/1595752
atggtca

SEQ ID NO: 52804 - DNA, 8 bp, Unknown
  misc_feature (1)..( 8): Matrix.002 file - promoters60/1595752
agaacaat

SEQ ID NO: 52805 - DNA, 6 bp, Unknown
  misc_feature (1)..( 6): Matrix.002 file - promoters60/1595752
tgcatt

SEQ ID NO: 52806 - DNA, 6 bp, Unknown
  misc_feature (1)..( 6): Matrix.002 file - promoters60/1595752
tttatt

SEQ ID NO: 52807 - DNA, 7 bp, Unknown
  misc_feature (1)..( 7): Matrix.002 file - promoters60/1595752
attcaaa

SEQ ID NO: 52808 - DNA, 6 bp, Unknown
  misc_feature (1)..( 6): Matrix.002 file - promoters60/1595752
caatca

SEQ ID NO: 52809 - DNA, 8 bp, Unknown
  misc_feature (1)..( 8): Matrix.002 file - promoters60/1595752
ttgagttt

SEQ ID NO: 52810 - DNA, 9 bp, Unknown
  misc_feature (1)..( 9): Matrix.002 file - promoters60/1595752
accctccaa

SEQ ID NO: 52811 - DNA, 11 bp, Unknown
  misc_feature (1)..( 11): Matrix.002 file - promoters60/1595752
aaagttagatg

SEQ ID NO: 52812 - DNA, 7 bp, Unknown
  misc_feature (1)..( 7): Matrix.002 file - promoters60/1595752
gacaaaa

SEQ ID NO: 52813 - DNA, 6 bp, Unknown
  misc_feature (1)..( 6): Matrix.002 file - promoters60/1595752
aacact

SEQ ID NO: 52814 - DNA, 11 bp, Unknown
  misc_feature (1)..( 11): Matrix.002 file - promoters60/1595772
attaatattta

SEQ ID NO: 52815 - DNA, 8 bp, Unknown
  misc_feature (1)..( 8): Matrix.002 file - promoters60/1595772
aaaatata

SEQ ID NO: 52816 - DNA, 12 bp, Unknown
  misc_feature (1)..( 12): Matrix.002 file - promoters60/1595772
aaataaaaaaaa

SEQ ID NO: 52817 - DNA, 8 bp, Unknown
  misc_feature (1)..( 8): Matrix.002 file - promoters60/1595772
tttttatt

SEQ ID NO: 52818 - DNA, 10 bp, Unknown
  misc_feature (1)..( 10): Matrix.002 file - promoters60/1595772
atatttaaaa

SEQ ID NO: 52819 - DNA, 11 bp, Unknown
  misc_feature (1)..( 11): Matrix.002 file - promoters60/1595772
gtttaaaaaat

SEQ ID NO: 52820 - DNA, 9 bp, Unknown
  misc_feature (1)..( 9): Matrix.002 file - promoters60/1595772
ataatttca

SEQ ID NO: 52821 - DNA, 9 bp, Unknown
  misc_feature (1)..( 9): Matrix.002 file - promoters60/1595772
aataaaaaa

SEQ ID NO: 52822 - DNA, 9 bp, Unknown
  misc_feature (1)..( 9): Matrix.002 file - promoters60/1595772
ctaaaaatg

SEQ ID NO: 52823 - DNA, 11 bp, Unknown
  misc_feature (1)..( 11): Matrix.002 file - promoters60/1595772
atttaaaaaaa

SEQ ID NO: 52824 - DNA, 10 bp, Unknown
  misc_feature (1)..( 10): Matrix.002 file - promoters60/1595772
aaaaacaaaa

SEQ ID NO: 52825 - DNA, 10 bp, Unknown
  misc_feature (1)..( 10): Matrix.002 file - promoters60/1595772
aaaacaaaaa

SEQ ID NO: 52826 - DNA, 11 bp, Unknown
  misc_feature (1)..( 11): Matrix.002 file - promoters60/1595772
ataaattcata

SEQ ID NO: 52827 - DNA, 10 bp, Unknown
  misc_feature (1)..( 10): Matrix.002 file - promoters60/1595772
aataaactaa

SEQ ID NO: 52828 - DNA, 7 bp, Unknown
  misc_feature (1)..( 7): Matrix.002 file - promoters60/1595772
aaaacaa

SEQ ID NO: 52829 - DNA, 6 bp, Unknown
  misc_feature (1)..( 6): Matrix.002 file - promoters60/1595772
atataa

SEQ ID NO: 52830 - DNA, 7 bp, Unknown
  misc_feature (1)..( 7): Matrix.002 file - promoters60/1595829
tatttta

SEQ ID NO: 52831 - DNA, 9 bp, Unknown
  misc_feature (1)..( 9): Matrix.002 file - promoters60/1595829
atataaatt

SEQ ID NO: 52832 - DNA, 9 bp, Unknown
  misc_feature (1)..( 9): Matrix.002 file - promoters60/1662827
tttatttgt

SEQ ID NO: 52833 - DNA, 11 bp, Unknown
  misc_feature (1)..( 11): Matrix.002 file - promoters60/1662827
tgactatttaa

SEQ ID NO: 52834 - DNA, 7 bp, Unknown
  misc_feature (1)..( 7): Matrix.002 file - promoters60/1662895
tgttggt

SEQ ID NO: 52835 - DNA, 6 bp, Unknown
  misc_feature (1)..( 6): Matrix.002 file - promoters60/1662895
tcatgt

SEQ ID NO: 52836 - DNA, 7 bp, Unknown
  misc_feature (1)..( 7): Matrix.002 file - promoters60/1662895
tttttca

SEQ ID NO: 52837 - DNA, 6 bp, Unknown
  misc_feature (1)..( 6): Matrix.002 file - promoters60/1662895
gttttt

SEQ ID NO: 52838 - DNA, 13 bp, Unknown
  misc_feature (1)..( 13): Matrix.002 file - promoters60/1662895
ctaaaaagtaatt

SEQ ID NO: 52839 - DNA, 6 bp, Unknown
  misc_feature (1)..( 6): Matrix.002 file - promoters60/1662895
agaaaa

SEQ ID NO: 52840 - DNA, 7 bp, Unknown
  misc_feature (1)..( 7): Matrix.002 file - promoters60/1662895
gttacat

SEQ ID NO: 52841 - DNA, 7 bp, Unknown
  misc_feature (1)..( 7): Matrix.002 file - promoters60/1662895
tttcaga

SEQ ID NO: 52842 - DNA, 6 bp, Unknown
  misc_feature (1)..( 6): Matrix.002 file - promoters60/1662895
gagaaa

SEQ ID NO: 52843 - DNA, 7 bp, Unknown
  misc_feature (1)..( 7): Matrix.002 file - promoters60/1662895
tatataa

SEQ ID NO: 52844 - DNA, 7 bp, Unknown
  misc_feature (1)..( 7): Matrix.002 file - promoters60/1662895
taagagg

SEQ ID NO: 52845 - DNA, 6 bp, Unknown
  misc_feature (1)..( 6): Matrix.002 file - promoters60/1662895
gagatt

SEQ ID NO: 52846 - DNA, 11 bp, Unknown
  misc_feature (1)..( 11): Matrix.002 file - promoters60/1662895
aattgaaattt

SEQ ID NO: 52847 - DNA, 14 bp, Unknown
  misc_feature (1)..( 14): Matrix.002 file - promoters60/1662917
tatatttgttaaac

SEQ ID NO: 52848 - DNA, 14 bp, Unknown
  misc_feature (1)..( 14): Matrix.002 file - promoters60/1662917
attagaatttttaa

SEQ ID NO: 52849 - DNA, 9 bp, Unknown
  misc_feature (1)..( 9): Matrix.002 file - promoters60/1662917
ttttgatga

SEQ ID NO: 52850 - DNA, 19 bp, Unknown
  misc_feature (1)..( 19): Matrix.002 file - promoters60/1662917
ttttaaattttaaaattat

SEQ ID NO: 52851 - DNA, 8 bp, Unknown
  misc_feature (1)..( 8): Matrix.002 file - promoters60/1662917
cattaaaa

SEQ ID NO: 52852 - DNA, 10 bp, Unknown
  misc_feature (1)..( 10): Matrix.002 file - promoters60/1662917
tatatataaa

SEQ ID NO: 52853 - DNA, 10 bp, Unknown
  misc_feature (1)..( 10): Matrix.002 file - promoters60/1662917
tataaataaa

SEQ ID NO: 52854 - DNA, 8 bp, Unknown
  misc_feature (1)..( 8): Matrix.002 file - promoters60/1662917
gaatatgt

SEQ ID NO: 52855 - DNA, 12 bp, Unknown
  misc_feature (1)..( 12): Matrix.002 file - promoters60/1662917
tttataagtata

SEQ ID NO: 52856 - DNA, 16 bp, Unknown
  misc_feature (1)..( 16): Matrix.002 file - promoters60/1662917
tgttaaataggaaaaa

SEQ ID NO: 52857 - DNA, 10 bp, Unknown
  misc_feature (1)..( 10): Matrix.002 file - promoters60/1662917
tgaatgtaaa

SEQ ID NO: 52858 - DNA, 14 bp, Unknown
  misc_feature (1)..( 14): Matrix.002 file - promoters60/1662917
ataactttataaaa

SEQ ID NO: 52859 - DNA, 6 bp, Unknown
  misc_feature (1)..( 6): Matrix.002 file - promoters60/1662917
aaatat

SEQ ID NO: 52860 - DNA, 12 bp, Unknown
  misc_feature (1)..( 12): Matrix.002 file - promoters60/1662917
tataatatatac

SEQ ID NO: 52861 - DNA, 9 bp, Unknown
  misc_feature (1)..( 9): Matrix.002 file - promoters60/1662917
taaaatatt

SEQ ID NO: 52862 - DNA, 7 bp, Unknown
  misc_feature (1)..( 7): Matrix.002 file - promoters60/1663024
tctctct

SEQ ID NO: 52863 - DNA, 9 bp, Unknown
  misc_feature (1)..( 9): Matrix.002 file - promoters60/1663024
gaaacccta

SEQ ID NO: 52864 - DNA, 6 bp, Unknown
  misc_feature (1)..( 6): Matrix.002 file - promoters60/1663024
atcgtc

SEQ ID NO: 52865 - DNA, 7 bp, Unknown
  misc_feature (1)..( 7): Matrix.002 file - promoters60/1663024
gctacca

SEQ ID NO: 52866 - DNA, 7 bp, Unknown
  misc_feature (1)..( 7): Matrix.002 file - promoters60/1663024
gttcatg

SEQ ID NO: 52867 - DNA, 7 bp, Unknown
  misc_feature (1)..( 7): Matrix.002 file - promoters60/1663024
aagcatg

SEQ ID NO: 52868 - DNA, 6 bp, Unknown
  misc_feature (1)..( 6): Matrix.002 file - promoters60/1663024
atgcgg

SEQ ID NO: 52869 - DNA, 7 bp, Unknown
  misc_feature (1)..( 7): Matrix.002 file - promoters60/1663024
ggtatca

SEQ ID NO: 52870 - DNA, 6 bp, Unknown
  misc_feature (1)..( 6): Matrix.002 file - promoters60/1663024
caagga

SEQ ID NO: 52871 - DNA, 6 bp, Unknown
  misc_feature (1)..( 6): Matrix.002 file - promoters60/1663024
gtttcc

SEQ ID NO: 52872 - DNA, 6 bp, Unknown
  misc_feature (1)..( 6): Matrix.002 file - promoters60/1663135
aacaaa

SEQ ID NO: 52873 - DNA, 8 bp, Unknown
  misc_feature (1)..( 8): Matrix.002 file - promoters60/1663135
acactttc

SEQ ID NO: 52874 - DNA, 7 bp, Unknown
  misc_feature (1)..( 7): Matrix.002 file - promoters60/1663135
tttttaa

SEQ ID NO: 52875 - DNA, 6 bp, Unknown
  misc_feature (1)..( 6): Matrix.002 file - promoters60/1663135
ttcttt

SEQ ID NO: 52876 - DNA, 9 bp, Unknown
  misc_feature (1)..( 9): Matrix.002 file - promoters60/1663135
aataaaatt

SEQ ID NO: 52877 - DNA, 6 bp, Unknown
  misc_feature (1)..( 6): Matrix.002 file - promoters60/1663135
taaata

SEQ ID NO: 52878 - DNA, 10 bp, Unknown
  misc_feature (1)..( 10): Matrix.002 file - promoters60/1663135
caaaacaaaa

SEQ ID NO: 52879 - DNA, 6 bp, Unknown
  misc_feature (1)..( 6): Matrix.002 file - promoters60/1663135
tgtttt

SEQ ID NO: 52880 - DNA, 7 bp, Unknown
  misc_feature (1)..( 7): Matrix.002 file - promoters60/1663135
aacatag

SEQ ID NO: 52881 - DNA, 6 bp, Unknown
  misc_feature (1)..( 6): Matrix.002 file - promoters60/1663135
ttgtaa

SEQ ID NO: 52882 - DNA, 6 bp, Unknown
  misc_feature (1)..( 6): Matrix.002 file - promoters60/1663135
tttgga

SEQ ID NO: 52883 - DNA, 8 bp, Unknown
  misc_feature (1)..( 8): Matrix.002 file - promoters60/1663135
aataaaat

SEQ ID NO: 52884 - DNA, 6 bp, Unknown
  misc_feature (1)..( 6): Matrix.002 file - promoters60/1663135
tctctc

SEQ ID NO: 52885 - DNA, 6 bp, Unknown
  misc_feature (1)..( 6): Matrix.002 file - promoters60/1663135
tcagat

SEQ ID NO: 52886 - DNA, 7 bp, Unknown
  misc_feature (1)..( 7): Matrix.002 file - promoters60/1663135
tttatgt

SEQ ID NO: 52887 - DNA, 7 bp, Unknown
  misc_feature (1)..( 7): Matrix.002 file - promoters60/1663135
tatgtat

SEQ ID NO: 52888 - DNA, 8 bp, Unknown
  misc_feature (1)..( 8): Matrix.002 file - promoters60/1663135
taaaaccg

SEQ ID NO: 52889 - DNA, 12 bp, Unknown
  misc_feature (1)..( 12): Matrix.002 file - promoters60/1663168
ttcttttcgtct

SEQ ID NO: 52890 - DNA, 8 bp, Unknown
  misc_feature (1)..( 8): Matrix.002 file - promoters60/1663217
atgatata

SEQ ID NO: 52891 - DNA, 7 bp, Unknown
  misc_feature (1)..( 7): Matrix.002 file - promoters60/1663217
tataaaa

SEQ ID NO: 52892 - DNA, 6 bp, Unknown
  misc_feature (1)..( 6): Matrix.002 file - promoters60/1663217
tatgat

SEQ ID NO: 52893 - DNA, 14 bp, Unknown
  misc_feature (1)..( 14): Matrix.002 file - promoters60/1663217
tgactttcgtcatt

SEQ ID NO: 52894 - DNA, 6 bp, Unknown
  misc_feature (1)..( 6): Matrix.002 file - promoters60/1663217
attgta

SEQ ID NO: 52895 - DNA, 7 bp, Unknown
  misc_feature (1)..( 7): Matrix.002 file - promoters60/1663217
aaagtga

SEQ ID NO: 52896 - DNA, 10 bp, Unknown
  misc_feature (1)..( 10): Matrix.002 file - promoters60/1663217
aaaccaatcc

SEQ ID NO: 52897 - DNA, 10 bp, Unknown
  misc_feature (1)..( 10): Matrix.002 file - promoters60/1663217
ataacaataa

SEQ ID NO: 52898 - DNA, 7 bp, Unknown
  misc_feature (1)..( 7): Matrix.002 file - promoters60/1663217
taaataa

SEQ ID NO: 52899 - DNA, 7 bp, Unknown
  misc_feature (1)..( 7): Matrix.002 file - promoters60/1663217
tagaaac

SEQ ID NO: 52900 - DNA, 6 bp, Unknown
  misc_feature (1)..( 6): Matrix.002 file - promoters60/1663217
ccaaat

SEQ ID NO: 52901 - DNA, 7 bp, Unknown
  misc_feature (1)..( 7): Matrix.002 file - promoters60/1663217
tcacaaa

SEQ ID NO: 52902 - DNA, 6 bp, Unknown
  misc_feature (1)..( 6): Matrix.002 file - promoters60/1663217
tcaaag

SEQ ID NO: 52903 - DNA, 7 bp, Unknown
  misc_feature (1)..( 7): Matrix.002 file - promoters60/1663217
acgtgcc

SEQ ID NO: 52904 - DNA, 6 bp, Unknown
  misc_feature (1)..( 6): Matrix.002 file - promoters60/1663217
tcttct

SEQ ID NO: 52905 - DNA, 12 bp, Unknown
  misc_feature (1)..( 12): Matrix.002 file - promoters60/1663278
tattgaaaaaga

SEQ ID NO: 52906 - DNA, 8 bp, Unknown
  misc_feature (1)..( 8): Matrix.002 file - promoters60/1663353
ttttgaaa

SEQ ID NO: 52907 - DNA, 8 bp, Unknown
  misc_feature (1)..( 8): Matrix.002 file - promoters60/1663353
catcgttt

SEQ ID NO: 52908 - DNA, 9 bp, Unknown
  misc_feature (1)..( 9): Matrix.002 file - promoters60/1663353
tctttcttc

SEQ ID NO: 52909 - DNA, 10 bp, Unknown
  misc_feature (1)..( 10): Matrix.002 file - promoters60/1663353
tatgttttga

SEQ ID NO: 52910 - DNA, 8 bp, Unknown
  misc_feature (1)..( 8): Matrix.002 file - promoters60/1664727
tattaaaa

SEQ ID NO: 52911 - DNA, 8 bp, Unknown
  misc_feature (1)..( 8): Matrix.002 file - promoters60/1664727
aaagttga

SEQ ID NO: 52912 - DNA, 8 bp, Unknown
  misc_feature (1)..( 8): Matrix.002 file - promoters60/1664727
aaagaaaa

SEQ ID NO: 52913 - DNA, 8 bp, Unknown
  misc_feature (1)..( 8): Matrix.002 file - promoters60/1664727
aaataaat

SEQ ID NO: 52914 - DNA, 7 bp, Unknown
  misc_feature (1)..( 7): Matrix.002 file - promoters60/1664727
ataacaa

SEQ ID NO: 52915 - DNA, 7 bp, Unknown
  misc_feature (1)..( 7): Matrix.002 file - promoters60/1664727
tgtattt

SEQ ID NO: 52916 - DNA, 8 bp, Unknown
  misc_feature (1)..( 8): Matrix.002 file - promoters60/1664727
tggaaagg

SEQ ID NO: 52917 - DNA, 6 bp, Unknown
  misc_feature (1)..( 6): Matrix.002 file - promoters60/1664727
aaagtt

SEQ ID NO: 52918 - DNA, 7 bp, Unknown
  misc_feature (1)..( 7): Matrix.002 file - promoters60/1664727
gtgaaaa

SEQ ID NO: 52919 - DNA, 8 bp, Unknown
  misc_feature (1)..( 8): Matrix.002 file - promoters60/1664727
caatgtaa

SEQ ID NO: 52920 - DNA, 8 bp, Unknown
  misc_feature (1)..( 8): Matrix.002 file - promoters60/1664727
tttagctt

SEQ ID NO: 52921 - DNA, 6 bp, Unknown
  misc_feature (1)..( 6): Matrix.002 file - promoters60/1664727
gaatta

SEQ ID NO: 52922 - DNA, 6 bp, Unknown
  misc_feature (1)..( 6): Matrix.002 file - promoters60/1664727
gcggaa

SEQ ID NO: 52923 - DNA, 7 bp, Unknown
  misc_feature (1)..( 7): Matrix.002 file - promoters60/1664727
tatcttc

SEQ ID NO: 52924 - DNA, 6 bp, Unknown
  misc_feature (1)..( 6): Matrix.002 file - promoters60/1664727
tccttg

SEQ ID NO: 52925 - DNA, 7 bp, Unknown
  misc_feature (1)..( 7): Matrix.002 file - promoters60/1664727
gatatat

SEQ ID NO: 52926 - DNA, 10 bp, Unknown
  misc_feature (1)..( 10): Matrix.002 file - promoters60/1664731
ggcttagatt

SEQ ID NO: 52927 - DNA, 6 bp, Unknown
  misc_feature (1)..( 6): Matrix.002 file - promoters60/1664731
tttttt

SEQ ID NO: 52928 - DNA, 6 bp, Unknown
  misc_feature (1)..( 6): Matrix.002 file - promoters60/1664731
aaatat

SEQ ID NO: 52929 - DNA, 8 bp, Unknown
  misc_feature (1)..( 8): Matrix.002 file - promoters60/1664731
aaatatca

SEQ ID NO: 52930 - DNA, 6 bp, Unknown
  misc_feature (1)..( 6): Matrix.002 file - promoters60/1664731
acacat

SEQ ID NO: 52931 - DNA, 7 bp, Unknown
  misc_feature (1)..( 7): Matrix.002 file - promoters60/1664731
atgatta

SEQ ID NO: 52932 - DNA, 8 bp, Unknown
  misc_feature (1)..( 8): Matrix.002 file - promoters60/1664731
aatgggcc

SEQ ID NO: 52933 - DNA, 7 bp, Unknown
  misc_feature (1)..( 7): Matrix.002 file - promoters60/1664731
atgatat

SEQ ID NO: 52934 - DNA, 6 bp, Unknown
  misc_feature (1)..( 6): Matrix.002 file - promoters60/1664731
ttttaa

SEQ ID NO: 52935 - DNA, 7 bp, Unknown
  misc_feature (1)..( 7): Matrix.002 file - promoters60/1664731
tttgaga

SEQ ID NO: 52936 - DNA, 7 bp, Unknown
  misc_feature (1)..( 7): Matrix.002 file - promoters60/1664731
gtaaaat

SEQ ID NO: 52937 - DNA, 8 bp, Unknown
  misc_feature (1)..( 8): Matrix.002 file - promoters60/1664870
tttgattc

SEQ ID NO: 52938 - DNA, 7 bp, Unknown
  misc_feature (1)..( 7): Matrix.002 file - promoters60/1664870
aacaaat

SEQ ID NO: 52939 - DNA, 9 bp, Unknown
  misc_feature (1)..( 9): Matrix.002 file - promoters60/1664870
taactaaaa

SEQ ID NO: 52940 - DNA, 8 bp, Unknown
  misc_feature (1)..( 8): Matrix.002 file - promoters60/1664870
taataact

SEQ ID NO: 52941 - DNA, 10 bp, Unknown
  misc_feature (1)..( 10): Matrix.002 file - promoters60/1664931
tccacaaaac

SEQ ID NO: 52942 - DNA, 8 bp, Unknown
  misc_feature (1)..( 8): Matrix.002 file - promoters60/1665056
aattttct

SEQ ID NO: 52943 - DNA, 10 bp, Unknown
  misc_feature (1)..( 10): Matrix.002 file - promoters60/1665056
tataaaattc

SEQ ID NO: 52944 - DNA, 13 bp, Unknown
  misc_feature (1)..( 13): Matrix.002 file - promoters60/1665056
tataaaaaaataa

SEQ ID NO: 52945 - DNA, 9 bp, Unknown
  misc_feature (1)..( 9): Matrix.002 file - promoters60/1665056
cttaattca

SEQ ID NO: 52946 - DNA, 8 bp, Unknown
  misc_feature (1)..( 8): Matrix.002 file - promoters60/1665056
tttgccag

SEQ ID NO: 52947 - DNA, 7 bp, Unknown
  misc_feature (1)..( 7): Matrix.002 file - promoters60/1665080
tttgtta

SEQ ID NO: 52948 - DNA, 9 bp, Unknown
  misc_feature (1)..( 9): Matrix.002 file - promoters60/1665080
cttgatttg

SEQ ID NO: 52949 - DNA, 10 bp, Unknown
  misc_feature (1)..( 10): Matrix.002 file - promoters60/1665080
tccctttttt

SEQ ID NO: 52950 - DNA, 7 bp, Unknown
  misc_feature (1)..( 7): Matrix.002 file - promoters60/1665080
aaggata

SEQ ID NO: 52951 - DNA, 9 bp, Unknown
  misc_feature (1)..( 9): Matrix.002 file - promoters60/1665080
agcaaaaaa

SEQ ID NO: 52952 - DNA, 9 bp, Unknown
  misc_feature (1)..( 9): Matrix.002 file - promoters60/1665080
atgttattt

SEQ ID NO: 52953 - DNA, 6 bp, Unknown
  misc_feature (1)..( 6): Matrix.002 file - promoters60/1665080
tataca

SEQ ID NO: 52954 - DNA, 9 bp, Unknown
  misc_feature (1)..( 9): Matrix.002 file - promoters60/1665080
attaaacta

SEQ ID NO: 52955 - DNA, 6 bp, Unknown
  misc_feature (1)..( 6): Matrix.002 file - promoters60/1665080
tttttc

SEQ ID NO: 52956 - DNA, 6 bp, Unknown
  misc_feature (1)..( 6): Matrix.002 file - promoters60/1665080
ggaaca

SEQ ID NO: 52957 - DNA, 10 bp, Unknown
  misc_feature (1)..( 10): Matrix.002 file - promoters60/1665080
gaacatgttc

SEQ ID NO: 52958 - DNA, 9 bp, Unknown
  misc_feature (1)..( 9): Matrix.002 file - promoters60/1665080
aatagttat

SEQ ID NO: 52959 - DNA, 9 bp, Unknown
  misc_feature (1)..( 9): Matrix.002 file - promoters60/1665080
tcttccaag

SEQ ID NO: 52960 - DNA, 7 bp, Unknown
  misc_feature (1)..( 7): Matrix.002 file - promoters60/1665080
tagataa

SEQ ID NO: 52961 - DNA, 6 bp, Unknown
  misc_feature (1)..( 6): Matrix.002 file - promoters60/1665080
cttttt

SEQ ID NO: 52962 - DNA, 7 bp, Unknown
  misc_feature (1)..( 7): Matrix.002 file - promoters60/1665080
tacaaaa

SEQ ID NO: 52963 - DNA, 7 bp, Unknown
  misc_feature (1)..( 7): Matrix.002 file - promoters60/1665080
gcaaaaa

SEQ ID NO: 52964 - DNA, 7 bp, Unknown
  misc_feature (1)..( 7): Matrix.002 file - promoters60/1665080
tttgttt

SEQ ID NO: 52965 - DNA, 6 bp, Unknown
  misc_feature (1)..( 6): Matrix.002 file - promoters60/1665080
ttcttt

SEQ ID NO: 52966 - DNA, 12 bp, Unknown
  misc_feature (1)..( 12): Matrix.002 file - promoters60/1665080
aaaaatatatat

SEQ ID NO: 52967 - DNA, 6 bp, Unknown
  misc_feature (1)..( 6): Matrix.002 file - promoters60/1665080
gggcct

SEQ ID NO: 52968 - DNA, 6 bp, Unknown
  misc_feature (1)..( 6): Matrix.002 file - promoters60/1665112
ttttat

SEQ ID NO: 52969 - DNA, 6 bp, Unknown
  misc_feature (1)..( 6): Matrix.002 file - promoters60/1665112
gtcatt

SEQ ID NO: 52970 - DNA, 9 bp, Unknown
  misc_feature (1)..( 9): Matrix.002 file - promoters60/1665112
ttaaaaaca

SEQ ID NO: 52971 - DNA, 7 bp, Unknown
  misc_feature (1)..( 7): Matrix.002 file - promoters60/1665112
aaagatt

SEQ ID NO: 52972 - DNA, 6 bp, Unknown
  misc_feature (1)..( 6): Matrix.002 file - promoters60/1665112
tttaaa

SEQ ID NO: 52973 - DNA, 6 bp, Unknown
  misc_feature (1)..( 6): Matrix.002 file - promoters60/1665112
ttttta

SEQ ID NO: 52974 - DNA, 7 bp, Unknown
  misc_feature (1)..( 7): Matrix.002 file - promoters60/1665112
aagattt

SEQ ID NO: 52975 - DNA, 7 bp, Unknown
  misc_feature (1)..( 7): Matrix.002 file - promoters60/1665112
ataattt

SEQ ID NO: 52976 - DNA, 8 bp, Unknown
  misc_feature (1)..( 8): Matrix.002 file - promoters60/1665112
aaggaaag

SEQ ID NO: 52977 - DNA, 6 bp, Unknown
  misc_feature (1)..( 6): Matrix.002 file - promoters60/1665112
atttat

SEQ ID NO: 52978 - DNA, 6 bp, Unknown
  misc_feature (1)..( 6): Matrix.002 file - promoters60/1665112
atgatc

SEQ ID NO: 52979 - DNA, 7 bp, Unknown
  misc_feature (1)..( 7): Matrix.002 file - promoters60/1665112
gttagag

SEQ ID NO: 52980 - DNA, 6 bp, Unknown
  misc_feature (1)..( 6): Matrix.002 file - promoters60/1665112
tcatat

SEQ ID NO: 52981 - DNA, 7 bp, Unknown
  misc_feature (1)..( 7): Matrix.002 file - promoters60/1665112
ttaggtg

SEQ ID NO: 52982 - DNA, 8 bp, Unknown
  misc_feature (1)..( 8): Matrix.002 file - promoters60/1665112
atacatac

SEQ ID NO: 52983 - DNA, 6 bp, Unknown
  misc_feature (1)..( 6): Matrix.002 file - promoters60/1665112
ttcaaa

SEQ ID NO: 52984 - DNA, 9 bp, Unknown
  misc_feature (1)..( 9): Matrix.002 file - promoters60/1673798
aaaataaaa

SEQ ID NO: 52985 - DNA, 7 bp, Unknown
  misc_feature (1)..( 7): Matrix.002 file - promoters60/1673806
ttcgtta

SEQ ID NO: 52986 - DNA, 8 bp, Unknown
  misc_feature (1)..( 8): Matrix.002 file - promoters60/1673806
taaaaaaa

SEQ ID NO: 52987 - DNA, 10 bp, Unknown
  misc_feature (1)..( 10): Matrix.002 file - promoters60/1673806
agacaatttt

SEQ ID NO: 52988 - DNA, 11 bp, Unknown
  misc_feature (1)..( 11): Matrix.002 file - promoters60/1673806
acataatttat

SEQ ID NO: 52989 - DNA, 8 bp, Unknown
  misc_feature (1)..( 8): Matrix.002 file - promoters60/1673826
ttctgatt

SEQ ID NO: 52990 - DNA, 8 bp, Unknown
  misc_feature (1)..( 8): Matrix.002 file - promoters60/1673826
atagattc

SEQ ID NO: 52991 - DNA, 6 bp, Unknown
  misc_feature (1)..( 6): Matrix.002 file - promoters60/1673826
tttgta

SEQ ID NO: 52992 - DNA, 6 bp, Unknown
  misc_feature (1)..( 6): Matrix.002 file - promoters60/1673826
attatt

SEQ ID NO: 52993 - DNA, 6 bp, Unknown
  misc_feature (1)..( 6): Matrix.002 file - promoters60/1673826
gtcaaa

SEQ ID NO: 52994 - DNA, 8 bp, Unknown
  misc_feature (1)..( 8): Matrix.002 file - promoters60/1673826
ttgaactt

SEQ ID NO: 52995 - DNA, 8 bp, Unknown
  misc_feature (1)..( 8): Matrix.002 file - promoters60/1673826
ttagtaat

SEQ ID NO: 52996 - DNA, 7 bp, Unknown
  misc_feature (1)..( 7): Matrix.002 file - promoters60/1673826
tatataa

SEQ ID NO: 52997 - DNA, 6 bp, Unknown
  misc_feature (1)..( 6): Matrix.002 file - promoters60/1673826
taaatt

SEQ ID NO: 52998 - DNA, 6 bp, Unknown
  misc_feature (1)..( 6): Matrix.002 file - promoters60/1673826
aaatat

SEQ ID NO: 52999 - DNA, 8 bp, Unknown
  misc_feature (1)..( 8): Matrix.002 file - promoters60/1673826
tataacaa

SEQ ID NO: 53000 - DNA, 7 bp, Unknown
  misc_feature (1)..( 7): Matrix.002 file - promoters60/1673826
aagaaat

SEQ ID NO: 53001 - DNA, 6 bp, Unknown
  misc_feature (1)..( 6): Matrix.002 file - promoters60/1673826
attttt

SEQ ID NO: 53002 - DNA, 7 bp, Unknown
  misc_feature (1)..( 7): Matrix.002 file - promoters60/1673826
aaaaata

SEQ ID NO: 53003 - DNA, 9 bp, Unknown
  misc_feature (1)..( 9): Matrix.002 file - promoters60/1673847
aaataaaat

SEQ ID NO: 53004 - DNA, 8 bp, Unknown
  misc_feature (1)..( 8): Matrix.002 file - promoters60/1673847
attaaaaa

SEQ ID NO: 53005 - DNA, 10 bp, Unknown
  misc_feature (1)..( 10): Matrix.002 file - promoters60/1673847
gtaataacac

SEQ ID NO: 53006 - DNA, 6 bp, Unknown
  misc_feature (1)..( 6): Matrix.002 file - promoters60/1673847
taaaaa

SEQ ID NO: 53007 - DNA, 6 bp, Unknown
  misc_feature (1)..( 6): Matrix.002 file - promoters60/1673847
gattaa

SEQ ID NO: 53008 - DNA, 7 bp, Unknown
  misc_feature (1)..( 7): Matrix.002 file - promoters60/1673847
aatataa

SEQ ID NO: 53009 - DNA, 11 bp, Unknown
  misc_feature (1)..( 11): Matrix.002 file - promoters60/1673847
ataaatcttat

SEQ ID NO: 53010 - DNA, 7 bp, Unknown
  misc_feature (1)..( 7): Matrix.002 file - promoters60/1673847
ttcaata

SEQ ID NO: 53011 - DNA, 8 bp, Unknown
  misc_feature (1)..( 8): Matrix.002 file - promoters60/1673847
atatgttt

SEQ ID NO: 53012 - DNA, 6 bp, Unknown
  misc_feature (1)..( 6): Matrix.002 file - promoters60/1673847
ctatct

SEQ ID NO: 53013 - DNA, 6 bp, Unknown
  misc_feature (1)..( 6): Matrix.002 file - promoters60/1673847
acttgt

SEQ ID NO: 53014 - DNA, 6 bp, Unknown
  misc_feature (1)..( 6): Matrix.002 file - promoters60/1673847
tataaa

SEQ ID NO: 53015 - DNA, 8 bp, Unknown
  misc_feature (1)..( 8): Matrix.002 file - promoters60/1673847
taaccttg

SEQ ID NO: 53016 - DNA, 7 bp, Unknown
  misc_feature (1)..( 7): Matrix.002 file - promoters60/1673847
tttgtat

SEQ ID NO: 53017 - DNA, 7 bp, Unknown
  misc_feature (1)..( 7): Matrix.002 file - promoters60/1673847
tctggtt

SEQ ID NO: 53018 - DNA, 6 bp, Unknown
  misc_feature (1)..( 6): Matrix.002 file - promoters60/1673847
tttgag

SEQ ID NO: 53019 - DNA, 7 bp, Unknown
  misc_feature (1)..( 7): Matrix.002 file - promoters60/1673849
atagttt

SEQ ID NO: 53020 - DNA, 9 bp, Unknown
  misc_feature (1)..( 9): Matrix.002 file - promoters60/1673849
tcataaaaa

SEQ ID NO: 53021 - DNA, 7 bp, Unknown
  misc_feature (1)..( 7): Matrix.002 file - promoters60/1673849
aaaaatt

SEQ ID NO: 53022 - DNA, 6 bp, Unknown
  misc_feature (1)..( 6): Matrix.002 file - promoters60/1673849
tatatt

SEQ ID NO: 53023 - DNA, 6 bp, Unknown
  misc_feature (1)..( 6): Matrix.002 file - promoters60/1673849
aaaatc

SEQ ID NO: 53024 - DNA, 7 bp, Unknown
  misc_feature (1)..( 7): Matrix.002 file - promoters60/1673849
tgtataa

SEQ ID NO: 53025 - DNA, 6 bp, Unknown
  misc_feature (1)..( 6): Matrix.002 file - promoters60/1673849
acatca

SEQ ID NO: 53026 - DNA, 9 bp, Unknown
  misc_feature (1)..( 9): Matrix.002 file - promoters60/1673849
tatataatt

SEQ ID NO: 53027 - DNA, 9 bp, Unknown
  misc_feature (1)..( 9): Matrix.002 file - promoters60/1673849
tattaaata

SEQ ID NO: 53028 - DNA, 7 bp, Unknown
  misc_feature (1)..( 7): Matrix.002 file - promoters60/1673849
aaaagtt

SEQ ID NO: 53029 - DNA, 6 bp, Unknown
  misc_feature (1)..( 6): Matrix.002 file - promoters60/1673849
ccacgt

SEQ ID NO: 53030 - DNA, 6 bp, Unknown
  misc_feature (1)..( 6): Matrix.002 file - promoters60/1673849
tatatg

SEQ ID NO: 53031 - DNA, 6 bp, Unknown
  misc_feature (1)..( 6): Matrix.002 file - promoters60/1673849
tatttt

SEQ ID NO: 53032 - DNA, 6 bp, Unknown
  misc_feature (1)..( 6): Matrix.002 file - promoters60/1673849
aatcca

SEQ ID NO: 53033 - DNA, 7 bp, Unknown
  misc_feature (1)..( 7): Matrix.002 file - promoters60/1673849
gagattt

SEQ ID NO: 53034 - DNA, 6 bp, Unknown
  misc_feature (1)..( 6): Matrix.002 file - promoters60/1673849
acaaaa

SEQ ID NO: 53035 - DNA, 7 bp, Unknown
  misc_feature (1)..( 7): Matrix.002 file - promoters60/1673849
tttacgt

SEQ ID NO: 53036 - DNA, 8 bp, Unknown
  misc_feature (1)..( 8): Matrix.002 file - promoters60/1673849
tctcgttc

SEQ ID NO: 53037 - DNA, 6 bp, Unknown
  misc_feature (1)..( 6): Matrix.002 file - promoters60/1673853
ttaaag

SEQ ID NO: 53038 - DNA, 9 bp, Unknown
  misc_feature (1)..( 9): Matrix.002 file - promoters60/1673853
taattgggt

SEQ ID NO: 53039 - DNA, 8 bp, Unknown
  misc_feature (1)..( 8): Matrix.002 file - promoters60/1673853
tattaatt

SEQ ID NO: 53040 - DNA, 10 bp, Unknown
  misc_feature (1)..( 10): Matrix.002 file - promoters60/1673853
actatatata

SEQ ID NO: 53041 - DNA, 8 bp, Unknown
  misc_feature (1)..( 8): Matrix.002 file - promoters60/1673853
gaacaaac

SEQ ID NO: 53042 - DNA, 7 bp, Unknown
  misc_feature (1)..( 7): Matrix.002 file - promoters60/1673853
gaagatt

SEQ ID NO: 53043 - DNA, 7 bp, Unknown
  misc_feature (1)..( 7): Matrix.002 file - promoters60/1673853
taacaag

SEQ ID NO: 53044 - DNA, 8 bp, Unknown
  misc_feature (1)..( 8): Matrix.002 file - promoters60/1673853
aataagac

SEQ ID NO: 53045 - DNA, 6 bp, Unknown
  misc_feature (1)..( 6): Matrix.002 file - promoters60/1673853
tttgaa

SEQ ID NO: 53046 - DNA, 6 bp, Unknown
  misc_feature (1)..( 6): Matrix.002 file - promoters60/1673853
ttcaaa

SEQ ID NO: 53047 - DNA, 6 bp, Unknown
  misc_feature (1)..( 6): Matrix.002 file - promoters60/1673853
aaaata

SEQ ID NO: 53048 - DNA, 7 bp, Unknown
  misc_feature (1)..( 7): Matrix.002 file - promoters60/1673853
aaacgaa

SEQ ID NO: 53049 - DNA, 7 bp, Unknown
  misc_feature (1)..( 7): Matrix.002 file - promoters60/1673853
ttaaata

SEQ ID NO: 53050 - DNA, 6 bp, Unknown
  misc_feature (1)..( 6): Matrix.002 file - promoters60/1673853
taaaaa

SEQ ID NO: 53051 - DNA, 7 bp, Unknown
  misc_feature (1)..( 7): Matrix.002 file - promoters60/1673853
ggtgaga

SEQ ID NO: 53052 - DNA, 6 bp, Unknown
  misc_feature (1)..( 6): Matrix.002 file - promoters60/1673853
gagaaa

SEQ ID NO: 53053 - DNA, 7 bp, Unknown
  misc_feature (1)..( 7): Matrix.002 file - promoters60/1710026
cggcttg

SEQ ID NO: 53054 - DNA, 7 bp, Unknown
  misc_feature (1)..( 7): Matrix.002 file - promoters60/1710026
aatcgga

SEQ ID NO: 53055 - DNA, 14 bp, Unknown
  misc_feature (1)..( 14): Matrix.002 file - promoters60/1710026
tctgggaaatcgga

SEQ ID NO: 53056 - DNA, 6 bp, Unknown
  misc_feature (1)..( 6): Matrix.002 file - promoters60/1710026
tttcaa

SEQ ID NO: 53057 - DNA, 6 bp, Unknown
  misc_feature (1)..( 6): Matrix.002 file - promoters60/1710026
ggaaat

SEQ ID NO: 53058 - DNA, 9 bp, Unknown
  misc_feature (1)..( 9): Matrix.002 file - promoters60/1710026
atttcaatc

SEQ ID NO: 53059 - DNA, 11 bp, Unknown
  misc_feature (1)..( 11): Matrix.002 file - promoters60/1711228
aacaaaaataa

SEQ ID NO: 53060 - DNA, 11 bp, Unknown
  misc_feature (1)..( 11): Matrix.002 file - promoters60/1711228
aaagaagaaaa

SEQ ID NO: 53061 - DNA, 12 bp, Unknown
  misc_feature (1)..( 12): Matrix.002 file - promoters60/1711318
tatattgaatat

SEQ ID NO: 53062 - DNA, 13 bp, Unknown
  misc_feature (1)..( 13): Matrix.002 file - promoters60/1711318
tagcatataaaaa

SEQ ID NO: 53063 - DNA, 9 bp, Unknown
  misc_feature (1)..( 9): Matrix.002 file - promoters60/1711318
tagaaaata

SEQ ID NO: 53064 - DNA, 10 bp, Unknown
  misc_feature (1)..( 10): Matrix.002 file - promoters60/1711318
aataatatag

SEQ ID NO: 53065 - DNA, 7 bp, Unknown
  misc_feature (1)..( 7): Matrix.002 file - promoters60/1711318
aaaataa

SEQ ID NO: 53066 - DNA, 15 bp, Unknown
  misc_feature (1)..( 15): Matrix.002 file - promoters60/1711586
aaaaaattataggaa

SEQ ID NO: 53067 - DNA, 7 bp, Unknown
  misc_feature (1)..( 7): Matrix.002 file - promoters60/1711586
ttacaat

SEQ ID NO: 53068 - DNA, 7 bp, Unknown
  misc_feature (1)..( 7): Matrix.002 file - promoters60/1711586
catgtat

SEQ ID NO: 53069 - DNA, 10 bp, Unknown
  misc_feature (1)..( 10): Matrix.002 file - promoters60/1711586
gatatagcaa

SEQ ID NO: 53070 - DNA, 9 bp, Unknown
  misc_feature (1)..( 9): Matrix.002 file - promoters60/1711586
aacataatc

SEQ ID NO: 53071 - DNA, 11 bp, Unknown
  misc_feature (1)..( 11): Matrix.002 file - promoters60/1711586
ttttgtagatt

SEQ ID NO: 53072 - DNA, 8 bp, Unknown
  misc_feature (1)..( 8): Matrix.002 file - promoters60/1711586
ttatatat

SEQ ID NO: 53073 - DNA, 9 bp, Unknown
  misc_feature (1)..( 9): Matrix.002 file - promoters60/1711586
ataaaaaca

SEQ ID NO: 53074 - DNA, 6 bp, Unknown
  misc_feature (1)..( 6): Matrix.002 file - promoters60/1711586
aaaaca

SEQ ID NO: 53075 - DNA, 6 bp, Unknown
  misc_feature (1)..( 6): Matrix.002 file - promoters60/1711630
ttttgt

SEQ ID NO: 53076 - DNA, 10 bp, Unknown
  misc_feature (1)..( 10): Matrix.002 file - promoters60/1711630
tttccaagta

SEQ ID NO: 53077 - DNA, 9 bp, Unknown
  misc_feature (1)..( 9): Matrix.002 file - promoters60/1711630
tccaatttc

SEQ ID NO: 53078 - DNA, 6 bp, Unknown
  misc_feature (1)..( 6): Matrix.002 file - promoters60/1711630
tgttta

SEQ ID NO: 53079 - DNA, 7 bp, Unknown
  misc_feature (1)..( 7): Matrix.002 file - promoters60/1711630
ctatctt

SEQ ID NO: 53080 - DNA, 9 bp, Unknown
  misc_feature (1)..( 9): Matrix.002 file - promoters60/1711630
tcttatttt

SEQ ID NO: 53081 - DNA, 7 bp, Unknown
  misc_feature (1)..( 7): Matrix.002 file - promoters60/1711630
actgatt

SEQ ID NO: 53082 - DNA, 6 bp, Unknown
  misc_feature (1)..( 6): Matrix.002 file - promoters60/1711630
cattga

SEQ ID NO: 53083 - DNA, 6 bp, Unknown
  misc_feature (1)..( 6): Matrix.002 file - promoters60/1711630
tattat

SEQ ID NO: 53084 - DNA, 6 bp, Unknown
  misc_feature (1)..( 6): Matrix.002 file - promoters60/1711630
ctttta

SEQ ID NO: 53085 - DNA, 6 bp, Unknown
  misc_feature (1)..( 6): Matrix.002 file - promoters60/1711630
tgtttt

SEQ ID NO: 53086 - DNA, 8 bp, Unknown
  misc_feature (1)..( 8): Matrix.002 file - promoters60/1711630
cttagaat

SEQ ID NO: 53087 - DNA, 6 bp, Unknown
  misc_feature (1)..( 6): Matrix.002 file - promoters60/1711630
cttgga

SEQ ID NO: 53088 - DNA, 6 bp, Unknown
  misc_feature (1)..( 6): Matrix.002 file - promoters60/1711630
cttttc

SEQ ID NO: 53089 - DNA, 6 bp, Unknown
  misc_feature (1)..( 6): Matrix.002 file - promoters60/1711630
ttttaa

SEQ ID NO: 53090 - DNA, 7 bp, Unknown
  misc_feature (1)..( 7): Matrix.002 file - promoters60/1711630
tttcttt

SEQ ID NO: 53091 - DNA, 7 bp, Unknown
  misc_feature (1)..( 7): Matrix.002 file - promoters60/1711630
cataatc

SEQ ID NO: 53092 - DNA, 7 bp, Unknown
  misc_feature (1)..( 7): Matrix.002 file - promoters60/1711630
ttaatct

SEQ ID NO: 53093 - DNA, 8 bp, Unknown
  misc_feature (1)..( 8): Matrix.002 file - promoters60/1711630
gaaactgt

SEQ ID NO: 53094 - DNA, 6 bp, Unknown
  misc_feature (1)..( 6): Matrix.002 file - promoters60/1711630
agtgat

SEQ ID NO: 53095 - DNA, 6 bp, Unknown
  misc_feature (1)..( 6): Matrix.002 file - promoters60/1711630
ctatag

SEQ ID NO: 53096 - DNA, 8 bp, Unknown
  misc_feature (1)..( 8): Matrix.002 file - promoters60/1712150
aaaaaata

SEQ ID NO: 53097 - DNA, 9 bp, Unknown
  misc_feature (1)..( 9): Matrix.002 file - promoters60/1712150
acacgcaag

SEQ ID NO: 53098 - DNA, 7 bp, Unknown
  misc_feature (1)..( 7): Matrix.002 file - promoters60/1712150
tcattca

SEQ ID NO: 53099 - DNA, 11 bp, Unknown
  misc_feature (1)..( 11): Matrix.002 file - promoters60/1712150
aaatttattct

SEQ ID NO: 53100 - DNA, 7 bp, Unknown
  misc_feature (1)..( 7): Matrix.002 file - promoters60/1712150
aaaaaca

SEQ ID NO: 53101 - DNA, 8 bp, Unknown
  misc_feature (1)..( 8): Matrix.002 file - promoters60/1712150
aagaaaat

SEQ ID NO: 53102 - DNA, 7 bp, Unknown
  misc_feature (1)..( 7): Matrix.002 file - promoters60/1712174
gaatcta

SEQ ID NO: 53103 - DNA, 7 bp, Unknown
  misc_feature (1)..( 7): Matrix.002 file - promoters60/1712174
ttttatc

SEQ ID NO: 53104 - DNA, 8 bp, Unknown
  misc_feature (1)..( 8): Matrix.002 file - promoters60/1712174
attatttg

SEQ ID NO: 53105 - DNA, 9 bp, Unknown
  misc_feature (1)..( 9): Matrix.002 file - promoters60/1712174
gtcaaaaaa

SEQ ID NO: 53106 - DNA, 6 bp, Unknown
  misc_feature (1)..( 6): Matrix.002 file - promoters60/1713765
aaaatt

SEQ ID NO: 53107 - DNA, 9 bp, Unknown
  misc_feature (1)..( 9): Matrix.002 file - promoters60/1713765
agagagaat

SEQ ID NO: 53108 - DNA, 7 bp, Unknown
  misc_feature (1)..( 7): Matrix.002 file - promoters60/1713765
ttgaata

SEQ ID NO: 53109 - DNA, 10 bp, Unknown
  misc_feature (1)..( 10): Matrix.002 file - promoters60/1713780
caaaacataa

SEQ ID NO: 53110 - DNA, 7 bp, Unknown
  misc_feature (1)..( 7): Matrix.002 file - promoters60/1713780
aaaatat

SEQ ID NO: 53111 - DNA, 7 bp, Unknown
  misc_feature (1)..( 7): Matrix.002 file - promoters60/1713780
tattcgt

SEQ ID NO: 53112 - DNA, 11 bp, Unknown
  misc_feature (1)..( 11): Matrix.002 file - promoters60/1713804
taaaagaatca

SEQ ID NO: 53113 - DNA, 10 bp, Unknown
  misc_feature (1)..( 10): Matrix.002 file - promoters60/1713804
aactgacttt

SEQ ID NO: 53114 - DNA, 7 bp, Unknown
  misc_feature (1)..( 7): Matrix.002 file - promoters60/1713804
ttatatc

SEQ ID NO: 53115 - DNA, 6 bp, Unknown
  misc_feature (1)..( 6): Matrix.002 file - promoters60/1713811
aaaaag

SEQ ID NO: 53116 - DNA, 8 bp, Unknown
  misc_feature (1)..( 8): Matrix.002 file - promoters60/1713811
gatgaaaa

SEQ ID NO: 53117 - DNA, 7 bp, Unknown
  misc_feature (1)..( 7): Matrix.002 file - promoters60/1713811
aatgtat

SEQ ID NO: 53118 - DNA, 6 bp, Unknown
  misc_feature (1)..( 6): Matrix.002 file - promoters60/1713811
tcgtgt

SEQ ID NO: 53119 - DNA, 6 bp, Unknown
  misc_feature (1)..( 6): Matrix.002 file - promoters60/1713811
ttttct

SEQ ID NO: 53120 - DNA, 7 bp, Unknown
  misc_feature (1)..( 7): Matrix.002 file - promoters60/1713811
gaatttg

SEQ ID NO: 53121 - DNA, 6 bp, Unknown
  misc_feature (1)..( 6): Matrix.002 file - promoters60/1713811
ttctct

SEQ ID NO: 53122 - DNA, 6 bp, Unknown
  misc_feature (1)..( 6): Matrix.002 file - promoters60/1713811
tatttt

SEQ ID NO: 53123 - DNA, 7 bp, Unknown
  misc_feature (1)..( 7): Matrix.002 file - promoters60/1713811
ttttaat

SEQ ID NO: 53124 - DNA, 7 bp, Unknown
  misc_feature (1)..( 7): Matrix.002 file - promoters60/1713811
taagtga

SEQ ID NO: 53125 - DNA, 6 bp, Unknown
  misc_feature (1)..( 6): Matrix.002 file - promoters60/1713811
catcat

SEQ ID NO: 53126 - DNA, 6 bp, Unknown
  misc_feature (1)..( 6): Matrix.002 file - promoters60/1713811
tcatat

SEQ ID NO: 53127 - DNA, 7 bp, Unknown
  misc_feature (1)..( 7): Matrix.002 file - promoters60/1713811
ttaggtg

SEQ ID NO: 53128 - DNA, 8 bp, Unknown
  misc_feature (1)..( 8): Matrix.002 file - promoters60/1713811
atacatac

SEQ ID NO: 53129 - DNA, 6 bp, Unknown
  misc_feature (1)..( 6): Matrix.002 file - promoters60/1713811
ttcaaa

SEQ ID NO: 53130 - DNA, 7 bp, Unknown
  misc_feature (1)..( 7): Matrix.002 file - promoters60/1713842
tatttat

SEQ ID NO: 53131 - DNA, 8 bp, Unknown
  misc_feature (1)..( 8): Matrix.002 file - promoters60/1713842
caaacctg

SEQ ID NO: 53132 - DNA, 8 bp, Unknown
  misc_feature (1)..( 8): Matrix.002 file - promoters60/1713842
agatacag

SEQ ID NO: 53133 - DNA, 9 bp, Unknown
  misc_feature (1)..( 9): Matrix.002 file - promoters60/1713842
tttcaagtt

SEQ ID NO: 53134 - DNA, 10 bp, Unknown
  misc_feature (1)..( 10): Matrix.002 file - promoters60/1713895
gacattatct

SEQ ID NO: 53135 - DNA, 9 bp, Unknown
  misc_feature (1)..( 9): Matrix.002 file - promoters60/1713895
aaagcccat

SEQ ID NO: 53136 - DNA, 11 bp, Unknown
  misc_feature (1)..( 11): Matrix.002 file - promoters60/1713895
atttatttgtg

SEQ ID NO: 53137 - DNA, 8 bp, Unknown
  misc_feature (1)..( 8): Matrix.002 file - promoters60/1713895
atgtacta

SEQ ID NO: 53138 - DNA, 6 bp, Unknown
  misc_feature (1)..( 6): Matrix.002 file - promoters60/1713895
tcaaaa

SEQ ID NO: 53139 - DNA, 8 bp, Unknown
  misc_feature (1)..( 8): Matrix.002 file - promoters60/1713895
atattttc

SEQ ID NO: 53140 - DNA, 11 bp, Unknown
  misc_feature (1)..( 11): Matrix.002 file - promoters60/1714694
tatcatttttt

SEQ ID NO: 53141 - DNA, 8 bp, Unknown
  misc_feature (1)..( 8): Matrix.002 file - promoters60/1714694
ttgtatat

SEQ ID NO: 53142 - DNA, 7 bp, Unknown
  misc_feature (1)..( 7): Matrix.002 file - promoters60/1714694
tttgctt

SEQ ID NO: 53143 - DNA, 7 bp, Unknown
  misc_feature (1)..( 7): Matrix.002 file - promoters60/1714772
aaacaaa

SEQ ID NO: 53144 - DNA, 11 bp, Unknown
  misc_feature (1)..( 11): Matrix.002 file - promoters60/1714772
taaaaaaaaag

SEQ ID NO: 53145 - DNA, 8 bp, Unknown
  misc_feature (1)..( 8): Matrix.002 file - promoters60/1714772
aaaaagaa

SEQ ID NO: 53146 - DNA, 8 bp, Unknown
  misc_feature (1)..( 8): Matrix.002 file - promoters60/1714772
aaacaaaa

SEQ ID NO: 53147 - DNA, 9 bp, Unknown
  misc_feature (1)..( 9): Matrix.002 file - promoters60/1714772
aaagtaaag

SEQ ID NO: 53148 - DNA, 8 bp, Unknown
  misc_feature (1)..( 8): Matrix.002 file - promoters60/1714772
ttttttaa

SEQ ID NO: 53149 - DNA, 10 bp, Unknown
  misc_feature (1)..( 10): Matrix.002 file - promoters60/1714772
atatttttta

SEQ ID NO: 53150 - DNA, 7 bp, Unknown
  misc_feature (1)..( 7): Matrix.002 file - promoters60/1714831
aaatgca

SEQ ID NO: 53151 - DNA, 12 bp, Unknown
  misc_feature (1)..( 12): Matrix.002 file - promoters60/1714865
gaaaaaaaaaaa

SEQ ID NO: 53152 - DNA, 11 bp, Unknown
  misc_feature (1)..( 11): Matrix.002 file - promoters60/1714865
atttattatgt

SEQ ID NO: 53153 - DNA, 9 bp, Unknown
  misc_feature (1)..( 9): Matrix.002 file - promoters60/1714865
tgaaaaaaa

SEQ ID NO: 53154 - DNA, 11 bp, Unknown
  misc_feature (1)..( 11): Matrix.002 file - promoters60/1714865
ataaaataaaa

SEQ ID NO: 53155 - DNA, 10 bp, Unknown
  misc_feature (1)..( 10): Matrix.002 file - promoters60/1714865
aaaaaagagt

SEQ ID NO: 53156 - DNA, 8 bp, Unknown
  misc_feature (1)..( 8): Matrix.002 file - promoters60/1714865
ataaataa

SEQ ID NO: 53157 - DNA, 9 bp, Unknown
  misc_feature (1)..( 9): Matrix.002 file - promoters60/1714865
gaaatacaa

SEQ ID NO: 53158 - DNA, 8 bp, Unknown
  misc_feature (1)..( 8): Matrix.002 file - promoters60/1714865
aaacaaat

SEQ ID NO: 53159 - DNA, 11 bp, Unknown
  misc_feature (1)..( 11): Matrix.002 file - promoters60/1714865
aaatattattt

SEQ ID NO: 53160 - DNA, 9 bp, Unknown
  misc_feature (1)..( 9): Matrix.002 file - promoters60/1714865
taaatacaa

SEQ ID NO: 53161 - DNA, 9 bp, Unknown
  misc_feature (1)..( 9): Matrix.002 file - promoters60/1714865
aaaaattta

SEQ ID NO: 53162 - DNA, 11 bp, Unknown
  misc_feature (1)..( 11): Matrix.002 file - promoters60/1714865
caaaaaaaaaa

SEQ ID NO: 53163 - DNA, 8 bp, Unknown
  misc_feature (1)..( 8): Matrix.002 file - promoters60/1714865
agaaaaat

SEQ ID NO: 53164 - DNA, 8 bp, Unknown
  misc_feature (1)..( 8): Matrix.002 file - promoters60/1714865
ttataatt

SEQ ID NO: 53165 - DNA, 8 bp, Unknown
  misc_feature (1)..( 8): Matrix.002 file - promoters60/1714912
aacaaaaa

SEQ ID NO: 53166 - DNA, 6 bp, Unknown
  misc_feature (1)..( 6): Matrix.002 file - promoters60/1714912
aaaaga

SEQ ID NO: 53167 - DNA, 6 bp, Unknown
  misc_feature (1)..( 6): Matrix.002 file - promoters60/1714912
gtatag

SEQ ID NO: 53168 - DNA, 11 bp, Unknown
  misc_feature (1)..( 11): Matrix.002 file - promoters60/1714912
aaaaagaaaaa

SEQ ID NO: 53169 - DNA, 7 bp, Unknown
  misc_feature (1)..( 7): Matrix.002 file - promoters60/1714912
agaaaaa

SEQ ID NO: 53170 - DNA, 8 bp, Unknown
  misc_feature (1)..( 8): Matrix.002 file - promoters60/1714912
ataaattc

SEQ ID NO: 53171 - DNA, 6 bp, Unknown
  misc_feature (1)..( 6): Matrix.002 file - promoters60/1714912
gtttga

SEQ ID NO: 53172 - DNA, 9 bp, Unknown
  misc_feature (1)..( 9): Matrix.002 file - promoters60/1714912
gaaacaaac

SEQ ID NO: 53173 - DNA, 6 bp, Unknown
  misc_feature (1)..( 6): Matrix.002 file - promoters60/1714912
ttgtgg

SEQ ID NO: 53174 - DNA, 10 bp, Unknown
  misc_feature (1)..( 10): Matrix.002 file - promoters60/1714912
ggtccatctt

SEQ ID NO: 53175 - DNA, 6 bp, Unknown
  misc_feature (1)..( 6): Matrix.002 file - promoters60/1714912
aaaaaa

SEQ ID NO: 53176 - DNA, 9 bp, Unknown
  misc_feature (1)..( 9): Matrix.002 file - promoters60/1714912
ttaaaaaaa

SEQ ID NO: 53177 - DNA, 6 bp, Unknown
  misc_feature (1)..( 6): Matrix.002 file - promoters60/1714912
caaaaa

SEQ ID NO: 53178 - DNA, 6 bp, Unknown
  misc_feature (1)..( 6): Matrix.002 file - promoters60/1714912
aaaaga

SEQ ID NO: 53179 - DNA, 7 bp, Unknown
  misc_feature (1)..( 7): Matrix.002 file - promoters60/1714912
tgataca

SEQ ID NO: 53180 - DNA, 15 bp, Unknown
  misc_feature (1)..( 15): Matrix.002 file - promoters60/1714912
accaatcagaattgt

SEQ ID NO: 53181 - DNA, 7 bp, Unknown
  misc_feature (1)..( 7): Matrix.002 file - promoters60/1714912
tctagtg

SEQ ID NO: 53182 - DNA, 6 bp, Unknown
  misc_feature (1)..( 6): Matrix.002 file - promoters60/1714912
ttaaag

SEQ ID NO: 53183 - DNA, 6 bp, Unknown
  misc_feature (1)..( 6): Matrix.002 file - promoters60/1714912
gtggta

SEQ ID NO: 53184 - DNA, 10 bp, Unknown
  misc_feature (1)..( 10): Matrix.002 file - promoters60/1714974
ttgaatttat

SEQ ID NO: 53185 - DNA, 7 bp, Unknown
  misc_feature (1)..( 7): Matrix.002 file - promoters60/1714974
caaacaa

SEQ ID NO: 53186 - DNA, 6 bp, Unknown
  misc_feature (1)..( 6): Matrix.002 file - promoters60/1714974
cttcac

SEQ ID NO: 53187 - DNA, 8 bp, Unknown
  misc_feature (1)..( 8): Matrix.002 file - promoters60/1714974
ataacgtt

SEQ ID NO: 53188 - DNA, 8 bp, Unknown
  misc_feature (1)..( 8): Matrix.002 file - promoters60/1714974
atatgtag

SEQ ID NO: 53189 - DNA, 8 bp, Unknown
  misc_feature (1)..( 8): Matrix.002 file - promoters60/1714974
cgacccaa

SEQ ID NO: 53190 - DNA, 6 bp, Unknown
  misc_feature (1)..( 6): Matrix.002 file - promoters60/1714974
ggtcta

SEQ ID NO: 53191 - DNA, 7 bp, Unknown
  misc_feature (1)..( 7): Matrix.002 file - promoters60/1714974
gaagaat

SEQ ID NO: 53192 - DNA, 9 bp, Unknown
  misc_feature (1)..( 9): Matrix.002 file - promoters60/1714974
ttcttcttc

SEQ ID NO: 53193 - DNA, 7 bp, Unknown
  misc_feature (1)..( 7): Matrix.002 file - promoters60/1714974
cttttgt

SEQ ID NO: 53194 - DNA, 6 bp, Unknown
  misc_feature (1)..( 6): Matrix.002 file - promoters60/1714974
tacttt

SEQ ID NO: 53195 - DNA, 9 bp, Unknown
  misc_feature (1)..( 9): Matrix.002 file - promoters60/1714974
aaaccaaat

SEQ ID NO: 53196 - DNA, 7 bp, Unknown
  misc_feature (1)..( 7): Matrix.002 file - promoters60/1714974
tataaaa

SEQ ID NO: 53197 - DNA, 6 bp, Unknown
  misc_feature (1)..( 6): Matrix.002 file - promoters60/1714974
tttgag

SEQ ID NO: 53198 - DNA, 6 bp, Unknown
  misc_feature (1)..( 6): Matrix.002 file - promoters60/1714974
aaaaac

SEQ ID NO: 53199 - DNA, 11 bp, Unknown
  misc_feature (1)..( 11): Matrix.002 file - promoters60/1714974
aaaaaatcatt

SEQ ID NO: 53200 - DNA, 8 bp, Unknown
  misc_feature (1)..( 8): Matrix.002 file - promoters60/1714989
aaaaaata

SEQ ID NO: 53201 - DNA, 10 bp, Unknown
  misc_feature (1)..( 10): Matrix.002 file - promoters60/1714989
aaaataaata

SEQ ID NO: 53202 - DNA, 9 bp, Unknown
  misc_feature (1)..( 9): Matrix.002 file - promoters60/1714989
ttaaaaaaa

SEQ ID NO: 53203 - DNA, 9 bp, Unknown
  misc_feature (1)..( 9): Matrix.002 file - promoters60/1714989
tacaaaaat

SEQ ID NO: 53204 - DNA, 10 bp, Unknown
  misc_feature (1)..( 10): Matrix.002 file - promoters60/1714989
aaacaataaa

SEQ ID NO: 53205 - DNA, 9 bp, Unknown
  misc_feature (1)..( 9): Matrix.002 file - promoters60/1714989
taaaattta

SEQ ID NO: 53206 - DNA, 6 bp, Unknown
  misc_feature (1)..( 6): Matrix.002 file - promoters60/1715220
tttttt

SEQ ID NO: 53207 - DNA, 6 bp, Unknown
  misc_feature (1)..( 6): Matrix.002 file - promoters60/1715220
caataa

SEQ ID NO: 53208 - DNA, 6 bp, Unknown
  misc_feature (1)..( 6): Matrix.002 file - promoters60/1715220
tttaat

SEQ ID NO: 53209 - DNA, 7 bp, Unknown
  misc_feature (1)..( 7): Matrix.002 file - promoters60/1715220
aaaaata

SEQ ID NO: 53210 - DNA, 7 bp, Unknown
  misc_feature (1)..( 7): Matrix.002 file - promoters60/1715220
cttaaga

SEQ ID NO: 53211 - DNA, 6 bp, Unknown
  misc_feature (1)..( 6): Matrix.002 file - promoters60/1715220
tcagag

SEQ ID NO: 53212 - DNA, 6 bp, Unknown
  misc_feature (1)..( 6): Matrix.002 file - promoters60/1715220
tcttgg

SEQ ID NO: 53213 - DNA, 7 bp, Unknown
  misc_feature (1)..( 7): Matrix.002 file - promoters60/1715220
gttattg

SEQ ID NO: 53214 - DNA, 7 bp, Unknown
  misc_feature (1)..( 7): Matrix.002 file - promoters60/1715220
cgtgttc

SEQ ID NO: 53215 - DNA, 6 bp, Unknown
  misc_feature (1)..( 6): Matrix.002 file - promoters60/1715220
tgttgt

SEQ ID NO: 53216 - DNA, 8 bp, Unknown
  misc_feature (1)..( 8): Matrix.002 file - promoters60/1715220
ttctgctg

SEQ ID NO: 53217 - DNA, 6 bp, Unknown
  misc_feature (1)..( 6): Matrix.002 file - promoters60/1715220
accaaa

SEQ ID NO: 53218 - DNA, 6 bp, Unknown
  misc_feature (1)..( 6): Matrix.002 file - promoters60/1715220
agttgt

SEQ ID NO: 53219 - DNA, 6 bp, Unknown
  misc_feature (1)..( 6): Matrix.002 file - promoters60/1715220
cttcct

SEQ ID NO: 53220 - DNA, 6 bp, Unknown
  misc_feature (1)..( 6): Matrix.002 file - promoters60/1715220
ctgtca

SEQ ID NO: 53221 - DNA, 6 bp, Unknown
  misc_feature (1)..( 6): Matrix.002 file - promoters60/1715220
atttta

SEQ ID NO: 53222 - DNA, 10 bp, Unknown
  misc_feature (1)..( 10): Matrix.002 file - promoters60/1715347
acattctgtt

SEQ ID NO: 53223 - DNA, 9 bp, Unknown
  misc_feature (1)..( 9): Matrix.002 file - promoters60/1715347
cattctttc

SEQ ID NO: 53224 - DNA, 8 bp, Unknown
  misc_feature (1)..( 8): Matrix.002 file - promoters60/1715347
acaatatc

SEQ ID NO: 53225 - DNA, 9 bp, Unknown
  misc_feature (1)..( 9): Matrix.002 file - promoters60/1715388
attgggcct

SEQ ID NO: 53226 - DNA, 8 bp, Unknown
  misc_feature (1)..( 8): Matrix.002 file - promoters60/1715388
aaatcaag

SEQ ID NO: 53227 - DNA, 10 bp, Unknown
  misc_feature (1)..( 10): Matrix.002 file - promoters60/1715388
ttgttattaa

SEQ ID NO: 53228 - DNA, 9 bp, Unknown
  misc_feature (1)..( 9): Matrix.002 file - promoters60/1715388
tttctgttc

SEQ ID NO: 53229 - DNA, 6 bp, Unknown
  misc_feature (1)..( 6): Matrix.002 file - promoters60/1715478
aagaaa

SEQ ID NO: 53230 - DNA, 7 bp, Unknown
  misc_feature (1)..( 7): Matrix.002 file - promoters60/1715478
agaaagt

SEQ ID NO: 53231 - DNA, 6 bp, Unknown
  misc_feature (1)..( 6): Matrix.002 file - promoters60/1715478
aaatgc

SEQ ID NO: 53232 - DNA, 10 bp, Unknown
  misc_feature (1)..( 10): Matrix.002 file - promoters60/1715478
actttataat

SEQ ID NO: 53233 - DNA, 9 bp, Unknown
  misc_feature (1)..( 9): Matrix.002 file - promoters60/1715478
tactcaatt

SEQ ID NO: 53234 - DNA, 8 bp, Unknown
  misc_feature (1)..( 8): Matrix.002 file - promoters60/1715478
ggtgggat

SEQ ID NO: 53235 - DNA, 6 bp, Unknown
  misc_feature (1)..( 6): Matrix.002 file - promoters60/1715478
tggaaa

SEQ ID NO: 53236 - DNA, 8 bp, Unknown
  misc_feature (1)..( 8): Matrix.002 file - promoters60/1715478
caacacca

SEQ ID NO: 53237 - DNA, 7 bp, Unknown
  misc_feature (1)..( 7): Matrix.002 file - promoters60/1715478
ttaattg

SEQ ID NO: 53238 - DNA, 7 bp, Unknown
  misc_feature (1)..( 7): Matrix.002 file - promoters60/1715478
catatcc

SEQ ID NO: 53239 - DNA, 7 bp, Unknown
  misc_feature (1)..( 7): Matrix.002 file - promoters60/1715478
ttatgtc

SEQ ID NO: 53240 - DNA, 10 bp, Unknown
  misc_feature (1)..( 10): Matrix.002 file - promoters60/1715478
ttttaataac

SEQ ID NO: 53241 - DNA, 7 bp, Unknown
  misc_feature (1)..( 7): Matrix.002 file - promoters60/1715478
attagta

SEQ ID NO: 53242 - DNA, 7 bp, Unknown
  misc_feature (1)..( 7): Matrix.002 file - promoters60/1715478
gattcag

SEQ ID NO: 53243 - DNA, 7 bp, Unknown
  misc_feature (1)..( 7): Matrix.002 file - promoters60/1715478
gatcgat

SEQ ID NO: 53244 - DNA, 9 bp, Unknown
  misc_feature (1)..( 9): Matrix.002 file - promoters60/1715482
taattcaaa

SEQ ID NO: 53245 - DNA, 9 bp, Unknown
  misc_feature (1)..( 9): Matrix.002 file - promoters60/1715482
aaaacaact

SEQ ID NO: 53246 - DNA, 6 bp, Unknown
  misc_feature (1)..( 6): Matrix.002 file - promoters60/1715510
atgatt

SEQ ID NO: 53247 - DNA, 6 bp, Unknown
  misc_feature (1)..( 6): Matrix.002 file - promoters60/1715510
aaaaga

SEQ ID NO: 53248 - DNA, 7 bp, Unknown
  misc_feature (1)..( 7): Matrix.002 file - promoters60/1715510
aaatatt

SEQ ID NO: 53249 - DNA, 8 bp, Unknown
  misc_feature (1)..( 8): Matrix.002 file - promoters60/1715510
attcaatt

SEQ ID NO: 53250 - DNA, 7 bp, Unknown
  misc_feature (1)..( 7): Matrix.002 file - promoters60/1715510
tcaattt

SEQ ID NO: 53251 - DNA, 7 bp, Unknown
  misc_feature (1)..( 7): Matrix.002 file - promoters60/1715510
tttattt

SEQ ID NO: 53252 - DNA, 6 bp, Unknown
  misc_feature (1)..( 6): Matrix.002 file - promoters60/1715510
agtaaa

SEQ ID NO: 53253 - DNA, 6 bp, Unknown
  misc_feature (1)..( 6): Matrix.002 file - promoters60/1715510
acaaaa

SEQ ID NO: 53254 - DNA, 9 bp, Unknown
  misc_feature (1)..( 9): Matrix.002 file - promoters60/1715510
aattacaca

SEQ ID NO: 53255 - DNA, 7 bp, Unknown
  misc_feature (1)..( 7): Matrix.002 file - promoters60/1715510
aaactaa

SEQ ID NO: 53256 - DNA, 7 bp, Unknown
  misc_feature (1)..( 7): Matrix.002 file - promoters60/1715510
attatga

SEQ ID NO: 53257 - DNA, 8 bp, Unknown
  misc_feature (1)..( 8): Matrix.002 file - promoters60/1715510
tttggatt

SEQ ID NO: 53258 - DNA, 8 bp, Unknown
  misc_feature (1)..( 8): Matrix.002 file - promoters60/1715510
gactacct

SEQ ID NO: 53259 - DNA, 6 bp, Unknown
  misc_feature (1)..( 6): Matrix.002 file - promoters60/1715510
atccaa

SEQ ID NO: 53260 - DNA, 7 bp, Unknown
  misc_feature (1)..( 7): Matrix.002 file - promoters60/1715510
ttcacgt

SEQ ID NO: 53261 - DNA, 6 bp, Unknown
  misc_feature (1)..( 6): Matrix.002 file - promoters60/1715510
atttga

SEQ ID NO: 53262 - DNA, 6 bp, Unknown
  misc_feature (1)..( 6): Matrix.002 file - promoters60/1715516
agaata

SEQ ID NO: 53263 - DNA, 7 bp, Unknown
  misc_feature (1)..( 7): Matrix.002 file - promoters60/1715516
ttatttt

SEQ ID NO: 53264 - DNA, 6 bp, Unknown
  misc_feature (1)..( 6): Matrix.002 file - promoters60/1715516
taacaa

SEQ ID NO: 53265 - DNA, 8 bp, Unknown
  misc_feature (1)..( 8): Matrix.002 file - promoters60/1715516
atttaaaa

SEQ ID NO: 53266 - DNA, 6 bp, Unknown
  misc_feature (1)..( 6): Matrix.002 file - promoters60/1715516
taatta

SEQ ID NO: 53267 - DNA, 6 bp, Unknown
  misc_feature (1)..( 6): Matrix.002 file - promoters60/1715516
ccatga

SEQ ID NO: 53268 - DNA, 7 bp, Unknown
  misc_feature (1)..( 7): Matrix.002 file - promoters60/1715516
gataata

SEQ ID NO: 53269 - DNA, 7 bp, Unknown
  misc_feature (1)..( 7): Matrix.002 file - promoters60/1715516
ttaaaaa

SEQ ID NO: 53270 - DNA, 8 bp, Unknown
  misc_feature (1)..( 8): Matrix.002 file - promoters60/1715516
taatgaaa

SEQ ID NO: 53271 - DNA, 6 bp, Unknown
  misc_feature (1)..( 6): Matrix.002 file - promoters60/1715516
aaacaa

SEQ ID NO: 53272 - DNA, 12 bp, Unknown
  misc_feature (1)..( 12): Matrix.002 file - promoters60/1715516
ctcctatatatt

SEQ ID NO: 53273 - DNA, 6 bp, Unknown
  misc_feature (1)..( 6): Matrix.002 file - promoters60/1715516
ttttta

SEQ ID NO: 53274 - DNA, 7 bp, Unknown
  misc_feature (1)..( 7): Matrix.002 file - promoters60/1715516
atagatt

SEQ ID NO: 53275 - DNA, 7 bp, Unknown
  misc_feature (1)..( 7): Matrix.002 file - promoters60/1715516
attacca

SEQ ID NO: 53276 - DNA, 10 bp, Unknown
  misc_feature (1)..( 10): Matrix.002 file - promoters60/1715516
aagaaatatg

SEQ ID NO: 53277 - DNA, 7 bp, Unknown
  misc_feature (1)..( 7): Matrix.002 file - promoters60/1715516
ataggaa

SEQ ID NO: 53278 - DNA, 7 bp, Unknown
  misc_feature (1)..( 7): Matrix.002 file - promoters60/1715516
aaaacaa

SEQ ID NO: 53279 - DNA, 12 bp, Unknown
  misc_feature (1)..( 12): Matrix.002 file - promoters60/1715516
aaaagaagaaag

SEQ ID NO: 53280 - DNA, 7 bp, Unknown
  misc_feature (1)..( 7): Matrix.002 file - promoters60/1715516
agcacat

SEQ ID NO: 53281 - DNA, 7 bp, Unknown
  misc_feature (1)..( 7): Matrix.002 file - promoters60/1715516
tatatct

SEQ ID NO: 53282 - DNA, 10 bp, Unknown
  misc_feature (1)..( 10): Matrix.002 file - promoters60/1715516
atagtttaac

SEQ ID NO: 53283 - DNA, 7 bp, Unknown
  misc_feature (1)..( 7): Matrix.002 file - promoters60/1715516
aaggaaa

SEQ ID NO: 53284 - DNA, 8 bp, Unknown
  misc_feature (1)..( 8): Matrix.002 file - promoters60/1715516
aactattt

SEQ ID NO: 53285 - DNA, 6 bp, Unknown
  misc_feature (1)..( 6): Matrix.002 file - promoters60/1715516
aatatg

SEQ ID NO: 53286 - DNA, 6 bp, Unknown
  misc_feature (1)..( 6): Matrix.002 file - promoters60/1715516
ttaggc

SEQ ID NO: 53287 - DNA, 11 bp, Unknown
  misc_feature (1)..( 11): Matrix.002 file - promoters60/1715535
gaaaattttca

SEQ ID NO: 53288 - DNA, 16 bp, Unknown
  misc_feature (1)..( 16): Matrix.002 file - promoters60/1715535
ataaactcttaaaaaa

SEQ ID NO: 53289 - DNA, 9 bp, Unknown
  misc_feature (1)..( 9): Matrix.002 file - promoters60/1715535
aacaattat

SEQ ID NO: 53290 - DNA, 11 bp, Unknown
  misc_feature (1)..( 11): Matrix.002 file - promoters60/1715595
ggtctcacata

SEQ ID NO: 53291 - DNA, 9 bp, Unknown
  misc_feature (1)..( 9): Matrix.002 file - promoters60/1715595
ctccggcga

SEQ ID NO: 53292 - DNA, 7 bp, Unknown
  misc_feature (1)..( 7): Matrix.002 file - promoters60/1715615
tataatg

SEQ ID NO: 53293 - DNA, 6 bp, Unknown
  misc_feature (1)..( 6): Matrix.002 file - promoters60/1715615
ttgttt

SEQ ID NO: 53294 - DNA, 6 bp, Unknown
  misc_feature (1)..( 6): Matrix.002 file - promoters60/1715615
aatcag

SEQ ID NO: 53295 - DNA, 6 bp, Unknown
  misc_feature (1)..( 6): Matrix.002 file - promoters60/1715615
taagga

SEQ ID NO: 53296 - DNA, 8 bp, Unknown
  misc_feature (1)..( 8): Matrix.002 file - promoters60/1715615
tctgttcc

SEQ ID NO: 53297 - DNA, 6 bp, Unknown
  misc_feature (1)..( 6): Matrix.002 file - promoters60/1715615
taaaga

SEQ ID NO: 53298 - DNA, 7 bp, Unknown
  misc_feature (1)..( 7): Matrix.002 file - promoters60/1715615
atcgaag

SEQ ID NO: 53299 - DNA, 7 bp, Unknown
  misc_feature (1)..( 7): Matrix.002 file - promoters60/1715615
aatgctc

SEQ ID NO: 53300 - DNA, 9 bp, Unknown
  misc_feature (1)..( 9): Matrix.002 file - promoters60/1715615
atgtccatt

SEQ ID NO: 53301 - DNA, 8 bp, Unknown
  misc_feature (1)..( 8): Matrix.002 file - promoters60/1715615
ttttcttt

SEQ ID NO: 53302 - DNA, 7 bp, Unknown
  misc_feature (1)..( 7): Matrix.002 file - promoters60/1715615
atctctt

SEQ ID NO: 53303 - DNA, 8 bp, Unknown
  misc_feature (1)..( 8): Matrix.002 file - promoters60/1715615
tcaacttt

SEQ ID NO: 53304 - DNA, 7 bp, Unknown
  misc_feature (1)..( 7): Matrix.002 file - promoters60/1715615
gaaacaa

SEQ ID NO: 53305 - DNA, 11 bp, Unknown
  misc_feature (1)..( 11): Matrix.002 file - promoters60/1715810
tgaaattaaaa

SEQ ID NO: 53306 - DNA, 7 bp, Unknown
  misc_feature (1)..( 7): Matrix.002 file - promoters60/1715810
gaatttt

SEQ ID NO: 53307 - DNA, 8 bp, Unknown
  misc_feature (1)..( 8): Matrix.002 file - promoters60/1715810
gtttcttt

SEQ ID NO: 53308 - DNA, 10 bp, Unknown
  misc_feature (1)..( 10): Matrix.002 file - promoters60/1715810
aaaaatcaag

SEQ ID NO: 53309 - DNA, 12 bp, Unknown
  misc_feature (1)..( 12): Matrix.002 file - promoters60/1715810
aaaagactaaaa

SEQ ID NO: 53310 - DNA, 11 bp, Unknown
  misc_feature (1)..( 11): Matrix.002 file - promoters60/1715810
aaaaagaaaag

SEQ ID NO: 53311 - DNA, 6 bp, Unknown
  misc_feature (1)..( 6): Matrix.002 file - promoters60/1715810
taaatt

SEQ ID NO: 53312 - DNA, 8 bp, Unknown
  misc_feature (1)..( 8): Matrix.002 file - promoters60/1715810
aactaaac

SEQ ID NO: 53313 - DNA, 9 bp, Unknown
  misc_feature (1)..( 9): Matrix.002 file - promoters60/1715810
ttaactaaa

SEQ ID NO: 53314 - DNA, 10 bp, Unknown
  misc_feature (1)..( 10): Matrix.002 file - promoters60/1716040
atttttaaaa

SEQ ID NO: 53315 - DNA, 10 bp, Unknown
  misc_feature (1)..( 10): Matrix.002 file - promoters60/1716040
ttgcaacttt

SEQ ID NO: 53316 - DNA, 8 bp, Unknown
  misc_feature (1)..( 8): Matrix.002 file - promoters60/1716040
tttctaat

SEQ ID NO: 53317 - DNA, 8 bp, Unknown
  misc_feature (1)..( 8): Matrix.002 file - promoters60/1716040
gattcttt

SEQ ID NO: 53318 - DNA, 8 bp, Unknown
  misc_feature (1)..( 8): Matrix.002 file - promoters60/1716040
atttcatg

SEQ ID NO: 53319 - DNA, 7 bp, Unknown
  misc_feature (1)..( 7): Matrix.002 file - promoters60/1716040
atggttc

SEQ ID NO: 53320 - DNA, 9 bp, Unknown
  misc_feature (1)..( 9): Matrix.002 file - promoters60/1806998
tataaagaa

SEQ ID NO: 53321 - DNA, 10 bp, Unknown
  misc_feature (1)..( 10): Matrix.002 file - promoters60/1806998
aacacaaagt

SEQ ID NO: 53322 - DNA, 8 bp, Unknown
  misc_feature (1)..( 8): Matrix.002 file - promoters60/1807067
ttttaaaa

SEQ ID NO: 53323 - DNA, 10 bp, Unknown
  misc_feature (1)..( 10): Matrix.002 file - promoters60/1807067
caacttattt

SEQ ID NO: 53324 - DNA, 8 bp, Unknown
  misc_feature (1)..( 8): Matrix.002 file - promoters60/1807067
aatatttt

SEQ ID NO: 53325 - DNA, 13 bp, Unknown
  misc_feature (1)..( 13): Matrix.002 file - promoters60/1807067
attatatcaacat

SEQ ID NO: 53326 - DNA, 9 bp, Unknown
  misc_feature (1)..( 9): Matrix.002 file - promoters60/1807067
atgatcaaa

SEQ ID NO: 53327 - DNA, 8 bp, Unknown
  misc_feature (1)..( 8): Matrix.002 file - promoters60/1807067
ttaaaaca

SEQ ID NO: 53328 - DNA, 10 bp, Unknown
  misc_feature (1)..( 10): Matrix.002 file - promoters60/1807067
ttgatcaaca

SEQ ID NO: 53329 - DNA, 9 bp, Unknown
  misc_feature (1)..( 9): Matrix.002 file - promoters60/1807067
atgtattat

SEQ ID NO: 53330 - DNA, 10 bp, Unknown
  misc_feature (1)..( 10): Matrix.002 file - promoters60/1807067
atataaataa

SEQ ID NO: 53331 - DNA, 7 bp, Unknown
  misc_feature (1)..( 7): Matrix.002 file - promoters60/1807067
aatattt

SEQ ID NO: 53332 - DNA, 8 bp, Unknown
  misc_feature (1)..( 8): Matrix.002 file - promoters60/1807067
tttatata

SEQ ID NO: 53333 - DNA, 8 bp, Unknown
  misc_feature (1)..( 8): Matrix.002 file - promoters60/1807067
tatttaaa

SEQ ID NO: 53334 - DNA, 8 bp, Unknown
  misc_feature (1)..( 8): Matrix.002 file - promoters60/1807067
acatgtta

SEQ ID NO: 53335 - DNA, 9 bp, Unknown
  misc_feature (1)..( 9): Matrix.002 file - promoters60/1807244
tgtcctaat

SEQ ID NO: 53336 - DNA, 6 bp, Unknown
  misc_feature (1)..( 6): Matrix.002 file - promoters60/1807244
gagaga

SEQ ID NO: 53337 - DNA, 8 bp, Unknown
  misc_feature (1)..( 8): Matrix.002 file - promoters60/1807244
gaagtagg

SEQ ID NO: 53338 - DNA, 6 bp, Unknown
  misc_feature (1)..( 6): Matrix.002 file - promoters60/1807244
aagcta

SEQ ID NO: 53339 - DNA, 7 bp, Unknown
  misc_feature (1)..( 7): Matrix.002 file - promoters60/1807244
catacta

SEQ ID NO: 53340 - DNA, 7 bp, Unknown
  misc_feature (1)..( 7): Matrix.002 file - promoters60/1807244
aaaacag

SEQ ID NO: 53341 - DNA, 6 bp, Unknown
  misc_feature (1)..( 6): Matrix.002 file - promoters60/1807244
gtggga

SEQ ID NO: 53342 - DNA, 6 bp, Unknown
  misc_feature (1)..( 6): Matrix.002 file - promoters60/1807244
ttcttg

SEQ ID NO: 53343 - DNA, 6 bp, Unknown
  misc_feature (1)..( 6): Matrix.002 file - promoters60/1807244
attaaa

SEQ ID NO: 53344 - DNA, 7 bp, Unknown
  misc_feature (1)..( 7): Matrix.002 file - promoters60/1807244
aacctcc

SEQ ID NO: 53345 - DNA, 9 bp, Unknown
  misc_feature (1)..( 9): Matrix.002 file - promoters60/1807244
aagatcgaa

SEQ ID NO: 53346 - DNA, 7 bp, Unknown
  misc_feature (1)..( 7): Matrix.002 file - promoters60/1807244
atgcagc

SEQ ID NO: 53347 - DNA, 6 bp, Unknown
  misc_feature (1)..( 6): Matrix.002 file - promoters60/1807244
tcacat

SEQ ID NO: 53348 - DNA, 6 bp, Unknown
  misc_feature (1)..( 6): Matrix.002 file - promoters60/1807244
aaacat

SEQ ID NO: 53349 - DNA, 8 bp, Unknown
  misc_feature (1)..( 8): Matrix.002 file - promoters60/1807415
ctttgtct

SEQ ID NO: 53350 - DNA, 8 bp, Unknown
  misc_feature (1)..( 8): Matrix.002 file - promoters60/1807415
tttctctc

SEQ ID NO: 53351 - DNA, 7 bp, Unknown
  misc_feature (1)..( 7): Matrix.002 file - promoters60/1807415
caaataa

SEQ ID NO: 53352 - DNA, 7 bp, Unknown
  misc_feature (1)..( 7): Matrix.002 file - promoters60/1807415
atcttta

SEQ ID NO: 53353 - DNA, 10 bp, Unknown
  misc_feature (1)..( 10): Matrix.002 file - promoters60/1807415
cattaaataa

SEQ ID NO: 53354 - DNA, 7 bp, Unknown
  misc_feature (1)..( 7): Matrix.002 file - promoters60/1807736
atttata

SEQ ID NO: 53355 - DNA, 15 bp, Unknown
  misc_feature (1)..( 15): Matrix.002 file - promoters60/1807771
atgtatgtcatttct

SEQ ID NO: 53356 - DNA, 12 bp, Unknown
  misc_feature (1)..( 12): Matrix.002 file - promoters60/1807771
agaataaataca

SEQ ID NO: 53357 - DNA, 7 bp, Unknown
  misc_feature (1)..( 7): Matrix.002 file - promoters60/1807774
aaatttt

SEQ ID NO: 53358 - DNA, 8 bp, Unknown
  misc_feature (1)..( 8): Matrix.002 file - promoters60/1807774
ataccaac

SEQ ID NO: 53359 - DNA, 10 bp, Unknown
  misc_feature (1)..( 10): Matrix.002 file - promoters60/1807774
ttttggaaat

SEQ ID NO: 53360 - DNA, 8 bp, Unknown
  misc_feature (1)..( 8): Matrix.002 file - promoters60/1807774
cactgttt

SEQ ID NO: 53361 - DNA, 10 bp, Unknown
  misc_feature (1)..( 10): Matrix.002 file - promoters60/1807774
taaaaatttt

SEQ ID NO: 53362 - DNA, 8 bp, Unknown
  misc_feature (1)..( 8): Matrix.002 file - promoters60/1807774
atttattt

SEQ ID NO: 53363 - DNA, 11 bp, Unknown
  misc_feature (1)..( 11): Matrix.002 file - promoters60/1807774
taacaattttt

SEQ ID NO: 53364 - DNA, 8 bp, Unknown
  misc_feature (1)..( 8): Matrix.002 file - promoters60/1807774
tataaata

SEQ ID NO: 53365 - DNA, 9 bp, Unknown
  misc_feature (1)..( 9): Matrix.002 file - promoters60/1808111
ttaaaaaaa

SEQ ID NO: 53366 - DNA, 10 bp, Unknown
  misc_feature (1)..( 10): Matrix.002 file - promoters60/1808111
acaaatggaa

SEQ ID NO: 53367 - DNA, 28 bp, Unknown
  misc_feature (1)..( 28): Matrix.002 file - promoters60/1808111
aagcctatataaaaggctacaagcatga

SEQ ID NO: 53368 - DNA, 8 bp, Unknown
  misc_feature (1)..( 8): Matrix.002 file - promoters60/1808137
tgtgtaaa

SEQ ID NO: 53369 - DNA, 8 bp, Unknown
  misc_feature (1)..( 8): Matrix.002 file - promoters60/1808137
acgtgatg

SEQ ID NO: 53370 - DNA, 6 bp, Unknown
  misc_feature (1)..( 6): Matrix.002 file - promoters60/1808137
atgggc

SEQ ID NO: 53371 - DNA, 6 bp, Unknown
  misc_feature (1)..( 6): Matrix.002 file - promoters60/1808137
ccaata

SEQ ID NO: 53372 - DNA, 10 bp, Unknown
  misc_feature (1)..( 10): Matrix.002 file - promoters60/1808137
ggtttatttt

SEQ ID NO: 53373 - DNA, 6 bp, Unknown
  misc_feature (1)..( 6): Matrix.002 file - promoters60/1808137
gatgtt

SEQ ID NO: 53374 - DNA, 7 bp, Unknown
  misc_feature (1)..( 7): Matrix.002 file - promoters60/1808137
tttaatt

SEQ ID NO: 53375 - DNA, 6 bp, Unknown
  misc_feature (1)..( 6): Matrix.002 file - promoters60/1808137
ttaaga

SEQ ID NO: 53376 - DNA, 6 bp, Unknown
  misc_feature (1)..( 6): Matrix.002 file - promoters60/1808137
gaaaag

SEQ ID NO: 53377 - DNA, 7 bp, Unknown
  misc_feature (1)..( 7): Matrix.002 file - promoters60/1808137
atgataa

SEQ ID NO: 53378 - DNA, 7 bp, Unknown
  misc_feature (1)..( 7): Matrix.002 file - promoters60/1808137
aacctgt

SEQ ID NO: 53379 - DNA, 8 bp, Unknown
  misc_feature (1)..( 8): Matrix.002 file - promoters60/1808137
ttgcatat

SEQ ID NO: 53380 - DNA, 8 bp, Unknown
  misc_feature (1)..( 8): Matrix.002 file - promoters60/1808137
tgttatgc

SEQ ID NO: 53381 - DNA, 7 bp, Unknown
  misc_feature (1)..( 7): Matrix.002 file - promoters60/1808137
ttgctaa

SEQ ID NO: 53382 - DNA, 6 bp, Unknown
  misc_feature (1)..( 6): Matrix.002 file - promoters60/1808137
ttcctt

SEQ ID NO: 53383 - DNA, 6 bp, Unknown
  misc_feature (1)..( 6): Matrix.002 file - promoters60/1808137
aagaga

SEQ ID NO: 53384 - DNA, 7 bp, Unknown
  misc_feature (1)..( 7): Matrix.002 file - promoters60/1808137
aagaaag

SEQ ID NO: 53385 - DNA, 12 bp, Unknown
  misc_feature (1)..( 12): Matrix.002 file - promoters60/1808156
cttgatctgttt

SEQ ID NO: 53386 - DNA, 10 bp, Unknown
  misc_feature (1)..( 10): Matrix.002 file - promoters60/1808156
aaaatttgaa

SEQ ID NO: 53387 - DNA, 10 bp, Unknown
  misc_feature (1)..( 10): Matrix.002 file - promoters60/1808172
tgttgacttt

SEQ ID NO: 53388 - DNA, 9 bp, Unknown
  misc_feature (1)..( 9): Matrix.002 file - promoters60/1808172
ttaaaaaaa

SEQ ID NO: 53389 - DNA, 13 bp, Unknown
  misc_feature (1)..( 13): Matrix.002 file - promoters60/1808172
aatgatatttatt

SEQ ID NO: 53390 - DNA, 12 bp, Unknown
  misc_feature (1)..( 12): Matrix.002 file - promoters60/1808172
tataattatttt

SEQ ID NO: 53391 - DNA, 13 bp, Unknown
  misc_feature (1)..( 13): Matrix.002 file - promoters60/1808172
agttaaattttta

SEQ ID NO: 53392 - DNA, 6 bp, Unknown
  misc_feature (1)..( 6): Matrix.002 file - promoters60/1808572
aattct

SEQ ID NO: 53393 - DNA, 11 bp, Unknown
  misc_feature (1)..( 11): Matrix.002 file - promoters60/1808572
actaattagta

SEQ ID NO: 53394 - DNA, 8 bp, Unknown
  misc_feature (1)..( 8): Matrix.002 file - promoters60/1808572
aaaaatac

SEQ ID NO: 53395 - DNA, 8 bp, Unknown
  misc_feature (1)..( 8): Matrix.002 file - promoters60/1808572
gtaaatta

SEQ ID NO: 53396 - DNA, 7 bp, Unknown
  misc_feature (1)..( 7): Matrix.002 file - promoters60/1808572
aaaaaaa

SEQ ID NO: 53397 - DNA, 7 bp, Unknown
  misc_feature (1)..( 7): Matrix.002 file - promoters60/1808572
tgaacca

SEQ ID NO: 53398 - DNA, 6 bp, Unknown
  misc_feature (1)..( 6): Matrix.002 file - promoters60/1808572
gatttg

SEQ ID NO: 53399 - DNA, 9 bp, Unknown
  misc_feature (1)..( 9): Matrix.002 file - promoters60/1808572
ttattttat

SEQ ID NO: 53400 - DNA, 9 bp, Unknown
  misc_feature (1)..( 9): Matrix.002 file - promoters60/1808572
aacatcttg

SEQ ID NO: 53401 - DNA, 8 bp, Unknown
  misc_feature (1)..( 8): Matrix.002 file - promoters60/1808572
atataaag

SEQ ID NO: 53402 - DNA, 7 bp, Unknown
  misc_feature (1)..( 7): Matrix.002 file - promoters60/1808572
tttaagt

SEQ ID NO: 53403 - DNA, 6 bp, Unknown
  misc_feature (1)..( 6): Matrix.002 file - promoters60/1808572
taatag

SEQ ID NO: 53404 - DNA, 7 bp, Unknown
  misc_feature (1)..( 7): Matrix.002 file - promoters60/1808572
actcaaa

SEQ ID NO: 53405 - DNA, 8 bp, Unknown
  misc_feature (1)..( 8): Matrix.002 file - promoters60/1808572
actatcat

SEQ ID NO: 53406 - DNA, 6 bp, Unknown
  misc_feature (1)..( 6): Matrix.002 file - promoters60/1808572
atttca

SEQ ID NO: 53407 - DNA, 6 bp, Unknown
  misc_feature (1)..( 6): Matrix.002 file - promoters60/1808572
ttttag

SEQ ID NO: 53408 - DNA, 6 bp, Unknown
  misc_feature (1)..( 6): Matrix.002 file - promoters60/1808572
cataat

SEQ ID NO: 53409 - DNA, 8 bp, Unknown
  misc_feature (1)..( 8): Matrix.002 file - promoters60/1808572
agcgcggg

SEQ ID NO: 53410 - DNA, 7 bp, Unknown
  misc_feature (1)..( 7): Matrix.002 file - promoters60/1808572
aaactaa

SEQ ID NO: 53411 - DNA, 7 bp, Unknown
  misc_feature (1)..( 7): Matrix.002 file - promoters60/1808572
aaagaat

SEQ ID NO: 53412 - DNA, 8 bp, Unknown
  misc_feature (1)..( 8): Matrix.002 file - promoters60/1808572
taatgcaa

SEQ ID NO: 53413 - DNA, 6 bp, Unknown
  misc_feature (1)..( 6): Matrix.002 file - promoters60/1808572
aattaa

SEQ ID NO: 53414 - DNA, 7 bp, Unknown
  misc_feature (1)..( 7): Matrix.002 file - promoters60/1808696
taaagtt

SEQ ID NO: 53415 - DNA, 15 bp, Unknown
  misc_feature (1)..( 15): Matrix.002 file - promoters60/1808696
aaaagcatacatata

SEQ ID NO: 53416 - DNA, 8 bp, Unknown
  misc_feature (1)..( 8): Matrix.002 file - promoters60/1808696
ctattatt

SEQ ID NO: 53417 - DNA, 9 bp, Unknown
  misc_feature (1)..( 9): Matrix.002 file - promoters60/1808696
aaatagtta

SEQ ID NO: 53418 - DNA, 8 bp, Unknown
  misc_feature (1)..( 8): Matrix.002 file - promoters60/1808696
tggttatt

SEQ ID NO: 53419 - DNA, 7 bp, Unknown
  misc_feature (1)..( 7): Matrix.002 file - promoters60/1808696
tacataa

SEQ ID NO: 53420 - DNA, 7 bp, Unknown
  misc_feature (1)..( 7): Matrix.002 file - promoters60/1808696
tgttcta

SEQ ID NO: 53421 - DNA, 10 bp, Unknown
  misc_feature (1)..( 10): Matrix.002 file - promoters60/1809157
aaaaaaataa

SEQ ID NO: 53422 - DNA, 10 bp, Unknown
  misc_feature (1)..( 10): Matrix.002 file - promoters60/1809222
gaaatagatt

SEQ ID NO: 53423 - DNA, 10 bp, Unknown
  misc_feature (1)..( 10): Matrix.002 file - promoters60/1809233
taaaattaag

SEQ ID NO: 53424 - DNA, 12 bp, Unknown
  misc_feature (1)..( 12): Matrix.002 file - promoters60/1809233
tactatataagt

SEQ ID NO: 53425 - DNA, 11 bp, Unknown
  misc_feature (1)..( 11): Matrix.002 file - promoters60/1809233
aaaaataaata

SEQ ID NO: 53426 - DNA, 9 bp, Unknown
  misc_feature (1)..( 9): Matrix.002 file - promoters60/1809233
aataaatat

SEQ ID NO: 53427 - DNA, 6 bp, Unknown
  misc_feature (1)..( 6): Matrix.002 file - promoters60/1809243
agtgtt

SEQ ID NO: 53428 - DNA, 6 bp, Unknown
  misc_feature (1)..( 6): Matrix.002 file - promoters60/1809243
aataaa

SEQ ID NO: 53429 - DNA, 10 bp, Unknown
  misc_feature (1)..( 10): Matrix.002 file - promoters60/1809243
aaattaattt

SEQ ID NO: 53430 - DNA, 6 bp, Unknown
  misc_feature (1)..( 6): Matrix.002 file - promoters60/1809243
caagtc

SEQ ID NO: 53431 - DNA, 7 bp, Unknown
  misc_feature (1)..( 7): Matrix.002 file - promoters60/1809243
taatctt

SEQ ID NO: 53432 - DNA, 6 bp, Unknown
  misc_feature (1)..( 6): Matrix.002 file - promoters60/1809243
acacgt

SEQ ID NO: 53433 - DNA, 6 bp, Unknown
  misc_feature (1)..( 6): Matrix.002 file - promoters60/1809243
ttaacc

SEQ ID NO: 53434 - DNA, 7 bp, Unknown
  misc_feature (1)..( 7): Matrix.002 file - promoters60/1809243
caaattt

SEQ ID NO: 53435 - DNA, 7 bp, Unknown
  misc_feature (1)..( 7): Matrix.002 file - promoters60/1809243
tttggaa

SEQ ID NO: 53436 - DNA, 7 bp, Unknown
  misc_feature (1)..( 7): Matrix.002 file - promoters60/1809243
attaatt

SEQ ID NO: 53437 - DNA, 6 bp, Unknown
  misc_feature (1)..( 6): Matrix.002 file - promoters60/1809243
ttaaaa

SEQ ID NO: 53438 - DNA, 8 bp, Unknown
  misc_feature (1)..( 8): Matrix.002 file - promoters60/1809243
attgttcc

SEQ ID NO: 53439 - DNA, 7 bp, Unknown
  misc_feature (1)..( 7): Matrix.002 file - promoters60/1809243
agaaaaa

SEQ ID NO: 53440 - DNA, 8 bp, Unknown
  misc_feature (1)..( 8): Matrix.002 file - promoters60/1809243
aaaaacaa

SEQ ID NO: 53441 - DNA, 6 bp, Unknown
  misc_feature (1)..( 6): Matrix.002 file - promoters60/1809243
agttgg

SEQ ID NO: 53442 - DNA, 6 bp, Unknown
  misc_feature (1)..( 6): Matrix.002 file - promoters60/1809243
tttccc

SEQ ID NO: 53443 - DNA, 10 bp, Unknown
  misc_feature (1)..( 10): Matrix.002 file - promoters60/1809253
aattacaaaa

SEQ ID NO: 53444 - DNA, 6 bp, Unknown
  misc_feature (1)..( 6): Matrix.002 file - promoters60/1809253
aaaaat

SEQ ID NO: 53445 - DNA, 11 bp, Unknown
  misc_feature (1)..( 11): Matrix.002 file - promoters60/1809253
aataaaaacaa

SEQ ID NO: 53446 - DNA, 7 bp, Unknown
  misc_feature (1)..( 7): Matrix.002 file - promoters60/1809253
acaaaaa

SEQ ID NO: 53447 - DNA, 7 bp, Unknown
  misc_feature (1)..( 7): Matrix.002 file - promoters60/1809253
aaccaac

SEQ ID NO: 53448 - DNA, 6 bp, Unknown
  misc_feature (1)..( 6): Matrix.002 file - promoters60/1809253
aaaata

SEQ ID NO: 53449 - DNA, 7 bp, Unknown
  misc_feature (1)..( 7): Matrix.002 file - promoters60/1809253
atatata

SEQ ID NO: 53450 - DNA, 8 bp, Unknown
  misc_feature (1)..( 8): Matrix.002 file - promoters60/1809253
caaaatct

SEQ ID NO: 53451 - DNA, 7 bp, Unknown
  misc_feature (1)..( 7): Matrix.002 file - promoters60/1809253
aaaagtc

SEQ ID NO: 53452 - DNA, 6 bp, Unknown
  misc_feature (1)..( 6): Matrix.002 file - promoters60/1809253
atgtca

SEQ ID NO: 53453 - DNA, 11 bp, Unknown
  misc_feature (1)..( 11): Matrix.002 file - promoters60/1809253
tatgtttacaa

SEQ ID NO: 53454 - DNA, 8 bp, Unknown
  misc_feature (1)..( 8): Matrix.002 file - promoters60/1809253
tgtctgta

SEQ ID NO: 53455 - DNA, 7 bp, Unknown
  misc_feature (1)..( 7): Matrix.002 file - promoters60/1809253
attattt

SEQ ID NO: 53456 - DNA, 6 bp, Unknown
  misc_feature (1)..( 6): Matrix.002 file - promoters60/1809253
tcgttt

SEQ ID NO: 53457 - DNA, 8 bp, Unknown
  misc_feature (1)..( 8): Matrix.002 file - promoters60/1809253
gttgactt

SEQ ID NO: 53458 - DNA, 6 bp, Unknown
  misc_feature (1)..( 6): Matrix.002 file - promoters60/1809253
tttcaa

SEQ ID NO: 53459 - DNA, 6 bp, Unknown
  misc_feature (1)..( 6): Matrix.002 file - promoters60/1809253
tctttc

SEQ ID NO: 53460 - DNA, 9 bp, Unknown
  misc_feature (1)..( 9): Matrix.002 file - promoters60/1809253
caaaaaaac

SEQ ID NO: 53461 - DNA, 6 bp, Unknown
  misc_feature (1)..( 6): Matrix.002 file - promoters60/1809253
aacaaa

SEQ ID NO: 53462 - DNA, 11 bp, Unknown
  misc_feature (1)..( 11): Matrix.002 file - promoters60/1830195
caaagaaaaat

SEQ ID NO: 53463 - DNA, 9 bp, Unknown
  misc_feature (1)..( 9): Matrix.002 file - promoters60/1923743
cggcggttc

SEQ ID NO: 53464 - DNA, 7 bp, Unknown
  misc_feature (1)..( 7): Matrix.002 file - promoters60/1923743
ttcaaaa

SEQ ID NO: 53465 - DNA, 9 bp, Unknown
  misc_feature (1)..( 9): Matrix.002 file - promoters60/1923743
acactaaaa

SEQ ID NO: 53466 - DNA, 6 bp, Unknown
  misc_feature (1)..( 6): Matrix.002 file - promoters60/1923743
tctaac

SEQ ID NO: 53467 - DNA, 7 bp, Unknown
  misc_feature (1)..( 7): Matrix.002 file - promoters60/1923743
gattttt

SEQ ID NO: 53468 - DNA, 6 bp, Unknown
  misc_feature (1)..( 6): Matrix.002 file - promoters60/1923743
taaaca

SEQ ID NO: 53469 - DNA, 7 bp, Unknown
  misc_feature (1)..( 7): Matrix.002 file - promoters60/1923743
gataacg

SEQ ID NO: 53470 - DNA, 9 bp, Unknown
  misc_feature (1)..( 9): Matrix.002 file - promoters60/1923743
atgtttgtt

SEQ ID NO: 53471 - DNA, 8 bp, Unknown
  misc_feature (1)..( 8): Matrix.002 file - promoters60/1923743
tgttcaaa

SEQ ID NO: 53472 - DNA, 7 bp, Unknown
  misc_feature (1)..( 7): Matrix.002 file - promoters60/1923743
aagaagt

SEQ ID NO: 53473 - DNA, 6 bp, Unknown
  misc_feature (1)..( 6): Matrix.002 file - promoters60/1923743
ctaaaa

SEQ ID NO: 53474 - DNA, 7 bp, Unknown
  misc_feature (1)..( 7): Matrix.002 file - promoters60/1923743
aggagtt

SEQ ID NO: 53475 - DNA, 6 bp, Unknown
  misc_feature (1)..( 6): Matrix.002 file - promoters60/1923743
aacaaa

SEQ ID NO: 53476 - DNA, 7 bp, Unknown
  misc_feature (1)..( 7): Matrix.002 file - promoters60/1923743
atccaat

SEQ ID NO: 53477 - DNA, 6 bp, Unknown
  misc_feature (1)..( 6): Matrix.002 file - promoters60/1923743
tattct

SEQ ID NO: 53478 - DNA, 8 bp, Unknown
  misc_feature (1)..( 8): Matrix.002 file - promoters60/1923743
taatgtaa

SEQ ID NO: 53479 - DNA, 9 bp, Unknown
  misc_feature (1)..( 9): Matrix.002 file - promoters60/1923743
taatgcact

SEQ ID NO: 53480 - DNA, 6 bp, Unknown
  misc_feature (1)..( 6): Matrix.002 file - promoters60/1923743
actatt

SEQ ID NO: 53481 - DNA, 7 bp, Unknown
  misc_feature (1)..( 7): Matrix.002 file - promoters60/1923743
cgactat

SEQ ID NO: 53482 - DNA, 7 bp, Unknown
  misc_feature (1)..( 7): Matrix.002 file - promoters60/1923750
attaaaa

SEQ ID NO: 53483 - DNA, 6 bp, Unknown
  misc_feature (1)..( 6): Matrix.002 file - promoters60/1923750
tattta

SEQ ID NO: 53484 - DNA, 7 bp, Unknown
  misc_feature (1)..( 7): Matrix.002 file - promoters60/1923750
gatattc

SEQ ID NO: 53485 - DNA, 6 bp, Unknown
  misc_feature (1)..( 6): Matrix.002 file - promoters60/1923750
aaaaca

SEQ ID NO: 53486 - DNA, 10 bp, Unknown
  misc_feature (1)..( 10): Matrix.002 file - promoters60/1923750
agaaaaaaaa

SEQ ID NO: 53487 - DNA, 6 bp, Unknown
  misc_feature (1)..( 6): Matrix.002 file - promoters60/1923750
ataata

SEQ ID NO: 53488 - DNA, 7 bp, Unknown
  misc_feature (1)..( 7): Matrix.002 file - promoters60/1923750
aaacaca

SEQ ID NO: 53489 - DNA, 7 bp, Unknown
  misc_feature (1)..( 7): Matrix.002 file - promoters60/1923750
actatag

SEQ ID NO: 53490 - DNA, 6 bp, Unknown
  misc_feature (1)..( 6): Matrix.002 file - promoters60/1923750
actata

SEQ ID NO: 53491 - DNA, 7 bp, Unknown
  misc_feature (1)..( 7): Matrix.002 file - promoters60/1923750
acagtta

SEQ ID NO: 53492 - DNA, 6 bp, Unknown
  misc_feature (1)..( 6): Matrix.002 file - promoters60/1923750
ttaatc

SEQ ID NO: 53493 - DNA, 8 bp, Unknown
  misc_feature (1)..( 8): Matrix.002 file - promoters60/1923750
tacaaaaa

SEQ ID NO: 53494 - DNA, 6 bp, Unknown
  misc_feature (1)..( 6): Matrix.002 file - promoters60/1923750
aattat

SEQ ID NO: 53495 - DNA, 7 bp, Unknown
  misc_feature (1)..( 7): Matrix.002 file - promoters60/1923750
taaacac

SEQ ID NO: 53496 - DNA, 6 bp, Unknown
  misc_feature (1)..( 6): Matrix.002 file - promoters60/1923750
caaaac

SEQ ID NO: 53497 - DNA, 8 bp, Unknown
  misc_feature (1)..( 8): Matrix.002 file - promoters60/1923750
tacaattt

SEQ ID NO: 53498 - DNA, 9 bp, Unknown
  misc_feature (1)..( 9): Matrix.002 file - promoters60/1923750
cagcttttt

SEQ ID NO: 53499 - DNA, 6 bp, Unknown
  misc_feature (1)..( 6): Matrix.002 file - promoters60/1923750
acaact

SEQ ID NO: 53500 - DNA, 7 bp, Unknown
  misc_feature (1)..( 7): Matrix.002 file - promoters60/1923750
tttctaa

SEQ ID NO: 53501 - DNA, 6 bp, Unknown
  misc_feature (1)..( 6): Matrix.002 file - promoters60/1923750
ctccaa

SEQ ID NO: 53502 - DNA, 7 bp, Unknown
  misc_feature (1)..( 7): Matrix.002 file - promoters60/1923750
tacaatt

SEQ ID NO: 53503 - DNA, 7 bp, Unknown
  misc_feature (1)..( 7): Matrix.002 file - promoters60/1923750
acataaa

SEQ ID NO: 53504 - DNA, 7 bp, Unknown
  misc_feature (1)..( 7): Matrix.002 file - promoters60/1923750
aaacttt

SEQ ID NO: 53505 - DNA, 6 bp, Unknown
  misc_feature (1)..( 6): Matrix.002 file - promoters60/1923750
taaata

SEQ ID NO: 53506 - DNA, 10 bp, Unknown
  misc_feature (1)..( 10): Matrix.002 file - promoters60/1957018
taatttggat

SEQ ID NO: 53507 - DNA, 15 bp, Unknown
  misc_feature (1)..( 15): Matrix.002 file - promoters60/1957018
ttttgaaaaaaaaaa

SEQ ID NO: 53508 - DNA, 8 bp, Unknown
  misc_feature (1)..( 8): Matrix.002 file - promoters60/1957018
attatcag

SEQ ID NO: 53509 - DNA, 9 bp, Unknown
  misc_feature (1)..( 9): Matrix.002 file - promoters60/1957018
agattctaa

SEQ ID NO: 53510 - DNA, 10 bp, Unknown
  misc_feature (1)..( 10): Matrix.002 file - promoters60/1957018
gattttttaa

SEQ ID NO: 53511 - DNA, 11 bp, Unknown
  misc_feature (1)..( 11): Matrix.002 file - promoters60/1957212
taaaaagacag

SEQ ID NO: 53512 - DNA, 9 bp, Unknown
  misc_feature (1)..( 9): Matrix.002 file - promoters60/1957296
aatgtagtt

SEQ ID NO: 53513 - DNA, 10 bp, Unknown
  misc_feature (1)..( 10): Matrix.002 file - promoters60/1957296
tctactactt

SEQ ID NO: 53514 - DNA, 6 bp, Unknown
  misc_feature (1)..( 6): Matrix.002 file - promoters60/1957296
aagaaa

SEQ ID NO: 53515 - DNA, 6 bp, Unknown
  misc_feature (1)..( 6): Matrix.002 file - promoters60/1957296
aattga

SEQ ID NO: 53516 - DNA, 7 bp, Unknown
  misc_feature (1)..( 7): Matrix.002 file - promoters60/1957296
gaaaatt

SEQ ID NO: 53517 - DNA, 6 bp, Unknown
  misc_feature (1)..( 6): Matrix.002 file - promoters60/1957296
tgtctt

SEQ ID NO: 53518 - DNA, 8 bp, Unknown
  misc_feature (1)..( 8): Matrix.002 file - promoters60/1957296
atcaatgt

SEQ ID NO: 53519 - DNA, 7 bp, Unknown
  misc_feature (1)..( 7): Matrix.002 file - promoters60/1957296
aatttat

SEQ ID NO: 53520 - DNA, 6 bp, Unknown
  misc_feature (1)..( 6): Matrix.002 file - promoters60/1957296
agaaca

SEQ ID NO: 53521 - DNA, 6 bp, Unknown
  misc_feature (1)..( 6): Matrix.002 file - promoters60/1957296
gatcaa

SEQ ID NO: 53522 - DNA, 6 bp, Unknown
  misc_feature (1)..( 6): Matrix.002 file - promoters60/1957296
ttaaaa

SEQ ID NO: 53523 - DNA, 6 bp, Unknown
  misc_feature (1)..( 6): Matrix.002 file - promoters60/1957296
aaaatt

SEQ ID NO: 53524 - DNA, 8 bp, Unknown
  misc_feature (1)..( 8): Matrix.002 file - promoters60/1957296
aatcaatt

SEQ ID NO: 53525 - DNA, 7 bp, Unknown
  misc_feature (1)..( 7): Matrix.002 file - promoters60/1957296
attaaat

SEQ ID NO: 53526 - DNA, 6 bp, Unknown
  misc_feature (1)..( 6): Matrix.002 file - promoters60/1957296
tataca

SEQ ID NO: 53527 - DNA, 7 bp, Unknown
  misc_feature (1)..( 7): Matrix.002 file - promoters60/1957303
aaaacga

SEQ ID NO: 53528 - DNA, 10 bp, Unknown
  misc_feature (1)..( 10): Matrix.002 file - promoters60/1957303
gaaaaaaaaa

SEQ ID NO: 53529 - DNA, 8 bp, Unknown
  misc_feature (1)..( 8): Matrix.002 file - promoters60/1957303
aaacgaaa

SEQ ID NO: 53530 - DNA, 8 bp, Unknown
  misc_feature (1)..( 8): Matrix.002 file - promoters60/1957303
gaagaaag

SEQ ID NO: 53531 - DNA, 12 bp, Unknown
  misc_feature (1)..( 12): Matrix.002 file - promoters60/1957303
agaagaaaatcg

SEQ ID NO: 53532 - DNA, 8 bp, Unknown
  misc_feature (1)..( 8): Matrix.002 file - promoters60/1957303
atttaaag

SEQ ID NO: 53533 - DNA, 8 bp, Unknown
  misc_feature (1)..( 8): Matrix.002 file - promoters60/1957303
ccaaatct

SEQ ID NO: 53534 - DNA, 8 bp, Unknown
  misc_feature (1)..( 8): Matrix.002 file - promoters60/1959878
tgtgtaaa

SEQ ID NO: 53535 - DNA, 8 bp, Unknown
  misc_feature (1)..( 8): Matrix.002 file - promoters60/1959878
acgtgatg

SEQ ID NO: 53536 - DNA, 6 bp, Unknown
  misc_feature (1)..( 6): Matrix.002 file - promoters60/1959878
atgggc

SEQ ID NO: 53537 - DNA, 6 bp, Unknown
  misc_feature (1)..( 6): Matrix.002 file - promoters60/1959878
ccaata

SEQ ID NO: 53538 - DNA, 10 bp, Unknown
  misc_feature (1)..( 10): Matrix.002 file - promoters60/1959878
ggtttatttt

SEQ ID NO: 53539 - DNA, 6 bp, Unknown
  misc_feature (1)..( 6): Matrix.002 file - promoters60/1959878
gatgtt

SEQ ID NO: 53540 - DNA, 7 bp, Unknown
  misc_feature (1)..( 7): Matrix.002 file - promoters60/1959878
tttaatt

SEQ ID NO: 53541 - DNA, 6 bp, Unknown
  misc_feature (1)..( 6): Matrix.002 file - promoters60/1959878
ttaaga

SEQ ID NO: 53542 - DNA, 6 bp, Unknown
  misc_feature (1)..( 6): Matrix.002 file - promoters60/1959878
gaaaag

SEQ ID NO: 53543 - DNA, 7 bp, Unknown
  misc_feature (1)..( 7): Matrix.002 file - promoters60/1959878
atgataa

SEQ ID NO: 53544 - DNA, 7 bp, Unknown
  misc_feature (1)..( 7): Matrix.002 file - promoters60/1959878
aacctgt

SEQ ID NO: 53545 - DNA, 8 bp, Unknown
  misc_feature (1)..( 8): Matrix.002 file - promoters60/1959878
ttgcatat

SEQ ID NO: 53546 - DNA, 8 bp, Unknown
  misc_feature (1)..( 8): Matrix.002 file - promoters60/1959878
tgttatgc

SEQ ID NO: 53547 - DNA, 7 bp, Unknown
  misc_feature (1)..( 7): Matrix.002 file - promoters60/1959878
ttgctaa

SEQ ID NO: 53548 - DNA, 6 bp, Unknown
  misc_feature (1)..( 6): Matrix.002 file - promoters60/1959878
ttcctt

SEQ ID NO: 53549 - DNA, 6 bp, Unknown
  misc_feature (1)..( 6): Matrix.002 file - promoters60/1959878
aagaga

SEQ ID NO: 53550 - DNA, 7 bp, Unknown
  misc_feature (1)..( 7): Matrix.002 file - promoters60/1959878
aagaaag

SEQ ID NO: 53551 - DNA, 7 bp, Unknown
  misc_feature (1)..( 7): Matrix.002 file - promoters60/1959904
tttgtgt

SEQ ID NO: 53552 - DNA, 10 bp, Unknown
  misc_feature (1)..( 10): Matrix.002 file - promoters60/1959904
tttacctttt

SEQ ID NO: 53553 - DNA, 6 bp, Unknown
  misc_feature (1)..( 6): Matrix.002 file - promoters60/1959904
caaatt

SEQ ID NO: 53554 - DNA, 7 bp, Unknown
  misc_feature (1)..( 7): Matrix.002 file - promoters60/1959904
ttagtca

SEQ ID NO: 53555 - DNA, 6 bp, Unknown
  misc_feature (1)..( 6): Matrix.002 file - promoters60/1959904
ttgatg

SEQ ID NO: 53556 - DNA, 8 bp, Unknown
  misc_feature (1)..( 8): Matrix.002 file - promoters60/1959904
ataaggcc

SEQ ID NO: 53557 - DNA, 8 bp, Unknown
  misc_feature (1)..( 8): Matrix.002 file - promoters60/1959904
atcatcaa

SEQ ID NO: 53558 - DNA, 7 bp, Unknown
  misc_feature (1)..( 7): Matrix.002 file - promoters60/1959904
tctgttt

SEQ ID NO: 53559 - DNA, 6 bp, Unknown
  misc_feature (1)..( 6): Matrix.002 file - promoters60/1959904
tttgtt

SEQ ID NO: 53560 - DNA, 6 bp, Unknown
  misc_feature (1)..( 6): Matrix.002 file - promoters60/1959904
attgtt

SEQ ID NO: 53561 - DNA, 7 bp, Unknown
  misc_feature (1)..( 7): Matrix.002 file - promoters60/1959904
ttttgtt

SEQ ID NO: 53562 - DNA, 8 bp, Unknown
  misc_feature (1)..( 8): Matrix.002 file - promoters60/1959904
ataatctt

SEQ ID NO: 53563 - DNA, 8 bp, Unknown
  misc_feature (1)..( 8): Matrix.002 file - promoters60/1959904
tgtgtaaa

SEQ ID NO: 53564 - DNA, 8 bp, Unknown
  misc_feature (1)..( 8): Matrix.002 file - promoters60/1959904
acgtgatg

SEQ ID NO: 53565 - DNA, 6 bp, Unknown
  misc_feature (1)..( 6): Matrix.002 file - promoters60/1959904
atgggc

SEQ ID NO: 53566 - DNA, 6 bp, Unknown
  misc_feature (1)..( 6): Matrix.002 file - promoters60/1959904
ccaata

SEQ ID NO: 53567 - DNA, 8 bp, Unknown
  misc_feature (1)..( 8): Matrix.002 file - promoters60/1959904
ggtttatt

SEQ ID NO: 53568 - DNA, 7 bp, Unknown
  misc_feature (1)..( 7): Matrix.002 file - promoters60/1959965
tatctta

SEQ ID NO: 53569 - DNA, 9 bp, Unknown
  misc_feature (1)..( 9): Matrix.002 file - promoters60/1959965
atataattt

SEQ ID NO: 53570 - DNA, 13 bp, Unknown
  misc_feature (1)..( 13): Matrix.002 file - promoters60/1959965
aaaattcatctaa

SEQ ID NO: 53571 - DNA, 6 bp, Unknown
  misc_feature (1)..( 6): Matrix.002 file - promoters60/1959965
tttcat

SEQ ID NO: 53572 - DNA, 7 bp, Unknown
  misc_feature (1)..( 7): Matrix.002 file - promoters60/1959965
agaaaaa

SEQ ID NO: 53573 - DNA, 7 bp, Unknown
  misc_feature (1)..( 7): Matrix.002 file - promoters60/1959965
ccatttt

SEQ ID NO: 53574 - DNA, 8 bp, Unknown
  misc_feature (1)..( 8): Matrix.002 file - promoters60/1959965
ttaaatat

SEQ ID NO: 53575 - DNA, 6 bp, Unknown
  misc_feature (1)..( 6): Matrix.002 file - promoters60/1959965
atgaat

SEQ ID NO: 53576 - DNA, 8 bp, Unknown
  misc_feature (1)..( 8): Matrix.002 file - promoters60/1959965
ttttcatt

SEQ ID NO: 53577 - DNA, 7 bp, Unknown
  misc_feature (1)..( 7): Matrix.002 file - promoters60/1959965
ttaggag

SEQ ID NO: 53578 - DNA, 7 bp, Unknown
  misc_feature (1)..( 7): Matrix.002 file - promoters60/1959965
tgaaacc

SEQ ID NO: 53579 - DNA, 7 bp, Unknown
  misc_feature (1)..( 7): Matrix.002 file - promoters60/1959965
tttactc

SEQ ID NO: 53580 - DNA, 7 bp, Unknown
  misc_feature (1)..( 7): Matrix.002 file - promoters60/1959965
tcctttt

SEQ ID NO: 53581 - DNA, 6 bp, Unknown
  misc_feature (1)..( 6): Matrix.002 file - promoters60/1959965
attttt

SEQ ID NO: 53582 - DNA, 6 bp, Unknown
  misc_feature (1)..( 6): Matrix.002 file - promoters60/1959965
agagat

SEQ ID NO: 53583 - DNA, 7 bp, Unknown
  misc_feature (1)..( 7): Matrix.002 file - promoters60/1959965
tatagtt

SEQ ID NO: 53584 - DNA, 7 bp, Unknown
  misc_feature (1)..( 7): Matrix.002 file - promoters60/1959965
tatatgt

SEQ ID NO: 53585 - DNA, 7 bp, Unknown
  misc_feature (1)..( 7): Matrix.002 file - promoters60/1959965
taagatt

SEQ ID NO: 53586 - DNA, 7 bp, Unknown
  misc_feature (1)..( 7): Matrix.002 file - promoters60/1959965
tggatat

SEQ ID NO: 53587 - DNA, 8 bp, Unknown
  misc_feature (1)..( 8): Matrix.002 file - promoters60/1959965
attgtttt

SEQ ID NO: 53588 - DNA, 8 bp, Unknown
  misc_feature (1)..( 8): Matrix.002 file - promoters60/1959977
gaagaaac

SEQ ID NO: 53589 - DNA, 11 bp, Unknown
  misc_feature (1)..( 11): Matrix.002 file - promoters60/1974282
atgacacaaat

SEQ ID NO: 53590 - DNA, 7 bp, Unknown
  misc_feature (1)..( 7): Matrix.002 file - promoters60/1974282
tttcaaa

SEQ ID NO: 53591 - DNA, 10 bp, Unknown
  misc_feature (1)..( 10): Matrix.002 file - promoters60/1974282
ttttatgttt

SEQ ID NO: 53592 - DNA, 10 bp, Unknown
  misc_feature (1)..( 10): Matrix.002 file - promoters60/1974282
attcaaaact

SEQ ID NO: 53593 - DNA, 10 bp, Unknown
  misc_feature (1)..( 10): Matrix.002 file - promoters60/1974282
aatttttgta

SEQ ID NO: 53594 - DNA, 9 bp, Unknown
  misc_feature (1)..( 9): Matrix.002 file - promoters60/1974501
aaataattt

SEQ ID NO: 53595 - DNA, 8 bp, Unknown
  misc_feature (1)..( 8): Matrix.002 file - promoters60/1974501
caaataat

SEQ ID NO: 53596 - DNA, 11 bp, Unknown
  misc_feature (1)..( 11): Matrix.002 file - promoters60/1974501
tcacaaataca

SEQ ID NO: 53597 - DNA, 7 bp, Unknown
  misc_feature (1)..( 7): Matrix.002 file - promoters60/1974501
actatag

SEQ ID NO: 53598 - DNA, 12 bp, Unknown
  misc_feature (1)..( 12): Matrix.002 file - promoters60/1974501
aatacaaattta

SEQ ID NO: 53599 - DNA, 10 bp, Unknown
  misc_feature (1)..( 10): Matrix.002 file - promoters60/1974501
atgtatttgt

SEQ ID NO: 53600 - DNA, 7 bp, Unknown
  misc_feature (1)..( 7): Matrix.002 file - promoters60/1975887
cttattg

SEQ ID NO: 53601 - DNA, 9 bp, Unknown
  misc_feature (1)..( 9): Matrix.002 file - promoters60/1975887
tttaattgc

SEQ ID NO: 53602 - DNA, 9 bp, Unknown
  misc_feature (1)..( 9): Matrix.002 file - promoters60/1975887
attgtaatt

SEQ ID NO: 53603 - DNA, 8 bp, Unknown
  misc_feature (1)..( 8): Matrix.002 file - promoters60/1975887
tatgtgtt

SEQ ID NO: 53604 - DNA, 8 bp, Unknown
  misc_feature (1)..( 8): Matrix.002 file - promoters60/1975887
ttattgta

SEQ ID NO: 53605 - DNA, 11 bp, Unknown
  misc_feature (1)..( 11): Matrix.002 file - promoters60/1975887
taaagttttga

SEQ ID NO: 53606 - DNA, 8 bp, Unknown
  misc_feature (1)..( 8): Matrix.002 file - promoters60/1975887
tatgaaaa

SEQ ID NO: 53607 - DNA, 7 bp, Unknown
  misc_feature (1)..( 7): Matrix.002 file - promoters60/1975887
gtatcaa

SEQ ID NO: 53608 - DNA, 9 bp, Unknown
  misc_feature (1)..( 9): Matrix.002 file - promoters60/1975887
agacagaag

SEQ ID NO: 53609 - DNA, 10 bp, Unknown
  misc_feature (1)..( 10): Matrix.002 file - promoters60/1975887
aaaggtttct

SEQ ID NO: 53610 - DNA, 6 bp, Unknown
  misc_feature (1)..( 6): Matrix.002 file - promoters60/1975895
atataa

SEQ ID NO: 53611 - DNA, 6 bp, Unknown
  misc_feature (1)..( 6): Matrix.002 file - promoters60/1975895
catgat

SEQ ID NO: 53612 - DNA, 6 bp, Unknown
  misc_feature (1)..( 6): Matrix.002 file - promoters60/1975895
actata

SEQ ID NO: 53613 - DNA, 7 bp, Unknown
  misc_feature (1)..( 7): Matrix.002 file - promoters60/1975895
attcacg

SEQ ID NO: 53614 - DNA, 9 bp, Unknown
  misc_feature (1)..( 9): Matrix.002 file - promoters60/1975895
aaaaataaa

SEQ ID NO: 53615 - DNA, 6 bp, Unknown
  misc_feature (1)..( 6): Matrix.002 file - promoters60/1975895
acgaat

SEQ ID NO: 53616 - DNA, 8 bp, Unknown
  misc_feature (1)..( 8): Matrix.002 file - promoters60/1975895
atgtacaa

SEQ ID NO: 53617 - DNA, 7 bp, Unknown
  misc_feature (1)..( 7): Matrix.002 file - promoters60/1975895
acaagaa

SEQ ID NO: 53618 - DNA, 6 bp, Unknown
  misc_feature (1)..( 6): Matrix.002 file - promoters60/1975895
taattt

SEQ ID NO: 53619 - DNA, 10 bp, Unknown
  misc_feature (1)..( 10): Matrix.002 file - promoters60/1975895
ataaaagctt

SEQ ID NO: 53620 - DNA, 8 bp, Unknown
  misc_feature (1)..( 8): Matrix.002 file - promoters60/1975895
catcgtct

SEQ ID NO: 53621 - DNA, 6 bp, Unknown
  misc_feature (1)..( 6): Matrix.002 file - promoters60/1975895
tctaac

SEQ ID NO: 53622 - DNA, 9 bp, Unknown
  misc_feature (1)..( 9): Matrix.002 file - promoters60/1975895
ttttcagct

SEQ ID NO: 53623 - DNA, 7 bp, Unknown
  misc_feature (1)..( 7): Matrix.002 file - promoters60/1975923
atacaaa

SEQ ID NO: 53624 - DNA, 11 bp, Unknown
  misc_feature (1)..( 11): Matrix.002 file - promoters60/1975923
gatttaaaatg

SEQ ID NO: 53625 - DNA, 10 bp, Unknown
  misc_feature (1)..( 10): Matrix.002 file - promoters60/1975923
ttaataaaat

SEQ ID NO: 53626 - DNA, 10 bp, Unknown
  misc_feature (1)..( 10): Matrix.002 file - promoters60/1975923
aaaattaatt

SEQ ID NO: 53627 - DNA, 10 bp, Unknown
  misc_feature (1)..( 10): Matrix.002 file - promoters60/1975923
aaatttataa

SEQ ID NO: 53628 - DNA, 17 bp, Unknown
  misc_feature (1)..( 17): Matrix.002 file - promoters60/1975940
aaaacaaaccaaaaaca

SEQ ID NO: 53629 - DNA, 14 bp, Unknown
  misc_feature (1)..( 14): Matrix.002 file - promoters60/1975940
agattttgtatata

SEQ ID NO: 53630 - DNA, 10 bp, Unknown
  misc_feature (1)..( 10): Matrix.002 file - promoters60/1975940
aattttattt

SEQ ID NO: 53631 - DNA, 12 bp, Unknown
  misc_feature (1)..( 12): Matrix.002 file - promoters60/1975956
tagaattactaa

SEQ ID NO: 53632 - DNA, 7 bp, Unknown
  misc_feature (1)..( 7): Matrix.002 file - promoters60/1975956
taataat

SEQ ID NO: 53633 - DNA, 6 bp, Unknown
  misc_feature (1)..( 6): Matrix.002 file - promoters60/1975956
aatttt

SEQ ID NO: 53634 - DNA, 14 bp, Unknown
  misc_feature (1)..( 14): Matrix.002 file - promoters60/1975956
ttgaatcaatattt

SEQ ID NO: 53635 - DNA, 7 bp, Unknown
  misc_feature (1)..( 7): Matrix.002 file - promoters60/1975956
tatacaa

SEQ ID NO: 53636 - DNA, 11 bp, Unknown
  misc_feature (1)..( 11): Matrix.002 file - promoters60/1975956
ttttctaaaat

SEQ ID NO: 53637 - DNA, 7 bp, Unknown
  misc_feature (1)..( 7): Matrix.002 file - promoters60/1975956
tataatt

SEQ ID NO: 53638 - DNA, 8 bp, Unknown
  misc_feature (1)..( 8): Matrix.002 file - promoters60/1975956
tgaaaaaa

SEQ ID NO: 53639 - DNA, 9 bp, Unknown
  misc_feature (1)..( 9): Matrix.002 file - promoters60/1975956
taaatttct

SEQ ID NO: 53640 - DNA, 7 bp, Unknown
  misc_feature (1)..( 7): Matrix.002 file - promoters60/1975956
aagagaa

SEQ ID NO: 53641 - DNA, 8 bp, Unknown
  misc_feature (1)..( 8): Matrix.002 file - promoters60/1975956
atggcttg

SEQ ID NO: 53642 - DNA, 7 bp, Unknown
  misc_feature (1)..( 7): Matrix.002 file - promoters60/1975956
tggattt

SEQ ID NO: 53643 - DNA, 6 bp, Unknown
  misc_feature (1)..( 6): Matrix.002 file - promoters60/1975956
aagatt

SEQ ID NO: 53644 - DNA, 6 bp, Unknown
  misc_feature (1)..( 6): Matrix.002 file - promoters60/1975956
ttggtt

SEQ ID NO: 53645 - DNA, 6 bp, Unknown
  misc_feature (1)..( 6): Matrix.002 file - promoters60/1975956
ttaacc

SEQ ID NO: 53646 - DNA, 7 bp, Unknown
  misc_feature (1)..( 7): Matrix.002 file - promoters60/1975956
ctcactc

SEQ ID NO: 53647 - DNA, 6 bp, Unknown
  misc_feature (1)..( 6): Matrix.002 file - promoters60/1975956
ataatt

SEQ ID NO: 53648 - DNA, 8 bp, Unknown
  misc_feature (1)..( 8): Matrix.002 file - promoters60/1975956
gaaatata

SEQ ID NO: 53649 - DNA, 6 bp, Unknown
  misc_feature (1)..( 6): Matrix.002 file - promoters60/1975956
ttatcc

SEQ ID NO: 53650 - DNA, 6 bp, Unknown
  misc_feature (1)..( 6): Matrix.002 file - promoters60/1975956
atttaa

SEQ ID NO: 53651 - DNA, 9 bp, Unknown
  misc_feature (1)..( 9): Matrix.002 file - promoters60/1976000
aaaacaatt

SEQ ID NO: 53652 - DNA, 7 bp, Unknown
  misc_feature (1)..( 7): Matrix.002 file - promoters60/1976000
aaaaata

SEQ ID NO: 53653 - DNA, 6 bp, Unknown
  misc_feature (1)..( 6): Matrix.002 file - promoters60/1976000
tgacaa

SEQ ID NO: 53654 - DNA, 7 bp, Unknown
  misc_feature (1)..( 7): Matrix.002 file - promoters60/1976000
attacaa

SEQ ID NO: 53655 - DNA, 6 bp, Unknown
  misc_feature (1)..( 6): Matrix.002 file - promoters60/1976000
taatta

SEQ ID NO: 53656 - DNA, 7 bp, Unknown
  misc_feature (1)..( 7): Matrix.002 file - promoters60/1976000
tctactg

SEQ ID NO: 53657 - DNA, 6 bp, Unknown
  misc_feature (1)..( 6): Matrix.002 file - promoters60/1976000
aaattg

SEQ ID NO: 53658 - DNA, 6 bp, Unknown
  misc_feature (1)..( 6): Matrix.002 file - promoters60/1976000
ccctat

SEQ ID NO: 53659 - DNA, 7 bp, Unknown
  misc_feature (1)..( 7): Matrix.002 file - promoters60/1976000
ctaaaat

SEQ ID NO: 53660 - DNA, 7 bp, Unknown
  misc_feature (1)..( 7): Matrix.002 file - promoters60/1976000
ttttgtt

SEQ ID NO: 53661 - DNA, 7 bp, Unknown
  misc_feature (1)..( 7): Matrix.002 file - promoters60/1976000
ttagtaa

SEQ ID NO: 53662 - DNA, 7 bp, Unknown
  misc_feature (1)..( 7): Matrix.002 file - promoters60/1976000
tctgttc

SEQ ID NO: 53663 - DNA, 6 bp, Unknown
  misc_feature (1)..( 6): Matrix.002 file - promoters60/1976000
aataat

SEQ ID NO: 53664 - DNA, 7 bp, Unknown
  misc_feature (1)..( 7): Matrix.002 file - promoters60/1976008
caaaaaa

SEQ ID NO: 53665 - DNA, 8 bp, Unknown
  misc_feature (1)..( 8): Matrix.002 file - promoters60/1976008
cggagaat

SEQ ID NO: 53666 - DNA, 8 bp, Unknown
  misc_feature (1)..( 8): Matrix.002 file - promoters60/1976008
aatcagaa

SEQ ID NO: 53667 - DNA, 11 bp, Unknown
  misc_feature (1)..( 11): Matrix.002 file - promoters60/1976008
ttcagatctca

SEQ ID NO: 53668 - DNA, 7 bp, Unknown
  misc_feature (1)..( 7): Matrix.002 file - promoters60/1976008
caaaaac

SEQ ID NO: 53669 - DNA, 9 bp, Unknown
  misc_feature (1)..( 9): Matrix.002 file - promoters60/1976008
atatcaaat

SEQ ID NO: 53670 - DNA, 9 bp, Unknown
  misc_feature (1)..( 9): Matrix.002 file - promoters60/1976008
tggaaaatt

SEQ ID NO: 53671 - DNA, 11 bp, Unknown
  misc_feature (1)..( 11): Matrix.002 file - promoters60/1976019
actaaaaaagt

SEQ ID NO: 53672 - DNA, 13 bp, Unknown
  misc_feature (1)..( 13): Matrix.002 file - promoters60/1976019
agaataaaaaaaa

SEQ ID NO: 53673 - DNA, 9 bp, Unknown
  misc_feature (1)..( 9): Matrix.002 file - promoters60/1976019
aattcagaa

SEQ ID NO: 53674 - DNA, 10 bp, Unknown
  misc_feature (1)..( 10): Matrix.002 file - promoters60/1976078
ataaaaaaag

SEQ ID NO: 53675 - DNA, 6 bp, Unknown
  misc_feature (1)..( 6): Matrix.002 file - promoters60/1976158
aataat

SEQ ID NO: 53676 - DNA, 7 bp, Unknown
  misc_feature (1)..( 7): Matrix.002 file - promoters60/1976158
tacatat

SEQ ID NO: 53677 - DNA, 12 bp, Unknown
  misc_feature (1)..( 12): Matrix.002 file - promoters60/1976158
aatttatttact

SEQ ID NO: 53678 - DNA, 6 bp, Unknown
  misc_feature (1)..( 6): Matrix.002 file - promoters60/1976158
atgatt

SEQ ID NO: 53679 - DNA, 7 bp, Unknown
  misc_feature (1)..( 7): Matrix.002 file - promoters60/1976158
tgtaatt

SEQ ID NO: 53680 - DNA, 6 bp, Unknown
  misc_feature (1)..( 6): Matrix.002 file - promoters60/1976158
gagata

SEQ ID NO: 53681 - DNA, 6 bp, Unknown
  misc_feature (1)..( 6): Matrix.002 file - promoters60/1976158
caacaa

SEQ ID NO: 53682 - DNA, 10 bp, Unknown
  misc_feature (1)..( 10): Matrix.002 file - promoters60/1976158
ttaatcaaaa

SEQ ID NO: 53683 - DNA, 6 bp, Unknown
  misc_feature (1)..( 6): Matrix.002 file - promoters60/1976158
tcaatt

SEQ ID NO: 53684 - DNA, 10 bp, Unknown
  misc_feature (1)..( 10): Matrix.002 file - promoters60/1976158
aatatacttt

SEQ ID NO: 53685 - DNA, 8 bp, Unknown
  misc_feature (1)..( 8): Matrix.002 file - promoters60/1976158
tcaagttt

SEQ ID NO: 53686 - DNA, 6 bp, Unknown
  misc_feature (1)..( 6): Matrix.002 file - promoters60/1976158
tttaca

SEQ ID NO: 53687 - DNA, 7 bp, Unknown
  misc_feature (1)..( 7): Matrix.002 file - promoters60/1976158
aacaaca

SEQ ID NO: 53688 - DNA, 8 bp, Unknown
  misc_feature (1)..( 8): Matrix.002 file - promoters60/1976158
aaaattat

SEQ ID NO: 53689 - DNA, 6 bp, Unknown
  misc_feature (1)..( 6): Matrix.002 file - promoters60/1976158
ttttgt

SEQ ID NO: 53690 - DNA, 7 bp, Unknown
  misc_feature (1)..( 7): Matrix.002 file - promoters60/1976158
ttagaat

SEQ ID NO: 53691 - DNA, 7 bp, Unknown
  misc_feature (1)..( 7): Matrix.002 file - promoters60/1976158
tttctta

SEQ ID NO: 53692 - DNA, 7 bp, Unknown
  misc_feature (1)..( 7): Matrix.002 file - promoters60/1976158
taatcaa

SEQ ID NO: 53693 - DNA, 8 bp, Unknown
  misc_feature (1)..( 8): Matrix.002 file - promoters60/1976158
agaaaaaa

SEQ ID NO: 53694 - DNA, 11 bp, Unknown
  misc_feature (1)..( 11): Matrix.002 file - promoters60/1976158
caattttctat

SEQ ID NO: 53695 - DNA, 6 bp, Unknown
  misc_feature (1)..( 6): Matrix.002 file - promoters60/1976158
gaaaca

SEQ ID NO: 53696 - DNA, 6 bp, Unknown
  misc_feature (1)..( 6): Matrix.002 file - promoters60/1976158
aataaa

SEQ ID NO: 53697 - DNA, 8 bp, Unknown
  misc_feature (1)..( 8): Matrix.002 file - promoters60/1976158
aaagaaaa

SEQ ID NO: 53698 - DNA, 7 bp, Unknown
  misc_feature (1)..( 7): Matrix.002 file - promoters60/1976158
aaaatca

SEQ ID NO: 53699 - DNA, 6 bp, Unknown
  misc_feature (1)..( 6): Matrix.002 file - promoters60/1976158
taaata

SEQ ID NO: 53700 - DNA, 10 bp, Unknown
  misc_feature (1)..( 10): Matrix.002 file - promoters60/1976170
agagatactt

SEQ ID NO: 53701 - DNA, 6 bp, Unknown
  misc_feature (1)..( 6): Matrix.002 file - promoters60/1976170
tttaac

SEQ ID NO: 53702 - DNA, 6 bp, Unknown
  misc_feature (1)..( 6): Matrix.002 file - promoters60/1976170
aatata

SEQ ID NO: 53703 - DNA, 6 bp, Unknown
  misc_feature (1)..( 6): Matrix.002 file - promoters60/1976170
ggaaaa

SEQ ID NO: 53704 - DNA, 7 bp, Unknown
  misc_feature (1)..( 7): Matrix.002 file - promoters60/1976170
gacaagg

SEQ ID NO: 53705 - DNA, 8 bp, Unknown
  misc_feature (1)..( 8): Matrix.002 file - promoters60/1976170
ttttactt

SEQ ID NO: 53706 - DNA, 9 bp, Unknown
  misc_feature (1)..( 9): Matrix.002 file - promoters60/1976170
aatatgtaa

SEQ ID NO: 53707 - DNA, 9 bp, Unknown
  misc_feature (1)..( 9): Matrix.002 file - promoters60/1976170
aaacaaaaa

SEQ ID NO: 53708 - DNA, 11 bp, Unknown
  misc_feature (1)..( 11): Matrix.002 file - promoters60/1976174
tgattaaataa

SEQ ID NO: 53709 - DNA, 10 bp, Unknown
  misc_feature (1)..( 10): Matrix.002 file - promoters60/1976226
gaaaattata

SEQ ID NO: 53710 - DNA, 13 bp, Unknown
  misc_feature (1)..( 13): Matrix.002 file - promoters60/1976333
taaaagtttgtta

SEQ ID NO: 53711 - DNA, 14 bp, Unknown
  misc_feature (1)..( 14): Matrix.002 file - promoters60/1976333
acaaaaattcaatt

SEQ ID NO: 53712 - DNA, 18 bp, Unknown
  misc_feature (1)..( 18): Matrix.002 file - promoters60/1976333
aataaagattcaataatt

SEQ ID NO: 53713 - DNA, 8 bp, Unknown
  misc_feature (1)..( 8): Matrix.002 file - promoters60/1976333
aaaatttc

SEQ ID NO: 53714 - DNA, 9 bp, Unknown
  misc_feature (1)..( 9): Matrix.002 file - promoters60/1976336
atactaaaa

SEQ ID NO: 53715 - DNA, 8 bp, Unknown
  misc_feature (1)..( 8): Matrix.002 file - promoters60/1976336
cacaaagt

SEQ ID NO: 53716 - DNA, 8 bp, Unknown
  misc_feature (1)..( 8): Matrix.002 file - promoters60/1976336
tacacaaa

SEQ ID NO: 53717 - DNA, 9 bp, Unknown
  misc_feature (1)..( 9): Matrix.002 file - promoters60/1976354
acaataaaa

SEQ ID NO: 53718 - DNA, 9 bp, Unknown
  misc_feature (1)..( 9): Matrix.002 file - promoters60/1976354
gtcacaaaa

SEQ ID NO: 53719 - DNA, 9 bp, Unknown
  misc_feature (1)..( 9): Matrix.002 file - promoters60/1976354
tcaaaaaaa

SEQ ID NO: 53720 - DNA, 9 bp, Unknown
  misc_feature (1)..( 9): Matrix.002 file - promoters60/1976354
ctaaaaata

SEQ ID NO: 53721 - DNA, 11 bp, Unknown
  misc_feature (1)..( 11): Matrix.002 file - promoters60/1976354
aatttttagca

SEQ ID NO: 53722 - DNA, 9 bp, Unknown
  misc_feature (1)..( 9): Matrix.002 file - promoters60/1976354
aacaaaatc

SEQ ID NO: 53723 - DNA, 13 bp, Unknown
  misc_feature (1)..( 13): Matrix.002 file - promoters60/1976354
tttgattagtatc

SEQ ID NO: 53724 - DNA, 13 bp, Unknown
  misc_feature (1)..( 13): Matrix.002 file - promoters60/1976381
attcaaaaaagct

SEQ ID NO: 53725 - DNA, 11 bp, Unknown
  misc_feature (1)..( 11): Matrix.002 file - promoters60/1976381
tgcataaaaga

SEQ ID NO: 53726 - DNA, 7 bp, Unknown
  misc_feature (1)..( 7): Matrix.002 file - promoters60/1976419
attagtt

SEQ ID NO: 53727 - DNA, 8 bp, Unknown
  misc_feature (1)..( 8): Matrix.002 file - promoters60/1976419
tataaaaa

SEQ ID NO: 53728 - DNA, 7 bp, Unknown
  misc_feature (1)..( 7): Matrix.002 file - promoters60/1976419
agacatt

SEQ ID NO: 53729 - DNA, 6 bp, Unknown
  misc_feature (1)..( 6): Matrix.002 file - promoters60/1976419
actttt

SEQ ID NO: 53730 - DNA, 7 bp, Unknown
  misc_feature (1)..( 7): Matrix.002 file - promoters60/1976419
acacgat

SEQ ID NO: 53731 - DNA, 6 bp, Unknown
  misc_feature (1)..( 6): Matrix.002 file - promoters60/1976419
cgaaaa

SEQ ID NO: 53732 - DNA, 9 bp, Unknown
  misc_feature (1)..( 9): Matrix.002 file - promoters60/1976419
ccaaaagta

SEQ ID NO: 53733 - DNA, 8 bp, Unknown
  misc_feature (1)..( 8): Matrix.002 file - promoters60/1976419
tcctacct

SEQ ID NO: 53734 - DNA, 8 bp, Unknown
  misc_feature (1)..( 8): Matrix.002 file - promoters60/1976419
atatatta

SEQ ID NO: 53735 - DNA, 6 bp, Unknown
  misc_feature (1)..( 6): Matrix.002 file - promoters60/1976419
tttata

SEQ ID NO: 53736 - DNA, 7 bp, Unknown
  misc_feature (1)..( 7): Matrix.002 file - promoters60/1976419
aatacac

SEQ ID NO: 53737 - DNA, 7 bp, Unknown
  misc_feature (1)..( 7): Matrix.002 file - promoters60/1976419
tacctaa

SEQ ID NO: 53738 - DNA, 8 bp, Unknown
  misc_feature (1)..( 8): Matrix.002 file - promoters60/1976419
tgaagtaa

SEQ ID NO: 53739 - DNA, 8 bp, Unknown
  misc_feature (1)..( 8): Matrix.002 file - promoters60/1976419
ggttcatt

SEQ ID NO: 53740 - DNA, 6 bp, Unknown
  misc_feature (1)..( 6): Matrix.002 file - promoters60/1976419
agaata

SEQ ID NO: 53741 - DNA, 6 bp, Unknown
  misc_feature (1)..( 6): Matrix.002 file - promoters60/1976419
gctatg

SEQ ID NO: 53742 - DNA, 6 bp, Unknown
  misc_feature (1)..( 6): Matrix.002 file - promoters60/1976419
tgatcc

SEQ ID NO: 53743 - DNA, 10 bp, Unknown
  misc_feature (1)..( 10): Matrix.002 file - promoters60/1976457
ataaataaaa

SEQ ID NO: 53744 - DNA, 8 bp, Unknown
  misc_feature (1)..( 8): Matrix.002 file - promoters60/1976457
aaaagttt

SEQ ID NO: 53745 - DNA, 11 bp, Unknown
  misc_feature (1)..( 11): Matrix.002 file - promoters60/1976457
taaaaaaatat

SEQ ID NO: 53746 - DNA, 11 bp, Unknown
  misc_feature (1)..( 11): Matrix.002 file - promoters60/1976457
ttatttgataa

SEQ ID NO: 53747 - DNA, 7 bp, Unknown
  misc_feature (1)..( 7): Matrix.002 file - promoters60/1976457
aataata

SEQ ID NO: 53748 - DNA, 9 bp, Unknown
  misc_feature (1)..( 9): Matrix.002 file - promoters60/1976457
aaatcatta

SEQ ID NO: 53749 - DNA, 9 bp, Unknown
  misc_feature (1)..( 9): Matrix.002 file - promoters60/1976504
aaataacaa

SEQ ID NO: 53750 - DNA, 8 bp, Unknown
  misc_feature (1)..( 8): Matrix.002 file - promoters60/1976511
tcttctct

SEQ ID NO: 53751 - DNA, 10 bp, Unknown
  misc_feature (1)..( 10): Matrix.002 file - promoters60/1976511
tttttgatta

SEQ ID NO: 53752 - DNA, 6 bp, Unknown
  misc_feature (1)..( 6): Matrix.002 file - promoters60/1976550
tagcct

SEQ ID NO: 53753 - DNA, 7 bp, Unknown
  misc_feature (1)..( 7): Matrix.002 file - promoters60/1976550
ttagttg

SEQ ID NO: 53754 - DNA, 8 bp, Unknown
  misc_feature (1)..( 8): Matrix.002 file - promoters60/1976550
aaataaaa

SEQ ID NO: 53755 - DNA, 7 bp, Unknown
  misc_feature (1)..( 7): Matrix.002 file - promoters60/1976550
tgtaaaa

SEQ ID NO: 53756 - DNA, 6 bp, Unknown
  misc_feature (1)..( 6): Matrix.002 file - promoters60/1976550
aaaatt

SEQ ID NO: 53757 - DNA, 7 bp, Unknown
  misc_feature (1)..( 7): Matrix.002 file - promoters60/1976550
tcccaat

SEQ ID NO: 53758 - DNA, 7 bp, Unknown
  misc_feature (1)..( 7): Matrix.002 file - promoters60/1976550
aaaatca

SEQ ID NO: 53759 - DNA, 8 bp, Unknown
  misc_feature (1)..( 8): Matrix.002 file - promoters60/1976550
ttgcttaa

SEQ ID NO: 53760 - DNA, 9 bp, Unknown
  misc_feature (1)..( 9): Matrix.002 file - promoters60/1976550
ttaaaattt

SEQ ID NO: 53761 - DNA, 6 bp, Unknown
  misc_feature (1)..( 6): Matrix.002 file - promoters60/1976550
aaagtc

SEQ ID NO: 53762 - DNA, 7 bp, Unknown
  misc_feature (1)..( 7): Matrix.002 file - promoters60/1976550
gataaaa

SEQ ID NO: 53763 - DNA, 7 bp, Unknown
  misc_feature (1)..( 7): Matrix.002 file - promoters60/1976550
tttttgt

SEQ ID NO: 53764 - DNA, 10 bp, Unknown
  misc_feature (1)..( 10): Matrix.002 file - promoters60/1976550
taatctgatc

SEQ ID NO: 53765 - DNA, 7 bp, Unknown
  misc_feature (1)..( 7): Matrix.002 file - promoters60/1976550
gtttgca

SEQ ID NO: 53766 - DNA, 9 bp, Unknown
  misc_feature (1)..( 9): Matrix.002 file - promoters60/1976550
taagcaaaa

SEQ ID NO: 53767 - DNA, 6 bp, Unknown
  misc_feature (1)..( 6): Matrix.002 file - promoters60/1976550
ctaaaa

SEQ ID NO: 53768 - DNA, 9 bp, Unknown
  misc_feature (1)..( 9): Matrix.002 file - promoters60/1976550
attgattta

SEQ ID NO: 53769 - DNA, 7 bp, Unknown
  misc_feature (1)..( 7): Matrix.002 file - promoters60/1976550
tgataaa

SEQ ID NO: 53770 - DNA, 7 bp, Unknown
  misc_feature (1)..( 7): Matrix.002 file - promoters60/1977519
taaaaat

SEQ ID NO: 53771 - DNA, 8 bp, Unknown
  misc_feature (1)..( 8): Matrix.002 file - promoters60/1977519
tattgttg

SEQ ID NO: 53772 - DNA, 10 bp, Unknown
  misc_feature (1)..( 10): Matrix.002 file - promoters60/1977519
ttgaatcaat

SEQ ID NO: 53773 - DNA, 9 bp, Unknown
  misc_feature (1)..( 9): Matrix.002 file - promoters60/1977519
gatttggtt

SEQ ID NO: 53774 - DNA, 6 bp, Unknown
  misc_feature (1)..( 6): Matrix.002 file - promoters60/1977519
agagaa

SEQ ID NO: 53775 - DNA, 6 bp, Unknown
  misc_feature (1)..( 6): Matrix.002 file - promoters60/1977519
aattat

SEQ ID NO: 53776 - DNA, 6 bp, Unknown
  misc_feature (1)..( 6): Matrix.002 file - promoters60/1977519
taaatt

SEQ ID NO: 53777 - DNA, 7 bp, Unknown
  misc_feature (1)..( 7): Matrix.002 file - promoters60/1977519
cctacaa

SEQ ID NO: 53778 - DNA, 6 bp, Unknown
  misc_feature (1)..( 6): Matrix.002 file - promoters60/1977519
aaccta

SEQ ID NO: 53779 - DNA, 6 bp, Unknown
  misc_feature (1)..( 6): Matrix.002 file - promoters60/1977519
attttg

SEQ ID NO: 53780 - DNA, 6 bp, Unknown
  misc_feature (1)..( 6): Matrix.002 file - promoters60/1977519
tgatat

SEQ ID NO: 53781 - DNA, 7 bp, Unknown
  misc_feature (1)..( 7): Matrix.002 file - promoters60/1977519
tggattt

SEQ ID NO: 53782 - DNA, 6 bp, Unknown
  misc_feature (1)..( 6): Matrix.002 file - promoters60/1977519
aagatt

SEQ ID NO: 53783 - DNA, 6 bp, Unknown
  misc_feature (1)..( 6): Matrix.002 file - promoters60/1977519
ttaacc

SEQ ID NO: 53784 - DNA, 7 bp, Unknown
  misc_feature (1)..( 7): Matrix.002 file - promoters60/1977519
ctcactc

SEQ ID NO: 53785 - DNA, 6 bp, Unknown
  misc_feature (1)..( 6): Matrix.002 file - promoters60/1977519
atttct

SEQ ID NO: 53786 - DNA, 10 bp, Unknown
  misc_feature (1)..( 10): Matrix.002 file - promoters60/1977533
aaaaatatac

SEQ ID NO: 53787 - DNA, 11 bp, Unknown
  misc_feature (1)..( 11): Matrix.002 file - promoters60/1977533
tttattctgaa

SEQ ID NO: 53788 - DNA, 8 bp, Unknown
  misc_feature (1)..( 8): Matrix.002 file - promoters60/1977533
ggattttg

SEQ ID NO: 53789 - DNA, 8 bp, Unknown
  misc_feature (1)..( 8): Matrix.002 file - promoters60/1977533
ttaacaaa

SEQ ID NO: 53790 - DNA, 10 bp, Unknown
  misc_feature (1)..( 10): Matrix.002 file - promoters60/1977537
tttctctctt

SEQ ID NO: 53791 - DNA, 7 bp, Unknown
  misc_feature (1)..( 7): Matrix.002 file - promoters60/1977537
aaatatt

SEQ ID NO: 53792 - DNA, 12 bp, Unknown
  misc_feature (1)..( 12): Matrix.002 file - promoters60/1977537
taaatattcggc

SEQ ID NO: 53793 - DNA, 7 bp, Unknown
  misc_feature (1)..( 7): Matrix.002 file - promoters60/1977537
tttccca

SEQ ID NO: 53794 - DNA, 7 bp, Unknown
  misc_feature (1)..( 7): Matrix.002 file - promoters60/1977537
gcaaatt

SEQ ID NO: 53795 - DNA, 6 bp, Unknown
  misc_feature (1)..( 6): Matrix.002 file - promoters60/1977537
tttgat

SEQ ID NO: 53796 - DNA, 8 bp, Unknown
  misc_feature (1)..( 8): Matrix.002 file - promoters60/1977537
ttttcatc

SEQ ID NO: 53797 - DNA, 9 bp, Unknown
  misc_feature (1)..( 9): Matrix.002 file - promoters60/1977537
gattttttt

SEQ ID NO: 53798 - DNA, 6 bp, Unknown
  misc_feature (1)..( 6): Matrix.002 file - promoters60/1977537
tgttat

SEQ ID NO: 53799 - DNA, 8 bp, Unknown
  misc_feature (1)..( 8): Matrix.002 file - promoters60/1977537
tgtatgtt

SEQ ID NO: 53800 - DNA, 6 bp, Unknown
  misc_feature (1)..( 6): Matrix.002 file - promoters60/1977537
ctctta

SEQ ID NO: 53801 - DNA, 6 bp, Unknown
  misc_feature (1)..( 6): Matrix.002 file - promoters60/1977537
atttaa

SEQ ID NO: 53802 - DNA, 6 bp, Unknown
  misc_feature (1)..( 6): Matrix.002 file - promoters60/1977537
aaattt

SEQ ID NO: 53803 - DNA, 7 bp, Unknown
  misc_feature (1)..( 7): Matrix.002 file - promoters60/1977537
attgggc

SEQ ID NO: 53804 - DNA, 6 bp, Unknown
  misc_feature (1)..( 6): Matrix.002 file - promoters60/1977537
gattga

SEQ ID NO: 53805 - DNA, 7 bp, Unknown
  misc_feature (1)..( 7): Matrix.002 file - promoters60/1977537
taactta

SEQ ID NO: 53806 - DNA, 7 bp, Unknown
  misc_feature (1)..( 7): Matrix.002 file - promoters60/1985373
aaagttc

SEQ ID NO: 53807 - DNA, 8 bp, Unknown
  misc_feature (1)..( 8): Matrix.002 file - promoters60/1985373
cttttttt

SEQ ID NO: 53808 - DNA, 11 bp, Unknown
  misc_feature (1)..( 11): Matrix.002 file - promoters60/1985373
ttataaagtat

SEQ ID NO: 53809 - DNA, 13 bp, Unknown
  misc_feature (1)..( 13): Matrix.002 file - promoters60/1985373
atgtttaatttac

SEQ ID NO: 53810 - DNA, 12 bp, Unknown
  misc_feature (1)..( 12): Matrix.002 file - promoters60/1985373
aatacaacttat

SEQ ID NO: 53811 - DNA, 6 bp, Unknown
  misc_feature (1)..( 6): Matrix.002 file - promoters60/1985373
ttatat

SEQ ID NO: 53812 - DNA, 7 bp, Unknown
  misc_feature (1)..( 7): Matrix.002 file - promoters60/1985373
gttcgtt

SEQ ID NO: 53813 - DNA, 9 bp, Unknown
  misc_feature (1)..( 9): Matrix.002 file - promoters60/1985373
ttgaaatac

SEQ ID NO: 53814 - DNA, 6 bp, Unknown
  misc_feature (1)..( 6): Matrix.002 file - promoters60/1985373
tatggc

SEQ ID NO: 53815 - DNA, 7 bp, Unknown
  misc_feature (1)..( 7): Matrix.002 file - promoters60/1985373
acccaaa

SEQ ID NO: 53816 - DNA, 6 bp, Unknown
  misc_feature (1)..( 6): Matrix.002 file - promoters60/1985373
tctaaa

SEQ ID NO: 53817 - DNA, 6 bp, Unknown
  misc_feature (1)..( 6): Matrix.002 file - promoters60/1985373
aaactt

SEQ ID NO: 53818 - DNA, 6 bp, Unknown
  misc_feature (1)..( 6): Matrix.002 file - promoters60/1985373
ttcaaa

SEQ ID NO: 53819 - DNA, 6 bp, Unknown
  misc_feature (1)..( 6): Matrix.002 file - promoters60/1985373
ttcatt

SEQ ID NO: 53820 - DNA, 6 bp, Unknown
  misc_feature (1)..( 6): Matrix.002 file - promoters60/1985373
aataat

SEQ ID NO: 53821 - DNA, 8 bp, Unknown
  misc_feature (1)..( 8): Matrix.002 file - promoters60/1985373
tgtcgaaa

SEQ ID NO: 53822 - DNA, 6 bp, Unknown
  misc_feature (1)..( 6): Matrix.002 file - promoters60/1985373
aaaagt

SEQ ID NO: 53823 - DNA, 8 bp, Unknown
  misc_feature (1)..( 8): Matrix.002 file - promoters60/1985373
aaaaaaat

SEQ ID NO: 53824 - DNA, 6 bp, Unknown
  misc_feature (1)..( 6): Matrix.002 file - promoters60/1985373
aattat

SEQ ID NO: 53825 - DNA, 6 bp, Unknown
  misc_feature (1)..( 6): Matrix.002 file - promoters60/1985373
aaaatt

SEQ ID NO: 53826 - DNA, 6 bp, Unknown
  misc_feature (1)..( 6): Matrix.002 file - promoters60/1985373
attata

SEQ ID NO: 53827 - DNA, 6 bp, Unknown
  misc_feature (1)..( 6): Matrix.002 file - promoters60/1985373
aaacaa

SEQ ID NO: 53828 - DNA, 6 bp, Unknown
  misc_feature (1)..( 6): Matrix.002 file - promoters60/1985373
aattga

SEQ ID NO: 53829 - DNA, 9 bp, Unknown
  misc_feature (1)..( 9): Matrix.002 file - promoters60/1985373
attcttttg

SEQ ID NO: 53830 - DNA, 7 bp, Unknown
  misc_feature (1)..( 7): Matrix.002 file - promoters60/1985373
tttgctt

SEQ ID NO: 53831 - DNA, 6 bp, Unknown
  misc_feature (1)..( 6): Matrix.002 file - promoters60/1985373
tattgg

SEQ ID NO: 53832 - DNA, 9 bp, Unknown
  misc_feature (1)..( 9): Matrix.002 file - promoters60/1985373
ataaaaaga

SEQ ID NO: 53833 - DNA, 8 bp, Unknown
  misc_feature (1)..( 8): Matrix.002 file - promoters60/1985590
gtttatat

SEQ ID NO: 53834 - DNA, 8 bp, Unknown
  misc_feature (1)..( 8): Matrix.002 file - promoters60/1985590
caattcaa

SEQ ID NO: 53835 - DNA, 7 bp, Unknown
  misc_feature (1)..( 7): Matrix.002 file - promoters60/1985590
gtaaata

SEQ ID NO: 53836 - DNA, 11 bp, Unknown
  misc_feature (1)..( 11): Matrix.002 file - promoters60/1985590
tttaaatacgt

SEQ ID NO: 53837 - DNA, 9 bp, Unknown
  misc_feature (1)..( 9): Matrix.002 file - promoters60/1985590
gaaaaataa

SEQ ID NO: 53838 - DNA, 8 bp, Unknown
  misc_feature (1)..( 8): Matrix.002 file - promoters60/1985590
aaacacaa

SEQ ID NO: 53839 - DNA, 11 bp, Unknown
  misc_feature (1)..( 11): Matrix.002 file - promoters60/1985590
tttttaattat

SEQ ID NO: 53840 - DNA, 7 bp, Unknown
  misc_feature (1)..( 7): Matrix.002 file - promoters60/1985590
ttcataa

SEQ ID NO: 53841 - DNA, 11 bp, Unknown
  misc_feature (1)..( 11): Matrix.002 file - promoters60/1985590
ttcatatgagt

SEQ ID NO: 53842 - DNA, 11 bp, Unknown
  misc_feature (1)..( 11): Matrix.002 file - promoters60/1985590
aaagaagaaaa

SEQ ID NO: 53843 - DNA, 7 bp, Unknown
  misc_feature (1)..( 7): Matrix.002 file - promoters60/1985590
ttatgtt

SEQ ID NO: 53844 - DNA, 6 bp, Unknown
  misc_feature (1)..( 6): Matrix.002 file - promoters60/1985621
ggattt

SEQ ID NO: 53845 - DNA, 7 bp, Unknown
  misc_feature (1)..( 7): Matrix.002 file - promoters60/1985621
gagagga

SEQ ID NO: 53846 - DNA, 6 bp, Unknown
  misc_feature (1)..( 6): Matrix.002 file - promoters60/1985621
ttttct

SEQ ID NO: 53847 - DNA, 10 bp, Unknown
  misc_feature (1)..( 10): Matrix.002 file - promoters60/1985621
tacataaatg

SEQ ID NO: 53848 - DNA, 7 bp, Unknown
  misc_feature (1)..( 7): Matrix.002 file - promoters60/1985621
aaaataa

SEQ ID NO: 53849 - DNA, 12 bp, Unknown
  misc_feature (1)..( 12): Matrix.002 file - promoters60/1985621
aataaaaccaaa

SEQ ID NO: 53850 - DNA, 8 bp, Unknown
  misc_feature (1)..( 8): Matrix.002 file - promoters60/1985621
ctacttct

SEQ ID NO: 53851 - DNA, 7 bp, Unknown
  misc_feature (1)..( 7): Matrix.002 file - promoters60/1985621
aacccgt

SEQ ID NO: 53852 - DNA, 6 bp, Unknown
  misc_feature (1)..( 6): Matrix.002 file - promoters60/1985621
cattta

SEQ ID NO: 53853 - DNA, 6 bp, Unknown
  misc_feature (1)..( 6): Matrix.002 file - promoters60/1985621
ctaata

SEQ ID NO: 53854 - DNA, 6 bp, Unknown
  misc_feature (1)..( 6): Matrix.002 file - promoters60/1985621
atttaa

SEQ ID NO: 53855 - DNA, 8 bp, Unknown
  misc_feature (1)..( 8): Matrix.002 file - promoters60/1985621
gaagaaac

SEQ ID NO: 53856 - DNA, 6 bp, Unknown
  misc_feature (1)..( 6): Matrix.002 file - promoters60/1985621
gaggtt

SEQ ID NO: 53857 - DNA, 6 bp, Unknown
  misc_feature (1)..( 6): Matrix.002 file - promoters60/1985621
tagtgt

SEQ ID NO: 53858 - DNA, 7 bp, Unknown
  misc_feature (1)..( 7): Matrix.002 file - promoters60/1985621
tttaaac

SEQ ID NO: 53859 - DNA, 7 bp, Unknown
  misc_feature (1)..( 7): Matrix.002 file - promoters60/1989445
caaaata

SEQ ID NO: 53860 - DNA, 14 bp, Unknown
  misc_feature (1)..( 14): Matrix.002 file - promoters60/1989445
catttattttaaat

SEQ ID NO: 53861 - DNA, 9 bp, Unknown
  misc_feature (1)..( 9): Matrix.002 file - promoters60/1989445
ataaatgaa

SEQ ID NO: 53862 - DNA, 13 bp, Unknown
  misc_feature (1)..( 13): Matrix.002 file - promoters60/1989445
attctcagaaatt

SEQ ID NO: 53863 - DNA, 12 bp, Unknown
  misc_feature (1)..( 12): Matrix.002 file - promoters60/2025006
aatttaaaaaaa

SEQ ID NO: 53864 - DNA, 9 bp, Unknown
  misc_feature (1)..( 9): Matrix.002 file - promoters60/2025006
ataaacaca

SEQ ID NO: 53865 - DNA, 7 bp, Unknown
  misc_feature (1)..( 7): Matrix.002 file - promoters60/2025006
aatcata

SEQ ID NO: 53866 - DNA, 7 bp, Unknown
  misc_feature (1)..( 7): Matrix.002 file - promoters60/2025006
gtttgaa

SEQ ID NO: 53867 - DNA, 13 bp, Unknown
  misc_feature (1)..( 13): Matrix.002 file - promoters60/2025006
aatagaaaaaacg

SEQ ID NO: 53868 - DNA, 9 bp, Unknown
  misc_feature (1)..( 9): Matrix.002 file - promoters60/2025006
taaataaaa

SEQ ID NO: 53869 - DNA, 9 bp, Unknown
  misc_feature (1)..( 9): Matrix.002 file - promoters60/2025006
taaataata

SEQ ID NO: 53870 - DNA, 7 bp, Unknown
  misc_feature (1)..( 7): Matrix.002 file - promoters60/2025006
gtaaatg

SEQ ID NO: 53871 - DNA, 16 bp, Unknown
  misc_feature (1)..( 16): Matrix.002 file - promoters60/2025006
tttgactattttaata

SEQ ID NO: 53872 - DNA, 8 bp, Unknown
  misc_feature (1)..( 8): Matrix.002 file - promoters60/2025006
accaaaat

SEQ ID NO: 53873 - DNA, 7 bp, Unknown
  misc_feature (1)..( 7): Matrix.002 file - promoters60/2025133
gggattt

SEQ ID NO: 53874 - DNA, 10 bp, Unknown
  misc_feature (1)..( 10): Matrix.002 file - promoters60/2025133
aaaaaaaaaa

SEQ ID NO: 53875 - DNA, 7 bp, Unknown
  misc_feature (1)..( 7): Matrix.002 file - promoters60/2025133
gttcaaa

SEQ ID NO: 53876 - DNA, 6 bp, Unknown
  misc_feature (1)..( 6): Matrix.002 file - promoters60/2025133
aaaaag

SEQ ID NO: 53877 - DNA, 6 bp, Unknown
  misc_feature (1)..( 6): Matrix.002 file - promoters60/2025133
gcagaa

SEQ ID NO: 53878 - DNA, 7 bp, Unknown
  misc_feature (1)..( 7): Matrix.002 file - promoters60/2025133
tgaatag

SEQ ID NO: 53879 - DNA, 7 bp, Unknown
  misc_feature (1)..( 7): Matrix.002 file - promoters60/2025133
aacaaat

SEQ ID NO: 53880 - DNA, 7 bp, Unknown
  misc_feature (1)..( 7): Matrix.002 file - promoters60/2025133
caaacgt

SEQ ID NO: 53881 - DNA, 8 bp, Unknown
  misc_feature (1)..( 8): Matrix.002 file - promoters60/2025133
ctggagag

SEQ ID NO: 53882 - DNA, 6 bp, Unknown
  misc_feature (1)..( 6): Matrix.002 file - promoters60/2025133
ttaata

SEQ ID NO: 53883 - DNA, 6 bp, Unknown
  misc_feature (1)..( 6): Matrix.002 file - promoters60/2025133
ttaata

SEQ ID NO: 53884 - DNA, 7 bp, Unknown
  misc_feature (1)..( 7): Matrix.002 file - promoters60/2025133
tttcaag

SEQ ID NO: 53885 - DNA, 8 bp, Unknown
  misc_feature (1)..( 8): Matrix.002 file - promoters60/2025133
gtttaata

SEQ ID NO: 53886 - DNA, 6 bp, Unknown
  misc_feature (1)..( 6): Matrix.002 file - promoters60/2025133
accaat

SEQ ID NO: 53887 - DNA, 7 bp, Unknown
  misc_feature (1)..( 7): Matrix.002 file - promoters60/2025133
tctgaac

SEQ ID NO: 53888 - DNA, 7 bp, Unknown
  misc_feature (1)..( 7): Matrix.002 file - promoters60/2025133
tatttta

SEQ ID NO: 53889 - DNA, 6 bp, Unknown
  misc_feature (1)..( 6): Matrix.002 file - promoters60/2025133
aaattt

SEQ ID NO: 53890 - DNA, 8 bp, Unknown
  misc_feature (1)..( 8): Matrix.002 file - promoters60/2025133
gtgtagaa

SEQ ID NO: 53891 - DNA, 6 bp, Unknown
  misc_feature (1)..( 6): Matrix.002 file - promoters60/2025133
aaaata

SEQ ID NO: 53892 - DNA, 8 bp, Unknown
  misc_feature (1)..( 8): Matrix.002 file - promoters60/2025133
ttattaac

SEQ ID NO: 53893 - DNA, 11 bp, Unknown
  misc_feature (1)..( 11): Matrix.002 file - promoters60/2025468
attttgtattt

SEQ ID NO: 53894 - DNA, 8 bp, Unknown
  misc_feature (1)..( 8): Matrix.002 file - promoters60/2025468
ttagtttt

SEQ ID NO: 53895 - DNA, 6 bp, Unknown
  misc_feature (1)..( 6): Matrix.002 file - promoters60/2025592
gaagtt

SEQ ID NO: 53896 - DNA, 6 bp, Unknown
  misc_feature (1)..( 6): Matrix.002 file - promoters60/2025592
atatta

SEQ ID NO: 53897 - DNA, 7 bp, Unknown
  misc_feature (1)..( 7): Matrix.002 file - promoters60/2025592
aatacat

SEQ ID NO: 53898 - DNA, 7 bp, Unknown
  misc_feature (1)..( 7): Matrix.002 file - promoters60/2025592
atgaata

SEQ ID NO: 53899 - DNA, 9 bp, Unknown
  misc_feature (1)..( 9): Matrix.002 file - promoters60/2025592
tgtctaaaa

SEQ ID NO: 53900 - DNA, 8 bp, Unknown
  misc_feature (1)..( 8): Matrix.002 file - promoters60/2025592
aaaataaa

SEQ ID NO: 53901 - DNA, 7 bp, Unknown
  misc_feature (1)..( 7): Matrix.002 file - promoters60/2025592
tttaaaa

SEQ ID NO: 53902 - DNA, 7 bp, Unknown
  misc_feature (1)..( 7): Matrix.002 file - promoters60/2025592
gttgtga

SEQ ID NO: 53903 - DNA, 7 bp, Unknown
  misc_feature (1)..( 7): Matrix.002 file - promoters60/2025592
atttttt

SEQ ID NO: 53904 - DNA, 6 bp, Unknown
  misc_feature (1)..( 6): Matrix.002 file - promoters60/2025592
tttgat

SEQ ID NO: 53905 - DNA, 12 bp, Unknown
  misc_feature (1)..( 12): Matrix.002 file - promoters60/2025592
caaataatattt

SEQ ID NO: 53906 - DNA, 8 bp, Unknown
  misc_feature (1)..( 8): Matrix.002 file - promoters60/2025592
attataat

SEQ ID NO: 53907 - DNA, 6 bp, Unknown
  misc_feature (1)..( 6): Matrix.002 file - promoters60/2025592
ttaatg

SEQ ID NO: 53908 - DNA, 6 bp, Unknown
  misc_feature (1)..( 6): Matrix.002 file - promoters60/2025592
catttc

SEQ ID NO: 53909 - DNA, 8 bp, Unknown
  misc_feature (1)..( 8): Matrix.002 file - promoters60/2025592
aaacacaa

SEQ ID NO: 53910 - DNA, 7 bp, Unknown
  misc_feature (1)..( 7): Matrix.002 file - promoters60/2025592
acaaagc

SEQ ID NO: 53911 - DNA, 7 bp, Unknown
  misc_feature (1)..( 7): Matrix.002 file - promoters60/2025592
tgtagtt

SEQ ID NO: 53912 - DNA, 6 bp, Unknown
  misc_feature (1)..( 6): Matrix.002 file - promoters60/2025592
cgtaaa

SEQ ID NO: 53913 - DNA, 8 bp, Unknown
  misc_feature (1)..( 8): Matrix.002 file - promoters60/2025592
taaaacaa

SEQ ID NO: 53914 - DNA, 6 bp, Unknown
  misc_feature (1)..( 6): Matrix.002 file - promoters60/2025592
atattt

SEQ ID NO: 53915 - DNA, 6 bp, Unknown
  misc_feature (1)..( 6): Matrix.002 file - promoters60/2025592
ttgtat

SEQ ID NO: 53916 - DNA, 9 bp, Unknown
  misc_feature (1)..( 9): Matrix.002 file - promoters60/2025627
atttttttc

SEQ ID NO: 53917 - DNA, 7 bp, Unknown
  misc_feature (1)..( 7): Matrix.002 file - promoters60/2025627
ttagaat

SEQ ID NO: 53918 - DNA, 8 bp, Unknown
  misc_feature (1)..( 8): Matrix.002 file - promoters60/2025627
tttattat

SEQ ID NO: 53919 - DNA, 9 bp, Unknown
  misc_feature (1)..( 9): Matrix.002 file - promoters60/2025627
attaaaaaa

SEQ ID NO: 53920 - DNA, 7 bp, Unknown
  misc_feature (1)..( 7): Matrix.002 file - promoters60/2025627
atcatgc

SEQ ID NO: 53921 - DNA, 6 bp, Unknown
  misc_feature (1)..( 6): Matrix.002 file - promoters60/2025627
tcacat

SEQ ID NO: 53922 - DNA, 7 bp, Unknown
  misc_feature (1)..( 7): Matrix.002 file - promoters60/2025627
aagtaaa

SEQ ID NO: 53923 - DNA, 8 bp, Unknown
  misc_feature (1)..( 8): Matrix.002 file - promoters60/2025627
atttattt

SEQ ID NO: 53924 - DNA, 6 bp, Unknown
  misc_feature (1)..( 6): Matrix.002 file - promoters60/2025627
ttttac

SEQ ID NO: 53925 - DNA, 10 bp, Unknown
  misc_feature (1)..( 10): Matrix.002 file - promoters60/2025627
taatattttt

SEQ ID NO: 53926 - DNA, 8 bp, Unknown
  misc_feature (1)..( 8): Matrix.002 file - promoters60/2025627
attcactt

SEQ ID NO: 53927 - DNA, 7 bp, Unknown
  misc_feature (1)..( 7): Matrix.002 file - promoters60/2025627
aaacaat

SEQ ID NO: 53928 - DNA, 9 bp, Unknown
  misc_feature (1)..( 9): Matrix.002 file - promoters60/2025627
tttatctaa

SEQ ID NO: 53929 - DNA, 8 bp, Unknown
  misc_feature (1)..( 8): Matrix.002 file - promoters60/2025627
taattcat

SEQ ID NO: 53930 - DNA, 7 bp, Unknown
  misc_feature (1)..( 7): Matrix.002 file - promoters60/2025627
aatctct

SEQ ID NO: 53931 - DNA, 8 bp, Unknown
  misc_feature (1)..( 8): Matrix.002 file - promoters60/2025627
tcttttca

SEQ ID NO: 53932 - DNA, 6 bp, Unknown
  misc_feature (1)..( 6): Matrix.002 file - promoters60/2025627
tttcag

SEQ ID NO: 53933 - DNA, 7 bp, Unknown
  misc_feature (1)..( 7): Matrix.002 file - promoters60/2025627
aaatatt

SEQ ID NO: 53934 - DNA, 11 bp, Unknown
  misc_feature (1)..( 11): Matrix.002 file - promoters60/2025627
tactgtattag

SEQ ID NO: 53935 - DNA, 6 bp, Unknown
  misc_feature (1)..( 6): Matrix.002 file - promoters60/2025627
tataat

SEQ ID NO: 53936 - DNA, 8 bp, Unknown
  misc_feature (1)..( 8): Matrix.002 file - promoters60/2025627
taatatta

SEQ ID NO: 53937 - DNA, 7 bp, Unknown
  misc_feature (1)..( 7): Matrix.002 file - promoters60/2026537
tttggta

SEQ ID NO: 53938 - DNA, 6 bp, Unknown
  misc_feature (1)..( 6): Matrix.002 file - promoters60/2026537
acaaat

SEQ ID NO: 53939 - DNA, 7 bp, Unknown
  misc_feature (1)..( 7): Matrix.002 file - promoters60/2026537
tggaatt

SEQ ID NO: 53940 - DNA, 6 bp, Unknown
  misc_feature (1)..( 6): Matrix.002 file - promoters60/2026537
ttcggt

SEQ ID NO: 53941 - DNA, 8 bp, Unknown
  misc_feature (1)..( 8): Matrix.002 file - promoters60/2026537
aggacgat

SEQ ID NO: 53942 - DNA, 11 bp, Unknown
  misc_feature (1)..( 11): Matrix.002 file - promoters60/2026771
aaattgtaaat

SEQ ID NO: 53943 - DNA, 12 bp, Unknown
  misc_feature (1)..( 12): Matrix.002 file - promoters60/2026771
tttaaaaaaaaa

SEQ ID NO: 53944 - DNA, 11 bp, Unknown
  misc_feature (1)..( 11): Matrix.002 file - promoters60/2026771
aaatcgtaaaa

SEQ ID NO: 53945 - DNA, 12 bp, Unknown
  misc_feature (1)..( 12): Matrix.002 file - promoters60/2026771
aattttgtaaat

SEQ ID NO: 53946 - DNA, 11 bp, Unknown
  misc_feature (1)..( 11): Matrix.002 file - promoters60/2026771
aaatttatttc

SEQ ID NO: 53947 - DNA, 8 bp, Unknown
  misc_feature (1)..( 8): Matrix.002 file - promoters60/2027233
atcaatcc

SEQ ID NO: 53948 - DNA, 8 bp, Unknown
  misc_feature (1)..( 8): Matrix.002 file - promoters60/2027233
ttcaatac

SEQ ID NO: 53949 - DNA, 13 bp, Unknown
  misc_feature (1)..( 13): Matrix.002 file - promoters60/2027233
tgagatttgattt

SEQ ID NO: 53950 - DNA, 16 bp, Unknown
  misc_feature (1)..( 16): Matrix.002 file - promoters60/2027233
gacaaacttcctatgt

SEQ ID NO: 53951 - DNA, 6 bp, Unknown
  misc_feature (1)..( 6): Matrix.002 file - promoters60/2027253
aataag

SEQ ID NO: 53952 - DNA, 9 bp, Unknown
  misc_feature (1)..( 9): Matrix.002 file - promoters60/2027253
aaaataaat

SEQ ID NO: 53953 - DNA, 6 bp, Unknown
  misc_feature (1)..( 6): Matrix.002 file - promoters60/2027253
taattg

SEQ ID NO: 53954 - DNA, 6 bp, Unknown
  misc_feature (1)..( 6): Matrix.002 file - promoters60/2027253
aaccgt

SEQ ID NO: 53955 - DNA, 8 bp, Unknown
  misc_feature (1)..( 8): Matrix.002 file - promoters60/2027253
tttaaaat

SEQ ID NO: 53956 - DNA, 8 bp, Unknown
  misc_feature (1)..( 8): Matrix.002 file - promoters60/2027253
tcaattaa

SEQ ID NO: 53957 - DNA, 6 bp, Unknown
  misc_feature (1)..( 6): Matrix.002 file - promoters60/2027253
tcatgt

SEQ ID NO: 53958 - DNA, 8 bp, Unknown
  misc_feature (1)..( 8): Matrix.002 file - promoters60/2027253
taaaagca

SEQ ID NO: 53959 - DNA, 7 bp, Unknown
  misc_feature (1)..( 7): Matrix.002 file - promoters60/2027253
catatta

SEQ ID NO: 53960 - DNA, 6 bp, Unknown
  misc_feature (1)..( 6): Matrix.002 file - promoters60/2027253
gataag

SEQ ID NO: 53961 - DNA, 6 bp, Unknown
  misc_feature (1)..( 6): Matrix.002 file - promoters60/2027253
actaaa

SEQ ID NO: 53962 - DNA, 8 bp, Unknown
  misc_feature (1)..( 8): Matrix.002 file - promoters60/2027253
tttctaac

SEQ ID NO: 53963 - DNA, 6 bp, Unknown
  misc_feature (1)..( 6): Matrix.002 file - promoters60/2027253
atacaa

SEQ ID NO: 53964 - DNA, 6 bp, Unknown
  misc_feature (1)..( 6): Matrix.002 file - promoters60/2027253
tatata

SEQ ID NO: 53965 - DNA, 6 bp, Unknown
  misc_feature (1)..( 6): Matrix.002 file - promoters60/2027268
ttaaca

SEQ ID NO: 53966 - DNA, 7 bp, Unknown
  misc_feature (1)..( 7): Matrix.002 file - promoters60/2027268
caatttt

SEQ ID NO: 53967 - DNA, 11 bp, Unknown
  misc_feature (1)..( 11): Matrix.002 file - promoters60/2027268
ttttgctaaaa

SEQ ID NO: 53968 - DNA, 8 bp, Unknown
  misc_feature (1)..( 8): Matrix.002 file - promoters60/2027268
agattact

SEQ ID NO: 53969 - DNA, 7 bp, Unknown
  misc_feature (1)..( 7): Matrix.002 file - promoters60/2027268
tttgatt

SEQ ID NO: 53970 - DNA, 7 bp, Unknown
  misc_feature (1)..( 7): Matrix.002 file - promoters60/2027268
taaaaga

SEQ ID NO: 53971 - DNA, 10 bp, Unknown
  misc_feature (1)..( 10): Matrix.002 file - promoters60/2027268
aacagaataa

SEQ ID NO: 53972 - DNA, 8 bp, Unknown
  misc_feature (1)..( 8): Matrix.002 file - promoters60/2027268
ccggatcg

SEQ ID NO: 53973 - DNA, 8 bp, Unknown
  misc_feature (1)..( 8): Matrix.002 file - promoters60/2027268
accctaga

SEQ ID NO: 53974 - DNA, 7 bp, Unknown
  misc_feature (1)..( 7): Matrix.002 file - promoters60/2027268
agagaca

SEQ ID NO: 53975 - DNA, 6 bp, Unknown
  misc_feature (1)..( 6): Matrix.002 file - promoters60/2027268
attata

SEQ ID NO: 53976 - DNA, 7 bp, Unknown
  misc_feature (1)..( 7): Matrix.002 file - promoters60/2027268
tttaaag

SEQ ID NO: 53977 - DNA, 13 bp, Unknown
  misc_feature (1)..( 13): Matrix.002 file - promoters60/2027268
ttgaatcaaaatt

SEQ ID NO: 53978 - DNA, 7 bp, Unknown
  misc_feature (1)..( 7): Matrix.002 file - promoters60/2027268
tggattt

SEQ ID NO: 53979 - DNA, 6 bp, Unknown
  misc_feature (1)..( 6): Matrix.002 file - promoters60/2027268
aagatt

SEQ ID NO: 53980 - DNA, 6 bp, Unknown
  misc_feature (1)..( 6): Matrix.002 file - promoters60/2027268
ttggtt

SEQ ID NO: 53981 - DNA, 6 bp, Unknown
  misc_feature (1)..( 6): Matrix.002 file - promoters60/2027268
ttaacc

SEQ ID NO: 53982 - DNA, 7 bp, Unknown
  misc_feature (1)..( 7): Matrix.002 file - promoters60/2027268
ctcactc

SEQ ID NO: 53983 - DNA, 6 bp, Unknown
  misc_feature (1)..( 6): Matrix.002 file - promoters60/2027268
atttct

SEQ ID NO: 53984 - DNA, 7 bp, Unknown
  misc_feature (1)..( 7): Matrix.002 file - promoters60/2028945
ttgaaat

SEQ ID NO: 53985 - DNA, 13 bp, Unknown
  misc_feature (1)..( 13): Matrix.002 file - promoters60/2028945
taaaaatttaaat

SEQ ID NO: 53986 - DNA, 5 bp, Unknown
  misc_feature (1)..( 5): Matrix.002 file - promoters60/2028945
cataa

SEQ ID NO: 53987 - DNA, 7 bp, Unknown
  misc_feature (1)..( 7): Matrix.002 file - promoters60/2028945
atgaata

SEQ ID NO: 53988 - DNA, 8 bp, Unknown
  misc_feature (1)..( 8): Matrix.002 file - promoters60/2028945
tatgaaaa

SEQ ID NO: 53989 - DNA, 7 bp, Unknown
  misc_feature (1)..( 7): Matrix.002 file - promoters60/2028945
atactat

SEQ ID NO: 53990 - DNA, 9 bp, Unknown
  misc_feature (1)..( 9): Matrix.002 file - promoters60/2028945
aacatttat

SEQ ID NO: 53991 - DNA, 8 bp, Unknown
  misc_feature (1)..( 8): Matrix.002 file - promoters60/2028945
tttaattt

SEQ ID NO: 53992 - DNA, 8 bp, Unknown
  misc_feature (1)..( 8): Matrix.002 file - promoters60/2028945
ttaaagca

SEQ ID NO: 53993 - DNA, 6 bp, Unknown
  misc_feature (1)..( 6): Matrix.002 file - promoters60/2028945
gttaaa

SEQ ID NO: 53994 - DNA, 8 bp, Unknown
  misc_feature (1)..( 8): Matrix.002 file - promoters60/2028945
ttttattt

SEQ ID NO: 53995 - DNA, 8 bp, Unknown
  misc_feature (1)..( 8): Matrix.002 file - promoters60/2028945
atcttaat

SEQ ID NO: 53996 - DNA, 6 bp, Unknown
  misc_feature (1)..( 6): Matrix.002 file - promoters60/2028945
tttttc

SEQ ID NO: 53997 - DNA, 6 bp, Unknown
  misc_feature (1)..( 6): Matrix.002 file - promoters60/2028945
ttaatt

SEQ ID NO: 53998 - DNA, 8 bp, Unknown
  misc_feature (1)..( 8): Matrix.002 file - promoters60/2028945
aaacatta

SEQ ID NO: 53999 - DNA, 6 bp, Unknown
  misc_feature (1)..( 6): Matrix.002 file - promoters60/2028945
atcact

SEQ ID NO: 54000 - DNA, 8 bp, Unknown
  misc_feature (1)..( 8): Matrix.002 file - promoters60/2028945
aaaacttt

SEQ ID NO: 54001 - DNA, 7 bp, Unknown
  misc_feature (1)..( 7): Matrix.002 file - promoters60/2028945
tttataa

SEQ ID NO: 54002 - DNA, 6 bp, Unknown
  misc_feature (1)..( 6): Matrix.002 file - promoters60/2028945
taacac

SEQ ID NO: 54003 - DNA, 6 bp, Unknown
  misc_feature (1)..( 6): Matrix.002 file - promoters60/2028945
accaat

SEQ ID NO: 54004 - DNA, 8 bp, Unknown
  misc_feature (1)..( 8): Matrix.002 file - promoters60/2028985
ttttagaa

SEQ ID NO: 54005 - DNA, 6 bp, Unknown
  misc_feature (1)..( 6): Matrix.002 file - promoters60/2028985
tttaat

SEQ ID NO: 54006 - DNA, 7 bp, Unknown
  misc_feature (1)..( 7): Matrix.002 file - promoters60/2028985
tgaattc

SEQ ID NO: 54007 - DNA, 10 bp, Unknown
  misc_feature (1)..( 10): Matrix.002 file - promoters60/2028985
gtttagtgaa

SEQ ID NO: 54008 - DNA, 6 bp, Unknown
  misc_feature (1)..( 6): Matrix.002 file - promoters60/2028985
aagtaa

SEQ ID NO: 54009 - DNA, 7 bp, Unknown
  misc_feature (1)..( 7): Matrix.002 file - promoters60/2028985
taaaaag

SEQ ID NO: 54010 - DNA, 11 bp, Unknown
  misc_feature (1)..( 11): Matrix.002 file - promoters60/2028985
tgatgaattga

SEQ ID NO: 54011 - DNA, 7 bp, Unknown
  misc_feature (1)..( 7): Matrix.002 file - promoters60/2028985
gtgaatg

SEQ ID NO: 54012 - DNA, 6 bp, Unknown
  misc_feature (1)..( 6): Matrix.002 file - promoters60/2028985
tctttg

SEQ ID NO: 54013 - DNA, 6 bp, Unknown
  misc_feature (1)..( 6): Matrix.002 file - promoters60/2028985
taatgt

SEQ ID NO: 54014 - DNA, 6 bp, Unknown
  misc_feature (1)..( 6): Matrix.002 file - promoters60/2028985
tataat

SEQ ID NO: 54015 - DNA, 8 bp, Unknown
  misc_feature (1)..( 8): Matrix.002 file - promoters60/2028985
caaaccgt

SEQ ID NO: 54016 - DNA, 8 bp, Unknown
  misc_feature (1)..( 8): Matrix.002 file - promoters60/2028985
aacatagt

SEQ ID NO: 54017 - DNA, 8 bp, Unknown
  misc_feature (1)..( 8): Matrix.002 file - promoters60/2028985
tcaaaaaa

SEQ ID NO: 54018 - DNA, 7 bp, Unknown
  misc_feature (1)..( 7): Matrix.002 file - promoters60/2028985
agtgcgg

SEQ ID NO: 54019 - DNA, 9 bp, Unknown
  misc_feature (1)..( 9): Matrix.002 file - promoters60/2028993
attactgca

SEQ ID NO: 54020 - DNA, 11 bp, Unknown
  misc_feature (1)..( 11): Matrix.002 file - promoters60/2028993
ttcttaaatgg

SEQ ID NO: 54021 - DNA, 8 bp, Unknown
  misc_feature (1)..( 8): Matrix.002 file - promoters60/2028993
gtcagaaa

SEQ ID NO: 54022 - DNA, 9 bp, Unknown
  misc_feature (1)..( 9): Matrix.002 file - promoters60/2028993
attaaccaa

SEQ ID NO: 54023 - DNA, 12 bp, Unknown
  misc_feature (1)..( 12): Matrix.002 file - promoters60/2028993
ttactaaaattt

SEQ ID NO: 54024 - DNA, 7 bp, Unknown
  misc_feature (1)..( 7): Matrix.002 file - promoters60/2028993
attataa

SEQ ID NO: 54025 - DNA, 6 bp, Unknown
  misc_feature (1)..( 6): Matrix.002 file - promoters60/2028993
cactat

SEQ ID NO: 54026 - DNA, 7 bp, Unknown
  misc_feature (1)..( 7): Matrix.002 file - promoters60/2028993
taaaaat

SEQ ID NO: 54027 - DNA, 7 bp, Unknown
  misc_feature (1)..( 7): Matrix.002 file - promoters60/2028993
taagttg

SEQ ID NO: 54028 - DNA, 8 bp, Unknown
  misc_feature (1)..( 8): Matrix.002 file - promoters60/2028993
ataaacca

SEQ ID NO: 54029 - DNA, 7 bp, Unknown
  misc_feature (1)..( 7): Matrix.002 file - promoters60/2028993
aaaatta

SEQ ID NO: 54030 - DNA, 6 bp, Unknown
  misc_feature (1)..( 6): Matrix.002 file - promoters60/2028993
aataag

SEQ ID NO: 54031 - DNA, 7 bp, Unknown
  misc_feature (1)..( 7): Matrix.002 file - promoters60/2028993
taaaaac

SEQ ID NO: 54032 - DNA, 8 bp, Unknown
  misc_feature (1)..( 8): Matrix.002 file - promoters60/2028993
tgaaaata

SEQ ID NO: 54033 - DNA, 6 bp, Unknown
  misc_feature (1)..( 6): Matrix.002 file - promoters60/2028993
aagcaa

SEQ ID NO: 54034 - DNA, 10 bp, Unknown
  misc_feature (1)..( 10): Matrix.002 file - promoters60/2028993
ccaaaaaaaa

SEQ ID NO: 54035 - DNA, 10 bp, Unknown
  misc_feature (1)..( 10): Matrix.002 file - promoters60/2028993
tgtaatgctt

SEQ ID NO: 54036 - DNA, 6 bp, Unknown
  misc_feature (1)..( 6): Matrix.002 file - promoters60/2028993
taatta

SEQ ID NO: 54037 - DNA, 7 bp, Unknown
  misc_feature (1)..( 7): Matrix.002 file - promoters60/2028997
attctgt

SEQ ID NO: 54038 - DNA, 7 bp, Unknown
  misc_feature (1)..( 7): Matrix.002 file - promoters60/2028997
cttctat

SEQ ID NO: 54039 - DNA, 7 bp, Unknown
  misc_feature (1)..( 7): Matrix.002 file - promoters60/2028997
tttcatt

SEQ ID NO: 54040 - DNA, 7 bp, Unknown
  misc_feature (1)..( 7): Matrix.002 file - promoters60/2028997
gtatctt

SEQ ID NO: 54041 - DNA, 6 bp, Unknown
  misc_feature (1)..( 6): Matrix.002 file - promoters60/2028997
catcat

SEQ ID NO: 54042 - DNA, 6 bp, Unknown
  misc_feature (1)..( 6): Matrix.002 file - promoters60/2028997
aagaaa

SEQ ID NO: 54043 - DNA, 7 bp, Unknown
  misc_feature (1)..( 7): Matrix.002 file - promoters60/2028997
aaagaaa

SEQ ID NO: 54044 - DNA, 9 bp, Unknown
  misc_feature (1)..( 9): Matrix.002 file - promoters60/2028997
ctcagtgat

SEQ ID NO: 54045 - DNA, 7 bp, Unknown
  misc_feature (1)..( 7): Matrix.002 file - promoters60/2028997
gttcttt

SEQ ID NO: 54046 - DNA, 7 bp, Unknown
  misc_feature (1)..( 7): Matrix.002 file - promoters60/2028997
attggaa

SEQ ID NO: 54047 - DNA, 6 bp, Unknown
  misc_feature (1)..( 6): Matrix.002 file - promoters60/2028997
aaggta

SEQ ID NO: 54048 - DNA, 8 bp, Unknown
  misc_feature (1)..( 8): Matrix.002 file - promoters60/2029009
acttaaaa

SEQ ID NO: 54049 - DNA, 9 bp, Unknown
  misc_feature (1)..( 9): Matrix.002 file - promoters60/2029009
tatactttt

SEQ ID NO: 54050 - DNA, 7 bp, Unknown
  misc_feature (1)..( 7): Matrix.002 file - promoters60/2029009
acattaa

SEQ ID NO: 54051 - DNA, 7 bp, Unknown
  misc_feature (1)..( 7): Matrix.002 file - promoters60/2029009
attttgg

SEQ ID NO: 54052 - DNA, 7 bp, Unknown
  misc_feature (1)..( 7): Matrix.002 file - promoters60/2029009
aagaaaa

SEQ ID NO: 54053 - DNA, 7 bp, Unknown
  misc_feature (1)..( 7): Matrix.002 file - promoters60/2029009
aataaaa

SEQ ID NO: 54054 - DNA, 6 bp, Unknown
  misc_feature (1)..( 6): Matrix.002 file - promoters60/2029009
aaaaat

SEQ ID NO: 54055 - DNA, 7 bp, Unknown
  misc_feature (1)..( 7): Matrix.002 file - promoters60/2029009
tttatcc

SEQ ID NO: 54056 - DNA, 6 bp, Unknown
  misc_feature (1)..( 6): Matrix.002 file - promoters60/2029009
ttagaa

SEQ ID NO: 54057 - DNA, 6 bp, Unknown
  misc_feature (1)..( 6): Matrix.002 file - promoters60/2029009
ttaaca

SEQ ID NO: 54058 - DNA, 6 bp, Unknown
  misc_feature (1)..( 6): Matrix.002 file - promoters60/2029009
taaaac

SEQ ID NO: 54059 - DNA, 6 bp, Unknown
  misc_feature (1)..( 6): Matrix.002 file - promoters60/2029009
tcaact

SEQ ID NO: 54060 - DNA, 6 bp, Unknown
  misc_feature (1)..( 6): Matrix.002 file - promoters60/2029009
aaaaaa

SEQ ID NO: 54061 - DNA, 6 bp, Unknown
  misc_feature (1)..( 6): Matrix.002 file - promoters60/2029009
aaaaat

SEQ ID NO: 54062 - DNA, 6 bp, Unknown
  misc_feature (1)..( 6): Matrix.002 file - promoters60/2029009
aatgaa

SEQ ID NO: 54063 - DNA, 8 bp, Unknown
  misc_feature (1)..( 8): Matrix.002 file - promoters60/2029009
gaatacga

SEQ ID NO: 54064 - DNA, 6 bp, Unknown
  misc_feature (1)..( 6): Matrix.002 file - promoters60/2029009
aacata

SEQ ID NO: 54065 - DNA, 6 bp, Unknown
  misc_feature (1)..( 6): Matrix.002 file - promoters60/2029009
cttgat

SEQ ID NO: 54066 - DNA, 7 bp, Unknown
  misc_feature (1)..( 7): Matrix.002 file - promoters60/2029009
aggatta

SEQ ID NO: 54067 - DNA, 9 bp, Unknown
  misc_feature (1)..( 9): Matrix.002 file - promoters60/2029016
aataaatta

SEQ ID NO: 54068 - DNA, 7 bp, Unknown
  misc_feature (1)..( 7): Matrix.002 file - promoters60/2029016
ttgtaaa

SEQ ID NO: 54069 - DNA, 10 bp, Unknown
  misc_feature (1)..( 10): Matrix.002 file - promoters60/2029016
tcaagttaaa

SEQ ID NO: 54070 - DNA, 8 bp, Unknown
  misc_feature (1)..( 8): Matrix.002 file - promoters60/2029016
ttagtttt

SEQ ID NO: 54071 - DNA, 11 bp, Unknown
  misc_feature (1)..( 11): Matrix.002 file - promoters60/2029016
caaataataaa

SEQ ID NO: 54072 - DNA, 8 bp, Unknown
  misc_feature (1)..( 8): Matrix.002 file - promoters60/2029016
aaagatca

SEQ ID NO: 54073 - DNA, 11 bp, Unknown
  misc_feature (1)..( 11): Matrix.002 file - promoters60/2029031
caaagttgttg

SEQ ID NO: 54074 - DNA, 10 bp, Unknown
  misc_feature (1)..( 10): Matrix.002 file - promoters60/2029033
gatttatttc

SEQ ID NO: 54075 - DNA, 13 bp, Unknown
  misc_feature (1)..( 13): Matrix.002 file - promoters60/2029033
gattattcattta

SEQ ID NO: 54076 - DNA, 7 bp, Unknown
  misc_feature (1)..( 7): Matrix.002 file - promoters60/2029033
tctctat

SEQ ID NO: 54077 - DNA, 6 bp, Unknown
  misc_feature (1)..( 6): Matrix.002 file - promoters60/2029049
tttagg

SEQ ID NO: 54078 - DNA, 6 bp, Unknown
  misc_feature (1)..( 6): Matrix.002 file - promoters60/2029049
taaaac

SEQ ID NO: 54079 - DNA, 7 bp, Unknown
  misc_feature (1)..( 7): Matrix.002 file - promoters60/2029049
aaaatta

SEQ ID NO: 54080 - DNA, 10 bp, Unknown
  misc_feature (1)..( 10): Matrix.002 file - promoters60/2029049
aaaaaaaaaa

SEQ ID NO: 54081 - DNA, 7 bp, Unknown
  misc_feature (1)..( 7): Matrix.002 file - promoters60/2029049
gggggac

SEQ ID NO: 54082 - DNA, 9 bp, Unknown
  misc_feature (1)..( 9): Matrix.002 file - promoters60/2029049
gagatattt

SEQ ID NO: 54083 - DNA, 6 bp, Unknown
  misc_feature (1)..( 6): Matrix.002 file - promoters60/2029049
attgtg

SEQ ID NO: 54084 - DNA, 6 bp, Unknown
  misc_feature (1)..( 6): Matrix.002 file - promoters60/2029049
ttgttt

SEQ ID NO: 54085 - DNA, 9 bp, Unknown
  misc_feature (1)..( 9): Matrix.002 file - promoters60/2029049
tatcgcttt

SEQ ID NO: 54086 - DNA, 9 bp, Unknown
  misc_feature (1)..( 9): Matrix.002 file - promoters60/2029049
tttcctata

SEQ ID NO: 54087 - DNA, 7 bp, Unknown
  misc_feature (1)..( 7): Matrix.002 file - promoters60/2029049
ctttcaa

SEQ ID NO: 54088 - DNA, 6 bp, Unknown
  misc_feature (1)..( 6): Matrix.002 file - promoters60/2029049
caattt

SEQ ID NO: 54089 - DNA, 13 bp, Unknown
  misc_feature (1)..( 13): Matrix.002 file - promoters60/2029075
caaaaaagaaata

SEQ ID NO: 54090 - DNA, 9 bp, Unknown
  misc_feature (1)..( 9): Matrix.002 file - promoters60/2029075
attttattc

SEQ ID NO: 54091 - DNA, 10 bp, Unknown
  misc_feature (1)..( 10): Matrix.002 file - promoters60/2029075
caaaaaacaa

SEQ ID NO: 54092 - DNA, 9 bp, Unknown
  misc_feature (1)..( 9): Matrix.002 file - promoters60/2029079
tataaaata

SEQ ID NO: 54093 - DNA, 10 bp, Unknown
  misc_feature (1)..( 10): Matrix.002 file - promoters60/2029079
tcgaagaaag

SEQ ID NO: 54094 - DNA, 15 bp, Unknown
  misc_feature (1)..( 15): Matrix.002 file - promoters60/2029087
aacaaaaaaagttta

SEQ ID NO: 54095 - DNA, 15 bp, Unknown
  misc_feature (1)..( 15): Matrix.002 file - promoters60/2029087
atcactgatccaaca

SEQ ID NO: 54096 - DNA, 7 bp, Unknown
  misc_feature (1)..( 7): Matrix.002 file - promoters60/2029087
aattatc

SEQ ID NO: 54097 - DNA, 6 bp, Unknown
  misc_feature (1)..( 6): Matrix.002 file - promoters60/2056926
tgggtt

SEQ ID NO: 54098 - DNA, 7 bp, Unknown
  misc_feature (1)..( 7): Matrix.002 file - promoters60/2056926
tcaaaaa

SEQ ID NO: 54099 - DNA, 8 bp, Unknown
  misc_feature (1)..( 8): Matrix.002 file - promoters60/2056926
agaacaat

SEQ ID NO: 54100 - DNA, 6 bp, Unknown
  misc_feature (1)..( 6): Matrix.002 file - promoters60/2056926
acgaaa

SEQ ID NO: 54101 - DNA, 8 bp, Unknown
  misc_feature (1)..( 8): Matrix.002 file - promoters60/2056926
aataaaag

SEQ ID NO: 54102 - DNA, 8 bp, Unknown
  misc_feature (1)..( 8): Matrix.002 file - promoters60/2056926
aaagatct

SEQ ID NO: 54103 - DNA, 7 bp, Unknown
  misc_feature (1)..( 7): Matrix.002 file - promoters60/2056926
agatttg

SEQ ID NO: 54104 - DNA, 7 bp, Unknown
  misc_feature (1)..( 7): Matrix.002 file - promoters60/2056926
gttctca

SEQ ID NO: 54105 - DNA, 7 bp, Unknown
  misc_feature (1)..( 7): Matrix.002 file - promoters60/2056926
ataagac

SEQ ID NO: 54106 - DNA, 7 bp, Unknown
  misc_feature (1)..( 7): Matrix.002 file - promoters60/2056926
aataata

SEQ ID NO: 54107 - DNA, 9 bp, Unknown
  misc_feature (1)..( 9): Matrix.002 file - promoters60/2056926
aaagaaaat

SEQ ID NO: 54108 - DNA, 11 bp, Unknown
  misc_feature (1)..( 11): Matrix.002 file - promoters60/2056926
attattcgctg

SEQ ID NO: 54109 - DNA, 7 bp, Unknown
  misc_feature (1)..( 7): Matrix.002 file - promoters60/2056926
gtcaaga

SEQ ID NO: 54110 - DNA, 7 bp, Unknown
  misc_feature (1)..( 7): Matrix.002 file - promoters60/2056926
cttatat

SEQ ID NO: 54111 - DNA, 12 bp, Unknown
  misc_feature (1)..( 12): Matrix.002 file - promoters60/2056926
taacttttgagt

SEQ ID NO: 54112 - DNA, 7 bp, Unknown
  misc_feature (1)..( 7): Matrix.002 file - promoters60/2056926
tctacac

SEQ ID NO: 54113 - DNA, 6 bp, Unknown
  misc_feature (1)..( 6): Matrix.002 file - promoters60/2056926
acttgt

SEQ ID NO: 54114 - DNA, 13 bp, Unknown
  misc_feature (1)..( 13): Matrix.002 file - promoters60/2104991
cttaaattataat

SEQ ID NO: 54115 - DNA, 11 bp, Unknown
  misc_feature (1)..( 11): Matrix.002 file - promoters60/2104991
atttcaaaaaa

SEQ ID NO: 54116 - DNA, 14 bp, Unknown
  misc_feature (1)..( 14): Matrix.002 file - promoters60/2104991
tacttttttattgt

SEQ ID NO: 54117 - DNA, 7 bp, Unknown
  misc_feature (1)..( 7): Matrix.002 file - promoters60/2105109
tttatat

SEQ ID NO: 54118 - DNA, 9 bp, Unknown
  misc_feature (1)..( 9): Matrix.002 file - promoters60/2105109
tattagtat

SEQ ID NO: 54119 - DNA, 26 bp, Unknown
  misc_feature (1)..( 26): Matrix.002 file - promoters60/2105109
attaaaacccaacaagtaacaataaa

SEQ ID NO: 54120 - DNA, 10 bp, Unknown
  misc_feature (1)..( 10): Matrix.002 file - promoters60/2105109
cataagccca

SEQ ID NO: 54121 - DNA, 17 bp, Unknown
  misc_feature (1)..( 17): Matrix.002 file - promoters60/2105109
gtttaccttattatctc

SEQ ID NO: 54122 - DNA, 8 bp, Unknown
  misc_feature (1)..( 8): Matrix.002 file - promoters60/2105109
aaataaaa

SEQ ID NO: 54123 - DNA, 8 bp, Unknown
  misc_feature (1)..( 8): Matrix.002 file - promoters60/2105109
aatataaa

SEQ ID NO: 54124 - DNA, 8 bp, Unknown
  misc_feature (1)..( 8): Matrix.002 file - promoters60/2105109
gatttggt

SEQ ID NO: 54125 - DNA, 6 bp, Unknown
  misc_feature (1)..( 6): Matrix.002 file - promoters60/2105141
aacaaa

SEQ ID NO: 54126 - DNA, 7 bp, Unknown
  misc_feature (1)..( 7): Matrix.002 file - promoters60/2105141
tttttat

SEQ ID NO: 54127 - DNA, 8 bp, Unknown
  misc_feature (1)..( 8): Matrix.002 file - promoters60/2105141
catatttt

SEQ ID NO: 54128 - DNA, 7 bp, Unknown
  misc_feature (1)..( 7): Matrix.002 file - promoters60/2105141
taaataa

SEQ ID NO: 54129 - DNA, 8 bp, Unknown
  misc_feature (1)..( 8): Matrix.002 file - promoters60/2105141
ttttcaat

SEQ ID NO: 54130 - DNA, 7 bp, Unknown
  misc_feature (1)..( 7): Matrix.002 file - promoters60/2105141
taaatta

SEQ ID NO: 54131 - DNA, 6 bp, Unknown
  misc_feature (1)..( 6): Matrix.002 file - promoters60/2105141
aacaca

SEQ ID NO: 54132 - DNA, 7 bp, Unknown
  misc_feature (1)..( 7): Matrix.002 file - promoters60/2105141
ataaaaa

SEQ ID NO: 54133 - DNA, 8 bp, Unknown
  misc_feature (1)..( 8): Matrix.002 file - promoters60/2105141
atgtttat

SEQ ID NO: 54134 - DNA, 9 bp, Unknown
  misc_feature (1)..( 9): Matrix.002 file - promoters60/2105141
cacaaatca

SEQ ID NO: 54135 - DNA, 7 bp, Unknown
  misc_feature (1)..( 7): Matrix.002 file - promoters60/2105141
aaaaccc

SEQ ID NO: 54136 - DNA, 7 bp, Unknown
  misc_feature (1)..( 7): Matrix.002 file - promoters60/2105141
acccttt

SEQ ID NO: 54137 - DNA, 8 bp, Unknown
  misc_feature (1)..( 8): Matrix.002 file - promoters60/2105141
gtgctaaa

SEQ ID NO: 54138 - DNA, 6 bp, Unknown
  misc_feature (1)..( 6): Matrix.002 file - promoters60/2105141
aagaat

SEQ ID NO: 54139 - DNA, 8 bp, Unknown
  misc_feature (1)..( 8): Matrix.002 file - promoters60/2105141
aaaacaaa

SEQ ID NO: 54140 - DNA, 6 bp, Unknown
  misc_feature (1)..( 6): Matrix.002 file - promoters60/2105141
gttttc

SEQ ID NO: 54141 - DNA, 7 bp, Unknown
  misc_feature (1)..( 7): Matrix.002 file - promoters60/2105141
ttattta

SEQ ID NO: 54142 - DNA, 6 bp, Unknown
  misc_feature (1)..( 6): Matrix.002 file - promoters60/2105141
cacaag

SEQ ID NO: 54143 - DNA, 6 bp, Unknown
  misc_feature (1)..( 6): Matrix.002 file - promoters60/2105141
tggcat

SEQ ID NO: 54144 - DNA, 8 bp, Unknown
  misc_feature (1)..( 8): Matrix.002 file - promoters60/2105398
aaaaaaaa

SEQ ID NO: 54145 - DNA, 14 bp, Unknown
  misc_feature (1)..( 14): Matrix.002 file - promoters60/2105398
atttcatattttca

SEQ ID NO: 54146 - DNA, 13 bp, Unknown
  misc_feature (1)..( 13): Matrix.002 file - promoters60/2105398
aattttgtaaaat

SEQ ID NO: 54147 - DNA, 10 bp, Unknown
  misc_feature (1)..( 10): Matrix.002 file - promoters60/2105398
tttagataga

SEQ ID NO: 54148 - DNA, 12 bp, Unknown
  misc_feature (1)..( 12): Matrix.002 file - promoters60/2105398
attttataaatt

SEQ ID NO: 54149 - DNA, 7 bp, Unknown
  misc_feature (1)..( 7): Matrix.002 file - promoters60/2105398
atttatt

SEQ ID NO: 54150 - DNA, 16 bp, Unknown
  misc_feature (1)..( 16): Matrix.002 file - promoters60/2105514
aaaaaggcccattata

SEQ ID NO: 54151 - DNA, 8 bp, Unknown
  misc_feature (1)..( 8): Matrix.002 file - promoters60/2105518
ggttatgt

SEQ ID NO: 54152 - DNA, 18 bp, Unknown
  misc_feature (1)..( 18): Matrix.002 file - promoters60/2105518
ctataccaaaaatgaaaa

SEQ ID NO: 54153 - DNA, 9 bp, Unknown
  misc_feature (1)..( 9): Matrix.002 file - promoters60/2105533
ctaaaaaga

SEQ ID NO: 54154 - DNA, 10 bp, Unknown
  misc_feature (1)..( 10): Matrix.002 file - promoters60/2105533
gtggactatt

SEQ ID NO: 54155 - DNA, 8 bp, Unknown
  misc_feature (1)..( 8): Matrix.002 file - promoters60/2105533
attgatag

SEQ ID NO: 54156 - DNA, 6 bp, Unknown
  misc_feature (1)..( 6): Matrix.002 file - promoters60/2105533
gttact

SEQ ID NO: 54157 - DNA, 6 bp, Unknown
  misc_feature (1)..( 6): Matrix.002 file - promoters60/2105533
tttaac

SEQ ID NO: 54158 - DNA, 6 bp, Unknown
  misc_feature (1)..( 6): Matrix.002 file - promoters60/2105533
agtaaa

SEQ ID NO: 54159 - DNA, 7 bp, Unknown
  misc_feature (1)..( 7): Matrix.002 file - promoters60/2105533
gattaaa

SEQ ID NO: 54160 - DNA, 9 bp, Unknown
  misc_feature (1)..( 9): Matrix.002 file - promoters60/2105533
aagaagtta

SEQ ID NO: 54161 - DNA, 8 bp, Unknown
  misc_feature (1)..( 8): Matrix.002 file - promoters60/2105533
aagctgtt

SEQ ID NO: 54162 - DNA, 8 bp, Unknown
  misc_feature (1)..( 8): Matrix.002 file - promoters60/2105533
tgttcaga

SEQ ID NO: 54163 - DNA, 6 bp, Unknown
  misc_feature (1)..( 6): Matrix.002 file - promoters60/2105533
ctcacc

SEQ ID NO: 54164 - DNA, 6 bp, Unknown
  misc_feature (1)..( 6): Matrix.002 file - promoters60/2105533
acacgt

SEQ ID NO: 54165 - DNA, 6 bp, Unknown
  misc_feature (1)..( 6): Matrix.002 file - promoters60/2105533
ttaacc

SEQ ID NO: 54166 - DNA, 7 bp, Unknown
  misc_feature (1)..( 7): Matrix.002 file - promoters60/2105533
caaattt

SEQ ID NO: 54167 - DNA, 8 bp, Unknown
  misc_feature (1)..( 8): Matrix.002 file - promoters60/2105533
tttggaaa

SEQ ID NO: 54168 - DNA, 7 bp, Unknown
  misc_feature (1)..( 7): Matrix.002 file - promoters60/2105533
attaatt

SEQ ID NO: 54169 - DNA, 7 bp, Unknown
  misc_feature (1)..( 7): Matrix.002 file - promoters60/2105533
cttatgt

SEQ ID NO: 54170 - DNA, 9 bp, Unknown
  misc_feature (1)..( 9): Matrix.002 file - promoters60/2105535
acaaagaaa

SEQ ID NO: 54171 - DNA, 10 bp, Unknown
  misc_feature (1)..( 10): Matrix.002 file - promoters60/2105912
gccagaaata

SEQ ID NO: 54172 - DNA, 7 bp, Unknown
  misc_feature (1)..( 7): Matrix.002 file - promoters60/2105912
acagata

SEQ ID NO: 54173 - DNA, 10 bp, Unknown
  misc_feature (1)..( 10): Matrix.002 file - promoters60/2105912
agatttgtta

SEQ ID NO: 54174 - DNA, 8 bp, Unknown
  misc_feature (1)..( 8): Matrix.002 file - promoters60/2105912
aaacagag

SEQ ID NO: 54175 - DNA, 11 bp, Unknown
  misc_feature (1)..( 11): Matrix.002 file - promoters60/2105912
aaggaatgata

SEQ ID NO: 54176 - DNA, 8 bp, Unknown
  misc_feature (1)..( 8): Matrix.002 file - promoters60/2105912
aaaaagag

SEQ ID NO: 54177 - DNA, 7 bp, Unknown
  misc_feature (1)..( 7): Matrix.002 file - promoters60/2105912
ttaattt

SEQ ID NO: 54178 - DNA, 8 bp, Unknown
  misc_feature (1)..( 8): Matrix.002 file - promoters60/2105912
ataaaaac

SEQ ID NO: 54179 - DNA, 8 bp, Unknown
  misc_feature (1)..( 8): Matrix.002 file - promoters60/2105912
aaacgaat

SEQ ID NO: 54180 - DNA, 9 bp, Unknown
  misc_feature (1)..( 9): Matrix.002 file - promoters60/2105912
gaaacagag

SEQ ID NO: 54181 - DNA, 8 bp, Unknown
  misc_feature (1)..( 8): Matrix.002 file - promoters60/2105912
aataataa

SEQ ID NO: 54182 - DNA, 6 bp, Unknown
  misc_feature (1)..( 6): Matrix.002 file - promoters60/2106027
gaaatt

SEQ ID NO: 54183 - DNA, 8 bp, Unknown
  misc_feature (1)..( 8): Matrix.002 file - promoters60/2106027
gaagagga

SEQ ID NO: 54184 - DNA, 6 bp, Unknown
  misc_feature (1)..( 6): Matrix.002 file - promoters60/2106027
ataatc

SEQ ID NO: 54185 - DNA, 9 bp, Unknown
  misc_feature (1)..( 9): Matrix.002 file - promoters60/2106027
aaagattgt

SEQ ID NO: 54186 - DNA, 8 bp, Unknown
  misc_feature (1)..( 8): Matrix.002 file - promoters60/2106027
atatcttc

SEQ ID NO: 54187 - DNA, 7 bp, Unknown
  misc_feature (1)..( 7): Matrix.002 file - promoters60/2106027
aggagat

SEQ ID NO: 54188 - DNA, 7 bp, Unknown
  misc_feature (1)..( 7): Matrix.002 file - promoters60/2106027
attctca

SEQ ID NO: 54189 - DNA, 8 bp, Unknown
  misc_feature (1)..( 8): Matrix.002 file - promoters60/2106027
tggaatcc

SEQ ID NO: 54190 - DNA, 7 bp, Unknown
  misc_feature (1)..( 7): Matrix.002 file - promoters60/2106027
atcatgc

SEQ ID NO: 54191 - DNA, 9 bp, Unknown
  misc_feature (1)..( 9): Matrix.002 file - promoters60/2106076
aagatcaaa

SEQ ID NO: 54192 - DNA, 6 bp, Unknown
  misc_feature (1)..( 6): Matrix.002 file - promoters60/2106109
tataat

SEQ ID NO: 54193 - DNA, 6 bp, Unknown
  misc_feature (1)..( 6): Matrix.002 file - promoters60/2106109
ccacca

SEQ ID NO: 54194 - DNA, 9 bp, Unknown
  misc_feature (1)..( 9): Matrix.002 file - promoters60/2106109
gtagatatt

SEQ ID NO: 54195 - DNA, 6 bp, Unknown
  misc_feature (1)..( 6): Matrix.002 file - promoters60/2106109
aacatt

SEQ ID NO: 54196 - DNA, 7 bp, Unknown
  misc_feature (1)..( 7): Matrix.002 file - promoters60/2106109
ttgatga

SEQ ID NO: 54197 - DNA, 8 bp, Unknown
  misc_feature (1)..( 8): Matrix.002 file - promoters60/2106109
ttaatcaa

SEQ ID NO: 54198 - DNA, 8 bp, Unknown
  misc_feature (1)..( 8): Matrix.002 file - promoters60/2106109
aaatggtt

SEQ ID NO: 54199 - DNA, 7 bp, Unknown
  misc_feature (1)..( 7): Matrix.002 file - promoters60/2106109
aatctct

SEQ ID NO: 54200 - DNA, 6 bp, Unknown
  misc_feature (1)..( 6): Matrix.002 file - promoters60/2106109
caaatt

SEQ ID NO: 54201 - DNA, 9 bp, Unknown
  misc_feature (1)..( 9): Matrix.002 file - promoters60/2106109
aatcaaaaa

SEQ ID NO: 54202 - DNA, 8 bp, Unknown
  misc_feature (1)..( 8): Matrix.002 file - promoters60/2106109
tatagtaa

SEQ ID NO: 54203 - DNA, 8 bp, Unknown
  misc_feature (1)..( 8): Matrix.002 file - promoters60/2106109
attttttt

SEQ ID NO: 54204 - DNA, 6 bp, Unknown
  misc_feature (1)..( 6): Matrix.002 file - promoters60/2106109
tttgtt

SEQ ID NO: 54205 - DNA, 6 bp, Unknown
  misc_feature (1)..( 6): Matrix.002 file - promoters60/2106109
tataac

SEQ ID NO: 54206 - DNA, 8 bp, Unknown
  misc_feature (1)..( 8): Matrix.002 file - promoters60/2106109
gaacaaag

SEQ ID NO: 54207 - DNA, 8 bp, Unknown
  misc_feature (1)..( 8): Matrix.002 file - promoters60/2106109
tttaaatg

SEQ ID NO: 54208 - DNA, 7 bp, Unknown
  misc_feature (1)..( 7): Matrix.002 file - promoters60/2106109
ccaaaca

SEQ ID NO: 54209 - DNA, 8 bp, Unknown
  misc_feature (1)..( 8): Matrix.002 file - promoters60/2106109
tacaaaaa

SEQ ID NO: 54210 - DNA, 8 bp, Unknown
  misc_feature (1)..( 8): Matrix.002 file - promoters60/2106109
aaaaaaag

SEQ ID NO: 54211 - DNA, 8 bp, Unknown
  misc_feature (1)..( 8): Matrix.002 file - promoters60/2106109
aacaacct

SEQ ID NO: 54212 - DNA, 7 bp, Unknown
  misc_feature (1)..( 7): Matrix.002 file - promoters60/2106659
tcttcat

SEQ ID NO: 54213 - DNA, 6 bp, Unknown
  misc_feature (1)..( 6): Matrix.002 file - promoters60/2106659
taaaac

SEQ ID NO: 54214 - DNA, 7 bp, Unknown
  misc_feature (1)..( 7): Matrix.002 file - promoters60/2106659
tatcctc

SEQ ID NO: 54215 - DNA, 6 bp, Unknown
  misc_feature (1)..( 6): Matrix.002 file - promoters60/2106659
atttat

SEQ ID NO: 54216 - DNA, 6 bp, Unknown
  misc_feature (1)..( 6): Matrix.002 file - promoters60/2106659
aaaacc

SEQ ID NO: 54217 - DNA, 7 bp, Unknown
  misc_feature (1)..( 7): Matrix.002 file - promoters60/2106659
tccgaaa

SEQ ID NO: 54218 - DNA, 9 bp, Unknown
  misc_feature (1)..( 9): Matrix.002 file - promoters60/2106659
gttagatcg

SEQ ID NO: 54219 - DNA, 6 bp, Unknown
  misc_feature (1)..( 6): Matrix.002 file - promoters60/2106659
aaatct

SEQ ID NO: 54220 - DNA, 7 bp, Unknown
  misc_feature (1)..( 7): Matrix.002 file - promoters60/2106659
atggttg

SEQ ID NO: 54221 - DNA, 6 bp, Unknown
  misc_feature (1)..( 6): Matrix.002 file - promoters60/2106659
tttgtt

SEQ ID NO: 54222 - DNA, 8 bp, Unknown
  misc_feature (1)..( 8): Matrix.002 file - promoters60/2106659
ttatcaag

SEQ ID NO: 54223 - DNA, 6 bp, Unknown
  misc_feature (1)..( 6): Matrix.002 file - promoters60/2106659
ttatct

SEQ ID NO: 54224 - DNA, 6 bp, Unknown
  misc_feature (1)..( 6): Matrix.002 file - promoters60/2106659
agtaaa

SEQ ID NO: 54225 - DNA, 7 bp, Unknown
  misc_feature (1)..( 7): Matrix.002 file - promoters60/2106659
aatcggg

SEQ ID NO: 54226 - DNA, 8 bp, Unknown
  misc_feature (1)..( 8): Matrix.002 file - promoters60/2106659
gaaacaaa

SEQ ID NO: 54227 - DNA, 10 bp, Unknown
  misc_feature (1)..( 10): Matrix.002 file - promoters60/2106659
ggaaaagaaa

SEQ ID NO: 54228 - DNA, 7 bp, Unknown
  misc_feature (1)..( 7): Matrix.002 file - promoters60/2106659
cccacta

SEQ ID NO: 54229 - DNA, 9 bp, Unknown
  misc_feature (1)..( 9): Matrix.002 file - promoters60/2106659
aaagaaaag

SEQ ID NO: 54230 - DNA, 7 bp, Unknown
  misc_feature (1)..( 7): Matrix.002 file - promoters60/2106659
gtatata

SEQ ID NO: 54231 - DNA, 9 bp, Unknown
  misc_feature (1)..( 9): Matrix.002 file - promoters60/2106682
tgagctgtt

SEQ ID NO: 54232 - DNA, 8 bp, Unknown
  misc_feature (1)..( 8): Matrix.002 file - promoters60/2106682
attacttc

SEQ ID NO: 54233 - DNA, 7 bp, Unknown
  misc_feature (1)..( 7): Matrix.002 file - promoters60/2106682
agcaaat

SEQ ID NO: 54234 - DNA, 9 bp, Unknown
  misc_feature (1)..( 9): Matrix.002 file - promoters60/2106682
aaaaaagct

SEQ ID NO: 54235 - DNA, 7 bp, Unknown
  misc_feature (1)..( 7): Matrix.002 file - promoters60/2106682
taaaggg

SEQ ID NO: 54236 - DNA, 6 bp, Unknown
  misc_feature (1)..( 6): Matrix.002 file - promoters60/2106682
tgtctc

SEQ ID NO: 54237 - DNA, 6 bp, Unknown
  misc_feature (1)..( 6): Matrix.002 file - promoters60/2106682
cctctg

SEQ ID NO: 54238 - DNA, 7 bp, Unknown
  misc_feature (1)..( 7): Matrix.002 file - promoters60/2106682
gtgacat

SEQ ID NO: 54239 - DNA, 7 bp, Unknown
  misc_feature (1)..( 7): Matrix.002 file - promoters60/2106682
taacaat

SEQ ID NO: 54240 - DNA, 6 bp, Unknown
  misc_feature (1)..( 6): Matrix.002 file - promoters60/2106682
tgtttc

SEQ ID NO: 54241 - DNA, 6 bp, Unknown
  misc_feature (1)..( 6): Matrix.002 file - promoters60/2106682
ggtccc

SEQ ID NO: 54242 - DNA, 6 bp, Unknown
  misc_feature (1)..( 6): Matrix.002 file - promoters60/2106682
tattat

SEQ ID NO: 54243 - DNA, 7 bp, Unknown
  misc_feature (1)..( 7): Matrix.002 file - promoters60/2106682
tacatat

SEQ ID NO: 54244 - DNA, 6 bp, Unknown
  misc_feature (1)..( 6): Matrix.002 file - promoters60/2106682
attctt

SEQ ID NO: 54245 - DNA, 10 bp, Unknown
  misc_feature (1)..( 10): Matrix.002 file - promoters60/2106682
taataaaaat

SEQ ID NO: 54246 - DNA, 8 bp, Unknown
  misc_feature (1)..( 8): Matrix.002 file - promoters60/2106682
caaaacta

SEQ ID NO: 54247 - DNA, 6 bp, Unknown
  misc_feature (1)..( 6): Matrix.002 file - promoters60/2106682
aacttc

SEQ ID NO: 54248 - DNA, 7 bp, Unknown
  misc_feature (1)..( 7): Matrix.002 file - promoters60/2106682
tcaaggt

SEQ ID NO: 54249 - DNA, 7 bp, Unknown
  misc_feature (1)..( 7): Matrix.002 file - promoters60/2106682
attatga

SEQ ID NO: 54250 - DNA, 9 bp, Unknown
  misc_feature (1)..( 9): Matrix.002 file - promoters60/2107016
ctttttatt

SEQ ID NO: 54251 - DNA, 9 bp, Unknown
  misc_feature (1)..( 9): Matrix.002 file - promoters60/2107016
gtcaaaaaa

SEQ ID NO: 54252 - DNA, 10 bp, Unknown
  misc_feature (1)..( 10): Matrix.002 file - promoters60/2107065
agaaaacaaa

SEQ ID NO: 54253 - DNA, 14 bp, Unknown
  misc_feature (1)..( 14): Matrix.002 file - promoters60/2107065
taattggggttaaa

SEQ ID NO: 54254 - DNA, 8 bp, Unknown
  misc_feature (1)..( 8): Matrix.002 file - promoters60/2107065
ccattata

SEQ ID NO: 54255 - DNA, 9 bp, Unknown
  misc_feature (1)..( 9): Matrix.002 file - promoters60/2107065
caaggaaag

SEQ ID NO: 54256 - DNA, 7 bp, Unknown
  misc_feature (1)..( 7): Matrix.002 file - promoters60/2107065
aaacaaa

SEQ ID NO: 54257 - DNA, 7 bp, Unknown
  misc_feature (1)..( 7): Matrix.002 file - promoters60/2107069
aagctgt

SEQ ID NO: 54258 - DNA, 7 bp, Unknown
  misc_feature (1)..( 7): Matrix.002 file - promoters60/2107069
gctaatg

SEQ ID NO: 54259 - DNA, 6 bp, Unknown
  misc_feature (1)..( 6): Matrix.002 file - promoters60/2107069
ttgatt

SEQ ID NO: 54260 - DNA, 6 bp, Unknown
  misc_feature (1)..( 6): Matrix.002 file - promoters60/2107069
gattct

SEQ ID NO: 54261 - DNA, 7 bp, Unknown
  misc_feature (1)..( 7): Matrix.002 file - promoters60/2107069
gaaatcc

SEQ ID NO: 54262 - DNA, 7 bp, Unknown
  misc_feature (1)..( 7): Matrix.002 file - promoters60/2107069
atgcaaa

SEQ ID NO: 54263 - DNA, 6 bp, Unknown
  misc_feature (1)..( 6): Matrix.002 file - promoters60/2107069
ccattg

SEQ ID NO: 54264 - DNA, 7 bp, Unknown
  misc_feature (1)..( 7): Matrix.002 file - promoters60/2107069
cttcgaa

SEQ ID NO: 54265 - DNA, 6 bp, Unknown
  misc_feature (1)..( 6): Matrix.002 file - promoters60/2107069
gttgga

SEQ ID NO: 54266 - DNA, 8 bp, Unknown
  misc_feature (1)..( 8): Matrix.002 file - promoters60/2107069
tgaaatct

SEQ ID NO: 54267 - DNA, 6 bp, Unknown
  misc_feature (1)..( 6): Matrix.002 file - promoters60/2107069
tacaac

SEQ ID NO: 54268 - DNA, 7 bp, Unknown
  misc_feature (1)..( 7): Matrix.002 file - promoters60/2107069
attcgac

SEQ ID NO: 54269 - DNA, 6 bp, Unknown
  misc_feature (1)..( 6): Matrix.002 file - promoters60/2107069
caaaac

SEQ ID NO: 54270 - DNA, 6 bp, Unknown
  misc_feature (1)..( 6): Matrix.002 file - promoters60/2107069
taccca

SEQ ID NO: 54271 - DNA, 6 bp, Unknown
  misc_feature (1)..( 6): Matrix.002 file - promoters60/2107069
ggaaaa

SEQ ID NO: 54272 - DNA, 6 bp, Unknown
  misc_feature (1)..( 6): Matrix.002 file - promoters60/2107069
gatggt

SEQ ID NO: 54273 - DNA, 7 bp, Unknown
  misc_feature (1)..( 7): Matrix.002 file - promoters60/2107069
tctcttg

SEQ ID NO: 54274 - DNA, 7 bp, Unknown
  misc_feature (1)..( 7): Matrix.002 file - promoters60/2107069
tttactc

SEQ ID NO: 54275 - DNA, 7 bp, Unknown
  misc_feature (1)..( 7): Matrix.002 file - promoters60/2107069
ctgaaac

SEQ ID NO: 54276 - DNA, 8 bp, Unknown
  misc_feature (1)..( 8): Matrix.002 file - promoters60/2113269
tttggttt

SEQ ID NO: 54277 - DNA, 10 bp, Unknown
  misc_feature (1)..( 10): Matrix.002 file - promoters60/2113269
aaacttttta

SEQ ID NO: 54278 - DNA, 8 bp, Unknown
  misc_feature (1)..( 8): Matrix.002 file - promoters60/2113269
ttataaaa

SEQ ID NO: 54279 - DNA, 8 bp, Unknown
  misc_feature (1)..( 8): Matrix.002 file - promoters60/2113269
gtaatttt

SEQ ID NO: 54280 - DNA, 14 bp, Unknown
  misc_feature (1)..( 14): Matrix.002 file - promoters60/2113269
tacctatctttata

SEQ ID NO: 54281 - DNA, 8 bp, Unknown
  misc_feature (1)..( 8): Matrix.002 file - promoters60/2113269
atataaat

SEQ ID NO: 54282 - DNA, 8 bp, Unknown
  misc_feature (1)..( 8): Matrix.002 file - promoters60/2113269
tgcataag

SEQ ID NO: 54283 - DNA, 10 bp, Unknown
  misc_feature (1)..( 10): Matrix.002 file - promoters60/2113269
tgaatctatg

SEQ ID NO: 54284 - DNA, 9 bp, Unknown
  misc_feature (1)..( 9): Matrix.002 file - promoters60/2113269
tatttaaaa

SEQ ID NO: 54285 - DNA, 12 bp, Unknown
  misc_feature (1)..( 12): Matrix.002 file - promoters60/2113269
accttttgatat

SEQ ID NO: 54286 - DNA, 10 bp, Unknown
  misc_feature (1)..( 10): Matrix.002 file - promoters60/2113269
attttcaaca

SEQ ID NO: 54287 - DNA, 8 bp, Unknown
  misc_feature (1)..( 8): Matrix.002 file - promoters60/2113269
ttttaaaa

SEQ ID NO: 54288 - DNA, 9 bp, Unknown
  misc_feature (1)..( 9): Matrix.002 file - promoters60/2113299
tgttgcata

SEQ ID NO: 54289 - DNA, 6 bp, Unknown
  misc_feature (1)..( 6): Matrix.002 file - promoters60/2113299
tatttc

SEQ ID NO: 54290 - DNA, 7 bp, Unknown
  misc_feature (1)..( 7): Matrix.002 file - promoters60/2113299
cggcggt

SEQ ID NO: 54291 - DNA, 8 bp, Unknown
  misc_feature (1)..( 8): Matrix.002 file - promoters60/2113299
taaaatca

SEQ ID NO: 54292 - DNA, 8 bp, Unknown
  misc_feature (1)..( 8): Matrix.002 file - promoters60/2113299
gtggttaa

SEQ ID NO: 54293 - DNA, 8 bp, Unknown
  misc_feature (1)..( 8): Matrix.002 file - promoters60/2113299
ataatttc

SEQ ID NO: 54294 - DNA, 7 bp, Unknown
  misc_feature (1)..( 7): Matrix.002 file - promoters60/2113299
aacactt

SEQ ID NO: 54295 - DNA, 7 bp, Unknown
  misc_feature (1)..( 7): Matrix.002 file - promoters60/2113299
tataaat

SEQ ID NO: 54296 - DNA, 9 bp, Unknown
  misc_feature (1)..( 9): Matrix.002 file - promoters60/2113299
caaaaataa

SEQ ID NO: 54297 - DNA, 8 bp, Unknown
  misc_feature (1)..( 8): Matrix.002 file - promoters60/2113299
aacaataa

SEQ ID NO: 54298 - DNA, 6 bp, Unknown
  misc_feature (1)..( 6): Matrix.002 file - promoters60/2113299
gtaaaa

SEQ ID NO: 54299 - DNA, 8 bp, Unknown
  misc_feature (1)..( 8): Matrix.002 file - promoters60/2113299
tttccatt

SEQ ID NO: 54300 - DNA, 7 bp, Unknown
  misc_feature (1)..( 7): Matrix.002 file - promoters60/2113299
tttattg

SEQ ID NO: 54301 - DNA, 7 bp, Unknown
  misc_feature (1)..( 7): Matrix.002 file - promoters60/2113315
atgcaat

SEQ ID NO: 54302 - DNA, 8 bp, Unknown
  misc_feature (1)..( 8): Matrix.002 file - promoters60/2113315
gtggaaat

SEQ ID NO: 54303 - DNA, 6 bp, Unknown
  misc_feature (1)..( 6): Matrix.002 file - promoters60/2113315
acatat

SEQ ID NO: 54304 - DNA, 6 bp, Unknown
  misc_feature (1)..( 6): Matrix.002 file - promoters60/2113315
atatgg

SEQ ID NO: 54305 - DNA, 6 bp, Unknown
  misc_feature (1)..( 6): Matrix.002 file - promoters60/2113315
ataata

SEQ ID NO: 54306 - DNA, 8 bp, Unknown
  misc_feature (1)..( 8): Matrix.002 file - promoters60/2113315
ttggcaaa

SEQ ID NO: 54307 - DNA, 7 bp, Unknown
  misc_feature (1)..( 7): Matrix.002 file - promoters60/2113315
ttacaaa

SEQ ID NO: 54308 - DNA, 6 bp, Unknown
  misc_feature (1)..( 6): Matrix.002 file - promoters60/2113315
ttaatt

SEQ ID NO: 54309 - DNA, 7 bp, Unknown
  misc_feature (1)..( 7): Matrix.002 file - promoters60/2113315
ataaaaa

SEQ ID NO: 54310 - DNA, 6 bp, Unknown
  misc_feature (1)..( 6): Matrix.002 file - promoters60/2113315
taaaat

SEQ ID NO: 54311 - DNA, 6 bp, Unknown
  misc_feature (1)..( 6): Matrix.002 file - promoters60/2113315
ctaaaa

SEQ ID NO: 54312 - DNA, 8 bp, Unknown
  misc_feature (1)..( 8): Matrix.002 file - promoters60/2113315
aaaatctc

SEQ ID NO: 54313 - DNA, 6 bp, Unknown
  misc_feature (1)..( 6): Matrix.002 file - promoters60/2113315
ttagtg

SEQ ID NO: 54314 - DNA, 7 bp, Unknown
  misc_feature (1)..( 7): Matrix.002 file - promoters60/2113315
taagaag

SEQ ID NO: 54315 - DNA, 6 bp, Unknown
  misc_feature (1)..( 6): Matrix.002 file - promoters60/2113315
aagtaa

SEQ ID NO: 54316 - DNA, 6 bp, Unknown
  misc_feature (1)..( 6): Matrix.002 file - promoters60/2113315
ttaaaa

SEQ ID NO: 54317 - DNA, 6 bp, Unknown
  misc_feature (1)..( 6): Matrix.002 file - promoters60/2113315
aactct

SEQ ID NO: 54318 - DNA, 7 bp, Unknown
  misc_feature (1)..( 7): Matrix.002 file - promoters60/2113315
attattt

SEQ ID NO: 54319 - DNA, 8 bp, Unknown
  misc_feature (1)..( 8): Matrix.002 file - promoters60/2113315
aataataa

SEQ ID NO: 54320 - DNA, 7 bp, Unknown
  misc_feature (1)..( 7): Matrix.002 file - promoters60/2113315
ttcctta

SEQ ID NO: 54321 - DNA, 7 bp, Unknown
  misc_feature (1)..( 7): Matrix.002 file - promoters60/2113315
actctat

SEQ ID NO: 54322 - DNA, 8 bp, Unknown
  misc_feature (1)..( 8): Matrix.002 file - promoters60/2113323
aaacaacc

SEQ ID NO: 54323 - DNA, 9 bp, Unknown
  misc_feature (1)..( 9): Matrix.002 file - promoters60/2113323
tgtcaagta

SEQ ID NO: 54324 - DNA, 9 bp, Unknown
  misc_feature (1)..( 9): Matrix.002 file - promoters60/2113323
caattattt

SEQ ID NO: 54325 - DNA, 8 bp, Unknown
  misc_feature (1)..( 8): Matrix.002 file - promoters60/2113323
gattgttt

SEQ ID NO: 54326 - DNA, 14 bp, Unknown
  misc_feature (1)..( 14): Matrix.002 file - promoters60/2113323
ttttctatagatta

SEQ ID NO: 54327 - DNA, 7 bp, Unknown
  misc_feature (1)..( 7): Matrix.002 file - promoters60/2113454
cttctta

SEQ ID NO: 54328 - DNA, 7 bp, Unknown
  misc_feature (1)..( 7): Matrix.002 file - promoters60/2113454
tctaatc

SEQ ID NO: 54329 - DNA, 6 bp, Unknown
  misc_feature (1)..( 6): Matrix.002 file - promoters60/2113454
aaataa

SEQ ID NO: 54330 - DNA, 6 bp, Unknown
  misc_feature (1)..( 6): Matrix.002 file - promoters60/2113454
aacaaa

SEQ ID NO: 54331 - DNA, 8 bp, Unknown
  misc_feature (1)..( 8): Matrix.002 file - promoters60/2113454
aaatgtat

SEQ ID NO: 54332 - DNA, 6 bp, Unknown
  misc_feature (1)..( 6): Matrix.002 file - promoters60/2113454
ttttgt

SEQ ID NO: 54333 - DNA, 7 bp, Unknown
  misc_feature (1)..( 7): Matrix.002 file - promoters60/2113454
tatacaa

SEQ ID NO: 54334 - DNA, 8 bp, Unknown
  misc_feature (1)..( 8): Matrix.002 file - promoters60/2113454
aaatatct

SEQ ID NO: 54335 - DNA, 6 bp, Unknown
  misc_feature (1)..( 6): Matrix.002 file - promoters60/2113454
tagtaa

SEQ ID NO: 54336 - DNA, 8 bp, Unknown
  misc_feature (1)..( 8): Matrix.002 file - promoters60/2113454
ttgaaatg

SEQ ID NO: 54337 - DNA, 8 bp, Unknown
  misc_feature (1)..( 8): Matrix.002 file - promoters60/2113454
tgattatt

SEQ ID NO: 54338 - DNA, 7 bp, Unknown
  misc_feature (1)..( 7): Matrix.002 file - promoters60/2113454
aaataaa

SEQ ID NO: 54339 - DNA, 7 bp, Unknown
  misc_feature (1)..( 7): Matrix.002 file - promoters60/2113454
atcatgt

SEQ ID NO: 54340 - DNA, 11 bp, Unknown
  misc_feature (1)..( 11): Matrix.002 file - promoters60/2113454
ttcctcaaaca

SEQ ID NO: 54341 - DNA, 7 bp, Unknown
  misc_feature (1)..( 7): Matrix.002 file - promoters60/2113454
gttacaa

SEQ ID NO: 54342 - DNA, 7 bp, Unknown
  misc_feature (1)..( 7): Matrix.002 file - promoters60/2113454
tccatca

SEQ ID NO: 54343 - DNA, 6 bp, Unknown
  misc_feature (1)..( 6): Matrix.002 file - promoters60/2113454
attcat

SEQ ID NO: 54344 - DNA, 7 bp, Unknown
  misc_feature (1)..( 7): Matrix.002 file - promoters60/2113454
acctaat

SEQ ID NO: 54345 - DNA, 8 bp, Unknown
  misc_feature (1)..( 8): Matrix.002 file - promoters60/2113454
taagttat

SEQ ID NO: 54346 - DNA, 8 bp, Unknown
  misc_feature (1)..( 8): Matrix.002 file - promoters60/2113454
ttctagtt

SEQ ID NO: 54347 - DNA, 8 bp, Unknown
  misc_feature (1)..( 8): Matrix.002 file - promoters60/2113454
tttaccaa

SEQ ID NO: 54348 - DNA, 6 bp, Unknown
  misc_feature (1)..( 6): Matrix.002 file - promoters60/2113454
caactt

SEQ ID NO: 54349 - DNA, 7 bp, Unknown
  misc_feature (1)..( 7): Matrix.002 file - promoters60/2113454
gtcaaaa

SEQ ID NO: 54350 - DNA, 7 bp, Unknown
  misc_feature (1)..( 7): Matrix.002 file - promoters60/2113454
aaattga

SEQ ID NO: 54351 - DNA, 7 bp, Unknown
  misc_feature (1)..( 7): Matrix.002 file - promoters60/2113454
catcagg

SEQ ID NO: 54352 - DNA, 10 bp, Unknown
  misc_feature (1)..( 10): Matrix.002 file - promoters60/2113462
atcttacata

SEQ ID NO: 54353 - DNA, 16 bp, Unknown
  misc_feature (1)..( 16): Matrix.002 file - promoters60/2113462
aaattaaaatataaaa

SEQ ID NO: 54354 - DNA, 8 bp, Unknown
  misc_feature (1)..( 8): Matrix.002 file - promoters60/2113462
cttatttc

SEQ ID NO: 54355 - DNA, 8 bp, Unknown
  misc_feature (1)..( 8): Matrix.002 file - promoters60/2113462
agatgaaa

SEQ ID NO: 54356 - DNA, 9 bp, Unknown
  misc_feature (1)..( 9): Matrix.002 file - promoters60/2113462
aacttaatc

SEQ ID NO: 54357 - DNA, 9 bp, Unknown
  misc_feature (1)..( 9): Matrix.002 file - promoters60/2113462
attgataat

SEQ ID NO: 54358 - DNA, 9 bp, Unknown
  misc_feature (1)..( 9): Matrix.002 file - promoters60/2113462
aaaatgaac

SEQ ID NO: 54359 - DNA, 7 bp, Unknown
  misc_feature (1)..( 7): Matrix.002 file - promoters60/2113462
aaaatta

SEQ ID NO: 54360 - DNA, 8 bp, Unknown
  misc_feature (1)..( 8): Matrix.002 file - promoters60/2113462
aaaattaa

SEQ ID NO: 54361 - DNA, 10 bp, Unknown
  misc_feature (1)..( 10): Matrix.002 file - promoters60/2113462
atctcataaa

SEQ ID NO: 54362 - DNA, 11 bp, Unknown
  misc_feature (1)..( 11): Matrix.002 file - promoters60/2113466
catataatttg

SEQ ID NO: 54363 - DNA, 6 bp, Unknown
  misc_feature (1)..( 6): Matrix.002 file - promoters60/2113466
attcat

SEQ ID NO: 54364 - DNA, 7 bp, Unknown
  misc_feature (1)..( 7): Matrix.002 file - promoters60/2113466
ttacaat

SEQ ID NO: 54365 - DNA, 9 bp, Unknown
  misc_feature (1)..( 9): Matrix.002 file - promoters60/2113466
ataatatat

SEQ ID NO: 54366 - DNA, 9 bp, Unknown
  misc_feature (1)..( 9): Matrix.002 file - promoters60/2113466
atttatgtt

SEQ ID NO: 54367 - DNA, 6 bp, Unknown
  misc_feature (1)..( 6): Matrix.002 file - promoters60/2113466
taagtt

SEQ ID NO: 54368 - DNA, 12 bp, Unknown
  misc_feature (1)..( 12): Matrix.002 file - promoters60/2113466
cttgtaaccaca

SEQ ID NO: 54369 - DNA, 8 bp, Unknown
  misc_feature (1)..( 8): Matrix.002 file - promoters60/2113466
ttaatatg

SEQ ID NO: 54370 - DNA, 7 bp, Unknown
  misc_feature (1)..( 7): Matrix.002 file - promoters60/2113466
tatatgt

SEQ ID NO: 54371 - DNA, 9 bp, Unknown
  misc_feature (1)..( 9): Matrix.002 file - promoters60/2113466
ctaaaaaac

SEQ ID NO: 54372 - DNA, 6 bp, Unknown
  misc_feature (1)..( 6): Matrix.002 file - promoters60/2113466
aaaaat

SEQ ID NO: 54373 - DNA, 7 bp, Unknown
  misc_feature (1)..( 7): Matrix.002 file - promoters60/2113466
ttttgct

SEQ ID NO: 54374 - DNA, 7 bp, Unknown
  misc_feature (1)..( 7): Matrix.002 file - promoters60/2113466
aagtttt

SEQ ID NO: 54375 - DNA, 9 bp, Unknown
  misc_feature (1)..( 9): Matrix.002 file - promoters60/2113466
ataacaata

SEQ ID NO: 54376 - DNA, 6 bp, Unknown
  misc_feature (1)..( 6): Matrix.002 file - promoters60/2113466
tttttg

SEQ ID NO: 54377 - DNA, 7 bp, Unknown
  misc_feature (1)..( 7): Matrix.002 file - promoters60/2113466
ttgattg

SEQ ID NO: 54378 - DNA, 9 bp, Unknown
  misc_feature (1)..( 9): Matrix.002 file - promoters60/2113466
acataaacc

SEQ ID NO: 54379 - DNA, 6 bp, Unknown
  misc_feature (1)..( 6): Matrix.002 file - promoters60/2113466
aacctt

SEQ ID NO: 54380 - DNA, 6 bp, Unknown
  misc_feature (1)..( 6): Matrix.002 file - promoters60/2113466
tttgta

SEQ ID NO: 54381 - DNA, 7 bp, Unknown
  misc_feature (1)..( 7): Matrix.002 file - promoters60/2113466
caaaata

SEQ ID NO: 54382 - DNA, 6 bp, Unknown
  misc_feature (1)..( 6): Matrix.002 file - promoters60/2113466
atatac

SEQ ID NO: 54383 - DNA, 10 bp, Unknown
  misc_feature (1)..( 10): Matrix.002 file - promoters60/2113466
atatatgcat

SEQ ID NO: 54384 - DNA, 6 bp, Unknown
  misc_feature (1)..( 6): Matrix.002 file - promoters60/2113466
tatttt

SEQ ID NO: 54385 - DNA, 7 bp, Unknown
  misc_feature (1)..( 7): Matrix.002 file - promoters60/2113466
tttgttt

SEQ ID NO: 54386 - DNA, 7 bp, Unknown
  misc_feature (1)..( 7): Matrix.002 file - promoters60/2113466
tttaatt

SEQ ID NO: 54387 - DNA, 10 bp, Unknown
  misc_feature (1)..( 10): Matrix.002 file - promoters60/2113466
aattaaacct

SEQ ID NO: 54388 - DNA, 6 bp, Unknown
  misc_feature (1)..( 6): Matrix.002 file - promoters60/2113466
aaaaca

SEQ ID NO: 54389 - DNA, 7 bp, Unknown
  misc_feature (1)..( 7): Matrix.002 file - promoters60/2113466
tttcaat

SEQ ID NO: 54390 - DNA, 14 bp, Unknown
  misc_feature (1)..( 14): Matrix.002 file - promoters60/2113481
caaatgatacattt

SEQ ID NO: 54391 - DNA, 11 bp, Unknown
  misc_feature (1)..( 11): Matrix.002 file - promoters60/2113481
ttaaataactt

SEQ ID NO: 54392 - DNA, 8 bp, Unknown
  misc_feature (1)..( 8): Matrix.002 file - promoters60/2113481
tataaata

SEQ ID NO: 54393 - DNA, 8 bp, Unknown
  misc_feature (1)..( 8): Matrix.002 file - promoters60/2113481
aagaaaat

SEQ ID NO: 54394 - DNA, 9 bp, Unknown
  misc_feature (1)..( 9): Matrix.002 file - promoters60/2113481
agaatctaa

SEQ ID NO: 54395 - DNA, 12 bp, Unknown
  misc_feature (1)..( 12): Matrix.002 file - promoters60/2113481
attagttaatat

SEQ ID NO: 54396 - DNA, 5 bp, Unknown
  misc_feature (1)..( 5): Matrix.002 file - promoters60/2113481
aacat

SEQ ID NO: 54397 - DNA, 8 bp, Unknown
  misc_feature (1)..( 8): Matrix.002 file - promoters60/2113481
atataata

SEQ ID NO: 54398 - DNA, 15 bp, Unknown
  misc_feature (1)..( 15): Matrix.002 file - promoters60/2113502
aaaaagggccaaaat

SEQ ID NO: 54399 - DNA, 6 bp, Unknown
  misc_feature (1)..( 6): Matrix.002 file - promoters60/2113592
taaaca

SEQ ID NO: 54400 - DNA, 10 bp, Unknown
  misc_feature (1)..( 10): Matrix.002 file - promoters60/2113592
tttttagatc

SEQ ID NO: 54401 - DNA, 9 bp, Unknown
  misc_feature (1)..( 9): Matrix.002 file - promoters60/2113592
aaatctttt

SEQ ID NO: 54402 - DNA, 7 bp, Unknown
  misc_feature (1)..( 7): Matrix.002 file - promoters60/2113592
gatatat

SEQ ID NO: 54403 - DNA, 6 bp, Unknown
  misc_feature (1)..( 6): Matrix.002 file - promoters60/2113592
ttttca

SEQ ID NO: 54404 - DNA, 7 bp, Unknown
  misc_feature (1)..( 7): Matrix.002 file - promoters60/2113592
cgaacaa

SEQ ID NO: 54405 - DNA, 7 bp, Unknown
  misc_feature (1)..( 7): Matrix.002 file - promoters60/2113592
atatcta

SEQ ID NO: 54406 - DNA, 9 bp, Unknown
  misc_feature (1)..( 9): Matrix.002 file - promoters60/2113592
ttactgttt

SEQ ID NO: 54407 - DNA, 10 bp, Unknown
  misc_feature (1)..( 10): Matrix.002 file - promoters60/2113592
attacttttt

SEQ ID NO: 54408 - DNA, 7 bp, Unknown
  misc_feature (1)..( 7): Matrix.002 file - promoters60/2113592
acaaaag

SEQ ID NO: 54409 - DNA, 7 bp, Unknown
  misc_feature (1)..( 7): Matrix.002 file - promoters60/2113592
ttgagtt

SEQ ID NO: 54410 - DNA, 10 bp, Unknown
  misc_feature (1)..( 10): Matrix.002 file - promoters60/2113592
actatatata

SEQ ID NO: 54411 - DNA, 8 bp, Unknown
  misc_feature (1)..( 8): Matrix.002 file - promoters60/2113592
acatagga

SEQ ID NO: 54412 - DNA, 6 bp, Unknown
  misc_feature (1)..( 6): Matrix.002 file - promoters60/2113592
tcaaat

SEQ ID NO: 54413 - DNA, 6 bp, Unknown
  misc_feature (1)..( 6): Matrix.002 file - promoters60/2113592
aaatta

SEQ ID NO: 54414 - DNA, 8 bp, Unknown
  misc_feature (1)..( 8): Matrix.002 file - promoters60/2113592
attactat

SEQ ID NO: 54415 - DNA, 6 bp, Unknown
  misc_feature (1)..( 6): Matrix.002 file - promoters60/2113592
atcgaa

SEQ ID NO: 54416 - DNA, 8 bp, Unknown
  misc_feature (1)..( 8): Matrix.002 file - promoters60/2113592
gaagtcac

SEQ ID NO: 54417 - DNA, 7 bp, Unknown
  misc_feature (1)..( 7): Matrix.002 file - promoters60/2113592
aaataat

SEQ ID NO: 54418 - DNA, 8 bp, Unknown
  misc_feature (1)..( 8): Matrix.002 file - promoters60/2113620
gaaggaag

SEQ ID NO: 54419 - DNA, 7 bp, Unknown
  misc_feature (1)..( 7): Matrix.002 file - promoters60/2113620
caaagaa

SEQ ID NO: 54420 - DNA, 7 bp, Unknown
  misc_feature (1)..( 7): Matrix.002 file - promoters60/2113620
atcacag

SEQ ID NO: 54421 - DNA, 6 bp, Unknown
  misc_feature (1)..( 6): Matrix.002 file - promoters60/2113620
tagtga

SEQ ID NO: 54422 - DNA, 8 bp, Unknown
  misc_feature (1)..( 8): Matrix.002 file - promoters60/2113620
tgtgactt

SEQ ID NO: 54423 - DNA, 6 bp, Unknown
  misc_feature (1)..( 6): Matrix.002 file - promoters60/2113620
ttgcaa

SEQ ID NO: 54424 - DNA, 6 bp, Unknown
  misc_feature (1)..( 6): Matrix.002 file - promoters60/2113620
attgtg

SEQ ID NO: 54425 - DNA, 7 bp, Unknown
  misc_feature (1)..( 7): Matrix.002 file - promoters60/2113620
tgcatgt

SEQ ID NO: 54426 - DNA, 8 bp, Unknown
  misc_feature (1)..( 8): Matrix.002 file - promoters60/2113620
caagttta

SEQ ID NO: 54427 - DNA, 9 bp, Unknown
  misc_feature (1)..( 9): Matrix.002 file - promoters60/2113620
accagccaa

SEQ ID NO: 54428 - DNA, 7 bp, Unknown
  misc_feature (1)..( 7): Matrix.002 file - promoters60/2113620
tgtattg

SEQ ID NO: 54429 - DNA, 6 bp, Unknown
  misc_feature (1)..( 6): Matrix.002 file - promoters60/2113620
atttgt

SEQ ID NO: 54430 - DNA, 7 bp, Unknown
  misc_feature (1)..( 7): Matrix.002 file - promoters60/2113620
tatgact

SEQ ID NO: 54431 - DNA, 8 bp, Unknown
  misc_feature (1)..( 8): Matrix.002 file - promoters60/2113620
ggtgggat

SEQ ID NO: 54432 - DNA, 6 bp, Unknown
  misc_feature (1)..( 6): Matrix.002 file - promoters60/2113620
tggaaa

SEQ ID NO: 54433 - DNA, 8 bp, Unknown
  misc_feature (1)..( 8): Matrix.002 file - promoters60/2113620
caacacca

SEQ ID NO: 54434 - DNA, 7 bp, Unknown
  misc_feature (1)..( 7): Matrix.002 file - promoters60/2113620
ttaattg

SEQ ID NO: 54435 - DNA, 8 bp, Unknown
  misc_feature (1)..( 8): Matrix.002 file - promoters60/2113620
acttcata

SEQ ID NO: 54436 - DNA, 7 bp, Unknown
  misc_feature (1)..( 7): Matrix.002 file - promoters60/2113620
catatcc

SEQ ID NO: 54437 - DNA, 11 bp, Unknown
  misc_feature (1)..( 11): Matrix.002 file - promoters60/2113624
tgtatttaaac

SEQ ID NO: 54438 - DNA, 8 bp, Unknown
  misc_feature (1)..( 8): Matrix.002 file - promoters60/2113624
tctttaat

SEQ ID NO: 54439 - DNA, 9 bp, Unknown
  misc_feature (1)..( 9): Matrix.002 file - promoters60/2113624
ttaaaaaaa

SEQ ID NO: 54440 - DNA, 9 bp, Unknown
  misc_feature (1)..( 9): Matrix.002 file - promoters60/2113624
gtataaaac

SEQ ID NO: 54441 - DNA, 7 bp, Unknown
  misc_feature (1)..( 7): Matrix.002 file - promoters60/2113624
ttacaat

SEQ ID NO: 54442 - DNA, 9 bp, Unknown
  misc_feature (1)..( 9): Matrix.002 file - promoters60/2113624
tcatttttt

SEQ ID NO: 54443 - DNA, 9 bp, Unknown
  misc_feature (1)..( 9): Matrix.002 file - promoters60/2113631
gcttcgttt

SEQ ID NO: 54444 - DNA, 6 bp, Unknown
  misc_feature (1)..( 6): Matrix.002 file - promoters60/2113631
gacatt

SEQ ID NO: 54445 - DNA, 6 bp, Unknown
  misc_feature (1)..( 6): Matrix.002 file - promoters60/2113631
ttctaa

SEQ ID NO: 54446 - DNA, 9 bp, Unknown
  misc_feature (1)..( 9): Matrix.002 file - promoters60/2113631
taacgtcaa

SEQ ID NO: 54447 - DNA, 7 bp, Unknown
  misc_feature (1)..( 7): Matrix.002 file - promoters60/2113631
acaaaat

SEQ ID NO: 54448 - DNA, 7 bp, Unknown
  misc_feature (1)..( 7): Matrix.002 file - promoters60/2113631
aatctcc

SEQ ID NO: 54449 - DNA, 8 bp, Unknown
  misc_feature (1)..( 8): Matrix.002 file - promoters60/2113631
aaaacctt

SEQ ID NO: 54450 - DNA, 8 bp, Unknown
  misc_feature (1)..( 8): Matrix.002 file - promoters60/2113631
atggataa

SEQ ID NO: 54451 - DNA, 9 bp, Unknown
  misc_feature (1)..( 9): Matrix.002 file - promoters60/2113631
caatgttgt

SEQ ID NO: 54452 - DNA, 6 bp, Unknown
  misc_feature (1)..( 6): Matrix.002 file - promoters60/2113631
tccttg

SEQ ID NO: 54453 - DNA, 6 bp, Unknown
  misc_feature (1)..( 6): Matrix.002 file - promoters60/2113631
gttatt

SEQ ID NO: 54454 - DNA, 7 bp, Unknown
  misc_feature (1)..( 7): Matrix.002 file - promoters60/2113631
aaaccaa

SEQ ID NO: 54455 - DNA, 6 bp, Unknown
  misc_feature (1)..( 6): Matrix.002 file - promoters60/2113631
agtaaa

SEQ ID NO: 54456 - DNA, 7 bp, Unknown
  misc_feature (1)..( 7): Matrix.002 file - promoters60/2113631
aatcggg

SEQ ID NO: 54457 - DNA, 8 bp, Unknown
  misc_feature (1)..( 8): Matrix.002 file - promoters60/2113631
gaaacaaa

SEQ ID NO: 54458 - DNA, 10 bp, Unknown
  misc_feature (1)..( 10): Matrix.002 file - promoters60/2113631
ggaaaagaaa

SEQ ID NO: 54459 - DNA, 7 bp, Unknown
  misc_feature (1)..( 7): Matrix.002 file - promoters60/2113631
cccacta

SEQ ID NO: 54460 - DNA, 9 bp, Unknown
  misc_feature (1)..( 9): Matrix.002 file - promoters60/2113631
aaagaaaag

SEQ ID NO: 54461 - DNA, 7 bp, Unknown
  misc_feature (1)..( 7): Matrix.002 file - promoters60/2113631
gtatata

SEQ ID NO: 54462 - DNA, 10 bp, Unknown
  misc_feature (1)..( 10): Matrix.002 file - promoters60/2113640
ctaaactaaa

SEQ ID NO: 54463 - DNA, 9 bp, Unknown
  misc_feature (1)..( 9): Matrix.002 file - promoters60/2113640
tagatttta

SEQ ID NO: 54464 - DNA, 8 bp, Unknown
  misc_feature (1)..( 8): Matrix.002 file - promoters60/2113640
aaaattaa

SEQ ID NO: 54465 - DNA, 7 bp, Unknown
  misc_feature (1)..( 7): Matrix.002 file - promoters60/2113640
aatatat

SEQ ID NO: 54466 - DNA, 7 bp, Unknown
  misc_feature (1)..( 7): Matrix.002 file - promoters60/2113640
ataaaca

SEQ ID NO: 54467 - DNA, 9 bp, Unknown
  misc_feature (1)..( 9): Matrix.002 file - promoters60/2113640
aatcgaata

SEQ ID NO: 54468 - DNA, 8 bp, Unknown
  misc_feature (1)..( 8): Matrix.002 file - promoters60/2113640
atttgtta

SEQ ID NO: 54469 - DNA, 9 bp, Unknown
  misc_feature (1)..( 9): Matrix.002 file - promoters60/2113640
aaaattaca

SEQ ID NO: 54470 - DNA, 9 bp, Unknown
  misc_feature (1)..( 9): Matrix.002 file - promoters60/2113660
ccaagaaaa

SEQ ID NO: 54471 - DNA, 7 bp, Unknown
  misc_feature (1)..( 7): Matrix.002 file - promoters60/2113660
aaataaa

SEQ ID NO: 54472 - DNA, 6 bp, Unknown
  misc_feature (1)..( 6): Matrix.002 file - promoters60/2113660
ataata

SEQ ID NO: 54473 - DNA, 6 bp, Unknown
  misc_feature (1)..( 6): Matrix.002 file - promoters60/2113660
atttgc

SEQ ID NO: 54474 - DNA, 7 bp, Unknown
  misc_feature (1)..( 7): Matrix.002 file - promoters60/2113660
aaataaa

SEQ ID NO: 54475 - DNA, 6 bp, Unknown
  misc_feature (1)..( 6): Matrix.002 file - promoters60/2113660
caagta

SEQ ID NO: 54476 - DNA, 7 bp, Unknown
  misc_feature (1)..( 7): Matrix.002 file - promoters60/2113660
gaaagaa

SEQ ID NO: 54477 - DNA, 7 bp, Unknown
  misc_feature (1)..( 7): Matrix.002 file - promoters60/2113660
cacaaag

SEQ ID NO: 54478 - DNA, 6 bp, Unknown
  misc_feature (1)..( 6): Matrix.002 file - promoters60/2113660
acataa

SEQ ID NO: 54479 - DNA, 6 bp, Unknown
  misc_feature (1)..( 6): Matrix.002 file - promoters60/2113660
tcagta

SEQ ID NO: 54480 - DNA, 8 bp, Unknown
  misc_feature (1)..( 8): Matrix.002 file - promoters60/2113660
atagtaaa

SEQ ID NO: 54481 - DNA, 6 bp, Unknown
  misc_feature (1)..( 6): Matrix.002 file - promoters60/2113660
aaattg

SEQ ID NO: 54482 - DNA, 8 bp, Unknown
  misc_feature (1)..( 8): Matrix.002 file - promoters60/2113660
agaaattt

SEQ ID NO: 54483 - DNA, 7 bp, Unknown
  misc_feature (1)..( 7): Matrix.002 file - promoters60/2113660
tttgaat

SEQ ID NO: 54484 - DNA, 7 bp, Unknown
  misc_feature (1)..( 7): Matrix.002 file - promoters60/2113660
acttcaa

SEQ ID NO: 54485 - DNA, 7 bp, Unknown
  misc_feature (1)..( 7): Matrix.002 file - promoters60/2113660
aatcttg

SEQ ID NO: 54486 - DNA, 6 bp, Unknown
  misc_feature (1)..( 6): Matrix.002 file - promoters60/2113660
gacaaa

SEQ ID NO: 54487 - DNA, 7 bp, Unknown
  misc_feature (1)..( 7): Matrix.002 file - promoters60/2113660
attcttt

SEQ ID NO: 54488 - DNA, 6 bp, Unknown
  misc_feature (1)..( 6): Matrix.002 file - promoters60/2113660
taaatc

SEQ ID NO: 54489 - DNA, 8 bp, Unknown
  misc_feature (1)..( 8): Matrix.002 file - promoters60/2113675
gtagagaa

SEQ ID NO: 54490 - DNA, 8 bp, Unknown
  misc_feature (1)..( 8): Matrix.002 file - promoters60/2113675
gaagaaat

SEQ ID NO: 54491 - DNA, 10 bp, Unknown
  misc_feature (1)..( 10): Matrix.002 file - promoters60/2113675
actttataat

SEQ ID NO: 54492 - DNA, 9 bp, Unknown
  misc_feature (1)..( 9): Matrix.002 file - promoters60/2113734
aattaaaga

SEQ ID NO: 54493 - DNA, 11 bp, Unknown
  misc_feature (1)..( 11): Matrix.002 file - promoters60/2113734
aattaaaataa

SEQ ID NO: 54494 - DNA, 9 bp, Unknown
  misc_feature (1)..( 9): Matrix.002 file - promoters60/2113734
aaagtttaa

SEQ ID NO: 54495 - DNA, 11 bp, Unknown
  misc_feature (1)..( 11): Matrix.002 file - promoters60/2113738
acagaattgaa

SEQ ID NO: 54496 - DNA, 9 bp, Unknown
  misc_feature (1)..( 9): Matrix.002 file - promoters60/2113738
gaaatattt

SEQ ID NO: 54497 - DNA, 13 bp, Unknown
  misc_feature (1)..( 13): Matrix.002 file - promoters60/2113738
taattttttttct

SEQ ID NO: 54498 - DNA, 13 bp, Unknown
  misc_feature (1)..( 13): Matrix.002 file - promoters60/2113839
attcataaaaaaa

SEQ ID NO: 54499 - DNA, 8 bp, Unknown
  misc_feature (1)..( 8): Matrix.002 file - promoters60/2113839
gaaaaaat

SEQ ID NO: 54500 - DNA, 12 bp, Unknown
  misc_feature (1)..( 12): Matrix.002 file - promoters60/2113839
aactaatgcaat

SEQ ID NO: 54501 - DNA, 11 bp, Unknown
  misc_feature (1)..( 11): Matrix.002 file - promoters60/2113839
atttctaaaaa

SEQ ID NO: 54502 - DNA, 10 bp, Unknown
  misc_feature (1)..( 10): Matrix.002 file - promoters60/2113839
aaagaaaaca

SEQ ID NO: 54503 - DNA, 9 bp, Unknown
  misc_feature (1)..( 9): Matrix.002 file - promoters60/2113839
caaaacaaa

SEQ ID NO: 54504 - DNA, 7 bp, Unknown
  misc_feature (1)..( 7): Matrix.002 file - promoters60/2113839
aattttg

SEQ ID NO: 54505 - DNA, 9 bp, Unknown
  misc_feature (1)..( 9): Matrix.002 file - promoters60/2113839
ttttgttta

SEQ ID NO: 54506 - DNA, 8 bp, Unknown
  misc_feature (1)..( 8): Matrix.002 file - promoters60/2113839
ttgagatc

SEQ ID NO: 54507 - DNA, 9 bp, Unknown
  misc_feature (1)..( 9): Matrix.002 file - promoters60/2113839
gaaatgaag

SEQ ID NO: 54508 - DNA, 8 bp, Unknown
  misc_feature (1)..( 8): Matrix.002 file - promoters60/2113839
aaaaatat

SEQ ID NO: 54509 - DNA, 12 bp, Unknown
  misc_feature (1)..( 12): Matrix.002 file - promoters60/2113839
ttttattaaaat

SEQ ID NO: 54510 - DNA, 9 bp, Unknown
  misc_feature (1)..( 9): Matrix.002 file - promoters60/2113839
ctttcacaa

SEQ ID NO: 54511 - DNA, 10 bp, Unknown
  misc_feature (1)..( 10): Matrix.002 file - promoters60/2113839
aaaataaatt

SEQ ID NO: 54512 - DNA, 7 bp, Unknown
  misc_feature (1)..( 7): Matrix.002 file - promoters60/2113839
ctataaa

SEQ ID NO: 54513 - DNA, 10 bp, Unknown
  misc_feature (1)..( 10): Matrix.002 file - promoters60/2113842
ttaatctttt

SEQ ID NO: 54514 - DNA, 8 bp, Unknown
  misc_feature (1)..( 8): Matrix.002 file - promoters60/2113842
ttttatat

SEQ ID NO: 54515 - DNA, 7 bp, Unknown
  misc_feature (1)..( 7): Matrix.002 file - promoters60/2113842
tttagat

SEQ ID NO: 54516 - DNA, 6 bp, Unknown
  misc_feature (1)..( 6): Matrix.002 file - promoters60/2113842
ttatat

SEQ ID NO: 54517 - DNA, 10 bp, Unknown
  misc_feature (1)..( 10): Matrix.002 file - promoters60/2113842
cgtaaaaata

SEQ ID NO: 54518 - DNA, 7 bp, Unknown
  misc_feature (1)..( 7): Matrix.002 file - promoters60/2113842
aaaataa

SEQ ID NO: 54519 - DNA, 7 bp, Unknown
  misc_feature (1)..( 7): Matrix.002 file - promoters60/2113842
aacgtta

SEQ ID NO: 54520 - DNA, 6 bp, Unknown
  misc_feature (1)..( 6): Matrix.002 file - promoters60/2113842
gtatca

SEQ ID NO: 54521 - DNA, 8 bp, Unknown
  misc_feature (1)..( 8): Matrix.002 file - promoters60/2113842
ctcaatat

SEQ ID NO: 54522 - DNA, 7 bp, Unknown
  misc_feature (1)..( 7): Matrix.002 file - promoters60/2113842
aaaatca

SEQ ID NO: 54523 - DNA, 8 bp, Unknown
  misc_feature (1)..( 8): Matrix.002 file - promoters60/2113842
attcacat

SEQ ID NO: 54524 - DNA, 7 bp, Unknown
  misc_feature (1)..( 7): Matrix.002 file - promoters60/2113842
taaattt

SEQ ID NO: 54525 - DNA, 6 bp, Unknown
  misc_feature (1)..( 6): Matrix.002 file - promoters60/2113842
atattt

SEQ ID NO: 54526 - DNA, 7 bp, Unknown
  misc_feature (1)..( 7): Matrix.002 file - promoters60/2113842
tcaaaaa

SEQ ID NO: 54527 - DNA, 6 bp, Unknown
  misc_feature (1)..( 6): Matrix.002 file - promoters60/2113842
attgct

SEQ ID NO: 54528 - DNA, 6 bp, Unknown
  misc_feature (1)..( 6): Matrix.002 file - promoters60/2113842
atctaa

SEQ ID NO: 54529 - DNA, 7 bp, Unknown
  misc_feature (1)..( 7): Matrix.002 file - promoters60/2113842
aaccacc

SEQ ID NO: 54530 - DNA, 7 bp, Unknown
  misc_feature (1)..( 7): Matrix.002 file - promoters60/2113842
atggtca

SEQ ID NO: 54531 - DNA, 8 bp, Unknown
  misc_feature (1)..( 8): Matrix.002 file - promoters60/2113842
agaacaat

SEQ ID NO: 54532 - DNA, 7 bp, Unknown
  misc_feature (1)..( 7): Matrix.002 file - promoters60/2113842
tatataa

SEQ ID NO: 54533 - DNA, 6 bp, Unknown
  misc_feature (1)..( 6): Matrix.002 file - promoters60/2113842
atttta

SEQ ID NO: 54534 - DNA, 8 bp, Unknown
  misc_feature (1)..( 8): Matrix.002 file - promoters60/2113842
ttatttga

SEQ ID NO: 54535 - DNA, 6 bp, Unknown
  misc_feature (1)..( 6): Matrix.002 file - promoters60/2113842
ttttca

SEQ ID NO: 54536 - DNA, 7 bp, Unknown
  misc_feature (1)..( 7): Matrix.002 file - promoters60/2113842
aaggggt

SEQ ID NO: 54537 - DNA, 10 bp, Unknown
  misc_feature (1)..( 10): Matrix.002 file - promoters60/2113842
aagtaaactt

SEQ ID NO: 54538 - DNA, 6 bp, Unknown
  misc_feature (1)..( 6): Matrix.002 file - promoters60/2113842
tcacaa

SEQ ID NO: 54539 - DNA, 11 bp, Unknown
  misc_feature (1)..( 11): Matrix.002 file - promoters60/2113846
attataattta

SEQ ID NO: 54540 - DNA, 9 bp, Unknown
  misc_feature (1)..( 9): Matrix.002 file - promoters60/2113846
aatttaacg

SEQ ID NO: 54541 - DNA, 11 bp, Unknown
  misc_feature (1)..( 11): Matrix.002 file - promoters60/2113846
taaaattattt

SEQ ID NO: 54542 - DNA, 7 bp, Unknown
  misc_feature (1)..( 7): Matrix.002 file - promoters60/2113846
ttatatc

SEQ ID NO: 54543 - DNA, 10 bp, Unknown
  misc_feature (1)..( 10): Matrix.002 file - promoters60/2113889
gttgactttt

SEQ ID NO: 54544 - DNA, 10 bp, Unknown
  misc_feature (1)..( 10): Matrix.002 file - promoters60/2113889
tataaaaaaa

SEQ ID NO: 54545 - DNA, 11 bp, Unknown
  misc_feature (1)..( 11): Matrix.002 file - promoters60/2113889
aatgataattc

SEQ ID NO: 54546 - DNA, 11 bp, Unknown
  misc_feature (1)..( 11): Matrix.002 file - promoters60/2113889
gttaaattttg

SEQ ID NO: 54547 - DNA, 12 bp, Unknown
  misc_feature (1)..( 12): Matrix.002 file - promoters60/2113889
gttaacttttta

SEQ ID NO: 54548 - DNA, 17 bp, Unknown
  misc_feature (1)..( 17): Matrix.002 file - promoters60/2113928
aaaaattattaaagtat

SEQ ID NO: 54549 - DNA, 7 bp, Unknown
  misc_feature (1)..( 7): Matrix.002 file - promoters60/2113928
ttactaa

SEQ ID NO: 54550 - DNA, 8 bp, Unknown
  misc_feature (1)..( 8): Matrix.002 file - promoters60/2113928
taatttta

SEQ ID NO: 54551 - DNA, 8 bp, Unknown
  misc_feature (1)..( 8): Matrix.002 file - promoters60/2113928
agtcggtc

SEQ ID NO: 54552 - DNA, 6 bp, Unknown
  misc_feature (1)..( 6): Matrix.002 file - promoters60/2113928
atttta

SEQ ID NO: 54553 - DNA, 9 bp, Unknown
  misc_feature (1)..( 9): Matrix.002 file - promoters60/2113928
gaattcaaa

SEQ ID NO: 54554 - DNA, 6 bp, Unknown
  misc_feature (1)..( 6): Matrix.002 file - promoters60/2113928
atattt

SEQ ID NO: 54555 - DNA, 9 bp, Unknown
  misc_feature (1)..( 9): Matrix.002 file - promoters60/2113928
aaataatat

SEQ ID NO: 54556 - DNA, 10 bp, Unknown
  misc_feature (1)..( 10): Matrix.002 file - promoters60/2113928
ctatatatat

SEQ ID NO: 54557 - DNA, 6 bp, Unknown
  misc_feature (1)..( 6): Matrix.002 file - promoters60/2113928
aaaaag

SEQ ID NO: 54558 - DNA, 6 bp, Unknown
  misc_feature (1)..( 6): Matrix.002 file - promoters60/2113928
aacaat

SEQ ID NO: 54559 - DNA, 6 bp, Unknown
  misc_feature (1)..( 6): Matrix.002 file - promoters60/2113928
atttct

SEQ ID NO: 54560 - DNA, 9 bp, Unknown
  misc_feature (1)..( 9): Matrix.002 file - promoters60/2113928
aatacaaat

SEQ ID NO: 54561 - DNA, 7 bp, Unknown
  misc_feature (1)..( 7): Matrix.002 file - promoters60/2113928
taaaaca

SEQ ID NO: 54562 - DNA, 7 bp, Unknown
  misc_feature (1)..( 7): Matrix.002 file - promoters60/2113928
tatatcc

SEQ ID NO: 54563 - DNA, 7 bp, Unknown
  misc_feature (1)..( 7): Matrix.002 file - promoters60/2113928
aaaatat

SEQ ID NO: 54564 - DNA, 6 bp, Unknown
  misc_feature (1)..( 6): Matrix.002 file - promoters60/2113928
caaaaa

SEQ ID NO: 54565 - DNA, 6 bp, Unknown
  misc_feature (1)..( 6): Matrix.002 file - promoters60/2113928
taatat

SEQ ID NO: 54566 - DNA, 6 bp, Unknown
  misc_feature (1)..( 6): Matrix.002 file - promoters60/2113928
aaaata

SEQ ID NO: 54567 - DNA, 7 bp, Unknown
  misc_feature (1)..( 7): Matrix.002 file - promoters60/2113928
aatcaaa

SEQ ID NO: 54568 - DNA, 10 bp, Unknown
  misc_feature (1)..( 10): Matrix.002 file - promoters60/2113928
ctaaaaaata

SEQ ID NO: 54569 - DNA, 8 bp, Unknown
  misc_feature (1)..( 8): Matrix.002 file - promoters60/2113967
caaatatt

SEQ ID NO: 54570 - DNA, 10 bp, Unknown
  misc_feature (1)..( 10): Matrix.002 file - promoters60/2113967
acttatttta

SEQ ID NO: 54571 - DNA, 11 bp, Unknown
  misc_feature (1)..( 11): Matrix.002 file - promoters60/2113967
ttaagtagatt

SEQ ID NO: 54572 - DNA, 8 bp, Unknown
  misc_feature (1)..( 8): Matrix.002 file - promoters60/2113967
tttcaatt

SEQ ID NO: 54573 - DNA, 12 bp, Unknown
  misc_feature (1)..( 12): Matrix.002 file - promoters60/2113967
aaaaaaacattg

SEQ ID NO: 54574 - DNA, 8 bp, Unknown
  misc_feature (1)..( 8): Matrix.002 file - promoters60/2113975
ttttattc

SEQ ID NO: 54575 - DNA, 7 bp, Unknown
  misc_feature (1)..( 7): Matrix.002 file - promoters60/2113975
attacaa

SEQ ID NO: 54576 - DNA, 7 bp, Unknown
  misc_feature (1)..( 7): Matrix.002 file - promoters60/2113975
aaacttc

SEQ ID NO: 54577 - DNA, 6 bp, Unknown
  misc_feature (1)..( 6): Matrix.002 file - promoters60/2113975
acttta

SEQ ID NO: 54578 - DNA, 8 bp, Unknown
  misc_feature (1)..( 8): Matrix.002 file - promoters60/2113975
aaaaaatc

SEQ ID NO: 54579 - DNA, 6 bp, Unknown
  misc_feature (1)..( 6): Matrix.002 file - promoters60/2113975
aaaaga

SEQ ID NO: 54580 - DNA, 8 bp, Unknown
  misc_feature (1)..( 8): Matrix.002 file - promoters60/2113975
tataatag

SEQ ID NO: 54581 - DNA, 7 bp, Unknown
  misc_feature (1)..( 7): Matrix.002 file - promoters60/2113975
attagtt

SEQ ID NO: 54582 - DNA, 8 bp, Unknown
  misc_feature (1)..( 8): Matrix.002 file - promoters60/2113975
caaactaa

SEQ ID NO: 54583 - DNA, 10 bp, Unknown
  misc_feature (1)..( 10): Matrix.002 file - promoters60/2113975
aatggataac

SEQ ID NO: 54584 - DNA, 6 bp, Unknown
  misc_feature (1)..( 6): Matrix.002 file - promoters60/2113975
taaaga

SEQ ID NO: 54585 - DNA, 7 bp, Unknown
  misc_feature (1)..( 7): Matrix.002 file - promoters60/2113975
aaaaagt

SEQ ID NO: 54586 - DNA, 8 bp, Unknown
  misc_feature (1)..( 8): Matrix.002 file - promoters60/2113975
aagaaaaa

SEQ ID NO: 54587 - DNA, 8 bp, Unknown
  misc_feature (1)..( 8): Matrix.002 file - promoters60/2113975
caataaaa

SEQ ID NO: 54588 - DNA, 6 bp, Unknown
  misc_feature (1)..( 6): Matrix.002 file - promoters60/2113975
agtttc

SEQ ID NO: 54589 - DNA, 9 bp, Unknown
  misc_feature (1)..( 9): Matrix.002 file - promoters60/2113975
tttgaccag

SEQ ID NO: 54590 - DNA, 6 bp, Unknown
  misc_feature (1)..( 6): Matrix.002 file - promoters60/2113975
ttcacc

SEQ ID NO: 54591 - DNA, 8 bp, Unknown
  misc_feature (1)..( 8): Matrix.002 file - promoters60/2113975
aaacaaaa

SEQ ID NO: 54592 - DNA, 7 bp, Unknown
  misc_feature (1)..( 7): Matrix.002 file - promoters60/2113975
caagtat

SEQ ID NO: 54593 - DNA, 6 bp, Unknown
  misc_feature (1)..( 6): Matrix.002 file - promoters60/2113975
ttattt

SEQ ID NO: 54594 - DNA, 6 bp, Unknown
  misc_feature (1)..( 6): Matrix.002 file - promoters60/2113975
aaaata

SEQ ID NO: 54595 - DNA, 7 bp, Unknown
  misc_feature (1)..( 7): Matrix.002 file - promoters60/2113975
ataaaat

SEQ ID NO: 54596 - DNA, 8 bp, Unknown
  misc_feature (1)..( 8): Matrix.002 file - promoters60/2114005
ttttctta

SEQ ID NO: 54597 - DNA, 8 bp, Unknown
  misc_feature (1)..( 8): Matrix.002 file - promoters60/2114005
aaaaacaa

SEQ ID NO: 54598 - DNA, 7 bp, Unknown
  misc_feature (1)..( 7): Matrix.002 file - promoters60/2114005
attcaaa

SEQ ID NO: 54599 - DNA, 7 bp, Unknown
  misc_feature (1)..( 7): Matrix.002 file - promoters60/2114005
aaaagat

SEQ ID NO: 54600 - DNA, 7 bp, Unknown
  misc_feature (1)..( 7): Matrix.002 file - promoters60/2114005
ttaatca

SEQ ID NO: 54601 - DNA, 7 bp, Unknown
  misc_feature (1)..( 7): Matrix.002 file - promoters60/2114005
ccaaagc

SEQ ID NO: 54602 - DNA, 6 bp, Unknown
  misc_feature (1)..( 6): Matrix.002 file - promoters60/2114005
aaaaca

SEQ ID NO: 54603 - DNA, 7 bp, Unknown
  misc_feature (1)..( 7): Matrix.002 file - promoters60/2114005
agtagga

SEQ ID NO: 54604 - DNA, 6 bp, Unknown
  misc_feature (1)..( 6): Matrix.002 file - promoters60/2114005
ttttta

SEQ ID NO: 54605 - DNA, 12 bp, Unknown
  misc_feature (1)..( 12): Matrix.002 file - promoters60/2114005
caaaaaataatt

SEQ ID NO: 54606 - DNA, 7 bp, Unknown
  misc_feature (1)..( 7): Matrix.002 file - promoters60/2114005
aaaagac

SEQ ID NO: 54607 - DNA, 6 bp, Unknown
  misc_feature (1)..( 6): Matrix.002 file - promoters60/2114005
aaactg

SEQ ID NO: 54608 - DNA, 15 bp, Unknown
  misc_feature (1)..( 15): Matrix.002 file - promoters60/2114005
aatacctcatttata

SEQ ID NO: 54609 - DNA, 7 bp, Unknown
  misc_feature (1)..( 7): Matrix.002 file - promoters60/2114005
ttaaaaa

SEQ ID NO: 54610 - DNA, 7 bp, Unknown
  misc_feature (1)..( 7): Matrix.002 file - promoters60/2114005
aaaattt

SEQ ID NO: 54611 - DNA, 8 bp, Unknown
  misc_feature (1)..( 8): Matrix.002 file - promoters60/2114005
ttatatat

SEQ ID NO: 54612 - DNA, 11 bp, Unknown
  misc_feature (1)..( 11): Matrix.002 file - promoters60/2114005
ttaagtgataa

SEQ ID NO: 54613 - DNA, 8 bp, Unknown
  misc_feature (1)..( 8): Matrix.002 file - promoters60/2114005
agagatta

SEQ ID NO: 54614 - DNA, 9 bp, Unknown
  misc_feature (1)..( 9): Matrix.002 file - promoters60/2114005
aaaaaaaca

SEQ ID NO: 54615 - DNA, 9 bp, Unknown
  misc_feature (1)..( 9): Matrix.002 file - promoters60/2114005
taaaaaaaa

SEQ ID NO: 54616 - DNA, 7 bp, Unknown
  misc_feature (1)..( 7): Matrix.002 file - promoters60/2114012
aaaatta

SEQ ID NO: 54617 - DNA, 8 bp, Unknown
  misc_feature (1)..( 8): Matrix.002 file - promoters60/2114012
aaaagttt

SEQ ID NO: 54618 - DNA, 10 bp, Unknown
  misc_feature (1)..( 10): Matrix.002 file - promoters60/2114012
acaaagacga

SEQ ID NO: 54619 - DNA, 8 bp, Unknown
  misc_feature (1)..( 8): Matrix.002 file - promoters60/2114012
tttattaa

SEQ ID NO: 54620 - DNA, 7 bp, Unknown
  misc_feature (1)..( 7): Matrix.002 file - promoters60/2114026
tatataa

SEQ ID NO: 54621 - DNA, 9 bp, Unknown
  misc_feature (1)..( 9): Matrix.002 file - promoters60/2114026
accctcata

SEQ ID NO: 54622 - DNA, 12 bp, Unknown
  misc_feature (1)..( 12): Matrix.002 file - promoters60/2114026
atagtttctcat

SEQ ID NO: 54623 - DNA, 12 bp, Unknown
  misc_feature (1)..( 12): Matrix.002 file - promoters60/2114026
caagtttttgaa

SEQ ID NO: 54624 - DNA, 8 bp, Unknown
  misc_feature (1)..( 8): Matrix.002 file - promoters60/2114026
caatcaaa

SEQ ID NO: 54625 - DNA, 9 bp, Unknown
  misc_feature (1)..( 9): Matrix.002 file - promoters60/2114026
catttttag

SEQ ID NO: 54626 - DNA, 9 bp, Unknown
  misc_feature (1)..( 9): Matrix.002 file - promoters60/2114026
aattttaaa

SEQ ID NO: 54627 - DNA, 7 bp, Unknown
  misc_feature (1)..( 7): Matrix.002 file - promoters60/2114026
tttaata

SEQ ID NO: 54628 - DNA, 16 bp, Unknown
  misc_feature (1)..( 16): Matrix.002 file - promoters60/2114030
tacattacaaaaaaaa

SEQ ID NO: 54629 - DNA, 6 bp, Unknown
  misc_feature (1)..( 6): Matrix.002 file - promoters60/2114030
aaaaaa

SEQ ID NO: 54630 - DNA, 8 bp, Unknown
  misc_feature (1)..( 8): Matrix.002 file - promoters60/2114030
tataaata

SEQ ID NO: 54631 - DNA, 8 bp, Unknown
  misc_feature (1)..( 8): Matrix.002 file - promoters60/2114095
aaaatctt

SEQ ID NO: 54632 - DNA, 10 bp, Unknown
  misc_feature (1)..( 10): Matrix.002 file - promoters60/2114115
aaaattttgt

SEQ ID NO: 54633 - DNA, 7 bp, Unknown
  misc_feature (1)..( 7): Matrix.002 file - promoters60/2114115
tattttt

SEQ ID NO: 54634 - DNA, 11 bp, Unknown
  misc_feature (1)..( 11): Matrix.002 file - promoters60/2114115
caaaaaaatat

SEQ ID NO: 54635 - DNA, 11 bp, Unknown
  misc_feature (1)..( 11): Matrix.002 file - promoters60/2114115
cgaacaaaagg

SEQ ID NO: 54636 - DNA, 11 bp, Unknown
  misc_feature (1)..( 11): Matrix.002 file - promoters60/2114138
aaatagatcta

SEQ ID NO: 54637 - DNA, 8 bp, Unknown
  misc_feature (1)..( 8): Matrix.002 file - promoters60/2114138
ttttgggt

SEQ ID NO: 54638 - DNA, 16 bp, Unknown
  misc_feature (1)..( 16): Matrix.002 file - promoters60/2114145
ctttcgaccaaaataa

SEQ ID NO: 54639 - DNA, 7 bp, Unknown
  misc_feature (1)..( 7): Matrix.002 file - promoters60/2114145
taccgga

SEQ ID NO: 54640 - DNA, 6 bp, Unknown
  misc_feature (1)..( 6): Matrix.002 file - promoters60/2114145
atacaa

SEQ ID NO: 54641 - DNA, 7 bp, Unknown
  misc_feature (1)..( 7): Matrix.002 file - promoters60/2114145
aaatgat

SEQ ID NO: 54642 - DNA, 9 bp, Unknown
  misc_feature (1)..( 9): Matrix.002 file - promoters60/2114145
atgattcta

SEQ ID NO: 54643 - DNA, 7 bp, Unknown
  misc_feature (1)..( 7): Matrix.002 file - promoters60/2114145
ataatat

SEQ ID NO: 54644 - DNA, 6 bp, Unknown
  misc_feature (1)..( 6): Matrix.002 file - promoters60/2114145
aaggca

SEQ ID NO: 54645 - DNA, 6 bp, Unknown
  misc_feature (1)..( 6): Matrix.002 file - promoters60/2114145
attata

SEQ ID NO: 54646 - DNA, 7 bp, Unknown
  misc_feature (1)..( 7): Matrix.002 file - promoters60/2114145
aaacttt

SEQ ID NO: 54647 - DNA, 7 bp, Unknown
  misc_feature (1)..( 7): Matrix.002 file - promoters60/2114145
tttatcc

SEQ ID NO: 54648 - DNA, 6 bp, Unknown
  misc_feature (1)..( 6): Matrix.002 file - promoters60/2114145
tttatt

SEQ ID NO: 54649 - DNA, 11 bp, Unknown
  misc_feature (1)..( 11): Matrix.002 file - promoters60/2114145
aaagaaacaaa

SEQ ID NO: 54650 - DNA, 8 bp, Unknown
  misc_feature (1)..( 8): Matrix.002 file - promoters60/2114145
aaaaaaaa

SEQ ID NO: 54651 - DNA, 6 bp, Unknown
  misc_feature (1)..( 6): Matrix.002 file - promoters60/2114145
tctctc

SEQ ID NO: 54652 - DNA, 6 bp, Unknown
  misc_feature (1)..( 6): Matrix.002 file - promoters60/2114145
taactt

SEQ ID NO: 54653 - DNA, 6 bp, Unknown
  misc_feature (1)..( 6): Matrix.002 file - promoters60/2114145
tcctcc

SEQ ID NO: 54654 - DNA, 6 bp, Unknown
  misc_feature (1)..( 6): Matrix.002 file - promoters60/2114145
atttta

SEQ ID NO: 54655 - DNA, 21 bp, Unknown
  misc_feature (1)..( 21): Matrix.002 file - promoters60/2114175
acacccatctcttctcgctca

SEQ ID NO: 54656 - DNA, 25 bp, Unknown
  misc_feature (1)..( 25): Matrix.002 file - promoters60/2114175
ggaacctgttgccaattactcgttt

SEQ ID NO: 54657 - DNA, 11 bp, Unknown
  misc_feature (1)..( 11): Matrix.002 file - promoters60/2114175
ttttattggtt

SEQ ID NO: 54658 - DNA, 19 bp, Unknown
  misc_feature (1)..( 19): Matrix.002 file - promoters60/2114175
caactactctatcaattat

SEQ ID NO: 54659 - DNA, 7 bp, Unknown
  misc_feature (1)..( 7): Matrix.002 file - promoters60/2114175
aaaaaaa

SEQ ID NO: 54660 - DNA, 9 bp, Unknown
  misc_feature (1)..( 9): Matrix.002 file - promoters60/2114175
aaaaaaaaa

SEQ ID NO: 54661 - DNA, 38 bp, Unknown
  misc_feature (1)..( 38): Matrix.002 file - promoters60/2114175
tttactctataaattatttccgcaaacacaaattatac

SEQ ID NO: 54662 - DNA, 10 bp, Unknown
  misc_feature (1)..( 10): Matrix.002 file - promoters60/2114175
acatcaacat

SEQ ID NO: 54663 - DNA, 23 bp, Unknown
  misc_feature (1)..( 23): Matrix.002 file - promoters60/2114175
tacatttttctactaatgtagaa

SEQ ID NO: 54664 - DNA, 12 bp, Unknown
  misc_feature (1)..( 12): Matrix.002 file - promoters60/2114175
aacttcacagta

SEQ ID NO: 54665 - DNA, 6 bp, Unknown
  misc_feature (1)..( 6): Matrix.002 file - promoters60/2114175
caaaat

SEQ ID NO: 54666 - DNA, 7 bp, Unknown
  misc_feature (1)..( 7): Matrix.002 file - promoters60/2114175
acaagca

SEQ ID NO: 54667 - DNA, 7 bp, Unknown
  misc_feature (1)..( 7): Matrix.002 file - promoters60/2114175
gataata

SEQ ID NO: 54668 - DNA, 6 bp, Unknown
  misc_feature (1)..( 6): Matrix.002 file - promoters60/2114175
aacaac

SEQ ID NO: 54669 - DNA, 13 bp, Unknown
  misc_feature (1)..( 13): Matrix.002 file - promoters60/2114175
acgccaaattcta

SEQ ID NO: 54670 - DNA, 6 bp, Unknown
  misc_feature (1)..( 6): Matrix.002 file - promoters60/2114175
agcaca

SEQ ID NO: 54671 - DNA, 32 bp, Unknown
  misc_feature (1)..( 32): Matrix.002 file - promoters60/2114175
cacaatctcaacgtgcactaaaaacgagtggt

SEQ ID NO: 54672 - DNA, 8 bp, Unknown
  misc_feature (1)..( 8): Matrix.002 file - promoters60/2114175
aaaatatc

SEQ ID NO: 54673 - DNA, 13 bp, Unknown
  misc_feature (1)..( 13): Matrix.002 file - promoters60/2114175
cataatgggacca

SEQ ID NO: 54674 - DNA, 8 bp, Unknown
  misc_feature (1)..( 8): Matrix.002 file - promoters60/2114175
agcatttg

SEQ ID NO: 54675 - DNA, 18 bp, Unknown
  misc_feature (1)..( 18): Matrix.002 file - promoters60/2114175
acacatatctccgcattt

SEQ ID NO: 54676 - DNA, 9 bp, Unknown
  misc_feature (1)..( 9): Matrix.002 file - promoters60/2114175
tttcccatc

SEQ ID NO: 54677 - DNA, 8 bp, Unknown
  misc_feature (1)..( 8): Matrix.002 file - promoters60/2114175
cttcataa

SEQ ID NO: 54678 - DNA, 6 bp, Unknown
  misc_feature (1)..( 6): Matrix.002 file - promoters60/2114175
taaccc

SEQ ID NO: 54679 - DNA, 14 bp, Unknown
  misc_feature (1)..( 14): Matrix.002 file - promoters60/2114175
cccacctcattata

SEQ ID NO: 54680 - DNA, 14 bp, Unknown
  misc_feature (1)..( 14): Matrix.002 file - promoters60/2114175
aataccaccctttg

SEQ ID NO: 54681 - DNA, 6 bp, Unknown
  misc_feature (1)..( 6): Matrix.002 file - promoters60/2114175
gtttat

SEQ ID NO: 54682 - DNA, 6 bp, Unknown
  misc_feature (1)..( 6): Matrix.002 file - promoters60/2114175
agcgaa

SEQ ID NO: 54683 - DNA, 6 bp, Unknown
  misc_feature (1)..( 6): Matrix.002 file - promoters60/2114175
gaaaca

SEQ ID NO: 54684 - DNA, 7 bp, Unknown
  misc_feature (1)..( 7): Matrix.002 file - promoters60/2114175
aaactct

SEQ ID NO: 54685 - DNA, 9 bp, Unknown
  misc_feature (1)..( 9): Matrix.002 file - promoters60/2114178
gtttcaaaa

SEQ ID NO: 54686 - DNA, 7 bp, Unknown
  misc_feature (1)..( 7): Matrix.002 file - promoters60/2114178
ttcaaaa

SEQ ID NO: 54687 - DNA, 13 bp, Unknown
  misc_feature (1)..( 13): Matrix.002 file - promoters60/2114178
ttgtaaaaaatga

SEQ ID NO: 54688 - DNA, 6 bp, Unknown
  misc_feature (1)..( 6): Matrix.002 file - promoters60/2114178
caataa

SEQ ID NO: 54689 - DNA, 6 bp, Unknown
  misc_feature (1)..( 6): Matrix.002 file - promoters60/2114178
aattat

SEQ ID NO: 54690 - DNA, 9 bp, Unknown
  misc_feature (1)..( 9): Matrix.002 file - promoters60/2114178
tgtattatt

SEQ ID NO: 54691 - DNA, 14 bp, Unknown
  misc_feature (1)..( 14): Matrix.002 file - promoters60/2114178
tatagcaaaactcc

SEQ ID NO: 54692 - DNA, 6 bp, Unknown
  misc_feature (1)..( 6): Matrix.002 file - promoters60/2114178
agaaaa

SEQ ID NO: 54693 - DNA, 7 bp, Unknown
  misc_feature (1)..( 7): Matrix.002 file - promoters60/2114178
cttcctc

SEQ ID NO: 54694 - DNA, 9 bp, Unknown
  misc_feature (1)..( 9): Matrix.002 file - promoters60/2114178
taggtcgta

SEQ ID NO: 54695 - DNA, 6 bp, Unknown
  misc_feature (1)..( 6): Matrix.002 file - promoters60/2114178
tttagt

SEQ ID NO: 54696 - DNA, 9 bp, Unknown
  misc_feature (1)..( 9): Matrix.002 file - promoters60/2114178
atctacttc

SEQ ID NO: 54697 - DNA, 8 bp, Unknown
  misc_feature (1)..( 8): Matrix.002 file - promoters60/2114178
aaaataac

SEQ ID NO: 54698 - DNA, 6 bp, Unknown
  misc_feature (1)..( 6): Matrix.002 file - promoters60/2114178
agcaaa

SEQ ID NO: 54699 - DNA, 7 bp, Unknown
  misc_feature (1)..( 7): Matrix.002 file - promoters60/2114178
ttcaaca

SEQ ID NO: 54700 - DNA, 7 bp, Unknown
  misc_feature (1)..( 7): Matrix.002 file - promoters60/2114178
aaaataa

SEQ ID NO: 54701 - DNA, 7 bp, Unknown
  misc_feature (1)..( 7): Matrix.002 file - promoters60/2114178
tttgtaa

SEQ ID NO: 54702 - DNA, 9 bp, Unknown
  misc_feature (1)..( 9): Matrix.002 file - promoters60/2114178
ttacctttt

SEQ ID NO: 54703 - DNA, 8 bp, Unknown
  misc_feature (1)..( 8): Matrix.002 file - promoters60/2114178
gttgtgtt

SEQ ID NO: 54704 - DNA, 8 bp, Unknown
  misc_feature (1)..( 8): Matrix.002 file - promoters60/2114200
aatcaatc

SEQ ID NO: 54705 - DNA, 8 bp, Unknown
  misc_feature (1)..( 8): Matrix.002 file - promoters60/2131829
tattgaaa

SEQ ID NO: 54706 - DNA, 9 bp, Unknown
  misc_feature (1)..( 9): Matrix.002 file - promoters60/2169576
tgttttcta

SEQ ID NO: 54707 - DNA, 12 bp, Unknown
  misc_feature (1)..( 12): Matrix.002 file - promoters60/2169576
ctcatatataac

SEQ ID NO: 54708 - DNA, 13 bp, Unknown
  misc_feature (1)..( 13): Matrix.002 file - promoters60/2169576
aactagattttta

SEQ ID NO: 54709 - DNA, 12 bp, Unknown
  misc_feature (1)..( 12): Matrix.002 file - promoters60/2169576
aaatttttttta

SEQ ID NO: 54710 - DNA, 8 bp, Unknown
  misc_feature (1)..( 8): Matrix.002 file - promoters60/2185389
tgaagaaa

SEQ ID NO: 54711 - DNA, 9 bp, Unknown
  misc_feature (1)..( 9): Matrix.002 file - promoters60/2185389
acaaaagaa

SEQ ID NO: 54712 - DNA, 8 bp, Unknown
  misc_feature (1)..( 8): Matrix.002 file - promoters60/2185389
ttttcttc

SEQ ID NO: 54713 - DNA, 11 bp, Unknown
  misc_feature (1)..( 11): Matrix.002 file - promoters60/2185389
gaaaaaaatga

SEQ ID NO: 54714 - DNA, 10 bp, Unknown
  misc_feature (1)..( 10): Matrix.002 file - promoters60/2185389
tttgaatcaa

SEQ ID NO: 54715 - DNA, 11 bp, Unknown
  misc_feature (1)..( 11): Matrix.002 file - promoters60/2187156
acataattaag

SEQ ID NO: 54716 - DNA, 9 bp, Unknown
  misc_feature (1)..( 9): Matrix.002 file - promoters60/2187156
tgtaaaaaa

SEQ ID NO: 54717 - DNA, 10 bp, Unknown
  misc_feature (1)..( 10): Matrix.002 file - promoters60/2217817
gaaatagatt

SEQ ID NO: 54718 - DNA, 8 bp, Unknown
  misc_feature (1)..( 8): Matrix.002 file - promoters60/2217996
cccagttt

SEQ ID NO: 54719 - DNA, 6 bp, Unknown
  misc_feature (1)..( 6): Matrix.002 file - promoters60/2218016
ttcaca

SEQ ID NO: 54720 - DNA, 6 bp, Unknown
  misc_feature (1)..( 6): Matrix.002 file - promoters60/2218016
agcttt

SEQ ID NO: 54721 - DNA, 6 bp, Unknown
  misc_feature (1)..( 6): Matrix.002 file - promoters60/2218016
ttttca

SEQ ID NO: 54722 - DNA, 7 bp, Unknown
  misc_feature (1)..( 7): Matrix.002 file - promoters60/2218016
atataag

SEQ ID NO: 54723 - DNA, 6 bp, Unknown
  misc_feature (1)..( 6): Matrix.002 file - promoters60/2218016
tcacta

SEQ ID NO: 54724 - DNA, 6 bp, Unknown
  misc_feature (1)..( 6): Matrix.002 file - promoters60/2218016
tcaatc

SEQ ID NO: 54725 - DNA, 6 bp, Unknown
  misc_feature (1)..( 6): Matrix.002 file - promoters60/2218016
agtaag

SEQ ID NO: 54726 - DNA, 7 bp, Unknown
  misc_feature (1)..( 7): Matrix.002 file - promoters60/2218016
accaaac

SEQ ID NO: 54727 - DNA, 7 bp, Unknown
  misc_feature (1)..( 7): Matrix.002 file - promoters60/2218016
ttgatgt

SEQ ID NO: 54728 - DNA, 10 bp, Unknown
  misc_feature (1)..( 10): Matrix.002 file - promoters60/2218207
atttcttttc

SEQ ID NO: 54729 - DNA, 8 bp, Unknown
  misc_feature (1)..( 8): Matrix.002 file - promoters60/2218260
caatagat

SEQ ID NO: 54730 - DNA, 10 bp, Unknown
  misc_feature (1)..( 10): Matrix.002 file - promoters60/2218260
atatatatag

SEQ ID NO: 54731 - DNA, 6 bp, Unknown
  misc_feature (1)..( 6): Matrix.002 file - promoters60/2685725
tcaatg

SEQ ID NO: 54732 - DNA, 8 bp, Unknown
  misc_feature (1)..( 8): Matrix.002 file - promoters60/2685725
gtcaaggt

SEQ ID NO: 54733 - DNA, 9 bp, Unknown
  misc_feature (1)..( 9): Matrix.002 file - promoters60/2685725
taatattgt

SEQ ID NO: 54734 - DNA, 7 bp, Unknown
  misc_feature (1)..( 7): Matrix.002 file - promoters60/2685725
aaggttc

SEQ ID NO: 54735 - DNA, 6 bp, Unknown
  misc_feature (1)..( 6): Matrix.002 file - promoters60/2685725
gatacg

SEQ ID NO: 54736 - DNA, 8 bp, Unknown
  misc_feature (1)..( 8): Matrix.002 file - promoters60/2685725
tcacacac

SEQ ID NO: 54737 - DNA, 7 bp, Unknown
  misc_feature (1)..( 7): Matrix.002 file - promoters60/2685725
ttaggta

SEQ ID NO: 54738 - DNA, 7 bp, Unknown
  misc_feature (1)..( 7): Matrix.002 file - promoters60/2685725
tataatg

SEQ ID NO: 54739 - DNA, 7 bp, Unknown
  misc_feature (1)..( 7): Matrix.002 file - promoters60/2685725
caaacga

SEQ ID NO: 54740 - DNA, 6 bp, Unknown
  misc_feature (1)..( 6): Matrix.002 file - promoters60/2685725
aataag

SEQ ID NO: 54741 - DNA, 7 bp, Unknown
  misc_feature (1)..( 7): Matrix.002 file - promoters60/2685873
acccaat

SEQ ID NO: 54742 - DNA, 8 bp, Unknown
  misc_feature (1)..( 8): Matrix.002 file - promoters60/2685873
tctatctt

SEQ ID NO: 54743 - DNA, 6 bp, Unknown
  misc_feature (1)..( 6): Matrix.002 file - promoters60/2685873
caacaa

SEQ ID NO: 54744 - DNA, 8 bp, Unknown
  misc_feature (1)..( 8): Matrix.002 file - promoters60/2685873
aaatatca

SEQ ID NO: 54745 - DNA, 6 bp, Unknown
  misc_feature (1)..( 6): Matrix.002 file - promoters60/2685873
aaagaa

SEQ ID NO: 54746 - DNA, 6 bp, Unknown
  misc_feature (1)..( 6): Matrix.002 file - promoters60/2685873
aaaaga

SEQ ID NO: 54747 - DNA, 8 bp, Unknown
  misc_feature (1)..( 8): Matrix.002 file - promoters60/2685873
ttctaaga

SEQ ID NO: 54748 - DNA, 8 bp, Unknown
  misc_feature (1)..( 8): Matrix.002 file - promoters60/2685873
tttttttt

SEQ ID NO: 54749 - DNA, 8 bp, Unknown
  misc_feature (1)..( 8): Matrix.002 file - promoters60/2685873
ttgcaatt

SEQ ID NO: 54750 - DNA, 7 bp, Unknown
  misc_feature (1)..( 7): Matrix.002 file - promoters60/2685873
aacaatt

SEQ ID NO: 54751 - DNA, 7 bp, Unknown
  misc_feature (1)..( 7): Matrix.002 file - promoters60/2685873
tctaaca

SEQ ID NO: 54752 - DNA, 6 bp, Unknown
  misc_feature (1)..( 6): Matrix.002 file - promoters60/2685873
attcaa

SEQ ID NO: 54753 - DNA, 6 bp, Unknown
  misc_feature (1)..( 6): Matrix.002 file - promoters60/2685873
aaaaaa

SEQ ID NO: 54754 - DNA, 8 bp, Unknown
  misc_feature (1)..( 8): Matrix.002 file - promoters60/2685873
aaaacctt

SEQ ID NO: 54755 - DNA, 7 bp, Unknown
  misc_feature (1)..( 7): Matrix.002 file - promoters60/2685873
gaaagaa

SEQ ID NO: 54756 - DNA, 6 bp, Unknown
  misc_feature (1)..( 6): Matrix.002 file - promoters60/2685873
ttgatg

SEQ ID NO: 54757 - DNA, 8 bp, Unknown
  misc_feature (1)..( 8): Matrix.002 file - promoters60/2685873
ttgagctt

SEQ ID NO: 54758 - DNA, 6 bp, Unknown
  misc_feature (1)..( 6): Matrix.002 file - promoters60/2685873
aatttg

SEQ ID NO: 54759 - DNA, 8 bp, Unknown
  misc_feature (1)..( 8): Matrix.002 file - promoters60/2685873
aaaccctt

SEQ ID NO: 54760 - DNA, 6 bp, Unknown
  misc_feature (1)..( 6): Matrix.002 file - promoters60/2685873
aatcaa

SEQ ID NO: 54761 - DNA, 8 bp, Unknown
  misc_feature (1)..( 8): Matrix.002 file - promoters60/2685873
caccactc

SEQ ID NO: 54762 - DNA, 13 bp, Unknown
  misc_feature (1)..( 13): Matrix.002 file - promoters60/2685951
ttggattaaataa

SEQ ID NO: 54763 - DNA, 8 bp, Unknown
  misc_feature (1)..( 8): Matrix.002 file - promoters60/2685951
tttatttt

SEQ ID NO: 54764 - DNA, 8 bp, Unknown
  misc_feature (1)..( 8): Matrix.002 file - promoters60/2685968
tgaaaata

SEQ ID NO: 54765 - DNA, 7 bp, Unknown
  misc_feature (1)..( 7): Matrix.002 file - promoters60/2685968
aagaaat

SEQ ID NO: 54766 - DNA, 6 bp, Unknown
  misc_feature (1)..( 6): Matrix.002 file - promoters60/2685968
aattaa

SEQ ID NO: 54767 - DNA, 8 bp, Unknown
  misc_feature (1)..( 8): Matrix.002 file - promoters60/2685968
atataaat

SEQ ID NO: 54768 - DNA, 8 bp, Unknown
  misc_feature (1)..( 8): Matrix.002 file - promoters60/2685968
aaaagaaa

SEQ ID NO: 54769 - DNA, 5 bp, Unknown
  misc_feature (1)..( 5): Matrix.002 file - promoters60/2685968
tattt

SEQ ID NO: 54770 - DNA, 12 bp, Unknown
  misc_feature (1)..( 12): Matrix.002 file - promoters60/2685968
gaaaaagaaaag

SEQ ID NO: 54771 - DNA, 6 bp, Unknown
  misc_feature (1)..( 6): Matrix.002 file - promoters60/2685968
cgtttt

SEQ ID NO: 54772 - DNA, 8 bp, Unknown
  misc_feature (1)..( 8): Matrix.002 file - promoters60/2685968
tttgttca

SEQ ID NO: 54773 - DNA, 7 bp, Unknown
  misc_feature (1)..( 7): Matrix.002 file - promoters60/2685968
agagaga

SEQ ID NO: 54774 - DNA, 6 bp, Unknown
  misc_feature (1)..( 6): Matrix.002 file - promoters60/2685968
ttttaa

SEQ ID NO: 54775 - DNA, 6 bp, Unknown
  misc_feature (1)..( 6): Matrix.002 file - promoters60/2685968
tttttt

SEQ ID NO: 54776 - DNA, 6 bp, Unknown
  misc_feature (1)..( 6): Matrix.002 file - promoters60/2685968
caaatt

SEQ ID NO: 54777 - DNA, 7 bp, Unknown
  misc_feature (1)..( 7): Matrix.002 file - promoters60/2685968
gaacaaa

SEQ ID NO: 54778 - DNA, 10 bp, Unknown
  misc_feature (1)..( 10): Matrix.002 file - promoters60/2685968
tattatttgt

SEQ ID NO: 54779 - DNA, 6 bp, Unknown
  misc_feature (1)..( 6): Matrix.002 file - promoters60/2685968
attatc

SEQ ID NO: 54780 - DNA, 9 bp, Unknown
  misc_feature (1)..( 9): Matrix.002 file - promoters60/2685968
ttttataaa

SEQ ID NO: 54781 - DNA, 7 bp, Unknown
  misc_feature (1)..( 7): Matrix.002 file - promoters60/2685968
ttcattt

SEQ ID NO: 54782 - DNA, 6 bp, Unknown
  misc_feature (1)..( 6): Matrix.002 file - promoters60/2685968
ttgcat

SEQ ID NO: 54783 - DNA, 8 bp, Unknown
  misc_feature (1)..( 8): Matrix.002 file - promoters60/2685968
aagataat

SEQ ID NO: 54784 - DNA, 7 bp, Unknown
  misc_feature (1)..( 7): Matrix.002 file - promoters60/2685968
tgtcaaa

SEQ ID NO: 54785 - DNA, 6 bp, Unknown
  misc_feature (1)..( 6): Matrix.002 file - promoters60/2685968
caaaga

SEQ ID NO: 54786 - DNA, 7 bp, Unknown
  misc_feature (1)..( 7): Matrix.002 file - promoters60/2685968
aaaaact

SEQ ID NO: 54787 - DNA, 6 bp, Unknown
  misc_feature (1)..( 6): Matrix.002 file - promoters60/2685968
acaaaa

SEQ ID NO: 54788 - DNA, 10 bp, Unknown
  misc_feature (1)..( 10): Matrix.002 file - promoters60/2685968
aaaacaaaac

SEQ ID NO: 54789 - DNA, 7 bp, Unknown
  misc_feature (1)..( 7): Matrix.002 file - promoters60/2685968
tttgatt

SEQ ID NO: 54790 - DNA, 8 bp, Unknown
  misc_feature (1)..( 8): Matrix.002 file - promoters60/2685968
aaaaacaa

SEQ ID NO: 54791 - DNA, 7 bp, Unknown
  misc_feature (1)..( 7): Matrix.002 file - promoters60/2685968
attaaaa

SEQ ID NO: 54792 - DNA, 8 bp, Unknown
  misc_feature (1)..( 8): Matrix.002 file - promoters60/2686138
ataactta

SEQ ID NO: 54793 - DNA, 8 bp, Unknown
  misc_feature (1)..( 8): Matrix.002 file - promoters60/2686138
tataatta

SEQ ID NO: 54794 - DNA, 10 bp, Unknown
  misc_feature (1)..( 10): Matrix.002 file - promoters60/2686138
aaacaattat

SEQ ID NO: 54795 - DNA, 8 bp, Unknown
  misc_feature (1)..( 8): Matrix.002 file - promoters60/2686138
ttgtattt

SEQ ID NO: 54796 - DNA, 7 bp, Unknown
  misc_feature (1)..( 7): Matrix.002 file - promoters60/2686138
ataattt

SEQ ID NO: 54797 - DNA, 7 bp, Unknown
  misc_feature (1)..( 7): Matrix.002 file - promoters60/2686138
attttgt

SEQ ID NO: 54798 - DNA, 6 bp, Unknown
  misc_feature (1)..( 6): Matrix.002 file - promoters60/2686138
attcat

SEQ ID NO: 54799 - DNA, 9 bp, Unknown
  misc_feature (1)..( 9): Matrix.002 file - promoters60/2686138
tataattaa

SEQ ID NO: 54800 - DNA, 6 bp, Unknown
  misc_feature (1)..( 6): Matrix.002 file - promoters60/2686138
aaaaat

SEQ ID NO: 54801 - DNA, 6 bp, Unknown
  misc_feature (1)..( 6): Matrix.002 file - promoters60/2686138
tgggtt

SEQ ID NO: 54802 - DNA, 7 bp, Unknown
  misc_feature (1)..( 7): Matrix.002 file - promoters60/2686138
aaataat

SEQ ID NO: 54803 - DNA, 6 bp, Unknown
  misc_feature (1)..( 6): Matrix.002 file - promoters60/2686138
acaaaa

SEQ ID NO: 54804 - DNA, 7 bp, Unknown
  misc_feature (1)..( 7): Matrix.002 file - promoters60/2686138
aaagtga

SEQ ID NO: 54805 - DNA, 8 bp, Unknown
  misc_feature (1)..( 8): Matrix.002 file - promoters60/2686138
taaagaaa

SEQ ID NO: 54806 - DNA, 6 bp, Unknown
  misc_feature (1)..( 6): Matrix.002 file - promoters60/2686138
aaaaac

SEQ ID NO: 54807 - DNA, 7 bp, Unknown
  misc_feature (1)..( 7): Matrix.002 file - promoters60/2686138
ctaaaat

SEQ ID NO: 54808 - DNA, 7 bp, Unknown
  misc_feature (1)..( 7): Matrix.002 file - promoters60/2686138
ttagtaa

SEQ ID NO: 54809 - DNA, 7 bp, Unknown
  misc_feature (1)..( 7): Matrix.002 file - promoters60/2686138
tctgttc

SEQ ID NO: 54810 - DNA, 6 bp, Unknown
  misc_feature (1)..( 6): Matrix.002 file - promoters60/2724638
tgaaaa

SEQ ID NO: 54811 - DNA, 6 bp, Unknown
  misc_feature (1)..( 6): Matrix.002 file - promoters60/2724638
ataata

SEQ ID NO: 54812 - DNA, 6 bp, Unknown
  misc_feature (1)..( 6): Matrix.002 file - promoters60/2724638
acagaa

SEQ ID NO: 54813 - DNA, 12 bp, Unknown
  misc_feature (1)..( 12): Matrix.002 file - promoters60/2724638
aaatattggggc

SEQ ID NO: 54814 - DNA, 7 bp, Unknown
  misc_feature (1)..( 7): Matrix.002 file - promoters60/2724638
gttaaaa

SEQ ID NO: 54815 - DNA, 9 bp, Unknown
  misc_feature (1)..( 9): Matrix.002 file - promoters60/2724638
agtgaaaca

SEQ ID NO: 54816 - DNA, 6 bp, Unknown
  misc_feature (1)..( 6): Matrix.002 file - promoters60/2724638
acaaaa

SEQ ID NO: 54817 - DNA, 9 bp, Unknown
  misc_feature (1)..( 9): Matrix.002 file - promoters60/2724638
atagtatat

SEQ ID NO: 54818 - DNA, 15 bp, Unknown
  misc_feature (1)..( 15): Matrix.002 file - promoters60/2724699
aacaaaaaaagttta

SEQ ID NO: 54819 - DNA, 15 bp, Unknown
  misc_feature (1)..( 15): Matrix.002 file - promoters60/2724699
atcactgatccaaca

SEQ ID NO: 54820 - DNA, 7 bp, Unknown
  misc_feature (1)..( 7): Matrix.002 file - promoters60/2724699
aattatc

SEQ ID NO: 54821 - DNA, 10 bp, Unknown
  misc_feature (1)..( 10): Matrix.002 file - promoters60/2724703
tgtgttttta

SEQ ID NO: 54822 - DNA, 7 bp, Unknown
  misc_feature (1)..( 7): Matrix.002 file - promoters60/2724703
ttttggt

SEQ ID NO: 54823 - DNA, 8 bp, Unknown
  misc_feature (1)..( 8): Matrix.002 file - promoters60/2724703
ttaaccca

SEQ ID NO: 54824 - DNA, 7 bp, Unknown
  misc_feature (1)..( 7): Matrix.002 file - promoters60/2724703
agagata

SEQ ID NO: 54825 - DNA, 9 bp, Unknown
  misc_feature (1)..( 9): Matrix.002 file - promoters60/2724703
tgataaccc

SEQ ID NO: 54826 - DNA, 8 bp, Unknown
  misc_feature (1)..( 8): Matrix.002 file - promoters60/2724703
tctcagag

SEQ ID NO: 54827 - DNA, 12 bp, Unknown
  misc_feature (1)..( 12): Matrix.002 file - promoters60/2724703
aaaaacaaaaca

SEQ ID NO: 54828 - DNA, 9 bp, Unknown
  misc_feature (1)..( 9): Matrix.002 file - promoters60/2724703
tatttaaaa

SEQ ID NO: 54829 - DNA, 8 bp, Unknown
  misc_feature (1)..( 8): Matrix.002 file - promoters60/2724703
aaaaactg

SEQ ID NO: 54830 - DNA, 10 bp, Unknown
  misc_feature (1)..( 10): Matrix.002 file - promoters60/2724724
tataacttga

SEQ ID NO: 54831 - DNA, 7 bp, Unknown
  misc_feature (1)..( 7): Matrix.002 file - promoters60/2724724
ttaaaca

SEQ ID NO: 54832 - DNA, 6 bp, Unknown
  misc_feature (1)..( 6): Matrix.002 file - promoters60/2724724
ctttat

SEQ ID NO: 54833 - DNA, 12 bp, Unknown
  misc_feature (1)..( 12): Matrix.002 file - promoters60/2724724
tcaaaaagaaat

SEQ ID NO: 54834 - DNA, 8 bp, Unknown
  misc_feature (1)..( 8): Matrix.002 file - promoters60/2724724
aaataaaa

SEQ ID NO: 54835 - DNA, 10 bp, Unknown
  misc_feature (1)..( 10): Matrix.002 file - promoters60/2724724
aaaaaaaata

SEQ ID NO: 54836 - DNA, 9 bp, Unknown
  misc_feature (1)..( 9): Matrix.002 file - promoters60/2724724
aatattttc

SEQ ID NO: 54837 - DNA, 8 bp, Unknown
  misc_feature (1)..( 8): Matrix.002 file - promoters60/2724724
tcacaaaa

SEQ ID NO: 54838 - DNA, 7 bp, Unknown
  misc_feature (1)..( 7): Matrix.002 file - promoters60/2724724
aaacgaa

SEQ ID NO: 54839 - DNA, 6 bp, Unknown
  misc_feature (1)..( 6): Matrix.002 file - promoters60/2724724
ctggtt

SEQ ID NO: 54840 - DNA, 7 bp, Unknown
  misc_feature (1)..( 7): Matrix.002 file - promoters60/2724724
tatctga

SEQ ID NO: 54841 - DNA, 7 bp, Unknown
  misc_feature (1)..( 7): Matrix.002 file - promoters60/2724724
caaagag

SEQ ID NO: 54842 - DNA, 8 bp, Unknown
  misc_feature (1)..( 8): Matrix.002 file - promoters60/2724724
tttgaatt

SEQ ID NO: 54843 - DNA, 8 bp, Unknown
  misc_feature (1)..( 8): Matrix.002 file - promoters60/2724724
ttttattt

SEQ ID NO: 54844 - DNA, 6 bp, Unknown
  misc_feature (1)..( 6): Matrix.002 file - promoters60/2724724
actaaa

SEQ ID NO: 54845 - DNA, 8 bp, Unknown
  misc_feature (1)..( 8): Matrix.002 file - promoters60/2724724
cccactaa

SEQ ID NO: 54846 - DNA, 9 bp, Unknown
  misc_feature (1)..( 9): Matrix.002 file - promoters60/2724724
taaaccaag

SEQ ID NO: 54847 - DNA, 6 bp, Unknown
  misc_feature (1)..( 6): Matrix.002 file - promoters60/2724724
actaaa

SEQ ID NO: 54848 - DNA, 6 bp, Unknown
  misc_feature (1)..( 6): Matrix.002 file - promoters60/2724724
agtaaa

SEQ ID NO: 54849 - DNA, 7 bp, Unknown
  misc_feature (1)..( 7): Matrix.002 file - promoters60/2724724
aatcggg

SEQ ID NO: 54850 - DNA, 10 bp, Unknown
  misc_feature (1)..( 10): Matrix.002 file - promoters60/2724724
ggaaaagaaa

SEQ ID NO: 54851 - DNA, 9 bp, Unknown
  misc_feature (1)..( 9): Matrix.002 file - promoters60/2724724
aaagaaaag

SEQ ID NO: 54852 - DNA, 7 bp, Unknown
  misc_feature (1)..( 7): Matrix.002 file - promoters60/2724724
gtatata

SEQ ID NO: 54853 - DNA, 6 bp, Unknown
  misc_feature (1)..( 6): Matrix.002 file - promoters60/2724736
aagatt

SEQ ID NO: 54854 - DNA, 7 bp, Unknown
  misc_feature (1)..( 7): Matrix.002 file - promoters60/2724736
aaaaatg

SEQ ID NO: 54855 - DNA, 7 bp, Unknown
  misc_feature (1)..( 7): Matrix.002 file - promoters60/2724736
caaattg

SEQ ID NO: 54856 - DNA, 8 bp, Unknown
  misc_feature (1)..( 8): Matrix.002 file - promoters60/2724736
tgactagg

SEQ ID NO: 54857 - DNA, 6 bp, Unknown
  misc_feature (1)..( 6): Matrix.002 file - promoters60/2724736
aatcct

SEQ ID NO: 54858 - DNA, 7 bp, Unknown
  misc_feature (1)..( 7): Matrix.002 file - promoters60/2724736
cacgtgt

SEQ ID NO: 54859 - DNA, 7 bp, Unknown
  misc_feature (1)..( 7): Matrix.002 file - promoters60/2724736
aaaaaga

SEQ ID NO: 54860 - DNA, 6 bp, Unknown
  misc_feature (1)..( 6): Matrix.002 file - promoters60/2724736
agattc

SEQ ID NO: 54861 - DNA, 7 bp, Unknown
  misc_feature (1)..( 7): Matrix.002 file - promoters60/2724736
aatacaa

SEQ ID NO: 54862 - DNA, 7 bp, Unknown
  misc_feature (1)..( 7): Matrix.002 file - promoters60/2724736
ccagatg

SEQ ID NO: 54863 - DNA, 7 bp, Unknown
  misc_feature (1)..( 7): Matrix.002 file - promoters60/2724736
gataata

SEQ ID NO: 54864 - DNA, 7 bp, Unknown
  misc_feature (1)..( 7): Matrix.002 file - promoters60/2724736
aaaattt

SEQ ID NO: 54865 - DNA, 12 bp, Unknown
  misc_feature (1)..( 12): Matrix.002 file - promoters60/2724736
tttaacaaaaag

SEQ ID NO: 54866 - DNA, 10 bp, Unknown
  misc_feature (1)..( 10): Matrix.002 file - promoters60/2724736
agatatcatc

SEQ ID NO: 54867 - DNA, 7 bp, Unknown
  misc_feature (1)..( 7): Matrix.002 file - promoters60/2724736
caattaa

SEQ ID NO: 54868 - DNA, 7 bp, Unknown
  misc_feature (1)..( 7): Matrix.002 file - promoters60/2724736
cagccac

SEQ ID NO: 54869 - DNA, 10 bp, Unknown
  misc_feature (1)..( 10): Matrix.002 file - promoters60/2781251
aaatcgaaat

SEQ ID NO: 54870 - DNA, 10 bp, Unknown
  misc_feature (1)..( 10): Matrix.002 file - promoters60/2781251
cttctttagc

SEQ ID NO: 54871 - DNA, 9 bp, Unknown
  misc_feature (1)..( 9): Matrix.002 file - promoters60/2781786
caattggat

SEQ ID NO: 54872 - DNA, 6 bp, Unknown
  misc_feature (1)..( 6): Matrix.002 file - promoters60/2781786
taagta

SEQ ID NO: 54873 - DNA, 6 bp, Unknown
  misc_feature (1)..( 6): Matrix.002 file - promoters60/2781786
ctttgc

SEQ ID NO: 54874 - DNA, 6 bp, Unknown
  misc_feature (1)..( 6): Matrix.002 file - promoters60/2781786
ggtgag

SEQ ID NO: 54875 - DNA, 11 bp, Unknown
  misc_feature (1)..( 11): Matrix.002 file - promoters60/2781786
ctgaaaattta

SEQ ID NO: 54876 - DNA, 12 bp, Unknown
  misc_feature (1)..( 12): Matrix.002 file - promoters60/2785798
tttttcaatgag

SEQ ID NO: 54877 - DNA, 10 bp, Unknown
  misc_feature (1)..( 10): Matrix.002 file - promoters60/2785798
gatgaaaatt

SEQ ID NO: 54878 - DNA, 9 bp, Unknown
  misc_feature (1)..( 9): Matrix.002 file - promoters60/2785798
attatttta

SEQ ID NO: 54879 - DNA, 5 bp, Unknown
  misc_feature (1)..( 5): Matrix.002 file - promoters60/2785798
aagtt

SEQ ID NO: 54880 - DNA, 8 bp, Unknown
  misc_feature (1)..( 8): Matrix.002 file - promoters60/2918658
aaaaataa

SEQ ID NO: 54881 - DNA, 11 bp, Unknown
  misc_feature (1)..( 11): Matrix.002 file - promoters60/2918658
aaaaaaaatat

SEQ ID NO: 54882 - DNA, 9 bp, Unknown
  misc_feature (1)..( 9): Matrix.002 file - promoters60/2918658
aaaaatatt

SEQ ID NO: 54883 - DNA, 12 bp, Unknown
  misc_feature (1)..( 12): Matrix.002 file - promoters60/2918658
ataatcaaaaac

SEQ ID NO: 54884 - DNA, 6 bp, Unknown
  misc_feature (1)..( 6): Matrix.002 file - promoters60/2918658
aaatgt

SEQ ID NO: 54885 - DNA, 8 bp, Unknown
  misc_feature (1)..( 8): Matrix.002 file - promoters60/2918658
atttattt

SEQ ID NO: 54886 - DNA, 8 bp, Unknown
  misc_feature (1)..( 8): Matrix.002 file - promoters60/2918674
tcatttca

SEQ ID NO: 54887 - DNA, 8 bp, Unknown
  misc_feature (1)..( 8): Matrix.002 file - promoters60/2918674
gtaaaaat

SEQ ID NO: 54888 - DNA, 9 bp, Unknown
  misc_feature (1)..( 9): Matrix.002 file - promoters60/2918680
aaaataggc

SEQ ID NO: 54889 - DNA, 15 bp, Unknown
  misc_feature (1)..( 15): Matrix.002 file - promoters60/2989991
aaatcatctcaatgc

SEQ ID NO: 54890 - DNA, 7 bp, Unknown
  misc_feature (1)..( 7): Matrix.002 file - promoters60/2989991
cataata

SEQ ID NO: 54891 - DNA, 8 bp, Unknown
  misc_feature (1)..( 8): Matrix.002 file - promoters60/2989991
caagaaca

SEQ ID NO: 54892 - DNA, 6 bp, Unknown
  misc_feature (1)..( 6): Matrix.002 file - promoters60/2989991
aattaa

SEQ ID NO: 54893 - DNA, 6 bp, Unknown
  misc_feature (1)..( 6): Matrix.002 file - promoters60/2989991
gatgaa

SEQ ID NO: 54894 - DNA, 6 bp, Unknown
  misc_feature (1)..( 6): Matrix.002 file - promoters60/2989991
ctctct

SEQ ID NO: 54895 - DNA, 7 bp, Unknown
  misc_feature (1)..( 7): Matrix.002 file - promoters60/2989991
tcgaatt

SEQ ID NO: 54896 - DNA, 9 bp, Unknown
  misc_feature (1)..( 9): Matrix.002 file - promoters60/2989991
aagctcgat

SEQ ID NO: 54897 - DNA, 6 bp, Unknown
  misc_feature (1)..( 6): Matrix.002 file - promoters60/2989991
gaaaaa

SEQ ID NO: 54898 - DNA, 7 bp, Unknown
  misc_feature (1)..( 7): Matrix.002 file - promoters60/2989991
aaaaaat

SEQ ID NO: 54899 - DNA, 7 bp, Unknown
  misc_feature (1)..( 7): Matrix.002 file - promoters60/2989991
attggtt

SEQ ID NO: 54900 - DNA, 6 bp, Unknown
  misc_feature (1)..( 6): Matrix.002 file - promoters60/2989991
aaactt

SEQ ID NO: 54901 - DNA, 8 bp, Unknown
  misc_feature (1)..( 8): Matrix.002 file - promoters60/2989991
aaaattaa

SEQ ID NO: 54902 - DNA, 7 bp, Unknown
  misc_feature (1)..( 7): Matrix.002 file - promoters60/2989991
tactata

SEQ ID NO: 54903 - DNA, 10 bp, Unknown
  misc_feature (1)..( 10): Matrix.002 file - promoters60/2990087
aaaactattt

SEQ ID NO: 54904 - DNA, 7 bp, Unknown
  misc_feature (1)..( 7): Matrix.002 file - promoters60/2990087
ttttctt

SEQ ID NO: 54905 - DNA, 7 bp, Unknown
  misc_feature (1)..( 7): Matrix.002 file - promoters60/2990087
tgtagtt

SEQ ID NO: 54906 - DNA, 6 bp, Unknown
  misc_feature (1)..( 6): Matrix.002 file - promoters60/2990087
tctaca

SEQ ID NO: 54907 - DNA, 6 bp, Unknown
  misc_feature (1)..( 6): Matrix.002 file - promoters60/2990087
ctaaaa

SEQ ID NO: 54908 - DNA, 8 bp, Unknown
  misc_feature (1)..( 8): Matrix.002 file - promoters60/2990087
attcatcc

SEQ ID NO: 54909 - DNA, 7 bp, Unknown
  misc_feature (1)..( 7): Matrix.002 file - promoters60/2990087
ttcatta

SEQ ID NO: 54910 - DNA, 7 bp, Unknown
  misc_feature (1)..( 7): Matrix.002 file - promoters60/2990087
aacaaag

SEQ ID NO: 54911 - DNA, 8 bp, Unknown
  misc_feature (1)..( 8): Matrix.002 file - promoters60/2990087
cttagaaa

SEQ ID NO: 54912 - DNA, 7 bp, Unknown
  misc_feature (1)..( 7): Matrix.002 file - promoters60/2990087
tatatat

SEQ ID NO: 54913 - DNA, 8 bp, Unknown
  misc_feature (1)..( 8): Matrix.002 file - promoters60/2990087
aataaaat

SEQ ID NO: 54914 - DNA, 10 bp, Unknown
  misc_feature (1)..( 10): Matrix.002 file - promoters60/2990087
ttaatatttt

SEQ ID NO: 54915 - DNA, 7 bp, Unknown
  misc_feature (1)..( 7): Matrix.002 file - promoters60/2990087
ttatttt

SEQ ID NO: 54916 - DNA, 6 bp, Unknown
  misc_feature (1)..( 6): Matrix.002 file - promoters60/2990087
taacat

SEQ ID NO: 54917 - DNA, 7 bp, Unknown
  misc_feature (1)..( 7): Matrix.002 file - promoters60/2990087
aatgtga

SEQ ID NO: 54918 - DNA, 8 bp, Unknown
  misc_feature (1)..( 8): Matrix.002 file - promoters60/2990087
aaaaaaaa

SEQ ID NO: 54919 - DNA, 8 bp, Unknown
  misc_feature (1)..( 8): Matrix.002 file - promoters60/2990087
atttgatt

SEQ ID NO: 54920 - DNA, 10 bp, Unknown
  misc_feature (1)..( 10): Matrix.002 file - promoters60/2990087
aaaaaaactt

SEQ ID NO: 54921 - DNA, 7 bp, Unknown
  misc_feature (1)..( 7): Matrix.002 file - promoters60/2990087
cttaaga

SEQ ID NO: 54922 - DNA, 6 bp, Unknown
  misc_feature (1)..( 6): Matrix.002 file - promoters60/2990087
aaacaa

SEQ ID NO: 54923 - DNA, 10 bp, Unknown
  misc_feature (1)..( 10): Matrix.002 file - promoters60/2990087
ttgaaagtac

SEQ ID NO: 54924 - DNA, 7 bp, Unknown
  misc_feature (1)..( 7): Matrix.002 file - promoters60/2990087
ataaagg

SEQ ID NO: 54925 - DNA, 7 bp, Unknown
  misc_feature (1)..( 7): Matrix.002 file - promoters60/2990087
ataaact

SEQ ID NO: 54926 - DNA, 7 bp, Unknown
  misc_feature (1)..( 7): Matrix.002 file - promoters60/2990087
ttgatta

SEQ ID NO: 54927 - DNA, 10 bp, Unknown
  misc_feature (1)..( 10): Matrix.002 file - promoters60/2990249
cgacaacttt

SEQ ID NO: 54928 - DNA, 6 bp, Unknown
  misc_feature (1)..( 6): Matrix.002 file - promoters60/2990249
ttttct

SEQ ID NO: 54929 - DNA, 6 bp, Unknown
  misc_feature (1)..( 6): Matrix.002 file - promoters60/2990249
tatata

SEQ ID NO: 54930 - DNA, 6 bp, Unknown
  misc_feature (1)..( 6): Matrix.002 file - promoters60/2990249
cactta

SEQ ID NO: 54931 - DNA, 7 bp, Unknown
  misc_feature (1)..( 7): Matrix.002 file - promoters60/2990249
agaaaca

SEQ ID NO: 54932 - DNA, 9 bp, Unknown
  misc_feature (1)..( 9): Matrix.002 file - promoters60/2990249
aaacaatat

SEQ ID NO: 54933 - DNA, 6 bp, Unknown
  misc_feature (1)..( 6): Matrix.002 file - promoters60/2990249
aacaat

SEQ ID NO: 54934 - DNA, 9 bp, Unknown
  misc_feature (1)..( 9): Matrix.002 file - promoters60/2990249
tgagtacac

SEQ ID NO: 54935 - DNA, 6 bp, Unknown
  misc_feature (1)..( 6): Matrix.002 file - promoters60/2990249
aagtgg

SEQ ID NO: 54936 - DNA, 6 bp, Unknown
  misc_feature (1)..( 6): Matrix.002 file - promoters60/2990249
gaataa

SEQ ID NO: 54937 - DNA, 6 bp, Unknown
  misc_feature (1)..( 6): Matrix.002 file - promoters60/2990249
tgtata

SEQ ID NO: 54938 - DNA, 9 bp, Unknown
  misc_feature (1)..( 9): Matrix.002 file - promoters60/2990249
caaaagcaa

SEQ ID NO: 54939 - DNA, 7 bp, Unknown
  misc_feature (1)..( 7): Matrix.002 file - promoters60/2990249
aaaatct

SEQ ID NO: 54940 - DNA, 7 bp, Unknown
  misc_feature (1)..( 7): Matrix.002 file - promoters60/2990249
ttctgtt

SEQ ID NO: 54941 - DNA, 7 bp, Unknown
  misc_feature (1)..( 7): Matrix.002 file - promoters60/2990249
gatgttc

SEQ ID NO: 54942 - DNA, 6 bp, Unknown
  misc_feature (1)..( 6): Matrix.002 file - promoters60/2990249
aaaaac

SEQ ID NO: 54943 - DNA, 8 bp, Unknown
  misc_feature (1)..( 8): Matrix.002 file - promoters60/2990249
acaaaacg

SEQ ID NO: 54944 - DNA, 9 bp, Unknown
  misc_feature (1)..( 9): Matrix.002 file - promoters60/2990249
tacacaaaa

SEQ ID NO: 54945 - DNA, 6 bp, Unknown
  misc_feature (1)..( 6): Matrix.002 file - promoters60/2990249
aattaa

SEQ ID NO: 54946 - DNA, 6 bp, Unknown
  misc_feature (1)..( 6): Matrix.002 file - promoters60/2990249
tctttt

SEQ ID NO: 54947 - DNA, 6 bp, Unknown
  misc_feature (1)..( 6): Matrix.002 file - promoters60/2990249
tatata

SEQ ID NO: 54948 - DNA, 8 bp, Unknown
  misc_feature (1)..( 8): Matrix.002 file - promoters60/2990263
aatttaac

SEQ ID NO: 54949 - DNA, 9 bp, Unknown
  misc_feature (1)..( 9): Matrix.002 file - promoters60/2990263
tataaaata

SEQ ID NO: 54950 - DNA, 9 bp, Unknown
  misc_feature (1)..( 9): Matrix.002 file - promoters60/2990263
atttttaca

SEQ ID NO: 54951 - DNA, 12 bp, Unknown
  misc_feature (1)..( 12): Matrix.002 file - promoters60/2990263
caaatcgaaaaa

SEQ ID NO: 54952 - DNA, 8 bp, Unknown
  misc_feature (1)..( 8): Matrix.002 file - promoters60/2990528
caaaacaa

SEQ ID NO: 54953 - DNA, 8 bp, Unknown
  misc_feature (1)..( 8): Matrix.002 file - promoters60/2990528
attcaatt

SEQ ID NO: 54954 - DNA, 7 bp, Unknown
  misc_feature (1)..( 7): Matrix.002 file - promoters60/2990528
cttatct

SEQ ID NO: 54955 - DNA, 15 bp, Unknown
  misc_feature (1)..( 15): Matrix.002 file - promoters60/2990528
acaaaaataaatcac

SEQ ID NO: 54956 - DNA, 9 bp, Unknown
  misc_feature (1)..( 9): Matrix.002 file - promoters60/2990544
ctttatttg

SEQ ID NO: 54957 - DNA, 8 bp, Unknown
  misc_feature (1)..( 8): Matrix.002 file - promoters60/2990548
tattcatt

SEQ ID NO: 54958 - DNA, 7 bp, Unknown
  misc_feature (1)..( 7): Matrix.002 file - promoters60/2990548
gtttgtc

SEQ ID NO: 54959 - DNA, 9 bp, Unknown
  misc_feature (1)..( 9): Matrix.002 file - promoters60/2990548
gaacgcaga

SEQ ID NO: 54960 - DNA, 8 bp, Unknown
  misc_feature (1)..( 8): Matrix.002 file - promoters60/2990548
cttcactg

SEQ ID NO: 54961 - DNA, 10 bp, Unknown
  misc_feature (1)..( 10): Matrix.002 file - promoters60/2990548
cttcactttg

SEQ ID NO: 54962 - DNA, 12 bp, Unknown
  misc_feature (1)..( 12): Matrix.002 file - promoters60/2990611
ctaaaaatatac

SEQ ID NO: 54963 - DNA, 10 bp, Unknown
  misc_feature (1)..( 10): Matrix.002 file - promoters60/2990611
aaattaacct

SEQ ID NO: 54964 - DNA, 9 bp, Unknown
  misc_feature (1)..( 9): Matrix.002 file - promoters60/2990611
aattaaaaa

SEQ ID NO: 54965 - DNA, 8 bp, Unknown
  misc_feature (1)..( 8): Matrix.002 file - promoters60/2990611
attgttta

SEQ ID NO: 54966 - DNA, 13 bp, Unknown
  misc_feature (1)..( 13): Matrix.002 file - promoters60/2990611
aaaaaggaaagaa

SEQ ID NO: 54967 - DNA, 7 bp, Unknown
  misc_feature (1)..( 7): Matrix.002 file - promoters60/2990616
ttaataa

SEQ ID NO: 54968 - DNA, 6 bp, Unknown
  misc_feature (1)..( 6): Matrix.002 file - promoters60/2990616
caaaac

SEQ ID NO: 54969 - DNA, 7 bp, Unknown
  misc_feature (1)..( 7): Matrix.002 file - promoters60/2990616
tgtgttg

SEQ ID NO: 54970 - DNA, 7 bp, Unknown
  misc_feature (1)..( 7): Matrix.002 file - promoters60/2990616
aaagtta

SEQ ID NO: 54971 - DNA, 7 bp, Unknown
  misc_feature (1)..( 7): Matrix.002 file - promoters60/2990616
agaaaaa

SEQ ID NO: 54972 - DNA, 7 bp, Unknown
  misc_feature (1)..( 7): Matrix.002 file - promoters60/2990616
attcaca

SEQ ID NO: 54973 - DNA, 7 bp, Unknown
  misc_feature (1)..( 7): Matrix.002 file - promoters60/2990616
aaataag

SEQ ID NO: 54974 - DNA, 6 bp, Unknown
  misc_feature (1)..( 6): Matrix.002 file - promoters60/2990616
tttatg

SEQ ID NO: 54975 - DNA, 7 bp, Unknown
  misc_feature (1)..( 7): Matrix.002 file - promoters60/2990616
taaacta

SEQ ID NO: 54976 - DNA, 7 bp, Unknown
  misc_feature (1)..( 7): Matrix.002 file - promoters60/2990616
ctggact

SEQ ID NO: 54977 - DNA, 6 bp, Unknown
  misc_feature (1)..( 6): Matrix.002 file - promoters60/2990616
aaggta

SEQ ID NO: 54978 - DNA, 10 bp, Unknown
  misc_feature (1)..( 10): Matrix.002 file - promoters60/2990616
taatctatga

SEQ ID NO: 54979 - DNA, 7 bp, Unknown
  misc_feature (1)..( 7): Matrix.002 file - promoters60/2990616
tatagtt

SEQ ID NO: 54980 - DNA, 11 bp, Unknown
  misc_feature (1)..( 11): Matrix.002 file - promoters60/2990616
aaacttcatct

SEQ ID NO: 54981 - DNA, 7 bp, Unknown
  misc_feature (1)..( 7): Matrix.002 file - promoters60/2990616
tatatgt

SEQ ID NO: 54982 - DNA, 7 bp, Unknown
  misc_feature (1)..( 7): Matrix.002 file - promoters60/2990616
taagatt

SEQ ID NO: 54983 - DNA, 7 bp, Unknown
  misc_feature (1)..( 7): Matrix.002 file - promoters60/2990616
tggatat

SEQ ID NO: 54984 - DNA, 8 bp, Unknown
  misc_feature (1)..( 8): Matrix.002 file - promoters60/2990616
attgtttt

SEQ ID NO: 54985 - DNA, 8 bp, Unknown
  misc_feature (1)..( 8): Matrix.002 file - promoters60/2990659
ttaaaaaa

SEQ ID NO: 54986 - DNA, 8 bp, Unknown
  misc_feature (1)..( 8): Matrix.002 file - promoters60/2990659
aaaatgaa

SEQ ID NO: 54987 - DNA, 7 bp, Unknown
  misc_feature (1)..( 7): Matrix.002 file - promoters60/2990659
atcattg

SEQ ID NO: 54988 - DNA, 8 bp, Unknown
  misc_feature (1)..( 8): Matrix.002 file - promoters60/2990659
aattcata

SEQ ID NO: 54989 - DNA, 10 bp, Unknown
  misc_feature (1)..( 10): Matrix.002 file - promoters60/2990659
tttttcacat

SEQ ID NO: 54990 - DNA, 7 bp, Unknown
  misc_feature (1)..( 7): Matrix.002 file - promoters60/2990659
acatttt

SEQ ID NO: 54991 - DNA, 8 bp, Unknown
  misc_feature (1)..( 8): Matrix.002 file - promoters60/2990659
aaagattt

SEQ ID NO: 54992 - DNA, 7 bp, Unknown
  misc_feature (1)..( 7): Matrix.002 file - promoters60/2990659
tttattt

SEQ ID NO: 54993 - DNA, 7 bp, Unknown
  misc_feature (1)..( 7): Matrix.002 file - promoters60/2990659
tttaatt

SEQ ID NO: 54994 - DNA, 7 bp, Unknown
  misc_feature (1)..( 7): Matrix.002 file - promoters60/2990659
taatgta

SEQ ID NO: 54995 - DNA, 6 bp, Unknown
  misc_feature (1)..( 6): Matrix.002 file - promoters60/2990659
acgatt

SEQ ID NO: 54996 - DNA, 7 bp, Unknown
  misc_feature (1)..( 7): Matrix.002 file - promoters60/2990659
tcaaaca

SEQ ID NO: 54997 - DNA, 8 bp, Unknown
  misc_feature (1)..( 8): Matrix.002 file - promoters60/2990659
atataact

SEQ ID NO: 54998 - DNA, 6 bp, Unknown
  misc_feature (1)..( 6): Matrix.002 file - promoters60/2990659
tgtttt

SEQ ID NO: 54999 - DNA, 8 bp, Unknown
  misc_feature (1)..( 8): Matrix.002 file - promoters60/2990659
taatctat

SEQ ID NO: 55000 - DNA, 9 bp, Unknown
  misc_feature (1)..( 9): Matrix.002 file - promoters60/2990659
tcaatgcat

SEQ ID NO: 55001 - DNA, 13 bp, Unknown
  misc_feature (1)..( 13): Matrix.002 file - promoters60/2990659
ataagattcacat

SEQ ID NO: 55002 - DNA, 7 bp, Unknown
  misc_feature (1)..( 7): Matrix.002 file - promoters60/2990659
tcactta

SEQ ID NO: 55003 - DNA, 7 bp, Unknown
  misc_feature (1)..( 7): Matrix.002 file - promoters60/2990659
ctaccaa

SEQ ID NO: 55004 - DNA, 8 bp, Unknown
  misc_feature (1)..( 8): Matrix.002 file - promoters60/2990659
aaaataag

SEQ ID NO: 55005 - DNA, 6 bp, Unknown
  misc_feature (1)..( 6): Matrix.002 file - promoters60/2990659
atagat

SEQ ID NO: 55006 - DNA, 7 bp, Unknown
  misc_feature (1)..( 7): Matrix.002 file - promoters60/2990659
agagata

SEQ ID NO: 55007 - DNA, 6 bp, Unknown
  misc_feature (1)..( 6): Matrix.002 file - promoters60/2990659
ttttgg

SEQ ID NO: 55008 - DNA, 6 bp, Unknown
  misc_feature (1)..( 6): Matrix.002 file - promoters60/2990659
taagat

SEQ ID NO: 55009 - DNA, 6 bp, Unknown
  misc_feature (1)..( 6): Matrix.002 file - promoters60/2990659
aaagaa

SEQ ID NO: 55010 - DNA, 12 bp, Unknown
  misc_feature (1)..( 12): Matrix.002 file - promoters60/2990659
aaaaacaaaaca

SEQ ID NO: 55011 - DNA, 6 bp, Unknown
  misc_feature (1)..( 6): Matrix.002 file - promoters60/2990659
aaaaat

SEQ ID NO: 55012 - DNA, 6 bp, Unknown
  misc_feature (1)..( 6): Matrix.002 file - promoters60/2990659
taaccc

SEQ ID NO: 55013 - DNA, 7 bp, Unknown
  misc_feature (1)..( 7): Matrix.002 file - promoters60/2990777
attcttc

SEQ ID NO: 55014 - DNA, 6 bp, Unknown
  misc_feature (1)..( 6): Matrix.002 file - promoters60/2990777
agagag

SEQ ID NO: 55015 - DNA, 8 bp, Unknown
  misc_feature (1)..( 8): Matrix.002 file - promoters60/2990777
attcaaaa

SEQ ID NO: 55016 - DNA, 8 bp, Unknown
  misc_feature (1)..( 8): Matrix.002 file - promoters60/2990777
tttatgtt

SEQ ID NO: 55017 - DNA, 6 bp, Unknown
  misc_feature (1)..( 6): Matrix.002 file - promoters60/2990777
aaaaag

SEQ ID NO: 55018 - DNA, 6 bp, Unknown
  misc_feature (1)..( 6): Matrix.002 file - promoters60/2990777
tataaa

SEQ ID NO: 55019 - DNA, 7 bp, Unknown
  misc_feature (1)..( 7): Matrix.002 file - promoters60/2990777
tcgcgaa

SEQ ID NO: 55020 - DNA, 7 bp, Unknown
  misc_feature (1)..( 7): Matrix.002 file - promoters60/2990777
agccggt

SEQ ID NO: 55021 - DNA, 8 bp, Unknown
  misc_feature (1)..( 8): Matrix.002 file - promoters60/2990777
aaaaatat

SEQ ID NO: 55022 - DNA, 6 bp, Unknown
  misc_feature (1)..( 6): Matrix.002 file - promoters60/2990777
atctga

SEQ ID NO: 55023 - DNA, 6 bp, Unknown
  misc_feature (1)..( 6): Matrix.002 file - promoters60/2990777
ccaaag

SEQ ID NO: 55024 - DNA, 10 bp, Unknown
  misc_feature (1)..( 10): Matrix.002 file - promoters60/2990777
ctcaatctaa

SEQ ID NO: 55025 - DNA, 6 bp, Unknown
  misc_feature (1)..( 6): Matrix.002 file - promoters60/2990777
gcgcag

SEQ ID NO: 55026 - DNA, 9 bp, Unknown
  misc_feature (1)..( 9): Matrix.002 file - promoters60/2990777
aaagtaaag

SEQ ID NO: 55027 - DNA, 6 bp, Unknown
  misc_feature (1)..( 6): Matrix.002 file - promoters60/2990777
agtaaa

SEQ ID NO: 55028 - DNA, 7 bp, Unknown
  misc_feature (1)..( 7): Matrix.002 file - promoters60/2990777
aatcggg

SEQ ID NO: 55029 - DNA, 8 bp, Unknown
  misc_feature (1)..( 8): Matrix.002 file - promoters60/2990777
gaaacaaa

SEQ ID NO: 55030 - DNA, 10 bp, Unknown
  misc_feature (1)..( 10): Matrix.002 file - promoters60/2990777
ggaaaagaaa

SEQ ID NO: 55031 - DNA, 7 bp, Unknown
  misc_feature (1)..( 7): Matrix.002 file - promoters60/2990777
cccacta

SEQ ID NO: 55032 - DNA, 7 bp, Unknown
  misc_feature (1)..( 7): Matrix.002 file - promoters60/2990777
gtatata

SEQ ID NO: 55033 - DNA, 7 bp, Unknown
  misc_feature (1)..( 7): Matrix.002 file - promoters60/2991101
tctattt

SEQ ID NO: 55034 - DNA, 12 bp, Unknown
  misc_feature (1)..( 12): Matrix.002 file - promoters60/2991101
ggtttatttata

SEQ ID NO: 55035 - DNA, 9 bp, Unknown
  misc_feature (1)..( 9): Matrix.002 file - promoters60/2991101
tctttttcc

SEQ ID NO: 55036 - DNA, 6 bp, Unknown
  misc_feature (1)..( 6): Matrix.002 file - promoters60/2991101
taaact

SEQ ID NO: 55037 - DNA, 6 bp, Unknown
  misc_feature (1)..( 6): Matrix.002 file - promoters60/2991101
tattcc

SEQ ID NO: 55038 - DNA, 6 bp, Unknown
  misc_feature (1)..( 6): Matrix.002 file - promoters60/2991101
agaaaa

SEQ ID NO: 55039 - DNA, 8 bp, Unknown
  misc_feature (1)..( 8): Matrix.002 file - promoters60/2991101
aaaaggta

SEQ ID NO: 55040 - DNA, 10 bp, Unknown
  misc_feature (1)..( 10): Matrix.002 file - promoters60/2991101
tttatttata

SEQ ID NO: 55041 - DNA, 7 bp, Unknown
  misc_feature (1)..( 7): Matrix.002 file - promoters60/2991101
aaatata

SEQ ID NO: 55042 - DNA, 7 bp, Unknown
  misc_feature (1)..( 7): Matrix.002 file - promoters60/2991101
atgatga

SEQ ID NO: 55043 - DNA, 8 bp, Unknown
  misc_feature (1)..( 8): Matrix.002 file - promoters60/2991101
attgtttt

SEQ ID NO: 55044 - DNA, 8 bp, Unknown
  misc_feature (1)..( 8): Matrix.002 file - promoters60/2991101
tgagtatt

SEQ ID NO: 55045 - DNA, 8 bp, Unknown
  misc_feature (1)..( 8): Matrix.002 file - promoters60/2991101
aagaggat

SEQ ID NO: 55046 - DNA, 7 bp, Unknown
  misc_feature (1)..( 7): Matrix.002 file - promoters60/2991101
tctaaaa

SEQ ID NO: 55047 - DNA, 6 bp, Unknown
  misc_feature (1)..( 6): Matrix.002 file - promoters60/2991122
aaccta

SEQ ID NO: 55048 - DNA, 6 bp, Unknown
  misc_feature (1)..( 6): Matrix.002 file - promoters60/2991122
ggagac

SEQ ID NO: 55049 - DNA, 8 bp, Unknown
  misc_feature (1)..( 8): Matrix.002 file - promoters60/2991122
ttggctgc

SEQ ID NO: 55050 - DNA, 7 bp, Unknown
  misc_feature (1)..( 7): Matrix.002 file - promoters60/2991122
ggtggta

SEQ ID NO: 55051 - DNA, 7 bp, Unknown
  misc_feature (1)..( 7): Matrix.002 file - promoters60/2991122
aggacag

SEQ ID NO: 55052 - DNA, 6 bp, Unknown
  misc_feature (1)..( 6): Matrix.002 file - promoters60/2991122
tgtgaa

SEQ ID NO: 55053 - DNA, 7 bp, Unknown
  misc_feature (1)..( 7): Matrix.002 file - promoters60/2991122
tagcaac

SEQ ID NO: 55054 - DNA, 8 bp, Unknown
  misc_feature (1)..( 8): Matrix.002 file - promoters60/2991122
caaatgaa

SEQ ID NO: 55055 - DNA, 6 bp, Unknown
  misc_feature (1)..( 6): Matrix.002 file - promoters60/2991122
ggctga

SEQ ID NO: 55056 - DNA, 11 bp, Unknown
  misc_feature (1)..( 11): Matrix.002 file - promoters60/2991122
agggtctcaga

SEQ ID NO: 55057 - DNA, 6 bp, Unknown
  misc_feature (1)..( 6): Matrix.002 file - promoters60/2991122
agattt

SEQ ID NO: 55058 - DNA, 9 bp, Unknown
  misc_feature (1)..( 9): Matrix.002 file - promoters60/2991235
catagagaa

SEQ ID NO: 55059 - DNA, 7 bp, Unknown
  misc_feature (1)..( 7): Matrix.002 file - promoters60/2991235
gataaca

SEQ ID NO: 55060 - DNA, 8 bp, Unknown
  misc_feature (1)..( 8): Matrix.002 file - promoters60/2991235
ttgattat

SEQ ID NO: 55061 - DNA, 7 bp, Unknown
  misc_feature (1)..( 7): Matrix.002 file - promoters60/2991235
tcaacaa

SEQ ID NO: 55062 - DNA, 8 bp, Unknown
  misc_feature (1)..( 8): Matrix.002 file - promoters60/2991235
caacacaa

SEQ ID NO: 55063 - DNA, 8 bp, Unknown
  misc_feature (1)..( 8): Matrix.002 file - promoters60/2991235
gaaaaaac

SEQ ID NO: 55064 - DNA, 6 bp, Unknown
  misc_feature (1)..( 6): Matrix.002 file - promoters60/2991235
gaagat

SEQ ID NO: 55065 - DNA, 10 bp, Unknown
  misc_feature (1)..( 10): Matrix.002 file - promoters60/2991235
gaagcattta

SEQ ID NO: 55066 - DNA, 7 bp, Unknown
  misc_feature (1)..( 7): Matrix.002 file - promoters60/2991235
cgtacat

SEQ ID NO: 55067 - DNA, 8 bp, Unknown
  misc_feature (1)..( 8): Matrix.002 file - promoters60/2991235
gtagagaa

SEQ ID NO: 55068 - DNA, 7 bp, Unknown
  misc_feature (1)..( 7): Matrix.002 file - promoters60/2991235
acaggta

SEQ ID NO: 55069 - DNA, 7 bp, Unknown
  misc_feature (1)..( 7): Matrix.002 file - promoters60/2991235
tttccag

SEQ ID NO: 55070 - DNA, 6 bp, Unknown
  misc_feature (1)..( 6): Matrix.002 file - promoters60/2991235
gattct

SEQ ID NO: 55071 - DNA, 8 bp, Unknown
  misc_feature (1)..( 8): Matrix.002 file - promoters60/2991235
attgcaga

SEQ ID NO: 55072 - DNA, 7 bp, Unknown
  misc_feature (1)..( 7): Matrix.002 file - promoters60/2991235
agaatgg

SEQ ID NO: 55073 - DNA, 9 bp, Unknown
  misc_feature (1)..( 9): Matrix.002 file - promoters60/2991235
gactctact

SEQ ID NO: 55074 - DNA, 6 bp, Unknown
  misc_feature (1)..( 6): Matrix.002 file - promoters60/2991235
aaagaa

SEQ ID NO: 55075 - DNA, 8 bp, Unknown
  misc_feature (1)..( 8): Matrix.002 file - promoters60/2991235
aagaagaa

SEQ ID NO: 55076 - DNA, 6 bp, Unknown
  misc_feature (1)..( 6): Matrix.002 file - promoters60/2991235
caaaag

SEQ ID NO: 55077 - DNA, 6 bp, Unknown
  misc_feature (1)..( 6): Matrix.002 file - promoters60/2991235
ttgaag

SEQ ID NO: 55078 - DNA, 7 bp, Unknown
  misc_feature (1)..( 7): Matrix.002 file - promoters60/2991235
ctccatt

SEQ ID NO: 55079 - DNA, 10 bp, Unknown
  misc_feature (1)..( 10): Matrix.002 file - promoters60/2991239
tcaaaaaaaa

SEQ ID NO: 55080 - DNA, 9 bp, Unknown
  misc_feature (1)..( 9): Matrix.002 file - promoters60/2991239
ctaatctaa

SEQ ID NO: 55081 - DNA, 10 bp, Unknown
  misc_feature (1)..( 10): Matrix.002 file - promoters60/2991239
aaaaatgcaa

SEQ ID NO: 55082 - DNA, 8 bp, Unknown
  misc_feature (1)..( 8): Matrix.002 file - promoters60/2991239
aaatatag

SEQ ID NO: 55083 - DNA, 28 bp, Unknown
  misc_feature (1)..( 28): Matrix.002 file - promoters60/2991239
aagcctatataaaaggctacaagcatga

SEQ ID NO: 55084 - DNA, 12 bp, Unknown
  misc_feature (1)..( 12): Matrix.002 file - promoters60/2991239
attaaaaatgga

SEQ ID NO: 55085 - DNA, 32 bp, Unknown; identical to SEQ ID NO: 37195
  misc_feature (1)..( 32): Matrix.002 file - promoters60/2991239

SEQ ID NO: 55086 - DNA, 9 bp, Unknown
  misc_feature (1)..( 9): Matrix.002 file - promoters60/2991239
taaatacaa

SEQ ID NO: 55087 - DNA, 8 bp, Unknown
  misc_feature (1)..( 8): Matrix.002 file - promoters60/2991239
taatacaa

SEQ ID NO: 55088 - DNA, 15 bp, Unknown
  misc_feature (1)..( 15): Matrix.002 file - promoters60/2991239
attgaagacttttca

SEQ ID NO: 55089 - DNA, 14 bp, Unknown
  misc_feature (1)..( 14): Matrix.002 file - promoters60/2991239
ctataagcatttaa

SEQ ID NO: 55090 - DNA, 25 bp, Unknown
  misc_feature (1)..( 25): Matrix.002 file - promoters60/2991239
agcatttaagtctatcgctagactg

SEQ ID NO: 55091 - DNA, 12 bp, Unknown
  misc_feature (1)..( 12): Matrix.002 file - promoters60/2991239
ctttcaaataaa

SEQ ID NO: 55092 - DNA, 9 bp, Unknown
  misc_feature (1)..( 9): Matrix.002 file - promoters60/2991281
atttgagag

SEQ ID NO: 55093 - DNA, 10 bp, Unknown
  misc_feature (1)..( 10): Matrix.002 file - promoters60/2991281
aaaaaatatt

SEQ ID NO: 55094 - DNA, 9 bp, Unknown
  misc_feature (1)..( 9): Matrix.002 file - promoters60/2991281
atgaaattt

SEQ ID NO: 55095 - DNA, 6 bp, Unknown
  misc_feature (1)..( 6): Matrix.002 file - promoters60/2991333
ctaaat

SEQ ID NO: 55096 - DNA, 7 bp, Unknown
  misc_feature (1)..( 7): Matrix.002 file - promoters60/2991333
aataaag

SEQ ID NO: 55097 - DNA, 6 bp, Unknown
  misc_feature (1)..( 6): Matrix.002 file - promoters60/2991333
tgaaaa

SEQ ID NO: 55098 - DNA, 6 bp, Unknown
  misc_feature (1)..( 6): Matrix.002 file - promoters60/2991333
attaag

SEQ ID NO: 55099 - DNA, 6 bp, Unknown
  misc_feature (1)..( 6): Matrix.002 file - promoters60/2991333
aaaatg

SEQ ID NO: 55100 - DNA, 7 bp, Unknown
  misc_feature (1)..( 7): Matrix.002 file - promoters60/2991333
ttcctct

SEQ ID NO: 55101 - DNA, 6 bp, Unknown
  misc_feature (1)..( 6): Matrix.002 file - promoters60/2991333
tcaaat

SEQ ID NO: 55102 - DNA, 7 bp, Unknown
  misc_feature (1)..( 7): Matrix.002 file - promoters60/2991333
aacgaat

SEQ ID NO: 55103 - DNA, 8 bp, Unknown
  misc_feature (1)..( 8): Matrix.002 file - promoters60/2991333
aaaataaa

SEQ ID NO: 55104 - DNA, 7 bp, Unknown
  misc_feature (1)..( 7): Matrix.002 file - promoters60/2991333
gaaaaaa

SEQ ID NO: 55105 - DNA, 7 bp, Unknown
  misc_feature (1)..( 7): Matrix.002 file - promoters60/2991333
accacac

SEQ ID NO: 55106 - DNA, 6 bp, Unknown
  misc_feature (1)..( 6): Matrix.002 file - promoters60/2991333
aaacac

SEQ ID NO: 55107 - DNA, 6 bp, Unknown
  misc_feature (1)..( 6): Matrix.002 file - promoters60/2991333
cttctc

SEQ ID NO: 55108 - DNA, 8 bp, Unknown
  misc_feature (1)..( 8): Matrix.002 file - promoters60/2991333
tctccaaa

SEQ ID NO: 55109 - DNA, 8 bp, Unknown
  misc_feature (1)..( 8): Matrix.002 file - promoters60/2991333
attaaaga

SEQ ID NO: 55110 - DNA, 6 bp, Unknown
  misc_feature (1)..( 6): Matrix.002 file - promoters60/2991333
aaattt

SEQ ID NO: 55111 - DNA, 6 bp, Unknown
  misc_feature (1)..( 6): Matrix.002 file - promoters60/2991333
aaggat

SEQ ID NO: 55112 - DNA, 10 bp, Unknown
  misc_feature (1)..( 10): Matrix.002 file - promoters60/2991466
atactaattg

SEQ ID NO: 55113 - DNA, 10 bp, Unknown
  misc_feature (1)..( 10): Matrix.002 file - promoters60/2991466
ttcaatttta

SEQ ID NO: 55114 - DNA, 7 bp, Unknown
  misc_feature (1)..( 7): Matrix.002 file - promoters60/2991466
caaagta

SEQ ID NO: 55115 - DNA, 7 bp, Unknown
  misc_feature (1)..( 7): Matrix.002 file - promoters60/2991466
ttgccac

SEQ ID NO: 55116 - DNA, 10 bp, Unknown
  misc_feature (1)..( 10): Matrix.002 file - promoters60/2991466
atttttcaaa

SEQ ID NO: 55117 - DNA, 6 bp, Unknown
  misc_feature (1)..( 6): Matrix.002 file - promoters60/2991466
caaaac

SEQ ID NO: 55118 - DNA, 7 bp, Unknown
  misc_feature (1)..( 7): Matrix.002 file - promoters60/2991466
aatgatc

SEQ ID NO: 55119 - DNA, 7 bp, Unknown
  misc_feature (1)..( 7): Matrix.002 file - promoters60/2991466
aatcttg

SEQ ID NO: 55120 - DNA, 8 bp, Unknown
  misc_feature (1)..( 8): Matrix.002 file - promoters60/2991466
acaaagaa

SEQ ID NO: 55121 - DNA, 6 bp, Unknown
  misc_feature (1)..( 6): Matrix.002 file - promoters60/2991466
aaaaaa

SEQ ID NO: 55122 - DNA, 7 bp, Unknown
  misc_feature (1)..( 7): Matrix.002 file - promoters60/2991466
tacaccc

SEQ ID NO: 55123 - DNA, 9 bp, Unknown
  misc_feature (1)..( 9): Matrix.002 file - promoters60/2991466
tcattttta

SEQ ID NO: 55124 - DNA, 6 bp, Unknown
  misc_feature (1)..( 6): Matrix.002 file - promoters60/2991466
agaaaa

SEQ ID NO: 55125 - DNA, 9 bp, Unknown
  misc_feature (1)..( 9): Matrix.002 file - promoters60/2991466
agaacaaat

SEQ ID NO: 55126 - DNA, 7 bp, Unknown
  misc_feature (1)..( 7): Matrix.002 file - promoters60/2991466
ttagatt

SEQ ID NO: 55127 - DNA, 6 bp, Unknown
  misc_feature (1)..( 6): Matrix.002 file - promoters60/2991466
aaccaa

SEQ ID NO: 55128 - DNA, 7 bp, Unknown
  misc_feature (1)..( 7): Matrix.002 file - promoters60/2991466
ataatac

SEQ ID NO: 55129 - DNA, 9 bp, Unknown
  misc_feature (1)..( 9): Matrix.002 file - promoters60/2991466
aaaataaat

SEQ ID NO: 55130 - DNA, 7 bp, Unknown
  misc_feature (1)..( 7): Matrix.002 file - promoters60/2991466
aaaaaga

SEQ ID NO: 55131 - DNA, 6 bp, Unknown
  misc_feature (1)..( 6): Matrix.002 file - promoters60/2991466
tgaatt

SEQ ID NO: 55132 - DNA, 6 bp, Unknown
  misc_feature (1)..( 6): Matrix.002 file - promoters60/2991466
aaaaat

SEQ ID NO: 55133 - DNA, 11 bp, Unknown
  misc_feature (1)..( 11): Matrix.002 file - promoters60/2991489
aaaaagggcca

SEQ ID NO: 55134 - DNA, 7 bp, Unknown
  misc_feature (1)..( 7): Matrix.002 file - promoters60/2991507
aaagtta

SEQ ID NO: 55135 - DNA, 7 bp, Unknown
  misc_feature (1)..( 7): Matrix.002 file - promoters60/2991507
tcaatat

SEQ ID NO: 55136 - DNA, 8 bp, Unknown
  misc_feature (1)..( 8): Matrix.002 file - promoters60/2991507
tcattttt

SEQ ID NO: 55137 - DNA, 9 bp, Unknown
  misc_feature (1)..( 9): Matrix.002 file - promoters60/2991507
tgtttttta

SEQ ID NO: 55138 - DNA, 14 bp, Unknown
  misc_feature (1)..( 14): Matrix.002 file - promoters60/2991507
ttttactaactttc

SEQ ID NO: 55139 - DNA, 7 bp, Unknown
  misc_feature (1)..( 7): Matrix.002 file - promoters60/2991507
taaaatc

SEQ ID NO: 55140 - DNA, 6 bp, Unknown
  misc_feature (1)..( 6): Matrix.002 file - promoters60/2991507
tagtta

SEQ ID NO: 55141 - DNA, 7 bp, Unknown
  misc_feature (1)..( 7): Matrix.002 file - promoters60/2991507
tttcaca

SEQ ID NO: 55142 - DNA, 7 bp, Unknown
  misc_feature (1)..( 7): Matrix.002 file - promoters60/2991507
attgtgg

SEQ ID NO: 55143 - DNA, 7 bp, Unknown
  misc_feature (1)..( 7): Matrix.002 file - promoters60/2991507
tttaatc

SEQ ID NO: 55144 - DNA, 8 bp, Unknown
  misc_feature (1)..( 8): Matrix.002 file - promoters60/2991507
acttcata

SEQ ID NO: 55145 - DNA, 7 bp, Unknown
  misc_feature (1)..( 7): Matrix.002 file - promoters60/2991507
gatcgat

SEQ ID NO: 55146 - DNA, 6 bp, Unknown
  misc_feature (1)..( 6): Matrix.002 file - promoters60/2991507
tgataa

SEQ ID NO: 55147 - DNA, 10 bp, Unknown
  misc_feature (1)..( 10): Matrix.002 file - promoters60/2991507
gcgatgaatg

SEQ ID NO: 55148 - DNA, 7 bp, Unknown
  misc_feature (1)..( 7): Matrix.002 file - promoters60/2991507
ttatgtc

SEQ ID NO: 55149 - DNA, 7 bp, Unknown
  misc_feature (1)..( 7): Matrix.002 file - promoters60/2991507
attagta

SEQ ID NO: 55150 - DNA, 7 bp, Unknown
  misc_feature (1)..( 7): Matrix.002 file - promoters60/2991507
gattcag

SEQ ID NO: 55151 - DNA, 11 bp, Unknown
  misc_feature (1)..( 11): Matrix.002 file - promoters60/2991515
ctttttttttg

SEQ ID NO: 55152 - DNA, 8 bp, Unknown
  misc_feature (1)..( 8): Matrix.002 file - promoters60/2991515
ttttttgc

SEQ ID NO: 55153 - DNA, 7 bp, Unknown
  misc_feature (1)..( 7): Matrix.002 file - promoters60/2991515
tttaata

SEQ ID NO: 55154 - DNA, 8 bp, Unknown
  misc_feature (1)..( 8): Matrix.002 file - promoters60/2991515
gaaacatt

SEQ ID NO: 55155 - DNA, 11 bp, Unknown
  misc_feature (1)..( 11): Matrix.002 file - promoters60/2991515
aattaaaaact

SEQ ID NO: 55156 - DNA, 9 bp, Unknown
  misc_feature (1)..( 9): Matrix.002 file - promoters60/2991515
tcatgttct

SEQ ID NO: 55157 - DNA, 8 bp, Unknown
  misc_feature (1)..( 8): Matrix.002 file - promoters60/2991515
tatggttt

SEQ ID NO: 55158 - DNA, 7 bp, Unknown
  misc_feature (1)..( 7): Matrix.002 file - promoters60/2991515
aaacagt

SEQ ID NO: 55159 - DNA, 9 bp, Unknown
  misc_feature (1)..( 9): Matrix.002 file - promoters60/2991515
aaattcatt

SEQ ID NO: 55160 - DNA, 4 bp, Unknown
  misc_feature (1)..( 4): Matrix.002 file - promoters60/2991774
aaat

SEQ ID NO: 55161 - DNA, 6 bp, Unknown
  misc_feature (1)..( 6): Matrix.002 file - promoters60/2992000
ttctaa

SEQ ID NO: 55162 - DNA, 9 bp, Unknown
  misc_feature (1)..( 9): Matrix.002 file - promoters60/2992000
attggaaag

SEQ ID NO: 55163 - DNA, 6 bp, Unknown
  misc_feature (1)..( 6): Matrix.002 file - promoters60/2992000
aataat

SEQ ID NO: 55164 - DNA, 7 bp, Unknown
  misc_feature (1)..( 7): Matrix.002 file - promoters60/2992000
cccaaaa

SEQ ID NO: 55165 - DNA, 6 bp, Unknown
  misc_feature (1)..( 6): Matrix.002 file - promoters60/2992000
aatcat

SEQ ID NO: 55166 - DNA, 10 bp, Unknown
  misc_feature (1)..( 10): Matrix.002 file - promoters60/2992000
tatgatatat

SEQ ID NO: 55167 - DNA, 6 bp, Unknown
  misc_feature (1)..( 6): Matrix.002 file - promoters60/2992000
aaatta

SEQ ID NO: 55168 - DNA, 7 bp, Unknown
  misc_feature (1)..( 7): Matrix.002 file - promoters60/2992000
attacaa

SEQ ID NO: 55169 - DNA, 7 bp, Unknown
  misc_feature (1)..( 7): Matrix.002 file - promoters60/2992000
tatcact

SEQ ID NO: 55170 - DNA, 6 bp, Unknown
  misc_feature (1)..( 6): Matrix.002 file - promoters60/2992101
ttccca

SEQ ID NO: 55171 - DNA, 8 bp, Unknown
  misc_feature (1)..( 8): Matrix.002 file - promoters60/2992101
ccgtatct

SEQ ID NO: 55172 - DNA, 8 bp, Unknown
  misc_feature (1)..( 8): Matrix.002 file - promoters60/2992101
tttcttat

SEQ ID NO: 55173 - DNA, 6 bp, Unknown
  misc_feature (1)..( 6): Matrix.002 file - promoters60/2992101
tcaaac

SEQ ID NO: 55174 - DNA, 9 bp, Unknown
  misc_feature (1)..( 9): Matrix.002 file - promoters60/2992101
ttaggattt

SEQ ID NO: 55175 - DNA, 7 bp, Unknown
  misc_feature (1)..( 7): Matrix.002 file - promoters60/2992101
tgaattg

SEQ ID NO: 55176 - DNA, 6 bp, Unknown
  misc_feature (1)..( 6): Matrix.002 file - promoters60/2992101
aaaaaa

SEQ ID NO: 55177 - DNA, 6 bp, Unknown
  misc_feature (1)..( 6): Matrix.002 file - promoters60/2992101
ttgact

SEQ ID NO: 55178 - DNA, 8 bp, Unknown
  misc_feature (1)..( 8): Matrix.002 file - promoters60/2992101
tcttttct

SEQ ID NO: 55179 - DNA, 7 bp, Unknown
  misc_feature (1)..( 7): Matrix.002 file - promoters60/2992101
tggattt

SEQ ID NO: 55180 - DNA, 7 bp, Unknown
  misc_feature (1)..( 7): Matrix.002 file - promoters60/2992101
ttgatta

SEQ ID NO: 55181 - DNA, 6 bp, Unknown
  misc_feature (1)..( 6): Matrix.002 file - promoters60/2992101
ttagtc

SEQ ID NO: 55182 - DNA, 6 bp, Unknown
  misc_feature (1)..( 6): Matrix.002 file - promoters60/2992101
gatgtg

SEQ ID NO: 55183 - DNA, 7 bp, Unknown
  misc_feature (1)..( 7): Matrix.002 file - promoters60/2992101
caaaaaa

SEQ ID NO: 55184 - DNA, 11 bp, Unknown
  misc_feature (1)..( 11): Matrix.002 file - promoters60/2992247
aacaaagatat

SEQ ID NO: 55185 - DNA, 6 bp, Unknown
  misc_feature (1)..( 6): Matrix.002 file - promoters60/2992247
aaaatc

SEQ ID NO: 55186 - DNA, 16 bp, Unknown
  misc_feature (1)..( 16): Matrix.002 file - promoters60/2992281
tataaatgggccgaat

SEQ ID NO: 55187 - DNA, 10 bp, Unknown
  misc_feature (1)..( 10): Matrix.002 file - promoters60/2992349
cttctgaaac

SEQ ID NO: 55188 - DNA, 11 bp, Unknown
  misc_feature (1)..( 11): Matrix.002 file - promoters60/2992349
cattaaatata

SEQ ID NO: 55189 - DNA, 9 bp, Unknown
  misc_feature (1)..( 9): Matrix.002 file - promoters60/2992349
aacaaaaaa

SEQ ID NO: 55190 - DNA, 6 bp, Unknown
  misc_feature (1)..( 6): Matrix.002 file - promoters60/2992373
ttcaaa

SEQ ID NO: 55191 - DNA, 6 bp, Unknown
  misc_feature (1)..( 6): Matrix.002 file - promoters60/2992373
ggtgtt

SEQ ID NO: 55192 - DNA, 8 bp, Unknown
  misc_feature (1)..( 8): Matrix.002 file - promoters60/2992373
acccccta

SEQ ID NO: 55193 - DNA, 6 bp, Unknown
  misc_feature (1)..( 6): Matrix.002 file - promoters60/2992373
atccga

SEQ ID NO: 55194 - DNA, 8 bp, Unknown
  misc_feature (1)..( 8): Matrix.002 file - promoters60/2992373
ttgggctg

SEQ ID NO: 55195 - DNA, 8 bp, Unknown
  misc_feature (1)..( 8): Matrix.002 file - promoters60/2992373
cattcgga

SEQ ID NO: 55196 - DNA, 7 bp, Unknown
  misc_feature (1)..( 7): Matrix.002 file - promoters60/2992373
accataa

SEQ ID NO: 55197 - DNA, 7 bp, Unknown
  misc_feature (1)..( 7): Matrix.002 file - promoters60/2992373
caacaaa

SEQ ID NO: 55198 - DNA, 6 bp, Unknown
  misc_feature (1)..( 6): Matrix.002 file - promoters60/2992373
gaatgg

SEQ ID NO: 55199 - DNA, 7 bp, Unknown
  misc_feature (1)..( 7): Matrix.002 file - promoters60/2992373
aaaggaa

SEQ ID NO: 55200 - DNA, 6 bp, Unknown
  misc_feature (1)..( 6): Matrix.002 file - promoters60/2992373
tgtttt

SEQ ID NO: 55201 - DNA, 6 bp, Unknown
  misc_feature (1)..( 6): Matrix.002 file - promoters60/2992373
ttttga

SEQ ID NO: 55202 - DNA, 10 bp, Unknown
  misc_feature (1)..( 10): Matrix.002 file - promoters60/2992373
tttaaggaag

SEQ ID NO: 55203 - DNA, 7 bp, Unknown
  misc_feature (1)..( 7): Matrix.002 file - promoters60/2992373
gatctat

SEQ ID NO: 55204 - DNA, 10 bp, Unknown
  misc_feature (1)..( 10): Matrix.002 file - promoters60/2992373
caaggtaaat

SEQ ID NO: 55205 - DNA, 6 bp, Unknown
  misc_feature (1)..( 6): Matrix.002 file - promoters60/2992373
tcttaa

SEQ ID NO: 55206 - DNA, 8 bp, Unknown
  misc_feature (1)..( 8): Matrix.002 file - promoters60/2992373
actctaaa

SEQ ID NO: 55207 - DNA, 10 bp, Unknown
  misc_feature (1)..( 10): Matrix.002 file - promoters60/2992722
gaaatagatt

SEQ ID NO: 55208 - DNA, 15 bp, Unknown
  misc_feature (1)..( 15): Matrix.002 file - promoters60/2993642
aaaaaaatatttaaa

SEQ ID NO: 55209 - DNA, 11 bp, Unknown
  misc_feature (1)..( 11): Matrix.002 file - promoters60/2993642
ttatagatttt

SEQ ID NO: 55210 - DNA, 9 bp, Unknown
  misc_feature (1)..( 9): Matrix.002 file - promoters60/2993705
ttacgaaag

SEQ ID NO: 55211 - DNA, 7 bp, Unknown
  misc_feature (1)..( 7): Matrix.002 file - promoters60/2993705
acaaaga

SEQ ID NO: 55212 - DNA, 7 bp, Unknown
  misc_feature (1)..( 7): Matrix.002 file - promoters60/2993705
tatatat

SEQ ID NO: 55213 - DNA, 6 bp, Unknown
  misc_feature (1)..( 6): Matrix.002 file - promoters60/2993705
tcataa

SEQ ID NO: 55214 - DNA, 6 bp, Unknown
  misc_feature (1)..( 6): Matrix.002 file - promoters60/2993705
catttc

SEQ ID NO: 55215 - DNA, 7 bp, Unknown
  misc_feature (1)..( 7): Matrix.002 file - promoters60/2993705
catatgt

SEQ ID NO: 55216 - DNA, 6 bp, Unknown
  misc_feature (1)..( 6): Matrix.002 file - promoters60/2993705
caagtc

SEQ ID NO: 55217 - DNA, 9 bp, Unknown
  misc_feature (1)..( 9): Matrix.002 file - promoters60/2993705
attaaatat

SEQ ID NO: 55218 - DNA, 7 bp, Unknown
  misc_feature (1)..( 7): Matrix.002 file - promoters60/2993705
gatacat

SEQ ID NO: 55219 - DNA, 8 bp, Unknown
  misc_feature (1)..( 8): Matrix.002 file - promoters60/2993705
gtcgatct

SEQ ID NO: 55220 - DNA, 6 bp, Unknown
  misc_feature (1)..( 6): Matrix.002 file - promoters60/2993705
taaact

SEQ ID NO: 55221 - DNA, 8 bp, Unknown
  misc_feature (1)..( 8): Matrix.002 file - promoters60/2993705
aatggtgt

SEQ ID NO: 55222 - DNA, 6 bp, Unknown
  misc_feature (1)..( 6): Matrix.002 file - promoters60/2993705
aatgtt

SEQ ID NO: 55223 - DNA, 7 bp, Unknown
  misc_feature (1)..( 7): Matrix.002 file - promoters60/2993705
tgtacat

SEQ ID NO: 55224 - DNA, 6 bp, Unknown
  misc_feature (1)..( 6): Matrix.002 file - promoters60/2993705
tatgag

SEQ ID NO: 55225 - DNA, 8 bp, Unknown
  misc_feature (1)..( 8): Matrix.002 file - promoters60/2993705
gatgtttc

SEQ ID NO: 55226 - DNA, 10 bp, Unknown
  misc_feature (1)..( 10): Matrix.002 file - promoters60/2994916
tttctctaat

SEQ ID NO: 55227 - DNA, 18 bp, Unknown
  misc_feature (1)..( 18): Matrix.002 file - promoters60/2994916
agatattttgtttaacaa

SEQ ID NO: 55228 - DNA, 6 bp, Unknown
  misc_feature (1)..( 6): Matrix.002 file - promoters60/2994916
tctttt

SEQ ID NO: 55229 - DNA, 6 bp, Unknown
  misc_feature (1)..( 6): Matrix.002 file - promoters60/2994916
ttaact

SEQ ID NO: 55230 - DNA, 7 bp, Unknown
  misc_feature (1)..( 7): Matrix.002 file - promoters60/2994916
tgaattc

SEQ ID NO: 55231 - DNA, 6 bp, Unknown
  misc_feature (1)..( 6): Matrix.002 file - promoters60/2994916
aaaaca

SEQ ID NO: 55232 - DNA, 6 bp, Unknown
  misc_feature (1)..( 6): Matrix.002 file - promoters60/2994916
tcatca

SEQ ID NO: 55233 - DNA, 9 bp, Unknown
  misc_feature (1)..( 9): Matrix.002 file - promoters60/2994916
aggttacta

SEQ ID NO: 55234 - DNA, 6 bp, Unknown
  misc_feature (1)..( 6): Matrix.002 file - promoters60/2994916
aacaaa

SEQ ID NO: 55235 - DNA, 8 bp, Unknown
  misc_feature (1)..( 8): Matrix.002 file - promoters60/2994916
cggtcaag

SEQ ID NO: 55236 - DNA, 6 bp, Unknown
  misc_feature (1)..( 6): Matrix.002 file - promoters60/2994916
aaacta

SEQ ID NO: 55237 - DNA, 6 bp, Unknown
  misc_feature (1)..( 6): Matrix.002 file - promoters60/2995898
tcgtcg

SEQ ID NO: 55238 - DNA, 7 bp, Unknown
  misc_feature (1)..( 7): Matrix.002 file - promoters60/2995898
agagaaa

SEQ ID NO: 55239 - DNA, 7 bp, Unknown
  misc_feature (1)..( 7): Matrix.002 file - promoters60/2995898
aaattcg

SEQ ID NO: 55240 - DNA, 11 bp, Unknown
  misc_feature (1)..( 11): Matrix.002 file - promoters60/2995898
cgccggagatt

SEQ ID NO: 55241 - DNA, 8 bp, Unknown
  misc_feature (1)..( 8): Matrix.002 file - promoters60/2995898
acgaagaa

SEQ ID NO: 55242 - DNA, 7 bp, Unknown
  misc_feature (1)..( 7): Matrix.002 file - promoters60/2995898
gttagtg

SEQ ID NO: 55243 - DNA, 8 bp, Unknown
  misc_feature (1)..( 8): Matrix.002 file - promoters60/2995898
gataattt

SEQ ID NO: 55244 - DNA, 8 bp, Unknown
  misc_feature (1)..( 8): Matrix.002 file - promoters60/2995898
ttaaaaaa

SEQ ID NO: 55245 - DNA, 6 bp, Unknown
  misc_feature (1)..( 6): Matrix.002 file - promoters60/2995898
gaaaat

SEQ ID NO: 55246 - DNA, 7 bp, Unknown
  misc_feature (1)..( 7): Matrix.002 file - promoters60/2995898
gtgaaat

SEQ ID NO: 55247 - DNA, 6 bp, Unknown
  misc_feature (1)..( 6): Matrix.002 file - promoters60/2995898
gagtga

SEQ ID NO: 55248 - DNA, 6 bp, Unknown
  misc_feature (1)..( 6): Matrix.002 file - promoters60/2995898
ttttta

SEQ ID NO: 55249 - DNA, 6 bp, Unknown
  misc_feature (1)..( 6): Matrix.002 file - promoters60/2995898
attttt

SEQ ID NO: 55250 - DNA, 8 bp, Unknown
  misc_feature (1)..( 8): Matrix.002 file - promoters60/2995898
aaagattt

SEQ ID NO: 55251 - DNA, 6 bp, Unknown
  misc_feature (1)..( 6): Matrix.002 file - promoters60/2995898
atttac

SEQ ID NO: 55252 - DNA, 7 bp, Unknown
  misc_feature (1)..( 7): Matrix.002 file - promoters60/2995898
caaagaa

SEQ ID NO: 55253 - DNA, 6 bp, Unknown
  misc_feature (1)..( 6): Matrix.002 file - promoters60/2995898
tttcaa

SEQ ID NO: 55254 - DNA, 7 bp, Unknown
  misc_feature (1)..( 7): Matrix.002 file - promoters60/2995898
taacgtt

SEQ ID NO: 55255 - DNA, 6 bp, Unknown
  misc_feature (1)..( 6): Matrix.002 file - promoters60/2995898
cttctt

SEQ ID NO: 55256 - DNA, 7 bp, Unknown
  misc_feature (1)..( 7): Matrix.002 file - promoters60/2995898
agattgt

SEQ ID NO: 55257 - DNA, 7 bp, Unknown
  misc_feature (1)..( 7): Matrix.002 file - promoters60/2995898
atataat

SEQ ID NO: 55258 - DNA, 7 bp, Unknown
  misc_feature (1)..( 7): Matrix.002 file - promoters60/2995898
tccaaaa

SEQ ID NO: 55259 - DNA, 6 bp, Unknown
  misc_feature (1)..( 6): Matrix.002 file - promoters60/2995898
aaaatt

SEQ ID NO: 55260 - DNA, 6 bp, Unknown
  misc_feature (1)..( 6): Matrix.002 file - promoters60/2995898
ggtatt

SEQ ID NO: 55261 - DNA, 11 bp, Unknown
  misc_feature (1)..( 11): Matrix.002 file - promoters60/2995898
tttaacttttt

SEQ ID NO: 55262 - DNA, 10 bp, Unknown
  misc_feature (1)..( 10): Matrix.002 file - promoters60/2995898
tttttaagtg

SEQ ID NO: 55263 - DNA, 6 bp, Unknown
  misc_feature (1)..( 6): Matrix.002 file - promoters60/2995898
agaata

SEQ ID NO: 55264 - DNA, 7 bp, Unknown
  misc_feature (1)..( 7): Matrix.002 file - promoters60/2996054
acaaaaa

SEQ ID NO: 55265 - DNA, 10 bp, Unknown
  misc_feature (1)..( 10): Matrix.002 file - promoters60/2996054
tgttttcact

SEQ ID NO: 55266 - DNA, 10 bp, Unknown
  misc_feature (1)..( 10): Matrix.002 file - promoters60/2996054
aactctttta

SEQ ID NO: 55267 - DNA, 7 bp, Unknown
  misc_feature (1)..( 7): Matrix.002 file - promoters60/2996054
tttatta

SEQ ID NO: 55268 - DNA, 9 bp, Unknown
  misc_feature (1)..( 9): Matrix.002 file - promoters60/2996054
ctgtcaaag

SEQ ID NO: 55269 - DNA, 6 bp, Unknown
  misc_feature (1)..( 6): Matrix.002 file - promoters60/2996080
gtgaga

SEQ ID NO: 55270 - DNA, 8 bp, Unknown
  misc_feature (1)..( 8): Matrix.002 file - promoters60/2996080
ctggctat

SEQ ID NO: 55271 - DNA, 7 bp, Unknown
  misc_feature (1)..( 7): Matrix.002 file - promoters60/2996080
tttcgag

SEQ ID NO: 55272 - DNA, 6 bp, Unknown
  misc_feature (1)..( 6): Matrix.002 file - promoters60/2996080
tgcttt

SEQ ID NO: 55273 - DNA, 6 bp, Unknown
  misc_feature (1)..( 6): Matrix.002 file - promoters60/2996080
tttatt

SEQ ID NO: 55274 - DNA, 6 bp, Unknown
  misc_feature (1)..( 6): Matrix.002 file - promoters60/2996080
caacaa

SEQ ID NO: 55275 - DNA, 6 bp, Unknown
  misc_feature (1)..( 6): Matrix.002 file - promoters60/2996080
gaaaca

SEQ ID NO: 55276 - DNA, 8 bp, Unknown
  misc_feature (1)..( 8): Matrix.002 file - promoters60/2996080
aaaataag

SEQ ID NO: 55277 - DNA, 6 bp, Unknown
  misc_feature (1)..( 6): Matrix.002 file - promoters60/2996080
tttgat

SEQ ID NO: 55278 - DNA, 6 bp, Unknown
  misc_feature (1)..( 6): Matrix.002 file - promoters60/2996080
ggtgga

SEQ ID NO: 55279 - DNA, 8 bp, Unknown
  misc_feature (1)..( 8): Matrix.002 file - promoters60/2996080
cttcaggt

SEQ ID NO: 55280 - DNA, 7 bp, Unknown
  misc_feature (1)..( 7): Matrix.002 file - promoters60/2996080
gacgacg

SEQ ID NO: 55281 - DNA, 7 bp, Unknown
  misc_feature (1)..( 7): Matrix.002 file - promoters60/2996080
tatcatc

SEQ ID NO: 55282 - DNA, 8 bp, Unknown
  misc_feature (1)..( 8): Matrix.002 file - promoters60/2996080
ctcaaaaa

SEQ ID NO: 55283 - DNA, 8 bp, Unknown
  misc_feature (1)..( 8): Matrix.002 file - promoters60/2996109
attatttt

SEQ ID NO: 55284 - DNA, 13 bp, Unknown
  misc_feature (1)..( 13): Matrix.002 file - promoters60/2996109
taattaaatataa

SEQ ID NO: 55285 - DNA, 13 bp, Unknown
  misc_feature (1)..( 13): Matrix.002 file - promoters60/2996109
taataaaacataa

SEQ ID NO: 55286 - DNA, 7 bp, Unknown
  misc_feature (1)..( 7): Matrix.002 file - promoters60/2996109
aaacatc

SEQ ID NO: 55287 - DNA, 8 bp, Unknown
  misc_feature (1)..( 8): Matrix.002 file - promoters60/2996109
ttttgtat

SEQ ID NO: 55288 - DNA, 13 bp, Unknown
  misc_feature (1)..( 13): Matrix.002 file - promoters60/2996109
aaaagtcaaaaaa

SEQ ID NO: 55289 - DNA, 8 bp, Unknown
  misc_feature (1)..( 8): Matrix.002 file - promoters60/2996109
aatatata

SEQ ID NO: 55290 - DNA, 7 bp, Unknown
  misc_feature (1)..( 7): Matrix.002 file - promoters60/2996109
tattata

SEQ ID NO: 55291 - DNA, 7 bp, Unknown
  misc_feature (1)..( 7): Matrix.002 file - promoters60/2996109
aaaaaag

SEQ ID NO: 55292 - DNA, 9 bp, Unknown
  misc_feature (1)..( 9): Matrix.002 file - promoters60/2996119
aaaaaacga

SEQ ID NO: 55293 - DNA, 8 bp, Unknown
  misc_feature (1)..( 8): Matrix.002 file - promoters60/2996119
aatatgtt

SEQ ID NO: 55294 - DNA, 9 bp, Unknown
  misc_feature (1)..( 9): Matrix.002 file - promoters60/2996119
ttggtgagt

SEQ ID NO: 55295 - DNA, 6 bp, Unknown
  misc_feature (1)..( 6): Matrix.002 file - promoters60/2996119
atactg

SEQ ID NO: 55296 - DNA, 6 bp, Unknown
  misc_feature (1)..( 6): Matrix.002 file - promoters60/2996119
aggaaa

SEQ ID NO: 55297 - DNA, 6 bp, Unknown
  misc_feature (1)..( 6): Matrix.002 file - promoters60/2996119
aaaaac

SEQ ID NO: 55298 - DNA, 6 bp, Unknown
  misc_feature (1)..( 6): Matrix.002 file - promoters60/2996119
gataaa

SEQ ID NO: 55299 - DNA, 8 bp, Unknown
  misc_feature (1)..( 8): Matrix.002 file - promoters60/2996119
aaaatcac

SEQ ID NO: 55300 - DNA, 7 bp, Unknown
  misc_feature (1)..( 7): Matrix.002 file - promoters60/2996119
gataaaa

SEQ ID NO: 55301 - DNA, 7 bp, Unknown
  misc_feature (1)..( 7): Matrix.002 file - promoters60/2996119
aatttat

SEQ ID NO: 55302 - DNA, 9 bp, Unknown
  misc_feature (1)..( 9): Matrix.002 file - promoters60/2996119
aagaaaaat

SEQ ID NO: 55303 - DNA, 7 bp, Unknown
  misc_feature (1)..( 7): Matrix.002 file - promoters60/2996119
tttcttg

SEQ ID NO: 55304 - DNA, 6 bp, Unknown
  misc_feature (1)..( 6): Matrix.002 file - promoters60/2996119
atttta

SEQ ID NO: 55305 - DNA, 6 bp, Unknown
  misc_feature (1)..( 6): Matrix.002 file - promoters60/2996119
tttttg

SEQ ID NO: 55306 - DNA, 7 bp, Unknown
  misc_feature (1)..( 7): Matrix.002 file - promoters60/2996119
tgtggtt

SEQ ID NO: 55307 - DNA, 13 bp, Unknown
  misc_feature (1)..( 13): Matrix.002 file - promoters60/2996222
aaagaatttctaa

SEQ ID NO: 55308 - DNA, 10 bp, Unknown
  misc_feature (1)..( 10): Matrix.002 file - promoters60/2996222
tttactaaaa

SEQ ID NO: 55309 - DNA, 9 bp, Unknown
  misc_feature (1)..( 9): Matrix.002 file - promoters60/2996222
aataatttt

SEQ ID NO: 55310 - DNA, 10 bp, Unknown
  misc_feature (1)..( 10): Matrix.002 file - promoters60/2996222
tattttacta

SEQ ID NO: 55311 - DNA, 10 bp, Unknown
  misc_feature (1)..( 10): Matrix.002 file - promoters60/2996222
ctatatataa

SEQ ID NO: 55312 - DNA, 11 bp, Unknown
  misc_feature (1)..( 11): Matrix.002 file - promoters60/2996222
aaaaaaataat

SEQ ID NO: 55313 - DNA, 9 bp, Unknown
  misc_feature (1)..( 9): Matrix.002 file - promoters60/2996222
aatttctta

SEQ ID NO: 55314 - DNA, 9 bp, Unknown
  misc_feature (1)..( 9): Matrix.002 file - promoters60/2996222
aaaacaatt

SEQ ID NO: 55315 - DNA, 9 bp, Unknown
  misc_feature (1)..( 9): Matrix.002 file - promoters60/2996222
ttaaagaag

SEQ ID NO: 55316 - DNA, 7 bp, Unknown
  misc_feature (1)..( 7): Matrix.002 file - promoters60/2996290
aaaacaa

SEQ ID NO: 55317 - DNA, 7 bp, Unknown
  misc_feature (1)..( 7): Matrix.002 file - promoters60/2996290
aactttg

SEQ ID NO: 55318 - DNA, 11 bp, Unknown
  misc_feature (1)..( 11): Matrix.002 file - promoters60/2996290
gtaaataataa

SEQ ID NO: 55319 - DNA, 6 bp, Unknown
  misc_feature (1)..( 6): Matrix.002 file - promoters60/2996290
ccaaaa

SEQ ID NO: 55320 - DNA, 7 bp, Unknown
  misc_feature (1)..( 7): Matrix.002 file - promoters60/2996290
aaaataa

SEQ ID NO: 55321 - DNA, 6 bp, Unknown
  misc_feature (1)..( 6): Matrix.002 file - promoters60/2996290
atagaa

SEQ ID NO: 55322 - DNA, 11 bp, Unknown
  misc_feature (1)..( 11): Matrix.002 file - promoters60/2996290
aaaaataataa

SEQ ID NO: 55323 - DNA, 7 bp, Unknown
  misc_feature (1)..( 7): Matrix.002 file - promoters60/2996290
aaataat

SEQ ID NO: 55324 - DNA, 7 bp, Unknown
  misc_feature (1)..( 7): Matrix.002 file - promoters60/2996290
attcata

SEQ ID NO: 55325 - DNA, 6 bp, Unknown
  misc_feature (1)..( 6): Matrix.002 file - promoters60/2996290
aaatct

SEQ ID NO: 55326 - DNA, 6 bp, Unknown
  misc_feature (1)..( 6): Matrix.002 file - promoters60/2996290
ttttaa

SEQ ID NO: 55327 - DNA, 8 bp, Unknown
  misc_feature (1)..( 8): Matrix.002 file - promoters60/2996290
aatggaac

SEQ ID NO: 55328 - DNA, 6 bp, Unknown
  misc_feature (1)..( 6): Matrix.002 file - promoters60/2996290
cttttt

SEQ ID NO: 55329 - DNA, 7 bp, Unknown
  misc_feature (1)..( 7): Matrix.002 file - promoters60/2996290
aagatct

SEQ ID NO: 55330 - DNA, 6 bp, Unknown
  misc_feature (1)..( 6): Matrix.002 file - promoters60/2996290
cactct

SEQ ID NO: 55331 - DNA, 9 bp, Unknown
  misc_feature (1)..( 9): Matrix.002 file - promoters60/2997951
ctaaaaata

SEQ ID NO: 55332 - DNA, 6 bp, Unknown
  misc_feature (1)..( 6): Matrix.002 file - promoters60/3003010
caaacc

SEQ ID NO: 55333 - DNA, 7 bp, Unknown
  misc_feature (1)..( 7): Matrix.002 file - promoters60/3003010
tttaggt

SEQ ID NO: 55334 - DNA, 6 bp, Unknown
  misc_feature (1)..( 6): Matrix.002 file - promoters60/3003010
ttcagt

SEQ ID NO: 55335 - DNA, 6 bp, Unknown
  misc_feature (1)..( 6): Matrix.002 file - promoters60/3003010
aatttt

SEQ ID NO: 55336 - DNA, 7 bp, Unknown
  misc_feature (1)..( 7): Matrix.002 file - promoters60/3003010
taaaaat

SEQ ID NO: 55337 - DNA, 7 bp, Unknown
  misc_feature (1)..( 7): Matrix.002 file - promoters60/3003010
caatatt

SEQ ID NO: 55338 - DNA, 8 bp, Unknown
  misc_feature (1)..( 8): Matrix.002 file - promoters60/3003010
aattatat

SEQ ID NO: 55339 - DNA, 6 bp, Unknown
  misc_feature (1)..( 6): Matrix.002 file - promoters60/3003010
aataaa

SEQ ID NO: 55340 - DNA, 7 bp, Unknown
  misc_feature (1)..( 7): Matrix.002 file - promoters60/3003010
tacagta

SEQ ID NO: 55341 - DNA, 8 bp, Unknown
  misc_feature (1)..( 8): Matrix.002 file - promoters60/3003010
aaaaaaat

SEQ ID NO: 55342 - DNA, 6 bp, Unknown
  misc_feature (1)..( 6): Matrix.002 file - promoters60/3011901
ataaaa

SEQ ID NO: 55343 - DNA, 6 bp, Unknown
  misc_feature (1)..( 6): Matrix.002 file - promoters60/3011901
aaaaca

SEQ ID NO: 55344 - DNA, 6 bp, Unknown
  misc_feature (1)..( 6): Matrix.002 file - promoters60/3011901
agtgca

SEQ ID NO: 55345 - DNA, 6 bp, Unknown
  misc_feature (1)..( 6): Matrix.002 file - promoters60/3011901
ttaaaa

SEQ ID NO: 55346 - DNA, 6 bp, Unknown
  misc_feature (1)..( 6): Matrix.002 file - promoters60/3011901
agaaaa

SEQ ID NO: 55347 - DNA, 6 bp, Unknown
  misc_feature (1)..( 6): Matrix.002 file - promoters60/3011901
gaagag

SEQ ID NO: 55348 - DNA, 7 bp, Unknown
  misc_feature (1)..( 7): Matrix.002 file - promoters60/3011901
aaaactt

SEQ ID NO: 55349 - DNA, 9 bp, Unknown
  misc_feature (1)..( 9): Matrix.002 file - promoters60/3011901
aattcataa

SEQ ID NO: 55350 - DNA, 6 bp, Unknown
  misc_feature (1)..( 6): Matrix.002 file - promoters60/3011901
gttaac

SEQ ID NO: 55351 - DNA, 9 bp, Unknown
  misc_feature (1)..( 9): Matrix.002 file - promoters60/3011901
agagaatat

SEQ ID NO: 55352 - DNA, 7 bp, Unknown
  misc_feature (1)..( 7): Matrix.002 file - promoters60/3011901
aaaccaa

SEQ ID NO: 55353 - DNA, 6 bp, Unknown
  misc_feature (1)..( 6): Matrix.002 file - promoters60/3011901
ccaatg

SEQ ID NO: 55354 - DNA, 7 bp, Unknown
  misc_feature (1)..( 7): Matrix.002 file - promoters60/3011901
cataaga

SEQ ID NO: 55355 - DNA, 7 bp, Unknown
  misc_feature (1)..( 7): Matrix.002 file - promoters60/3011901
ggcacat

SEQ ID NO: 55356 - DNA, 7 bp, Unknown
  misc_feature (1)..( 7): Matrix.002 file - promoters60/3011901
taaataa

SEQ ID NO: 55357 - DNA, 11 bp, Unknown
  misc_feature (1)..( 11): Matrix.002 file - promoters60/3014276
taatgataatc

SEQ ID NO: 55358 - DNA, 9 bp, Unknown
  misc_feature (1)..( 9): Matrix.002 file - promoters60/3014276
ctcgtcttc

SEQ ID NO: 55359 - DNA, 9 bp, Unknown
  misc_feature (1)..( 9): Matrix.002 file - promoters60/3014276
tgtttaaaa

SEQ ID NO: 55360 - DNA, 7 bp, Unknown
  misc_feature (1)..( 7): Matrix.002 file - promoters60/3014276
atctctc

SEQ ID NO: 55361 - DNA, 7 bp, Unknown
  misc_feature (1)..( 7): Matrix.002 file - promoters60/3043322
attatat

SEQ ID NO: 55362 - DNA, 5 bp, Unknown
  misc_feature (1)..( 5): Matrix.002 file - promoters60/3043322
tgtga

SEQ ID NO: 55363 - DNA, 7 bp, Unknown
  misc_feature (1)..( 7): Matrix.002 file - promoters60/3043322
acgatta

SEQ ID NO: 55364 - DNA, 7 bp, Unknown
  misc_feature (1)..( 7): Matrix.002 file - promoters60/3043322
atcattc

SEQ ID NO: 55365 - DNA, 6 bp, Unknown
  misc_feature (1)..( 6): Matrix.002 file - promoters60/3043322
aaagtc

SEQ ID NO: 55366 - DNA, 6 bp, Unknown
  misc_feature (1)..( 6): Matrix.002 file - promoters60/3043322
catatt

SEQ ID NO: 55367 - DNA, 8 bp, Unknown
  misc_feature (1)..( 8): Matrix.002 file - promoters60/3043322
atttgatt

SEQ ID NO: 55368 - DNA, 8 bp, Unknown
  misc_feature (1)..( 8): Matrix.002 file - promoters60/3043322
aaccattt

SEQ ID NO: 55369 - DNA, 9 bp, Unknown
  misc_feature (1)..( 9): Matrix.002 file - promoters60/3043322
aataaaatc

SEQ ID NO: 55370 - DNA, 10 bp, Unknown
  misc_feature (1)..( 10): Matrix.002 file - promoters60/3043322
ttaatatttt

SEQ ID NO: 55371 - DNA, 7 bp, Unknown
  misc_feature (1)..( 7): Matrix.002 file - promoters60/3043322
ttatttt

SEQ ID NO: 55372 - DNA, 6 bp, Unknown
  misc_feature (1)..( 6): Matrix.002 file - promoters60/3043322
taacat

SEQ ID NO: 55373 - DNA, 8 bp, Unknown
  misc_feature (1)..( 8): Matrix.002 file - promoters60/3043322
aaaaaaaa

SEQ ID NO: 55374 - DNA, 10 bp, Unknown
  misc_feature (1)..( 10): Matrix.002 file - promoters60/3043322
aaaaaaactt

SEQ ID NO: 55375 - DNA, 6 bp, Unknown
  misc_feature (1)..( 6): Matrix.002 file - promoters60/3043322
tatatt

SEQ ID NO: 55376 - DNA, 8 bp, Unknown
  misc_feature (1)..( 8): Matrix.002 file - promoters60/3043322
tctataga

SEQ ID NO: 55377 - DNA, 7 bp, Unknown
  misc_feature (1)..( 7): Matrix.002 file - promoters60/3043322
tttgtta

SEQ ID NO: 55378 - DNA, 7 bp, Unknown
  misc_feature (1)..( 7): Matrix.002 file - promoters60/3043322
aacaaaa

SEQ ID NO: 55379 - DNA, 6 bp, Unknown
  misc_feature (1)..( 6): Matrix.002 file - promoters60/3043322
ttctta

SEQ ID NO: 55380 - DNA, 8 bp, Unknown
  misc_feature (1)..( 8): Matrix.002 file - promoters60/3043322
tttgttta

SEQ ID NO: 55381 - DNA, 9 bp, Unknown
  misc_feature (1)..( 9): Matrix.002 file - promoters60/3043962
tttatttgt

SEQ ID NO: 55382 - DNA, 9 bp, Unknown
  misc_feature (1)..( 9): Matrix.002 file - promoters60/3043962
atttgattg

SEQ ID NO: 55383 - DNA, 11 bp, Unknown
  misc_feature (1)..( 11): Matrix.002 file - promoters60/3043962
aaactatttaa

SEQ ID NO: 55384 - DNA, 6 bp, Unknown
  misc_feature (1)..( 6): Matrix.002 file - promoters60/3100782
tttgta

SEQ ID NO: 55385 - DNA, 7 bp, Unknown
  misc_feature (1)..( 7): Matrix.002 file - promoters60/3100782
atcattt

SEQ ID NO: 55386 - DNA, 8 bp, Unknown
  misc_feature (1)..( 8): Matrix.002 file - promoters60/3100782
aacagaaa

SEQ ID NO: 55387 - DNA, 7 bp, Unknown
  misc_feature (1)..( 7): Matrix.002 file - promoters60/3100782
ataaaat

SEQ ID NO: 55388 - DNA, 8 bp, Unknown
  misc_feature (1)..( 8): Matrix.002 file - promoters60/3100782
aaaaagaa

SEQ ID NO: 55389 - DNA, 7 bp, Unknown
  misc_feature (1)..( 7): Matrix.002 file - promoters60/3100782
ccaacat

SEQ ID NO: 55390 - DNA, 7 bp, Unknown
  misc_feature (1)..( 7): Matrix.002 file - promoters60/3100782
caattct

SEQ ID NO: 55391 - DNA, 6 bp, Unknown
  misc_feature (1)..( 6): Matrix.002 file - promoters60/3100782
ttctgg

SEQ ID NO: 55392 - DNA, 7 bp, Unknown
  misc_feature (1)..( 7): Matrix.002 file - promoters60/3100782
cataact

SEQ ID NO: 55393 - DNA, 8 bp, Unknown
  misc_feature (1)..( 8): Matrix.002 file - promoters60/3100782
attcttac

SEQ ID NO: 55394 - DNA, 7 bp, Unknown
  misc_feature (1)..( 7): Matrix.002 file - promoters60/3100782
tttgaga

SEQ ID NO: 55395 - DNA, 6 bp, Unknown
  misc_feature (1)..( 6): Matrix.002 file - promoters60/3238306
tttatt

SEQ ID NO: 55396 - DNA, 8 bp, Unknown
  misc_feature (1)..( 8): Matrix.002 file - promoters60/3238306
caactcca

SEQ ID NO: 55397 - DNA, 8 bp, Unknown
  misc_feature (1)..( 8): Matrix.002 file - promoters60/3238306
aaaaatat

SEQ ID NO: 55398 - DNA, 8 bp, Unknown
  misc_feature (1)..( 8): Matrix.002 file - promoters60/3238306
caaatcaa

SEQ ID NO: 55399 - DNA, 6 bp, Unknown
  misc_feature (1)..( 6): Matrix.002 file - promoters60/3238306
ttatat

SEQ ID NO: 55400 - DNA, 7 bp, Unknown
  misc_feature (1)..( 7): Matrix.002 file - promoters60/3238306
gatcaat

SEQ ID NO: 55401 - DNA, 9 bp, Unknown
  misc_feature (1)..( 9): Matrix.002 file - promoters60/3238306
acaaacaca

SEQ ID NO: 55402 - DNA, 6 bp, Unknown
  misc_feature (1)..( 6): Matrix.002 file - promoters60/3238306
acaata

SEQ ID NO: 55403 - DNA, 9 bp, Unknown
  misc_feature (1)..( 9): Matrix.002 file - promoters60/3238306
gtttgggcg

SEQ ID NO: 55404 - DNA, 7 bp, Unknown
  misc_feature (1)..( 7): Matrix.002 file - promoters60/3238306
ataccaa

SEQ ID NO: 55405 - DNA, 6 bp, Unknown
  misc_feature (1)..( 6): Matrix.002 file - promoters60/3238306
gtctaa

SEQ ID NO: 55406 - DNA, 6 bp, Unknown
  misc_feature (1)..( 6): Matrix.002 file - promoters60/3238306
aatgtc

SEQ ID NO: 55407 - DNA, 6 bp, Unknown
  misc_feature (1)..( 6): Matrix.002 file - promoters60/3238306
acgtaa

SEQ ID NO: 55408 - DNA, 6 bp, Unknown
  misc_feature (1)..( 6): Matrix.002 file - promoters60/3238306
agattc

SEQ ID NO: 55409 - DNA, 8 bp, Unknown
  misc_feature (1)..( 8): Matrix.002 file - promoters60/3238306
gagaagga

SEQ ID NO: 55410 - DNA, 6 bp, Unknown
  misc_feature (1)..( 6): Matrix.002 file - promoters60/3239163
gccaat

SEQ ID NO: 55411 - DNA, 6 bp, Unknown
  misc_feature (1)..( 6): Matrix.002 file - promoters60/3239163
gcagag

SEQ ID NO: 55412 - DNA, 6 bp, Unknown
  misc_feature (1)..( 6): Matrix.002 file - promoters60/3239163
ttaaag

SEQ ID NO: 55413 - DNA, 8 bp, Unknown
  misc_feature (1)..( 8): Matrix.002 file - promoters60/3239163
aattctaa

SEQ ID NO: 55414 - DNA, 7 bp, Unknown
  misc_feature (1)..( 7): Matrix.002 file - promoters60/3239163
aatcgga

SEQ ID NO: 55415 - DNA, 11 bp, Unknown
  misc_feature (1)..( 11): Matrix.002 file - promoters60/3239163
agacagtgaag

SEQ ID NO: 55416 - DNA, 6 bp, Unknown
  misc_feature (1)..( 6): Matrix.002 file - promoters60/3239163
aagtgt

SEQ ID NO: 55417 - DNA, 6 bp, Unknown
  misc_feature (1)..( 6): Matrix.002 file - promoters60/3239163
atatat

SEQ ID NO: 55418 - DNA, 7 bp, Unknown
  misc_feature (1)..( 7): Matrix.002 file - promoters60/3239163
acaatac

SEQ ID NO: 55419 - DNA, 9 bp, Unknown
  misc_feature (1)..( 9): Matrix.002 file - promoters60/3239163
atacaaata

SEQ ID NO: 55420 - DNA, 6 bp, Unknown
  misc_feature (1)..( 6): Matrix.002 file - promoters60/3239163
tcaaat

SEQ ID NO: 55421 - DNA, 6 bp, Unknown
  misc_feature (1)..( 6): Matrix.002 file - promoters60/3239163
gagcag

SEQ ID NO: 55422 - DNA, 7 bp, Unknown
  misc_feature (1)..( 7): Matrix.002 file - promoters60/3239163
gaaataa

SEQ ID NO: 55423 - DNA, 6 bp, Unknown
  misc_feature (1)..( 6): Matrix.002 file - promoters60/3239175
aaggat

SEQ ID NO: 55424 - DNA, 8 bp, Unknown
  misc_feature (1)..( 8): Matrix.002 file - promoters60/3239175
aatgcttt

SEQ ID NO: 55425 - DNA, 8 bp, Unknown
  misc_feature (1)..( 8): Matrix.002 file - promoters60/3239175
gaaagaca

SEQ ID NO: 55426 - DNA, 7 bp, Unknown
  misc_feature (1)..( 7): Matrix.002 file - promoters60/3239175
atagttg

SEQ ID NO: 55427 - DNA, 6 bp, Unknown
  misc_feature (1)..( 6): Matrix.002 file - promoters60/3239175
taaaaa

SEQ ID NO: 55428 - DNA, 9 bp, Unknown
  misc_feature (1)..( 9): Matrix.002 file - promoters60/3239175
aaaggaaaa

SEQ ID NO: 55429 - DNA, 9 bp, Unknown
  misc_feature (1)..( 9): Matrix.002 file - promoters60/3239175
gagtatata

SEQ ID NO: 55430 - DNA, 7 bp, Unknown
  misc_feature (1)..( 7): Matrix.002 file - promoters60/3239175
tggctag

SEQ ID NO: 55431 - DNA, 6 bp, Unknown
  misc_feature (1)..( 6): Matrix.002 file - promoters60/3239175
agagta

SEQ ID NO: 55432 - DNA, 8 bp, Unknown
  misc_feature (1)..( 8): Matrix.002 file - promoters60/3239175
ttgaactc

SEQ ID NO: 55433 - DNA, 7 bp, Unknown
  misc_feature (1)..( 7): Matrix.002 file - promoters60/3239175
tggattt

SEQ ID NO: 55434 - DNA, 8 bp, Unknown
  misc_feature (1)..( 8): Matrix.002 file - promoters60/3239175
tctagtgt

SEQ ID NO: 55435 - DNA, 7 bp, Unknown
  misc_feature (1)..( 7): Matrix.002 file - promoters60/3239175
actttag

SEQ ID NO: 55436 - DNA, 6 bp, Unknown
  misc_feature (1)..( 6): Matrix.002 file - promoters60/3239175
ttaaag

SEQ ID NO: 55437 - DNA, 6 bp, Unknown
  misc_feature (1)..( 6): Matrix.002 file - promoters60/3239175
agtaaa

SEQ ID NO: 55438 - DNA, 7 bp, Unknown
  misc_feature (1)..( 7): Matrix.002 file - promoters60/3239175
aatcggg

SEQ ID NO: 55439 - DNA, 10 bp, Unknown
  misc_feature (1)..( 10): Matrix.002 file - promoters60/3239175
ggaaaagaaa

SEQ ID NO: 55440 - DNA, 7 bp, Unknown
  misc_feature (1)..( 7): Matrix.002 file - promoters60/3239175
cccacta

SEQ ID NO: 55441 - DNA, 7 bp, Unknown
  misc_feature (1)..( 7): Matrix.002 file - promoters60/3239193
aattgaa

SEQ ID NO: 55442 - DNA, 7 bp, Unknown
  misc_feature (1)..( 7): Matrix.002 file - promoters60/3239193
gaataga

SEQ ID NO: 55443 - DNA, 8 bp, Unknown
  misc_feature (1)..( 8): Matrix.002 file - promoters60/3239193
tatataaa

SEQ ID NO: 55444 - DNA, 7 bp, Unknown
  misc_feature (1)..( 7): Matrix.002 file - promoters60/3239193
attgaag

SEQ ID NO: 55445 - DNA, 9 bp, Unknown
  misc_feature (1)..( 9): Matrix.002 file - promoters60/3239193
aaaaataag

SEQ ID NO: 55446 - DNA, 7 bp, Unknown
  misc_feature (1)..( 7): Matrix.002 file - promoters60/3408983
tatatat

SEQ ID NO: 55447 - DNA, 6 bp, Unknown
  misc_feature (1)..( 6): Matrix.002 file - promoters60/3408983
agaatc

SEQ ID NO: 55448 - DNA, 7 bp, Unknown
  misc_feature (1)..( 7): Matrix.002 file - promoters60/3408983
tgtaata

SEQ ID NO: 55449 - DNA, 7 bp, Unknown
  misc_feature (1)..( 7): Matrix.002 file - promoters60/3408983
gatggaa

SEQ ID NO: 55450 - DNA, 8 bp, Unknown
  misc_feature (1)..( 8): Matrix.002 file - promoters60/3408983
aaatatga

SEQ ID NO: 55451 - DNA, 8 bp, Unknown
  misc_feature (1)..( 8): Matrix.002 file - promoters60/3408983
aagctata

SEQ ID NO: 55452 - DNA, 7 bp, Unknown
  misc_feature (1)..( 7): Matrix.002 file - promoters60/3408983
aaataaa

SEQ ID NO: 55453 - DNA, 6 bp, Unknown
  misc_feature (1)..( 6): Matrix.002 file - promoters60/3408983
cataat

SEQ ID NO: 55454 - DNA, 7 bp, Unknown
  misc_feature (1)..( 7): Matrix.002 file - promoters60/3408983
aaaaaaa

SEQ ID NO: 55455 - DNA, 6 bp, Unknown
  misc_feature (1)..( 6): Matrix.002 file - promoters60/3408983
aaaata

SEQ ID NO: 55456 - DNA, 8 bp, Unknown
  misc_feature (1)..( 8): Matrix.002 file - promoters60/3408983
tttaaatt

SEQ ID NO: 55457 - DNA, 7 bp, Unknown
  misc_feature (1)..( 7): Matrix.002 file - promoters60/3408983
ttaattt

SEQ ID NO: 55458 - DNA, 7 bp, Unknown
  misc_feature (1)..( 7): Matrix.002 file - promoters60/3408983
ttactaa

SEQ ID NO: 55459 - DNA, 6 bp, Unknown
  misc_feature (1)..( 6): Matrix.002 file - promoters60/3408983
aattta

SEQ ID NO: 55460 - DNA, 9 bp, Unknown
  misc_feature (1)..( 9): Matrix.002 file - promoters60/3408983
tctctctct

SEQ ID NO: 55461 - DNA, 6 bp, Unknown
  misc_feature (1)..( 6): Matrix.002 file - promoters60/3408983
cgagaa

SEQ ID NO: 55462 - DNA, 8 bp, Unknown
  misc_feature (1)..( 8): Matrix.002 file - promoters60/3408983
caacaaaa

SEQ ID NO: 55463 - DNA, 6 bp, Unknown
  misc_feature (1)..( 6): Matrix.002 file - promoters60/3408983
gagttt

SEQ ID NO: 55464 - DNA, 8 bp, Unknown
  misc_feature (1)..( 8): Matrix.002 file - promoters60/3409161
attttttt

SEQ ID NO: 55465 - DNA, 6 bp, Unknown
  misc_feature (1)..( 6): Matrix.002 file - promoters60/3409161
agtctt

SEQ ID NO: 55466 - DNA, 6 bp, Unknown
  misc_feature (1)..( 6): Matrix.002 file - promoters60/3409161
tctttt

SEQ ID NO: 55467 - DNA, 8 bp, Unknown
  misc_feature (1)..( 8): Matrix.002 file - promoters60/3409161
tttcgttt

SEQ ID NO: 55468 - DNA, 6 bp, Unknown
  misc_feature (1)..( 6): Matrix.002 file - promoters60/3409161
tttatt

SEQ ID NO: 55469 - DNA, 6 bp, Unknown
  misc_feature (1)..( 6): Matrix.002 file - promoters60/3409161
aaacag

SEQ ID NO: 55470 - DNA, 8 bp, Unknown
  misc_feature (1)..( 8): Matrix.002 file - promoters60/3409161
aaagaaca

SEQ ID NO: 55471 - DNA, 7 bp, Unknown
  misc_feature (1)..( 7): Matrix.002 file - promoters60/3409161
cagagga

SEQ ID NO: 55472 - DNA, 8 bp, Unknown
  misc_feature (1)..( 8): Matrix.002 file - promoters60/3409161
ctaacgaa

SEQ ID NO: 55473 - DNA, 7 bp, Unknown
  misc_feature (1)..( 7): Matrix.002 file - promoters60/3409161
ctcaaaa

SEQ ID NO: 55474 - DNA, 6 bp, Unknown
  misc_feature (1)..( 6): Matrix.002 file - promoters60/3409161
caatgc

SEQ ID NO: 55475 - DNA, 6 bp, Unknown
  misc_feature (1)..( 6): Matrix.002 file - promoters60/3409161
catttc

SEQ ID NO: 55476 - DNA, 6 bp, Unknown
  misc_feature (1)..( 6): Matrix.002 file - promoters60/3409161
ccccca

SEQ ID NO: 55477 - DNA, 6 bp, Unknown
  misc_feature (1)..( 6): Matrix.002 file - promoters60/3409161
gagata

SEQ ID NO: 55478 - DNA, 8 bp, Unknown
  misc_feature (1)..( 8): Matrix.002 file - promoters60/3409165
aaaacaaa

SEQ ID NO: 55479 - DNA, 8 bp, Unknown
  misc_feature (1)..( 8): Matrix.002 file - promoters60/3409165
cctctata

SEQ ID NO: 55480 - DNA, 6 bp, Unknown
  misc_feature (1)..( 6): Matrix.002 file - promoters60/3409165
aataaa

SEQ ID NO: 55481 - DNA, 12 bp, Unknown
  misc_feature (1)..( 12): Matrix.002 file - promoters60/3409165
attacaaaatat

SEQ ID NO: 55482 - DNA, 8 bp, Unknown
  misc_feature (1)..( 8): Matrix.002 file - promoters60/3409214
aacaaaga

SEQ ID NO: 55483 - DNA, 8 bp, Unknown
  misc_feature (1)..( 8): Matrix.002 file - promoters60/3409214
tttccttt

SEQ ID NO: 55484 - DNA, 9 bp, Unknown
  misc_feature (1)..( 9): Matrix.002 file - promoters60/3409214
ttctttgtt

SEQ ID NO: 55485 - DNA, 7 bp, Unknown
  misc_feature (1)..( 7): Matrix.002 file - promoters60/3409390
cacctca

SEQ ID NO: 55486 - DNA, 6 bp, Unknown
  misc_feature (1)..( 6): Matrix.002 file - promoters60/3409390
cttttc

SEQ ID NO: 55487 - DNA, 6 bp, Unknown
  misc_feature (1)..( 6): Matrix.002 file - promoters60/3409390
aaaatt

SEQ ID NO: 55488 - DNA, 9 bp, Unknown
  misc_feature (1)..( 9): Matrix.002 file - promoters60/3409390
acataaata

SEQ ID NO: 55489 - DNA, 9 bp, Unknown
  misc_feature (1)..( 9): Matrix.002 file - promoters60/3409390
ttatacaat

SEQ ID NO: 55490 - DNA, 7 bp, Unknown
  misc_feature (1)..( 7): Matrix.002 file - promoters60/3409390
ataaggt

SEQ ID NO: 55491 - DNA, 9 bp, Unknown
  misc_feature (1)..( 9): Matrix.002 file - promoters60/3409390
tttattttt

SEQ ID NO: 55492 - DNA, 6 bp, Unknown
  misc_feature (1)..( 6): Matrix.002 file - promoters60/3409390
tttttt

SEQ ID NO: 55493 - DNA, 7 bp, Unknown
  misc_feature (1)..( 7): Matrix.002 file - promoters60/3409390
aaaaaaa

SEQ ID NO: 55494 - DNA, 7 bp, Unknown
  misc_feature (1)..( 7): Matrix.002 file - promoters60/3409390
aaaaaca

SEQ ID NO: 55495 - DNA, 6 bp, Unknown
  misc_feature (1)..( 6): Matrix.002 file - promoters60/3409390
acaaaa

SEQ ID NO: 55496 - DNA, 6 bp, Unknown
  misc_feature (1)..( 6): Matrix.002 file - promoters60/3409390
aagaaa

SEQ ID NO: 55497 - DNA, 6 bp, Unknown
  misc_feature (1)..( 6): Matrix.002 file - promoters60/3409390
cgtggc

SEQ ID NO: 55498 - DNA, 7 bp, Unknown
  misc_feature (1)..( 7): Matrix.002 file - promoters60/3409390
agtattt

SEQ ID NO: 55499 - DNA, 7 bp, Unknown
  misc_feature (1)..( 7): Matrix.002 file - promoters60/3409390
tttgctg

SEQ ID NO: 55500 - DNA, 8 bp, Unknown
  misc_feature (1)..( 8): Matrix.002 file - promoters60/3409390
attttttt

SEQ ID NO: 55501 - DNA, 6 bp, Unknown
  misc_feature (1)..( 6): Matrix.002 file - promoters60/3409390
ggttag

SEQ ID NO: 55502 - DNA, 6 bp, Unknown
  misc_feature (1)..( 6): Matrix.002 file - promoters60/3409390
tcaatc

SEQ ID NO: 55503 - DNA, 6 bp, Unknown
  misc_feature (1)..( 6): Matrix.002 file - promoters60/3409390
aagcta

SEQ ID NO: 55504 - DNA, 7 bp, Unknown
  misc_feature (1)..( 7): Matrix.002 file - promoters60/3409637
tttgtta

SEQ ID NO: 55505 - DNA, 8 bp, Unknown
  misc_feature (1)..( 8): Matrix.002 file - promoters60/3409637
catgaatt

SEQ ID NO: 55506 - DNA, 9 bp, Unknown
  misc_feature (1)..( 9): Matrix.002 file - promoters60/3409637
caaatttct

SEQ ID NO: 55507 - DNA, 11 bp, Unknown
  misc_feature (1)..( 11): Matrix.002 file - promoters60/3409637
aattttttgaa

SEQ ID NO: 55508 - DNA, 8 bp, Unknown
  misc_feature (1)..( 8): Matrix.002 file - promoters60/3409637
tttggttt

SEQ ID NO: 55509 - DNA, 7 bp, Unknown
  misc_feature (1)..( 7): Matrix.002 file - promoters60/3409637
tttaacc

SEQ ID NO: 55510 - DNA, 13 bp, Unknown
  misc_feature (1)..( 13): Matrix.002 file - promoters60/3433703
aaagaatttctcc

SEQ ID NO: 55511 - DNA, 11 bp, Unknown
  misc_feature (1)..( 11): Matrix.002 file - promoters60/3433703
caaacaatcat

SEQ ID NO: 55512 - DNA, 9 bp, Unknown
  misc_feature (1)..( 9): Matrix.002 file - promoters60/3433703
aaaacaatt

SEQ ID NO: 55513 - DNA, 12 bp, Unknown
  misc_feature (1)..( 12): Matrix.002 file - promoters60/3433703
tatataaatata

SEQ ID NO: 55514 - DNA, 10 bp, Unknown
  misc_feature (1)..( 10): Matrix.002 file - promoters60/3433703
tatataaatc

SEQ ID NO: 55515 - DNA, 11 bp, Unknown
  misc_feature (1)..( 11): Matrix.002 file - promoters60/3433703
aatcatttctt

SEQ ID NO: 55516 - DNA, 12 bp, Unknown
  misc_feature (1)..( 12): Matrix.002 file - promoters60/3433799
gattgataacag

SEQ ID NO: 55517 - DNA, 7 bp, Unknown
  misc_feature (1)..( 7): Matrix.002 file - promoters60/3433799
tggaaaa

SEQ ID NO: 55518 - DNA, 9 bp, Unknown
  misc_feature (1)..( 9): Matrix.002 file - promoters60/3433799
aaaccattt

SEQ ID NO: 55519 - DNA, 10 bp, Unknown
  misc_feature (1)..( 10): Matrix.002 file - promoters60/3433799
actttataat

SEQ ID NO: 55520 - DNA, 8 bp, Unknown
  misc_feature (1)..( 8): Matrix.002 file - promoters60/3433831
ttgcattt

SEQ ID NO: 55521 - DNA, 8 bp, Unknown
  misc_feature (1)..( 8): Matrix.002 file - promoters60/3433831
ataaaaaa

SEQ ID NO: 55522 - DNA, 7 bp, Unknown
  misc_feature (1)..( 7): Matrix.002 file - promoters60/3433831
taacaaa

SEQ ID NO: 55523 - DNA, 7 bp, Unknown
  misc_feature (1)..( 7): Matrix.002 file - promoters60/3433831
agaatta

SEQ ID NO: 55524 - DNA, 9 bp, Unknown
  misc_feature (1)..( 9): Matrix.002 file - promoters60/3433831
attagataa

SEQ ID NO: 55525 - DNA, 7 bp, Unknown
  misc_feature (1)..( 7): Matrix.002 file - promoters60/3433831
ttaagaa

SEQ ID NO: 55526 - DNA, 6 bp, Unknown
  misc_feature (1)..( 6): Matrix.002 file - promoters60/3433831
ataatt

SEQ ID NO: 55527 - DNA, 6 bp, Unknown
  misc_feature (1)..( 6): Matrix.002 file - promoters60/3433831
tttaat

SEQ ID NO: 55528 - DNA, 7 bp, Unknown
  misc_feature (1)..( 7): Matrix.002 file - promoters60/3433831
gagagat

SEQ ID NO: 55529 - DNA, 8 bp, Unknown
  misc_feature (1)..( 8): Matrix.002 file - promoters60/3433831
cacaattg

SEQ ID NO: 55530 - DNA, 7 bp, Unknown
  misc_feature (1)..( 7): Matrix.002 file - promoters60/3433831
atgacaa

SEQ ID NO: 55531 - DNA, 6 bp, Unknown
  misc_feature (1)..( 6): Matrix.002 file - promoters60/3433831
tcatat

SEQ ID NO: 55532 - DNA, 7 bp, Unknown
  misc_feature (1)..( 7): Matrix.002 file - promoters60/3433831
ttaggtg

SEQ ID NO: 55533 - DNA, 8 bp, Unknown
  misc_feature (1)..( 8): Matrix.002 file - promoters60/3433831
atacatac

SEQ ID NO: 55534 - DNA, 6 bp, Unknown
  misc_feature (1)..( 6): Matrix.002 file - promoters60/3433831
ttcaaa

SEQ ID NO: 55535 - DNA, 7 bp, Unknown
  misc_feature (1)..( 7): Matrix.002 file - promoters60/3433904
agtaaac

SEQ ID NO: 55536 - DNA, 10 bp, Unknown
  misc_feature (1)..( 10): Matrix.002 file - promoters60/3433926
aatcttagca

SEQ ID NO: 55537 - DNA, 8 bp, Unknown
  misc_feature (1)..( 8): Matrix.002 file - promoters60/3433926
aattctta

SEQ ID NO: 55538 - DNA, 9 bp, Unknown
  misc_feature (1)..( 9): Matrix.002 file - promoters60/3433978
aaataaaat

SEQ ID NO: 55539 - DNA, 8 bp, Unknown
  misc_feature (1)..( 8): Matrix.002 file - promoters60/3433978
ttttgttc

SEQ ID NO: 55540 - DNA, 9 bp, Unknown
  misc_feature (1)..( 9): Matrix.002 file - promoters60/3433978
aaagttata

SEQ ID NO: 55541 - DNA, 9 bp, Unknown
  misc_feature (1)..( 9): Matrix.002 file - promoters60/3433978
ttattaaaa

SEQ ID NO: 55542 - DNA, 8 bp, Unknown
  misc_feature (1)..( 8): Matrix.002 file - promoters60/3433998
acatatct

SEQ ID NO: 55543 - DNA, 7 bp, Unknown
  misc_feature (1)..( 7): Matrix.002 file - promoters60/3433998
caaaaaa

SEQ ID NO: 55544 - DNA, 8 bp, Unknown
  misc_feature (1)..( 8): Matrix.002 file - promoters60/3433998
caaagttc

SEQ ID NO: 55545 - DNA, 7 bp, Unknown
  misc_feature (1)..( 7): Matrix.002 file - promoters60/3433998
ttttaaa

SEQ ID NO: 55546 - DNA, 8 bp, Unknown
  misc_feature (1)..( 8): Matrix.002 file - promoters60/3433998
tcttatct

SEQ ID NO: 55547 - DNA, 9 bp, Unknown
  misc_feature (1)..( 9): Matrix.002 file - promoters60/3433998
cacatatcc

SEQ ID NO: 55548 - DNA, 7 bp, Unknown
  misc_feature (1)..( 7): Matrix.002 file - promoters60/3433998
ataaaat

SEQ ID NO: 55549 - DNA, 7 bp, Unknown
  misc_feature (1)..( 7): Matrix.002 file - promoters60/3433998
aaaaaaa

SEQ ID NO: 55550 - DNA, 6 bp, Unknown
  misc_feature (1)..( 6): Matrix.002 file - promoters60/3433998
aaaaaa

SEQ ID NO: 55551 - DNA, 11 bp, Unknown
  misc_feature (1)..( 11): Matrix.002 file - promoters60/3434028
ttcgaatcaat

SEQ ID NO: 55552 - DNA, 9 bp, Unknown
  misc_feature (1)..( 9): Matrix.002 file - promoters60/3434028
taatgtttg

SEQ ID NO: 55553 - DNA, 8 bp, Unknown
  misc_feature (1)..( 8): Matrix.002 file - promoters60/3434036
ggtgggat

SEQ ID NO: 55554 - DNA, 7 bp, Unknown
  misc_feature (1)..( 7): Matrix.002 file - promoters60/3434036
cttgatt

SEQ ID NO: 55555 - DNA, 7 bp, Unknown
  misc_feature (1)..( 7): Matrix.002 file - promoters60/3434036
atctgtt

SEQ ID NO: 55556 - DNA, 7 bp, Unknown
  misc_feature (1)..( 7): Matrix.002 file - promoters60/3434036
aagatca

SEQ ID NO: 55557 - DNA, 6 bp, Unknown
  misc_feature (1)..( 6): Matrix.002 file - promoters60/3434036
ctttac

SEQ ID NO: 55558 - DNA, 9 bp, Unknown
  misc_feature (1)..( 9): Matrix.002 file - promoters60/3434036
ctttgtttt

SEQ ID NO: 55559 - DNA, 7 bp, Unknown
  misc_feature (1)..( 7): Matrix.002 file - promoters60/3434036
acgagag

SEQ ID NO: 55560 - DNA, 7 bp, Unknown
  misc_feature (1)..( 7): Matrix.002 file - promoters60/3434036
gttagga

SEQ ID NO: 55561 - DNA, 6 bp, Unknown
  misc_feature (1)..( 6): Matrix.002 file - promoters60/3434036
gatcgg

SEQ ID NO: 55562 - DNA, 7 bp, Unknown
  misc_feature (1)..( 7): Matrix.002 file - promoters60/3434036
gatcgga

SEQ ID NO: 55563 - DNA, 6 bp, Unknown
  misc_feature (1)..( 6): Matrix.002 file - promoters60/3434036
acgcga

SEQ ID NO: 55564 - DNA, 9 bp, Unknown
  misc_feature (1)..( 9): Matrix.002 file - promoters60/3434036
aatccaaga

SEQ ID NO: 55565 - DNA, 7 bp, Unknown
  misc_feature (1)..( 7): Matrix.002 file - promoters60/3434036
agacaaa

SEQ ID NO: 55566 - DNA, 7 bp, Unknown
  misc_feature (1)..( 7): Matrix.002 file - promoters60/3434036
ttaaaaa

SEQ ID NO: 55567 - DNA, 8 bp, Unknown
  misc_feature (1)..( 8): Matrix.002 file - promoters60/3434036
gtagagaa

SEQ ID NO: 55568 - DNA, 6 bp, Unknown
  misc_feature (1)..( 6): Matrix.002 file - promoters60/3434036
agaaga

SEQ ID NO: 55569 - DNA, 6 bp, Unknown
  misc_feature (1)..( 6): Matrix.002 file - promoters60/3434036
gtgatt

SEQ ID NO: 55570 - DNA, 11 bp, Unknown
  misc_feature (1)..( 11): Matrix.002 file - promoters60/3434044
aaaacaaaaat

SEQ ID NO: 55571 - DNA, 12 bp, Unknown
  misc_feature (1)..( 12): Matrix.002 file - promoters60/3434044
gatattgtttgc

SEQ ID NO: 55572 - DNA, 15 bp, Unknown
  misc_feature (1)..( 15): Matrix.002 file - promoters60/3434044
caagaaagaaaaaaa

SEQ ID NO: 55573 - DNA, 11 bp, Unknown
  misc_feature (1)..( 11): Matrix.002 file - promoters60/3434044
ataaaatgata

SEQ ID NO: 55574 - DNA, 11 bp, Unknown
  misc_feature (1)..( 11): Matrix.002 file - promoters60/3434044
aagaaaaaaaa

SEQ ID NO: 55575 - DNA, 8 bp, Unknown
  misc_feature (1)..( 8): Matrix.002 file - promoters60/3434044
aattaaaa

SEQ ID NO: 55576 - DNA, 10 bp, Unknown
  misc_feature (1)..( 10): Matrix.002 file - promoters60/3434044
agaaaatcat

SEQ ID NO: 55577 - DNA, 8 bp, Unknown
  misc_feature (1)..( 8): Matrix.002 file - promoters60/3434074
aaagtcat

SEQ ID NO: 55578 - DNA, 6 bp, Unknown
  misc_feature (1)..( 6): Matrix.002 file - promoters60/3434074
ttgaag

SEQ ID NO: 55579 - DNA, 10 bp, Unknown
  misc_feature (1)..( 10): Matrix.002 file - promoters60/3434074
gataacctta

SEQ ID NO: 55580 - DNA, 9 bp, Unknown
  misc_feature (1)..( 9): Matrix.002 file - promoters60/3434074
aacattttg

SEQ ID NO: 55581 - DNA, 6 bp, Unknown
  misc_feature (1)..( 6): Matrix.002 file - promoters60/3434074
ctgatt

SEQ ID NO: 55582 - DNA, 6 bp, Unknown
  misc_feature (1)..( 6): Matrix.002 file - promoters60/3434074
ggctga

SEQ ID NO: 55583 - DNA, 11 bp, Unknown
  misc_feature (1)..( 11): Matrix.002 file - promoters60/3434074
agggtctcaga

SEQ ID NO: 55584 - DNA, 6 bp, Unknown
  misc_feature (1)..( 6): Matrix.002 file - promoters60/3434074
agattt

SEQ ID NO: 55585 - DNA, 6 bp, Unknown
  misc_feature (1)..( 6): Matrix.002 file - promoters60/3434112
taaaaa

SEQ ID NO: 55586 - DNA, 9 bp, Unknown
  misc_feature (1)..( 9): Matrix.002 file - promoters60/3434112
tcatacaat

SEQ ID NO: 55587 - DNA, 7 bp, Unknown
  misc_feature (1)..( 7): Matrix.002 file - promoters60/3434112
tataccg

SEQ ID NO: 55588 - DNA, 6 bp, Unknown
  misc_feature (1)..( 6): Matrix.002 file - promoters60/3434112
tctcca

SEQ ID NO: 55589 - DNA, 7 bp, Unknown
  misc_feature (1)..( 7): Matrix.002 file - promoters60/3434112
atttctc

SEQ ID NO: 55590 - DNA, 7 bp, Unknown
  misc_feature (1)..( 7): Matrix.002 file - promoters60/3434112
tgtgata

SEQ ID NO: 55591 - DNA, 8 bp, Unknown
  misc_feature (1)..( 8): Matrix.002 file - promoters60/3434112
aaacagat

SEQ ID NO: 55592 - DNA, 8 bp, Unknown
  misc_feature (1)..( 8): Matrix.002 file - promoters60/3434112
ctcgtcgt

SEQ ID NO: 55593 - DNA, 11 bp, Unknown
  misc_feature (1)..( 11): Matrix.002 file - promoters60/3434112
ctgagaagaag

SEQ ID NO: 55594 - DNA, 7 bp, Unknown
  misc_feature (1)..( 7): Matrix.002 file - promoters60/3434112
ttgaatt

SEQ ID NO: 55595 - DNA, 6 bp, Unknown
  misc_feature (1)..( 6): Matrix.002 file - promoters60/3434112
atttga

SEQ ID NO: 55596 - DNA, 6 bp, Unknown
  misc_feature (1)..( 6): Matrix.002 file - promoters60/3434112
actatt

SEQ ID NO: 55597 - DNA, 6 bp, Unknown
  misc_feature (1)..( 6): Matrix.002 file - promoters60/3434147
tcaaaa

SEQ ID NO: 55598 - DNA, 8 bp, Unknown
  misc_feature (1)..( 8): Matrix.002 file - promoters60/3434147
aaataata

SEQ ID NO: 55599 - DNA, 7 bp, Unknown
  misc_feature (1)..( 7): Matrix.002 file - promoters60/3434147
tagataa

SEQ ID NO: 55600 - DNA, 12 bp, Unknown
  misc_feature (1)..( 12): Matrix.002 file - promoters60/3434147
ctgaaataaatt

SEQ ID NO: 55601 - DNA, 6 bp, Unknown
  misc_feature (1)..( 6): Matrix.002 file - promoters60/3434147
ttatgt

SEQ ID NO: 55602 - DNA, 11 bp, Unknown
  misc_feature (1)..( 11): Matrix.002 file - promoters60/3434147
tttgtaaacaa

SEQ ID NO: 55603 - DNA, 9 bp, Unknown
  misc_feature (1)..( 9): Matrix.002 file - promoters60/3434147
tatattatt

SEQ ID NO: 55604 - DNA, 9 bp, Unknown
  misc_feature (1)..( 9): Matrix.002 file - promoters60/3434147
attaaaatt

SEQ ID NO: 55605 - DNA, 7 bp, Unknown
  misc_feature (1)..( 7): Matrix.002 file - promoters60/3434147
gacaaaa

SEQ ID NO: 55606 - DNA, 7 bp, Unknown
  misc_feature (1)..( 7): Matrix.002 file - promoters60/3434147
ttcaata

SEQ ID NO: 55607 - DNA, 8 bp, Unknown
  misc_feature (1)..( 8): Matrix.002 file - promoters60/3434147
atttcaca

SEQ ID NO: 55608 - DNA, 6 bp, Unknown
  misc_feature (1)..( 6): Matrix.002 file - promoters60/3434147
tattta

SEQ ID NO: 55609 - DNA, 6 bp, Unknown
  misc_feature (1)..( 6): Matrix.002 file - promoters60/3434147
taaaac

SEQ ID NO: 55610 - DNA, 6 bp, Unknown
  misc_feature (1)..( 6): Matrix.002 file - promoters60/3434147
cccaat

SEQ ID NO: 55611 - DNA, 11 bp, Unknown
  misc_feature (1)..( 11): Matrix.002 file - promoters60/3434147
aagcaaacagg

SEQ ID NO: 55612 - DNA, 9 bp, Unknown
  misc_feature (1)..( 9): Matrix.002 file - promoters60/3434233
tattgaaaa

SEQ ID NO: 55613 - DNA, 9 bp, Unknown
  misc_feature (1)..( 9): Matrix.002 file - promoters60/3434256
ttttgcttc

SEQ ID NO: 55614 - DNA, 9 bp, Unknown
  misc_feature (1)..( 9): Matrix.002 file - promoters60/3434256
tttgttatt

SEQ ID NO: 55615 - DNA, 13 bp, Unknown
  misc_feature (1)..( 13): Matrix.002 file - promoters60/3434256
gtatatataaaac

SEQ ID NO: 55616 - DNA, 10 bp, Unknown
  misc_feature (1)..( 10): Matrix.002 file - promoters60/3434256
gttaataaaa

SEQ ID NO: 55617 - DNA, 11 bp, Unknown
  misc_feature (1)..( 11): Matrix.002 file - promoters60/3434256
actaatttgct

SEQ ID NO: 55618 - DNA, 12 bp, Unknown
  misc_feature (1)..( 12): Matrix.002 file - promoters60/3434256
attaatttgctt

SEQ ID NO: 55619 - DNA, 14 bp, Unknown
  misc_feature (1)..( 14): Matrix.002 file - promoters60/3434256
ttaatttattccta

SEQ ID NO: 55620 - DNA, 15 bp, Unknown
  misc_feature (1)..( 15): Matrix.002 file - promoters60/3434256
agagattaagtactt

SEQ ID NO: 55621 - DNA, 10 bp, Unknown
  misc_feature (1)..( 10): Matrix.002 file - promoters60/3434256
aaattaatgt

SEQ ID NO: 55622 - DNA, 12 bp, Unknown
  misc_feature (1)..( 12): Matrix.002 file - promoters60/3434256
taaaacattttt

SEQ ID NO: 55623 - DNA, 16 bp, Unknown
  misc_feature (1)..( 16): Matrix.002 file - promoters60/3434256
tttaataaattaataa

SEQ ID NO: 55624 - DNA, 7 bp, Unknown
  misc_feature (1)..( 7): Matrix.002 file - promoters60/3434279
tttgttt

SEQ ID NO: 55625 - DNA, 9 bp, Unknown
  misc_feature (1)..( 9): Matrix.002 file - promoters60/3434299
catataaaa

SEQ ID NO: 55626 - DNA, 9 bp, Unknown
  misc_feature (1)..( 9): Matrix.002 file - promoters60/3434311
atcaaaatg

SEQ ID NO: 55627 - DNA, 11 bp, Unknown
  misc_feature (1)..( 11): Matrix.002 file - promoters60/3434311
gttcaaaatgt

SEQ ID NO: 55628 - DNA, 7 bp, Unknown
  misc_feature (1)..( 7): Matrix.002 file - promoters60/3434381
aaaacac

SEQ ID NO: 55629 - DNA, 6 bp, Unknown
  misc_feature (1)..( 6): Matrix.002 file - promoters60/3434381
accact

SEQ ID NO: 55630 - DNA, 6 bp, Unknown
  misc_feature (1)..( 6): Matrix.002 file - promoters60/3434381
aaacta

SEQ ID NO: 55631 - DNA, 7 bp, Unknown
  misc_feature (1)..( 7): Matrix.002 file - promoters60/3434381
taatcca

SEQ ID NO: 55632 - DNA, 7 bp, Unknown
  misc_feature (1)..( 7): Matrix.002 file - promoters60/3434381
gatgaca

SEQ ID NO: 55633 - DNA, 7 bp, Unknown
  misc_feature (1)..( 7): Matrix.002 file - promoters60/3434381
ttggttt

SEQ ID NO: 55634 - DNA, 12 bp, Unknown
  misc_feature (1)..( 12): Matrix.002 file - promoters60/3434381
ttgaaatgaaaa

SEQ ID NO: 55635 - DNA, 6 bp, Unknown
  misc_feature (1)..( 6): Matrix.002 file - promoters60/3434381
aaaaga

SEQ ID NO: 55636 - DNA, 6 bp, Unknown
  misc_feature (1)..( 6): Matrix.002 file - promoters60/3434381
tgtgat

SEQ ID NO: 55637 - DNA, 8 bp, Unknown
  misc_feature (1)..( 8): Matrix.002 file - promoters60/3434381
acataaac

SEQ ID NO: 55638 - DNA, 6 bp, Unknown
  misc_feature (1)..( 6): Matrix.002 file - promoters60/3434381
cttctt

SEQ ID NO: 55639 - DNA, 7 bp, Unknown
  misc_feature (1)..( 7): Matrix.002 file - promoters60/3434381
atttgaa

SEQ ID NO: 55640 - DNA, 6 bp, Unknown
  misc_feature (1)..( 6): Matrix.002 file - promoters60/3434381
ttaaaa

SEQ ID NO: 55641 - DNA, 6 bp, Unknown
  misc_feature (1)..( 6): Matrix.002 file - promoters60/3434381
atattg

SEQ ID NO: 55642 - DNA, 8 bp, Unknown
  misc_feature (1)..( 8): Matrix.002 file - promoters60/3434381
attaaatt

SEQ ID NO: 55643 - DNA, 6 bp, Unknown
  misc_feature (1)..( 6): Matrix.002 file - promoters60/3434381
ggttga

SEQ ID NO: 55644 - DNA, 7 bp, Unknown
  misc_feature (1)..( 7): Matrix.002 file - promoters60/3434381
caaattg

SEQ ID NO: 55645 - DNA, 7 bp, Unknown
  misc_feature (1)..( 7): Matrix.002 file - promoters60/3434381
attcata

SEQ ID NO: 55646 - DNA, 7 bp, Unknown
  misc_feature (1)..( 7): Matrix.002 file - promoters60/3434381
ataaata

SEQ ID NO: 55647 - DNA, 7 bp, Unknown
  misc_feature (1)..( 7): Matrix.002 file - promoters60/3434381
taagtaa

SEQ ID NO: 55648 - DNA, 8 bp, Unknown
  misc_feature (1)..( 8): Matrix.002 file - promoters60/3434381
aaacaaaa

SEQ ID NO: 55649 - DNA, 7 bp, Unknown
  misc_feature (1)..( 7): Matrix.002 file - promoters60/3434381
aaaatag

SEQ ID NO: 55650 - DNA, 6 bp, Unknown
  misc_feature (1)..( 6): Matrix.002 file - promoters60/3434400
cagaaa

SEQ ID NO: 55651 - DNA, 11 bp, Unknown
  misc_feature (1)..( 11): Matrix.002 file - promoters60/3434400
actttataatg

SEQ ID NO: 55652 - DNA, 10 bp, Unknown
  misc_feature (1)..( 10): Matrix.002 file - promoters60/3434400
ctgcaaagaa

SEQ ID NO: 55653 - DNA, 8 bp, Unknown
  misc_feature (1)..( 8): Matrix.002 file - promoters60/3434471
aacaaaca

SEQ ID NO: 55654 - DNA, 6 bp, Unknown
  misc_feature (1)..( 6): Matrix.002 file - promoters60/3434496
actttt

SEQ ID NO: 55655 - DNA, 6 bp, Unknown
  misc_feature (1)..( 6): Matrix.002 file - promoters60/3434496
attctc

SEQ ID NO: 55656 - DNA, 7 bp, Unknown
  misc_feature (1)..( 7): Matrix.002 file - promoters60/3434496
aatttga

SEQ ID NO: 55657 - DNA, 9 bp, Unknown
  misc_feature (1)..( 9): Matrix.002 file - promoters60/3434496
gatggcaaa

SEQ ID NO: 55658 - DNA, 7 bp, Unknown
  misc_feature (1)..( 7): Matrix.002 file - promoters60/3434496
tgggctc

SEQ ID NO: 55659 - DNA, 6 bp, Unknown
  misc_feature (1)..( 6): Matrix.002 file - promoters60/3434496
gattca

SEQ ID NO: 55660 - DNA, 7 bp, Unknown
  misc_feature (1)..( 7): Matrix.002 file - promoters60/3434496
gcaacaa

SEQ ID NO: 55661 - DNA, 8 bp, Unknown
  misc_feature (1)..( 8): Matrix.002 file - promoters60/3434496
caaaaaac

SEQ ID NO: 55662 - DNA, 6 bp, Unknown
  misc_feature (1)..( 6): Matrix.002 file - promoters60/3434496
atagat

SEQ ID NO: 55663 - DNA, 9 bp, Unknown
  misc_feature (1)..( 9): Matrix.002 file - promoters60/3434496
tttccaatt

SEQ ID NO: 55664 - DNA, 6 bp, Unknown
  misc_feature (1)..( 6): Matrix.002 file - promoters60/3434496
aatttc

SEQ ID NO: 55665 - DNA, 6 bp, Unknown
  misc_feature (1)..( 6): Matrix.002 file - promoters60/3434496
aaactg

SEQ ID NO: 55666 - DNA, 10 bp, Unknown
  misc_feature (1)..( 10): Matrix.002 file - promoters60/3434496
aaaccaattt

SEQ ID NO: 55667 - DNA, 7 bp, Unknown
  misc_feature (1)..( 7): Matrix.002 file - promoters60/3434496
aaactat

SEQ ID NO: 55668 - DNA, 9 bp, Unknown
  misc_feature (1)..( 9): Matrix.002 file - promoters60/3434496
atcaaaccg

SEQ ID NO: 55669 - DNA, 7 bp, Unknown
  misc_feature (1)..( 7): Matrix.002 file - promoters60/3434496
cgagatt

SEQ ID NO: 55670 - DNA, 7 bp, Unknown
  misc_feature (1)..( 7): Matrix.002 file - promoters60/3434496
aagcttg

SEQ ID NO: 55671 - DNA, 6 bp, Unknown
  misc_feature (1)..( 6): Matrix.002 file - promoters60/3434496
gctgat

SEQ ID NO: 55672 - DNA, 6 bp, Unknown
  misc_feature (1)..( 6): Matrix.002 file - promoters60/3434496
tgtaat

SEQ ID NO: 55673 - DNA, 10 bp, Unknown
  misc_feature (1)..( 10): Matrix.002 file - promoters60/3434563
caaaacaaaa

SEQ ID NO: 55674 - DNA, 8 bp, Unknown
  misc_feature (1)..( 8): Matrix.002 file - promoters60/3434648
tctccatc

SEQ ID NO: 55675 - DNA, 9 bp, Unknown
  misc_feature (1)..( 9): Matrix.002 file - promoters60/3434648
cttgtcata

SEQ ID NO: 55676 - DNA, 8 bp, Unknown
  misc_feature (1)..( 8): Matrix.002 file - promoters60/3434648
gtatccat

SEQ ID NO: 55677 - DNA, 6 bp, Unknown
  misc_feature (1)..( 6): Matrix.002 file - promoters60/3434648
gatttg

SEQ ID NO: 55678 - DNA, 9 bp, Unknown
  misc_feature (1)..( 9): Matrix.002 file - promoters60/3434648
atgtatcag

SEQ ID NO: 55679 - DNA, 7 bp, Unknown
  misc_feature (1)..( 7): Matrix.002 file - promoters60/3434648
ctaaatc

SEQ ID NO: 55680 - DNA, 27 bp, Unknown
  misc_feature (1)..( 27): Matrix.002 file - promoters60/3434648
attcatacccacatgatcatgtcttct

SEQ ID NO: 55681 - DNA, 9 bp, Unknown
  misc_feature (1)..( 9): Matrix.002 file - promoters60/3434648
ttctaacca

SEQ ID NO: 55682 - DNA, 12 bp, Unknown
  misc_feature (1)..( 12): Matrix.002 file - promoters60/3434648
tccacaagttga

SEQ ID NO: 55683 - DNA, 7 bp, Unknown
  misc_feature (1)..( 7): Matrix.002 file - promoters60/3434648
attgatt

SEQ ID NO: 55684 - DNA, 11 bp, Unknown
  misc_feature (1)..( 11): Matrix.002 file - promoters60/3434648
aacttgggacc

SEQ ID NO: 55685 - DNA, 31 bp, Unknown
  misc_feature (1)..( 31): Matrix.002 file - promoters60/3434648
taatagtttctccttatatataatgaaacaa

SEQ ID NO: 55686 - DNA, 7 bp, Unknown
  misc_feature (1)..( 7): Matrix.002 file - promoters60/3434649
taaccac

SEQ ID NO: 55687 - DNA, 10 bp, Unknown
  misc_feature (1)..( 10): Matrix.002 file - promoters60/3434648
atatatgttt

SEQ ID NO: 55688 - DNA, 6 bp, Unknown
  misc_feature (1)..( 6): Matrix.002 file - promoters60/3434648
atagat

SEQ ID NO: 55689 - DNA, 6 bp, Unknown
  misc_feature (1)..( 6): Matrix.002 file - promoters60/3434648
ttttaa

SEQ ID NO: 55690 - DNA, 6 bp, Unknown
  misc_feature (1)..( 6): Matrix.002 file - promoters60/3434648
aaaaca

SEQ ID NO: 55691 - DNA, 7 bp, Unknown
  misc_feature (1)..( 7): Matrix.002 file - promoters60/3434652
gttcttt

SEQ ID NO: 55692 - DNA, 8 bp, Unknown
  misc_feature (1)..( 8): Matrix.002 file - promoters60/3434652
aaaattaa

SEQ ID NO: 55693 - DNA, 8 bp, Unknown
  misc_feature (1)..( 8): Matrix.002 file - promoters60/3434652
gataaaaa

SEQ ID NO: 55694 - DNA, 9 bp, Unknown
  misc_feature (1)..( 9): Matrix.002 file - promoters60/3434652
attttttaa

SEQ ID NO: 55695 - DNA, 9 bp, Unknown
  misc_feature (1)..( 9): Matrix.002 file - promoters60/3434652
taaagttgt

SEQ ID NO: 55696 - DNA, 7 bp, Unknown
  misc_feature (1)..( 7): Matrix.002 file - promoters60/3434652
atctaaa

SEQ ID NO: 55697 - DNA, 8 bp, Unknown
  misc_feature (1)..( 8): Matrix.002 file - promoters60/3434652
tgtattat

SEQ ID NO: 55698 - DNA, 10 bp, Unknown
  misc_feature (1)..( 10): Matrix.002 file - promoters60/3434652
tttaactata

SEQ ID NO: 55699 - DNA, 6 bp, Unknown
  misc_feature (1)..( 6): Matrix.002 file - promoters60/3434652
agtcaa

SEQ ID NO: 55700 - DNA, 6 bp, Unknown
  misc_feature (1)..( 6): Matrix.002 file - promoters60/3434652
taacca

SEQ ID NO: 55701 - DNA, 6 bp, Unknown
  misc_feature (1)..( 6): Matrix.002 file - promoters60/3434652
tataaa

SEQ ID NO: 55702 - DNA, 7 bp, Unknown
  misc_feature (1)..( 7): Matrix.002 file - promoters60/3434652
actatag

SEQ ID NO: 55703 - DNA, 6 bp, Unknown
  misc_feature (1)..( 6): Matrix.002 file - promoters60/3434652
ttttgt

SEQ ID NO: 55704 - DNA, 7 bp, Unknown
  misc_feature (1)..( 7): Matrix.002 file - promoters60/3434652
tttatta

SEQ ID NO: 55705 - DNA, 7 bp, Unknown
  misc_feature (1)..( 7): Matrix.002 file - promoters60/3434652
acaactt

SEQ ID NO: 55706 - DNA, 6 bp, Unknown
  misc_feature (1)..( 6): Matrix.002 file - promoters60/3434652
aacagc

SEQ ID NO: 55707 - DNA, 7 bp, Unknown
  misc_feature (1)..( 7): Matrix.002 file - promoters60/3434652
acttgta

SEQ ID NO: 55708 - DNA, 6 bp, Unknown
  misc_feature (1)..( 6): Matrix.002 file - promoters60/3434652
ccaatc

SEQ ID NO: 55709 - DNA, 8 bp, Unknown
  misc_feature (1)..( 8): Matrix.002 file - promoters60/3434652
aataagac

SEQ ID NO: 55710 - DNA, 7 bp, Unknown
  misc_feature (1)..( 7): Matrix.002 file - promoters60/3434652
aaacata

SEQ ID NO: 55711 - DNA, 8 bp, Unknown
  misc_feature (1)..( 8): Matrix.002 file - promoters60/3434652
ctaaaatt

SEQ ID NO: 55712 - DNA, 6 bp, Unknown
  misc_feature (1)..( 6): Matrix.002 file - promoters60/3434652
attaaa

SEQ ID NO: 55713 - DNA, 6 bp, Unknown
  misc_feature (1)..( 6): Matrix.002 file - promoters60/3434652
aaaaag

SEQ ID NO: 55714 - DNA, 7 bp, Unknown
  misc_feature (1)..( 7): Matrix.002 file - promoters60/3434652
tttataa

SEQ ID NO: 55715 - DNA, 6 bp, Unknown
  misc_feature (1)..( 6): Matrix.002 file - promoters60/3434652
tcagct

SEQ ID NO: 55716 - DNA, 6 bp, Unknown
  misc_feature (1)..( 6): Matrix.002 file - promoters60/3434652
ctattc

SEQ ID NO: 55717 - DNA, 6 bp, Unknown
  misc_feature (1)..( 6): Matrix.002 file - promoters60/3434652
attttt

SEQ ID NO: 55718 - DNA, 7 bp, Unknown
  misc_feature (1)..( 7): Matrix.002 file - promoters60/3434652
aaagttt

SEQ ID NO: 55719 - DNA, 6 bp, Unknown
  misc_feature (1)..( 6): Matrix.002 file - promoters60/3434836
ttcaaa

SEQ ID NO: 55720 - DNA, 7 bp, Unknown
  misc_feature (1)..( 7): Matrix.002 file - promoters60/3434836
caaaaaa

SEQ ID NO: 55721 - DNA, 7 bp, Unknown
  misc_feature (1)..( 7): Matrix.002 file - promoters60/3434836
ggtgttt

SEQ ID NO: 55722 - DNA, 7 bp, Unknown
  misc_feature (1)..( 7): Matrix.002 file - promoters60/3434836
aacaaaa

SEQ ID NO: 55723 - DNA, 7 bp, Unknown
  misc_feature (1)..( 7): Matrix.002 file - promoters60/3434836
ttagtat

SEQ ID NO: 55724 - DNA, 8 bp, Unknown
  misc_feature (1)..( 8): Matrix.002 file - promoters60/3434836
tattagtc

SEQ ID NO: 55725 - DNA, 8 bp, Unknown
  misc_feature (1)..( 8): Matrix.002 file - promoters60/3434836
aaaagtgt

SEQ ID NO: 55726 - DNA, 7 bp, Unknown
  misc_feature (1)..( 7): Matrix.002 file - promoters60/3434836
tttattg

SEQ ID NO: 55727 - DNA, 7 bp, Unknown
  misc_feature (1)..( 7): Matrix.002 file - promoters60/3434836
tttggtt

SEQ ID NO: 55728 - DNA, 8 bp, Unknown
  misc_feature (1)..( 8): Matrix.002 file - promoters60/3434836
caaatcag

SEQ ID NO: 55729 - DNA, 6 bp, Unknown
  misc_feature (1)..( 6): Matrix.002 file - promoters60/3434836
atcaga

SEQ ID NO: 55730 - DNA, 6 bp, Unknown
  misc_feature (1)..( 6): Matrix.002 file - promoters60/3434836
gataga

SEQ ID NO: 55731 - DNA, 6 bp, Unknown
  misc_feature (1)..( 6): Matrix.002 file - promoters60/3434836
agatct

SEQ ID NO: 55732 - DNA, 9 bp, Unknown
  misc_feature (1)..( 9): Matrix.002 file - promoters60/3434836
attaaaaga

SEQ ID NO: 55733 - DNA, 10 bp, Unknown
  misc_feature (1)..( 10): Matrix.002 file - promoters60/3434836
tctctgatca

SEQ ID NO: 55734 - DNA, 8 bp, Unknown
  misc_feature (1)..( 8): Matrix.002 file - promoters60/3434909
tatatctt

SEQ ID NO: 55735 - DNA, 9 bp, Unknown
  misc_feature (1)..( 9): Matrix.002 file - promoters60/3434909
aaggagata

SEQ ID NO: 55736 - DNA, 7 bp, Unknown
  misc_feature (1)..( 7): Matrix.002 file - promoters60/3434909
atcagaa

SEQ ID NO: 55737 - DNA, 6 bp, Unknown
  misc_feature (1)..( 6): Matrix.002 file - promoters60/3434909
taaaaa

SEQ ID NO: 55738 - DNA, 11 bp, Unknown
  misc_feature (1)..( 11): Matrix.002 file - promoters60/3434909
caacatgaaat

SEQ ID NO: 55739 - DNA, 8 bp, Unknown
  misc_feature (1)..( 8): Matrix.002 file - promoters60/3434909
taatgtta

SEQ ID NO: 55740 - DNA, 10 bp, Unknown
  misc_feature (1)..( 10): Matrix.002 file - promoters60/3434909
cccataaaaa

SEQ ID NO: 55741 - DNA, 6 bp, Unknown
  misc_feature (1)..( 6): Matrix.002 file - promoters60/3434909
tccatt

SEQ ID NO: 55742 - DNA, 6 bp, Unknown
  misc_feature (1)..( 6): Matrix.002 file - promoters60/3434909
tcaaca

SEQ ID NO: 55743 - DNA, 8 bp, Unknown
  misc_feature (1)..( 8): Matrix.002 file - promoters60/3434909
atgtaata

SEQ ID NO: 55744 - DNA, 9 bp, Unknown
  misc_feature (1)..( 9): Matrix.002 file - promoters60/3434909
atcaaatct

SEQ ID NO: 55745 - DNA, 6 bp, Unknown
  misc_feature (1)..( 6): Matrix.002 file - promoters60/3434909
ttccgc

SEQ ID NO: 55746 - DNA, 9 bp, Unknown
  misc_feature (1)..( 9): Matrix.002 file - promoters60/3435057
aaatatata

SEQ ID NO: 55747 - DNA, 9 bp, Unknown
  misc_feature (1)..( 9): Matrix.002 file - promoters60/3435057
aaaatatat

SEQ ID NO: 55748 - DNA, 5 bp, Unknown
  misc_feature (1)..( 5): Matrix.002 file - promoters60/3435057
cataa

SEQ ID NO: 55749 - DNA, 9 bp, Unknown
  misc_feature (1)..( 9): Matrix.002 file - promoters60/3435057
ccataaaaa

SEQ ID NO: 55750 - DNA, 12 bp, Unknown
  misc_feature (1)..( 12): Matrix.002 file - promoters60/3435057
atactgtctttt

SEQ ID NO: 55751 - DNA, 8 bp, Unknown
  misc_feature (1)..( 8): Matrix.002 file - promoters60/3435057
aaaaatta

SEQ ID NO: 55752 - DNA, 10 bp, Unknown
  misc_feature (1)..( 10): Matrix.002 file - promoters60/3435057
ctttttattt

SEQ ID NO: 55753 - DNA, 9 bp, Unknown
  misc_feature (1)..( 9): Matrix.002 file - promoters60/3435057
gtttaattt

SEQ ID NO: 55754 - DNA, 7 bp, Unknown
  misc_feature (1)..( 7): Matrix.002 file - promoters60/3435057
atatatt

SEQ ID NO: 55755 - DNA, 9 bp, Unknown
  misc_feature (1)..( 9): Matrix.002 file - promoters60/3435057
gttatcata

SEQ ID NO: 55756 - DNA, 9 bp, Unknown
  misc_feature (1)..( 9): Matrix.002 file - promoters60/3435057
ctatatata

SEQ ID NO: 55757 - DNA, 8 bp, Unknown
  misc_feature (1)..( 8): Matrix.002 file - promoters60/3435091
tcttcttt

SEQ ID NO: 55758 - DNA, 13 bp, Unknown
  misc_feature (1)..( 13): Matrix.002 file - promoters60/3435091
tttcataactatt

SEQ ID NO: 55759 - DNA, 10 bp, Unknown
  misc_feature (1)..( 10): Matrix.002 file - promoters60/3435091
gtatataaat

SEQ ID NO: 55760 - DNA, 11 bp, Unknown
  misc_feature (1)..( 11): Matrix.002 file - promoters60/3435091
caactttgaaa

SEQ ID NO: 55761 - DNA, 8 bp, Unknown
  misc_feature (1)..( 8): Matrix.002 file - promoters60/3435091
attaatga

SEQ ID NO: 55762 - DNA, 10 bp, Unknown
  misc_feature (1)..( 10): Matrix.002 file - promoters60/3435091
aactttgaaa

SEQ ID NO: 55763 - DNA, 9 bp, Unknown
  misc_feature (1)..( 9): Matrix.002 file - promoters60/3435091
aattataaa

SEQ ID NO: 55764 - DNA, 12 bp, Unknown
  misc_feature (1)..( 12): Matrix.002 file - promoters60/3435133
aaataattgtat

SEQ ID NO: 55765 - DNA, 10 bp, Unknown
  misc_feature (1)..( 10): Matrix.002 file - promoters60/3435133
gaaatagatt

SEQ ID NO: 55766 - DNA, 11 bp, Unknown
  misc_feature (1)..( 11): Matrix.002 file - promoters60/3435133
ttacttaaatt

SEQ ID NO: 55767 - DNA, 6 bp, Unknown
  misc_feature (1)..( 6): Matrix.002 file - promoters60/3435213
agtcgt

SEQ ID NO: 55768 - DNA, 7 bp, Unknown
  misc_feature (1)..( 7): Matrix.002 file - promoters60/3435213
tctagct

SEQ ID NO: 55769 - DNA, 6 bp, Unknown
  misc_feature (1)..( 6): Matrix.002 file - promoters60/3435213
cttgta

SEQ ID NO: 55770 - DNA, 7 bp, Unknown
  misc_feature (1)..( 7): Matrix.002 file - promoters60/3435213
tttctgt

SEQ ID NO: 55771 - DNA, 7 bp, Unknown
  misc_feature (1)..( 7): Matrix.002 file - promoters60/3435213
ttcttca

SEQ ID NO: 55772 - DNA, 8 bp, Unknown
  misc_feature (1)..( 8): Matrix.002 file - promoters60/3435213
tgtagtca

SEQ ID NO: 55773 - DNA, 7 bp, Unknown
  misc_feature (1)..( 7): Matrix.002 file - promoters60/3435213
aaccaaa

SEQ ID NO: 55774 - DNA, 6 bp, Unknown
  misc_feature (1)..( 6): Matrix.002 file - promoters60/3435213
aaacag

SEQ ID NO: 55775 - DNA, 8 bp, Unknown
  misc_feature (1)..( 8): Matrix.002 file - promoters60/3435213
tcctcttt

SEQ ID NO: 55776 - DNA, 8 bp, Unknown
  misc_feature (1)..( 8): Matrix.002 file - promoters60/3435213
tctcctgc

SEQ ID NO: 55777 - DNA, 6 bp, Unknown
  misc_feature (1)..( 6): Matrix.002 file - promoters60/3435213
tagagt

SEQ ID NO: 55778 - DNA, 11 bp, Unknown
  misc_feature (1)..( 11): Matrix.002 file - promoters60/3435239
gacgattttgt

SEQ ID NO: 55779 - DNA, 8 bp, Unknown
  misc_feature (1)..( 8): Matrix.002 file - promoters60/3435239
attcgtat

SEQ ID NO: 55780 - DNA, 15 bp, Unknown
  misc_feature (1)..( 15): Matrix.002 file - promoters60/3435239
ctcgttttttattgg

SEQ ID NO: 55781 - DNA, 8 bp, Unknown
  misc_feature (1)..( 8): Matrix.002 file - promoters60/3435239
tcttgttt

SEQ ID NO: 55782 - DNA, 8 bp, Unknown
  misc_feature (1)..( 8): Matrix.002 file - promoters60/3435239
atttgttt

SEQ ID NO: 55783 - DNA, 9 bp, Unknown
  misc_feature (1)..( 9): Matrix.002 file - promoters60/3435239
ttttatttt

SEQ ID NO: 55784 - DNA, 9 bp, Unknown
  misc_feature (1)..( 9): Matrix.002 file - promoters60/3435239
aaaagtaga

SEQ ID NO: 55785 - DNA, 10 bp, Unknown
  misc_feature (1)..( 10): Matrix.002 file - promoters60/3435274
atgaaaatag

SEQ ID NO: 55786 - DNA, 7 bp, Unknown
  misc_feature (1)..( 7): Matrix.002 file - promoters60/3435274
aataaca

SEQ ID NO: 55787 - DNA, 6 bp, Unknown
  misc_feature (1)..( 6): Matrix.002 file - promoters60/3435274
agtcaa

SEQ ID NO: 55788 - DNA, 7 bp, Unknown
  misc_feature (1)..( 7): Matrix.002 file - promoters60/3435274
agaagga

SEQ ID NO: 55789 - DNA, 6 bp, Unknown
  misc_feature (1)..( 6): Matrix.002 file - promoters60/3435274
aaacaa

SEQ ID NO: 55790 - DNA, 6 bp, Unknown
  misc_feature (1)..( 6): Matrix.002 file - promoters60/3435274
aatcaa

SEQ ID NO: 55791 - DNA, 12 bp, Unknown
  misc_feature (1)..( 12): Matrix.002 file - promoters60/3435274
caggattgattt

SEQ ID NO: 55792 - DNA, 7 bp, Unknown
  misc_feature (1)..( 7): Matrix.002 file - promoters60/3435274
acttgtg

SEQ ID NO: 55793 - DNA, 7 bp, Unknown
  misc_feature (1)..( 7): Matrix.002 file - promoters60/3435274
ttatgtc

SEQ ID NO: 55794 - DNA, 10 bp, Unknown
  misc_feature (1)..( 10): Matrix.002 file - promoters60/3435274
ttttaataac

SEQ ID NO: 55795 - DNA, 7 bp, Unknown
  misc_feature (1)..( 7): Matrix.002 file - promoters60/3435274
attagta

SEQ ID NO: 55796 - DNA, 6 bp, Unknown
  misc_feature (1)..( 6): Matrix.002 file - promoters60/3435274
aaaatc

SEQ ID NO: 55797 - DNA, 7 bp, Unknown
  misc_feature (1)..( 7): Matrix.002 file - promoters60/3435274
gattcag

SEQ ID NO: 55798 - DNA, 7 bp, Unknown
  misc_feature (1)..( 7): Matrix.002 file - promoters60/3435274
gatcgat

SEQ ID NO: 55799 - DNA, 7 bp, Unknown
  misc_feature (1)..( 7): Matrix.002 file - promoters60/3435282
agaaata

SEQ ID NO: 55800 - DNA, 7 bp, Unknown
  misc_feature (1)..( 7): Matrix.002 file - promoters60/3435282
tgaatta

SEQ ID NO: 55801 - DNA, 7 bp, Unknown
  misc_feature (1)..( 7): Matrix.002 file - promoters60/3435282
gttgatt

SEQ ID NO: 55802 - DNA, 7 bp, Unknown
  misc_feature (1)..( 7): Matrix.002 file - promoters60/3435282
tgtcggc

SEQ ID NO: 55803 - DNA, 6 bp, Unknown
  misc_feature (1)..( 6): Matrix.002 file - promoters60/3435282
ttataa

SEQ ID NO: 55804 - DNA, 6 bp, Unknown
  misc_feature (1)..( 6): Matrix.002 file - promoters60/3435282
ttatgt

SEQ ID NO: 55805 - DNA, 9 bp, Unknown
  misc_feature (1)..( 9): Matrix.002 file - promoters60/3435282
ttgtatctc

SEQ ID NO: 55806 - DNA, 7 bp, Unknown
  misc_feature (1)..( 7): Matrix.002 file - promoters60/3435282
tatcttt

SEQ ID NO: 55807 - DNA, 6 bp, Unknown
  misc_feature (1)..( 6): Matrix.002 file - promoters60/3435282
agcatc

SEQ ID NO: 55808 - DNA, 6 bp, Unknown
  misc_feature (1)..( 6): Matrix.002 file - promoters60/3435282
cttttc

SEQ ID NO: 55809 - DNA, 6 bp, Unknown
  misc_feature (1)..( 6): Matrix.002 file - promoters60/3435282
tttgga

SEQ ID NO: 55810 - DNA, 6 bp, Unknown
  misc_feature (1)..( 6): Matrix.002 file - promoters60/3435282
aaccaa

SEQ ID NO: 55811 - DNA, 7 bp, Unknown
  misc_feature (1)..( 7): Matrix.002 file - promoters60/3435282
aaagatt

SEQ ID NO: 55812 - DNA, 7 bp, Unknown
  misc_feature (1)..( 7): Matrix.002 file - promoters60/3435282
aaaaaag

SEQ ID NO: 55813 - DNA, 7 bp, Unknown
  misc_feature (1)..( 7): Matrix.002 file - promoters60/3435282
ataatat

SEQ ID NO: 55814 - DNA, 8 bp, Unknown
  misc_feature (1)..( 8): Matrix.002 file - promoters60/3435282
tttacaag

SEQ ID NO: 55815 - DNA, 9 bp, Unknown
  misc_feature (1)..( 9): Matrix.002 file - promoters60/3435282
aatacaaaa

SEQ ID NO: 55816 - DNA, 6 bp, Unknown
  misc_feature (1)..( 6): Matrix.002 file - promoters60/3435282
taaaaa

SEQ ID NO: 55817 - DNA, 6 bp, Unknown
  misc_feature (1)..( 6): Matrix.002 file - promoters60/3435282
attttg

SEQ ID NO: 55818 - DNA, 8 bp, Unknown
  misc_feature (1)..( 8): Matrix.002 file - promoters60/3435341
attggttt

SEQ ID NO: 55819 - DNA, 7 bp, Unknown
  misc_feature (1)..( 7): Matrix.002 file - promoters60/3435341
gaactta

SEQ ID NO: 55820 - DNA, 7 bp, Unknown
  misc_feature (1)..( 7): Matrix.002 file - promoters60/3435341
tgacaag

SEQ ID NO: 55821 - DNA, 6 bp, Unknown
  misc_feature (1)..( 6): Matrix.002 file - promoters60/3435341
aatttt

SEQ ID NO: 55822 - DNA, 6 bp, Unknown
  misc_feature (1)..( 6): Matrix.002 file - promoters60/3435341
ttttga

SEQ ID NO: 55823 - DNA, 7 bp, Unknown
  misc_feature (1)..( 7): Matrix.002 file - promoters60/3435341
agtaata

SEQ ID NO: 55824 - DNA, 7 bp, Unknown
  misc_feature (1)..( 7): Matrix.002 file - promoters60/3435341
aatgtgt

SEQ ID NO: 55825 - DNA, 6 bp, Unknown
  misc_feature (1)..( 6): Matrix.002 file - promoters60/3435341
ggtttg

SEQ ID NO: 55826 - DNA, 6 bp, Unknown
  misc_feature (1)..( 6): Matrix.002 file - promoters60/3435341
ttcaat

SEQ ID NO: 55827 - DNA, 6 bp, Unknown
  misc_feature (1)..( 6): Matrix.002 file - promoters60/3435341
aagtta

SEQ ID NO: 55828 - DNA, 7 bp, Unknown
  misc_feature (1)..( 7): Matrix.002 file - promoters60/3435341
gagcaat

SEQ ID NO: 55829 - DNA, 8 bp, Unknown
  misc_feature (1)..( 8): Matrix.002 file - promoters60/3435341
ttgcaatt

SEQ ID NO: 55830 - DNA, 6 bp, Unknown
  misc_feature (1)..( 6): Matrix.002 file - promoters60/3435341
tttctt

SEQ ID NO: 55831 - DNA, 10 bp, Unknown
  misc_feature (1)..( 10): Matrix.002 file - promoters60/3435341
ttactgatag

SEQ ID NO: 55832 - DNA, 7 bp, Unknown
  misc_feature (1)..( 7): Matrix.002 file - promoters60/3435341
tttaatc

SEQ ID NO: 55833 - DNA, 6 bp, Unknown
  misc_feature (1)..( 6): Matrix.002 file - promoters60/3435341
gggacc

SEQ ID NO: 55834 - DNA, 8 bp, Unknown
  misc_feature (1)..( 8): Matrix.002 file - promoters60/3435341
cctaactt

SEQ ID NO: 55835 - DNA, 8 bp, Unknown
  misc_feature (1)..( 8): Matrix.002 file - promoters60/3435341
cttgattg

SEQ ID NO: 55836 - DNA, 6 bp, Unknown
  misc_feature (1)..( 6): Matrix.002 file - promoters60/3435341
tctttg

SEQ ID NO: 55837 - DNA, 6 bp, Unknown
  misc_feature (1)..( 6): Matrix.002 file - promoters60/3435341
gaggaa

SEQ ID NO: 55838 - DNA, 6 bp, Unknown
  misc_feature (1)..( 6): Matrix.002 file - promoters60/3435341
tttttg

SEQ ID NO: 55839 - DNA, 10 bp, Unknown
  misc_feature (1)..( 10): Matrix.002 file - promoters60/3435411
ctcatcttct

SEQ ID NO: 55840 - DNA, 9 bp, Unknown
  misc_feature (1)..( 9): Matrix.002 file - promoters60/3435411
tctaaaatc

SEQ ID NO: 55841 - DNA, 8 bp, Unknown
  misc_feature (1)..( 8): Matrix.002 file - promoters60/3435411
gaagaaaa

SEQ ID NO: 55842 - DNA, 7 bp, Unknown
  misc_feature (1)..( 7): Matrix.002 file - promoters60/3435411
aaaaatt

SEQ ID NO: 55843 - DNA, 10 bp, Unknown
  misc_feature (1)..( 10): Matrix.002 file - promoters60/3435411
agagagaaca

SEQ ID NO: 55844 - DNA, 7 bp, Unknown
  misc_feature (1)..( 7): Matrix.002 file - promoters60/3435411
aacaaag

SEQ ID NO: 55845 - DNA, 6 bp, Unknown
  misc_feature (1)..( 6): Matrix.002 file - promoters60/3435411
gttttc

SEQ ID NO: 55846 - DNA, 6 bp, Unknown
  misc_feature (1)..( 6): Matrix.002 file - promoters60/3435411
agcttc

SEQ ID NO: 55847 - DNA, 9 bp, Unknown
  misc_feature (1)..( 9): Matrix.002 file - promoters60/3435411
atcttaact

SEQ ID NO: 55848 - DNA, 6 bp, Unknown
  misc_feature (1)..( 6): Matrix.002 file - promoters60/3435411
ataatt

SEQ ID NO: 55849 - DNA, 6 bp, Unknown
  misc_feature (1)..( 6): Matrix.002 file - promoters60/3435411
tttagg

SEQ ID NO: 55850 - DNA, 9 bp, Unknown
  misc_feature (1)..( 9): Matrix.002 file - promoters60/3435411
gagcctgat

SEQ ID NO: 55851 - DNA, 6 bp, Unknown
  misc_feature (1)..( 6): Matrix.002 file - promoters60/3435411
aattgc

SEQ ID NO: 55852 - DNA, 6 bp, Unknown
  misc_feature (1)..( 6): Matrix.002 file - promoters60/3435411
tccaaa

SEQ ID NO: 55853 - DNA, 6 bp, Unknown
  misc_feature (1)..( 6): Matrix.002 file - promoters60/3435411
aaacga

SEQ ID NO: 55854 - DNA, 6 bp, Unknown
  misc_feature (1)..( 6): Matrix.002 file - promoters60/3435411
ttgact

SEQ ID NO: 55855 - DNA, 8 bp, Unknown
  misc_feature (1)..( 8): Matrix.002 file - promoters60/3435411
ccaagacg

SEQ ID NO: 55856 - DNA, 7 bp, Unknown
  misc_feature (1)..( 7): Matrix.002 file - promoters60/3435411
aggccca

SEQ ID NO: 55857 - DNA, 8 bp, Unknown
  misc_feature (1)..( 8): Matrix.002 file - promoters60/3435452
attttctt

SEQ ID NO: 55858 - DNA, 9 bp, Unknown
  misc_feature (1)..( 9): Matrix.002 file - promoters60/3435469
tgttttcta

SEQ ID NO: 55859 - DNA, 13 bp, Unknown
  misc_feature (1)..( 13): Matrix.002 file - promoters60/3435469
ctcatatataaca

SEQ ID NO: 55860 - DNA, 10 bp, Unknown
  misc_feature (1)..( 10): Matrix.002 file - promoters60/3435469
ctagattttt

SEQ ID NO: 55861 - DNA, 12 bp, Unknown
  misc_feature (1)..( 12): Matrix.002 file - promoters60/3435469
aaatttttttta

SEQ ID NO: 55862 - DNA, 8 bp, Unknown
  misc_feature (1)..( 8): Matrix.002 file - promoters60/3435469
cttttttt

SEQ ID NO: 55863 - DNA, 9 bp, Unknown
  misc_feature (1)..( 9): Matrix.002 file - promoters60/3435534
acaaaaaat

SEQ ID NO: 55864 - DNA, 8 bp, Unknown
  misc_feature (1)..( 8): Matrix.002 file - promoters60/3435534
agacaaaa

SEQ ID NO: 55865 - DNA, 10 bp, Unknown
  misc_feature (1)..( 10): Matrix.002 file - promoters60/3435534
acacaaaaaa

SEQ ID NO: 55866 - DNA, 6 bp, Unknown
  misc_feature (1)..( 6): Matrix.002 file - promoters60/3435578
tatcaa

SEQ ID NO: 55867 - DNA, 11 bp, Unknown
  misc_feature (1)..( 11): Matrix.002 file - promoters60/3435578
ttgacattaca

SEQ ID NO: 55868 - DNA, 7 bp, Unknown
  misc_feature (1)..( 7): Matrix.002 file - promoters60/3435578
tgtgttt

SEQ ID NO: 55869 - DNA, 8 bp, Unknown
  misc_feature (1)..( 8): Matrix.002 file - promoters60/3435578
ttagcaag

SEQ ID NO: 55870 - DNA, 7 bp, Unknown
  misc_feature (1)..( 7): Matrix.002 file - promoters60/3435578
aggagaa

SEQ ID NO: 55871 - DNA, 7 bp, Unknown
  misc_feature (1)..( 7): Matrix.002 file - promoters60/3435578
attaggt

SEQ ID NO: 55872 - DNA, 8 bp, Unknown
  misc_feature (1)..( 8): Matrix.002 file - promoters60/3435578
ttcacaaa

SEQ ID NO: 55873 - DNA, 10 bp, Unknown
  misc_feature (1)..( 10): Matrix.002 file - promoters60/3435578
ttcacaaact

SEQ ID NO: 55874 - DNA, 7 bp, Unknown
  misc_feature (1)..( 7): Matrix.002 file - promoters60/3435578
tcttctt

SEQ ID NO: 55875 - DNA, 6 bp, Unknown
  misc_feature (1)..( 6): Matrix.002 file - promoters60/3435578
taacca

SEQ ID NO: 55876 - DNA, 6 bp, Unknown
  misc_feature (1)..( 6): Matrix.002 file - promoters60/3435578
aacttt

SEQ ID NO: 55877 - DNA, 7 bp, Unknown
  misc_feature (1)..( 7): Matrix.002 file - promoters60/3435578
tatacaa

SEQ ID NO: 55878 - DNA, 8 bp, Unknown
  misc_feature (1)..( 8): Matrix.002 file - promoters60/3435578
aacaaaca

SEQ ID NO: 55879 - DNA, 6 bp, Unknown
  misc_feature (1)..( 6): Matrix.002 file - promoters60/3435578
atttca

SEQ ID NO: 55880 - DNA, 8 bp, Unknown
  misc_feature (1)..( 8): Matrix.002 file - promoters60/3435578
cagctatt

SEQ ID NO: 55881 - DNA, 7 bp, Unknown
  misc_feature (1)..( 7): Matrix.002 file - promoters60/3435578
attgttg

SEQ ID NO: 55882 - DNA, 8 bp, Unknown
  misc_feature (1)..( 8): Matrix.002 file - promoters60/3435578
cataaaaa

SEQ ID NO: 55883 - DNA, 7 bp, Unknown
  misc_feature (1)..( 7): Matrix.002 file - promoters60/3435578
acagatt

SEQ ID NO: 55884 - DNA, 7 bp, Unknown
  misc_feature (1)..( 7): Matrix.002 file - promoters60/3435578
tttagtt

SEQ ID NO: 55885 - DNA, 11 bp, Unknown
  misc_feature (1)..( 11): Matrix.002 file - promoters60/3435605
tctaatttaat

SEQ ID NO: 55886 - DNA, 13 bp, Unknown
  misc_feature (1)..( 13): Matrix.002 file - promoters60/3435605
aaattataaaatc

SEQ ID NO: 55887 - DNA, 10 bp, Unknown
  misc_feature (1)..( 10): Matrix.002 file - promoters60/3435605
tttaatgtca

SEQ ID NO: 55888 - DNA, 12 bp, Unknown
  misc_feature (1)..( 12): Matrix.002 file - promoters60/3435605
cacaaatatgtt

SEQ ID NO: 55889 - DNA, 8 bp, Unknown
  misc_feature (1)..( 8): Matrix.002 file - promoters60/3435605
attaaatc

SEQ ID NO: 55890 - DNA, 11 bp, Unknown
  misc_feature (1)..( 11): Matrix.002 file - promoters60/3435605
cataaattgta

SEQ ID NO: 55891 - DNA, 8 bp, Unknown
  misc_feature (1)..( 8): Matrix.002 file - promoters60/3435605
ttaaatta

SEQ ID NO: 55892 - DNA, 9 bp, Unknown
  misc_feature (1)..( 9): Matrix.002 file - promoters60/3435620
tcataaagc

SEQ ID NO: 55893 - DNA, 10 bp, Unknown
  misc_feature (1)..( 10): Matrix.002 file - promoters60/3435620
ttagttctaa

SEQ ID NO: 55894 - DNA, 7 bp, Unknown
  misc_feature (1)..( 7): Matrix.002 file - promoters60/3435620
gaaaaaa

SEQ ID NO: 55895 - DNA, 7 bp, Unknown
  misc_feature (1)..( 7): Matrix.002 file - promoters60/3435620
caaaaac

SEQ ID NO: 55896 - DNA, 10 bp, Unknown
  misc_feature (1)..( 10): Matrix.002 file - promoters60/3435620
tcatttgtat

SEQ ID NO: 55897 - DNA, 9 bp, Unknown
  misc_feature (1)..( 9): Matrix.002 file - promoters60/3435620
ataacatac

SEQ ID NO: 55898 - DNA, 11 bp, Unknown
  misc_feature (1)..( 11): Matrix.002 file - promoters60/3435632
gaaacaaaaaa

SEQ ID NO: 55899 - DNA, 9 bp, Unknown
  misc_feature (1)..( 9): Matrix.002 file - promoters60/3435632
tttgattgt

SEQ ID NO: 55900 - DNA, 8 bp, Unknown
  misc_feature (1)..( 8): Matrix.002 file - promoters60/3435646
tttaggga

SEQ ID NO: 55901 - DNA, 7 bp, Unknown
  misc_feature (1)..( 7): Matrix.002 file - promoters60/3435683
cttatca

SEQ ID NO: 55902 - DNA, 7 bp, Unknown
  misc_feature (1)..( 7): Matrix.002 file - promoters60/3435683
caaatac

SEQ ID NO: 55903 - DNA, 8 bp, Unknown
  misc_feature (1)..( 8): Matrix.002 file - promoters60/3435683
ccaaaaac

SEQ ID NO: 55904 - DNA, 8 bp, Unknown
  misc_feature (1)..( 8): Matrix.002 file - promoters60/3435683
acaaagtg

SEQ ID NO: 55905 - DNA, 9 bp, Unknown
  misc_feature (1)..( 9): Matrix.002 file - promoters60/3435683
aatttcaaa

SEQ ID NO: 55906 - DNA, 6 bp, Unknown
  misc_feature (1)..( 6): Matrix.002 file - promoters60/3435683
tgtaat

SEQ ID NO: 55907 - DNA, 6 bp, Unknown
  misc_feature (1)..( 6): Matrix.002 file - promoters60/3435683
aattta

SEQ ID NO: 55908 - DNA, 9 bp, Unknown
  misc_feature (1)..( 9): Matrix.002 file - promoters60/3435683
tgttaaaat

SEQ ID NO: 55909 - DNA, 7 bp, Unknown
  misc_feature (1)..( 7): Matrix.002 file - promoters60/3435683
tatatat

SEQ ID NO: 55910 - DNA, 6 bp, Unknown
  misc_feature (1)..( 6): Matrix.002 file - promoters60/3435683
ggctga

SEQ ID NO: 55911 - DNA, 11 bp, Unknown
  misc_feature (1)..( 11): Matrix.002 file - promoters60/3435683
agggtctcaga

SEQ ID NO: 55912 - DNA, 6 bp, Unknown
  misc_feature (1)..( 6): Matrix.002 file - promoters60/3435683
agattt

SEQ ID NO: 55913 - DNA, 12 bp, Unknown
  misc_feature (1)..( 12): Matrix.002 file - promoters60/3435761
aaatgggcctat

SEQ ID NO: 55914 - DNA, 6 bp, Unknown
  misc_feature (1)..( 6): Matrix.002 file - promoters60/3435765
ttaaac

SEQ ID NO: 55915 - DNA, 7 bp, Unknown
  misc_feature (1)..( 7): Matrix.002 file - promoters60/3435765
tgttttt

SEQ ID NO: 55916 - DNA, 9 bp, Unknown
  misc_feature (1)..( 9): Matrix.002 file - promoters60/3435765
gttttttaa

SEQ ID NO: 55917 - DNA, 9 bp, Unknown
  misc_feature (1)..( 9): Matrix.002 file - promoters60/3435765
ataaaataa

SEQ ID NO: 55918 - DNA, 7 bp, Unknown
  misc_feature (1)..( 7): Matrix.002 file - promoters60/3435765
ataagga

SEQ ID NO: 55919 - DNA, 7 bp, Unknown
  misc_feature (1)..( 7): Matrix.002 file - promoters60/3435765
ataaatg

SEQ ID NO: 55920 - DNA, 6 bp, Unknown
  misc_feature (1)..( 6): Matrix.002 file - promoters60/3435765
tatatg

SEQ ID NO: 55921 - DNA, 6 bp, Unknown
  misc_feature (1)..( 6): Matrix.002 file - promoters60/3435765
aaacat

SEQ ID NO: 55922 - DNA, 7 bp, Unknown
  misc_feature (1)..( 7): Matrix.002 file - promoters60/3435765
ttatgat

SEQ ID NO: 55923 - DNA, 6 bp, Unknown
  misc_feature (1)..( 6): Matrix.002 file - promoters60/3435765
acatgt

SEQ ID NO: 55924 - DNA, 9 bp, Unknown
  misc_feature (1)..( 9): Matrix.002 file - promoters60/3435765
agaagatta

SEQ ID NO: 55925 - DNA, 6 bp, Unknown
  misc_feature (1)..( 6): Matrix.002 file - promoters60/3435765
aatgct

SEQ ID NO: 55926 - DNA, 6 bp, Unknown
  misc_feature (1)..( 6): Matrix.002 file - promoters60/3435765
aatatg

SEQ ID NO: 55927 - DNA, 6 bp, Unknown
  misc_feature (1)..( 6): Matrix.002 file - promoters60/3435765
gagttc

SEQ ID NO: 55928 - DNA, 6 bp, Unknown
  misc_feature (1)..( 6): Matrix.002 file - promoters60/3435765
ccattt

SEQ ID NO: 55929 - DNA, 6 bp, Unknown
  misc_feature (1)..( 6): Matrix.002 file - promoters60/3435765
tgaaaa

SEQ ID NO: 55930 - DNA, 8 bp, Unknown
  misc_feature (1)..( 8): Matrix.002 file - promoters60/3435765
atgaacat

SEQ ID NO: 55931 - DNA, 7 bp, Unknown
  misc_feature (1)..( 7): Matrix.002 file - promoters60/3435765
tatgttg

SEQ ID NO: 55932 - DNA, 7 bp, Unknown
  misc_feature (1)..( 7): Matrix.002 file - promoters60/3435765
attaaga

SEQ ID NO: 55933 - DNA, 7 bp, Unknown
  misc_feature (1)..( 7): Matrix.002 file - promoters60/3435765
tctcttt

SEQ ID NO: 55934 - DNA, 7 bp, Unknown
  misc_feature (1)..( 7): Matrix.002 file - promoters60/3435765
aaacaaa

SEQ ID NO: 55935 - DNA, 6 bp, Unknown
  misc_feature (1)..( 6): Matrix.002 file - promoters60/3435765
tcttaa

SEQ ID NO: 55936 - DNA, 14 bp, Unknown
  misc_feature (1)..( 14): Matrix.002 file - promoters60/3435819
atcggagatttgtt

SEQ ID NO: 55937 - DNA, 9 bp, Unknown
  misc_feature (1)..( 9): Matrix.002 file - promoters60/3435819
cgaaagaaa

SEQ ID NO: 55938 - DNA, 10 bp, Unknown
  misc_feature (1)..( 10): Matrix.002 file - promoters60/3435819
acgatttaag

SEQ ID NO: 55939 - DNA, 7 bp, Unknown
  misc_feature (1)..( 7): Matrix.002 file - promoters60/3435819
atttttt

SEQ ID NO: 55940 - DNA, 11 bp, Unknown
  misc_feature (1)..( 11): Matrix.002 file - promoters60/3435819
ttaatgggttc

SEQ ID NO: 55941 - DNA, 9 bp, Unknown
  misc_feature (1)..( 9): Matrix.002 file - promoters60/3435829
gaatacata

SEQ ID NO: 55942 - DNA, 8 bp, Unknown
  misc_feature (1)..( 8): Matrix.002 file - promoters60/3435829
aattatat

SEQ ID NO: 55943 - DNA, 8 bp, Unknown
  misc_feature (1)..( 8): Matrix.002 file - promoters60/3435829
tcaaaatt

SEQ ID NO: 55944 - DNA, 8 bp, Unknown
  misc_feature (1)..( 8): Matrix.002 file - promoters60/3435829
ctaaaata

SEQ ID NO: 55945 - DNA, 8 bp, Unknown
  misc_feature (1)..( 8): Matrix.002 file - promoters60/3435829
attaacta

SEQ ID NO: 55946 - DNA, 9 bp, Unknown
  misc_feature (1)..( 9): Matrix.002 file - promoters60/3435833
atgaaaaaa

SEQ ID NO: 55947 - DNA, 12 bp, Unknown
  misc_feature (1)..( 12): Matrix.002 file - promoters60/3435833
tcaaaagattaa

SEQ ID NO: 55948 - DNA, 13 bp, Unknown
  misc_feature (1)..( 13): Matrix.002 file - promoters60/3435833
atatgacaaaaat

SEQ ID NO: 55949 - DNA, 11 bp, Unknown
  misc_feature (1)..( 11): Matrix.002 file - promoters60/3435833
aatgattaaat

SEQ ID NO: 55950 - DNA, 10 bp, Unknown
  misc_feature (1)..( 10): Matrix.002 file - promoters60/3435833
aaatttttca

SEQ ID NO: 55951 - DNA, 8 bp, Unknown
  misc_feature (1)..( 8): Matrix.002 file - promoters60/3435891
aatgcaac

SEQ ID NO: 55952 - DNA, 6 bp, Unknown
  misc_feature (1)..( 6): Matrix.002 file - promoters60/3435891
aaattt

SEQ ID NO: 55953 - DNA, 10 bp, Unknown
  misc_feature (1)..( 10): Matrix.002 file - promoters60/3435891
tgttttcact

SEQ ID NO: 55954 - DNA, 7 bp, Unknown
  misc_feature (1)..( 7): Matrix.002 file - promoters60/3435891
gttaata

SEQ ID NO: 55955 - DNA, 10 bp, Unknown
  misc_feature (1)..( 10): Matrix.002 file - promoters60/3435891
aactctttta

SEQ ID NO: 55956 - DNA, 6 bp, Unknown
  misc_feature (1)..( 6): Matrix.002 file - promoters60/3435891
caaaaa

SEQ ID NO: 55957 - DNA, 7 bp, Unknown
  misc_feature (1)..( 7): Matrix.002 file - promoters60/3435891
tttatta

SEQ ID NO: 55958 - DNA, 7 bp, Unknown
  misc_feature (1)..( 7): Matrix.002 file - promoters60/3435891
tgaaatt

SEQ ID NO: 55959 - DNA, 6 bp, Unknown
  misc_feature (1)..( 6): Matrix.002 file - promoters60/3435891
aagttg

SEQ ID NO: 55960 - DNA, 8 bp, Unknown
  misc_feature (1)..( 8): Matrix.002 file - promoters60/3435891
attactat

SEQ ID NO: 55961 - DNA, 6 bp, Unknown
  misc_feature (1)..( 6): Matrix.002 file - promoters60/3435891
taattc

SEQ ID NO: 55962 - DNA, 8 bp, Unknown
  misc_feature (1)..( 8): Matrix.002 file - promoters60/3435891
tgtcaaag

SEQ ID NO: 55963 - DNA, 7 bp, Unknown
  misc_feature (1)..( 7): Matrix.002 file - promoters60/3435891
aaaaaaa

SEQ ID NO: 55964 - DNA, 6 bp, Unknown
  misc_feature (1)..( 6): Matrix.002 file - promoters60/3435891
tgtcga

SEQ ID NO: 55965 - DNA, 7 bp, Unknown
  misc_feature (1)..( 7): Matrix.002 file - promoters60/3435891
tttactt

SEQ ID NO: 55966 - DNA, 6 bp, Unknown
  misc_feature (1)..( 6): Matrix.002 file - promoters60/3435891
ttgtac

SEQ ID NO: 55967 - DNA, 10 bp, Unknown
  misc_feature (1)..( 10): Matrix.002 file - promoters60/3435902
attgcaaata

SEQ ID NO: 55968 - DNA, 6 bp, Unknown
  misc_feature (1)..( 6): Matrix.002 file - promoters60/3435902
tcttcc

SEQ ID NO: 55969 - DNA, 6 bp, Unknown
  misc_feature (1)..( 6): Matrix.002 file - promoters60/3435902
aagaaa

SEQ ID NO: 55970 - DNA, 6 bp, Unknown
  misc_feature (1)..( 6): Matrix.002 file - promoters60/3435902
ttgcta

SEQ ID NO: 55971 - DNA, 6 bp, Unknown
  misc_feature (1)..( 6): Matrix.002 file - promoters60/3435902
tctgta

SEQ ID NO: 55972 - DNA, 8 bp, Unknown
  misc_feature (1)..( 8): Matrix.002 file - promoters60/3435902
acatcttt

SEQ ID NO: 55973 - DNA, 6 bp, Unknown
  misc_feature (1)..( 6): Matrix.002 file - promoters60/3435902
atagta

SEQ ID NO: 55974 - DNA, 9 bp, Unknown
  misc_feature (1)..( 9): Matrix.002 file - promoters60/3435902
tattcccat

SEQ ID NO: 55975 - DNA, 6 bp, Unknown
  misc_feature (1)..( 6): Matrix.002 file - promoters60/3435902
tgcaat

SEQ ID NO: 55976 - DNA, 8 bp, Unknown
  misc_feature (1)..( 8): Matrix.002 file - promoters60/3435902
taaattac

SEQ ID NO: 55977 - DNA, 6 bp, Unknown
  misc_feature (1)..( 6): Matrix.002 file - promoters60/3435902
aaatat

SEQ ID NO: 55978 - DNA, 9 bp, Unknown
  misc_feature (1)..( 9): Matrix.002 file - promoters60/3435902
ataatgttt

SEQ ID NO: 55979 - DNA, 7 bp, Unknown
  misc_feature (1)..( 7): Matrix.002 file - promoters60/3435902
atagata

SEQ ID NO: 55980 - DNA, 7 bp, Unknown
  misc_feature (1)..( 7): Matrix.002 file - promoters60/3435902
atggaat

SEQ ID NO: 55981 - DNA, 7 bp, Unknown
  misc_feature (1)..( 7): Matrix.002 file - promoters60/3435902
accaaat

SEQ ID NO: 55982 - DNA, 6 bp, Unknown
  misc_feature (1)..( 6): Matrix.002 file - promoters60/3435902
tattat

SEQ ID NO: 55983 - DNA, 6 bp, Unknown
  misc_feature (1)..( 6): Matrix.002 file - promoters60/3435902
aaaaaa

SEQ ID NO: 55984 - DNA, 6 bp, Unknown
  misc_feature (1)..( 6): Matrix.002 file - promoters60/3435902
gtcaaa

SEQ ID NO: 55985 - DNA, 6 bp, Unknown
  misc_feature (1)..( 6): Matrix.002 file - promoters60/3435902
ggcgag

SEQ ID NO: 55986 - DNA, 6 bp, Unknown
  misc_feature (1)..( 6): Matrix.002 file - promoters60/3436121
tttaag

SEQ ID NO: 55987 - DNA, 6 bp, Unknown
  misc_feature (1)..( 6): Matrix.002 file - promoters60/3436121
ttcttt

SEQ ID NO: 55988 - DNA, 7 bp, Unknown
  misc_feature (1)..( 7): Matrix.002 file - promoters60/3436121
tctctat

SEQ ID NO: 55989 - DNA, 6 bp, Unknown
  misc_feature (1)..( 6): Matrix.002 file - promoters60/3436121
ctgtgt

SEQ ID NO: 55990 - DNA, 6 bp, Unknown
  misc_feature (1)..( 6): Matrix.002 file - promoters60/3436121
gagaag

SEQ ID NO: 55991 - DNA, 6 bp, Unknown
  misc_feature (1)..( 6): Matrix.002 file - promoters60/3436121
aagaaa

SEQ ID NO: 55992 - DNA, 8 bp, Unknown
  misc_feature (1)..( 8): Matrix.002 file - promoters60/3436121
cacataaa

SEQ ID NO: 55993 - DNA, 7 bp, Unknown
  misc_feature (1)..( 7): Matrix.002 file - promoters60/3436121
tctgttt

SEQ ID NO: 55994 - DNA, 6 bp, Unknown
  misc_feature (1)..( 6): Matrix.002 file - promoters60/3436121
atgtct

SEQ ID NO: 55995 - DNA, 7 bp, Unknown
  misc_feature (1)..( 7): Matrix.002 file - promoters60/3436121
ttggaga

SEQ ID NO: 55996 - DNA, 6 bp, Unknown
  misc_feature (1)..( 6): Matrix.002 file - promoters60/3436121
gaagat

SEQ ID NO: 55997 - DNA, 6 bp, Unknown
  misc_feature (1)..( 6): Matrix.002 file - promoters60/3436121
gatcga

SEQ ID NO: 55998 - DNA, 6 bp, Unknown
  misc_feature (1)..( 6): Matrix.002 file - promoters60/3436121
aaatgc

SEQ ID NO: 55999 - DNA, 8 bp, Unknown
  misc_feature (1)..( 8): Matrix.002 file - promoters60/3436121
ggacttgt

SEQ ID NO: 56000 - DNA, 9 bp, Unknown
  misc_feature (1)..( 9): Matrix.002 file - promoters60/3436196
ccaaaaaaa

SEQ ID NO: 56001 - DNA, 9 bp, Unknown
  misc_feature (1)..( 9): Matrix.002 file - promoters60/3436196
taaaattct

SEQ ID NO: 56002 - DNA, 8 bp, Unknown
  misc_feature (1)..( 8): Matrix.002 file - promoters60/3436196
aatttatt

SEQ ID NO: 56003 - DNA, 8 bp, Unknown
  misc_feature (1)..( 8): Matrix.002 file - promoters60/3436265
taaacttt

SEQ ID NO: 56004 - DNA, 10 bp, Unknown
  misc_feature (1)..( 10): Matrix.002 file - promoters60/3436265
tcaattattt

SEQ ID NO: 56005 - DNA, 9 bp, Unknown
  misc_feature (1)..( 9): Matrix.002 file - promoters60/3436265
attaataat

SEQ ID NO: 56006 - DNA, 9 bp, Unknown
  misc_feature (1)..( 9): Matrix.002 file - promoters60/3436265
cttctttgt

SEQ ID NO: 56007 - DNA, 12 bp, Unknown
  misc_feature (1)..( 12): Matrix.002 file - promoters60/3436265
taaaaaatatta

SEQ ID NO: 56008 - DNA, 8 bp, Unknown
  misc_feature (1)..( 8): Matrix.002 file - promoters60/3436265
aataatat

SEQ ID NO: 56009 - DNA, 13 bp, Unknown
  misc_feature (1)..( 13): Matrix.002 file - promoters60/3436267
attcttaatttca

SEQ ID NO: 56010 - DNA, 6 bp, Unknown
  misc_feature (1)..( 6): Matrix.002 file - promoters60/3436412
ttgtat

SEQ ID NO: 56011 - DNA, 7 bp, Unknown
  misc_feature (1)..( 7): Matrix.002 file - promoters60/3436412
cacggtc

SEQ ID NO: 56012 - DNA, 6 bp, Unknown
  misc_feature (1)..( 6): Matrix.002 file - promoters60/3436412
tctgaa

SEQ ID NO: 56013 - DNA, 6 bp, Unknown
  misc_feature (1)..( 6): Matrix.002 file - promoters60/3436412
ggttta

SEQ ID NO: 56014 - DNA, 6 bp, Unknown
  misc_feature (1)..( 6): Matrix.002 file - promoters60/3436412
ttgact

SEQ ID NO: 56015 - DNA, 6 bp, Unknown
  misc_feature (1)..( 6): Matrix.002 file - promoters60/3436412
ggctgt

SEQ ID NO: 56016 - DNA, 7 bp, Unknown
  misc_feature (1)..( 7): Matrix.002 file - promoters60/3436412
attaaaa

SEQ ID NO: 56017 - DNA, 6 bp, Unknown
  misc_feature (1)..( 6): Matrix.002 file - promoters60/3436412
tgaatt

SEQ ID NO: 56018 - DNA, 7 bp, Unknown
  misc_feature (1)..( 7): Matrix.002 file - promoters60/3436412
aaagcta

SEQ ID NO: 56019 - DNA, 7 bp, Unknown
  misc_feature (1)..( 7): Matrix.002 file - promoters60/3436412
gatcaac

SEQ ID NO: 56020 - DNA, 7 bp, Unknown
  misc_feature (1)..( 7): Matrix.002 file - promoters60/3436412
atacaat

SEQ ID NO: 56021 - DNA, 16 bp, Unknown
  misc_feature (1)..( 16): Matrix.002 file - promoters60/3436412
agaaaacgaattaaat

SEQ ID NO: 56022 - DNA, 7 bp, Unknown
  misc_feature (1)..( 7): Matrix.002 file - promoters60/3436412
attgtat

SEQ ID NO: 56023 - DNA, 6 bp, Unknown
  misc_feature (1)..( 6): Matrix.002 file - promoters60/3436412
aaccac

SEQ ID NO: 56024 - DNA, 8 bp, Unknown
  misc_feature (1)..( 8): Matrix.002 file - promoters60/3436412
cctggatt

SEQ ID NO: 56025 - DNA, 7 bp, Unknown
  misc_feature (1)..( 7): Matrix.002 file - promoters60/3436412
aaaagat

SEQ ID NO: 56026 - DNA, 11 bp, Unknown
  misc_feature (1)..( 11): Matrix.002 file - promoters60/3436481
tacataaaaat

SEQ ID NO: 56027 - DNA, 11 bp, Unknown
  misc_feature (1)..( 11): Matrix.002 file - promoters60/3436481
tatataaaaaa

SEQ ID NO: 56028 - DNA, 9 bp, Unknown
  misc_feature (1)..( 9): Matrix.002 file - promoters60/3436481
aacaaaaaa

SEQ ID NO: 56029 - DNA, 8 bp, Unknown
  misc_feature (1)..( 8): Matrix.002 file - promoters60/3436529
cttccaaa

SEQ ID NO: 56030 - DNA, 10 bp, Unknown
  misc_feature (1)..( 10): Matrix.002 file - promoters60/3436529
aaactacaac

SEQ ID NO: 56031 - DNA, 10 bp, Unknown
  misc_feature (1)..( 10): Matrix.002 file - promoters60/3436529
aaacgtgaaa

SEQ ID NO: 56032 - DNA, 11 bp, Unknown
  misc_feature (1)..( 11): Matrix.002 file - promoters60/3436529
tatatataaag

SEQ ID NO: 56033 - DNA, 12 bp, Unknown
  misc_feature (1)..( 12): Matrix.002 file - promoters60/3436529
actaattagaaa

SEQ ID NO: 56034 - DNA, 9 bp, Unknown
  misc_feature (1)..( 9): Matrix.002 file - promoters60/3436529
tgaatatta

SEQ ID NO: 56035 - DNA, 7 bp, Unknown
  misc_feature (1)..( 7): Matrix.002 file - promoters60/3436655
tccaatg

SEQ ID NO: 56036 - DNA, 6 bp, Unknown
  misc_feature (1)..( 6): Matrix.002 file - promoters60/3436655
atggtt

SEQ ID NO: 56037 - DNA, 10 bp, Unknown
  misc_feature (1)..( 10): Matrix.002 file - promoters60/3436655
ttttgtttct

SEQ ID NO: 56038 - DNA, 6 bp, Unknown
  misc_feature (1)..( 6): Matrix.002 file - promoters60/3436655
tgcaaa

SEQ ID NO: 56039 - DNA, 6 bp, Unknown
  misc_feature (1)..( 6): Matrix.002 file - promoters60/3436655
atcaga

SEQ ID NO: 56040 - DNA, 9 bp, Unknown
  misc_feature (1)..( 9): Matrix.002 file - promoters60/3436655
aaatggaat

SEQ ID NO: 56041 - DNA, 6 bp, Unknown
  misc_feature (1)..( 6): Matrix.002 file - promoters60/3436655
agagtc

SEQ ID NO: 56042 - DNA, 6 bp, Unknown
  misc_feature (1)..( 6): Matrix.002 file - promoters60/3436655
taaaaa

SEQ ID NO: 56043 - DNA, 9 bp, Unknown
  misc_feature (1)..( 9): Matrix.002 file - promoters60/3436655
ataatgttt

SEQ ID NO: 56044 - DNA, 7 bp, Unknown
  misc_feature (1)..( 7): Matrix.002 file - promoters60/3436655
atagata

SEQ ID NO: 56045 - DNA, 7 bp, Unknown
  misc_feature (1)..( 7): Matrix.002 file - promoters60/3436655
accaaat

SEQ ID NO: 56046 - DNA, 6 bp, Unknown
  misc_feature (1)..( 6): Matrix.002 file - promoters60/3436655
tattat

SEQ ID NO: 56047 - DNA, 6 bp, Unknown
  misc_feature (1)..( 6): Matrix.002 file - promoters60/3436655
aaaaaa

SEQ ID NO: 56048 - DNA, 6 bp, Unknown
  misc_feature (1)..( 6): Matrix.002 file - promoters60/3436655
gtcaaa

SEQ ID NO: 56049 - DNA, 6 bp, Unknown
  misc_feature (1)..( 6): Matrix.002 file - promoters60/3436655
ggcgag

SEQ ID NO: 56050 - DNA, 8 bp, Unknown
  misc_feature (1)..( 8): Matrix.002 file - promoters60/3436701
gtccttct

SEQ ID NO: 56051 - DNA, 6 bp, Unknown
  misc_feature (1)..( 6): Matrix.002 file - promoters60/3436701
acatta

SEQ ID NO: 56052 - DNA, 7 bp, Unknown
  misc_feature (1)..( 7): Matrix.002 file - promoters60/3436701
tcagcat

SEQ ID NO: 56053 - DNA, 7 bp, Unknown
  misc_feature (1)..( 7): Matrix.002 file - promoters60/3436701
tctaatt

SEQ ID NO: 56054 - DNA, 6 bp, Unknown
  misc_feature (1)..( 6): Matrix.002 file - promoters60/3436701
agatca

SEQ ID NO: 56055 - DNA, 9 bp, Unknown
  misc_feature (1)..( 9): Matrix.002 file - promoters60/3436701
cacaactat

SEQ ID NO: 56056 - DNA, 8 bp, Unknown
  misc_feature (1)..( 8): Matrix.002 file - promoters60/3436701
ggacgttg

SEQ ID NO: 56057 - DNA, 7 bp, Unknown
  misc_feature (1)..( 7): Matrix.002 file - promoters60/3436701
ttcattt

SEQ ID NO: 56058 - DNA, 6 bp, Unknown
  misc_feature (1)..( 6): Matrix.002 file - promoters60/3436701
aaattg

SEQ ID NO: 56059 - DNA, 7 bp, Unknown
  misc_feature (1)..( 7): Matrix.002 file - promoters60/3436701
tgaggaa

SEQ ID NO: 56060 - DNA, 6 bp, Unknown
  misc_feature (1)..( 6): Matrix.002 file - promoters60/3436701
gaagag

SEQ ID NO: 56061 - DNA, 7 bp, Unknown
  misc_feature (1)..( 7): Matrix.002 file - promoters60/3436701
aaaagag

SEQ ID NO: 56062 - DNA, 10 bp, Unknown
  misc_feature (1)..( 10): Matrix.002 file - promoters60/3437072
tttgtttttc

SEQ ID NO: 56063 - DNA, 7 bp, Unknown
  misc_feature (1)..( 7): Matrix.002 file - promoters60/3437072
tttatta

SEQ ID NO: 56064 - DNA, 6 bp, Unknown
  misc_feature (1)..( 6): Matrix.002 file - promoters60/3437072
taaacc

SEQ ID NO: 56065 - DNA, 6 bp, Unknown
  misc_feature (1)..( 6): Matrix.002 file - promoters60/3437072
tttccc

SEQ ID NO: 56066 - DNA, 6 bp, Unknown
  misc_feature (1)..( 6): Matrix.002 file - promoters60/3437072
taaatt

SEQ ID NO: 56067 - DNA, 8 bp, Unknown
  misc_feature (1)..( 8): Matrix.002 file - promoters60/3437072
caaacaag

SEQ ID NO: 56068 - DNA, 6 bp, Unknown
  misc_feature (1)..( 6): Matrix.002 file - promoters60/3437072
actttt

SEQ ID NO: 56069 - DNA, 8 bp, Unknown
  misc_feature (1)..( 8): Matrix.002 file - promoters60/3437072
ttaaatta

SEQ ID NO: 56070 - DNA, 6 bp, Unknown
  misc_feature (1)..( 6): Matrix.002 file - promoters60/3437072
atttgt

SEQ ID NO: 56071 - DNA, 6 bp, Unknown
  misc_feature (1)..( 6): Matrix.002 file - promoters60/3437072
tctttt

SEQ ID NO: 56072 - DNA, 7 bp, Unknown
  misc_feature (1)..( 7): Matrix.002 file - promoters60/3437072
ttccttt

SEQ ID NO: 56073 - DNA, 8 bp, Unknown
  misc_feature (1)..( 8): Matrix.002 file - promoters60/3437072
agagaaat

SEQ ID NO: 56074 - DNA, 9 bp, Unknown
  misc_feature (1)..( 9): Matrix.002 file - promoters60/3437072
aataaattt

SEQ ID NO: 56075 - DNA, 10 bp, Unknown
  misc_feature (1)..( 10): Matrix.002 file - promoters60/3437072
cgaatttaac

SEQ ID NO: 56076 - DNA, 8 bp, Unknown
  misc_feature (1)..( 8): Matrix.002 file - promoters60/3437072
ttgatgtt

SEQ ID NO: 56077 - DNA, 9 bp, Unknown
  misc_feature (1)..( 9): Matrix.002 file - promoters60/3437087
tgaaagtga

SEQ ID NO: 56078 - DNA, 9 bp, Unknown
  misc_feature (1)..( 9): Matrix.002 file - promoters60/3437087
atggttgaa

SEQ ID NO: 56079 - DNA, 8 bp, Unknown
  misc_feature (1)..( 8): Matrix.002 file - promoters60/3437150
ggaataga

SEQ ID NO: 56080 - DNA, 9 bp, Unknown
  misc_feature (1)..( 9): Matrix.002 file - promoters60/3437150
aaagaagag

SEQ ID NO: 56081 - DNA, 8 bp, Unknown
  misc_feature (1)..( 8): Matrix.002 file - promoters60/3437150
aaaaaaga

SEQ ID NO: 56082 - DNA, 7 bp, Unknown
  misc_feature (1)..( 7): Matrix.002 file - promoters60/3437150
ttataaa

SEQ ID NO: 56083 - DNA, 15 bp, Unknown
  misc_feature (1)..( 15): Matrix.002 file - promoters60/3437150
gtgaatttgaattaa

SEQ ID NO: 56084 - DNA, 9 bp, Unknown
  misc_feature (1)..( 9): Matrix.002 file - promoters60/3437193
ttatagttt

SEQ ID NO: 56085 - DNA, 8 bp, Unknown
  misc_feature (1)..( 8): Matrix.002 file - promoters60/3437193
aaaaaaaa

SEQ ID NO: 56086 - DNA, 9 bp, Unknown
  misc_feature (1)..( 9): Matrix.002 file - promoters60/3437193
aaaaatata

SEQ ID NO: 56087 - DNA, 10 bp, Unknown
  misc_feature (1)..( 10): Matrix.002 file - promoters60/3437193
aaataaaata

SEQ ID NO: 56088 - DNA, 9 bp, Unknown
  misc_feature (1)..( 9): Matrix.002 file - promoters60/3437193
gaaaaaaca

SEQ ID NO: 56089 - DNA, 7 bp, Unknown
  misc_feature (1)..( 7): Matrix.002 file - promoters60/3437193
acatata

SEQ ID NO: 56090 - DNA, 15 bp, Unknown
  misc_feature (1)..( 15): Matrix.002 file - promoters60/3437244
taaaaattcataatc

SEQ ID NO: 56091 - DNA, 9 bp, Unknown
  misc_feature (1)..( 9): Matrix.002 file - promoters60/3437244
aaaaataaa

SEQ ID NO: 56092 - DNA, 12 bp, Unknown
  misc_feature (1)..( 12): Matrix.002 file - promoters60/3437244
aaaaaataaaat

SEQ ID NO: 56093 - DNA, 8 bp, Unknown
  misc_feature (1)..( 8): Matrix.002 file - promoters60/3437244
aaaacaaa

SEQ ID NO: 56094 - DNA, 6 bp, Unknown
  misc_feature (1)..( 6): Matrix.002 file - promoters60/3437244
atatta

SEQ ID NO: 56095 - DNA, 8 bp, Unknown
  misc_feature (1)..( 8): Matrix.002 file - promoters60/3437244
atttttgt

SEQ ID NO: 56096 - DNA, 13 bp, Unknown
  misc_feature (1)..( 13): Matrix.002 file - promoters60/3437244
aaatcaattattt

SEQ ID NO: 56097 - DNA, 5 bp, Unknown
  misc_feature (1)..( 5): Matrix.002 file - promoters60/3437244
cgttt

SEQ ID NO: 56098 - DNA, 15 bp, Unknown
  misc_feature (1)..( 15): Matrix.002 file - promoters60/3437244
tatccaaaatgaaat

SEQ ID NO: 56099 - DNA, 10 bp, Unknown
  misc_feature (1)..( 10): Matrix.002 file - promoters60/3437244
agtttaaaat

SEQ ID NO: 56100 - DNA, 9 bp, Unknown
  misc_feature (1)..( 9): Matrix.002 file - promoters60/3437331
ttatttgtg

SEQ ID NO: 56101 - DNA, 13 bp, Unknown
  misc_feature (1)..( 13): Matrix.002 file - promoters60/3437331
cagaatttgtgcc

SEQ ID NO: 56102 - DNA, 10 bp, Unknown
  misc_feature (1)..( 10): Matrix.002 file - promoters60/3437331
aaacagatta

SEQ ID NO: 56103 - DNA, 9 bp, Unknown
  misc_feature (1)..( 9): Matrix.002 file - promoters60/3437367
ttttcactg

SEQ ID NO: 56104 - DNA, 9 bp, Unknown
  misc_feature (1)..( 9): Matrix.002 file - promoters60/3437367
agttttata

SEQ ID NO: 56105 - DNA, 8 bp, Unknown
  misc_feature (1)..( 8): Matrix.002 file - promoters60/3437367
acaaacaa

SEQ ID NO: 56106 - DNA, 13 bp, Unknown
  misc_feature (1)..( 13): Matrix.002 file - promoters60/3437367
aaaattactaaaa

SEQ ID NO: 56107 - DNA, 8 bp, Unknown
  misc_feature (1)..( 8): Matrix.002 file - promoters60/3437367
attttgaa

SEQ ID NO: 56108 - DNA, 7 bp, Unknown
  misc_feature (1)..( 7): Matrix.002 file - promoters60/3437367
attttaa

SEQ ID NO: 56109 - DNA, 6 bp, Unknown
  misc_feature (1)..( 6): Matrix.002 file - promoters60/3437367
aaaaaa

SEQ ID NO: 56110 - DNA, 14 bp, Unknown
  misc_feature (1)..( 14): Matrix.002 file - promoters60/3437375
catctacttccata

SEQ ID NO: 56111 - DNA, 13 bp, Unknown
  misc_feature (1)..( 13): Matrix.002 file - promoters60/3437375
aaagttttctcta

SEQ ID NO: 56112 - DNA, 11 bp, Unknown
  misc_feature (1)..( 11): Matrix.002 file - promoters60/3437660
gaaatagatta

SEQ ID NO: 56113 - DNA, 8 bp, Unknown
  misc_feature (1)..( 8): Matrix.002 file - promoters60/3437671
atataata

SEQ ID NO: 56114 - DNA, 6 bp, Unknown
  misc_feature (1)..( 6): Matrix.002 file - promoters60/3437671
atttga

SEQ ID NO: 56115 - DNA, 7 bp, Unknown
  misc_feature (1)..( 7): Matrix.002 file - promoters60/3437671
ttaggtg

SEQ ID NO: 56116 - DNA, 6 bp, Unknown
  misc_feature (1)..( 6): Matrix.002 file - promoters60/3437671
aaatgg

SEQ ID NO: 56117 - DNA, 7 bp, Unknown
  misc_feature (1)..( 7): Matrix.002 file - promoters60/3437671
cacctaa

SEQ ID NO: 56118 - DNA, 7 bp, Unknown
  misc_feature (1)..( 7): Matrix.002 file - promoters60/3437671
aaaacga

SEQ ID NO: 56119 - DNA, 10 bp, Unknown
  misc_feature (1)..( 10): Matrix.002 file - promoters60/3437671
ttagataatt

SEQ ID NO: 56120 - DNA, 6 bp, Unknown
  misc_feature (1)..( 6): Matrix.002 file - promoters60/3437671
aaatta

SEQ ID NO: 56121 - DNA, 7 bp, Unknown
  misc_feature (1)..( 7): Matrix.002 file - promoters60/3437671
catctga

SEQ ID NO: 56122 - DNA, 6 bp, Unknown
  misc_feature (1)..( 6): Matrix.002 file - promoters60/3437671
atttat

SEQ ID NO: 56123 - DNA, 6 bp, Unknown
  misc_feature (1)..( 6): Matrix.002 file - promoters60/3437671
tcatat

SEQ ID NO: 56124 - DNA, 8 bp, Unknown
  misc_feature (1)..( 8): Matrix.002 file - promoters60/3437671
atacatac

SEQ ID NO: 56125 - DNA, 6 bp, Unknown
  misc_feature (1)..( 6): Matrix.002 file - promoters60/3437671
ttcaaa

SEQ ID NO: 56126 - DNA, 7 bp, Unknown
  misc_feature (1)..( 7): Matrix.002 file - promoters60/3437776
ctacatt

SEQ ID NO: 56127 - DNA, 8 bp, Unknown
  misc_feature (1)..( 8): Matrix.002 file - promoters60/3437776
ttataaat

SEQ ID NO: 56128 - DNA, 6 bp, Unknown
  misc_feature (1)..( 6): Matrix.002 file - promoters60/3437776
agattt

SEQ ID NO: 56129 - DNA, 7 bp, Unknown
  misc_feature (1)..( 7): Matrix.002 file - promoters60/3437776
atttacc

SEQ ID NO: 56130 - DNA, 8 bp, Unknown
  misc_feature (1)..( 8): Matrix.002 file - promoters60/3437776
atatatga

SEQ ID NO: 56131 - DNA, 7 bp, Unknown
  misc_feature (1)..( 7): Matrix.002 file - promoters60/3437776
tttaata

SEQ ID NO: 56132 - DNA, 6 bp, Unknown
  misc_feature (1)..( 6): Matrix.002 file - promoters60/3437776
gtgtgt

SEQ ID NO: 56133 - DNA, 6 bp, Unknown
  misc_feature (1)..( 6): Matrix.002 file - promoters60/3437776
acagct

SEQ ID NO: 56134 - DNA, 6 bp, Unknown
  misc_feature (1)..( 6): Matrix.002 file - promoters60/3437776
ccatat

SEQ ID NO: 56135 - DNA, 8 bp, Unknown
  misc_feature (1)..( 8): Matrix.002 file - promoters60/3437776
tgcctcag

SEQ ID NO: 56136 - DNA, 7 bp, Unknown
  misc_feature (1)..( 7): Matrix.002 file - promoters60/3437776
ttcggtt

SEQ ID NO: 56137 - DNA, 8 bp, Unknown
  misc_feature (1)..( 8): Matrix.002 file - promoters60/3437776
gtgggtat

SEQ ID NO: 56138 - DNA, 12 bp, Unknown
  misc_feature (1)..( 12): Matrix.002 file - promoters60/3437779
ctaattttagag

SEQ ID NO: 56139 - DNA, 9 bp, Unknown
  misc_feature (1)..( 9): Matrix.002 file - promoters60/3437779
tatgacaaa

SEQ ID NO: 56140 - DNA, 13 bp, Unknown
  misc_feature (1)..( 13): Matrix.002 file - promoters60/3437779
gaaaaatatttac

SEQ ID NO: 56141 - DNA, 10 bp, Unknown
  misc_feature (1)..( 10): Matrix.002 file - promoters60/3437803
gtccaaaaat

SEQ ID NO: 56142 - DNA, 7 bp, Unknown
  misc_feature (1)..( 7): Matrix.002 file - promoters60/3437803
cattttc

SEQ ID NO: 56143 - DNA, 11 bp, Unknown
  misc_feature (1)..( 11): Matrix.002 file - promoters60/3437803
tcacaacttta

SEQ ID NO: 56144 - DNA, 9 bp, Unknown
  misc_feature (1)..( 9): Matrix.002 file - promoters60/3437803
gttgtatat

SEQ ID NO: 56145 - DNA, 12 bp, Unknown
  misc_feature (1)..( 12): Matrix.002 file - promoters60/3437803
tcctatttaaag

SEQ ID NO: 56146 - DNA, 9 bp, Unknown
  misc_feature (1)..( 9): Matrix.002 file - promoters60/3437803
tttacaaga

SEQ ID NO: 56147 - DNA, 9 bp, Unknown
  misc_feature (1)..( 9): Matrix.002 file - promoters60/3437808
aagatttaa

SEQ ID NO: 56148 - DNA, 13 bp, Unknown
  misc_feature (1)..( 13): Matrix.002 file - promoters60/3437871
cataaaagaaaaa

SEQ ID NO: 56149 - DNA, 12 bp, Unknown
  misc_feature (1)..( 12): Matrix.002 file - promoters60/3437871
gaacaaaaaaac

SEQ ID NO: 56150 - DNA, 6 bp, Unknown
  misc_feature (1)..( 6): Matrix.002 file - promoters60/3437875
tataat

SEQ ID NO: 56151 - DNA, 10 bp, Unknown
  misc_feature (1)..( 10): Matrix.002 file - promoters60/3437875
aataaaatta

SEQ ID NO: 56152 - DNA, 7 bp, Unknown
  misc_feature (1)..( 7): Matrix.002 file - promoters60/3437875
ttaatgt

SEQ ID NO: 56153 - DNA, 7 bp, Unknown
  misc_feature (1)..( 7): Matrix.002 file - promoters60/3437875
gtgatgt

SEQ ID NO: 56154 - DNA, 7 bp, Unknown
  misc_feature (1)..( 7): Matrix.002 file - promoters60/3437875
agaccaa

SEQ ID NO: 56155 - DNA, 9 bp, Unknown
  misc_feature (1)..( 9): Matrix.002 file - promoters60/3437875
tcagacttt

SEQ ID NO: 56156 - DNA, 6 bp, Unknown
  misc_feature (1)..( 6): Matrix.002 file - promoters60/3437875
ttctca

SEQ ID NO: 56157 - DNA, 6 bp, Unknown
  misc_feature (1)..( 6): Matrix.002 file - promoters60/3437875
tgtttc

SEQ ID NO: 56158 - DNA, 7 bp, Unknown
  misc_feature (1)..( 7): Matrix.002 file - promoters60/3437991
gatgaca

SEQ ID NO: 56159 - DNA, 8 bp, Unknown
  misc_feature (1)..( 8): Matrix.002 file - promoters60/3437991
aaatcaaa

SEQ ID NO: 56160 - DNA, 8 bp, Unknown
  misc_feature (1)..( 8): Matrix.002 file - promoters60/3437991
aaataatt

SEQ ID NO: 56161 - DNA, 6 bp, Unknown
  misc_feature (1)..( 6): Matrix.002 file - promoters60/3437991
gagaga

SEQ ID NO: 56162 - DNA, 9 bp, Unknown
  misc_feature (1)..( 9): Matrix.002 file - promoters60/3437991
ttttcattt

SEQ ID NO: 56163 - DNA, 6 bp, Unknown
  misc_feature (1)..( 6): Matrix.002 file - promoters60/3437991
taaaaa

SEQ ID NO: 56164 - DNA, 7 bp, Unknown
  misc_feature (1)..( 7): Matrix.002 file - promoters60/3437991
agaaaat

SEQ ID NO: 56165 - DNA, 6 bp, Unknown
  misc_feature (1)..( 6): Matrix.002 file - promoters60/3437991
ttataa

SEQ ID NO: 56166 - DNA, 10 bp, Unknown
  misc_feature (1)..( 10): Matrix.002 file - promoters60/3437991
tgtaataaat

SEQ ID NO: 56167 - DNA, 11 bp, Unknown
  misc_feature (1)..( 11): Matrix.002 file - promoters60/3437991
aataaacaatt

SEQ ID NO: 56168 - DNA, 8 bp, Unknown
  misc_feature (1)..( 8): Matrix.002 file - promoters60/3437991
tcaaaccc

SEQ ID NO: 56169 - DNA, 6 bp, Unknown
  misc_feature (1)..( 6): Matrix.002 file - promoters60/3437991
actaat

SEQ ID NO: 56170 - DNA, 6 bp, Unknown
  misc_feature (1)..( 6): Matrix.002 file - promoters60/3437991
ctattc

SEQ ID NO: 56171 - DNA, 7 bp, Unknown
  misc_feature (1)..( 7): Matrix.002 file - promoters60/3437991
taaatgt

SEQ ID NO: 56172 - DNA, 6 bp, Unknown
  misc_feature (1)..( 6): Matrix.002 file - promoters60/3437991
aatatt

SEQ ID NO: 56173 - DNA, 7 bp, Unknown
  misc_feature (1)..( 7): Matrix.002 file - promoters60/3437991
agaaata

SEQ ID NO: 56174 - DNA, 6 bp, Unknown
  misc_feature (1)..( 6): Matrix.002 file - promoters60/3437991
tgattt

SEQ ID NO: 56175 - DNA, 6 bp, Unknown
  misc_feature (1)..( 6): Matrix.002 file - promoters60/3437991
ctaaac

SEQ ID NO: 56176 - DNA, 6 bp, Unknown
  misc_feature (1)..( 6): Matrix.002 file - promoters60/3437991
attcaa

SEQ ID NO: 56177 - DNA, 8 bp, Unknown
  misc_feature (1)..( 8): Matrix.002 file - promoters60/3437991
attattca

SEQ ID NO: 56178 - DNA, 8 bp, Unknown
  misc_feature (1)..( 8): Matrix.002 file - promoters60/3437991
gtccaaaa

SEQ ID NO: 56179 - DNA, 7 bp, Unknown
  misc_feature (1)..( 7): Matrix.002 file - promoters60/3437991
tagaatt

SEQ ID NO: 56180 - DNA, 6 bp, Unknown
  misc_feature (1)..( 6): Matrix.002 file - promoters60/3437991
gtgatt

SEQ ID NO: 56181 - DNA, 8 bp, Unknown
  misc_feature (1)..( 8): Matrix.002 file - promoters60/3437991
atatattt

SEQ ID NO: 56182 - DNA, 6 bp, Unknown
  misc_feature (1)..( 6): Matrix.002 file - promoters60/3437991
atttaa

SEQ ID NO: 56183 - DNA, 6 bp, Unknown
  misc_feature (1)..( 6): Matrix.002 file - promoters60/3437991
atttat

SEQ ID NO: 56184 - DNA, 9 bp, Unknown
  misc_feature (1)..( 9): Matrix.002 file - promoters60/3437991
aatatatat

SEQ ID NO: 56185 - DNA, 9 bp, Unknown
  misc_feature (1)..( 9): Matrix.002 file - promoters60/3437991
taaaataat

SEQ ID NO: 56186 - DNA, 7 bp, Unknown
  misc_feature (1)..( 7): Matrix.002 file - promoters60/3437991
ttacaca

SEQ ID NO: 56187 - DNA, 6 bp, Unknown
  misc_feature (1)..( 6): Matrix.002 file - promoters60/3437991
aataaa

SEQ ID NO: 56188 - DNA, 7 bp, Unknown
  misc_feature (1)..( 7): Matrix.002 file - promoters60/3437991
tatcaaa

SEQ ID NO: 56189 - DNA, 6 bp, Unknown
  misc_feature (1)..( 6): Matrix.002 file - promoters60/3438046
tttttg

SEQ ID NO: 56190 - DNA, 10 bp, Unknown
  misc_feature (1)..( 10): Matrix.002 file - promoters60/3438046
atgtaagaaa

SEQ ID NO: 56191 - DNA, 11 bp, Unknown
  misc_feature (1)..( 11): Matrix.002 file - promoters60/3438046
cctaaatttat

SEQ ID NO: 56192 - DNA, 6 bp, Unknown
  misc_feature (1)..( 6): Matrix.002 file - promoters60/3438046
atactt

SEQ ID NO: 56193 - DNA, 6 bp, Unknown
  misc_feature (1)..( 6): Matrix.002 file - promoters60/3438046
ctatct

SEQ ID NO: 56194 - DNA, 9 bp, Unknown
  misc_feature (1)..( 9): Matrix.002 file - promoters60/3438046
gaaactaaa

SEQ ID NO: 56195 - DNA, 8 bp, Unknown
  misc_feature (1)..( 8): Matrix.002 file - promoters60/3438046
gaatgcat

SEQ ID NO: 56196 - DNA, 7 bp, Unknown
  misc_feature (1)..( 7): Matrix.002 file - promoters60/3438046
aaacaat

SEQ ID NO: 56197 - DNA, 9 bp, Unknown
  misc_feature (1)..( 9): Matrix.002 file - promoters60/3438046
tgtaaacac

SEQ ID NO: 56198 - DNA, 8 bp, Unknown
  misc_feature (1)..( 8): Matrix.002 file - promoters60/3438046
ttgtcgtg

SEQ ID NO: 56199 - DNA, 7 bp, Unknown
  misc_feature (1)..( 7): Matrix.002 file - promoters60/3438046
tcaaaaa

SEQ ID NO: 56200 - DNA, 7 bp, Unknown
  misc_feature (1)..( 7): Matrix.002 file - promoters60/3438046
caaaaat

SEQ ID NO: 56201 - DNA, 7 bp, Unknown
  misc_feature (1)..( 7): Matrix.002 file - promoters60/3438046
gggaaaa

SEQ ID NO: 56202 - DNA, 8 bp, Unknown
  misc_feature (1)..( 8): Matrix.002 file - promoters60/3438046
ttcgtttc

SEQ ID NO: 56203 - DNA, 7 bp, Unknown
  misc_feature (1)..( 7): Matrix.002 file - promoters60/3438069
agaaagt

SEQ ID NO: 56204 - DNA, 8 bp, Unknown
  misc_feature (1)..( 8): Matrix.002 file - promoters60/3438069
tcaaaatc

SEQ ID NO: 56205 - DNA, 8 bp, Unknown
  misc_feature (1)..( 8): Matrix.002 file - promoters60/3438069
gttaattg

SEQ ID NO: 56206 - DNA, 12 bp, Unknown
  misc_feature (1)..( 12): Matrix.002 file - promoters60/3438171
gtaaaaaaattt

SEQ ID NO: 56207 - DNA, 13 bp, Unknown
  misc_feature (1)..( 13): Matrix.002 file - promoters60/3438171
aaataaaattaaa

SEQ ID NO: 56208 - DNA, 14 bp, Unknown
  misc_feature (1)..( 14): Matrix.002 file - promoters60/3438171
taaataaaaatttt

SEQ ID NO: 56209 - DNA, 9 bp, Unknown
  misc_feature (1)..( 9): Matrix.002 file - promoters60/3438171
atttaaata

SEQ ID NO: 56210 - DNA, 19 bp, Unknown
  misc_feature (1)..( 19): Matrix.002 file - promoters60/3438171
caaaaatattcaaaacaat

SEQ ID NO: 56211 - DNA, 11 bp, Unknown
  misc_feature (1)..( 11): Matrix.002 file - promoters60/3438171
ttaatatatat

SEQ ID NO: 56212 - DNA, 11 bp, Unknown
  misc_feature (1)..( 11): Matrix.002 file - promoters60/3438171
ttaatattaaa

SEQ ID NO: 56213 - DNA, 10 bp, Unknown
  misc_feature (1)..( 10): Matrix.002 file - promoters60/3438171
ctttttatta

SEQ ID NO: 56214 - DNA, 9 bp, Unknown
  misc_feature (1)..( 9): Matrix.002 file - promoters60/3438171
taaattttc

SEQ ID NO: 56215 - DNA, 10 bp, Unknown
  misc_feature (1)..( 10): Matrix.002 file - promoters60/3438171
aaaataaaaa

SEQ ID NO: 56216 - DNA, 10 bp, Unknown
  misc_feature (1)..( 10): Matrix.002 file - promoters60/3438171
gagaaatttt

SEQ ID NO: 56217 - DNA, 9 bp, Unknown
  misc_feature (1)..( 9): Matrix.002 file - promoters60/3438171
aacaaaaaa

SEQ ID NO: 56218 - DNA, 13 bp, Unknown
  misc_feature (1)..( 13): Matrix.002 file - promoters60/3438171
cacttatatataa

SEQ ID NO: 56219 - DNA, 8 bp, Unknown
  misc_feature (1)..( 8): Matrix.002 file - promoters60/3438222
aataatta

SEQ ID NO: 56220 - DNA, 8 bp, Unknown
  misc_feature (1)..( 8): Matrix.002 file - promoters60/3438222
ctacacaa

SEQ ID NO: 56221 - DNA, 7 bp, Unknown
  misc_feature (1)..( 7): Matrix.002 file - promoters60/3438222
aagaaac

SEQ ID NO: 56222 - DNA, 7 bp, Unknown
  misc_feature (1)..( 7): Matrix.002 file - promoters60/3438222
ggtggta

SEQ ID NO: 56223 - DNA, 8 bp, Unknown
  misc_feature (1)..( 8): Matrix.002 file - promoters60/3438222
attgatgt

SEQ ID NO: 56224 - DNA, 6 bp, Unknown
  misc_feature (1)..( 6): Matrix.002 file - promoters60/3438222
attact

SEQ ID NO: 56225 - DNA, 7 bp, Unknown
  misc_feature (1)..( 7): Matrix.002 file - promoters60/3438222
gatcttt

SEQ ID NO: 56226 - DNA, 6 bp, Unknown
  misc_feature (1)..( 6): Matrix.002 file - promoters60/3438222
caactg

SEQ ID NO: 56227 - DNA, 6 bp, Unknown
  misc_feature (1)..( 6): Matrix.002 file - promoters60/3438222
tgaaaa

SEQ ID NO: 56228 - DNA, 8 bp, Unknown
  misc_feature (1)..( 8): Matrix.002 file - promoters60/3438222
tatcaaat

SEQ ID NO: 56229 - DNA, 6 bp, Unknown
  misc_feature (1)..( 6): Matrix.002 file - promoters60/3438222
taagag

SEQ ID NO: 56230 - DNA, 6 bp, Unknown
  misc_feature (1)..( 6): Matrix.002 file - promoters60/3438222
taaaaa

SEQ ID NO: 56231 - DNA, 6 bp, Unknown
  misc_feature (1)..( 6): Matrix.002 file - promoters60/3438222
caagtg

SEQ ID NO: 56232 - DNA, 8 bp, Unknown
  misc_feature (1)..( 8): Matrix.002 file - promoters60/3438222
aaaacatc

SEQ ID NO: 56233 - DNA, 7 bp, Unknown
  misc_feature (1)..( 7): Matrix.002 file - promoters60/3438222
aaaaaat

SEQ ID NO: 56234 - DNA, 6 bp, Unknown
  misc_feature (1)..( 6): Matrix.002 file - promoters60/3438222
aacaat

SEQ ID NO: 56235 - DNA, 6 bp, Unknown
  misc_feature (1)..( 6): Matrix.002 file - promoters60/3438222
catgtt

SEQ ID NO: 56236 - DNA, 7 bp, Unknown
  misc_feature (1)..( 7): Matrix.002 file - promoters60/3438222
aaaataa

SEQ ID NO: 56237 - DNA, 6 bp, Unknown
  misc_feature (1)..( 6): Matrix.002 file - promoters60/3438222
ccacgt

SEQ ID NO: 56238 - DNA, 6 bp, Unknown
  misc_feature (1)..( 6): Matrix.002 file - promoters60/3438222
tttctt

SEQ ID NO: 56239 - DNA, 8 bp, Unknown
  misc_feature (1)..( 8): Matrix.002 file - promoters60/3438236
attctaat

SEQ ID NO: 56240 - DNA, 9 bp, Unknown
  misc_feature (1)..( 9): Matrix.002 file - promoters60/3438351
ttcaatagt

SEQ ID NO: 56241 - DNA, 6 bp, Unknown
  misc_feature (1)..( 6): Matrix.002 file - promoters60/3438351
attttt

SEQ ID NO: 56242 - DNA, 5 bp, Unknown
  misc_feature (1)..( 5): Matrix.002 file - promoters60/3438351
caaaa

SEQ ID NO: 56243 - DNA, 7 bp, Unknown
  misc_feature (1)..( 7): Matrix.002 file - promoters60/3438351
agaatca

SEQ ID NO: 56244 - DNA, 7 bp, Unknown
  misc_feature (1)..( 7): Matrix.002 file - promoters60/3438351
attacaa

SEQ ID NO: 56245 - DNA, 6 bp, Unknown
  misc_feature (1)..( 6): Matrix.002 file - promoters60/3438351
attatt

SEQ ID NO: 56246 - DNA, 9 bp, Unknown
  misc_feature (1)..( 9): Matrix.002 file - promoters60/3438351
atcaaacta

SEQ ID NO: 56247 - DNA, 9 bp, Unknown
  misc_feature (1)..( 9): Matrix.002 file - promoters60/3438351
tttgatcct

SEQ ID NO: 56248 - DNA, 6 bp, Unknown
  misc_feature (1)..( 6): Matrix.002 file - promoters60/3438351
ttttaa

SEQ ID NO: 56249 - DNA, 7 bp, Unknown
  misc_feature (1)..( 7): Matrix.002 file - promoters60/3438351
taaaaat

SEQ ID NO: 56250 - DNA, 6 bp, Unknown
  misc_feature (1)..( 6): Matrix.002 file - promoters60/3438351
aaatca

SEQ ID NO: 56251 - DNA, 7 bp, Unknown
  misc_feature (1)..( 7): Matrix.002 file - promoters60/3438351
aaaagtc

SEQ ID NO: 56252 - DNA, 9 bp, Unknown
  misc_feature (1)..( 9): Matrix.002 file - promoters60/3438351
taaaaattt

SEQ ID NO: 56253 - DNA, 7 bp, Unknown
  misc_feature (1)..( 7): Matrix.002 file - promoters60/3438351
tcttctt

SEQ ID NO: 56254 - DNA, 7 bp, Unknown
  misc_feature (1)..( 7): Matrix.002 file - promoters60/3438351
tcagatt

SEQ ID NO: 56255 - DNA, 6 bp, Unknown
  misc_feature (1)..( 6): Matrix.002 file - promoters60/3438351
ttgttt

SEQ ID NO: 56256 - DNA, 7 bp, Unknown
  misc_feature (1)..( 7): Matrix.002 file - promoters60/3438351
tttcttt

SEQ ID NO: 56257 - DNA, 6 bp, Unknown
  misc_feature (1)..( 6): Matrix.002 file - promoters60/3438351
cttata

SEQ ID NO: 56258 - DNA, 8 bp, Unknown
  misc_feature (1)..( 8): Matrix.002 file - promoters60/3438351
gtttgctt

SEQ ID NO: 56259 - DNA, 7 bp, Unknown
  misc_feature (1)..( 7): Matrix.002 file - promoters60/3438351
tgacaaa

SEQ ID NO: 56260 - DNA, 8 bp, Unknown
  misc_feature (1)..( 8): Matrix.002 file - promoters60/3438369
aaataaaa

SEQ ID NO: 56261 - DNA, 7 bp, Unknown
  misc_feature (1)..( 7): Matrix.002 file - promoters60/3438373
ttgcttc

SEQ ID NO: 56262 - DNA, 7 bp, Unknown
  misc_feature (1)..( 7): Matrix.002 file - promoters60/3438373
ggaacaa

SEQ ID NO: 56263 - DNA, 7 bp, Unknown
  misc_feature (1)..( 7): Matrix.002 file - promoters60/3438373
acaagat

SEQ ID NO: 56264 - DNA, 7 bp, Unknown
  misc_feature (1)..( 7): Matrix.002 file - promoters60/3438373
attacat

SEQ ID NO: 56265 - DNA, 6 bp, Unknown
  misc_feature (1)..( 6): Matrix.002 file - promoters60/3438373
ttgtaa

SEQ ID NO: 56266 - DNA, 6 bp, Unknown
  misc_feature (1)..( 6): Matrix.002 file - promoters60/3438373
gaaaat

SEQ ID NO: 56267 - DNA, 8 bp, Unknown
  misc_feature (1)..( 8): Matrix.002 file - promoters60/3438373
gttcctaa

SEQ ID NO: 56268 - DNA, 7 bp, Unknown
  misc_feature (1)..( 7): Matrix.002 file - promoters60/3438373
aatcaat

SEQ ID NO: 56269 - DNA, 8 bp, Unknown
  misc_feature (1)..( 8): Matrix.002 file - promoters60/3438373
atatctta

SEQ ID NO: 56270 - DNA, 6 bp, Unknown
  misc_feature (1)..( 6): Matrix.002 file - promoters60/3438373
gttcgt

SEQ ID NO: 56271 - DNA, 9 bp, Unknown
  misc_feature (1)..( 9): Matrix.002 file - promoters60/3438373
tgaatcgaa

SEQ ID NO: 56272 - DNA, 7 bp, Unknown
  misc_feature (1)..( 7): Matrix.002 file - promoters60/3438373
agaaaaa

SEQ ID NO: 56273 - DNA, 6 bp, Unknown
  misc_feature (1)..( 6): Matrix.002 file - promoters60/3438373
agtaaa

SEQ ID NO: 56274 - DNA, 7 bp, Unknown
  misc_feature (1)..( 7): Matrix.002 file - promoters60/3438373
aatcggg

SEQ ID NO: 56275 - DNA, 8 bp, Unknown
  misc_feature (1)..( 8): Matrix.002 file - promoters60/3438373
gaaacaaa

SEQ ID NO: 56276 - DNA, 10 bp, Unknown
  misc_feature (1)..( 10): Matrix.002 file - promoters60/3438373
ggaaaagaaa

SEQ ID NO: 56277 - DNA, 7 bp, Unknown
  misc_feature (1)..( 7): Matrix.002 file - promoters60/3438373
cccacta

SEQ ID NO: 56278 - DNA, 9 bp, Unknown
  misc_feature (1)..( 9): Matrix.002 file - promoters60/3438373
aaagaaaag

SEQ ID NO: 56279 - DNA, 7 bp, Unknown
  misc_feature (1)..( 7): Matrix.002 file - promoters60/3438373
gtatata

SEQ ID NO: 56280 - DNA, 7 bp, Unknown
  misc_feature (1)..( 7): Matrix.002 file - promoters60/3438420
ttccttt

SEQ ID NO: 56281 - DNA, 8 bp, Unknown
  misc_feature (1)..( 8): Matrix.002 file - promoters60/3438420
tttatctc

SEQ ID NO: 56282 - DNA, 6 bp, Unknown
  misc_feature (1)..( 6): Matrix.002 file - promoters60/3438420
tctcaa

SEQ ID NO: 56283 - DNA, 7 bp, Unknown
  misc_feature (1)..( 7): Matrix.002 file - promoters60/3438420
ttttaga

SEQ ID NO: 56284 - DNA, 11 bp, Unknown
  misc_feature (1)..( 11): Matrix.002 file - promoters60/3438420
atcaaaatcat

SEQ ID NO: 56285 - DNA, 9 bp, Unknown
  misc_feature (1)..( 9): Matrix.002 file - promoters60/3438420
ccagtattc

SEQ ID NO: 56286 - DNA, 8 bp, Unknown
  misc_feature (1)..( 8): Matrix.002 file - promoters60/3438420
gattttac

SEQ ID NO: 56287 - DNA, 6 bp, Unknown
  misc_feature (1)..( 6): Matrix.002 file - promoters60/3438420
ttttgg

SEQ ID NO: 56288 - DNA, 7 bp, Unknown
  misc_feature (1)..( 7): Matrix.002 file - promoters60/3438420
ttttttt

SEQ ID NO: 56289 - DNA, 6 bp, Unknown
  misc_feature (1)..( 6): Matrix.002 file - promoters60/3438420
tcactt

SEQ ID NO: 56290 - DNA, 6 bp, Unknown
  misc_feature (1)..( 6): Matrix.002 file - promoters60/3438420
ggtaaa

SEQ ID NO: 56291 - DNA, 6 bp, Unknown
  misc_feature (1)..( 6): Matrix.002 file - promoters60/3438420
tgtgtt

SEQ ID NO: 56292 - DNA, 6 bp, Unknown
  misc_feature (1)..( 6): Matrix.002 file - promoters60/3438420
tttttt

SEQ ID NO: 56293 - DNA, 6 bp, Unknown
  misc_feature (1)..( 6): Matrix.002 file - promoters60/3438420
cttttt

SEQ ID NO: 56294 - DNA, 8 bp, Unknown
  misc_feature (1)..( 8): Matrix.002 file - promoters60/3438420
aaatgtaa

SEQ ID NO: 56295 - DNA, 6 bp, Unknown
  misc_feature (1)..( 6): Matrix.002 file - promoters60/3438420
ttatat

SEQ ID NO: 56296 - DNA, 7 bp, Unknown
  misc_feature (1)..( 7): Matrix.002 file - promoters60/3438420
ttttaga

SEQ ID NO: 56297 - DNA, 6 bp, Unknown
  misc_feature (1)..( 6): Matrix.002 file - promoters60/3438420
aaaata

SEQ ID NO: 56298 - DNA, 7 bp, Unknown
  misc_feature (1)..( 7): Matrix.002 file - promoters60/3438420
aaccaac

SEQ ID NO: 56299 - DNA, 8 bp, Unknown
  misc_feature (1)..( 8): Matrix.002 file - promoters60/3438429
aacagaga

SEQ ID NO: 56300 - DNA, 6 bp, Unknown
  misc_feature (1)..( 6): Matrix.002 file - promoters60/3438429
taaaaa

SEQ ID NO: 56301 - DNA, 7 bp, Unknown
  misc_feature (1)..( 7): Matrix.002 file - promoters60/3438429
ttcatct

SEQ ID NO: 56302 - DNA, 6 bp, Unknown
  misc_feature (1)..( 6): Matrix.002 file - promoters60/3438429
aaaatt

SEQ ID NO: 56303 - DNA, 8 bp, Unknown
  misc_feature (1)..( 8): Matrix.002 file - promoters60/3438429
aaaacaat

SEQ ID NO: 56304 - DNA, 8 bp, Unknown
  misc_feature (1)..( 8): Matrix.002 file - promoters60/3438429
aaaatgag

SEQ ID NO: 56305 - DNA, 7 bp, Unknown
  misc_feature (1)..( 7): Matrix.002 file - promoters60/3438429
tgagttt

SEQ ID NO: 56306 - DNA, 8 bp, Unknown
  misc_feature (1)..( 8): Matrix.002 file - promoters60/3438429
agaaattg

SEQ ID NO: 56307 - DNA, 10 bp, Unknown
  misc_feature (1)..( 10): Matrix.002 file - promoters60/3438429
ttgccactct

SEQ ID NO: 56308 - DNA, 6 bp, Unknown
  misc_feature (1)..( 6): Matrix.002 file - promoters60/3438429
tcttct

SEQ ID NO: 56309 - DNA, 7 bp, Unknown
  misc_feature (1)..( 7): Matrix.002 file - promoters60/3438429
ttccaaa

SEQ ID NO: 56310 - DNA, 6 bp, Unknown
  misc_feature (1)..( 6): Matrix.002 file - promoters60/3438429
agaaaa

SEQ ID NO: 56311 - DNA, 6 bp, Unknown
  misc_feature (1)..( 6): Matrix.002 file - promoters60/3438429
aaaagt

SEQ ID NO: 56312 - DNA, 8 bp, Unknown
  misc_feature (1)..( 8): Matrix.002 file - promoters60/3438429
tttaattt

SEQ ID NO: 56313 - DNA, 8 bp, Unknown
  misc_feature (1)..( 8): Matrix.002 file - promoters60/3438429
tttagttt

SEQ ID NO: 56314 - DNA, 7 bp, Unknown
  misc_feature (1)..( 7): Matrix.002 file - promoters60/3438429
tttattt

SEQ ID NO: 56315 - DNA, 6 bp, Unknown
  misc_feature (1)..( 6): Matrix.002 file - promoters60/3438429
caaacc

SEQ ID NO: 56316 - DNA, 7 bp, Unknown
  misc_feature (1)..( 7): Matrix.002 file - promoters60/3438429
tttaggt

SEQ ID NO: 56317 - DNA, 6 bp, Unknown
  misc_feature (1)..( 6): Matrix.002 file - promoters60/3438429
ttcagt

SEQ ID NO: 56318 - DNA, 6 bp, Unknown
  misc_feature (1)..( 6): Matrix.002 file - promoters60/3438494
ggagga

SEQ ID NO: 56319 - DNA, 6 bp, Unknown
  misc_feature (1)..( 6): Matrix.002 file - promoters60/3438494
ttaatt

SEQ ID NO: 56320 - DNA, 7 bp, Unknown
  misc_feature (1)..( 7): Matrix.002 file - promoters60/3438494
caaagag

SEQ ID NO: 56321 - DNA, 7 bp, Unknown
  misc_feature (1)..( 7): Matrix.002 file - promoters60/3438494
tataaaa

SEQ ID NO: 56322 - DNA, 7 bp, Unknown
  misc_feature (1)..( 7): Matrix.002 file - promoters60/3438494
acaaaat

SEQ ID NO: 56323 - DNA, 7 bp, Unknown
  misc_feature (1)..( 7): Matrix.002 file - promoters60/3438494
atgaaat

SEQ ID NO: 56324 - DNA, 6 bp, Unknown
  misc_feature (1)..( 6): Matrix.002 file - promoters60/3438494
aagttg

SEQ ID NO: 56325 - DNA, 7 bp, Unknown
  misc_feature (1)..( 7): Matrix.002 file - promoters60/3438494
gttgaac

SEQ ID NO: 56326 - DNA, 12 bp, Unknown
  misc_feature (1)..( 12): Matrix.002 file - promoters60/3438494
atatatataaag

SEQ ID NO: 56327 - DNA, 8 bp, Unknown
  misc_feature (1)..( 8): Matrix.002 file - promoters60/3438494
tttaagtt

SEQ ID NO: 56328 - DNA, 9 bp, Unknown
  misc_feature (1)..( 9): Matrix.002 file - promoters60/3438494
acatggttt

SEQ ID NO: 56329 - DNA, 7 bp, Unknown
  misc_feature (1)..( 7): Matrix.002 file - promoters60/3438494
aaacata

SEQ ID NO: 56330 - DNA, 7 bp, Unknown
  misc_feature (1)..( 7): Matrix.002 file - promoters60/3438494
atataca

SEQ ID NO: 56331 - DNA, 7 bp, Unknown
  misc_feature (1)..( 7): Matrix.002 file - promoters60/3438494
ttaagtt

SEQ ID NO: 56332 - DNA, 7 bp, Unknown
  misc_feature (1)..( 7): Matrix.002 file - promoters60/3438494
taaaact

SEQ ID NO: 56333 - DNA, 6 bp, Unknown
  misc_feature (1)..( 6): Matrix.002 file - promoters60/3438494
gaaaaa

SEQ ID NO: 56334 - DNA, 6 bp, Unknown
  misc_feature (1)..( 6): Matrix.002 file - promoters60/3438494
aattca

SEQ ID NO: 56335 - DNA, 8 bp, Unknown
  misc_feature (1)..( 8): Matrix.002 file - promoters60/3438494
agtatttt

SEQ ID NO: 56336 - DNA, 7 bp, Unknown
  misc_feature (1)..( 7): Matrix.002 file - promoters60/3438494
attaaaa

SEQ ID NO: 56337 - DNA, 7 bp, Unknown
  misc_feature (1)..( 7): Matrix.002 file - promoters60/3438505
gttcctt

SEQ ID NO: 56338 - DNA, 8 bp, Unknown
  misc_feature (1)..( 8): Matrix.002 file - promoters60/3438505
gttgattc

SEQ ID NO: 56339 - DNA, 8 bp, Unknown
  misc_feature (1)..( 8): Matrix.002 file - promoters60/3438505
cgacatgt

SEQ ID NO: 56340 - DNA, 8 bp, Unknown
  misc_feature (1)..( 8): Matrix.002 file - promoters60/3438505
tacacata

SEQ ID NO: 56341 - DNA, 6 bp, Unknown
  misc_feature (1)..( 6): Matrix.002 file - promoters60/3438512
caaatc

SEQ ID NO: 56342 - DNA, 12 bp, Unknown
  misc_feature (1)..( 12): Matrix.002 file - promoters60/3438512
caacaatgtaca

SEQ ID NO: 56343 - DNA, 14 bp, Unknown
  misc_feature (1)..( 14): Matrix.002 file - promoters60/3438512
aacttttacttatt

SEQ ID NO: 56344 - DNA, 7 bp, Unknown
  misc_feature (1)..( 7): Matrix.002 file - promoters60/3438512
attataa

SEQ ID NO: 56345 - DNA, 6 bp, Unknown
  misc_feature (1)..( 6): Matrix.002 file - promoters60/3438518
aaaata

SEQ ID NO: 56346 - DNA, 6 bp, Unknown
  misc_feature (1)..( 6): Matrix.002 file - promoters60/3438518
ttaaaa

SEQ ID NO: 56347 - DNA, 7 bp, Unknown
  misc_feature (1)..( 7): Matrix.002 file - promoters60/3438518
aaaatta

SEQ ID NO: 56348 - DNA, 9 bp, Unknown
  misc_feature (1)..( 9): Matrix.002 file - promoters60/3438518
aatacattt

SEQ ID NO: 56349 - DNA, 6 bp, Unknown
  misc_feature (1)..( 6): Matrix.002 file - promoters60/3438518
tcctct

SEQ ID NO: 56350 - DNA, 8 bp, Unknown
  misc_feature (1)..( 8): Matrix.002 file - promoters60/3438518
tatatata

SEQ ID NO: 56351 - DNA, 6 bp, Unknown
  misc_feature (1)..( 6): Matrix.002 file - promoters60/3438518
aataaa

SEQ ID NO: 56352 - DNA, 6 bp, Unknown
  misc_feature (1)..( 6): Matrix.002 file - promoters60/3438518
ctaacc

SEQ ID NO: 56353 - DNA, 6 bp, Unknown
  misc_feature (1)..( 6): Matrix.002 file - promoters60/3438518
attagt

SEQ ID NO: 56354 - DNA, 6 bp, Unknown
  misc_feature (1)..( 6): Matrix.002 file - promoters60/3438518
ttaaca

SEQ ID NO: 56355 - DNA, 6 bp, Unknown
  misc_feature (1)..( 6): Matrix.002 file - promoters60/3438518
taagaa

SEQ ID NO: 56356 - DNA, 6 bp, Unknown
  misc_feature (1)..( 6): Matrix.002 file - promoters60/3438518
gataga

SEQ ID NO: 56357 - DNA, 9 bp, Unknown
  misc_feature (1)..( 9): Matrix.002 file - promoters60/3438518
gagtggagt

SEQ ID NO: 56358 - DNA, 8 bp, Unknown
  misc_feature (1)..( 8): Matrix.002 file - promoters60/3438518
gacgaaaa

SEQ ID NO: 56359 - DNA, 6 bp, Unknown
  misc_feature (1)..( 6): Matrix.002 file - promoters60/3438518
cgattt

SEQ ID NO: 56360 - DNA, 7 bp, Unknown
  misc_feature (1)..( 7): Matrix.002 file - promoters60/3438518
tcaattt

SEQ ID NO: 56361 - DNA, 7 bp, Unknown
  misc_feature (1)..( 7): Matrix.002 file - promoters60/3438518
tttgaat

SEQ ID NO: 56362 - DNA, 6 bp, Unknown
  misc_feature (1)..( 6): Matrix.002 file - promoters60/3438518
aataaa

SEQ ID NO: 56363 - DNA, 8 bp, Unknown
  misc_feature (1)..( 8): Matrix.002 file - promoters60/3438518
aaatagaa

SEQ ID NO: 56364 - DNA, 7 bp, Unknown
  misc_feature (1)..( 7): Matrix.002 file - promoters60/3438518
aatattt

SEQ ID NO: 56365 - DNA, 6 bp, Unknown
  misc_feature (1)..( 6): Matrix.002 file - promoters60/3438518
agcttc

SEQ ID NO: 56366 - DNA, 7 bp, Unknown
  misc_feature (1)..( 7): Matrix.002 file - promoters60/3438518
acacaaa

SEQ ID NO: 56367 - DNA, 11 bp, Unknown
  misc_feature (1)..( 11): Matrix.002 file - promoters60/3438594
gaaaaacttct

SEQ ID NO: 56368 - DNA, 9 bp, Unknown
  misc_feature (1)..( 9): Matrix.002 file - promoters60/3438594
aaataaaaa

SEQ ID NO: 56369 - DNA, 11 bp, Unknown
  misc_feature (1)..( 11): Matrix.002 file - promoters60/3438594
aaaataaaaat

SEQ ID NO: 56370 - DNA, 9 bp, Unknown
  misc_feature (1)..( 9): Matrix.002 file - promoters60/3438594
aattaatta

SEQ ID NO: 56371 - DNA, 9 bp, Unknown
  misc_feature (1)..( 9): Matrix.002 file - promoters60/3438594
aaagaaaag

SEQ ID NO: 56372 - DNA, 12 bp, Unknown
  misc_feature (1)..( 12): Matrix.002 file - promoters60/3438594
aaaataaaaata

SEQ ID NO: 56373 - DNA, 9 bp, Unknown
  misc_feature (1)..( 9): Matrix.002 file - promoters60/3438594
agaaaaata

SEQ ID NO: 56374 - DNA, 12 bp, Unknown
  misc_feature (1)..( 12): Matrix.002 file - promoters60/3438594
agtaaacaaaat

SEQ ID NO: 56375 - DNA, 11 bp, Unknown
  misc_feature (1)..( 11): Matrix.002 file - promoters60/3438594
aaaaaaagatc

SEQ ID NO: 56376 - DNA, 9 bp, Unknown
  misc_feature (1)..( 9): Matrix.002 file - promoters60/3438594
ttatttatg

SEQ ID NO: 56377 - DNA, 9 bp, Unknown
  misc_feature (1)..( 9): Matrix.002 file - promoters60/3438648
agaaaaaaa

SEQ ID NO: 56378 - DNA, 7 bp, Unknown
  misc_feature (1)..( 7): Matrix.002 file - promoters60/3438919
ggtctat

SEQ ID NO: 56379 - DNA, 9 bp, Unknown
  misc_feature (1)..( 9): Matrix.002 file - promoters60/3438919
tttaatcaa

SEQ ID NO: 56380 - DNA, 6 bp, Unknown
  misc_feature (1)..( 6): Matrix.002 file - promoters60/3438919
taatta

SEQ ID NO: 56381 - DNA, 6 bp, Unknown
  misc_feature (1)..( 6): Matrix.002 file - promoters60/3438919
ttaaaa

SEQ ID NO: 56382 - DNA, 6 bp, Unknown
  misc_feature (1)..( 6): Matrix.002 file - promoters60/3438919
aaaaaa

SEQ ID NO: 56383 - DNA, 9 bp, Unknown
  misc_feature (1)..( 9): Matrix.002 file - promoters60/3438919
tttaatcaa

SEQ ID NO: 56384 - DNA, 6 bp, Unknown
  misc_feature (1)..( 6): Matrix.002 file - promoters60/3438919
gacgtg

SEQ ID NO: 56385 - DNA, 7 bp, Unknown
  misc_feature (1)..( 7): Matrix.002 file - promoters60/3438919
tttatta

SEQ ID NO: 56386 - DNA, 7 bp, Unknown
  misc_feature (1)..( 7): Matrix.002 file - promoters60/3438919
attaggc

SEQ ID NO: 56387 - DNA, 7 bp, Unknown
  misc_feature (1)..( 7): Matrix.002 file - promoters60/3438919
ttaaaaa

SEQ ID NO: 56388 - DNA, 7 bp, Unknown
  misc_feature (1)..( 7): Matrix.002 file - promoters60/3438919
aatacat

SEQ ID NO: 56389 - DNA, 8 bp, Unknown
  misc_feature (1)..( 8): Matrix.002 file - promoters60/3438919
ctgacaaa

SEQ ID NO: 56390 - DNA, 8 bp, Unknown
  misc_feature (1)..( 8): Matrix.002 file - promoters60/3438927
tgttgtgc

SEQ ID NO: 56391 - DNA, 12 bp, Unknown
  misc_feature (1)..( 12): Matrix.002 file - promoters60/3438927
tttcaaggattc

SEQ ID NO: 56392 - DNA, 6 bp, Unknown
  misc_feature (1)..( 6): Matrix.002 file - promoters60/3438927
ttcata

SEQ ID NO: 56393 - DNA, 7 bp, Unknown
  misc_feature (1)..( 7): Matrix.002 file - promoters60/3438927
aaagaca

SEQ ID NO: 56394 - DNA, 9 bp, Unknown
  misc_feature (1)..( 9): Matrix.002 file - promoters60/3438927
ataagtaaa

SEQ ID NO: 56395 - DNA, 8 bp, Unknown
  misc_feature (1)..( 8): Matrix.002 file - promoters60/3438927
tcacttta

SEQ ID NO: 56396 - DNA, 9 bp, Unknown
  misc_feature (1)..( 9): Matrix.002 file - promoters60/3438927
aaaaaaaat

SEQ ID NO: 56397 - DNA, 6 bp, Unknown
  misc_feature (1)..( 6): Matrix.002 file - promoters60/3438927
gaagaa

SEQ ID NO: 56398 - DNA, 8 bp, Unknown
  misc_feature (1)..( 8): Matrix.002 file - promoters60/3438927
attagttt

SEQ ID NO: 56399 - DNA, 7 bp, Unknown
  misc_feature (1)..( 7): Matrix.002 file - promoters60/3438927
tattttt

SEQ ID NO: 56400 - DNA, 9 bp, Unknown
  misc_feature (1)..( 9): Matrix.002 file - promoters60/3438927
aaaaaaaaa

SEQ ID NO: 56401 - DNA, 6 bp, Unknown
  misc_feature (1)..( 6): Matrix.002 file - promoters60/3438927
taaaac

SEQ ID NO: 56402 - DNA, 8 bp, Unknown
  misc_feature (1)..( 8): Matrix.002 file - promoters60/3438927
agtaaaaa

SEQ ID NO: 56403 - DNA, 8 bp, Unknown
  misc_feature (1)..( 8): Matrix.002 file - promoters60/3438927
attatgtt

SEQ ID NO: 56404 - DNA, 13 bp, Unknown
  misc_feature (1)..( 13): Matrix.002 file - promoters60/3438927
gaaatatcttaac

SEQ ID NO: 56405 - DNA, 7 bp, Unknown
  misc_feature (1)..( 7): Matrix.002 file - promoters60/3438927
aacaaat

SEQ ID NO: 56406 - DNA, 6 bp, Unknown
  misc_feature (1)..( 6): Matrix.002 file - promoters60/3438927
aagaaa

SEQ ID NO: 56407 - DNA, 7 bp, Unknown
  misc_feature (1)..( 7): Matrix.002 file - promoters60/3438927
ttaatgt

SEQ ID NO: 56408 - DNA, 7 bp, Unknown
  misc_feature (1)..( 7): Matrix.002 file - promoters60/3438927
aatcggg

SEQ ID NO: 56409 - DNA, 8 bp, Unknown
  misc_feature (1)..( 8): Matrix.002 file - promoters60/3438927
gaaacaaa

SEQ ID NO: 56410 - DNA, 10 bp, Unknown
  misc_feature (1)..( 10): Matrix.002 file - promoters60/3438927
ggaaaagaaa

SEQ ID NO: 56411 - DNA, 7 bp, Unknown
  misc_feature (1)..( 7): Matrix.002 file - promoters60/3438927
cccacta

SEQ ID NO: 56412 - DNA, 9 bp, Unknown
  misc_feature (1)..( 9): Matrix.002 file - promoters60/3438927
aaagaaaag

SEQ ID NO: 56413 - DNA, 7 bp, Unknown
  misc_feature (1)..( 7): Matrix.002 file - promoters60/3438927
gtatata

SEQ ID NO: 56414 - DNA, 7 bp, Unknown
  misc_feature (1)..( 7): Matrix.002 file - promoters60/3438946
agaaagt

SEQ ID NO: 56415 - DNA, 8 bp, Unknown
  misc_feature (1)..( 8): Matrix.002 file - promoters60/3438946
tcaaaatc

SEQ ID NO: 56416 - DNA, 8 bp, Unknown
  misc_feature (1)..( 8): Matrix.002 file - promoters60/3438946
gttaattg

SEQ ID NO: 56417 - DNA, 8 bp, Unknown
  misc_feature (1)..( 8): Matrix.002 file - promoters60/3438990
aaaattac

SEQ ID NO: 56418 - DNA, 6 bp, Unknown
  misc_feature (1)..( 6): Matrix.002 file - promoters60/3438990
aacact

SEQ ID NO: 56419 - DNA, 9 bp, Unknown
  misc_feature (1)..( 9): Matrix.002 file - promoters60/3438990
gcatatttt

SEQ ID NO: 56420 - DNA, 8 bp, Unknown
  misc_feature (1)..( 8): Matrix.002 file - promoters60/3438990
tattttat

SEQ ID NO: 56421 - DNA, 8 bp, Unknown
  misc_feature (1)..( 8): Matrix.002 file - promoters60/3438990
aaaaaaaa

SEQ ID NO: 56422 - DNA, 6 bp, Unknown
  misc_feature (1)..( 6): Matrix.002 file - promoters60/3438990
aataaa

SEQ ID NO: 56423 - DNA, 6 bp, Unknown
  misc_feature (1)..( 6): Matrix.002 file - promoters60/3438990
ttaagt

SEQ ID NO: 56424 - DNA, 6 bp, Unknown
  misc_feature (1)..( 6): Matrix.002 file - promoters60/3438990
tatatt

SEQ ID NO: 56425 - DNA, 7 bp, Unknown
  misc_feature (1)..( 7): Matrix.002 file - promoters60/3438990
aaaatct

SEQ ID NO: 56426 - DNA, 7 bp, Unknown
  misc_feature (1)..( 7): Matrix.002 file - promoters60/3438990
caagtaa

SEQ ID NO: 56427 - DNA, 7 bp, Unknown
  misc_feature (1)..( 7): Matrix.002 file - promoters60/3438990
tgttgaa

SEQ ID NO: 56428 - DNA, 6 bp, Unknown
  misc_feature (1)..( 6): Matrix.002 file - promoters60/3438990
ctaaaa

SEQ ID NO: 56429 - DNA, 10 bp, Unknown
  misc_feature (1)..( 10): Matrix.002 file - promoters60/3438990
aaaaccaaac

SEQ ID NO: 56430 - DNA, 7 bp, Unknown
  misc_feature (1)..( 7): Matrix.002 file - promoters60/3438990
gcccaat

SEQ ID NO: 56431 - DNA, 10 bp, Unknown
  misc_feature (1)..( 10): Matrix.002 file - promoters60/3439043
aaagaaaaaa

SEQ ID NO: 56432 - DNA, 8 bp, Unknown
  misc_feature (1)..( 8): Matrix.002 file - promoters60/3439044
ttaagtct

SEQ ID NO: 56433 - DNA, 7 bp, Unknown
  misc_feature (1)..( 7): Matrix.002 file - promoters60/3439056
ttagctt

SEQ ID NO: 56434 - DNA, 6 bp, Unknown
  misc_feature (1)..( 6): Matrix.002 file - promoters60/3439056
ctttat

SEQ ID NO: 56435 - DNA, 9 bp, Unknown
  misc_feature (1)..( 9): Matrix.002 file - promoters60/3439056
aaaaccaaa

SEQ ID NO: 56436 - DNA, 7 bp, Unknown
  misc_feature (1)..( 7): Matrix.002 file - promoters60/3439056
atcattt

SEQ ID NO: 56437 - DNA, 6 bp, Unknown
  misc_feature (1)..( 6): Matrix.002 file - promoters60/3439056
gcatgg

SEQ ID NO: 56438 - DNA, 6 bp, Unknown
  misc_feature (1)..( 6): Matrix.002 file - promoters60/3439056
ttgata

SEQ ID NO: 56439 - DNA, 8 bp, Unknown
  misc_feature (1)..( 8): Matrix.002 file - promoters60/3439056
taaaatta

SEQ ID NO: 56440 - DNA, 6 bp, Unknown
  misc_feature (1)..( 6): Matrix.002 file - promoters60/3439056
ttggtc

SEQ ID NO: 56441 - DNA, 8 bp, Unknown
  misc_feature (1)..( 8): Matrix.002 file - promoters60/3439056
ttttagat

SEQ ID NO: 56442 - DNA, 8 bp, Unknown
  misc_feature (1)..( 8): Matrix.002 file - promoters60/3439056
caatattt

SEQ ID NO: 56443 - DNA, 6 bp, Unknown
  misc_feature (1)..( 6): Matrix.002 file - promoters60/3439056
aaattt

SEQ ID NO: 56444 - DNA, 6 bp, Unknown
  misc_feature (1)..( 6): Matrix.002 file - promoters60/3439056
catgtc

SEQ ID NO: 56445 - DNA, 7 bp, Unknown
  misc_feature (1)..( 7): Matrix.002 file - promoters60/3439056
ataattt

SEQ ID NO: 56446 - DNA, 7 bp, Unknown
  misc_feature (1)..( 7): Matrix.002 file - promoters60/3439056
agcccta

SEQ ID NO: 56447 - DNA, 9 bp, Unknown
  misc_feature (1)..( 9): Matrix.002 file - promoters60/3439056
tttagcatg

SEQ ID NO: 56448 - DNA, 7 bp, Unknown
  misc_feature (1)..( 7): Matrix.002 file - promoters60/3439056
ataaata

SEQ ID NO: 56449 - DNA, 9 bp, Unknown
  misc_feature (1)..( 9): Matrix.002 file - promoters60/3439059
tataaaaat

SEQ ID NO: 56450 - DNA, 8 bp, Unknown
  misc_feature (1)..( 8): Matrix.002 file - promoters60/3439059
tcatatag

SEQ ID NO: 56451 - DNA, 6 bp, Unknown
  misc_feature (1)..( 6): Matrix.002 file - promoters60/3439063
tttcta

SEQ ID NO: 56452 - DNA, 12 bp, Unknown
  misc_feature (1)..( 12): Matrix.002 file - promoters60/3439063
taaaaaaaaaaa

SEQ ID NO: 56453 - DNA, 7 bp, Unknown
  misc_feature (1)..( 7): Matrix.002 file - promoters60/3439063
tatatat

SEQ ID NO: 56454 - DNA, 8 bp, Unknown
  misc_feature (1)..( 8): Matrix.002 file - promoters60/3439063
tatatata

SEQ ID NO: 56455 - DNA, 6 bp, Unknown
  misc_feature (1)..( 6): Matrix.002 file - promoters60/3439063
atgaat

SEQ ID NO: 56456 - DNA, 6 bp, Unknown
  misc_feature (1)..( 6): Matrix.002 file - promoters60/3439063
attgag

SEQ ID NO: 56457 - DNA, 8 bp, Unknown
  misc_feature (1)..( 8): Matrix.002 file - promoters60/3439063
aagtcaaa

SEQ ID NO: 56458 - DNA, 9 bp, Unknown
  misc_feature (1)..( 9): Matrix.002 file - promoters60/3439063
tcaacatta

SEQ ID NO: 56459 - DNA, 7 bp, Unknown
  misc_feature (1)..( 7): Matrix.002 file - promoters60/3439063
aagttta

SEQ ID NO: 56460 - DNA, 6 bp, Unknown
  misc_feature (1)..( 6): Matrix.002 file - promoters60/3439063
tttatt

SEQ ID NO: 56461 - DNA, 8 bp, Unknown
  misc_feature (1)..( 8): Matrix.002 file - promoters60/3439063
aaatcctc

SEQ ID NO: 56462 - DNA, 7 bp, Unknown
  misc_feature (1)..( 7): Matrix.002 file - promoters60/3439063
tataaat

SEQ ID NO: 56463 - DNA, 12 bp, Unknown
  misc_feature (1)..( 12): Matrix.002 file - promoters60/3439063
aacatgtcttag

SEQ ID NO: 56464 - DNA, 7 bp, Unknown
  misc_feature (1)..( 7): Matrix.002 file - promoters60/3439063
tttaatt

SEQ ID NO: 56465 - DNA, 7 bp, Unknown
  misc_feature (1)..( 7): Matrix.002 file - promoters60/3439063
aacatat

SEQ ID NO: 56466 - DNA, 8 bp, Unknown
  misc_feature (1)..( 8): Matrix.002 file - promoters60/3439063
ttttctat

SEQ ID NO: 56467 - DNA, 6 bp, Unknown
  misc_feature (1)..( 6): Matrix.002 file - promoters60/3439063
attaat

SEQ ID NO: 56468 - DNA, 9 bp, Unknown
  misc_feature (1)..( 9): Matrix.002 file - promoters60/3439063
tcatcattt

SEQ ID NO: 56469 - DNA, 6 bp, Unknown
  misc_feature (1)..( 6): Matrix.002 file - promoters60/3439063
gataat

SEQ ID NO: 56470 - DNA, 7 bp, Unknown
  misc_feature (1)..( 7): Matrix.002 file - promoters60/3439063
taacata

SEQ ID NO: 56471 - DNA, 7 bp, Unknown
  misc_feature (1)..( 7): Matrix.002 file - promoters60/3439063
taaatat

SEQ ID NO: 56472 - DNA, 10 bp, Unknown
  misc_feature (1)..( 10): Matrix.002 file - promoters60/3439063
tatattttta

SEQ ID NO: 56473 - DNA, 8 bp, Unknown
  misc_feature (1)..( 8): Matrix.002 file - promoters60/3439063
tttacact

SEQ ID NO: 56474 - DNA, 7 bp, Unknown
  misc_feature (1)..( 7): Matrix.002 file - promoters60/3439063
taaacat

SEQ ID NO: 56475 - DNA, 7 bp, Unknown
  misc_feature (1)..( 7): Matrix.002 file - promoters60/3439063
ataacaa

SEQ ID NO: 56476 - DNA, 10 bp, Unknown
  misc_feature (1)..( 10): Matrix.002 file - promoters60/3439184
ttctctactt

SEQ ID NO: 56477 - DNA, 6 bp, Unknown
  misc_feature (1)..( 6): Matrix.002 file - promoters60/3439184
aattta

SEQ ID NO: 56478 - DNA, 9 bp, Unknown
  misc_feature (1)..( 9): Matrix.002 file - promoters60/3439184
tataattta

SEQ ID NO: 56479 - DNA, 7 bp, Unknown
  misc_feature (1)..( 7): Matrix.002 file - promoters60/3439184
ctaagat

SEQ ID NO: 56480 - DNA, 7 bp, Unknown
  misc_feature (1)..( 7): Matrix.002 file - promoters60/3439184
taatgtt

SEQ ID NO: 56481 - DNA, 7 bp, Unknown
  misc_feature (1)..( 7): Matrix.002 file - promoters60/3439184
tgtattg

SEQ ID NO: 56482 - DNA, 7 bp, Unknown
  misc_feature (1)..( 7): Matrix.002 file - promoters60/3439184
ttcacta

SEQ ID NO: 56483 - DNA, 7 bp, Unknown
  misc_feature (1)..( 7): Matrix.002 file - promoters60/3439184
tctgttc

SEQ ID NO: 56484 - DNA, 7 bp, Unknown
  misc_feature (1)..( 7): Matrix.002 file - promoters60/3439184
ttgaagc

SEQ ID NO: 56485 - DNA, 7 bp, Unknown
  misc_feature (1)..( 7): Matrix.002 file - promoters60/3439184
tttttac

SEQ ID NO: 56486 - DNA, 6 bp, Unknown
  misc_feature (1)..( 6): Matrix.002 file - promoters60/3439184
tgaatt

SEQ ID NO: 56487 - DNA, 8 bp, Unknown
  misc_feature (1)..( 8): Matrix.002 file - promoters60/3439184
ttgtacat

SEQ ID NO: 56488 - DNA, 6 bp, Unknown
  misc_feature (1)..( 6): Matrix.002 file - promoters60/3439184
tttaac

SEQ ID NO: 56489 - DNA, 7 bp, Unknown
  misc_feature (1)..( 7): Matrix.002 file - promoters60/3439184
ggaccat

SEQ ID NO: 56490 - DNA, 12 bp, Unknown
  misc_feature (1)..( 12): Matrix.002 file - promoters60/3439184
attaaagaccaa

SEQ ID NO: 56491 - DNA, 7 bp, Unknown
  misc_feature (1)..( 7): Matrix.002 file - promoters60/3439184
ctgcaac

SEQ ID NO: 56492 - DNA, 6 bp, Unknown
  misc_feature (1)..( 6): Matrix.002 file - promoters60/3439184
ttatat

SEQ ID NO: 56493 - DNA, 6 bp, Unknown
  misc_feature (1)..( 6): Matrix.002 file - promoters60/3439184
tcaatg

SEQ ID NO: 56494 - DNA, 6 bp, Unknown
  misc_feature (1)..( 6): Matrix.002 file - promoters60/3439184
taacca

SEQ ID NO: 56495 - DNA, 13 bp, Unknown
  misc_feature (1)..( 13): Matrix.002 file - promoters60/3439206
aagaaaattcttt

SEQ ID NO: 56496 - DNA, 8 bp, Unknown
  misc_feature (1)..( 8): Matrix.002 file - promoters60/3439206
tttattat

SEQ ID NO: 56497 - DNA, 8 bp, Unknown
  misc_feature (1)..( 8): Matrix.002 file - promoters60/3439206
gttttgat

SEQ ID NO: 56498 - DNA, 9 bp, Unknown
  misc_feature (1)..( 9): Matrix.002 file - promoters60/3439213
cttgtttat

SEQ ID NO: 56499 - DNA, 8 bp, Unknown
  misc_feature (1)..( 8): Matrix.002 file - promoters60/3439224
tttgttgt

SEQ ID NO: 56500 - DNA, 13 bp, Unknown
  misc_feature (1)..( 13): Matrix.002 file - promoters60/3439224
attatatgggcct

SEQ ID NO: 56501 - DNA, 7 bp, Unknown
  misc_feature (1)..( 7): Matrix.002 file - promoters60/3439242
taaacca

SEQ ID NO: 56502 - DNA, 8 bp, Unknown
  misc_feature (1)..( 8): Matrix.002 file - promoters60/3439242
tatcgtgt

SEQ ID NO: 56503 - DNA, 7 bp, Unknown
  misc_feature (1)..( 7): Matrix.002 file - promoters60/3439242
tgtgttg

SEQ ID NO: 56504 - DNA, 6 bp, Unknown
  misc_feature (1)..( 6): Matrix.002 file - promoters60/3439242
ttattt

SEQ ID NO: 56505 - DNA, 7 bp, Unknown
  misc_feature (1)..( 7): Matrix.002 file - promoters60/3439242
tgattat

SEQ ID NO: 56506 - DNA, 6 bp, Unknown
  misc_feature (1)..( 6): Matrix.002 file - promoters60/3439242
tgttaa

SEQ ID NO: 56507 - DNA, 6 bp, Unknown
  misc_feature (1)..( 6): Matrix.002 file - promoters60/3439242
tttata

SEQ ID NO: 56508 - DNA, 6 bp, Unknown
  misc_feature (1)..( 6): Matrix.002 file - promoters60/3439242
tcacat

SEQ ID NO: 56509 - DNA, 8 bp, Unknown
  misc_feature (1)..( 8): Matrix.002 file - promoters60/3439242
atcaaacc

SEQ ID NO: 56510 - DNA, 6 bp, Unknown
  misc_feature (1)..( 6): Matrix.002 file - promoters60/3439242
aactat

SEQ ID NO: 56511 - DNA, 7 bp, Unknown
  misc_feature (1)..( 7): Matrix.002 file - promoters60/3439242
tcaattt

SEQ ID NO: 56512 - DNA, 6 bp, Unknown
  misc_feature (1)..( 6): Matrix.002 file - promoters60/3439242
tttgct

SEQ ID NO: 56513 - DNA, 6 bp, Unknown
  misc_feature (1)..( 6): Matrix.002 file - promoters60/3439242
gttttc

SEQ ID NO: 56514 - DNA, 9 bp, Unknown
  misc_feature (1)..( 9): Matrix.002 file - promoters60/3439242
tttgacttt

SEQ ID NO: 56515 - DNA, 9 bp, Unknown
  misc_feature (1)..( 9): Matrix.002 file - promoters60/3439242
ggggtagaa

SEQ ID NO: 56516 - DNA, 9 bp, Unknown
  misc_feature (1)..( 9): Matrix.002 file - promoters60/3439242
gtataaata

SEQ ID NO: 56517 - DNA, 6 bp, Unknown
  misc_feature (1)..( 6): Matrix.002 file - promoters60/3439242
aaattg

SEQ ID NO: 56518 - DNA, 7 bp, Unknown
  misc_feature (1)..( 7): Matrix.002 file - promoters60/3439242
tgaggaa

SEQ ID NO: 56519 - DNA, 6 bp, Unknown
  misc_feature (1)..( 6): Matrix.002 file - promoters60/3439242
gaagag

SEQ ID NO: 56520 - DNA, 7 bp, Unknown
  misc_feature (1)..( 7): Matrix.002 file - promoters60/3439242
aaaagag

SEQ ID NO: 56521 - DNA, 9 bp, Unknown
  misc_feature (1)..( 9): Matrix.002 file - promoters60/3439289
ttattttca

SEQ ID NO: 56522 - DNA, 8 bp, Unknown
  misc_feature (1)..( 8): Matrix.002 file - promoters60/3439289
atttaaaa

SEQ ID NO: 56523 - DNA, 8 bp, Unknown
  misc_feature (1)..( 8): Matrix.002 file - promoters60/3439289
ttaaaaaa

SEQ ID NO: 56524 - DNA, 8 bp, Unknown
  misc_feature (1)..( 8): Matrix.002 file - promoters60/3439289
caaaatta

SEQ ID NO: 56525 - DNA, 10 bp, Unknown
  misc_feature (1)..( 10): Matrix.002 file - promoters60/3439289
caatataaaa

SEQ ID NO: 56526 - DNA, 13 bp, Unknown
  misc_feature (1)..( 13): Matrix.002 file - promoters60/3439289
ccataaaggaaaa

SEQ ID NO: 56527 - DNA, 13 bp, Unknown
  misc_feature (1)..( 13): Matrix.002 file - promoters60/3439289
aaaggaaaacaat

SEQ ID NO: 56528 - DNA, 7 bp, Unknown
  misc_feature (1)..( 7): Matrix.002 file - promoters60/3439289
tttttac

SEQ ID NO: 56529 - DNA, 13 bp, Unknown
  misc_feature (1)..( 13): Matrix.002 file - promoters60/3439289
ctcgtataaattg

SEQ ID NO: 56530 - DNA, 11 bp, Unknown
  misc_feature (1)..( 11): Matrix.002 file - promoters60/3439289
aaataggaata

SEQ ID NO: 56531 - DNA, 7 bp, Unknown
  misc_feature (1)..( 7): Matrix.002 file - promoters60/3439330
attttaa

SEQ ID NO: 56532 - DNA, 9 bp, Unknown
  misc_feature (1)..( 9): Matrix.002 file - promoters60/3439330
ttttaaaaa

SEQ ID NO: 56533 - DNA, 6 bp, Unknown
  misc_feature (1)..( 6): Matrix.002 file - promoters60/3439330
aatcaa

SEQ ID NO: 56534 - DNA, 6 bp, Unknown
  misc_feature (1)..( 6): Matrix.002 file - promoters60/3439330
aatttt

SEQ ID NO: 56535 - DNA, 6 bp, Unknown
  misc_feature (1)..( 6): Matrix.002 file - promoters60/3439330
catata

SEQ ID NO: 56536 - DNA, 8 bp, Unknown
  misc_feature (1)..( 8): Matrix.002 file - promoters60/3439330
atttctaa

SEQ ID NO: 56537 - DNA, 7 bp, Unknown
  misc_feature (1)..( 7): Matrix.002 file - promoters60/3439330
tttattt

SEQ ID NO: 56538 - DNA, 11 bp, Unknown
  misc_feature (1)..( 11): Matrix.002 file - promoters60/3439330
aaaaaaaattt

SEQ ID NO: 56539 - DNA, 7 bp, Unknown
  misc_feature (1)..( 7): Matrix.002 file - promoters60/3439330
aataaaa

SEQ ID NO: 56540 - DNA, 6 bp, Unknown
  misc_feature (1)..( 6): Matrix.002 file - promoters60/3439330
aatttt

SEQ ID NO: 56541 - DNA, 9 bp, Unknown
  misc_feature (1)..( 9): Matrix.002 file - promoters60/3439330
tttacaaaa

SEQ ID NO: 56542 - DNA, 6 bp, Unknown
  misc_feature (1)..( 6): Matrix.002 file - promoters60/3439330
ttctaa

SEQ ID NO: 56543 - DNA, 7 bp, Unknown
  misc_feature (1)..( 7): Matrix.002 file - promoters60/3439330
ataaaaa

SEQ ID NO: 56544 - DNA, 8 bp, Unknown
  misc_feature (1)..( 8): Matrix.002 file - promoters60/3439330
aaaagaga

SEQ ID NO: 56545 - DNA, 6 bp, Unknown
  misc_feature (1)..( 6): Matrix.002 file - promoters60/3439330
ttttgt

SEQ ID NO: 56546 - DNA, 6 bp, Unknown
  misc_feature (1)..( 6): Matrix.002 file - promoters60/3439330
tgtttt

SEQ ID NO: 56547 - DNA, 7 bp, Unknown
  misc_feature (1)..( 7): Matrix.002 file - promoters60/3439330
gtaatgt

SEQ ID NO: 56548 - DNA, 6 bp, Unknown
  misc_feature (1)..( 6): Matrix.002 file - promoters60/3439330
ccccca

SEQ ID NO: 56549 - DNA, 6 bp, Unknown
  misc_feature (1)..( 6): Matrix.002 file - promoters60/3439353
aaccgt

SEQ ID NO: 56550 - DNA, 8 bp, Unknown
  misc_feature (1)..( 8): Matrix.002 file - promoters60/3439353
tttaaaat

SEQ ID NO: 56551 - DNA, 8 bp, Unknown
  misc_feature (1)..( 8): Matrix.002 file - promoters60/3439353
tcaattaa

SEQ ID NO: 56552 - DNA, 6 bp, Unknown
  misc_feature (1)..( 6): Matrix.002 file - promoters60/3439353
tcatgt

SEQ ID NO: 56553 - DNA, 8 bp, Unknown
  misc_feature (1)..( 8): Matrix.002 file - promoters60/3439353
taaaagca

SEQ ID NO: 56554 - DNA, 9 bp, Unknown
  misc_feature (1)..( 9): Matrix.002 file - promoters60/3439353
gaaaaaaaa

SEQ ID NO: 56555 - DNA, 7 bp, Unknown
  misc_feature (1)..( 7): Matrix.002 file - promoters60/3439353
catatta

SEQ ID NO: 56556 - DNA, 6 bp, Unknown
  misc_feature (1)..( 6): Matrix.002 file - promoters60/3439353
gataag

SEQ ID NO: 56557 - DNA, 8 bp, Unknown
  misc_feature (1)..( 8): Matrix.002 file - promoters60/3439353
ttccaccg

SEQ ID NO: 56558 - DNA, 6 bp, Unknown
  misc_feature (1)..( 6): Matrix.002 file - promoters60/3439353
ttttgt

SEQ ID NO: 56559 - DNA, 7 bp, Unknown
  misc_feature (1)..( 7): Matrix.002 file - promoters60/3439353
tacattt

SEQ ID NO: 56560 - DNA, 7 bp, Unknown
  misc_feature (1)..( 7): Matrix.002 file - promoters60/3439353
aaatcta

SEQ ID NO: 56561 - DNA, 11 bp, Unknown
  misc_feature (1)..( 11): Matrix.002 file - promoters60/3439353
gtaaaagttta

SEQ ID NO: 56562 - DNA, 7 bp, Unknown
  misc_feature (1)..( 7): Matrix.002 file - promoters60/3439353
ttaaatt

SEQ ID NO: 56563 - DNA, 6 bp, Unknown
  misc_feature (1)..( 6): Matrix.002 file - promoters60/3439353
attttc

SEQ ID NO: 56564 - DNA, 6 bp, Unknown
  misc_feature (1)..( 6): Matrix.002 file - promoters60/3439353
caaaat

SEQ ID NO: 56565 - DNA, 10 bp, Unknown
  misc_feature (1)..( 10): Matrix.002 file - promoters60/3439353
acaacaatct

SEQ ID NO: 56566 - DNA, 6 bp, Unknown
  misc_feature (1)..( 6): Matrix.002 file - promoters60/3439353
cacaca

SEQ ID NO: 56567 - DNA, 10 bp, Unknown
  misc_feature (1)..( 10): Matrix.002 file - promoters60/3439364
ttgtaaaaaa

SEQ ID NO: 56568 - DNA, 14 bp, Unknown
  misc_feature (1)..( 14): Matrix.002 file - promoters60/3439364
atatttttaaaaaa

SEQ ID NO: 56569 - DNA, 9 bp, Unknown
  misc_feature (1)..( 9): Matrix.002 file - promoters60/3439364
aacagtttc

SEQ ID NO: 56570 - DNA, 9 bp, Unknown
  misc_feature (1)..( 9): Matrix.002 file - promoters60/3439364
atatttaaa

SEQ ID NO: 56571 - DNA, 9 bp, Unknown
  misc_feature (1)..( 9): Matrix.002 file - promoters60/3439364
aaaataaaa

SEQ ID NO: 56572 - DNA, 7 bp, Unknown
  misc_feature (1)..( 7): Matrix.002 file - promoters60/3439374
ttacatg

SEQ ID NO: 56573 - DNA, 11 bp, Unknown
  misc_feature (1)..( 11): Matrix.002 file - promoters60/3439374
aaaagctatca

SEQ ID NO: 56574 - DNA, 7 bp, Unknown
  misc_feature (1)..( 7): Matrix.002 file - promoters60/3439374
aaaatta

SEQ ID NO: 56575 - DNA, 8 bp, Unknown
  misc_feature (1)..( 8): Matrix.002 file - promoters60/3439374
aaaaagca

SEQ ID NO: 56576 - DNA, 9 bp, Unknown
  misc_feature (1)..( 9): Matrix.002 file - promoters60/3439374
aattcaata

SEQ ID NO: 56577 - DNA, 7 bp, Unknown
  misc_feature (1)..( 7): Matrix.002 file - promoters60/3439374
ataagac

SEQ ID NO: 56578 - DNA, 8 bp, Unknown
  misc_feature (1)..( 8): Matrix.002 file - promoters60/3439374
tctaattt

SEQ ID NO: 56579 - DNA, 7 bp, Unknown
  misc_feature (1)..( 7): Matrix.002 file - promoters60/3439374
gatattt

SEQ ID NO: 56580 - DNA, 7 bp, Unknown
  misc_feature (1)..( 7): Matrix.002 file - promoters60/3439374
aaaaagc

SEQ ID NO: 56581 - DNA, 9 bp, Unknown
  misc_feature (1)..( 9): Matrix.002 file - promoters60/3439374
taattagaa

SEQ ID NO: 56582 - DNA, 8 bp, Unknown
  misc_feature (1)..( 8): Matrix.002 file - promoters60/3439374
atccaacg

SEQ ID NO: 56583 - DNA, 6 bp, Unknown
  misc_feature (1)..( 6): Matrix.002 file - promoters60/3439374
aataaa

SEQ ID NO: 56584 - DNA, 7 bp, Unknown
  misc_feature (1)..( 7): Matrix.002 file - promoters60/3439374
ataaaat

SEQ ID NO: 56585 - DNA, 9 bp, Unknown
  misc_feature (1)..( 9): Matrix.002 file - promoters60/3439374
aataaaaat

SEQ ID NO: 56586 - DNA, 6 bp, Unknown
  misc_feature (1)..( 6): Matrix.002 file - promoters60/3439374
tttcta

SEQ ID NO: 56587 - DNA, 8 bp, Unknown
  misc_feature (1)..( 8): Matrix.002 file - promoters60/3439374
ctataaat

SEQ ID NO: 56588 - DNA, 6 bp, Unknown
  misc_feature (1)..( 6): Matrix.002 file - promoters60/3439374
acctaa

SEQ ID NO: 56589 - DNA, 11 bp, Unknown
  misc_feature (1)..( 11): Matrix.002 file - promoters60/3439472
acaaagaaaga

SEQ ID NO: 56590 - DNA, 10 bp, Unknown
  misc_feature (1)..( 10): Matrix.002 file - promoters60/3439472
atttttgtaa

SEQ ID NO: 56591 - DNA, 14 bp, Unknown
  misc_feature (1)..( 14): Matrix.002 file - promoters60/3439472
caaaagggccgaat

SEQ ID NO: 56592 - DNA, 10 bp, Unknown
  misc_feature (1)..( 10): Matrix.002 file - promoters60/3439472
caagtaaaaa

SEQ ID NO: 56593 - DNA, 8 bp, Unknown
  misc_feature (1)..( 8): Matrix.002 file - promoters60/3439482
aatcgtta

SEQ ID NO: 56594 - DNA, 6 bp, Unknown
  misc_feature (1)..( 6): Matrix.002 file - promoters60/3439506
tgtttt

SEQ ID NO: 56595 - DNA, 8 bp, Unknown
  misc_feature (1)..( 8): Matrix.002 file - promoters60/3439506
tgaagatg

SEQ ID NO: 56596 - DNA, 6 bp, Unknown
  misc_feature (1)..( 6): Matrix.002 file - promoters60/3439506
atgtta

SEQ ID NO: 56597 - DNA, 6 bp, Unknown
  misc_feature (1)..( 6): Matrix.002 file - promoters60/3439506
aaggtt

SEQ ID NO: 56598 - DNA, 6 bp, Unknown
  misc_feature (1)..( 6): Matrix.002 file - promoters60/3439506
ttcata

SEQ ID NO: 56599 - DNA, 7 bp, Unknown
  misc_feature (1)..( 7): Matrix.002 file - promoters60/3439506
tgggttg

SEQ ID NO: 56600 - DNA, 8 bp, Unknown
  misc_feature (1)..( 8): Matrix.002 file - promoters60/3439506
aaattgaa

SEQ ID NO: 56601 - DNA, 7 bp, Unknown
  misc_feature (1)..( 7): Matrix.002 file - promoters60/3439506
tgtaaaa

SEQ ID NO: 56602 - DNA, 7 bp, Unknown
  misc_feature (1)..( 7): Matrix.002 file - promoters60/3439506
agagaaa

SEQ ID NO: 56603 - DNA, 10 bp, Unknown
  misc_feature (1)..( 10): Matrix.002 file - promoters60/3439506
atgcttttgt

SEQ ID NO: 56604 - DNA, 8 bp, Unknown
  misc_feature (1)..( 8): Matrix.002 file - promoters60/3439506
aaaaaaga

SEQ ID NO: 56605 - DNA, 8 bp, Unknown
  misc_feature (1)..( 8): Matrix.002 file - promoters60/3439506
ttaatatt

SEQ ID NO: 56606 - DNA, 7 bp, Unknown
  misc_feature (1)..( 7): Matrix.002 file - promoters60/3439506
tgaggaa

SEQ ID NO: 56607 - DNA, 6 bp, Unknown
  misc_feature (1)..( 6): Matrix.002 file - promoters60/3439506
gaagag

SEQ ID NO: 56608 - DNA, 8 bp, Unknown
  misc_feature (1)..( 8): Matrix.002 file - promoters60/3439593
aggaattt

SEQ ID NO: 56609 - DNA, 7 bp, Unknown
  misc_feature (1)..( 7): Matrix.002 file - promoters60/3439595
aacgaaa

SEQ ID NO: 56610 - DNA, 7 bp, Unknown
  misc_feature (1)..( 7): Matrix.002 file - promoters60/3439595
taattca

SEQ ID NO: 56611 - DNA, 11 bp, Unknown
  misc_feature (1)..( 11): Matrix.002 file - promoters60/3439595
tgacatgattt

SEQ ID NO: 56612 - DNA, 7 bp, Unknown
  misc_feature (1)..( 7): Matrix.002 file - promoters60/3439595
caaattt

SEQ ID NO: 56613 - DNA, 11 bp, Unknown
  misc_feature (1)..( 11): Matrix.002 file - promoters60/3439595
cccttataaaa

SEQ ID NO: 56614 - DNA, 12 bp, Unknown
  misc_feature (1)..( 12): Matrix.002 file - promoters60/3439605
ttcgattttgcg

SEQ ID NO: 56615 - DNA, 10 bp, Unknown
  misc_feature (1)..( 10): Matrix.002 file - promoters60/3439605
ctgaaaacaa

SEQ ID NO: 56616 - DNA, 12 bp, Unknown
  misc_feature (1)..( 12): Matrix.002 file - promoters60/3439605
actatttaaatg

SEQ ID NO: 56617 - DNA, 7 bp, Unknown
  misc_feature (1)..( 7): Matrix.002 file - promoters60/3439605
taatttc

SEQ ID NO: 56618 - DNA, 9 bp, Unknown
  misc_feature (1)..( 9): Matrix.002 file - promoters60/3439605
cgattaaat

SEQ ID NO: 56619 - DNA, 14 bp, Unknown
  misc_feature (1)..( 14): Matrix.002 file - promoters60/3439605
acatgaaataatta

SEQ ID NO: 56620 - DNA, 8 bp, Unknown
  misc_feature (1)..( 8): Matrix.002 file - promoters60/3439605
tcacaaag

SEQ ID NO: 56621 - DNA, 11 bp, Unknown
  misc_feature (1)..( 11): Matrix.002 file - promoters60/3439605
taaattctggg

SEQ ID NO: 56622 - DNA, 8 bp, Unknown
  misc_feature (1)..( 8): Matrix.002 file - promoters60/3439605
attttaat

SEQ ID NO: 56623 - DNA, 7 bp, Unknown
  misc_feature (1)..( 7): Matrix.002 file - promoters60/3439605
catttat

SEQ ID NO: 56624 - DNA, 8 bp, Unknown
  misc_feature (1)..( 8): Matrix.002 file - promoters60/3439605
gaaaacaa

SEQ ID NO: 56625 - DNA, 10 bp, Unknown
  misc_feature (1)..( 10): Matrix.002 file - promoters60/3439614
tctgtcaaaa

SEQ ID NO: 56626 - DNA, 9 bp, Unknown
  misc_feature (1)..( 9): Matrix.002 file - promoters60/3439614
aaagataga

SEQ ID NO: 56627 - DNA, 15 bp, Unknown
  misc_feature (1)..( 15): Matrix.002 file - promoters60/3439614
cacaaataaaaacaa

SEQ ID NO: 56628 - DNA, 14 bp, Unknown
  misc_feature (1)..( 14): Matrix.002 file - promoters60/3439614
aaaaaaaataaata

SEQ ID NO: 56629 - DNA, 12 bp, Unknown
  misc_feature (1)..( 12): Matrix.002 file - promoters60/3439614
caaaatttataa

SEQ ID NO: 56630 - DNA, 13 bp, Unknown
  misc_feature (1)..( 13): Matrix.002 file - promoters60/3439614
gtaaaataaatca

SEQ ID NO: 56631 - DNA, 12 bp, Unknown
  misc_feature (1)..( 12): Matrix.002 file - promoters60/3439641
tataaaaagaaa

SEQ ID NO: 56632 - DNA, 9 bp, Unknown
  misc_feature (1)..( 9): Matrix.002 file - promoters60/3439641
ttatatttt

SEQ ID NO: 56633 - DNA, 12 bp, Unknown
  misc_feature (1)..( 12): Matrix.002 file - promoters60/3439641
aaaatatgtttt

SEQ ID NO: 56634 - DNA, 11 bp, Unknown
  misc_feature (1)..( 11): Matrix.002 file - promoters60/3439641
gtttgattcgt

SEQ ID NO: 56635 - DNA, 7 bp, Unknown
  misc_feature (1)..( 7): Matrix.002 file - promoters60/3439641
taatata

SEQ ID NO: 56636 - DNA, 9 bp, Unknown
  misc_feature (1)..( 9): Matrix.002 file - promoters60/3439641
ttatattag

SEQ ID NO: 56637 - DNA, 11 bp, Unknown
  misc_feature (1)..( 11): Matrix.002 file - promoters60/3439641
aagaaatatat

SEQ ID NO: 56638 - DNA, 10 bp, Unknown
  misc_feature (1)..( 10): Matrix.002 file - promoters60/3439662
taattttgaa

SEQ ID NO: 56639 - DNA, 7 bp, Unknown
  misc_feature (1)..( 7): Matrix.002 file - promoters60/3439905
aaataat

SEQ ID NO: 56640 - DNA, 8 bp, Unknown
  misc_feature (1)..( 8): Matrix.002 file - promoters60/3439905
tgaaatca

SEQ ID NO: 56641 - DNA, 7 bp, Unknown
  misc_feature (1)..( 7): Matrix.002 file - promoters60/3439905
taaaaaa

SEQ ID NO: 56642 - DNA, 6 bp, Unknown
  misc_feature (1)..( 6): Matrix.002 file - promoters60/3439905
aatgaa

SEQ ID NO: 56643 - DNA, 6 bp, Unknown
  misc_feature (1)..( 6): Matrix.002 file - promoters60/3439905
ggaaat

SEQ ID NO: 56644 - DNA, 6 bp, Unknown
  misc_feature (1)..( 6): Matrix.002 file - promoters60/3439905
aagaaa

SEQ ID NO: 56645 - DNA, 7 bp, Unknown
  misc_feature (1)..( 7): Matrix.002 file - promoters60/3439905
aaaaaat

SEQ ID NO: 56646 - DNA, 9 bp, Unknown
  misc_feature (1)..( 9): Matrix.002 file - promoters60/3439905
ttctctctc

SEQ ID NO: 56647 - DNA, 7 bp, Unknown
  misc_feature (1)..( 7): Matrix.002 file - promoters60/3439905
attcttc

SEQ ID NO: 56648 - DNA, 6 bp, Unknown
  misc_feature (1)..( 6): Matrix.002 file - promoters60/3439905
tataaa

SEQ ID NO: 56649 - DNA, 10 bp, Unknown
  misc_feature (1)..( 10): Matrix.002 file - promoters60/3442171
ttttattcaa

SEQ ID NO: 56650 - DNA, 10 bp, Unknown
  misc_feature (1)..( 10): Matrix.002 file - promoters60/3442171
aaataaagtt

SEQ ID NO: 56651 - DNA, 14 bp, Unknown
  misc_feature (1)..( 14): Matrix.002 file - promoters60/3445482
aaaaagggcctata

SEQ ID NO: 56652 - DNA, 9 bp, Unknown
  misc_feature (1)..( 9): Matrix.002 file - promoters60/3445482
acaaaacca

SEQ ID NO: 56653 - DNA, 10 bp, Unknown
  misc_feature (1)..( 10): Matrix.002 file - promoters60/3593205
aaaaataaac

SEQ ID NO: 56654 - DNA, 13 bp, Unknown
  misc_feature (1)..( 13): Matrix.002 file - promoters60/3593205
aattggatcttat

SEQ ID NO: 56655 - DNA, 8 bp, Unknown
  misc_feature (1)..( 8): Matrix.002 file - promoters60/3593205
aactaaaa

SEQ ID NO: 56656 - DNA, 10 bp, Unknown
  misc_feature (1)..( 10): Matrix.002 file - promoters60/3593205
acaataatat

SEQ ID NO: 56657 - DNA, 9 bp, Unknown
  misc_feature (1)..( 9): Matrix.002 file - promoters60/3593205
ctattttat

SEQ ID NO: 56658 - DNA, 13 bp, Unknown
  misc_feature (1)..( 13): Matrix.002 file - promoters60/3593205
aattagatcttat

SEQ ID NO: 56659 - DNA, 7 bp, Unknown
  misc_feature (1)..( 7): Matrix.002 file - promoters60/3593230
gttaata

SEQ ID NO: 56660 - DNA, 6 bp, Unknown
  misc_feature (1)..( 6): Matrix.002 file - promoters60/3593243
attaaa

SEQ ID NO: 56661 - DNA, 10 bp, Unknown
  misc_feature (1)..( 10): Matrix.002 file - promoters60/3593243
aaacataatg

SEQ ID NO: 56662 - DNA, 8 bp, Unknown
  misc_feature (1)..( 8): Matrix.002 file - promoters60/3593243
atatcttt

SEQ ID NO: 56663 - DNA, 8 bp, Unknown
  misc_feature (1)..( 8): Matrix.002 file - promoters60/3593243
ttgttttc

SEQ ID NO: 56664 - DNA, 6 bp, Unknown
  misc_feature (1)..( 6): Matrix.002 file - promoters60/3593243
cttcaa

SEQ ID NO: 56665 - DNA, 6 bp, Unknown
  misc_feature (1)..( 6): Matrix.002 file - promoters60/3593243
cattta

SEQ ID NO: 56666 - DNA, 6 bp, Unknown
  misc_feature (1)..( 6): Matrix.002 file - promoters60/3593243
caaaaa

SEQ ID NO: 56667 - DNA, 6 bp, Unknown
  misc_feature (1)..( 6): Matrix.002 file - promoters60/3593243
aaatgc

SEQ ID NO: 56668 - DNA, 9 bp, Unknown
  misc_feature (1)..( 9): Matrix.002 file - promoters60/3593243
taacacata

SEQ ID NO: 56669 - DNA, 7 bp, Unknown
  misc_feature (1)..( 7): Matrix.002 file - promoters60/3593243
ataataa

SEQ ID NO: 56670 - DNA, 6 bp, Unknown
  misc_feature (1)..( 6): Matrix.002 file - promoters60/3593243
tttaag

SEQ ID NO: 56671 - DNA, 9 bp, Unknown
  misc_feature (1)..( 9): Matrix.002 file - promoters60/3593243
agtattaat

SEQ ID NO: 56672 - DNA, 9 bp, Unknown
  misc_feature (1)..( 9): Matrix.002 file - promoters60/3593243
agacaagtt

SEQ ID NO: 56673 - DNA, 7 bp, Unknown
  misc_feature (1)..( 7): Matrix.002 file - promoters60/3593243
ttacatg

SEQ ID NO: 56674 - DNA, 7 bp, Unknown
  misc_feature (1)..( 7): Matrix.002 file - promoters60/3593243
tctctga

SEQ ID NO: 56675 - DNA, 9 bp, Unknown
  misc_feature (1)..( 9): Matrix.002 file - promoters60/3593243
aacacacat

SEQ ID NO: 56676 - DNA, 6 bp, Unknown
  misc_feature (1)..( 6): Matrix.002 file - promoters60/3593243
atgtca

SEQ ID NO: 56677 - DNA, 9 bp, Unknown
  misc_feature (1)..( 9): Matrix.002 file - promoters60/3593243
gttaatctt

SEQ ID NO: 56678 - DNA, 7 bp, Unknown
  misc_feature (1)..( 7): Matrix.002 file - promoters60/3593243
aacatta

SEQ ID NO: 56679 - DNA, 6 bp, Unknown
  misc_feature (1)..( 6): Matrix.002 file - promoters60/3593243
aagaaa

SEQ ID NO: 56680 - DNA, 6 bp, Unknown
  misc_feature (1)..( 6): Matrix.002 file - promoters60/3593243
cttctt

SEQ ID NO: 56681 - DNA, 6 bp, Unknown
  misc_feature (1)..( 6): Matrix.002 file - promoters60/3593243
tataaa

SEQ ID NO: 56682 - DNA, 7 bp, Unknown
  misc_feature (1)..( 7): Matrix.002 file - promoters60/3593264
gtttttg

SEQ ID NO: 56683 - DNA, 10 bp, Unknown
  misc_feature (1)..( 10): Matrix.002 file - promoters60/3593264
ttaaattaat

SEQ ID NO: 56684 - DNA, 10 bp, Unknown
  misc_feature (1)..( 10): Matrix.002 file - promoters60/3593264
aaaaaaattc

SEQ ID NO: 56685 - DNA, 8 bp, Unknown
  misc_feature (1)..( 8): Matrix.002 file - promoters60/3593264
cattttac

SEQ ID NO: 56686 - DNA, 13 bp, Unknown
  misc_feature (1)..( 13): Matrix.002 file - promoters60/3593264
aaacaaaaaaaaa

SEQ ID NO: 56687 - DNA, 10 bp, Unknown
  misc_feature (1)..( 10): Matrix.002 file - promoters60/3593264
tctcaaaaaa

SEQ ID NO: 56688 - DNA, 12 bp, Unknown
  misc_feature (1)..( 12): Matrix.002 file - promoters60/3593264
caaaatttctca

SEQ ID NO: 56689 - DNA, 12 bp, Unknown
  misc_feature (1)..( 12): Matrix.002 file - promoters60/3593264
tctcaaaaataa

SEQ ID NO: 56690 - DNA, 10 bp, Unknown
  misc_feature (1)..( 10): Matrix.002 file - promoters60/3593264
aaaataaaat

SEQ ID NO: 56691 - DNA, 8 bp, Unknown
  misc_feature (1)..( 8): Matrix.002 file - promoters60/3593264
ctctattt

SEQ ID NO: 56692 - DNA, 8 bp, Unknown
  misc_feature (1)..( 8): Matrix.002 file - promoters60/3593264
tatataaa

SEQ ID NO: 56693 - DNA, 8 bp, Unknown
  misc_feature (1)..( 8): Matrix.002 file - promoters60/3593264
gttttgtt

SEQ ID NO: 56694 - DNA, 8 bp, Unknown
  misc_feature (1)..( 8): Matrix.002 file - promoters60/3593290
tatcagtt

SEQ ID NO: 56695 - DNA, 6 bp, Unknown
  misc_feature (1)..( 6): Matrix.002 file - promoters60/3593290
tttaga

SEQ ID NO: 56696 - DNA, 6 bp, Unknown
  misc_feature (1)..( 6): Matrix.002 file - promoters60/3593290
taactt

SEQ ID NO: 56697 - DNA, 10 bp, Unknown
  misc_feature (1)..( 10): Matrix.002 file - promoters60/3593290
atatgtgaga

SEQ ID NO: 56698 - DNA, 8 bp, Unknown
  misc_feature (1)..( 8): Matrix.002 file - promoters60/3593290
tttttgtc

SEQ ID NO: 56699 - DNA, 6 bp, Unknown
  misc_feature (1)..( 6): Matrix.002 file - promoters60/3593290
tctttt

SEQ ID NO: 56700 - DNA, 6 bp, Unknown
  misc_feature (1)..( 6): Matrix.002 file - promoters60/3593290
tttctt

SEQ ID NO: 56701 - DNA, 7 bp, Unknown
  misc_feature (1)..( 7): Matrix.002 file - promoters60/3593290
tttattt

SEQ ID NO: 56702 - DNA, 7 bp, Unknown
  misc_feature (1)..( 7): Matrix.002 file - promoters60/3593290
ctcagaa

SEQ ID NO: 56703 - DNA, 10 bp, Unknown
  misc_feature (1)..( 10): Matrix.002 file - promoters60/3593290
gattgttgtg

SEQ ID NO: 56704 - DNA, 9 bp, Unknown
  misc_feature (1)..( 9): Matrix.002 file - promoters60/3593290
gatcaggaa

SEQ ID NO: 56705 - DNA, 8 bp, Unknown
  misc_feature (1)..( 8): Matrix.002 file - promoters60/3593290
atttggac

SEQ ID NO: 56706 - DNA, 8 bp, Unknown
  misc_feature (1)..( 8): Matrix.002 file - promoters60/3593290
ctttagac

SEQ ID NO: 56707 - DNA, 7 bp, Unknown
  misc_feature (1)..( 7): Matrix.002 file - promoters60/3593290
gaaactt

SEQ ID NO: 56708 - DNA, 7 bp, Unknown
  misc_feature (1)..( 7): Matrix.002 file - promoters60/3593290
tcatctg

SEQ ID NO: 56709 - DNA, 7 bp, Unknown
  misc_feature (1)..( 7): Matrix.002 file - promoters60/3593290
ctttttg

SEQ ID NO: 56710 - DNA, 9 bp, Unknown
  misc_feature (1)..( 9): Matrix.002 file - promoters60/3593340
tttaaagaa

SEQ ID NO: 56711 - DNA, 12 bp, Unknown
  misc_feature (1)..( 12): Matrix.002 file - promoters60/3593340
aaaaatggtaaa

SEQ ID NO: 56712 - DNA, 11 bp, Unknown
  misc_feature (1)..( 11): Matrix.002 file - promoters60/3593340
aaggcaaaaga

SEQ ID NO: 56713 - DNA, 7 bp, Unknown
  misc_feature (1)..( 7): Matrix.002 file - promoters60/3593340
ttaattt

SEQ ID NO: 56714 - DNA, 7 bp, Unknown
  misc_feature (1)..( 7): Matrix.002 file - promoters60/3593340
tttatta

SEQ ID NO: 56715 - DNA, 9 bp, Unknown
  misc_feature (1)..( 9): Matrix.002 file - promoters60/3593340
ttttaataa

SEQ ID NO: 56716 - DNA, 11 bp, Unknown
  misc_feature (1)..( 11): Matrix.002 file - promoters60/3593340
gtaaaaaatat

SEQ ID NO: 56717 - DNA, 8 bp, Unknown
  misc_feature (1)..( 8): Matrix.002 file - promoters60/3593346
aaaataat

SEQ ID NO: 56718 - DNA, 7 bp, Unknown
  misc_feature (1)..( 7): Matrix.002 file - promoters60/3593346
aaacaaa

SEQ ID NO: 56719 - DNA, 8 bp, Unknown
  misc_feature (1)..( 8): Matrix.002 file - promoters60/3593346
aaatcttt

SEQ ID NO: 56720 - DNA, 8 bp, Unknown
  misc_feature (1)..( 8): Matrix.002 file - promoters60/3594312
cttttaaa

SEQ ID NO: 56721 - DNA, 10 bp, Unknown
  misc_feature (1)..( 10): Matrix.002 file - promoters60/3594312
tacataaata

SEQ ID NO: 56722 - DNA, 16 bp, Unknown
  misc_feature (1)..( 16): Matrix.002 file - promoters60/3594312
aaaaaggcccaaaaaa

SEQ ID NO: 56723 - DNA, 9 bp, Unknown
  misc_feature (1)..( 9): Matrix.002 file - promoters60/3594312
attcttaaa

SEQ ID NO: 56724 - DNA, 16 bp, Unknown
  misc_feature (1)..( 16): Matrix.002 file - promoters60/3597145
acaaatctttaaatat

SEQ ID NO: 56725 - DNA, 6 bp, Unknown
  misc_feature (1)..( 6): Matrix.002 file - promoters60/3597158
aatact

SEQ ID NO: 56726 - DNA, 7 bp, Unknown
  misc_feature (1)..( 7): Matrix.002 file - promoters60/3597158
tttgtaa

SEQ ID NO: 56727 - DNA, 7 bp, Unknown
  misc_feature (1)..( 7): Matrix.002 file - promoters60/3597158
aaagttg

SEQ ID NO: 56728 - DNA, 6 bp, Unknown
  misc_feature (1)..( 6): Matrix.002 file - promoters60/3597158
attaaa

SEQ ID NO: 56729 - DNA, 8 bp, Unknown
  misc_feature (1)..( 8): Matrix.002 file - promoters60/3597158
gtttcctc

SEQ ID NO: 56730 - DNA, 9 bp, Unknown
  misc_feature (1)..( 9): Matrix.002 file - promoters60/3597158
tcttcttct

SEQ ID NO: 56731 - DNA, 8 bp, Unknown
  misc_feature (1)..( 8): Matrix.002 file - promoters60/3597158
tcacatag

SEQ ID NO: 56732 - DNA, 9 bp, Unknown
  misc_feature (1)..( 9): Matrix.002 file - promoters60/3597158
aaagaaaaa

SEQ ID NO: 56733 - DNA, 7 bp, Unknown
  misc_feature (1)..( 7): Matrix.002 file - promoters60/3597158
aaaaatt

SEQ ID NO: 56734 - DNA, 7 bp, Unknown
  misc_feature (1)..( 7): Matrix.002 file - promoters60/3597158
aaacaac

SEQ ID NO: 56735 - DNA, 6 bp, Unknown
  misc_feature (1)..( 6): Matrix.002 file - promoters60/3597158
actctc

SEQ ID NO: 56736 - DNA, 8 bp, Unknown
  misc_feature (1)..( 8): Matrix.002 file - promoters60/3597158
tgtcattt

SEQ ID NO: 56737 - DNA, 7 bp, Unknown
  misc_feature (1)..( 7): Matrix.002 file - promoters60/3597158
aatcttc

SEQ ID NO: 56738 - DNA, 6 bp, Unknown
  misc_feature (1)..( 6): Matrix.002 file - promoters60/3597158
ttggta

SEQ ID NO: 56739 - DNA, 6 bp, Unknown
  misc_feature (1)..( 6): Matrix.002 file - promoters60/3597158
aaccaa

SEQ ID NO: 56740 - DNA, 9 bp, Unknown
  misc_feature (1)..( 9): Matrix.002 file - promoters60/3597158
tttcaaaag

SEQ ID NO: 56741 - DNA, 6 bp, Unknown
  misc_feature (1)..( 6): Matrix.002 file - promoters60/3597158
aagaaa

SEQ ID NO: 56742 - DNA, 6 bp, Unknown
  misc_feature (1)..( 6): Matrix.002 file - promoters60/3597158
tagtta

SEQ ID NO: 56743 - DNA, 8 bp, Unknown
  misc_feature (1)..( 8): Matrix.002 file - promoters60/3597158
agttccac

SEQ ID NO: 56744 - DNA, 7 bp, Unknown
  misc_feature (1)..( 7): Matrix.002 file - promoters60/3597158
atcacat

SEQ ID NO: 56745 - DNA, 6 bp, Unknown
  misc_feature (1)..( 6): Matrix.002 file - promoters60/3597158
aaacat

SEQ ID NO: 56746 - DNA, 7 bp, Unknown
  misc_feature (1)..( 7): Matrix.002 file - promoters60/3597158
ttctctc

SEQ ID NO: 56747 - DNA, 9 bp, Unknown
  misc_feature (1)..( 9): Matrix.002 file - promoters60/3597162
ttcaattta

SEQ ID NO: 56748 - DNA, 6 bp, Unknown
  misc_feature (1)..( 6): Matrix.002 file - promoters60/3597162
atcaac

SEQ ID NO: 56749 - DNA, 7 bp, Unknown
  misc_feature (1)..( 7): Matrix.002 file - promoters60/3597162
tgacttg

SEQ ID NO: 56750 - DNA, 8 bp, Unknown
  misc_feature (1)..( 8): Matrix.002 file - promoters60/3597162
agataaaa

SEQ ID NO: 56751 - DNA, 7 bp, Unknown
  misc_feature (1)..( 7): Matrix.002 file - promoters60/3597162
acaattt

SEQ ID NO: 56752 - DNA, 8 bp, Unknown
  misc_feature (1)..( 8): Matrix.002 file - promoters60/3597162
agaaaatt

SEQ ID NO: 56753 - DNA, 6 bp, Unknown
  misc_feature (1)..( 6): Matrix.002 file - promoters60/3597162
ttggtt

SEQ ID NO: 56754 - DNA, 6 bp, Unknown
  misc_feature (1)..( 6): Matrix.002 file - promoters60/3597162
aacttt

SEQ ID NO: 56755 - DNA, 6 bp, Unknown
  misc_feature (1)..( 6): Matrix.002 file - promoters60/3597162
aattga

SEQ ID NO: 56756 - DNA, 7 bp, Unknown
  misc_feature (1)..( 7): Matrix.002 file - promoters60/3597162
aatagat

SEQ ID NO: 56757 - DNA, 6 bp, Unknown
  misc_feature (1)..( 6): Matrix.002 file - promoters60/3597162
taccat

SEQ ID NO: 56758 - DNA, 7 bp, Unknown
  misc_feature (1)..( 7): Matrix.002 file - promoters60/3597162
ataatat

SEQ ID NO: 56759 - DNA, 13 bp, Unknown
  misc_feature (1)..( 13): Matrix.002 file - promoters60/3597162
tctatataaatcc

SEQ ID NO: 56760 - DNA, 7 bp, Unknown
  misc_feature (1)..( 7): Matrix.002 file - promoters60/3597162
ttaaaat

SEQ ID NO: 56761 - DNA, 6 bp, Unknown
  misc_feature (1)..( 6): Matrix.002 file - promoters60/3597162
attcaa

SEQ ID NO: 56762 - DNA, 9 bp, Unknown
  misc_feature (1)..( 9): Matrix.002 file - promoters60/3597162
ttttatttt

SEQ ID NO: 56763 - DNA, 7 bp, Unknown
  misc_feature (1)..( 7): Matrix.002 file - promoters60/3597162
tctcata

SEQ ID NO: 56764 - DNA, 6 bp, Unknown
  misc_feature (1)..( 6): Matrix.002 file - promoters60/3597162
aattta

SEQ ID NO: 56765 - DNA, 9 bp, Unknown
  misc_feature (1)..( 9): Matrix.002 file - promoters60/3597162
taaacttaa

SEQ ID NO: 56766 - DNA, 7 bp, Unknown
  misc_feature (1)..( 7): Matrix.002 file - promoters60/3597162
actctca

SEQ ID NO: 56767 - DNA, 8 bp, Unknown
  misc_feature (1)..( 8): Matrix.003 file - promoters60/3597175
tttattca

SEQ ID NO: 56768 - DNA, 12 bp, Unknown
  misc_feature (1)..( 12): Matrix.003 file - promoters60/3597175
tttattttaaaa

SEQ ID NO: 56769 - DNA, 10 bp, Unknown
  misc_feature (1)..( 10): Matrix.003 file - promoters60/3597175
ctaattaaaa

SEQ ID NO: 56770 - DNA, 16 bp, Unknown
  misc_feature (1)..( 16): Matrix.003 file - promoters60/3597175
aaaaactttattcttc

SEQ ID NO: 56771 - DNA, 14 bp, Unknown
  misc_feature (1)..( 14): Matrix.003 file - promoters60/3597175
gtagcctataaata

SEQ ID NO: 56772 - DNA, 12 bp, Unknown
  misc_feature (1)..( 12): Matrix.003 file - promoters60/3597175
aaaaagtttttt

SEQ ID NO: 56773 - DNA, 15 bp, Unknown
  misc_feature (1)..( 15): Matrix.003 file - promoters60/3597175
tataacaaaaaattt

SEQ ID NO: 56774 - DNA, 10 bp, Unknown
  misc_feature (1)..( 10): Matrix.003 file - promoters60/3597175
aaataaattt

SEQ ID NO: 56775 - DNA, 8 bp, Unknown
  misc_feature (1)..( 8): Matrix.003 file - promoters60/3600084
atttttat

SEQ ID NO: 56776 - DNA, 7 bp, Unknown
  misc_feature (1)..( 7): Matrix.003 file - promoters60/3600084
tccaaaa

SEQ ID NO: 56777 - DNA, 7 bp, Unknown
  misc_feature (1)..( 7): Matrix.003 file - promoters60/3600084
ttaaaaa

SEQ ID NO: 56778 - DNA, 6 bp, Unknown
  misc_feature (1)..( 6): Matrix.003 file - promoters60/3600084
aaaaca

SEQ ID NO: 56779 - DNA, 6 bp, Unknown
  misc_feature (1)..( 6): Matrix.003 file - promoters60/3600084
aattac

SEQ ID NO: 56780 - DNA, 7 bp, Unknown
  misc_feature (1)..( 7): Matrix.003 file - promoters60/3600084
aagaagt

SEQ ID NO: 56781 - DNA, 8 bp, Unknown
  misc_feature (1)..( 8): Matrix.003 file - promoters60/3600084
tttttttt

SEQ ID NO: 56782 - DNA, 10 bp, Unknown
  misc_feature (1)..( 10): Matrix.003 file - promoters60/3600084
attaatgttc

SEQ ID NO: 56783 - DNA, 6 bp, Unknown
  misc_feature (1)..( 6): Matrix.003 file - promoters60/3600084
taaaat

SEQ ID NO: 56784 - DNA, 7 bp, Unknown
  misc_feature (1)..( 7): Matrix.003 file - promoters60/3600084
tccaaaa

SEQ ID NO: 56785 - DNA, 9 bp, Unknown
  misc_feature (1)..( 9): Matrix.003 file - promoters60/3600084
ttcatctca

SEQ ID NO: 56786 - DNA, 6 bp, Unknown
  misc_feature (1)..( 6): Matrix.003 file - promoters60/3600084
catcct

SEQ ID NO: 56787 - DNA, 7 bp, Unknown
  misc_feature (1)..( 7): Matrix.003 file - promoters60/3600084
actgaaa

SEQ ID NO: 56788 - DNA, 8 bp, Unknown
  misc_feature (1)..( 8): Matrix.003 file - promoters60/3600084
aaaacaaa

SEQ ID NO: 56789 - DNA, 7 bp, Unknown
  misc_feature (1)..( 7): Matrix.003 file - promoters60/3600084
gtcaaaa

SEQ ID NO: 56790 - DNA, 7 bp, Unknown
  misc_feature (1)..( 7): Matrix.003 file - promoters60/3611292
ataaaat

SEQ ID NO: 56791 - DNA, 9 bp, Unknown
  misc_feature (1)..( 9): Matrix.003 file - promoters60/3611292
taactaaaa

SEQ ID NO: 56792 - DNA, 8 bp, Unknown
  misc_feature (1)..( 8): Matrix.003 file - promoters60/3611292
tctttttt

SEQ ID NO: 56793 - DNA, 11 bp, Unknown
  misc_feature (1)..( 11): Matrix.003 file - promoters60/3611292
caaaaaaatca

SEQ ID NO: 56794 - DNA, 8 bp, Unknown
  misc_feature (1)..( 8): Matrix.003 file - promoters60/3646410
aaaaaaaa

SEQ ID NO: 56795 - DNA, 9 bp, Unknown
  misc_feature (1)..( 9): Matrix.003 file - promoters60/3646410
aaaagattt

SEQ ID NO: 56796 - DNA, 9 bp, Unknown
  misc_feature (1)..( 9): Matrix.003 file - promoters60/3646410
gaaagtctt

SEQ ID NO: 56797 - DNA, 7 bp, Unknown
  misc_feature (1)..( 7): Matrix.003 file - promoters60/3659211
aatgtag

SEQ ID NO: 56798 - DNA, 8 bp, Unknown
  misc_feature (1)..( 8): Matrix.003 file - promoters60/3659211
aatatttt

SEQ ID NO: 56799 - DNA, 7 bp, Unknown
  misc_feature (1)..( 7): Matrix.003 file - promoters60/3659211
actggtg

SEQ ID NO: 56800 - DNA, 6 bp, Unknown
  misc_feature (1)..( 6): Matrix.003 file - promoters60/3659211
aaaaga

SEQ ID NO: 56801 - DNA, 8 bp, Unknown
  misc_feature (1)..( 8): Matrix.003 file - promoters60/3659211
atttagtt

SEQ ID NO: 56802 - DNA, 7 bp, Unknown
  misc_feature (1)..( 7): Matrix.003 file - promoters60/3659211
tacaatt

SEQ ID NO: 56803 - DNA, 6 bp, Unknown
  misc_feature (1)..( 6): Matrix.003 file - promoters60/3659211
gaatca

SEQ ID NO: 56804 - DNA, 8 bp, Unknown
  misc_feature (1)..( 8): Matrix.003 file - promoters60/3659211
ataaatta

SEQ ID NO: 56805 - DNA, 7 bp, Unknown
  misc_feature (1)..( 7): Matrix.003 file - promoters60/3659211
aaaaaag

SEQ ID NO: 56806 - DNA, 10 bp, Unknown
  misc_feature (1)..( 10): Matrix.003 file - promoters60/3659211
gcaaaaacaa

SEQ ID NO: 56807 - DNA, 7 bp, Unknown
  misc_feature (1)..( 7): Matrix.003 file - promoters60/3659211
gaaaatt

SEQ ID NO: 56808 - DNA, 6 bp, Unknown
  misc_feature (1)..( 6): Matrix.003 file - promoters60/3659211
cgtttt

SEQ ID NO: 56809 - DNA, 7 bp, Unknown
  misc_feature (1)..( 7): Matrix.003 file - promoters60/3659211
cgagaat

SEQ ID NO: 56810 - DNA, 6 bp, Unknown
  misc_feature (1)..( 6): Matrix.003 file - promoters60/3659211
gaatca

SEQ ID NO: 56811 - DNA, 7 bp, Unknown
  misc_feature (1)..( 7): Matrix.003 file - promoters60/3659211
tccagtt

SEQ ID NO: 56812 - DNA, 6 bp, Unknown
  misc_feature (1)..( 6): Matrix.003 file - promoters60/3659211
tttccg

SEQ ID NO: 56813 - DNA, 6 bp, Unknown
  misc_feature (1)..( 6): Matrix.003 file - promoters60/3659211
aaccct

SEQ ID NO: 56814 - DNA, 11 bp, Unknown
  misc_feature (1)..( 11): Matrix.003 file - promoters60/3659426
aaaggaacaag

SEQ ID NO: 56815 - DNA, 8 bp, Unknown
  misc_feature (1)..( 8): Matrix.003 file - promoters60/4254292
tagaaaaa

SEQ ID NO: 56816 - DNA, 9 bp, Unknown
  misc_feature (1)..( 9): Matrix.003 file - promoters60/4254292
tcccaaaat

SEQ ID NO: 56817 - DNA, 12 bp, Unknown
  misc_feature (1)..( 12): Matrix.003 file - promoters60/4254292
ttcttaaatttt

SEQ ID NO: 56818 - DNA, 11 bp, Unknown
  misc_feature (1)..( 11): Matrix.003 file - promoters60/4254292
actgattaaag

SEQ ID NO: 56819 - DNA, 9 bp, Unknown
  misc_feature (1)..( 9): Matrix.003 file - promoters60/4254426
tccttataa

SEQ ID NO: 56820 - DNA, 11 bp, Unknown
  misc_feature (1)..( 11): Matrix.003 file - promoters60/4254807
tagaatttgaa

SEQ ID NO: 56821 - DNA, 7 bp, Unknown
  misc_feature (1)..( 7): Matrix.003 file - promoters60/4256562
tttatta

SEQ ID NO: 56822 - DNA, 7 bp, Unknown
  misc_feature (1)..( 7): Matrix.003 file - promoters60/4256562
attatta

SEQ ID NO: 56823 - DNA, 12 bp, Unknown
  misc_feature (1)..( 12): Matrix.003 file - promoters60/4256562
tagaaaaaacag

SEQ ID NO: 56824 - DNA, 12 bp, Unknown
  misc_feature (1)..( 12): Matrix.003 file - promoters60/4256562
acaaacattaca

SEQ ID NO: 56825 - DNA, 9 bp, Unknown
  misc_feature (1)..( 9): Matrix.003 file - promoters60/4256562
tcgataaaa

SEQ ID NO: 56826 - DNA, 11 bp, Unknown
  misc_feature (1)..( 11): Matrix.003 file - promoters60/4262222
aatttataaat

SEQ ID NO: 56827 - DNA, 9 bp, Unknown
  misc_feature (1)..( 9): Matrix.003 file - promoters60/4262222
atattaaat

SEQ ID NO: 56828 - DNA, 10 bp, Unknown
  misc_feature (1)..( 10): Matrix.003 file - promoters60/4262222
acatgttaga

SEQ ID NO: 56829 - DNA, 6 bp, Unknown
  misc_feature (1)..( 6): Matrix.003 file - promoters60/4262416
aatata

SEQ ID NO: 56830 - DNA, 7 bp, Unknown
  misc_feature (1)..( 7): Matrix.003 file - promoters60/4262416
ttaatat

SEQ ID NO: 56831 - DNA, 6 bp, Unknown
  misc_feature (1)..( 6): Matrix.003 file - promoters60/4262416
tattaa

SEQ ID NO: 56832 - DNA, 6 bp, Unknown
  misc_feature (1)..( 6): Matrix.003 file - promoters60/4262416
tatatt

SEQ ID NO: 56833 - DNA, 7 bp, Unknown
  misc_feature (1)..( 7): Matrix.003 file - promoters60/4262416
attatca

SEQ ID NO: 56834 - DNA, 6 bp, Unknown
  misc_feature (1)..( 6): Matrix.003 file - promoters60/4262416
aataaa

SEQ ID NO: 56835 - DNA, 11 bp, Unknown
  misc_feature (1)..( 11): Matrix.003 file - promoters60/4262416
ataaacgcaaa

SEQ ID NO: 56836 - DNA, 8 bp, Unknown
  misc_feature (1)..( 8): Matrix.003 file - promoters60/4262416
ctgaaata

SEQ ID NO: 56837 - DNA, 6 bp, Unknown
  misc_feature (1)..( 6): Matrix.003 file - promoters60/4262416
aaacct

SEQ ID NO: 56838 - DNA, 6 bp, Unknown
  misc_feature (1)..( 6): Matrix.003 file - promoters60/4262416
aaatag

SEQ ID NO: 56839 - DNA, 6 bp, Unknown
  misc_feature (1)..( 6): Matrix.003 file - promoters60/4262416
aacacg

SEQ ID NO: 56840 - DNA, 9 bp, Unknown
  misc_feature (1)..( 9): Matrix.003 file - promoters60/4262416
aatactttg

SEQ ID NO: 56841 - DNA, 7 bp, Unknown
  misc_feature (1)..( 7): Matrix.003 file - promoters60/4262416
acaaaaa

SEQ ID NO: 56842 - DNA, 7 bp, Unknown
  misc_feature (1)..( 7): Matrix.003 file - promoters60/4262416
gtccaat

SEQ ID NO: 56843 - DNA, 7 bp, Unknown
  misc_feature (1)..( 7): Matrix.003 file - promoters60/4262416
aattcat

SEQ ID NO: 56844 - DNA, 6 bp, Unknown
  misc_feature (1)..( 6): Matrix.003 file - promoters60/4262416
acagaa

SEQ ID NO: 56845 - DNA, 9 bp, Unknown
  misc_feature (1)..( 9): Matrix.003 file - promoters60/4262420
atattttta

SEQ ID NO: 56846 - DNA, 10 bp, Unknown
  misc_feature (1)..( 10): Matrix.003 file - promoters60/4262422
tagtgttaat

SEQ ID NO: 56847 - DNA, 9 bp, Unknown
  misc_feature (1)..( 9): Matrix.003 file - promoters60/4262422
tggataaga

SEQ ID NO: 56848 - DNA, 12 bp, Unknown
  misc_feature (1)..( 12): Matrix.003 file - promoters60/4262422
taatttaattag

SEQ ID NO: 56849 - DNA, 9 bp, Unknown
  misc_feature (1)..( 9): Matrix.003 file - promoters60/4262428
aatataaat

SEQ ID NO: 56850 - DNA, 9 bp, Unknown
  misc_feature (1)..( 9): Matrix.003 file - promoters60/4262428
taatataaa

SEQ ID NO: 56851 - DNA, 14 bp, Unknown
  misc_feature (1)..( 14): Matrix.003 file - promoters60/4262446
agaaattttttaaa

SEQ ID NO: 56852 - DNA, 11 bp, Unknown
  misc_feature (1)..( 11): Matrix.003 file - promoters60/4262446
taatttctatt

SEQ ID NO: 56853 - DNA, 11 bp, Unknown
  misc_feature (1)..( 11): Matrix.003 file - promoters60/4262446
ttattaaacaa

SEQ ID NO: 56854 - DNA, 11 bp, Unknown
  misc_feature (1)..( 11): Matrix.003 file - promoters60/4262446
attttgaaata

SEQ ID NO: 56855 - DNA, 12 bp, Unknown
  misc_feature (1)..( 12): Matrix.003 file - promoters60/4262446
attttcaaatca

SEQ ID NO: 56856 - DNA, 8 bp, Unknown
  misc_feature (1)..( 8): Matrix.003 file - promoters60/4262446
aaaaattt

SEQ ID NO: 56857 - DNA, 10 bp, Unknown
  misc_feature (1)..( 10): Matrix.003 file - promoters60/4262446
tattaaaaaa

SEQ ID NO: 56858 - DNA, 12 bp, Unknown
  misc_feature (1)..( 12): Matrix.003 file - promoters60/4262446
tttataaaaaga

SEQ ID NO: 56859 - DNA, 9 bp, Unknown
  misc_feature (1)..( 9): Matrix.003 file - promoters60/4262446
caataaatt

SEQ ID NO: 56860 - DNA, 8 bp, Unknown
  misc_feature (1)..( 8): Matrix.003 file - promoters60/4262562
gagattct

SEQ ID NO: 56861 - DNA, 13 bp, Unknown
  misc_feature (1)..( 13): Matrix.003 file - promoters60/4262562
taattaaactttt

SEQ ID NO: 56862 - DNA, 9 bp, Unknown
  misc_feature (1)..( 9): Matrix.003 file - promoters60/4262562
gagtgacaa

SEQ ID NO: 56863 - DNA, 8 bp, Unknown
  misc_feature (1)..( 8): Matrix.003 file - promoters60/4262562
atatcgaa

SEQ ID NO: 56864 - DNA, 8 bp, Unknown
  misc_feature (1)..( 8): Matrix.003 file - promoters60/4262562
tacgaaat

SEQ ID NO: 56865 - DNA, 8 bp, Unknown
  misc_feature (1)..( 8): Matrix.003 file - promoters60/4262562
atacttat

SEQ ID NO: 56866 - DNA, 7 bp, Unknown
  misc_feature (1)..( 7): Matrix.003 file - promoters60/4262562
atagatt

SEQ ID NO: 56867 - DNA, 11 bp, Unknown
  misc_feature (1)..( 11): Matrix.003 file - promoters60/4265699
tttagtcaaaa

SEQ ID NO: 56868 - DNA, 9 bp, Unknown
  misc_feature (1)..( 9): Matrix.003 file - promoters60/4265699
aaaagaaat

SEQ ID NO: 56869 - DNA, 12 bp, Unknown
  misc_feature (1)..( 12): Matrix.003 file - promoters60/4267125
cttttcccaaca

SEQ ID NO: 56870 - DNA, 8 bp, Unknown
  misc_feature (1)..( 8): Matrix.003 file - promoters60/4270131
ttaataac

SEQ ID NO: 56871 - DNA, 7 bp, Unknown
  misc_feature (1)..( 7): Matrix.003 file - promoters60/4270131
gctgaga

SEQ ID NO: 56872 - DNA, 6 bp, Unknown
  misc_feature (1)..( 6): Matrix.003 file - promoters60/4270131
tttttt

SEQ ID NO: 56873 - DNA, 7 bp, Unknown
  misc_feature (1)..( 7): Matrix.003 file - promoters60/4270131
tttgttt

SEQ ID NO: 56874 - DNA, 7 bp, Unknown
  misc_feature (1)..( 7): Matrix.003 file - promoters60/4270131
tttattt

SEQ ID NO: 56875 - DNA, 7 bp, Unknown
  misc_feature (1)..( 7): Matrix.003 file - promoters60/4270131
ctaattt

SEQ ID NO: 56876 - DNA, 9 bp, Unknown
  misc_feature (1)..( 9): Matrix.003 file - promoters60/4270131
ccgaatttt

SEQ ID NO: 56877 - DNA, 6 bp, Unknown
  misc_feature (1)..( 6): Matrix.003 file - promoters60/4270131
tttatc

SEQ ID NO: 56878 - DNA, 6 bp, Unknown
  misc_feature (1)..( 6): Matrix.003 file - promoters60/4270131
agcaaa

SEQ ID NO: 56879 - DNA, 7 bp, Unknown
  misc_feature (1)..( 7): Matrix.003 file - promoters60/4270131
atgaaca

SEQ ID NO: 56880 - DNA, 6 bp, Unknown
  misc_feature (1)..( 6): Matrix.003 file - promoters60/4270131
tgtttc

SEQ ID NO: 56881 - DNA, 6 bp, Unknown
  misc_feature (1)..( 6): Matrix.003 file - promoters60/4270131
tataaa

SEQ ID NO: 56882 - DNA, 6 bp, Unknown
  misc_feature (1)..( 6): Matrix.003 file - promoters60/4270131
tataaa

SEQ ID NO: 56883 - DNA, 9 bp, Unknown
  misc_feature (1)..( 9): Matrix.003 file - promoters60/4281576
caaaaaaaa

SEQ ID NO: 56884 - DNA, 11 bp, Unknown
  misc_feature (1)..( 11): Matrix.003 file - promoters60/4281576
taattttttgt

SEQ ID NO: 56885 - DNA, 7 bp, Unknown
  misc_feature (1)..( 7): Matrix.003 file - promoters60/4281576
tcatatt

SEQ ID NO: 56886 - DNA, 9 bp, Unknown
  misc_feature (1)..( 9): Matrix.003 file - promoters60/4281576
taacaaaac

SEQ ID NO: 56887 - DNA, 8 bp, Unknown
  misc_feature (1)..( 8): Matrix.003 file - promoters60/4281576
gtctttct

SEQ ID NO: 56888 - DNA, 6 bp, Unknown
  misc_feature (1)..( 6): Matrix.003 file - promoters60/4281645
tatttt

SEQ ID NO: 56889 - DNA, 7 bp, Unknown
  misc_feature (1)..( 7): Matrix.003 file - promoters60/4281645
aaaacat

SEQ ID NO: 56890 - DNA, 8 bp, Unknown
  misc_feature (1)..( 8): Matrix.003 file - promoters60/4281645
aatatgat

SEQ ID NO: 56891 - DNA, 7 bp, Unknown
  misc_feature (1)..( 7): Matrix.003 file - promoters60/4281645
gatcaat

SEQ ID NO: 56892 - DNA, 6 bp, Unknown
  misc_feature (1)..( 6): Matrix.003 file - promoters60/4281645
aaattt

SEQ ID NO: 56893 - DNA, 6 bp, Unknown
  misc_feature (1)..( 6): Matrix.003 file - promoters60/4281645
agaaaa

SEQ ID NO: 56894 - DNA, 8 bp, Unknown
  misc_feature (1)..( 8): Matrix.003 file - promoters60/4281645
agaaaatt

SEQ ID NO: 56895 - DNA, 10 bp, Unknown
  misc_feature (1)..( 10): Matrix.003 file - promoters60/4281645
aacaaaaaaa

SEQ ID NO: 56896 - DNA, 6 bp, Unknown
  misc_feature (1)..( 6): Matrix.003 file - promoters60/4281645
tgaaaa

SEQ ID NO: 56897 - DNA, 7 bp, Unknown
  misc_feature (1)..( 7): Matrix.003 file - promoters60/4281645
tgtgata

SEQ ID NO: 56898 - DNA, 7 bp, Unknown
  misc_feature (1)..( 7): Matrix.003 file - promoters60/4281645
aaacaac

SEQ ID NO: 56899 - DNA, 8 bp, Unknown
  misc_feature (1)..( 8): Matrix.003 file - promoters60/4281645
ccggagaa

SEQ ID NO: 56900 - DNA, 7 bp, Unknown
  misc_feature (1)..( 7): Matrix.003 file - promoters60/4281645
gtaactc

SEQ ID NO: 56901 - DNA, 7 bp, Unknown
  misc_feature (1)..( 7): Matrix.003 file - promoters60/4281645
gtttatg

SEQ ID NO: 56902 - DNA, 8 bp, Unknown
  misc_feature (1)..( 8): Matrix.003 file - promoters60/4281645
aactgaaa

SEQ ID NO: 56903 - DNA, 6 bp, Unknown
  misc_feature (1)..( 6): Matrix.003 file - promoters60/4281645
caaaaa

SEQ ID NO: 56904 - DNA, 7 bp, Unknown
  misc_feature (1)..( 7): Matrix.003 file - promoters60/4281645
aaaatat

SEQ ID NO: 56905 - DNA, 7 bp, Unknown
  misc_feature (1)..( 7): Matrix.003 file - promoters60/4281645
gtctctc

SEQ ID NO: 56906 - DNA, 10 bp, Unknown
  misc_feature (1)..( 10): Matrix.003 file - promoters60/4281662
actttataaa

SEQ ID NO: 56907 - DNA, 8 bp, Unknown
  misc_feature (1)..( 8): Matrix.003 file - promoters60/4281662
aagatagt

SEQ ID NO: 56908 - DNA, 8 bp, Unknown
  misc_feature (1)..( 8): Matrix.003 file - promoters60/4281662
attatgtc

SEQ ID NO: 56909 - DNA, 9 bp, Unknown
  misc_feature (1)..( 9): Matrix.003 file - promoters60/4281662
ctttaaaat

SEQ ID NO: 56910 - DNA, 7 bp, Unknown
  misc_feature (1)..( 7): Matrix.003 file - promoters60/4281662
tccattt

SEQ ID NO: 56911 - DNA, 7 bp, Unknown
  misc_feature (1)..( 7): Matrix.003 file - promoters60/4281683
aacctat

SEQ ID NO: 56912 - DNA, 6 bp, Unknown
  misc_feature (1)..( 6): Matrix.003 file - promoters60/4281683
cttttc

SEQ ID NO: 56913 - DNA, 6 bp, Unknown
  misc_feature (1)..( 6): Matrix.003 file - promoters60/4281683
cttgaa

SEQ ID NO: 56914 - DNA, 9 bp, Unknown
  misc_feature (1)..( 9): Matrix.003 file - promoters60/4281683
cacaatccc

SEQ ID NO: 56915 - DNA, 6 bp, Unknown
  misc_feature (1)..( 6): Matrix.003 file - promoters60/4281683
agaaaa

SEQ ID NO: 56916 - DNA, 12 bp, Unknown
  misc_feature (1)..( 12): Matrix.003 file - promoters60/4281683
cttttcaatttc

SEQ ID NO: 56917 - DNA, 7 bp, Unknown
  misc_feature (1)..( 7): Matrix.003 file - promoters60/4281683
ctacatt

SEQ ID NO: 56918 - DNA, 7 bp, Unknown
  misc_feature (1)..( 7): Matrix.003 file - promoters60/4281683
tttgtat

SEQ ID NO: 56919 - DNA, 6 bp, Unknown
  misc_feature (1)..( 6): Matrix.003 file - promoters60/4281683
atttaa

SEQ ID NO: 56920 - DNA, 6 bp, Unknown
  misc_feature (1)..( 6): Matrix.003 file - promoters60/4281683
aactat

SEQ ID NO: 56921 - DNA, 7 bp, Unknown
  misc_feature (1)..( 7): Matrix.003 file - promoters60/4281683
attcggt

SEQ ID NO: 56922 - DNA, 6 bp, Unknown
  misc_feature (1)..( 6): Matrix.003 file - promoters60/4281683
caacca

SEQ ID NO: 56923 - DNA, 6 bp, Unknown
  misc_feature (1)..( 6): Matrix.003 file - promoters60/4281683
ggctga

SEQ ID NO: 56924 - DNA, 11 bp, Unknown
  misc_feature (1)..( 11): Matrix.003 file - promoters60/4281683
agggtctcaga

SEQ ID NO: 56925 - DNA, 6 bp, Unknown
  misc_feature (1)..( 6): Matrix.003 file - promoters60/4281683
agattt

SEQ ID NO: 56926 - DNA, 8 bp, Unknown
  misc_feature (1)..( 8): Matrix.003 file - promoters60/4281690
aaaacaaa

SEQ ID NO: 56927 - DNA, 8 bp, Unknown
  misc_feature (1)..( 8): Matrix.003 file - promoters60/4281690
cctctata

SEQ ID NO: 56928 - DNA, 6 bp, Unknown
  misc_feature (1)..( 6): Matrix.003 file - promoters60/4281690
aataaa

SEQ ID NO: 56929 - DNA, 12 bp, Unknown
  misc_feature (1)..( 12): Matrix.003 file - promoters60/4281690
attacaaaatat

SEQ ID NO: 56930 - DNA, 8 bp, Unknown
  misc_feature (1)..( 8): Matrix.003 file - promoters60/4281711
gaataaaa

SEQ ID NO: 56931 - DNA, 9 bp, Unknown
  misc_feature (1)..( 9): Matrix.003 file - promoters60/4281737
aacaaaaaa

SEQ ID NO: 56932 - DNA, 9 bp, Unknown
  misc_feature (1)..( 9): Matrix.003 file - promoters60/4281737
aaatgtatt

SEQ ID NO: 56933 - DNA, 9 bp, Unknown
  misc_feature (1)..( 9): Matrix.003 file - promoters60/4281737
aagtttttg

SEQ ID NO: 56934 - DNA, 14 bp, Unknown
  misc_feature (1)..( 14): Matrix.003 file - promoters60/4281737
aatataaatggaat

SEQ ID NO: 56935 - DNA, 14 bp, Unknown
  misc_feature (1)..( 14): Matrix.003 file - promoters60/4281737
atatataaaaatat

SEQ ID NO: 56936 - DNA, 9 bp, Unknown
  misc_feature (1)..( 9): Matrix.003 file - promoters60/4281737
ttactccaa

SEQ ID NO: 56937 - DNA, 14 bp, Unknown
  misc_feature (1)..( 14): Matrix.003 file - promoters60/4281737
caaacctcatttaa

SEQ ID NO: 56938 - DNA, 12 bp, Unknown
  misc_feature (1)..( 12): Matrix.003 file - promoters60/4281737
agaatttaattt

SEQ ID NO: 56939 - DNA, 10 bp, Unknown
  misc_feature (1)..( 10): Matrix.003 file - promoters60/4281744
gaaatagatt

SEQ ID NO: 56940 - DNA, 9 bp, Unknown
  misc_feature (1)..( 9): Matrix.003 file - promoters60/4281773
tatataaac

SEQ ID NO: 56941 - DNA, 11 bp, Unknown
  misc_feature (1)..( 11): Matrix.003 file - promoters60/4281773
taaaataaatt

SEQ ID NO: 56942 - DNA, 7 bp, Unknown
  misc_feature (1)..( 7): Matrix.003 file - promoters60/4281799
gcaaaag

SEQ ID NO: 56943 - DNA, 8 bp, Unknown
  misc_feature (1)..( 8): Matrix.003 file - promoters60/4281799
taaacccg

SEQ ID NO: 56944 - DNA, 8 bp, Unknown
  misc_feature (1)..( 8): Matrix.003 file - promoters60/4281799
acaaattt

SEQ ID NO: 56945 - DNA, 6 bp, Unknown
  misc_feature (1)..( 6): Matrix.003 file - promoters60/4281799
ccatta

SEQ ID NO: 56946 - DNA, 7 bp, Unknown
  misc_feature (1)..( 7): Matrix.003 file - promoters60/4281799
attatta

SEQ ID NO: 56947 - DNA, 8 bp, Unknown
  misc_feature (1)..( 8): Matrix.003 file - promoters60/4281799
actaaaaa

SEQ ID NO: 56948 - DNA, 7 bp, Unknown
  misc_feature (1)..( 7): Matrix.003 file - promoters60/4281799
atagatt

SEQ ID NO: 56949 - DNA, 6 bp, Unknown
  misc_feature (1)..( 6): Matrix.003 file - promoters60/4281799
agcaaa

SEQ ID NO: 56950 - DNA, 7 bp, Unknown
  misc_feature (1)..( 7): Matrix.003 file - promoters60/4281799
aaaactt

SEQ ID NO: 56951 - DNA, 7 bp, Unknown
  misc_feature (1)..( 7): Matrix.003 file - promoters60/4281799
aatgtgg

SEQ ID NO: 56952 - DNA, 10 bp, Unknown
  misc_feature (1)..( 10): Matrix.003 file - promoters60/4281799
ttgaaattca

SEQ ID NO: 56953 - DNA, 11 bp, Unknown
  misc_feature (1)..( 11): Matrix.003 file - promoters60/4281799
gttttaataaa

SEQ ID NO: 56954 - DNA, 9 bp, Unknown
  misc_feature (1)..( 9): Matrix.003 file - promoters60/4281799
aaatcattt

SEQ ID NO: 56955 - DNA, 7 bp, Unknown
  misc_feature (1)..( 7): Matrix.003 file - promoters60/4281799
ttttgta

SEQ ID NO: 56956 - DNA, 7 bp, Unknown
  misc_feature (1)..( 7): Matrix.003 file - promoters60/4281799
tgtaaat

SEQ ID NO: 56957 - DNA, 7 bp, Unknown
  misc_feature (1)..( 7): Matrix.003 file - promoters60/4281799
tttggta

SEQ ID NO: 56958 - DNA, 7 bp, Unknown
  misc_feature (1)..( 7): Matrix.003 file - promoters60/4281799
aaataga

SEQ ID NO: 56959 - DNA, 7 bp, Unknown
  misc_feature (1)..( 7): Matrix.003 file - promoters60/4281799
tttccaa

SEQ ID NO: 56960 - DNA, 6 bp, Unknown
  misc_feature (1)..( 6): Matrix.003 file - promoters60/4281799
aaaaat

SEQ ID NO: 56961 - DNA, 9 bp, Unknown
  misc_feature (1)..( 9): Matrix.003 file - promoters60/4281799
aaaagccct

SEQ ID NO: 56962 - DNA, 9 bp, Unknown
  misc_feature (1)..( 9): Matrix.003 file - promoters60/4281799
tattgaaac

SEQ ID NO: 56963 - DNA, 10 bp, Unknown
  misc_feature (1)..( 10): Matrix.003 file - promoters60/4281837
cttgtaatct

SEQ ID NO: 56964 - DNA, 8 bp, Unknown
  misc_feature (1)..( 8): Matrix.003 file - promoters60/4281837
tatattac

SEQ ID NO: 56965 - DNA, 9 bp, Unknown
  misc_feature (1)..( 9): Matrix.003 file - promoters60/4281837
ttgtctgtg

SEQ ID NO: 56966 - DNA, 10 bp, Unknown
  misc_feature (1)..( 10): Matrix.003 file - promoters60/4281837
taaaaaaata

SEQ ID NO: 56967 - DNA, 12 bp, Unknown
  misc_feature (1)..( 12): Matrix.003 file - promoters60/4281837
tactatattact

SEQ ID NO: 56968 - DNA, 9 bp, Unknown
  misc_feature (1)..( 9): Matrix.003 file - promoters60/4281837
gaaacaaaa

SEQ ID NO: 56969 - DNA, 9 bp, Unknown
  misc_feature (1)..( 9): Matrix.003 file - promoters60/4281837
ttattttta

SEQ ID NO: 56970 - DNA, 9 bp, Unknown
  misc_feature (1)..( 9): Matrix.003 file - promoters60/4281876
aataaataa

SEQ ID NO: 56971 - DNA, 11 bp, Unknown
  misc_feature (1)..( 11): Matrix.003 file - promoters60/4281925
aaaataaaaca

SEQ ID NO: 56972 - DNA, 10 bp, Unknown
  misc_feature (1)..( 10): Matrix.003 file - promoters60/4281925
taaatttttt

SEQ ID NO: 56973 - DNA, 10 bp, Unknown
  misc_feature (1)..( 10): Matrix.003 file - promoters60/4281925
tacatgatat

SEQ ID NO: 56974 - DNA, 11 bp, Unknown
  misc_feature (1)..( 11): Matrix.003 file - promoters60/4281925
ttataaaaata

SEQ ID NO: 56975 - DNA, 12 bp, Unknown
  misc_feature (1)..( 12): Matrix.003 file - promoters60/4281925
taatttacaaat

SEQ ID NO: 56976 - DNA, 15 bp, Unknown
  misc_feature (1)..( 15): Matrix.003 file - promoters60/4281925
atcaaaatttgtttt

SEQ ID NO: 56977 - DNA, 11 bp, Unknown
  misc_feature (1)..( 11): Matrix.003 file - promoters60/4281925
aaaaatttttt

SEQ ID NO: 56978 - DNA, 12 bp, Unknown
  misc_feature (1)..( 12): Matrix.003 file - promoters60/4281961
tagaaaaaacag

SEQ ID NO: 56979 - DNA, 12 bp, Unknown
  misc_feature (1)..( 12): Matrix.003 file - promoters60/4281961
acaaacattaca

SEQ ID NO: 56980 - DNA, 10 bp, Unknown
  misc_feature (1)..( 10): Matrix.003 file - promoters60/4281961
tcgttaaaag

SEQ ID NO: 56981 - DNA, 6 bp, Unknown
  misc_feature (1)..( 6): Matrix.003 file - promoters60/4281994
aatttt

SEQ ID NO: 56982 - DNA, 6 bp, Unknown
  misc_feature (1)..( 6): Matrix.003 file - promoters60/4281994
ttcaaa

SEQ ID NO: 56983 - DNA, 7 bp, Unknown
  misc_feature (1)..( 7): Matrix.003 file - promoters60/4281994
attcaaa

SEQ ID NO: 56984 - DNA, 7 bp, Unknown
  misc_feature (1)..( 7): Matrix.003 file - promoters60/4281994
aaacaaa

SEQ ID NO: 56985 - DNA, 7 bp, Unknown
  misc_feature (1)..( 7): Matrix.003 file - promoters60/4281994
aatattt

SEQ ID NO: 56986 - DNA, 8 bp, Unknown
  misc_feature (1)..( 8): Matrix.003 file - promoters60/4281994
agtagaat

SEQ ID NO: 56987 - DNA, 6 bp, Unknown
  misc_feature (1)..( 6): Matrix.003 file - promoters60/4281994
tttaaa

SEQ ID NO: 56988 - DNA, 9 bp, Unknown
  misc_feature (1)..( 9): Matrix.003 file - promoters60/4281994
ataaaatta

SEQ ID NO: 56989 - DNA, 9 bp, Unknown
  misc_feature (1)..( 9): Matrix.003 file - promoters60/4281994
ataaaatta

SEQ ID NO: 56990 - DNA, 9 bp, Unknown
  misc_feature (1)..( 9): Matrix.003 file - promoters60/4281994
attttaaag

SEQ ID NO: 56991 - DNA, 7 bp, Unknown
  misc_feature (1)..( 7): Matrix.003 file - promoters60/4281994
ataatta

SEQ ID NO: 56992 - DNA, 9 bp, Unknown
  misc_feature (1)..( 9): Matrix.003 file - promoters60/4281994
tataaatta

SEQ ID NO: 56993 - DNA, 6 bp, Unknown
  misc_feature (1)..( 6): Matrix.003 file - promoters60/4281994
aaatta

SEQ ID NO: 56994 - DNA, 8 bp, Unknown
  misc_feature (1)..( 8): Matrix.003 file - promoters60/4281994
tattaata

SEQ ID NO: 56995 - DNA, 9 bp, Unknown
  misc_feature (1)..( 9): Matrix.003 file - promoters60/4281994
ataacttat

SEQ ID NO: 56996 - DNA, 8 bp, Unknown
  misc_feature (1)..( 8): Matrix.003 file - promoters60/4281994
aaaaagaa

SEQ ID NO: 56997 - DNA, 6 bp, Unknown
  misc_feature (1)..( 6): Matrix.003 file - promoters60/4281994
agtaaa

SEQ ID NO: 56998 - DNA, 6 bp, Unknown
  misc_feature (1)..( 6): Matrix.003 file - promoters60/4281994
aaaaat

SEQ ID NO: 56999 - DNA, 6 bp, Unknown
  misc_feature (1)..( 6): Matrix.003 file - promoters60/4281994
aataaa

SEQ ID NO: 57000 - DNA, 6 bp, Unknown
  misc_feature (1)..( 6): Matrix.003 file - promoters60/4281994
taattt

SEQ ID NO: 57001 - DNA, 7 bp, Unknown
  misc_feature (1)..( 7): Matrix.003 file - promoters60/4281994
attcata

SEQ ID NO: 57002 - DNA, 6 bp, Unknown
  misc_feature (1)..( 6): Matrix.003 file - promoters60/4281994
ctatat

SEQ ID NO: 57003 - DNA, 6 bp, Unknown
  misc_feature (1)..( 6): Matrix.003 file - promoters60/4281994
tatata

SEQ ID NO: 57004 - DNA, 6 bp, Unknown
  misc_feature (1)..( 6): Matrix.003 file - promoters60/4281994
ttagaa

SEQ ID NO: 57005 - DNA, 15 bp, Unknown
  misc_feature (1)..( 15): Matrix.003 file - promoters60/4281997
aacaaaaaaagttta

SEQ ID NO: 57006 - DNA, 15 bp, Unknown
  misc_feature (1)..( 15): Matrix.003 file - promoters60/4281997
atcactgatccaaca

SEQ ID NO: 57007 - DNA, 7 bp, Unknown
  misc_feature (1)..( 7): Matrix.003 file - promoters60/4281997
aattatc

SEQ ID NO: 57008 - DNA, 10 bp, Unknown
  misc_feature (1)..( 10): Matrix.003 file - promoters60/4282072
ctataatgaa

SEQ ID NO: 57009 - DNA, 6 bp, Unknown
  misc_feature (1)..( 6): Matrix.003 file - promoters60/4282072
atttgt

SEQ ID NO: 57010 - DNA, 8 bp, Unknown
  misc_feature (1)..( 8): Matrix.003 file - promoters60/4282072
tatgtttg

SEQ ID NO: 57011 - DNA, 6 bp, Unknown
  misc_feature (1)..( 6): Matrix.003 file - promoters60/4282072
actata

SEQ ID NO: 57012 - DNA, 7 bp, Unknown
  misc_feature (1)..( 7): Matrix.003 file - promoters60/4282072
caaaaac

SEQ ID NO: 57013 - DNA, 7 bp, Unknown
  misc_feature (1)..( 7): Matrix.003 file - promoters60/4282072
caaaatc

SEQ ID NO: 57014 - DNA, 9 bp, Unknown
  misc_feature (1)..( 9): Matrix.003 file - promoters60/4282072
actacaaac

SEQ ID NO: 57015 - DNA, 6 bp, Unknown
  misc_feature (1)..( 6): Matrix.003 file - promoters60/4282072
aaaact

SEQ ID NO: 57016 - DNA, 8 bp, Unknown
  misc_feature (1)..( 8): Matrix.003 file - promoters60/4282072
aacaatat

SEQ ID NO: 57017 - DNA, 8 bp, Unknown
  misc_feature (1)..( 8): Matrix.003 file - promoters60/4282072
aggcaaat

SEQ ID NO: 57018 - DNA, 10 bp, Unknown
  misc_feature (1)..( 10): Matrix.003 file - promoters60/4282072
cagtgtcgga

SEQ ID NO: 57019 - DNA, 9 bp, Unknown
  misc_feature (1)..( 9): Matrix.003 file - promoters60/4282072
ttttgatta

SEQ ID NO: 57020 - DNA, 6 bp, Unknown
  misc_feature (1)..( 6): Matrix.003 file - promoters60/4282072
taaaca

SEQ ID NO: 57021 - DNA, 7 bp, Unknown
  misc_feature (1)..( 7): Matrix.003 file - promoters60/4282072
taaatct

SEQ ID NO: 57022 - DNA, 8 bp, Unknown
  misc_feature (1)..( 8): Matrix.003 file - promoters60/4282072
tactaact

SEQ ID NO: 57023 - DNA, 10 bp, Unknown
  misc_feature (1)..( 10): Matrix.003 file - promoters60/4282072
aaaaataaag

SEQ ID NO: 57024 - DNA, 7 bp, Unknown
  misc_feature (1)..( 7): Matrix.003 file - promoters60/4282072
agaaaag

SEQ ID NO: 57025 - DNA, 9 bp, Unknown
  misc_feature (1)..( 9): Matrix.003 file - promoters60/4282072
caaaaaaga

SEQ ID NO: 57026 - DNA, 10 bp, Unknown
  misc_feature (1)..( 10): Matrix.003 file - promoters60/4282072
attaaaaaaa

SEQ ID NO: 57027 - DNA, 7 bp, Unknown
  misc_feature (1)..( 7): Matrix.003 file - promoters60/4282126
tctgcaa

SEQ ID NO: 57028 - DNA, 8 bp, Unknown
  misc_feature (1)..( 8): Matrix.003 file - promoters60/4282126
cataaaca

SEQ ID NO: 57029 - DNA, 8 bp, Unknown
  misc_feature (1)..( 8): Matrix.003 file - promoters60/4282126
tacaattt

SEQ ID NO: 57030 - DNA, 6 bp, Unknown
  misc_feature (1)..( 6): Matrix.003 file - promoters60/4282126
aaacat

SEQ ID NO: 57031 - DNA, 6 bp, Unknown
  misc_feature (1)..( 6): Matrix.003 file - promoters60/4282126
taattg

SEQ ID NO: 57032 - DNA, 7 bp, Unknown
  misc_feature (1)..( 7): Matrix.003 file - promoters60/4282126
ttagcat

SEQ ID NO: 57033 - DNA, 11 bp, Unknown
  misc_feature (1)..( 11): Matrix.003 file - promoters60/4282126
aatttattgtt

SEQ ID NO: 57034 - DNA, 8 bp, Unknown
  misc_feature (1)..( 8): Matrix.003 file - promoters60/4282126
tttgtaat

SEQ ID NO: 57035 - DNA, 9 bp, Unknown
  misc_feature (1)..( 9): Matrix.003 file - promoters60/4282126
aagcaaatc

SEQ ID NO: 57036 - DNA, 7 bp, Unknown
  misc_feature (1)..( 7): Matrix.003 file - promoters60/4282126
tttgttt

SEQ ID NO: 57037 - DNA, 7 bp, Unknown
  misc_feature (1)..( 7): Matrix.003 file - promoters60/4282126
tttagat

SEQ ID NO: 57038 - DNA, 8 bp, Unknown
  misc_feature (1)..( 8): Matrix.003 file - promoters60/4282126
aagtcaga

SEQ ID NO: 57039 - DNA, 7 bp, Unknown
  misc_feature (1)..( 7): Matrix.003 file - promoters60/4282126
aaagtta

SEQ ID NO: 57040 - DNA, 7 bp, Unknown
  misc_feature (1)..( 7): Matrix.003 file - promoters60/4282126
ctcagac

SEQ ID NO: 57041 - DNA, 6 bp, Unknown
  misc_feature (1)..( 6): Matrix.003 file - promoters60/4282126
cgagag

SEQ ID NO: 57042 - DNA, 8 bp, Unknown
  misc_feature (1)..( 8): Matrix.003 file - promoters60/4282126
ttgggaga

SEQ ID NO: 57043 - DNA, 6 bp, Unknown
  misc_feature (1)..( 6): Matrix.003 file - promoters60/4282126
gtgaca

SEQ ID NO: 57044 - DNA, 7 bp, Unknown
  misc_feature (1)..( 7): Matrix.003 file - promoters60/4282126
agaccaa

SEQ ID NO: 57045 - DNA, 9 bp, Unknown
  misc_feature (1)..( 9): Matrix.003 file - promoters60/4282126
aaactaaac

SEQ ID NO: 57046 - DNA, 7 bp, Unknown
  misc_feature (1)..( 7): Matrix.003 file - promoters60/4282126
agaagaa

SEQ ID NO: 57047 - DNA, 7 bp, Unknown
  misc_feature (1)..( 7): Matrix.003 file - promoters60/4282145
tcaaatg

SEQ ID NO: 57048 - DNA, 6 bp, Unknown
  misc_feature (1)..( 6): Matrix.003 file - promoters60/4282145
cataat

SEQ ID NO: 57049 - DNA, 10 bp, Unknown
  misc_feature (1)..( 10): Matrix.003 file - promoters60/4282145
gaaaatgatt

SEQ ID NO: 57050 - DNA, 8 bp, Unknown
  misc_feature (1)..( 8): Matrix.003 file - promoters60/4282145
attagacg

SEQ ID NO: 57051 - DNA, 6 bp, Unknown
  misc_feature (1)..( 6): Matrix.003 file - promoters60/4282145
caaaaa

SEQ ID NO: 57052 - DNA, 8 bp, Unknown
  misc_feature (1)..( 8): Matrix.003 file - promoters60/4282145
aaactaat

SEQ ID NO: 57053 - DNA, 7 bp, Unknown
  misc_feature (1)..( 7): Matrix.003 file - promoters60/4282145
gttaaac

SEQ ID NO: 57054 - DNA, 7 bp, Unknown
  misc_feature (1)..( 7): Matrix.003 file - promoters60/4282145
attttat

SEQ ID NO: 57055 - DNA, 7 bp, Unknown
  misc_feature (1)..( 7): Matrix.003 file - promoters60/4282145
tttaaaa

SEQ ID NO: 57056 - DNA, 6 bp, Unknown
  misc_feature (1)..( 6): Matrix.003 file - promoters60/4282145
aatttg

SEQ ID NO: 57057 - DNA, 7 bp, Unknown
  misc_feature (1)..( 7): Matrix.003 file - promoters60/4282145
ttaataa

SEQ ID NO: 57058 - DNA, 7 bp, Unknown
  misc_feature (1)..( 7): Matrix.003 file - promoters60/4282145
tacaata

SEQ ID NO: 57059 - DNA, 8 bp, Unknown
  misc_feature (1)..( 8): Matrix.003 file - promoters60/4282145
acaaaaca

SEQ ID NO: 57060 - DNA, 6 bp, Unknown
  misc_feature (1)..( 6): Matrix.003 file - promoters60/4282145
gacaaa

SEQ ID NO: 57061 - DNA, 7 bp, Unknown
  misc_feature (1)..( 7): Matrix.003 file - promoters60/4282145
ataataa

SEQ ID NO: 57062 - DNA, 6 bp, Unknown
  misc_feature (1)..( 6): Matrix.003 file - promoters60/4282145
cttata

SEQ ID NO: 57063 - DNA, 9 bp, Unknown
  misc_feature (1)..( 9): Matrix.003 file - promoters60/4282145
attttaaaa

SEQ ID NO: 57064 - DNA, 8 bp, Unknown
  misc_feature (1)..( 8): Matrix.003 file - promoters60/4282145
aaattaaa

SEQ ID NO: 57065 - DNA, 6 bp, Unknown
  misc_feature (1)..( 6): Matrix.003 file - promoters60/4282145
ctacat

SEQ ID NO: 57066 - DNA, 6 bp, Unknown
  misc_feature (1)..( 6): Matrix.003 file - promoters60/4282145
aaatta

SEQ ID NO: 57067 - DNA, 9 bp, Unknown
  misc_feature (1)..( 9): Matrix.003 file - promoters60/4282145
atccatata

SEQ ID NO: 57068 - DNA, 7 bp, Unknown
  misc_feature (1)..( 7): Matrix.003 file - promoters60/4282145
tataaaa

SEQ ID NO: 57069 - DNA, 12 bp, Unknown
  misc_feature (1)..( 12): Matrix.003 file - promoters60/4282186
ccgatcttgtgc

SEQ ID NO: 57070 - DNA, 6 bp, Unknown
  misc_feature (1)..( 6): Matrix.003 file - promoters60/4282186
gcgtca

SEQ ID NO: 57071 - DNA, 7 bp, Unknown
  misc_feature (1)..( 7): Matrix.003 file - promoters60/4282186
caaactt

SEQ ID NO: 57072 - DNA, 8 bp, Unknown
  misc_feature (1)..( 8): Matrix.003 file - promoters60/4282186
caaaatct

SEQ ID NO: 57073 - DNA, 6 bp, Unknown
  misc_feature (1)..( 6): Matrix.003 file - promoters60/4282186
tacaca

SEQ ID NO: 57074 - DNA, 7 bp, Unknown
  misc_feature (1)..( 7): Matrix.003 file - promoters60/4282186
ttggttt

SEQ ID NO: 57075 - DNA, 6 bp, Unknown
  misc_feature (1)..( 6): Matrix.003 file - promoters60/4282186
ttggtt

SEQ ID NO: 57076 - DNA, 9 bp, Unknown
  misc_feature (1)..( 9): Matrix.003 file - promoters60/4282186
agccaatca

SEQ ID NO: 57077 - DNA, 6 bp, Unknown
  misc_feature (1)..( 6): Matrix.003 file - promoters60/4282186
tgttta

SEQ ID NO: 57078 - DNA, 6 bp, Unknown
  misc_feature (1)..( 6): Matrix.003 file - promoters60/4282186
tgaatt

SEQ ID NO: 57079 - DNA, 8 bp, Unknown
  misc_feature (1)..( 8): Matrix.003 file - promoters60/4282186
ttaaaaga

SEQ ID NO: 57080 - DNA, 8 bp, Unknown
  misc_feature (1)..( 8): Matrix.003 file - promoters60/4282186
tgtcgttc

SEQ ID NO: 57081 - DNA, 8 bp, Unknown
  misc_feature (1)..( 8): Matrix.003 file - promoters60/4282186
caaagaaa

SEQ ID NO: 57082 - DNA, 6 bp, Unknown
  misc_feature (1)..( 6): Matrix.003 file - promoters60/4282186
gaaagt

SEQ ID NO: 57083 - DNA, 15 bp, Unknown
  misc_feature (1)..( 15): Matrix.003 file - promoters60/4282186
atcaaaatagaaaat

SEQ ID NO: 57084 - DNA, 7 bp, Unknown
  misc_feature (1)..( 7): Matrix.003 file - promoters60/4282186
gaaacaa

SEQ ID NO: 57085 - DNA, 8 bp, Unknown
  misc_feature (1)..( 8): Matrix.003 file - promoters60/4282186
tataaaaa

SEQ ID NO: 57086 - DNA, 8 bp, Unknown
  misc_feature (1)..( 8): Matrix.003 file - promoters60/4282186
tctaatct

SEQ ID NO: 57087 - DNA, 7 bp, Unknown
  misc_feature (1)..( 7): Matrix.003 file - promoters60/4282186
aataaaa

SEQ ID NO: 57088 - DNA, 9 bp, Unknown
  misc_feature (1)..( 9): Matrix.003 file - promoters60/4282202
aaagtgttg

SEQ ID NO: 57089 - DNA, 6 bp, Unknown
  misc_feature (1)..( 6): Matrix.003 file - promoters60/4282202
gagaat

SEQ ID NO: 57090 - DNA, 8 bp, Unknown
  misc_feature (1)..( 8): Matrix.003 file - promoters60/4282202
tctaatgg

SEQ ID NO: 57091 - DNA, 8 bp, Unknown
  misc_feature (1)..( 8): Matrix.003 file - promoters60/4282202
caatttgt

SEQ ID NO: 57092 - DNA, 15 bp, Unknown
  misc_feature (1)..( 15): Matrix.003 file - promoters60/4282202
aaataaaaaacatac

SEQ ID NO: 57093 - DNA, 6 bp, Unknown
  misc_feature (1)..( 6): Matrix.003 file - promoters60/4282202
cctcca

SEQ ID NO: 57094 - DNA, 6 bp, Unknown
  misc_feature (1)..( 6): Matrix.003 file - promoters60/4282202
gttttc

SEQ ID NO: 57095 - DNA, 10 bp, Unknown
  misc_feature (1)..( 10): Matrix.003 file - promoters60/4282202
agaaaacttt

SEQ ID NO: 57096 - DNA, 8 bp, Unknown
  misc_feature (1)..( 8): Matrix.003 file - promoters60/4282202
ttaacgta

SEQ ID NO: 57097 - DNA, 6 bp, Unknown
  misc_feature (1)..( 6): Matrix.003 file - promoters60/4282202
ttgatt

SEQ ID NO: 57098 - DNA, 7 bp, Unknown
  misc_feature (1)..( 7): Matrix.003 file - promoters60/4282202
gttgttg

SEQ ID NO: 57099 - DNA, 6 bp, Unknown
  misc_feature (1)..( 6): Matrix.003 file - promoters60/4282202
aaatta

SEQ ID NO: 57100 - DNA, 8 bp, Unknown
  misc_feature (1)..( 8): Matrix.003 file - promoters60/4282202
tttaatta

SEQ ID NO: 57101 - DNA, 6 bp, Unknown
  misc_feature (1)..( 6): Matrix.003 file - promoters60/4282202
caaaac

SEQ ID NO: 57102 - DNA, 6 bp, Unknown
  misc_feature (1)..( 6): Matrix.003 file - promoters60/4282202
ttctta

SEQ ID NO: 57103 - DNA, 6 bp, Unknown
  misc_feature (1)..( 6): Matrix.003 file - promoters60/4282202
aacctc

SEQ ID NO: 57104 - DNA, 6 bp, Unknown
  misc_feature (1)..( 6): Matrix.003 file - promoters60/4282202
ttggat

SEQ ID NO: 57105 - DNA, 6 bp, Unknown
  misc_feature (1)..( 6): Matrix.003 file - promoters60/4282202
tcaaca

SEQ ID NO: 57106 - DNA, 6 bp, Unknown
  misc_feature (1)..( 6): Matrix.003 file - promoters60/4282202
gtttgt

SEQ ID NO: 57107 - DNA, 6 bp, Unknown
  misc_feature (1)..( 6): Matrix.003 file - promoters60/4282202
cttcac

SEQ ID NO: 57108 - DNA, 9 bp, Unknown
  misc_feature (1)..( 9): Matrix.003 file - promoters60/4282308
taatattat

SEQ ID NO: 57109 - DNA, 8 bp, Unknown
  misc_feature (1)..( 8): Matrix.003 file - promoters60/4282308
gttacaat

SEQ ID NO: 57110 - DNA, 7 bp, Unknown
  misc_feature (1)..( 7): Matrix.003 file - promoters60/4282308
ggaaatt

SEQ ID NO: 57111 - DNA, 10 bp, Unknown
  misc_feature (1)..( 10): Matrix.003 file - promoters60/4282308
tgattattac

SEQ ID NO: 57112 - DNA, 13 bp, Unknown
  misc_feature (1)..( 13): Matrix.003 file - promoters60/4282308
aataagttatata

SEQ ID NO: 57113 - DNA, 8 bp, Unknown
  misc_feature (1)..( 8): Matrix.003 file - promoters60/4282308
acaacaca

SEQ ID NO: 57114 - DNA, 6 bp, Unknown
  misc_feature (1)..( 6): Matrix.003 file - promoters60/4282308
tttttt

SEQ ID NO: 57115 - DNA, 6 bp, Unknown
  misc_feature (1)..( 6): Matrix.003 file - promoters60/4282308
tcaaaa

SEQ ID NO: 57116 - DNA, 6 bp, Unknown
  misc_feature (1)..( 6): Matrix.003 file - promoters60/4282308
aagact

SEQ ID NO: 57117 - DNA, 8 bp, Unknown
  misc_feature (1)..( 8): Matrix.003 file - promoters60/4282308
aatctctc

SEQ ID NO: 57118 - DNA, 8 bp, Unknown
  misc_feature (1)..( 8): Matrix.003 file - promoters60/4282308
ttgaaatg

SEQ ID NO: 57119 - DNA, 7 bp, Unknown
  misc_feature (1)..( 7): Matrix.003 file - promoters60/4282308
aaataaa

SEQ ID NO: 57120 - DNA, 7 bp, Unknown
  misc_feature (1)..( 7): Matrix.003 file - promoters60/4282308
atcatgt

SEQ ID NO: 57121 - DNA, 11 bp, Unknown
  misc_feature (1)..( 11): Matrix.003 file - promoters60/4282308
ttcctcaaaca

SEQ ID NO: 57122 - DNA, 7 bp, Unknown
  misc_feature (1)..( 7): Matrix.003 file - promoters60/4282308
tccatca

SEQ ID NO: 57123 - DNA, 6 bp, Unknown
  misc_feature (1)..( 6): Matrix.003 file - promoters60/4282308
attcat

SEQ ID NO: 57124 - DNA, 7 bp, Unknown
  misc_feature (1)..( 7): Matrix.003 file - promoters60/4282308
acctaat

SEQ ID NO: 57125 - DNA, 8 bp, Unknown
  misc_feature (1)..( 8): Matrix.003 file - promoters60/4282308
ttctagtt

SEQ ID NO: 57126 - DNA, 8 bp, Unknown
  misc_feature (1)..( 8): Matrix.003 file - promoters60/4282308
tttaccaa

SEQ ID NO: 57127 - DNA, 6 bp, Unknown
  misc_feature (1)..( 6): Matrix.003 file - promoters60/4282308
caactt

SEQ ID NO: 57128 - DNA, 7 bp, Unknown
  misc_feature (1)..( 7): Matrix.003 file - promoters60/4282308
gtcaaaa

SEQ ID NO: 57129 - DNA, 7 bp, Unknown
  misc_feature (1)..( 7): Matrix.003 file - promoters60/4282308
aaattga

SEQ ID NO: 57130 - DNA, 7 bp, Unknown
  misc_feature (1)..( 7): Matrix.003 file - promoters60/4282308
catcagg

SEQ ID NO: 57131 - DNA, 15 bp, Unknown
  misc_feature (1)..( 15): Matrix.003 file - promoters60/4282316
aacaaaaaaagttta

SEQ ID NO: 57132 - DNA, 15 bp, Unknown
  misc_feature (1)..( 15): Matrix.003 file - promoters60/4282316
atcactgatccaaca

SEQ ID NO: 57133 - DNA, 7 bp, Unknown
  misc_feature (1)..( 7): Matrix.003 file - promoters60/4282316
aattatc

SEQ ID NO: 57134 - DNA, 6 bp, Unknown
  misc_feature (1)..( 6): Matrix.003 file - promoters60/4282320
tgtggc

SEQ ID NO: 57135 - DNA, 7 bp, Unknown
  misc_feature (1)..( 7): Matrix.003 file - promoters60/4282320
gagaaaa

SEQ ID NO: 57136 - DNA, 7 bp, Unknown
  misc_feature (1)..( 7): Matrix.003 file - promoters60/4282320
aagaaga

SEQ ID NO: 57137 - DNA, 9 bp, Unknown
  misc_feature (1)..( 9): Matrix.003 file - promoters60/4282320
cagagaaag

SEQ ID NO: 57138 - DNA, 6 bp, Unknown
  misc_feature (1)..( 6): Matrix.003 file - promoters60/4282320
aatgga

SEQ ID NO: 57139 - DNA, 7 bp, Unknown
  misc_feature (1)..( 7): Matrix.003 file - promoters60/4282320
atatcat

SEQ ID NO: 57140 - DNA, 7 bp, Unknown
  misc_feature (1)..( 7): Matrix.003 file - promoters60/4282320
aagattt

SEQ ID NO: 57141 - DNA, 7 bp, Unknown
  misc_feature (1)..( 7): Matrix.003 file - promoters60/4282320
ttaacag

SEQ ID NO: 57142 - DNA, 7 bp, Unknown
  misc_feature (1)..( 7): Matrix.003 file - promoters60/4282320
actggaa

SEQ ID NO: 57143 - DNA, 6 bp, Unknown
  misc_feature (1)..( 6): Matrix.003 file - promoters60/4282320
ttctca

SEQ ID NO: 57144 - DNA, 7 bp, Unknown
  misc_feature (1)..( 7): Matrix.003 file - promoters60/4282320
ttgaagt

SEQ ID NO: 57145 - DNA, 6 bp, Unknown
  misc_feature (1)..( 6): Matrix.003 file - promoters60/4282320
atggaa

SEQ ID NO: 57146 - DNA, 6 bp, Unknown
  misc_feature (1)..( 6): Matrix.003 file - promoters60/4282320
aaagaa

SEQ ID NO: 57147 - DNA, 7 bp, Unknown
  misc_feature (1)..( 7): Matrix.003 file - promoters60/4282320
tagagaa

SEQ ID NO: 57148 - DNA, 7 bp, Unknown
  misc_feature (1)..( 7): Matrix.003 file - promoters60/4282320
aaggaga

SEQ ID NO: 57149 - DNA, 7 bp, Unknown
  misc_feature (1)..( 7): Matrix.003 file - promoters60/4282320
aaagaag

SEQ ID NO: 57150 - DNA, 6 bp, Unknown
  misc_feature (1)..( 6): Matrix.003 file - promoters60/4282320
caaaag

SEQ ID NO: 57151 - DNA, 6 bp, Unknown
  misc_feature (1)..( 6): Matrix.003 file - promoters60/4282320
caacac

SEQ ID NO: 57152 - DNA, 7 bp, Unknown
  misc_feature (1)..( 7): Matrix.003 file - promoters60/4282320
ctccatt

SEQ ID NO: 57153 - DNA, 7 bp, Unknown
  misc_feature (1)..( 7): Matrix.003 file - promoters60/4282324
taataat

SEQ ID NO: 57154 - DNA, 10 bp, Unknown
  misc_feature (1)..( 10): Matrix.003 file - promoters60/4282324
aacactaaaa

SEQ ID NO: 57155 - DNA, 12 bp, Unknown
  misc_feature (1)..( 12): Matrix.003 file - promoters60/4282324
taaaattcattt

SEQ ID NO: 57156 - DNA, 16 bp, Unknown
  misc_feature (1)..( 16): Matrix.003 file - promoters60/4282324
agatttgttaactaaa

SEQ ID NO: 57157 - DNA, 7 bp, Unknown
  misc_feature (1)..( 7): Matrix.003 file - promoters60/4282324
aaaacaa

SEQ ID NO: 57158 - DNA, 11 bp, Unknown
  misc_feature (1)..( 11): Matrix.003 file - promoters60/4282324
ctataaaaccc

SEQ ID NO: 57159 - DNA, 7 bp, Unknown
  misc_feature (1)..( 7): Matrix.003 file - promoters60/4282327
aaagtaa

SEQ ID NO: 57160 - DNA, 7 bp, Unknown
  misc_feature (1)..( 7): Matrix.003 file - promoters60/4282327
aataagt

SEQ ID NO: 57161 - DNA, 6 bp, Unknown
  misc_feature (1)..( 6): Matrix.003 file - promoters60/4282327
gaaaag

SEQ ID NO: 57162 - DNA, 6 bp, Unknown
  misc_feature (1)..( 6): Matrix.003 file - promoters60/4282327
aaaaat

SEQ ID NO: 57163 - DNA, 6 bp, Unknown
  misc_feature (1)..( 6): Matrix.003 file - promoters60/4282327
gtttaa

SEQ ID NO: 57164 - DNA, 8 bp, Unknown
  misc_feature (1)..( 8): Matrix.003 file - promoters60/4282327
gcaacatt

SEQ ID NO: 57165 - DNA, 7 bp, Unknown
  misc_feature (1)..( 7): Matrix.003 file - promoters60/4282327
attcgtc

SEQ ID NO: 57166 - DNA, 7 bp, Unknown
  misc_feature (1)..( 7): Matrix.003 file - promoters60/4282327
aataatt

SEQ ID NO: 57167 - DNA, 8 bp, Unknown
  misc_feature (1)..( 8): Matrix.003 file - promoters60/4282327
tatataaa

SEQ ID NO: 57168 - DNA, 7 bp, Unknown
  misc_feature (1)..( 7): Matrix.003 file - promoters60/4282327
tatggaa

SEQ ID NO: 57169 - DNA, 8 bp, Unknown
  misc_feature (1)..( 8): Matrix.003 file - promoters60/4282327
attggtta

SEQ ID NO: 57170 - DNA, 7 bp, Unknown
  misc_feature (1)..( 7): Matrix.003 file - promoters60/4282327
tttatgc

SEQ ID NO: 57171 - DNA, 7 bp, Unknown
  misc_feature (1)..( 7): Matrix.003 file - promoters60/4282327
gacgtat

SEQ ID NO: 57172 - DNA, 11 bp, Unknown
  misc_feature (1)..( 11): Matrix.003 file - promoters60/4282327
tttcagtataa

SEQ ID NO: 57173 - DNA, 7 bp, Unknown
  misc_feature (1)..( 7): Matrix.003 file - promoters60/4282327
aagaaga

SEQ ID NO: 57174 - DNA, 10 bp, Unknown
  misc_feature (1)..( 10): Matrix.003 file - promoters60/4282395
tttcttagta

SEQ ID NO: 57175 - DNA, 9 bp, Unknown
  misc_feature (1)..( 9): Matrix.003 file - promoters60/4282395
cacaaaaac

SEQ ID NO: 57176 - DNA, 11 bp, Unknown
  misc_feature (1)..( 11): Matrix.003 file - promoters60/4282395
gggagttattt

SEQ ID NO: 57177 - DNA, 11 bp, Unknown
  misc_feature (1)..( 11): Matrix.003 file - promoters60/4282395
gaaattatttt

SEQ ID NO: 57178 - DNA, 9 bp, Unknown
  misc_feature (1)..( 9): Matrix.003 file - promoters60/4282414
cagaaatac

SEQ ID NO: 57179 - DNA, 11 bp, Unknown
  misc_feature (1)..( 11): Matrix.003 file - promoters60/4282414
caagcattaac

SEQ ID NO: 57180 - DNA, 9 bp, Unknown
  misc_feature (1)..( 9): Matrix.003 file - promoters60/4282418
aaactaaaa

SEQ ID NO: 57181 - DNA, 10 bp, Unknown
  misc_feature (1)..( 10): Matrix.003 file - promoters60/4282418
taaaataaaa

SEQ ID NO: 57182 - DNA, 13 bp, Unknown
  misc_feature (1)..( 13): Matrix.003 file - promoters60/4282418
aaaataatatcat

SEQ ID NO: 57183 - DNA, 9 bp, Unknown
  misc_feature (1)..( 9): Matrix.003 file - promoters60/4282418
taagtaaac

SEQ ID NO: 57184 - DNA, 7 bp, Unknown
  misc_feature (1)..( 7): Matrix.003 file - promoters60/4282418
ataaaaa

SEQ ID NO: 57185 - DNA, 6 bp, Unknown
  misc_feature (1)..( 6): Matrix.003 file - promoters60/4282421
tttaat

SEQ ID NO: 57186 - DNA, 7 bp, Unknown
  misc_feature (1)..( 7): Matrix.003 file - promoters60/4282421
gctttct

SEQ ID NO: 57187 - DNA, 8 bp, Unknown
  misc_feature (1)..( 8): Matrix.003 file - promoters60/4282421
tctaatct

SEQ ID NO: 57188 - DNA, 6 bp, Unknown
  misc_feature (1)..( 6): Matrix.003 file - promoters60/4282421
aaaaat

SEQ ID NO: 57189 - DNA, 7 bp, Unknown
  misc_feature (1)..( 7): Matrix.003 file - promoters60/4282421
attagta

SEQ ID NO: 57190 - DNA, 7 bp, Unknown
  misc_feature (1)..( 7): Matrix.003 file - promoters60/4282421
ttttcat

SEQ ID NO: 57191 - DNA, 6 bp, Unknown
  misc_feature (1)..( 6): Matrix.003 file - promoters60/4282421
atttgt

SEQ ID NO: 57192 - DNA, 7 bp, Unknown
  misc_feature (1)..( 7): Matrix.003 file - promoters60/4282421
taccaaa

SEQ ID NO: 57193 - DNA, 7 bp, Unknown
  misc_feature (1)..( 7): Matrix.003 file - promoters60/4282421
cttctta

SEQ ID NO: 57194 - DNA, 6 bp, Unknown
  misc_feature (1)..( 6): Matrix.003 file - promoters60/4282421
tgtatt

SEQ ID NO: 57195 - DNA, 7 bp, Unknown
  misc_feature (1)..( 7): Matrix.003 file - promoters60/4282421
tgtatat

SEQ ID NO: 57196 - DNA, 8 bp, Unknown
  misc_feature (1)..( 8): Matrix.003 file - promoters60/4282421
tctggttt

SEQ ID NO: 57197 - DNA, 7 bp, Unknown
  misc_feature (1)..( 7): Matrix.003 file - promoters60/4282421
tttactt

SEQ ID NO: 57198 - DNA, 8 bp, Unknown
  misc_feature (1)..( 8): Matrix.003 file - promoters60/4282421
cttgtctc

SEQ ID NO: 57199 - DNA, 7 bp, Unknown
  misc_feature (1)..( 7): Matrix.003 file - promoters60/4282421
ttgaagc

SEQ ID NO: 57200 - DNA, 6 bp, Unknown
  misc_feature (1)..( 6): Matrix.003 file - promoters60/4282421
cctttt

SEQ ID NO: 57201 - DNA, 7 bp, Unknown
  misc_feature (1)..( 7): Matrix.003 file - promoters60/4282421
ttttttt

SEQ ID NO: 57202 - DNA, 7 bp, Unknown
  misc_feature (1)..( 7): Matrix.003 file - promoters60/4282421
ggcctat

SEQ ID NO: 57203 - DNA, 8 bp, Unknown
  misc_feature (1)..( 8): Matrix.003 file - promoters60/4282436
caaaaaaa

SEQ ID NO: 57204 - DNA, 6 bp, Unknown
  misc_feature (1)..( 6): Matrix.003 file - promoters60/4282436
aaaaca

SEQ ID NO: 57205 - DNA, 8 bp, Unknown
  misc_feature (1)..( 8): Matrix.003 file - promoters60/4282436
gaaataaa

SEQ ID NO: 57206 - DNA, 7 bp, Unknown
  misc_feature (1)..( 7): Matrix.003 file - promoters60/4282436
caaattt

SEQ ID NO: 57207 - DNA, 6 bp, Unknown
  misc_feature (1)..( 6): Matrix.003 file - promoters60/4282436
ttaaaa

SEQ ID NO: 57208 - DNA, 6 bp, Unknown
  misc_feature (1)..( 6): Matrix.003 file - promoters60/4282436
gtaacg

SEQ ID NO: 57209 - DNA, 7 bp, Unknown
  misc_feature (1)..( 7): Matrix.003 file - promoters60/4282436
gtggtta

SEQ ID NO: 57210 - DNA, 10 bp, Unknown
  misc_feature (1)..( 10): Matrix.003 file - promoters60/4282436
tacgtgtcaa

SEQ ID NO: 57211 - DNA, 20 bp, Unknown
  misc_feature (1)..( 20): Matrix.003 file - promoters60/4282436
ttggctattgcttcaccgcc

SEQ ID NO: 57212 - DNA, 16 bp, Unknown
  misc_feature (1)..( 16): Matrix.003 file - promoters60/4282436
gaccgagtcgtcctcg

SEQ ID NO: 57213 - DNA, 19 bp, Unknown
  misc_feature (1)..( 19): Matrix.003 file - promoters60/4282436
ttcttcttctataaatcaa

SEQ ID NO: 57214 - DNA, 6 bp, Unknown
  misc_feature (1)..( 6): Matrix.003 file - promoters60/4282436
gcttct

SEQ ID NO: 57215 - DNA, 8 bp, Unknown
  misc_feature (1)..( 8): Matrix.003 file - promoters60/4282436
ttctggcc

SEQ ID NO: 57216 - DNA, 7 bp, Unknown
  misc_feature (1)..( 7): Matrix.003 file - promoters60/4282436
tacatat

SEQ ID NO: 57217 - DNA, 15 bp, Unknown
  misc_feature (1)..( 15): Matrix.003 file - promoters60/4282436
cgccttagctttctc

SEQ ID NO: 57218 - DNA, 6 bp, Unknown
  misc_feature (1)..( 6): Matrix.003 file - promoters60/4282436
tttttt

SEQ ID NO: 57219 - DNA, 9 bp, Unknown
  misc_feature (1)..( 9): Matrix.003 file - promoters60/4282436
acaaaaagg

SEQ ID NO: 57220 - DNA, 7 bp, Unknown
  misc_feature (1)..( 7): Matrix.003 file - promoters60/4282436
acgaaga

SEQ ID NO: 57221 - DNA, 6 bp, Unknown
  misc_feature (1)..( 6): Matrix.003 file - promoters60/4282436
gttcaa

SEQ ID NO: 57222 - DNA, 6 bp, Unknown
  misc_feature (1)..( 6): Matrix.003 file - promoters60/4282436
gtatat

SEQ ID NO: 57223 - DNA, 9 bp, Unknown
  misc_feature (1)..( 9): Matrix.003 file - promoters60/4282436
atctaatga

SEQ ID NO: 57224 - DNA, 6 bp, Unknown
  misc_feature (1)..( 6): Matrix.003 file - promoters60/4282436
tcagta

SEQ ID NO: 57225 - DNA, 6 bp, Unknown
  misc_feature (1)..( 6): Matrix.003 file - promoters60/4282436
aacaac

SEQ ID NO: 57226 - DNA, 15 bp, Unknown
  misc_feature (1)..( 15): Matrix.003 file - promoters60/4282436
aatacccaaagagct

SEQ ID NO: 57227 - DNA, 7 bp, Unknown
  misc_feature (1)..( 7): Matrix.003 file - promoters60/4282450
aataata

SEQ ID NO: 57228 - DNA, 8 bp, Unknown
  misc_feature (1)..( 8): Matrix.003 file - promoters60/4282450
aataataa

SEQ ID NO: 57229 - DNA, 7 bp, Unknown
  misc_feature (1)..( 7): Matrix.003 file - promoters60/4282450
tataaaa

SEQ ID NO: 57230 - DNA, 7 bp, Unknown
  misc_feature (1)..( 7): Matrix.003 file - promoters60/4282450
cggagct

SEQ ID NO: 57231 - DNA, 6 bp, Unknown
  misc_feature (1)..( 6): Matrix.003 file - promoters60/4282450
cattga

SEQ ID NO: 57232 - DNA, 8 bp, Unknown
  misc_feature (1)..( 8): Matrix.003 file - promoters60/4282450
tatctaaa

SEQ ID NO: 57233 - DNA, 6 bp, Unknown
  misc_feature (1)..( 6): Matrix.003 file - promoters60/4282450
tgtttc

SEQ ID NO: 57234 - DNA, 6 bp, Unknown
  misc_feature (1)..( 6): Matrix.003 file - promoters60/4282487
aaattg

SEQ ID NO: 57235 - DNA, 7 bp, Unknown
  misc_feature (1)..( 7): Matrix.003 file - promoters60/4282487
taagcgt

SEQ ID NO: 57236 - DNA, 6 bp, Unknown
  misc_feature (1)..( 6): Matrix.003 file - promoters60/4282487
tttagt

SEQ ID NO: 57237 - DNA, 7 bp, Unknown
  misc_feature (1)..( 7): Matrix.003 file - promoters60/4282487
tttcatg

SEQ ID NO: 57238 - DNA, 7 bp, Unknown
  misc_feature (1)..( 7): Matrix.003 file - promoters60/4282487
taagcgt

SEQ ID NO: 57239 - DNA, 11 bp, Unknown
  misc_feature (1)..( 11): Matrix.003 file - promoters60/4282487
tagttgattcg

SEQ ID NO: 57240 - DNA, 7 bp, Unknown
  misc_feature (1)..( 7): Matrix.003 file - promoters60/4282487
gttaatg

SEQ ID NO: 57241 - DNA, 9 bp, Unknown
  misc_feature (1)..( 9): Matrix.003 file - promoters60/4282487
tgaaaccaa

SEQ ID NO: 57242 - DNA, 7 bp, Unknown
  misc_feature (1)..( 7): Matrix.003 file - promoters60/4282487
caaaaga

SEQ ID NO: 57243 - DNA, 6 bp, Unknown
  misc_feature (1)..( 6): Matrix.003 file - promoters60/4282487
taataa

SEQ ID NO: 57244 - DNA, 6 bp, Unknown
  misc_feature (1)..( 6): Matrix.003 file - promoters60/4282487
cggttt

SEQ ID NO: 57245 - DNA, 9 bp, Unknown
  misc_feature (1)..( 9): Matrix.003 file - promoters60/4282487
cttttaatt

SEQ ID NO: 57246 - DNA, 6 bp, Unknown
  misc_feature (1)..( 6): Matrix.003 file - promoters60/4282487
aattgt

SEQ ID NO: 57247 - DNA, 6 bp, Unknown
  misc_feature (1)..( 6): Matrix.003 file - promoters60/4282487
tatgaa

SEQ ID NO: 57248 - DNA, 7 bp, Unknown
  misc_feature (1)..( 7): Matrix.003 file - promoters60/4282487
aatgttt

SEQ ID NO: 57249 - DNA, 6 bp, Unknown
  misc_feature (1)..( 6): Matrix.003 file - promoters60/4282487
taatat

SEQ ID NO: 57250 - DNA, 7 bp, Unknown
  misc_feature (1)..( 7): Matrix.003 file - promoters60/4282487
aaaatga

SEQ ID NO: 57251 - DNA, 7 bp, Unknown
  misc_feature (1)..( 7): Matrix.003 file - promoters60/4282487
tttaaga

SEQ ID NO: 57252 - DNA, 8 bp, Unknown
  misc_feature (1)..( 8): Matrix.003 file - promoters60/4282487
gaaaacgc

SEQ ID NO: 57253 - DNA, 6 bp, Unknown
  misc_feature (1)..( 6): Matrix.003 file - promoters60/4282503
agaaat

SEQ ID NO: 57254 - DNA, 7 bp, Unknown
  misc_feature (1)..( 7): Matrix.003 file - promoters60/4282503
aagatta

SEQ ID NO: 57255 - DNA, 7 bp, Unknown
  misc_feature (1)..( 7): Matrix.003 file - promoters60/4282503
tttgcaa

SEQ ID NO: 57256 - DNA, 7 bp, Unknown
  misc_feature (1)..( 7): Matrix.003 file - promoters60/4282503
taaaatc

SEQ ID NO: 57257 - DNA, 6 bp, Unknown
  misc_feature (1)..( 6): Matrix.003 file - promoters60/4282503
tataaa

SEQ ID NO: 57258 - DNA, 6 bp, Unknown
  misc_feature (1)..( 6): Matrix.003 file - promoters60/4282503
tcaaag

SEQ ID NO: 57259 - DNA, 7 bp, Unknown
  misc_feature (1)..( 7): Matrix.003 file - promoters60/4282503
aaaattt

SEQ ID NO: 57260 - DNA, 10 bp, Unknown
  misc_feature (1)..( 10): Matrix.003 file - promoters60/4282503
ttttaataac

SEQ ID NO: 57261 - DNA, 11 bp, Unknown
  misc_feature (1)..( 11): Matrix.003 file - promoters60/4282503
tttattaaatg

SEQ ID NO: 57262 - DNA, 6 bp, Unknown
  misc_feature (1)..( 6): Matrix.003 file - promoters60/4282503
tatata

SEQ ID NO: 57263 - DNA, 6 bp, Unknown
  misc_feature (1)..( 6): Matrix.003 file - promoters60/4282503
ttatat

SEQ ID NO: 57264 - DNA, 6 bp, Unknown
  misc_feature (1)..( 6): Matrix.003 file - promoters60/4282503
tcatat

SEQ ID NO: 57265 - DNA, 7 bp, Unknown
  misc_feature (1)..( 7): Matrix.003 file - promoters60/4282503
ttatgtc

SEQ ID NO: 57266 - DNA, 7 bp, Unknown
  misc_feature (1)..( 7): Matrix.003 file - promoters60/4282503
attagta

SEQ ID NO: 57267 - DNA, 7 bp, Unknown
  misc_feature (1)..( 7): Matrix.003 file - promoters60/4282503
gattcag

SEQ ID NO: 57268 - DNA, 7 bp, Unknown
  misc_feature (1)..( 7): Matrix.003 file - promoters60/4282503
gatcgat

SEQ ID NO: 57269 - DNA, 7 bp, Unknown
  misc_feature (1)..( 7): Matrix.003 file - promoters60/4282506
gtgattg

SEQ ID NO: 57270 - DNA, 7 bp, Unknown
  misc_feature (1)..( 7): Matrix.003 file - promoters60/4282506
agaggag

SEQ ID NO: 57271 - DNA, 6 bp, Unknown
  misc_feature (1)..( 6): Matrix.003 file - promoters60/4282506
tctttc

SEQ ID NO: 57272 - DNA, 8 bp, Unknown
  misc_feature (1)..( 8): Matrix.003 file - promoters60/4282506
cttcttct

SEQ ID NO: 57273 - DNA, 6 bp, Unknown
  misc_feature (1)..( 6): Matrix.003 file - promoters60/4282506
ttctct

SEQ ID NO: 57274 - DNA, 10 bp, Unknown
  misc_feature (1)..( 10): Matrix.003 file - promoters60/4282506
caataaccaa

SEQ ID NO: 57275 - DNA, 7 bp, Unknown
  misc_feature (1)..( 7): Matrix.003 file - promoters60/4282506
tttataa

SEQ ID NO: 57276 - DNA, 6 bp, Unknown
  misc_feature (1)..( 6): Matrix.003 file - promoters60/4282506
tattct

SEQ ID NO: 57277 - DNA, 7 bp, Unknown
  misc_feature (1)..( 7): Matrix.003 file - promoters60/4282506
ttcatct

SEQ ID NO: 57278 - DNA, 7 bp, Unknown
  misc_feature (1)..( 7): Matrix.003 file - promoters60/4282506
gtatcaa

SEQ ID NO: 57279 - DNA, 8 bp, Unknown
  misc_feature (1)..( 8): Matrix.003 file - promoters60/4282506
cagctatt

SEQ ID NO: 57280 - DNA, 7 bp, Unknown
  misc_feature (1)..( 7): Matrix.003 file - promoters60/4282506
attgttg

SEQ ID NO: 57281 - DNA, 8 bp, Unknown
  misc_feature (1)..( 8): Matrix.003 file - promoters60/4282506
cataaaaa

SEQ ID NO: 57282 - DNA, 7 bp, Unknown
  misc_feature (1)..( 7): Matrix.003 file - promoters60/4282506
acagatt

SEQ ID NO: 57283 - DNA, 7 bp, Unknown
  misc_feature (1)..( 7): Matrix.003 file - promoters60/4282506
tttagtt

SEQ ID NO: 57284 - DNA, 8 bp, Unknown
  misc_feature (1)..( 8): Matrix.003 file - promoters60/4282506
ttcaaaaa

SEQ ID NO: 57285 - DNA, 7 bp, Unknown
  misc_feature (1)..( 7): Matrix.003 file - promoters60/4282564
attacaa

SEQ ID NO: 57286 - DNA, 9 bp, Unknown
  misc_feature (1)..( 9): Matrix.003 file - promoters60/4282564
ttcaatcat

SEQ ID NO: 57287 - DNA, 10 bp, Unknown
  misc_feature (1)..( 10): Matrix.003 file - promoters60/4282564
aatcaacaaa

SEQ ID NO: 57288 - DNA, 8 bp, Unknown
  misc_feature (1)..( 8): Matrix.003 file - promoters60/4282564
ataaaacc

SEQ ID NO: 57289 - DNA, 6 bp, Unknown
  misc_feature (1)..( 6): Matrix.003 file - promoters60/4282564
attgga

SEQ ID NO: 57290 - DNA, 6 bp, Unknown
  misc_feature (1)..( 6): Matrix.003 file - promoters60/4282564
aactaa

SEQ ID NO: 57291 - DNA, 6 bp, Unknown
  misc_feature (1)..( 6): Matrix.003 file - promoters60/4282564
tgtttc

SEQ ID NO: 57292 - DNA, 12 bp, Unknown
  misc_feature (1)..( 12): Matrix.003 file - promoters60/4282580
atgattgattga

SEQ ID NO: 57293 - DNA, 8 bp, Unknown
  misc_feature (1)..( 8): Matrix.003 file - promoters60/4282580
ttttttag

SEQ ID NO: 57294 - DNA, 10 bp, Unknown
  misc_feature (1)..( 10): Matrix.003 file - promoters60/4282580
tattttcatt

SEQ ID NO: 57295 - DNA, 8 bp, Unknown
  misc_feature (1)..( 8): Matrix.003 file - promoters60/4282580
taattttg

SEQ ID NO: 57296 - DNA, 6 bp, Unknown
  misc_feature (1)..( 6): Matrix.003 file - promoters60/4282580
atttga

SEQ ID NO: 57297 - DNA, 9 bp, Unknown
  misc_feature (1)..( 9): Matrix.003 file - promoters60/4282580
atttagatc

SEQ ID NO: 57298 - DNA, 8 bp, Unknown
  misc_feature (1)..( 8): Matrix.003 file - promoters60/4282588
aacaaaat

SEQ ID NO: 57299 - DNA, 6 bp, Unknown
  misc_feature (1)..( 6): Matrix.003 file - promoters60/4282588
aatgtg

SEQ ID NO: 57300 - DNA, 6 bp, Unknown
  misc_feature (1)..( 6): Matrix.003 file - promoters60/4282588
acacat

SEQ ID NO: 57301 - DNA, 7 bp, Unknown
  misc_feature (1)..( 7): Matrix.003 file - promoters60/4282588
caataaa

SEQ ID NO: 57302 - DNA, 8 bp, Unknown
  misc_feature (1)..( 8): Matrix.003 file - promoters60/4282588
agaaaaat

SEQ ID NO: 57303 - DNA, 9 bp, Unknown
  misc_feature (1)..( 9): Matrix.003 file - promoters60/4282588
aatgaagta

SEQ ID NO: 57304 - DNA, 10 bp, Unknown
  misc_feature (1)..( 10): Matrix.003 file - promoters60/4282588
gaaaaatcta

SEQ ID NO: 57305 - DNA, 9 bp, Unknown
  misc_feature (1)..( 9): Matrix.003 file - promoters60/4282588
ctataaata

SEQ ID NO: 57306 - DNA, 7 bp, Unknown
  misc_feature (1)..( 7): Matrix.003 file - promoters60/4282588
tttgtaa

SEQ ID NO: 57307 - DNA, 7 bp, Unknown
  misc_feature (1)..( 7): Matrix.003 file - promoters60/4282588
aataata

SEQ ID NO: 57308 - DNA, 9 bp, Unknown
  misc_feature (1)..( 9): Matrix.003 file - promoters60/4282588
ataataact

SEQ ID NO: 57309 - DNA, 6 bp, Unknown
  misc_feature (1)..( 6): Matrix.003 file - promoters60/4282588
aataaa

SEQ ID NO: 57310 - DNA, 6 bp, Unknown
  misc_feature (1)..( 6): Matrix.003 file - promoters60/4282588
aaaaac

SEQ ID NO: 57311 - DNA, 7 bp, Unknown
  misc_feature (1)..( 7): Matrix.003 file - promoters60/4282588
aaaaaaa

SEQ ID NO: 57312 - DNA, 10 bp, Unknown
  misc_feature (1)..( 10): Matrix.003 file - promoters60/4282588
ttgatttttt

SEQ ID NO: 57313 - DNA, 7 bp, Unknown
  misc_feature (1)..( 7): Matrix.003 file - promoters60/4282588
tttaaaa

SEQ ID NO: 57314 - DNA, 7 bp, Unknown
  misc_feature (1)..( 7): Matrix.003 file - promoters60/4282588
tttaaac

SEQ ID NO: 57315 - DNA, 7 bp, Unknown
  misc_feature (1)..( 7): Matrix.003 file - promoters60/4282588
actaata

SEQ ID NO: 57316 - DNA, 8 bp, Unknown
  misc_feature (1)..( 8): Matrix.003 file - promoters60/4282588
tttaaact

SEQ ID NO: 57317 - DNA, 6 bp, Unknown
  misc_feature (1)..( 6): Matrix.003 file - promoters60/4282588
gcataa

SEQ ID NO: 57318 - DNA, 11 bp, Unknown
  misc_feature (1)..( 11): Matrix.003 file - promoters60/4282588
aatatttttct

SEQ ID NO: 57319 - DNA, 7 bp, Unknown
  misc_feature (1)..( 7): Matrix.003 file - promoters60/4282588
aaaatta

SEQ ID NO: 57320 - DNA, 7 bp, Unknown
  misc_feature (1)..( 7): Matrix.003 file - promoters60/4282588
aaaaata

SEQ ID NO: 57321 - DNA, 6 bp, Unknown
  misc_feature (1)..( 6): Matrix.003 file - promoters60/4282588
tttgac

SEQ ID NO: 57322 - DNA, 7 bp, Unknown
  misc_feature (1)..( 7): Matrix.003 file - promoters60/4282588
aaaaaag

SEQ ID NO: 57323 - DNA, 9 bp, Unknown
  misc_feature (1)..( 9): Matrix.003 file - promoters60/4282588
aaaagactc

SEQ ID NO: 57324 - DNA, 6 bp, Unknown
  misc_feature (1)..( 6): Matrix.003 file - promoters60/4282588
cagccg

SEQ ID NO: 57325 - DNA, 6 bp, Unknown
  misc_feature (1)..( 6): Matrix.003 file - promoters60/4282588
tctcct

SEQ ID NO: 57326 - DNA, 8 bp, Unknown
  misc_feature (1)..( 8): Matrix.003 file - promoters60/4282611
tttgattc

SEQ ID NO: 57327 - DNA, 7 bp, Unknown
  misc_feature (1)..( 7): Matrix.003 file - promoters60/4282611
aacaaat

SEQ ID NO: 57328 - DNA, 9 bp, Unknown
  misc_feature (1)..( 9): Matrix.003 file - promoters60/4282611
taactaaaa

SEQ ID NO: 57329 - DNA, 8 bp, Unknown
  misc_feature (1)..( 8): Matrix.003 file - promoters60/4282611
taataact

SEQ ID NO: 57330 - DNA, 9 bp, Unknown
  misc_feature (1)..( 9): Matrix.003 file - promoters60/4282614
tttattcac

SEQ ID NO: 57331 - DNA, 9 bp, Unknown
  misc_feature (1)..( 9): Matrix.003 file - promoters60/4282614
gatttgttt

SEQ ID NO: 57332 - DNA, 10 bp, Unknown
  misc_feature (1)..( 10): Matrix.003 file - promoters60/4282614
aaaatatttt

SEQ ID NO: 57333 - DNA, 9 bp, Unknown
  misc_feature (1)..( 9): Matrix.003 file - promoters60/4282614
acaatcata

SEQ ID NO: 57334 - DNA, 9 bp, Unknown
  misc_feature (1)..( 9): Matrix.003 file - promoters60/4282614
taatttcat

SEQ ID NO: 57335 - DNA, 7 bp, Unknown
  misc_feature (1)..( 7): Matrix.003 file - promoters60/4282614
aaaagaa

SEQ ID NO: 57336 - DNA, 12 bp, Unknown
  misc_feature (1)..( 12): Matrix.003 file - promoters60/4282614
aaaatatgtatt

SEQ ID NO: 57337 - DNA, 10 bp, Unknown
  misc_feature (1)..( 10): Matrix.003 file - promoters60/4282614
aaacaaaaag

SEQ ID NO: 57338 - DNA, 7 bp, Unknown
  misc_feature (1)..( 7): Matrix.003 file - promoters60/4282626
ataaaaa

SEQ ID NO: 57339 - DNA, 13 bp, Unknown
  misc_feature (1)..( 13): Matrix.003 file - promoters60/4282626
aaaaattaaaaga

SEQ ID NO: 57340 - DNA, 7 bp, Unknown
  misc_feature (1)..( 7): Matrix.003 file - promoters60/4282626
tagaaag

SEQ ID NO: 57341 - DNA, 8 bp, Unknown
  misc_feature (1)..( 8): Matrix.003 file - promoters60/4282626
gtgtattt

SEQ ID NO: 57342 - DNA, 7 bp, Unknown
  misc_feature (1)..( 7): Matrix.003 file - promoters60/4282626
aaaatca

SEQ ID NO: 57343 - DNA, 8 bp, Unknown
  misc_feature (1)..( 8): Matrix.003 file - promoters60/4282626
cttagttg

SEQ ID NO: 57344 - DNA, 9 bp, Unknown
  misc_feature (1)..( 9): Matrix.003 file - promoters60/4282626
aagtaaaaa

SEQ ID NO: 57345 - DNA, 9 bp, Unknown
  misc_feature (1)..( 9): Matrix.003 file - promoters60/4282626
aaaaaataa

SEQ ID NO: 57346 - DNA, 10 bp, Unknown
  misc_feature (1)..( 10): Matrix.003 file - promoters60/4282626
aaaaattatt

SEQ ID NO: 57347 - DNA, 6 bp, Unknown
  misc_feature (1)..( 6): Matrix.003 file - promoters60/4282626
tattta

SEQ ID NO: 57348 - DNA, 6 bp, Unknown
  misc_feature (1)..( 6): Matrix.003 file - promoters60/4282626
aaaagt

SEQ ID NO: 57349 - DNA, 6 bp, Unknown
  misc_feature (1)..( 6): Matrix.003 file - promoters60/4282626
gaataa

SEQ ID NO: 57350 - DNA, 7 bp, Unknown
  misc_feature (1)..( 7): Matrix.003 file - promoters60/4282626
atatttt

SEQ ID NO: 57351 - DNA, 8 bp, Unknown
  misc_feature (1)..( 8): Matrix.003 file - promoters60/4282626
ttaacttg

SEQ ID NO: 57352 - DNA, 6 bp, Unknown
  misc_feature (1)..( 6): Matrix.003 file - promoters60/4282626
tgtttc

SEQ ID NO: 57353 - DNA, 7 bp, Unknown
  misc_feature (1)..( 7): Matrix.003 file - promoters60/4282626
cgtcttc

SEQ ID NO: 57354 - DNA, 7 bp, Unknown
  misc_feature (1)..( 7): Matrix.003 file - promoters60/4282626
gtattat

SEQ ID NO: 57355 - DNA, 6 bp, Unknown
  misc_feature (1)..( 6): Matrix.003 file - promoters60/4282626
aatttg

SEQ ID NO: 57356 - DNA, 8 bp, Unknown
  misc_feature (1)..( 8): Matrix.003 file - promoters60/4282641
ttaagaaa

SEQ ID NO: 57357 - DNA, 7 bp, Unknown
  misc_feature (1)..( 7): Matrix.003 file - promoters60/4282641
agatttt

SEQ ID NO: 57358 - DNA, 9 bp, Unknown
  misc_feature (1)..( 9): Matrix.003 file - promoters60/4282641
attttatga

SEQ ID NO: 57359 - DNA, 8 bp, Unknown
  misc_feature (1)..( 8): Matrix.003 file - promoters60/4282641
cttttctc

SEQ ID NO: 57360 - DNA, 7 bp, Unknown
  misc_feature (1)..( 7): Matrix.003 file - promoters60/4282641
tcatttg

SEQ ID NO: 57361 - DNA, 9 bp, Unknown
  misc_feature (1)..( 9): Matrix.003 file - promoters60/4282647
atcctatat

SEQ ID NO: 57362 - DNA, 6 bp, Unknown
  misc_feature (1)..( 6): Matrix.003 file - promoters60/4282647
ttgaat

SEQ ID NO: 57363 - DNA, 13 bp, Unknown
  misc_feature (1)..( 13): Matrix.003 file - promoters60/4282647
ttaatcaaaattt

SEQ ID NO: 57364 - DNA, 9 bp, Unknown
  misc_feature (1)..( 9): Matrix.003 file - promoters60/4282647
ttttgattt

SEQ ID NO: 57365 - DNA, 6 bp, Unknown
  misc_feature (1)..( 6): Matrix.003 file - promoters60/4282647
ttgatt

SEQ ID NO: 57366 - DNA, 7 bp, Unknown
  misc_feature (1)..( 7): Matrix.003 file - promoters60/4282647
cttcttt

SEQ ID NO: 57367 - DNA, 8 bp, Unknown
  misc_feature (1)..( 8): Matrix.003 file - promoters60/4282647
tatcattt

SEQ ID NO: 57368 - DNA, 7 bp, Unknown
  misc_feature (1)..( 7): Matrix.003 file - promoters60/4282647
ttgaaat

SEQ ID NO: 57369 - DNA, 6 bp, Unknown
  misc_feature (1)..( 6): Matrix.003 file - promoters60/4282647
aaatat

SEQ ID NO: 57370 - DNA, 12 bp, Unknown
  misc_feature (1)..( 12): Matrix.003 file - promoters60/4282647
aacaaacacaac

SEQ ID NO: 57371 - DNA, 8 bp, Unknown
  misc_feature (1)..( 8): Matrix.003 file - promoters60/4282647
ctaaattt

SEQ ID NO: 57372 - DNA, 9 bp, Unknown
  misc_feature (1)..( 9): Matrix.003 file - promoters60/4282647
taaaaaact

SEQ ID NO: 57373 - DNA, 8 bp, Unknown
  misc_feature (1)..( 8): Matrix.003 file - promoters60/4282647
gacaactt

SEQ ID NO: 57374 - DNA, 7 bp, Unknown
  misc_feature (1)..( 7): Matrix.003 file - promoters60/4282647
atttttt

SEQ ID NO: 57375 - DNA, 8 bp, Unknown
  misc_feature (1)..( 8): Matrix.003 file - promoters60/4282647
tcagtaat

SEQ ID NO: 57376 - DNA, 6 bp, Unknown
  misc_feature (1)..( 6): Matrix.003 file - promoters60/4282647
tctatt

SEQ ID NO: 57377 - DNA, 7 bp, Unknown
  misc_feature (1)..( 7): Matrix.003 file - promoters60/4282647
caaaatt

SEQ ID NO: 57378 - DNA, 7 bp, Unknown
  misc_feature (1)..( 7): Matrix.003 file - promoters60/4282647
tacaaaa

SEQ ID NO: 57379 - DNA, 7 bp, Unknown
  misc_feature (1)..( 7): Matrix.003 file - promoters60/4282647
aataaaa

SEQ ID NO: 57380 - DNA, 7 bp, Unknown
  misc_feature (1)..( 7): Matrix.003 file - promoters60/4282647
atataat

SEQ ID NO: 57381 - DNA, 8 bp, Unknown
  misc_feature (1)..( 8): Matrix.003 file - promoters60/4282647
gttaatac

SEQ ID NO: 57382 - DNA, 8 bp, Unknown
  misc_feature (1)..( 8): Matrix.003 file - promoters60/4282647
tattcttt

SEQ ID NO: 57383 - DNA, 8 bp, Unknown
  misc_feature (1)..( 8): Matrix.003 file - promoters60/4282647
ctttattc

SEQ ID NO: 57384 - DNA, 8 bp, Unknown
  misc_feature (1)..( 8): Matrix.003 file - promoters60/4282647
ttgtcgta

SEQ ID NO: 57385 - DNA, 8 bp, Unknown
  misc_feature (1)..( 8): Matrix.003 file - promoters60/4282647
cattaatg

SEQ ID NO: 57386 - DNA, 6 bp, Unknown
  misc_feature (1)..( 6): Matrix.003 file - promoters60/4282647
actctc

SEQ ID NO: 57387 - DNA, 9 bp, Unknown
  misc_feature (1)..( 9): Matrix.003 file - promoters60/4282667
taatttttg

SEQ ID NO: 57388 - DNA, 10 bp, Unknown
  misc_feature (1)..( 10): Matrix.003 file - promoters60/4282695
acttcaaaaa

SEQ ID NO: 57389 - DNA, 9 bp, Unknown
  misc_feature (1)..( 9): Matrix.003 file - promoters60/4282695
tctcaaact

SEQ ID NO: 57390 - DNA, 7 bp, Unknown
  misc_feature (1)..( 7): Matrix.003 file - promoters60/4282695
ttgcaga

SEQ ID NO: 57391 - DNA, 8 bp, Unknown
  misc_feature (1)..( 8): Matrix.003 file - promoters60/4282695
gagaaaaa

SEQ ID NO: 57392 - DNA, 8 bp, Unknown
  misc_feature (1)..( 8): Matrix.003 file - promoters60/4282695
aaaaaatt

SEQ ID NO: 57393 - DNA, 7 bp, Unknown
  misc_feature (1)..( 7): Matrix.003 file - promoters60/4282695
aataatt

SEQ ID NO: 57394 - DNA, 7 bp, Unknown
  misc_feature (1)..( 7): Matrix.003 file - promoters60/4282695
atggtgg

SEQ ID NO: 57395 - DNA, 7 bp, Unknown
  misc_feature (1)..( 7): Matrix.003 file - promoters60/4282695
ctcatca

SEQ ID NO: 57396 - DNA, 8 bp, Unknown
  misc_feature (1)..( 8): Matrix.003 file - promoters60/4282695
ccaatcag

SEQ ID NO: 57397 - DNA, 9 bp, Unknown
  misc_feature (1)..( 9): Matrix.003 file - promoters60/4282695
aatcaatgt

SEQ ID NO: 57398 - DNA, 8 bp, Unknown
  misc_feature (1)..( 8): Matrix.003 file - promoters60/4282695
cataatca

SEQ ID NO: 57399 - DNA, 9 bp, Unknown
  misc_feature (1)..( 9): Matrix.003 file - promoters60/4282695
aaaaaaatg

SEQ ID NO: 57400 - DNA, 8 bp, Unknown
  misc_feature (1)..( 8): Matrix.003 file - promoters60/4282695
aaaaggaa

SEQ ID NO: 57401 - DNA, 10 bp, Unknown
  misc_feature (1)..( 10): Matrix.003 file - promoters60/4282695
aaaaaaagga

SEQ ID NO: 57402 - DNA, 13 bp, Unknown
  misc_feature (1)..( 13): Matrix.003 file - promoters60/4282744
tttatgaaatcta

SEQ ID NO: 57403 - DNA, 10 bp, Unknown
  misc_feature (1)..( 10): Matrix.003 file - promoters60/4282744
aaaactgtaa

SEQ ID NO: 57404 - DNA, 9 bp, Unknown
  misc_feature (1)..( 9): Matrix.003 file - promoters60/4282744
aacaaaaac

SEQ ID NO: 57405 - DNA, 8 bp, Unknown
  misc_feature (1)..( 8): Matrix.003 file - promoters60/4282744
taataata

SEQ ID NO: 57406 - DNA, 8 bp, Unknown
  misc_feature (1)..( 8): Matrix.003 file - promoters60/4282744
aaaaatcc

SEQ ID NO: 57407 - DNA, 10 bp, Unknown
  misc_feature (1)..( 10): Matrix.003 file - promoters60/4282748
ttcgtagaca

SEQ ID NO: 57408 - DNA, 7 bp, Unknown
  misc_feature (1)..( 7): Matrix.003 file - promoters60/4282748
tgactat

SEQ ID NO: 57409 - DNA, 6 bp, Unknown
  misc_feature (1)..( 6): Matrix.003 file - promoters60/4282748
gtcaat

SEQ ID NO: 57410 - DNA, 9 bp, Unknown
  misc_feature (1)..( 9): Matrix.003 file - promoters60/4282748
tttattgtt

SEQ ID NO: 57411 - DNA, 6 bp, Unknown
  misc_feature (1)..( 6): Matrix.003 file - promoters60/4282748
attgta

SEQ ID NO: 57412 - DNA, 8 bp, Unknown
  misc_feature (1)..( 8): Matrix.003 file - promoters60/4282748
caaataat

SEQ ID NO: 57413 - DNA, 6 bp, Unknown
  misc_feature (1)..( 6): Matrix.003 file - promoters60/4282748
tacaaa

SEQ ID NO: 57414 - DNA, 9 bp, Unknown
  misc_feature (1)..( 9): Matrix.003 file - promoters60/4282748
cataaattt

SEQ ID NO: 57415 - DNA, 6 bp, Unknown
  misc_feature (1)..( 6): Matrix.003 file - promoters60/4282748
ttatat

SEQ ID NO: 57416 - DNA, 6 bp, Unknown
  misc_feature (1)..( 6): Matrix.003 file - promoters60/4282748
ggtttg

SEQ ID NO: 57417 - DNA, 6 bp, Unknown
  misc_feature (1)..( 6): Matrix.003 file - promoters60/4282748
ggttga

SEQ ID NO: 57418 - DNA, 6 bp, Unknown
  misc_feature (1)..( 6): Matrix.003 file - promoters60/4282748
ttattg

SEQ ID NO: 57419 - DNA, 7 bp, Unknown
  misc_feature (1)..( 7): Matrix.003 file - promoters60/4282748
ttgtatg

SEQ ID NO: 57420 - DNA, 6 bp, Unknown
  misc_feature (1)..( 6): Matrix.003 file - promoters60/4282748
cgtgtc

SEQ ID NO: 57421 - DNA, 7 bp, Unknown
  misc_feature (1)..( 7): Matrix.003 file - promoters60/4282748
aatatat

SEQ ID NO: 57422 - DNA, 6 bp, Unknown
  misc_feature (1)..( 6): Matrix.003 file - promoters60/4282788
aaaaaa

SEQ ID NO: 57423 - DNA, 8 bp, Unknown
  misc_feature (1)..( 8): Matrix.003 file - promoters60/4282788
tgtaaaat

SEQ ID NO: 57424 - DNA, 6 bp, Unknown
  misc_feature (1)..( 6): Matrix.003 file - promoters60/4282788
gtaaac

SEQ ID NO: 57425 - DNA, 8 bp, Unknown
  misc_feature (1)..( 8): Matrix.003 file - promoters60/4282788
gataagag

SEQ ID NO: 57426 - DNA, 6 bp, Unknown
  misc_feature (1)..( 6): Matrix.003 file - promoters60/4282788
agagtt

SEQ ID NO: 57427 - DNA, 6 bp, Unknown
  misc_feature (1)..( 6): Matrix.003 file - promoters60/4282788
tgtctc

SEQ ID NO: 57428 - DNA, 8 bp, Unknown
  misc_feature (1)..( 8): Matrix.003 file - promoters60/4282788
tttgattt

SEQ ID NO: 57429 - DNA, 7 bp, Unknown
  misc_feature (1)..( 7): Matrix.003 file - promoters60/4282788
tctctaa

SEQ ID NO: 57430 - DNA, 6 bp, Unknown
  misc_feature (1)..( 6): Matrix.003 file - promoters60/4282788
tgtttc

SEQ ID NO: 57431 - DNA, 7 bp, Unknown
  misc_feature (1)..( 7): Matrix.003 file - promoters60/4282788
gttgtct

SEQ ID NO: 57432 - DNA, 7 bp, Unknown
  misc_feature (1)..( 7): Matrix.003 file - promoters60/4282788
tatcatt

SEQ ID NO: 57433 - DNA, 7 bp, Unknown
  misc_feature (1)..( 7): Matrix.003 file - promoters60/4282788
gaatttg

SEQ ID NO: 57434 - DNA, 7 bp, Unknown
  misc_feature (1)..( 7): Matrix.003 file - promoters60/4282788
ttagatc

SEQ ID NO: 57435 - DNA, 6 bp, Unknown
  misc_feature (1)..( 6): Matrix.003 file - promoters60/4282788
catttg

SEQ ID NO: 57436 - DNA, 9 bp, Unknown
  misc_feature (1)..( 9): Matrix.003 file - promoters60/4282795
taatcgttt

SEQ ID NO: 57437 - DNA, 7 bp, Unknown
  misc_feature (1)..( 7): Matrix.003 file - promoters60/4282795
ttttagt

SEQ ID NO: 57438 - DNA, 7 bp, Unknown
  misc_feature (1)..( 7): Matrix.003 file - promoters60/4282795
gttaatg

SEQ ID NO: 57439 - DNA, 11 bp, Unknown
  misc_feature (1)..( 11): Matrix.003 file - promoters60/4282795
atgaaaaccaa

SEQ ID NO: 57440 - DNA, 12 bp, Unknown
  misc_feature (1)..( 12): Matrix.003 file - promoters60/4282795
aacctttatgta

SEQ ID NO: 57441 - DNA, 8 bp, Unknown
  misc_feature (1)..( 8): Matrix.003 file - promoters60/4282795
cggtttgg

SEQ ID NO: 57442 - DNA, 11 bp, Unknown
  misc_feature (1)..( 11): Matrix.003 file - promoters60/4282795
tcttttgattt

SEQ ID NO: 57443 - DNA, 9 bp, Unknown
  misc_feature (1)..( 9): Matrix.003 file - promoters60/4282795
tattaatat

SEQ ID NO: 57444 - DNA, 9 bp, Unknown
  misc_feature (1)..( 9): Matrix.003 file - promoters60/4282795
ttttagaaa

SEQ ID NO: 57445 - DNA, 6 bp, Unknown
  misc_feature (1)..( 6): Matrix.003 file - promoters60/4282795
tttctt

SEQ ID NO: 57446 - DNA, 12 bp, Unknown
  misc_feature (1)..( 12): Matrix.003 file - promoters60/4282795
ttttaactaaca

SEQ ID NO: 57447 - DNA, 7 bp, Unknown
  misc_feature (1)..( 7): Matrix.003 file - promoters60/4282832
aaattta

SEQ ID NO: 57448 - DNA, 7 bp, Unknown
  misc_feature (1)..( 7): Matrix.003 file - promoters60/4282832
aaagaaa

SEQ ID NO: 57449 - DNA, 7 bp, Unknown
  misc_feature (1)..( 7): Matrix.003 file - promoters60/4282832
aagaaaa

SEQ ID NO: 57450 - DNA, 7 bp, Unknown
  misc_feature (1)..( 7): Matrix.003 file - promoters60/4282832
ttaaatc

SEQ ID NO: 57451 - DNA, 7 bp, Unknown
  misc_feature (1)..( 7): Matrix.003 file - promoters60/4282832
aaaatcc

SEQ ID NO: 57452 - DNA, 6 bp, Unknown
  misc_feature (1)..( 6): Matrix.003 file - promoters60/4282832
agagaa

SEQ ID NO: 57453 - DNA, 8 bp, Unknown
  misc_feature (1)..( 8): Matrix.003 file - promoters60/4282832
gttctgaa

SEQ ID NO: 57454 - DNA, 7 bp, Unknown
  misc_feature (1)..( 7): Matrix.003 file - promoters60/4282832
ccctgtg

SEQ ID NO: 57455 - DNA, 7 bp, Unknown
  misc_feature (1)..( 7): Matrix.003 file - promoters60/4282832
ttctcat

SEQ ID NO: 57456 - DNA, 8 bp, Unknown
  misc_feature (1)..( 8): Matrix.003 file - promoters60/4282832
tttagctt

SEQ ID NO: 57457 - DNA, 6 bp, Unknown
  misc_feature (1)..( 6): Matrix.003 file - promoters60/4282832
gaatta

SEQ ID NO: 57458 - DNA, 6 bp, Unknown
  misc_feature (1)..( 6): Matrix.003 file - promoters60/4282832
gcggaa

SEQ ID NO: 57459 - DNA, 6 bp, Unknown
  misc_feature (1)..( 6): Matrix.003 file - promoters60/4282832
aaagaa

SEQ ID NO: 57460 - DNA, 7 bp, Unknown
  misc_feature (1)..( 7): Matrix.003 file - promoters60/4282832
tatcttc

SEQ ID NO: 57461 - DNA, 6 bp, Unknown
  misc_feature (1)..( 6): Matrix.003 file - promoters60/4282832
tccttg

SEQ ID NO: 57462 - DNA, 7 bp, Unknown
  misc_feature (1)..( 7): Matrix.003 file - promoters60/4282832
gatatat

SEQ ID NO: 57463 - DNA, 9 bp, Unknown
  misc_feature (1)..( 9): Matrix.003 file - promoters60/4282859
tctatctga

SEQ ID NO: 57464 - DNA, 6 bp, Unknown
  misc_feature (1)..( 6): Matrix.003 file - promoters60/4282859
gaaaat

SEQ ID NO: 57465 - DNA, 7 bp, Unknown
  misc_feature (1)..( 7): Matrix.003 file - promoters60/4282859
tgaaaaa

SEQ ID NO: 57466 - DNA, 7 bp, Unknown
  misc_feature (1)..( 7): Matrix.003 file - promoters60/4282859
atgactc

SEQ ID NO: 57467 - DNA, 7 bp, Unknown
  misc_feature (1)..( 7): Matrix.003 file - promoters60/4282859
attctta

SEQ ID NO: 57468 - DNA, 6 bp, Unknown
  misc_feature (1)..( 6): Matrix.003 file - promoters60/4282859
atttaa

SEQ ID NO: 57469 - DNA, 6 bp, Unknown
  misc_feature (1)..( 6): Matrix.003 file - promoters60/4282859
aaaatt

SEQ ID NO: 57470 - DNA, 6 bp, Unknown
  misc_feature (1)..( 6): Matrix.003 file - promoters60/4282859
aaggaa

SEQ ID NO: 57471 - DNA, 14 bp, Unknown
  misc_feature (1)..( 14): Matrix.003 file - promoters60/4282877
acaattgggcctaa

SEQ ID NO: 57472 - DNA, 6 bp, Unknown
  misc_feature (1)..( 6): Matrix.003 file - promoters60/4282877
tcaaat

SEQ ID NO: 57473 - DNA, 12 bp, Unknown
  misc_feature (1)..( 12): Matrix.003 file - promoters60/4282877
acaagaagaaga

SEQ ID NO: 57474 - DNA, 10 bp, Unknown
  misc_feature (1)..( 10): Matrix.003 file - promoters60/4282915
gatttttgtg

SEQ ID NO: 57475 - DNA, 9 bp, Unknown
  misc_feature (1)..( 9): Matrix.003 file - promoters60/4282915
ttttacaaa

SEQ ID NO: 57476 - DNA, 6 bp, Unknown
  misc_feature (1)..( 6): Matrix.003 file - promoters60/4282915
ccaaaa

SEQ ID NO: 57477 - DNA, 8 bp, Unknown
  misc_feature (1)..( 8): Matrix.003 file - promoters60/4282915
atttgttt

SEQ ID NO: 57478 - DNA, 10 bp, Unknown
  misc_feature (1)..( 10): Matrix.003 file - promoters60/4282915
tataattgaa

SEQ ID NO: 57479 - DNA, 10 bp, Unknown
  misc_feature (1)..( 10): Matrix.003 file - promoters60/4282915
aaataataaa

SEQ ID NO: 57480 - DNA, 6 bp, Unknown
  misc_feature (1)..( 6): Matrix.003 file - promoters60/4282939
aagaga

SEQ ID NO: 57481 - DNA, 6 bp, Unknown
  misc_feature (1)..( 6): Matrix.003 file - promoters60/4282939
gatcat

SEQ ID NO: 57482 - DNA, 7 bp, Unknown
  misc_feature (1)..( 7): Matrix.003 file - promoters60/4282939
tctacat

SEQ ID NO: 57483 - DNA, 8 bp, Unknown
  misc_feature (1)..( 8): Matrix.003 file - promoters60/4282939
tttagaaa

SEQ ID NO: 57484 - DNA, 8 bp, Unknown
  misc_feature (1)..( 8): Matrix.003 file - promoters60/4282939
taaaatta

SEQ ID NO: 57485 - DNA, 8 bp, Unknown
  misc_feature (1)..( 8): Matrix.003 file - promoters60/4282939
aataaata

SEQ ID NO: 57486 - DNA, 10 bp, Unknown
  misc_feature (1)..( 10): Matrix.003 file - promoters60/4282939
ctataataat

SEQ ID NO: 57487 - DNA, 7 bp, Unknown
  misc_feature (1)..( 7): Matrix.003 file - promoters60/4282939
ttgcctc

SEQ ID NO: 57488 - DNA, 8 bp, Unknown
  misc_feature (1)..( 8): Matrix.003 file - promoters60/4282939
agaaaaga

SEQ ID NO: 57489 - DNA, 7 bp, Unknown
  misc_feature (1)..( 7): Matrix.003 file - promoters60/4282939
cataccc

SEQ ID NO: 57490 - DNA, 7 bp, Unknown
  misc_feature (1)..( 7): Matrix.003 file - promoters60/4282939
ctgggaa

SEQ ID NO: 57491 - DNA, 8 bp, Unknown
  misc_feature (1)..( 8): Matrix.003 file - promoters60/4282939
gttaactc

SEQ ID NO: 57492 - DNA, 8 bp, Unknown
  misc_feature (1)..( 8): Matrix.003 file - promoters60/4282941
atttaaag

SEQ ID NO: 57493 - DNA, 8 bp, Unknown
  misc_feature (1)..( 8): Matrix.003 file - promoters60/4282941
tataattt

SEQ ID NO: 57494 - DNA, 8 bp, Unknown
  misc_feature (1)..( 8): Matrix.003 file - promoters60/4282941
tgagttcg

SEQ ID NO: 57495 - DNA, 9 bp, Unknown
  misc_feature (1)..( 9): Matrix.003 file - promoters60/4282941
taaaaattg

SEQ ID NO: 57496 - DNA, 6 bp, Unknown
  misc_feature (1)..( 6): Matrix.003 file - promoters60/4282941
attggg

SEQ ID NO: 57497 - DNA, 6 bp, Unknown
  misc_feature (1)..( 6): Matrix.003 file - promoters60/4282941
tgagat

SEQ ID NO: 57498 - DNA, 12 bp, Unknown
  misc_feature (1)..( 12): Matrix.003 file - promoters60/4282941
tatttaattttt

SEQ ID NO: 57499 - DNA, 9 bp, Unknown
  misc_feature (1)..( 9): Matrix.003 file - promoters60/4282941
aatataaat

SEQ ID NO: 57500 - DNA, 9 bp, Unknown
  misc_feature (1)..( 9): Matrix.003 file - promoters60/4282941
taaatattc

SEQ ID NO: 57501 - DNA, 7 bp, Unknown
  misc_feature (1)..( 7): Matrix.003 file - promoters60/4282941
ttaaaat

SEQ ID NO: 57502 - DNA, 6 bp, Unknown
  misc_feature (1)..( 6): Matrix.003 file - promoters60/4282941
aaataa

SEQ ID NO: 57503 - DNA, 7 bp, Unknown
  misc_feature (1)..( 7): Matrix.003 file - promoters60/4282941
cataaaa

SEQ ID NO: 57504 - DNA, 6 bp, Unknown
  misc_feature (1)..( 6): Matrix.003 file - promoters60/4282941
aaaatt

SEQ ID NO: 57505 - DNA, 9 bp, Unknown
  misc_feature (1)..( 9): Matrix.003 file - promoters60/4282941
tttatatta

SEQ ID NO: 57506 - DNA, 14 bp, Unknown
  misc_feature (1)..( 14): Matrix.003 file - promoters60/4282941
aatacaaattatat

SEQ ID NO: 57507 - DNA, 6 bp, Unknown
  misc_feature (1)..( 6): Matrix.003 file - promoters60/4282941
atatta

SEQ ID NO: 57508 - DNA, 8 bp, Unknown
  misc_feature (1)..( 8): Matrix.003 file - promoters60/4282941
tatgaaac

SEQ ID NO: 57509 - DNA, 8 bp, Unknown
  misc_feature (1)..( 8): Matrix.003 file - promoters60/4282941
tttaaaag

SEQ ID NO: 57510 - DNA, 7 bp, Unknown
  misc_feature (1)..( 7): Matrix.003 file - promoters60/4282941
aatctaa

SEQ ID NO: 57511 - DNA, 9 bp, Unknown
  misc_feature (1)..( 9): Matrix.003 file - promoters60/4282941
atatatttt

SEQ ID NO: 57512 - DNA, 6 bp, Unknown
  misc_feature (1)..( 6): Matrix.003 file - promoters60/4282941
taaaaa

SEQ ID NO: 57513 - DNA, 7 bp, Unknown
  misc_feature (1)..( 7): Matrix.003 file - promoters60/4282941
atatttt

SEQ ID NO: 57514 - DNA, 7 bp, Unknown
  misc_feature (1)..( 7): Matrix.003 file - promoters60/4282941
aatacaa

SEQ ID NO: 57515 - DNA, 11 bp, Unknown
  misc_feature (1)..( 11): Matrix.003 file - promoters60/4283003
aataatttgta

SEQ ID NO: 57516 - DNA, 7 bp, Unknown
  misc_feature (1)..( 7): Matrix.003 file - promoters60/4283003
ttgtaac

SEQ ID NO: 57517 - DNA, 7 bp, Unknown
  misc_feature (1)..( 7): Matrix.003 file - promoters60/4283003
atacaaa

SEQ ID NO: 57518 - DNA, 6 bp, Unknown
  misc_feature (1)..( 6): Matrix.003 file - promoters60/4283003
aaaaaa

SEQ ID NO: 57519 - DNA, 9 bp, Unknown
  misc_feature (1)..( 9): Matrix.003 file - promoters60/4283003
atcaatcat

SEQ ID NO: 57520 - DNA, 8 bp, Unknown
  misc_feature (1)..( 8): Matrix.003 file - promoters60/4283003
ttagttta

SEQ ID NO: 57521 - DNA, 7 bp, Unknown
  misc_feature (1)..( 7): Matrix.003 file - promoters60/4283003
aacagaa

SEQ ID NO: 57522 - DNA, 6 bp, Unknown
  misc_feature (1)..( 6): Matrix.003 file - promoters60/4283003
ctctta

SEQ ID NO: 57523 - DNA, 6 bp, Unknown
  misc_feature (1)..( 6): Matrix.003 file - promoters60/4283003
atcatt

SEQ ID NO: 57524 - DNA, 6 bp, Unknown
  misc_feature (1)..( 6): Matrix.003 file - promoters60/4283003
cattat

SEQ ID NO: 57525 - DNA, 7 bp, Unknown
  misc_feature (1)..( 7): Matrix.003 file - promoters60/4283003
gaaaaaa

SEQ ID NO: 57526 - DNA, 8 bp, Unknown
  misc_feature (1)..( 8): Matrix.003 file - promoters60/4283003
aacagtta

SEQ ID NO: 57527 - DNA, 11 bp, Unknown
  misc_feature (1)..( 11): Matrix.003 file - promoters60/4283003
actaaccaaat

SEQ ID NO: 57528 - DNA, 7 bp, Unknown
  misc_feature (1)..( 7): Matrix.003 file - promoters60/4283003
ttagtaa

SEQ ID NO: 57529 - DNA, 6 bp, Unknown
  misc_feature (1)..( 6): Matrix.003 file - promoters60/4283003
tttatt

SEQ ID NO: 57530 - DNA, 7 bp, Unknown
  misc_feature (1)..( 7): Matrix.003 file - promoters60/4283003
aaacaaa

SEQ ID NO: 57531 - DNA, 6 bp, Unknown
  misc_feature (1)..( 6): Matrix.003 file - promoters60/4283003
catgaa

SEQ ID NO: 57532 - DNA, 6 bp, Unknown
  misc_feature (1)..( 6): Matrix.003 file - promoters60/4283003
tcccaa

SEQ ID NO: 57533 - DNA, 6 bp, Unknown
  misc_feature (1)..( 6): Matrix.003 file - promoters60/4283003
agaaaa

SEQ ID NO: 57534 - DNA, 8 bp, Unknown
  misc_feature (1)..( 8): Matrix.003 file - promoters60/4283003
gcatccaa

SEQ ID NO: 57535 - DNA, 13 bp, Unknown
  misc_feature (1)..( 13): Matrix.003 file - promoters60/4283005
ttaagtttaagca

SEQ ID NO: 57536 - DNA, 13 bp, Unknown
  misc_feature (1)..( 13): Matrix.003 file - promoters60/4283005
aaaaaaaataata

SEQ ID NO: 57537 - DNA, 6 bp, Unknown
  misc_feature (1)..( 6): Matrix.003 file - promoters60/4283005
aaaaat

SEQ ID NO: 57538 - DNA, 12 bp, Unknown
  misc_feature (1)..( 12): Matrix.003 file - promoters60/4283005
ccaaaaaaaaaa

SEQ ID NO: 57539 - DNA, 31 bp, Unknown
  misc_feature (1)..( 31): Matrix.003 file - promoters60/4283005
attcatttttctgagtctcttaagtcttacg

SEQ ID NO: 57540 - DNA, 9 bp, Unknown
  misc_feature (1)..( 9): Matrix.003 file - promoters60/4283005
tatatatat

SEQ ID NO: 57541 - DNA, 9 bp, Unknown
  misc_feature (1)..( 9): Matrix.003 file - promoters60/4283005
gagaaaaaa

SEQ ID NO: 57542 - DNA, 11 bp, Unknown
  misc_feature (1)..( 11): Matrix.003 file - promoters60/4283005
tttaataactt

SEQ ID NO: 57543 - DNA, 12 bp, Unknown
  misc_feature (1)..( 12): Matrix.003 file - promoters60/4283005
aaaaatttaata

SEQ ID NO: 57544 - DNA, 7 bp, Unknown
  misc_feature (1)..( 7): Matrix.003 file - promoters60/4283013
cgcagca

SEQ ID NO: 57545 - DNA, 7 bp, Unknown
  misc_feature (1)..( 7): Matrix.003 file - promoters60/4283013
atagata

SEQ ID NO: 57546 - DNA, 7 bp, Unknown
  misc_feature (1)..( 7): Matrix.003 file - promoters60/4283013
caaagtt

SEQ ID NO: 57547 - DNA, 6 bp, Unknown
  misc_feature (1)..( 6): Matrix.003 file - promoters60/4283013
atatta

SEQ ID NO: 57548 - DNA, 9 bp, Unknown
  misc_feature (1)..( 9): Matrix.003 file - promoters60/4283013
gttatgtca

SEQ ID NO: 57549 - DNA, 7 bp, Unknown
  misc_feature (1)..( 7): Matrix.003 file - promoters60/4283013
tacaata

SEQ ID NO: 57550 - DNA, 7 bp, Unknown
  misc_feature (1)..( 7): Matrix.003 file - promoters60/4283013
atgaaga

SEQ ID NO: 57551 - DNA, 7 bp, Unknown
  misc_feature (1)..( 7): Matrix.003 file - promoters60/4283013
tcgtcat

SEQ ID NO: 57552 - DNA, 7 bp, Unknown
  misc_feature (1)..( 7): Matrix.003 file - promoters60/4283013
caacttg

SEQ ID NO: 57553 - DNA, 7 bp, Unknown
  misc_feature (1)..( 7): Matrix.003 file - promoters60/4283013
ataaaca

SEQ ID NO: 57554 - DNA, 7 bp, Unknown
  misc_feature (1)..( 7): Matrix.003 file - promoters60/4283013
ctttcct

SEQ ID NO: 57555 - DNA, 7 bp, Unknown
  misc_feature (1)..( 7): Matrix.003 file - promoters60/4283013
tcacaat

SEQ ID NO: 57556 - DNA, 8 bp, Unknown
  misc_feature (1)..( 8): Matrix.003 file - promoters60/4283013
tcaattat

SEQ ID NO: 57557 - DNA, 9 bp, Unknown
  misc_feature (1)..( 9): Matrix.003 file - promoters60/4283017
ttattcaat

SEQ ID NO: 57558 - DNA, 6 bp, Unknown
  misc_feature (1)..( 6): Matrix.003 file - promoters60/4283017
tcccac

SEQ ID NO: 57559 - DNA, 7 bp, Unknown
  misc_feature (1)..( 7): Matrix.003 file - promoters60/4283017
taaccat

SEQ ID NO: 57560 - DNA, 6 bp, Unknown
  misc_feature (1)..( 6): Matrix.003 file - promoters60/4283017
attttc

SEQ ID NO: 57561 - DNA, 6 bp, Unknown
  misc_feature (1)..( 6): Matrix.003 file - promoters60/4283017
tgaatt

SEQ ID NO: 57562 - DNA, 6 bp, Unknown
  misc_feature (1)..( 6): Matrix.003 file - promoters60/4283017
gattat

SEQ ID NO: 57563 - DNA, 6 bp, Unknown
  misc_feature (1)..( 6): Matrix.003 file - promoters60/4283017
tgtatt

SEQ ID NO: 57564 - DNA, 7 bp, Unknown
  misc_feature (1)..( 7): Matrix.003 file - promoters60/4283017
tataaac

SEQ ID NO: 57565 - DNA, 9 bp, Unknown
  misc_feature (1)..( 9): Matrix.003 file - promoters60/4283017
aaaagatct

SEQ ID NO: 57566 - DNA, 6 bp, Unknown
  misc_feature (1)..( 6): Matrix.003 file - promoters60/4283017
atcttc

SEQ ID NO: 57567 - DNA, 6 bp, Unknown
  misc_feature (1)..( 6): Matrix.003 file - promoters60/4283041
cattca

SEQ ID NO: 57568 - DNA, 6 bp, Unknown
  misc_feature (1)..( 6): Matrix.003 file - promoters60/4283041
tcacaa

SEQ ID NO: 57569 - DNA, 7 bp, Unknown
  misc_feature (1)..( 7): Matrix.003 file - promoters60/4283041
ttattta

SEQ ID NO: 57570 - DNA, 11 bp, Unknown
  misc_feature (1)..( 11): Matrix.003 file - promoters60/4283041
aaaaaaagaaa

SEQ ID NO: 57571 - DNA, 7 bp, Unknown
  misc_feature (1)..( 7): Matrix.003 file - promoters60/4283041
aagggaa

SEQ ID NO: 57572 - DNA, 6 bp, Unknown
  misc_feature (1)..( 6): Matrix.003 file - promoters60/4283041
tcgaaa

SEQ ID NO: 57573 - DNA, 11 bp, Unknown
  misc_feature (1)..( 11): Matrix.003 file - promoters60/4283041
aacacaccaaa

SEQ ID NO: 57574 - DNA, 7 bp, Unknown
  misc_feature (1)..( 7): Matrix.003 file - promoters60/4283041
aaaaaaa

SEQ ID NO: 57575 - DNA, 7 bp, Unknown
  misc_feature (1)..( 7): Matrix.003 file - promoters60/4283041
aataaaa

SEQ ID NO: 57576 - DNA, 6 bp, Unknown
  misc_feature (1)..( 6): Matrix.003 file - promoters60/4283041
agtaaa

SEQ ID NO: 57577 - DNA, 7 bp, Unknown
  misc_feature (1)..( 7): Matrix.003 file - promoters60/4283041
aatcggg

SEQ ID NO: 57578 - DNA, 8 bp, Unknown
  misc_feature (1)..( 8): Matrix.003 file - promoters60/4283041
gaaacaaa

SEQ ID NO: 57579 - DNA, 10 bp, Unknown
  misc_feature (1)..( 10): Matrix.003 file - promoters60/4283041
ggaaaagaaa

SEQ ID NO: 57580 - DNA, 7 bp, Unknown
  misc_feature (1)..( 7): Matrix.003 file - promoters60/4283041
cccacta

SEQ ID NO: 57581 - DNA, 9 bp, Unknown
  misc_feature (1)..( 9): Matrix.003 file - promoters60/4283041
aaagaaaag

SEQ ID NO: 57582 - DNA, 7 bp, Unknown
  misc_feature (1)..( 7): Matrix.003 file - promoters60/4283041
gtatata

SEQ ID NO: 57583 - DNA, 9 bp, Unknown
  misc_feature (1)..( 9): Matrix.003 file - promoters60/4283105
atacgatag

SEQ ID NO: 57584 - DNA, 7 bp, Unknown
  misc_feature (1)..( 7): Matrix.003 file - promoters60/4283105
actattt

SEQ ID NO: 57585 - DNA, 9 bp, Unknown
  misc_feature (1)..( 9): Matrix.003 file - promoters60/4283105
ttaatctaa

SEQ ID NO: 57586 - DNA, 10 bp, Unknown
  misc_feature (1)..( 10): Matrix.003 file - promoters60/4283105
attcgttttc

SEQ ID NO: 57587 - DNA, 7 bp, Unknown
  misc_feature (1)..( 7): Matrix.003 file - promoters60/4283105
tttaaca

SEQ ID NO: 57588 - DNA, 7 bp, Unknown
  misc_feature (1)..( 7): Matrix.003 file - promoters60/4283105
acaaatt

SEQ ID NO: 57589 - DNA, 7 bp, Unknown
  misc_feature (1)..( 7): Matrix.003 file - promoters60/4283105
cataaaa

SEQ ID NO: 57590 - DNA, 7 bp, Unknown
  misc_feature (1)..( 7): Matrix.003 file - promoters60/4283105
tcaaaac

SEQ ID NO: 57591 - DNA, 8 bp, Unknown
  misc_feature (1)..( 8): Matrix.003 file - promoters60/4283105
accaatca

SEQ ID NO: 57592 - DNA, 6 bp, Unknown
  misc_feature (1)..( 6): Matrix.003 file - promoters60/4283105
agaaag

SEQ ID NO: 57593 - DNA, 6 bp, Unknown
  misc_feature (1)..( 6): Matrix.003 file - promoters60/4283105
aataat

SEQ ID NO: 57594 - DNA, 8 bp, Unknown
  misc_feature (1)..( 8): Matrix.003 file - promoters60/4283105
tctactaa

SEQ ID NO: 57595 - DNA, 7 bp, Unknown
  misc_feature (1)..( 7): Matrix.003 file - promoters60/4283105
tgaaaca

SEQ ID NO: 57596 - DNA, 7 bp, Unknown
  misc_feature (1)..( 7): Matrix.003 file - promoters60/4283105
tagagaa

SEQ ID NO: 57597 - DNA, 6 bp, Unknown
  misc_feature (1)..( 6): Matrix.003 file - promoters60/4283105
aacact

SEQ ID NO: 57598 - DNA, 6 bp, Unknown
  misc_feature (1)..( 6): Matrix.003 file - promoters60/4283105
ttctta

SEQ ID NO: 57599 - DNA, 6 bp, Unknown
  misc_feature (1)..( 6): Matrix.003 file - promoters60/4283105
gtcata

SEQ ID NO: 57600 - DNA, 8 bp, Unknown
  misc_feature (1)..( 8): Matrix.003 file - promoters60/4283105
caaaacaa

SEQ ID NO: 57601 - DNA, 7 bp, Unknown
  misc_feature (1)..( 7): Matrix.003 file - promoters60/4283105
ttaaaca

SEQ ID NO: 57602 - DNA, 6 bp, Unknown
  misc_feature (1)..( 6): Matrix.003 file - promoters60/4283105
attctt

SEQ ID NO: 57603 - DNA, 9 bp, Unknown
  misc_feature (1)..( 9): Matrix.003 file - promoters60/4283218
tatataaac

SEQ ID NO: 57604 - DNA, 7 bp, Unknown
  misc_feature (1)..( 7): Matrix.003 file - promoters60/4283218
tttttac

SEQ ID NO: 57605 - DNA, 7 bp, Unknown
  misc_feature (1)..( 7): Matrix.003 file - promoters60/4283222
tttactt

SEQ ID NO: 57606 - DNA, 7 bp, Unknown
  misc_feature (1)..( 7): Matrix.003 file - promoters60/4283222
aaataca

SEQ ID NO: 57607 - DNA, 9 bp, Unknown
  misc_feature (1)..( 9): Matrix.003 file - promoters60/4283222
aaatatttt

SEQ ID NO: 57608 - DNA, 6 bp, Unknown
  misc_feature (1)..( 6): Matrix.003 file - promoters60/4283222
ttttat

SEQ ID NO: 57609 - DNA, 6 bp, Unknown
  misc_feature (1)..( 6): Matrix.003 file - promoters60/4283222
aataat

SEQ ID NO: 57610 - DNA, 9 bp, Unknown
  misc_feature (1)..( 9): Matrix.003 file - promoters60/4283222
taaaaattt

SEQ ID NO: 57611 - DNA, 7 bp, Unknown
  misc_feature (1)..( 7): Matrix.003 file - promoters60/4283222
atttatt

SEQ ID NO: 57612 - DNA, 6 bp, Unknown
  misc_feature (1)..( 6): Matrix.003 file - promoters60/4283222
acaaaa

SEQ ID NO: 57613 - DNA, 6 bp, Unknown
  misc_feature (1)..( 6): Matrix.003 file - promoters60/4283222
atacaa

SEQ ID NO: 57614 - DNA, 9 bp, Unknown
  misc_feature (1)..( 9): Matrix.003 file - promoters60/4283222
taaacattg

SEQ ID NO: 57615 - DNA, 6 bp, Unknown
  misc_feature (1)..( 6): Matrix.003 file - promoters60/4283222
ccaaat

SEQ ID NO: 57616 - DNA, 8 bp, Unknown
  misc_feature (1)..( 8): Matrix.003 file - promoters60/4283222
aaattgaa

SEQ ID NO: 57617 - DNA, 6 bp, Unknown
  misc_feature (1)..( 6): Matrix.003 file - promoters60/4283222
attttt

SEQ ID NO: 57618 - DNA, 6 bp, Unknown
  misc_feature (1)..( 6): Matrix.003 file - promoters60/4283222
ttacta

SEQ ID NO: 57619 - DNA, 6 bp, Unknown
  misc_feature (1)..( 6): Matrix.003 file - promoters60/4283222
atttgc

SEQ ID NO: 57620 - DNA, 7 bp, Unknown
  misc_feature (1)..( 7): Matrix.003 file - promoters60/4283222
tttatcg

SEQ ID NO: 57621 - DNA, 6 bp, Unknown
  misc_feature (1)..( 6): Matrix.003 file - promoters60/4283222
attttt

SEQ ID NO: 57622 - DNA, 6 bp, Unknown
  misc_feature (1)..( 6): Matrix.003 file - promoters60/4283222
tccatt

SEQ ID NO: 57623 - DNA, 6 bp, Unknown
  misc_feature (1)..( 6): Matrix.003 file - promoters60/4283222
aattat

SEQ ID NO: 57624 - DNA, 8 bp, Unknown
  misc_feature (1)..( 8): Matrix.003 file - promoters60/4283222
tgtggaga

SEQ ID NO: 57625 - DNA, 6 bp, Unknown
  misc_feature (1)..( 6): Matrix.003 file - promoters60/4283222
agacta

SEQ ID NO: 57626 - DNA, 7 bp, Unknown
  misc_feature (1)..( 7): Matrix.003 file - promoters60/4283222
aaagatc

SEQ ID NO: 57627 - DNA, 6 bp, Unknown
  misc_feature (1)..( 6): Matrix.003 file - promoters60/4283222
agtgat

SEQ ID NO: 57628 - DNA, 7 bp, Unknown
  misc_feature (1)..( 7): Matrix.003 file - promoters60/4283222
ttcgtta

SEQ ID NO: 57629 - DNA, 6 bp, Unknown
  misc_feature (1)..( 6): Matrix.003 file - promoters60/4283222
ttgcca

SEQ ID NO: 57630 - DNA, 6 bp, Unknown
  misc_feature (1)..( 6): Matrix.003 file - promoters60/4283222
aatatt

SEQ ID NO: 57631 - DNA, 9 bp, Unknown
  misc_feature (1)..( 9): Matrix.003 file - promoters60/4283222
aaaacaatt

SEQ ID NO: 57632 - DNA, 7 bp, Unknown
  misc_feature (1)..( 7): Matrix.003 file - promoters60/4283222
aagatat

SEQ ID NO: 57633 - DNA, 9 bp, Unknown
  misc_feature (1)..( 9): Matrix.003 file - promoters60/4283222
attcttgct

SEQ ID NO: 57634 - DNA, 8 bp, Unknown
  misc_feature (1)..( 8): Matrix.003 file - promoters60/4283240
aaatttag

SEQ ID NO: 57635 - DNA, 8 bp, Unknown
  misc_feature (1)..( 8): Matrix.003 file - promoters60/4283240
aaattata

SEQ ID NO: 57636 - DNA, 8 bp, Unknown
  misc_feature (1)..( 8): Matrix.003 file - promoters60/4283240
gatatttt

SEQ ID NO: 57637 - DNA, 8 bp, Unknown
  misc_feature (1)..( 8): Matrix.003 file - promoters60/4283293
tttatttc

SEQ ID NO: 57638 - DNA, 7 bp, Unknown
  misc_feature (1)..( 7): Matrix.003 file - promoters60/4283293
tatttaa

SEQ ID NO: 57639 - DNA, 8 bp, Unknown
  misc_feature (1)..( 8): Matrix.003 file - promoters60/4283297
caaagaaa

SEQ ID NO: 57640 - DNA, 9 bp, Unknown
  misc_feature (1)..( 9): Matrix.003 file - promoters60/4283297
taaaatcat

SEQ ID NO: 57641 - DNA, 11 bp, Unknown
  misc_feature (1)..( 11): Matrix.003 file - promoters60/4283297
aaatattggaa

SEQ ID NO: 57642 - DNA, 12 bp, Unknown
  misc_feature (1)..( 12): Matrix.003 file - promoters60/4283338
taaccgattaaa

SEQ ID NO: 57643 - DNA, 11 bp, Unknown
  misc_feature (1)..( 11): Matrix.003 file - promoters60/4283338
gaaaaaataaa

SEQ ID NO: 57644 - DNA, 14 bp, Unknown
  misc_feature (1)..( 14): Matrix.003 file - promoters60/4283378
taaatttgttaacc

SEQ ID NO: 57645 - DNA, 14 bp, Unknown
  misc_feature (1)..( 14): Matrix.003 file - promoters60/4283378
attagaaaatttca

SEQ ID NO: 57646 - DNA, 8 bp, Unknown
  misc_feature (1)..( 8): Matrix.003 file - promoters60/4283378
ttttgaag

SEQ ID NO: 57647 - DNA, 19 bp, Unknown
  misc_feature (1)..( 19): Matrix.003 file - promoters60/4283378
tgaaataaattttaaaaat

SEQ ID NO: 57648 - DNA, 11 bp, Unknown
  misc_feature (1)..( 11): Matrix.003 file - promoters60/4283378
tatatataaac

SEQ ID NO: 57649 - DNA, 12 bp, Unknown
  misc_feature (1)..( 12): Matrix.003 file - promoters60/4283378
tataaaaaacaa

SEQ ID NO: 57650 - DNA, 10 bp, Unknown
  misc_feature (1)..( 10): Matrix.003 file - promoters60/4283378
aattagttta

SEQ ID NO: 57651 - DNA, 6 bp, Unknown
  misc_feature (1)..( 6): Matrix.003 file - promoters60/4283390
tctcga

SEQ ID NO: 57652 - DNA, 9 bp, Unknown
  misc_feature (1)..( 9): Matrix.003 file - promoters60/4283390
gccatggct

SEQ ID NO: 57653 - DNA, 6 bp, Unknown
  misc_feature (1)..( 6): Matrix.003 file - promoters60/4283390
aaaagc

SEQ ID NO: 57654 - DNA, 8 bp, Unknown
  misc_feature (1)..( 8): Matrix.003 file - promoters60/4283390
aataaatt

SEQ ID NO: 57655 - DNA, 9 bp, Unknown
  misc_feature (1)..( 9): Matrix.003 file - promoters60/4283390
attatgtat

SEQ ID NO: 57656 - DNA, 6 bp, Unknown
  misc_feature (1)..( 6): Matrix.003 file - promoters60/4283390
aaactt

SEQ ID NO: 57657 - DNA, 11 bp, Unknown
  misc_feature (1)..( 11): Matrix.003 file - promoters60/4283390
aagcgaacaac

SEQ ID NO: 57658 - DNA, 6 bp, Unknown
  misc_feature (1)..( 6): Matrix.003 file - promoters60/4283390
aaatta

SEQ ID NO: 57659 - DNA, 7 bp, Unknown
  misc_feature (1)..( 7): Matrix.003 file - promoters60/4283390
attacaa

SEQ ID NO: 57660 - DNA, 6 bp, Unknown
  misc_feature (1)..( 6): Matrix.003 file - promoters60/4283390
acattc

SEQ ID NO: 57661 - DNA, 8 bp, Unknown
  misc_feature (1)..( 8): Matrix.003 file - promoters60/4283390
aaagagtt

SEQ ID NO: 57662 - DNA, 7 bp, Unknown
  misc_feature (1)..( 7): Matrix.003 file - promoters60/4283397
attttaa

SEQ ID NO: 57663 - DNA, 9 bp, Unknown
  misc_feature (1)..( 9): Matrix.003 file - promoters60/4283397
ttttaaaaa

SEQ ID NO: 57664 - DNA, 6 bp, Unknown
  misc_feature (1)..( 6): Matrix.003 file - promoters60/4283397
aatcaa

SEQ ID NO: 57665 - DNA, 6 bp, Unknown
  misc_feature (1)..( 6): Matrix.003 file - promoters60/4283397
aatttt

SEQ ID NO: 57666 - DNA, 6 bp, Unknown
  misc_feature (1)..( 6): Matrix.003 file - promoters60/4283397
catata

SEQ ID NO: 57667 - DNA, 8 bp, Unknown
  misc_feature (1)..( 8): Matrix.003 file - promoters60/4283397
atttctaa

SEQ ID NO: 57668 - DNA, 7 bp, Unknown
  misc_feature (1)..( 7): Matrix.003 file - promoters60/4283397
tttattt

SEQ ID NO: 57669 - DNA, 11 bp, Unknown
  misc_feature (1)..( 11): Matrix.003 file - promoters60/4283397
aaaaaaaattt

SEQ ID NO: 57670 - DNA, 7 bp, Unknown
  misc_feature (1)..( 7): Matrix.003 file - promoters60/4283397
aataaaa

SEQ ID NO: 57671 - DNA, 6 bp, Unknown
  misc_feature (1)..( 6): Matrix.003 file - promoters60/4283397
aatttt

SEQ ID NO: 57672 - DNA, 9 bp, Unknown
  misc_feature (1)..( 9): Matrix.003 file - promoters60/4283397
tttacaaaa

SEQ ID NO: 57673 - DNA, 6 bp, Unknown
  misc_feature (1)..( 6): Matrix.003 file - promoters60/4283397
ttctaa

SEQ ID NO: 57674 - DNA, 7 bp, Unknown
  misc_feature (1)..( 7): Matrix.003 file - promoters60/4283397
ataaaaa

SEQ ID NO: 57675 - DNA, 8 bp, Unknown
  misc_feature (1)..( 8): Matrix.003 file - promoters60/4283397
aaaagaga

SEQ ID NO: 57676 - DNA, 6 bp, Unknown
  misc_feature (1)..( 6): Matrix.003 file - promoters60/4283397
ttttgt

SEQ ID NO: 57677 - DNA, 6 bp, Unknown
  misc_feature (1)..( 6): Matrix.003 file - promoters60/4283397
tgtttt

SEQ ID NO: 57678 - DNA, 7 bp, Unknown
  misc_feature (1)..( 7): Matrix.003 file - promoters60/4283397
gtaatgt

SEQ ID NO: 57679 - DNA, 6 bp, Unknown
  misc_feature (1)..( 6): Matrix.003 file - promoters60/4283397
ccccca

SEQ ID NO: 57680 - DNA, 6 bp, Unknown
  misc_feature (1)..( 6): Matrix.003 file - promoters60/4283425
tcttct

SEQ ID NO: 57681 - DNA, 9 bp, Unknown
  misc_feature (1)..( 9): Matrix.003 file - promoters60/4283425
ccaaaaaaa

SEQ ID NO: 57682 - DNA, 6 bp, Unknown
  misc_feature (1)..( 6): Matrix.003 file - promoters60/4283425
cataga

SEQ ID NO: 57683 - DNA, 6 bp, Unknown
  misc_feature (1)..( 6): Matrix.003 file - promoters60/4283425
gaaaaa

SEQ ID NO: 57684 - DNA, 9 bp, Unknown
  misc_feature (1)..( 9): Matrix.003 file - promoters60/4283425
ggtctaaag

SEQ ID NO: 57685 - DNA, 8 bp, Unknown
  misc_feature (1)..( 8): Matrix.003 file - promoters60/4283425
tataatat

SEQ ID NO: 57686 - DNA, 10 bp, Unknown
  misc_feature (1)..( 10): Matrix.003 file - promoters60/4283425
agttagattt

SEQ ID NO: 57687 - DNA, 9 bp, Unknown
  misc_feature (1)..( 9): Matrix.003 file - promoters60/4283425
tatacatgt

SEQ ID NO: 57688 - DNA, 11 bp, Unknown
  misc_feature (1)..( 11): Matrix.003 file - promoters60/4283425
aaaccatatta

SEQ ID NO: 57689 - DNA, 6 bp, Unknown
  misc_feature (1)..( 6): Matrix.003 file - promoters60/4283425
gacaaa

SEQ ID NO: 57690 - DNA, 6 bp, Unknown
  misc_feature (1)..( 6): Matrix.003 file - promoters60/4283425
aaaaaa

SEQ ID NO: 57691 - DNA, 6 bp, Unknown
  misc_feature (1)..( 6): Matrix.003 file - promoters60/4283425
agacaa

SEQ ID NO: 57692 - DNA, 6 bp, Unknown
  misc_feature (1)..( 6): Matrix.003 file - promoters60/4283425
agagac

SEQ ID NO: 57693 - DNA, 7 bp, Unknown
  misc_feature (1)..( 7): Matrix.003 file - promoters60/4283425
tcttatt

SEQ ID NO: 57694 - DNA, 6 bp, Unknown
  misc_feature (1)..( 6): Matrix.003 file - promoters60/4283425
catatt

SEQ ID NO: 57695 - DNA, 6 bp, Unknown
  misc_feature (1)..( 6): Matrix.003 file - promoters60/4283425
tatttt

SEQ ID NO: 57696 - DNA, 7 bp, Unknown
  misc_feature (1)..( 7): Matrix.003 file - promoters60/4283425
ttttttt

SEQ ID NO: 57697 - DNA, 9 bp, Unknown
  misc_feature (1)..( 9): Matrix.003 file - promoters60/4283425
caatatttt

SEQ ID NO: 57698 - DNA, 8 bp, Unknown
  misc_feature (1)..( 8): Matrix.003 file - promoters60/4283425
caacaaaa

SEQ ID NO: 57699 - DNA, 6 bp, Unknown
  misc_feature (1)..( 6): Matrix.003 file - promoters60/4283425
aaaaaa

SEQ ID NO: 57700 - DNA, 11 bp, Unknown
  misc_feature (1)..( 11): Matrix.003 file - promoters60/4283425
ttcatatcttt

SEQ ID NO: 57701 - DNA, 7 bp, Unknown
  misc_feature (1)..( 7): Matrix.003 file - promoters60/4283425
cacagtt

SEQ ID NO: 57702 - DNA, 8 bp, Unknown
  misc_feature (1)..( 8): Matrix.003 file - promoters60/4283425
gcgaaaat

SEQ ID NO: 57703 - DNA, 7 bp, Unknown
  misc_feature (1)..( 7): Matrix.003 file - promoters60/4283425
ataaata

SEQ ID NO: 57704 - DNA, 10 bp, Unknown
  misc_feature (1)..( 10): Matrix.003 file - promoters60/4283425
tataaatata

SEQ ID NO: 57705 - DNA, 6 bp, Unknown
  misc_feature (1)..( 6): Matrix.003 file - promoters60/4283510
tagctc

SEQ ID NO: 57706 - DNA, 9 bp, Unknown
  misc_feature (1)..( 9): Matrix.003 file - promoters60/4283510
tttctcttc

SEQ ID NO: 57707 - DNA, 7 bp, Unknown
  misc_feature (1)..( 7): Matrix.003 file - promoters60/4283510
atttttc

SEQ ID NO: 57708 - DNA, 8 bp, Unknown
  misc_feature (1)..( 8): Matrix.003 file - promoters60/4283614
tatattat

SEQ ID NO: 57709 - DNA, 6 bp, Unknown
  misc_feature (1)..( 6): Matrix.003 file - promoters60/4283614
acatgg

SEQ ID NO: 57710 - DNA, 7 bp, Unknown
  misc_feature (1)..( 7): Matrix.003 file - promoters60/4283614
ttgatga

SEQ ID NO: 57711 - DNA, 9 bp, Unknown
  misc_feature (1)..( 9): Matrix.003 file - promoters60/4283614
aaccctaaa

SEQ ID NO: 57712 - DNA, 8 bp, Unknown
  misc_feature (1)..( 8): Matrix.003 file - promoters60/4283614
tacaaacg

SEQ ID NO: 57713 - DNA, 6 bp, Unknown
  misc_feature (1)..( 6): Matrix.003 file - promoters60/4283614
tgaaaa

SEQ ID NO: 57714 - DNA, 7 bp, Unknown
  misc_feature (1)..( 7): Matrix.003 file - promoters60/4283614
aacctga

SEQ ID NO: 57715 - DNA, 8 bp, Unknown
  misc_feature (1)..( 8): Matrix.003 file - promoters60/4283614
atgaaaat

SEQ ID NO: 57716 - DNA, 7 bp, Unknown
  misc_feature (1)..( 7): Matrix.003 file - promoters60/4283614
tctatcc

SEQ ID NO: 57717 - DNA, 7 bp, Unknown
  misc_feature (1)..( 7): Matrix.003 file - promoters60/4283614
caaacta

SEQ ID NO: 57718 - DNA, 6 bp, Unknown
  misc_feature (1)..( 6): Matrix.003 file - promoters60/4283614
aaaaat

SEQ ID NO: 57719 - DNA, 6 bp, Unknown
  misc_feature (1)..( 6): Matrix.003 file - promoters60/4283614
aaatta

SEQ ID NO: 57720 - DNA, 7 bp, Unknown
  misc_feature (1)..( 7): Matrix.003 file - promoters60/4283614
cttcttt

SEQ ID NO: 57721 - DNA, 6 bp, Unknown
  misc_feature (1)..( 6): Matrix.003 file - promoters60/4283614
gaatca

SEQ ID NO: 57722 - DNA, 7 bp, Unknown
  misc_feature (1)..( 7): Matrix.003 file - promoters60/4283614
tccagtt

SEQ ID NO: 57723 - DNA, 6 bp, Unknown
  misc_feature (1)..( 6): Matrix.003 file - promoters60/4283614
tttccg

SEQ ID NO: 57724 - DNA, 6 bp, Unknown
  misc_feature (1)..( 6): Matrix.003 file - promoters60/4283614
ataaat

SEQ ID NO: 57725 - DNA, 9 bp, Unknown
  misc_feature (1)..( 9): Matrix.003 file - promoters60/4283616
tatcgtttg

SEQ ID NO: 57726 - DNA, 10 bp, Unknown
  misc_feature (1)..( 10): Matrix.003 file - promoters60/4283616
tactctccgt

SEQ ID NO: 57727 - DNA, 16 bp, Unknown
  misc_feature (1)..( 16): Matrix.003 file - promoters60/4283616
aaaaattaaaacaagt

SEQ ID NO: 57728 - DNA, 8 bp, Unknown
  misc_feature (1)..( 8): Matrix.003 file - promoters60/4283616
tagggttt

SEQ ID NO: 57729 - DNA, 9 bp, Unknown
  misc_feature (1)..( 9): Matrix.003 file - promoters60/4283616
gactaaaga

SEQ ID NO: 57730 - DNA, 8 bp, Unknown
  misc_feature (1)..( 8): Matrix.003 file - promoters60/4283624
tttgcatt

SEQ ID NO: 57731 - DNA, 11 bp, Unknown
  misc_feature (1)..( 11): Matrix.003 file - promoters60/4283624
tatttttaaaa

SEQ ID NO: 57732 - DNA, 11 bp, Unknown
  misc_feature (1)..( 11): Matrix.003 file - promoters60/4283624
aaactttaata

SEQ ID NO: 57733 - DNA, 7 bp, Unknown
  misc_feature (1)..( 7): Matrix.003 file - promoters60/4283624
tcactta

SEQ ID NO: 57734 - DNA, 14 bp, Unknown
  misc_feature (1)..( 14): Matrix.003 file - promoters60/4304982
ataaagtaatttaa

SEQ ID NO: 57735 - DNA, 11 bp, Unknown
  misc_feature (1)..( 11): Matrix.003 file - promoters60/4378608
tttttaaattt

SEQ ID NO: 57736 - DNA, 11 bp, Unknown
  misc_feature (1)..( 11): Matrix.003 file - promoters60/4378608
gataagtaaag

SEQ ID NO: 57737 - DNA, 9 bp, Unknown
  misc_feature (1)..( 9): Matrix.003 file - promoters60/4378608
ctctccaat

SEQ ID NO: 57738 - DNA, 9 bp, Unknown
  misc_feature (1)..( 9): Matrix.003 file - promoters60/4378608
aatttacaa

SEQ ID NO: 57739 - DNA, 11 bp, Unknown
  misc_feature (1)..( 11): Matrix.003 file - promoters60/4577400
acataattaag

SEQ ID NO: 57740 - DNA, 8 bp, Unknown
  misc_feature (1)..( 8): Matrix.003 file - promoters60/4577400
gtaaaaat

SEQ ID NO: 57741 - DNA, 11 bp, Unknown
  misc_feature (1)..( 11): Matrix.003 file - promoters60/4607678
tttatattata

SEQ ID NO: 57742 - DNA, 10 bp, Unknown
  misc_feature (1)..( 10): Matrix.003 file - promoters60/4607678
ttctatttca

SEQ ID NO: 57743 - DNA, 8 bp, Unknown
  misc_feature (1)..( 8): Matrix.003 file - promoters60/4607678
ttcaattg

SEQ ID NO: 57744 - DNA, 13 bp, Unknown
  misc_feature (1)..( 13): Matrix.003 file - promoters60/4607678
tcattttcaaaag

SEQ ID NO: 57745 - DNA, 14 bp, Unknown
  misc_feature (1)..( 14): Matrix.003 file - promoters60/4607678
aatattttcaaaag

SEQ ID NO: 57746 - DNA, 12 bp, Unknown
  misc_feature (1)..( 12): Matrix.003 file - promoters60/4607678
caataatgatat

SEQ ID NO: 57747 - DNA, 10 bp, Unknown
  misc_feature (1)..( 10): Matrix.003 file - promoters60/4607678
attttaaaaa

SEQ ID NO: 57748 - DNA, 14 bp, Unknown
  misc_feature (1)..( 14): Matrix.003 file - promoters60/4607678
tttggttacaagta

SEQ ID NO: 57749 - DNA, 9 bp, Unknown
  misc_feature (1)..( 9): Matrix.003 file - promoters60/4607678
tttacaaga

SEQ ID NO: 57750 - DNA, 8 bp, Unknown
  misc_feature (1)..( 8): Matrix.003 file - promoters60/4607692
taaaattt

SEQ ID NO: 57751 - DNA, 9 bp, Unknown
  misc_feature (1)..( 9): Matrix.003 file - promoters60/4607692
ttaaatatc

SEQ ID NO: 57752 - DNA, 10 bp, Unknown
  misc_feature (1)..( 10): Matrix.003 file - promoters60/4607692
tttacttcta

SEQ ID NO: 57753 - DNA, 11 bp, Unknown
  misc_feature (1)..( 11): Matrix.003 file - promoters60/4607692
taaaaaaacta

SEQ ID NO: 57754 - DNA, 9 bp, Unknown
  misc_feature (1)..( 9): Matrix.003 file - promoters60/4607692
aataaaatt

SEQ ID NO: 57755 - DNA, 9 bp, Unknown
  misc_feature (1)..( 9): Matrix.003 file - promoters60/4607692
aaataaaaa

SEQ ID NO: 57756 - DNA, 11 bp, Unknown
  misc_feature (1)..( 11): Matrix.003 file - promoters60/4607692
acaaatttatt

SEQ ID NO: 57757 - DNA, 9 bp, Unknown
  misc_feature (1)..( 9): Matrix.003 file - promoters60/4607692
aaaaaagaa

SEQ ID NO: 57758 - DNA, 9 bp, Unknown
  misc_feature (1)..( 9): Matrix.003 file - promoters60/4608096
catataaaa

SEQ ID NO: 57759 - DNA, 10 bp, Unknown
  misc_feature (1)..( 10): Matrix.003 file - promoters60/4608104
tataagaaaa

SEQ ID NO: 57760 - DNA, 12 bp, Unknown
  misc_feature (1)..( 12): Matrix.003 file - promoters60/4608104
aaactaatagac

SEQ ID NO: 57761 - DNA, 9 bp, Unknown
  misc_feature (1)..( 9): Matrix.003 file - promoters60/4608104
taagaaaaa

SEQ ID NO: 57762 - DNA, 9 bp, Unknown
  misc_feature (1)..( 9): Matrix.003 file - promoters60/4608104
aaaaattac

SEQ ID NO: 57763 - DNA, 10 bp, Unknown
  misc_feature (1)..( 10): Matrix.003 file - promoters60/4608104
caagaaaaaa

SEQ ID NO: 57764 - DNA, 11 bp, Unknown
  misc_feature (1)..( 11): Matrix.003 file - promoters60/4608104
aaaagaaaaaa

SEQ ID NO: 57765 - DNA, 8 bp, Unknown
  misc_feature (1)..( 8): Matrix.003 file - promoters60/4608140
catttttg

SEQ ID NO: 57766 - DNA, 7 bp, Unknown
  misc_feature (1)..( 7): Matrix.003 file - promoters60/4608140
ttgctaa

SEQ ID NO: 57767 - DNA, 10 bp, Unknown
  misc_feature (1)..( 10): Matrix.003 file - promoters60/4608140
tgtaaaaatt

SEQ ID NO: 57768 - DNA, 7 bp, Unknown
  misc_feature (1)..( 7): Matrix.003 file - promoters60/4608140
aaaatta

SEQ ID NO: 57769 - DNA, 8 bp, Unknown
  misc_feature (1)..( 8): Matrix.003 file - promoters60/4608140
aaaacaat

SEQ ID NO: 57770 - DNA, 10 bp, Unknown
  misc_feature (1)..( 10): Matrix.003 file - promoters60/4608140
agagacaaat

SEQ ID NO: 57771 - DNA, 9 bp, Unknown
  misc_feature (1)..( 9): Matrix.003 file - promoters60/4608140
tctttggat

SEQ ID NO: 57772 - DNA, 8 bp, Unknown
  misc_feature (1)..( 8): Matrix.003 file - promoters60/4608140
catatttg

SEQ ID NO: 57773 - DNA, 8 bp, Unknown
  misc_feature (1)..( 8): Matrix.003 file - promoters60/4608140
attttttt

SEQ ID NO: 57774 - DNA, 9 bp, Unknown
  misc_feature (1)..( 9): Matrix.003 file - promoters60/4608961
gcatatttt

SEQ ID NO: 57775 - DNA, 10 bp, Unknown
  misc_feature (1)..( 10): Matrix.003 file - promoters60/4608961
catgtttaaa

SEQ ID NO: 57776 - DNA, 9 bp, Unknown
  misc_feature (1)..( 9): Matrix.003 file - promoters60/4608961
tgagtatat

SEQ ID NO: 57777 - DNA, 10 bp, Unknown
  misc_feature (1)..( 10): Matrix.003 file - promoters60/4608961
atatgcataa

SEQ ID NO: 57778 - DNA, 10 bp, Unknown
  misc_feature (1)..( 10): Matrix.003 file - promoters60/4608961
tgttttttat

SEQ ID NO: 57779 - DNA, 11 bp, Unknown
  misc_feature (1)..( 11): Matrix.003 file - promoters60/4608965
taaaaattaac

SEQ ID NO: 57780 - DNA, 7 bp, Unknown
  misc_feature (1)..( 7): Matrix.003 file - promoters60/4608985
aaaaatt

SEQ ID NO: 57781 - DNA, 12 bp, Unknown
  misc_feature (1)..( 12): Matrix.003 file - promoters60/4608985
aaaattaaataa

SEQ ID NO: 57782 - DNA, 9 bp, Unknown
  misc_feature (1)..( 9): Matrix.003 file - promoters60/4608985
aaaaaaaat

SEQ ID NO: 57783 - DNA, 11 bp, Unknown
  misc_feature (1)..( 11): Matrix.003 file - promoters60/4608985
ttcaaaaataa

SEQ ID NO: 57784 - DNA, 11 bp, Unknown
  misc_feature (1)..( 11): Matrix.003 file - promoters60/4608985
ataagtttaat

SEQ ID NO: 57785 - DNA, 10 bp, Unknown
  misc_feature (1)..( 10): Matrix.003 file - promoters60/4608985
aaaaaataaa

SEQ ID NO: 57786 - DNA, 8 bp, Unknown
  misc_feature (1)..( 8): Matrix.003 file - promoters60/4608985
ttttattt

SEQ ID NO: 57787 - DNA, 11 bp, Unknown
  misc_feature (1)..( 11): Matrix.003 file - promoters60/4608985
atttccaaata

SEQ ID NO: 57788 - DNA, 9 bp, Unknown
  misc_feature (1)..( 9): Matrix.003 file - promoters60/4608985
ttaaaaaat

SEQ ID NO: 57789 - DNA, 9 bp, Unknown
  misc_feature (1)..( 9): Matrix.003 file - promoters60/4608985
tgaaaaaat

SEQ ID NO: 57790 - DNA, 9 bp, Unknown
  misc_feature (1)..( 9): Matrix.003 file - promoters60/4610292
caattaaat

SEQ ID NO: 57791 - DNA, 13 bp, Unknown
  misc_feature (1)..( 13): Matrix.003 file - promoters60/4610551
aatgggcctaata

SEQ ID NO: 57792 - DNA, 6 bp, Unknown
  misc_feature (1)..( 6): Matrix.003 file - promoters60/4610628
aaaaca

SEQ ID NO: 57793 - DNA, 7 bp, Unknown
  misc_feature (1)..( 7): Matrix.003 file - promoters60/4610628
atcatga

SEQ ID NO: 57794 - DNA, 6 bp, Unknown
  misc_feature (1)..( 6): Matrix.003 file - promoters60/4610628
gtttta

SEQ ID NO: 57795 - DNA, 7 bp, Unknown
  misc_feature (1)..( 7): Matrix.003 file - promoters60/4610628
tttatgt

SEQ ID NO: 57796 - DNA, 7 bp, Unknown
  misc_feature (1)..( 7): Matrix.003 file - promoters60/4610628
ttaaaac

SEQ ID NO: 57797 - DNA, 8 bp, Unknown
  misc_feature (1)..( 8): Matrix.003 file - promoters60/4610628
tctgtttg

SEQ ID NO: 57798 - DNA, 8 bp, Unknown
  misc_feature (1)..( 8): Matrix.003 file - promoters60/4610628
aaaaacat

SEQ ID NO: 57799 - DNA, 7 bp, Unknown
  misc_feature (1)..( 7): Matrix.003 file - promoters60/4610628
aaccaat

SEQ ID NO: 57800 - DNA, 6 bp, Unknown
  misc_feature (1)..( 6): Matrix.003 file - promoters60/4610628
cctata

SEQ ID NO: 57801 - DNA, 15 bp, Unknown
  misc_feature (1)..( 15): Matrix.003 file - promoters60/4610628
aaggcaggctgtcac

SEQ ID NO: 57802 - DNA, 27 bp, Unknown
  misc_feature (1)..( 27): Matrix.003 file - promoters60/4610628
tggcggaccccaacaaattatcaaatc

SEQ ID NO: 57803 - DNA, 8 bp, Unknown
  misc_feature (1)..( 8): Matrix.003 file - promoters60/4610628
aataaatt

SEQ ID NO: 57804 - DNA, 8 bp, Unknown
  misc_feature (1)..( 8): Matrix.003 file - promoters60/4610628
ccatccat

SEQ ID NO: 57805 - DNA, 8 bp, Unknown
  misc_feature (1)..( 8): Matrix.003 file - promoters60/4610628
tatagtat

SEQ ID NO: 57806 - DNA, 7 bp, Unknown
  misc_feature (1)..( 7): Matrix.003 file - promoters60/4610628
aaacgtg

SEQ ID NO: 57807 - DNA, 6 bp, Unknown
  misc_feature (1)..( 6): Matrix.003 file - promoters60/4610628
caaaaa

SEQ ID NO: 57808 - DNA, 8 bp, Unknown
  misc_feature (1)..( 8): Matrix.003 file - promoters60/4610628
caataagt

SEQ ID NO: 57809 - DNA, 7 bp, Unknown
  misc_feature (1)..( 7): Matrix.003 file - promoters60/4610628
tccaatt

SEQ ID NO: 57810 - DNA, 6 bp, Unknown
  misc_feature (1)..( 6): Matrix.003 file - promoters60/4610628
ttttta

SEQ ID NO: 57811 - DNA, 8 bp, Unknown
  misc_feature (1)..( 8): Matrix.003 file - promoters60/4610628
gtaagtta

SEQ ID NO: 57812 - DNA, 7 bp, Unknown
  misc_feature (1)..( 7): Matrix.003 file - promoters60/4610628
aatcaaa

SEQ ID NO: 57813 - DNA, 8 bp, Unknown
  misc_feature (1)..( 8): Matrix.003 file - promoters60/4611225
tgtctgta

SEQ ID NO: 57814 - DNA, 7 bp, Unknown
  misc_feature (1)..( 7): Matrix.003 file - promoters60/4611225
attattt

SEQ ID NO: 57815 - DNA, 6 bp, Unknown
  misc_feature (1)..( 6): Matrix.003 file - promoters60/4611225
tcgttt

SEQ ID NO: 57816 - DNA, 8 bp, Unknown
  misc_feature (1)..( 8): Matrix.003 file - promoters60/4611225
gttgactt

SEQ ID NO: 57817 - DNA, 6 bp, Unknown
  misc_feature (1)..( 6): Matrix.003 file - promoters60/4611225
tttcaa

SEQ ID NO: 57818 - DNA, 6 bp, Unknown
  misc_feature (1)..( 6): Matrix.003 file - promoters60/4611225
tctttc

SEQ ID NO: 57819 - DNA, 9 bp, Unknown
  misc_feature (1)..( 9): Matrix.003 file - promoters60/4611225
caaaaaaac

SEQ ID NO: 57820 - DNA, 6 bp, Unknown
  misc_feature (1)..( 6): Matrix.003 file - promoters60/4611225
aacaaa

SEQ ID NO: 57821 - DNA, 12 bp, Unknown
  misc_feature (1)..( 12): Matrix.003 file - promoters60/4611225
tcatcaatcttt

SEQ ID NO: 57822 - DNA, 7 bp, Unknown
  misc_feature (1)..( 7): Matrix.003 file - promoters60/4611225
aacaaaa

SEQ ID NO: 57823 - DNA, 7 bp, Unknown
  misc_feature (1)..( 7): Matrix.003 file - promoters60/4611225
tatgcat

SEQ ID NO: 57824 - DNA, 7 bp, Unknown
  misc_feature (1)..( 7): Matrix.003 file - promoters60/4611225
acagatc

SEQ ID NO: 57825 - DNA, 6 bp, Unknown
  misc_feature (1)..( 6): Matrix.003 file - promoters60/4611225
tattta

SEQ ID NO: 57826 - DNA, 7 bp, Unknown
  misc_feature (1)..( 7): Matrix.003 file - promoters60/4611225
cttattc

SEQ ID NO: 57827 - DNA, 6 bp, Unknown
  misc_feature (1)..( 6): Matrix.003 file - promoters60/4611225
aatatc

SEQ ID NO: 57828 - DNA, 7 bp, Unknown
  misc_feature (1)..( 7): Matrix.003 file - promoters60/4611225
cagaaaa

SEQ ID NO: 57829 - DNA, 6 bp, Unknown
  misc_feature (1)..( 6): Matrix.003 file - promoters60/4611225
aataaa

SEQ ID NO: 57830 - DNA, 6 bp, Unknown
  misc_feature (1)..( 6): Matrix.003 file - promoters60/4701809
tcaatc

SEQ ID NO: 57831 - DNA, 9 bp, Unknown
  misc_feature (1)..( 9): Matrix.003 file - promoters60/4701809
aaaatcaat

SEQ ID NO: 57832 - DNA, 11 bp, Unknown
  misc_feature (1)..( 11): Matrix.003 file - promoters60/4766314
aaacgaagtaa

SEQ ID NO: 57833 - DNA, 8 bp, Unknown
  misc_feature (1)..( 8): Matrix.003 file - promoters60/4766314
aaaacgac

SEQ ID NO: 57834 - DNA, 10 bp, Unknown
  misc_feature (1)..( 10): Matrix.003 file - promoters60/4766314
aatgagattt

SEQ ID NO: 57835 - DNA, 8 bp, Unknown
  misc_feature (1)..( 8): Matrix.003 file - promoters60/4766314
tatgttat

SEQ ID NO: 57836 - DNA, 8 bp, Unknown
  misc_feature (1)..( 8): Matrix.003 file - promoters60/4766314
aaaaatat

SEQ ID NO: 57837 - DNA, 14 bp, Unknown
  misc_feature (1)..( 14): Matrix.003 file - promoters60/4766320
ctaatttccaatca

SEQ ID NO: 57838 - DNA, 10 bp, Unknown
  misc_feature (1)..( 10): Matrix.003 file - promoters60/4766320
cattttgata

SEQ ID NO: 57839 - DNA, 10 bp, Unknown
  misc_feature (1)..( 10): Matrix.003 file - promoters60/4766320
aaatcttatc

SEQ ID NO: 57840 - DNA, 7 bp, Unknown
  misc_feature (1)..( 7): Matrix.003 file - promoters60/4766320
ttaaaaa

SEQ ID NO: 57841 - DNA, 7 bp, Unknown
  misc_feature (1)..( 7): Matrix.003 file - promoters60/4766324
actcgag

SEQ ID NO: 57842 - DNA, 8 bp, Unknown
  misc_feature (1)..( 8): Matrix.003 file - promoters60/4766324
caatcaaa

SEQ ID NO: 57843 - DNA, 8 bp, Unknown
  misc_feature (1)..( 8): Matrix.003 file - promoters60/4766324
actatata

SEQ ID NO: 57844 - DNA, 8 bp, Unknown
  misc_feature (1)..( 8): Matrix.003 file - promoters60/4766324
catttttt

SEQ ID NO: 57845 - DNA, 8 bp, Unknown
  misc_feature (1)..( 8): Matrix.003 file - promoters60/4766324
attttaaa

SEQ ID NO: 57846 - DNA, 7 bp, Unknown
  misc_feature (1)..( 7): Matrix.003 file - promoters60/4766324
tttaata

SEQ ID NO: 57847 - DNA, 7 bp, Unknown
  misc_feature (1)..( 7): Matrix.003 file - promoters60/4766335
taactaa

SEQ ID NO: 57848 - DNA, 6 bp, Unknown
  misc_feature (1)..( 6): Matrix.003 file - promoters60/4766335
aatgta

SEQ ID NO: 57849 - DNA, 9 bp, Unknown
  misc_feature (1)..( 9): Matrix.003 file - promoters60/4766335
accttaaac

SEQ ID NO: 57850 - DNA, 7 bp, Unknown
  misc_feature (1)..( 7): Matrix.003 file - promoters60/4766335
atcaagt

SEQ ID NO: 57851 - DNA, 12 bp, Unknown
  misc_feature (1)..( 12): Matrix.003 file - promoters60/4766335
tagttaaatgaa

SEQ ID NO: 57852 - DNA, 9 bp, Unknown
  misc_feature (1)..( 9): Matrix.003 file - promoters60/4766335
ttaaatgaa

SEQ ID NO: 57853 - DNA, 7 bp, Unknown
  misc_feature (1)..( 7): Matrix.003 file - promoters60/4766335
aataatt

SEQ ID NO: 57854 - DNA, 9 bp, Unknown
  misc_feature (1)..( 9): Matrix.003 file - promoters60/4766335
ttggagcct

SEQ ID NO: 57855 - DNA, 7 bp, Unknown
  misc_feature (1)..( 7): Matrix.003 file - promoters60/4766335
aaaacat

SEQ ID NO: 57856 - DNA, 9 bp, Unknown
  misc_feature (1)..( 9): Matrix.003 file - promoters60/4766335
tctataaat

SEQ ID NO: 57857 - DNA, 7 bp, Unknown
  misc_feature (1)..( 7): Matrix.003 file - promoters60/4766335
tttccct

SEQ ID NO: 57858 - DNA, 9 bp, Unknown
  misc_feature (1)..( 9): Matrix.003 file - promoters60/4766335
ttatgtgga

SEQ ID NO: 57859 - DNA, 11 bp, Unknown
  misc_feature (1)..( 11): Matrix.003 file - promoters60/4766335
cgaaactggtc

SEQ ID NO: 57860 - DNA, 8 bp, Unknown
  misc_feature (1)..( 8): Matrix.003 file - promoters60/4766335
gaactcat

SEQ ID NO: 57861 - DNA, 7 bp, Unknown
  misc_feature (1)..( 7): Matrix.003 file - promoters60/4766335
agaagaa

SEQ ID NO: 57862 - DNA, 6 bp, Unknown
  misc_feature (1)..( 6): Matrix.003 file - promoters60/4766335
gtgtaa

SEQ ID NO: 57863 - DNA, 9 bp, Unknown
  misc_feature (1)..( 9): Matrix.003 file - promoters60/4766335
aaacaaaaa

SEQ ID NO: 57864 - DNA, 8 bp, Unknown
  misc_feature (1)..( 8): Matrix.003 file - promoters60/4766335
aaaatttg

SEQ ID NO: 57865 - DNA, 6 bp, Unknown
  misc_feature (1)..( 6): Matrix.003 file - promoters60/4766335
taagat

SEQ ID NO: 57866 - DNA, 7 bp, Unknown
  misc_feature (1)..( 7): Matrix.003 file - promoters60/4766335
ctaatct

SEQ ID NO: 57867 - DNA, 6 bp, Unknown
  misc_feature (1)..( 6): Matrix.003 file - promoters60/4766335
agaaat

SEQ ID NO: 57868 - DNA, 6 bp, Unknown
  misc_feature (1)..( 6): Matrix.003 file - promoters60/4766335
ttcgtg

SEQ ID NO: 57869 - DNA, 6 bp, Unknown
  misc_feature (1)..( 6): Matrix.003 file - promoters60/4766335
catcac

SEQ ID NO: 57870 - DNA, 6 bp, Unknown
  misc_feature (1)..( 6): Matrix.003 file - promoters60/4766357
ggtact

SEQ ID NO: 57871 - DNA, 7 bp, Unknown
  misc_feature (1)..( 7): Matrix.003 file - promoters60/4766357
atacaaa

SEQ ID NO: 57872 - DNA, 8 bp, Unknown
  misc_feature (1)..( 8): Matrix.003 file - promoters60/4766357
ccatatac

SEQ ID NO: 57873 - DNA, 7 bp, Unknown
  misc_feature (1)..( 7): Matrix.003 file - promoters60/4766357
tataatc

SEQ ID NO: 57874 - DNA, 7 bp, Unknown
  misc_feature (1)..( 7): Matrix.003 file - promoters60/4766357
tttcaaa

SEQ ID NO: 57875 - DNA, 6 bp, Unknown
  misc_feature (1)..( 6): Matrix.003 file - promoters60/4766357
cagaag

SEQ ID NO: 57876 - DNA, 7 bp, Unknown
  misc_feature (1)..( 7): Matrix.003 file - promoters60/4766357
aagaaat

SEQ ID NO: 57877 - DNA, 7 bp, Unknown
  misc_feature (1)..( 7): Matrix.003 file - promoters60/4766357
ccaaaaa

SEQ ID NO: 57878 - DNA, 7 bp, Unknown
  misc_feature (1)..( 7): Matrix.003 file - promoters60/4766365
tcctttt

SEQ ID NO: 57879 - DNA, 8 bp, Unknown
  misc_feature (1)..( 8): Matrix.003 file - promoters60/4766365
aaataaaa

SEQ ID NO: 57880 - DNA, 8 bp, Unknown
  misc_feature (1)..( 8): Matrix.003 file - promoters60/4766365
gaatctat

SEQ ID NO: 57881 - DNA, 9 bp, Unknown
  misc_feature (1)..( 9): Matrix.003 file - promoters60/4766365
tgtcttgat

SEQ ID NO: 57882 - DNA, 7 bp, Unknown
  misc_feature (1)..( 7): Matrix.003 file - promoters60/4766376
gacaaaa

SEQ ID NO: 57883 - DNA, 9 bp, Unknown
  misc_feature (1)..( 9): Matrix.003 file - promoters60/4766395
atttatttt

SEQ ID NO: 57884 - DNA, 7 bp, Unknown
  misc_feature (1)..( 7): Matrix.003 file - promoters60/4766395
gttgttt

SEQ ID NO: 57885 - DNA, 8 bp, Unknown
  misc_feature (1)..( 8): Matrix.003 file - promoters60/4766395
aaaatata

SEQ ID NO: 57886 - DNA, 6 bp, Unknown
  misc_feature (1)..( 6): Matrix.003 file - promoters60/4766395
aaagaa

SEQ ID NO: 57887 - DNA, 6 bp, Unknown
  misc_feature (1)..( 6): Matrix.003 file - promoters60/4766395
ttatca

SEQ ID NO: 57888 - DNA, 6 bp, Unknown
  misc_feature (1)..( 6): Matrix.003 file - promoters60/4766395
ataaac

SEQ ID NO: 57889 - DNA, 6 bp, Unknown
  misc_feature (1)..( 6): Matrix.003 file - promoters60/4766395
cacatg

SEQ ID NO: 57890 - DNA, 6 bp, Unknown
  misc_feature (1)..( 6): Matrix.003 file - promoters60/4766395
tctcca

SEQ ID NO: 57891 - DNA, 8 bp, Unknown
  misc_feature (1)..( 8): Matrix.003 file - promoters60/4766395
tataaata

SEQ ID NO: 57892 - DNA, 7 bp, Unknown
  misc_feature (1)..( 7): Matrix.003 file - promoters60/4766395
ttaaatt

SEQ ID NO: 57893 - DNA, 8 bp, Unknown
  misc_feature (1)..( 8): Matrix.003 file - promoters60/4766395
aaaataat

SEQ ID NO: 57894 - DNA, 6 bp, Unknown
  misc_feature (1)..( 6): Matrix.003 file - promoters60/4766395
atattt

SEQ ID NO: 57895 - DNA, 6 bp, Unknown
  misc_feature (1)..( 6): Matrix.003 file - promoters60/4766395
atatat

SEQ ID NO: 57896 - DNA, 6 bp, Unknown
  misc_feature (1)..( 6): Matrix.003 file - promoters60/4766395
aaatct

SEQ ID NO: 57897 - DNA, 7 bp, Unknown
  misc_feature (1)..( 7): Matrix.003 file - promoters60/4766395
aaaaatt

SEQ ID NO: 57898 - DNA, 6 bp, Unknown
  misc_feature (1)..( 6): Matrix.003 file - promoters60/4766395
aaaaaa

SEQ ID NO: 57899 - DNA, 7 bp, Unknown
  misc_feature (1)..( 7): Matrix.003 file - promoters60/4766395
aaagtta

SEQ ID NO: 57900 - DNA, 8 bp, Unknown
  misc_feature (1)..( 8): Matrix.003 file - promoters60/4766395
aaatgtaa

SEQ ID NO: 57901 - DNA, 6 bp, Unknown
  misc_feature (1)..( 6): Matrix.003 file - promoters60/4766421
ttaact

SEQ ID NO: 57902 - DNA, 8 bp, Unknown
  misc_feature (1)..( 8): Matrix.003 file - promoters60/4766421
ttaaaatt

SEQ ID NO: 57903 - DNA, 7 bp, Unknown
  misc_feature (1)..( 7): Matrix.003 file - promoters60/4766421
atgtttt

SEQ ID NO: 57904 - DNA, 8 bp, Unknown
  misc_feature (1)..( 8): Matrix.003 file - promoters60/4766421
aatcagat

SEQ ID NO: 57905 - DNA, 7 bp, Unknown
  misc_feature (1)..( 7): Matrix.003 file - promoters60/4766421
tggagcc

SEQ ID NO: 57906 - DNA, 6 bp, Unknown
  misc_feature (1)..( 6): Matrix.003 file - promoters60/4766421
tatctg

SEQ ID NO: 57907 - DNA, 6 bp, Unknown
  misc_feature (1)..( 6): Matrix.003 file - promoters60/4766421
tagata

SEQ ID NO: 57908 - DNA, 8 bp, Unknown
  misc_feature (1)..( 8): Matrix.003 file - promoters60/4766421
aattgatt

SEQ ID NO: 57909 - DNA, 7 bp, Unknown
  misc_feature (1)..( 7): Matrix.003 file - promoters60/4766421
caaaatt

SEQ ID NO: 57910 - DNA, 10 bp, Unknown
  misc_feature (1)..( 10): Matrix.003 file - promoters60/4766421
attatccatt

SEQ ID NO: 57911 - DNA, 6 bp, Unknown
  misc_feature (1)..( 6): Matrix.003 file - promoters60/4766421
acagtg

SEQ ID NO: 57912 - DNA, 6 bp, Unknown
  misc_feature (1)..( 6): Matrix.003 file - promoters60/4766421
gaactt

SEQ ID NO: 57913 - DNA, 9 bp, Unknown
  misc_feature (1)..( 9): Matrix.003 file - promoters60/4766421
gataatttg

SEQ ID NO: 57914 - DNA, 8 bp, Unknown
  misc_feature (1)..( 8): Matrix.003 file - promoters60/4766421
ttcacaga

SEQ ID NO: 57915 - DNA, 6 bp, Unknown
  misc_feature (1)..( 6): Matrix.003 file - promoters60/4766421
tcttgt

SEQ ID NO: 57916 - DNA, 6 bp, Unknown
  misc_feature (1)..( 6): Matrix.003 file - promoters60/4766421
gtgtgc

SEQ ID NO: 57917 - DNA, 6 bp, Unknown
  misc_feature (1)..( 6): Matrix.003 file - promoters60/4766429
ttcaca

SEQ ID NO: 57918 - DNA, 6 bp, Unknown
  misc_feature (1)..( 6): Matrix.003 file - promoters60/4766429
agcttt

SEQ ID NO: 57919 - DNA, 6 bp, Unknown
  misc_feature (1)..( 6): Matrix.003 file - promoters60/4766429
ttttca

SEQ ID NO: 57920 - DNA, 6 bp, Unknown
  misc_feature (1)..( 6): Matrix.003 file - promoters60/4766429
ttccaa

SEQ ID NO: 57921 - DNA, 6 bp, Unknown
  misc_feature (1)..( 6): Matrix.003 file - promoters60/4766429
aatcat

SEQ ID NO: 57922 - DNA, 6 bp, Unknown
  misc_feature (1)..( 6): Matrix.003 file - promoters60/4766429
catttt

SEQ ID NO: 57923 - DNA, 8 bp, Unknown
  misc_feature (1)..( 8): Matrix.003 file - promoters60/4766429
tttattaa

SEQ ID NO: 57924 - DNA, 7 bp, Unknown
  misc_feature (1)..( 7): Matrix.003 file - promoters60/4766429
aagaaac

SEQ ID NO: 57925 - DNA, 7 bp, Unknown
  misc_feature (1)..( 7): Matrix.003 file - promoters60/4766429
ctctata

SEQ ID NO: 57926 - DNA, 9 bp, Unknown
  misc_feature (1)..( 9): Matrix.003 file - promoters60/4766429
aagaaaaaa

SEQ ID NO: 57927 - DNA, 7 bp, Unknown
  misc_feature (1)..( 7): Matrix.003 file - promoters60/4766429
caaactt

SEQ ID NO: 57928 - DNA, 7 bp, Unknown
  misc_feature (1)..( 7): Matrix.003 file - promoters60/4766447
aatcatt

SEQ ID NO: 57929 - DNA, 9 bp, Unknown
  misc_feature (1)..( 9): Matrix.003 file - promoters60/4766447
atcttattc

SEQ ID NO: 57930 - DNA, 11 bp, Unknown
  misc_feature (1)..( 11): Matrix.003 file - promoters60/4766447
tttatggtttc

SEQ ID NO: 57931 - DNA, 8 bp, Unknown
  misc_feature (1)..( 8): Matrix.003 file - promoters60/4766447
ttgtataa

SEQ ID NO: 57932 - DNA, 8 bp, Unknown
  misc_feature (1)..( 8): Matrix.003 file - promoters60/4766447
tcaaacaa

SEQ ID NO: 57933 - DNA, 7 bp, Unknown
  misc_feature (1)..( 7): Matrix.003 file - promoters60/4766447
tttattt

SEQ ID NO: 57934 - DNA, 11 bp, Unknown
  misc_feature (1)..( 11): Matrix.003 file - promoters60/4766447
aatccaatttt

SEQ ID NO: 57935 - DNA, 11 bp, Unknown
  misc_feature (1)..( 11): Matrix.003 file - promoters60/4766477
aaaaacaaaat

SEQ ID NO: 57936 - DNA, 10 bp, Unknown
  misc_feature (1)..( 10): Matrix.003 file - promoters60/4766477
actgcttctc

SEQ ID NO: 57937 - DNA, 13 bp, Unknown
  misc_feature (1)..( 13): Matrix.003 file - promoters60/4766477
taacaatttacaa

SEQ ID NO: 57938 - DNA, 15 bp, Unknown
  misc_feature (1)..( 15): Matrix.003 file - promoters60/4766487
tgtcaaatttcaaca

SEQ ID NO: 57939 - DNA, 9 bp, Unknown
  misc_feature (1)..( 9): Matrix.003 file - promoters60/4766487
aaaataaaa

SEQ ID NO: 57940 - DNA, 13 bp, Unknown
  misc_feature (1)..( 13): Matrix.003 file - promoters60/4766487
caagaagaaaaaa

SEQ ID NO: 57941 - DNA, 7 bp, Unknown
  misc_feature (1)..( 7): Matrix.003 file - promoters60/4766490
tttgttg

SEQ ID NO: 57942 - DNA, 6 bp, Unknown
  misc_feature (1)..( 6): Matrix.003 file - promoters60/4766490
caaaaa

SEQ ID NO: 57943 - DNA, 8 bp, Unknown
  misc_feature (1)..( 8): Matrix.003 file - promoters60/4766490
gaaaaaaa

SEQ ID NO: 57944 - DNA, 8 bp, Unknown
  misc_feature (1)..( 8): Matrix.003 file - promoters60/4766490
caactatt

SEQ ID NO: 57945 - DNA, 7 bp, Unknown
  misc_feature (1)..( 7): Matrix.003 file - promoters60/4766490
tttcatg

SEQ ID NO: 57946 - DNA, 6 bp, Unknown
  misc_feature (1)..( 6): Matrix.003 file - promoters60/4766490
taaaaa

SEQ ID NO: 57947 - DNA, 8 bp, Unknown
  misc_feature (1)..( 8): Matrix.003 file - promoters60/4766490
tcgacatg

SEQ ID NO: 57948 - DNA, 7 bp, Unknown
  misc_feature (1)..( 7): Matrix.003 file - promoters60/4766490
acgtggt

SEQ ID NO: 57949 - DNA, 6 bp, Unknown
  misc_feature (1)..( 6): Matrix.003 file - promoters60/4766490
ggtgga

SEQ ID NO: 57950 - DNA, 6 bp, Unknown
  misc_feature (1)..( 6): Matrix.003 file - promoters60/4766490
aaagaa

SEQ ID NO: 57951 - DNA, 6 bp, Unknown
  misc_feature (1)..( 6): Matrix.003 file - promoters60/4766490
acaaca

SEQ ID NO: 57952 - DNA, 12 bp, Unknown
  misc_feature (1)..( 12): Matrix.003 file - promoters60/4766490
aaaaaagaagaa

SEQ ID NO: 57953 - DNA, 9 bp, Unknown
  misc_feature (1)..( 9): Matrix.003 file - promoters60/4766490
atgataaga

SEQ ID NO: 57954 - DNA, 6 bp, Unknown
  misc_feature (1)..( 6): Matrix.003 file - promoters60/4766490
aataaa

SEQ ID NO: 57955 - DNA, 6 bp, Unknown
  misc_feature (1)..( 6): Matrix.003 file - promoters60/4766490
aactag

SEQ ID NO: 57956 - DNA, 7 bp, Unknown
  misc_feature (1)..( 7): Matrix.003 file - promoters60/4766490
aatgttg

SEQ ID NO: 57957 - DNA, 8 bp, Unknown
  misc_feature (1)..( 8): Matrix.003 file - promoters60/4766490
tggcaaag

SEQ ID NO: 57958 - DNA, 7 bp, Unknown
  misc_feature (1)..( 7): Matrix.003 file - promoters60/4766490
cgtcttc

SEQ ID NO: 57959 - DNA, 7 bp, Unknown
  misc_feature (1)..( 7): Matrix.003 file - promoters60/4766553
catatat

SEQ ID NO: 57960 - DNA, 6 bp, Unknown
  misc_feature (1)..( 6): Matrix.003 file - promoters60/4766553
tttact

SEQ ID NO: 57961 - DNA, 6 bp, Unknown
  misc_feature (1)..( 6): Matrix.003 file - promoters60/4766553
tgtttt

SEQ ID NO: 57962 - DNA, 8 bp, Unknown
  misc_feature (1)..( 8): Matrix.003 file - promoters60/4766553
tctgataa

SEQ ID NO: 57963 - DNA, 7 bp, Unknown
  misc_feature (1)..( 7): Matrix.003 file - promoters60/4766553
ttaattt

SEQ ID NO: 57964 - DNA, 7 bp, Unknown
  misc_feature (1)..( 7): Matrix.003 file - promoters60/4766553
gcaggat

SEQ ID NO: 57965 - DNA, 8 bp, Unknown
  misc_feature (1)..( 8): Matrix.003 file - promoters60/4766553
gtagagaa

SEQ ID NO: 57966 - DNA, 6 bp, Unknown
  misc_feature (1)..( 6): Matrix.003 file - promoters60/4766553
agaaga

SEQ ID NO: 57967 - DNA, 6 bp, Unknown
  misc_feature (1)..( 6): Matrix.003 file - promoters60/4766553
gtgatt

SEQ ID NO: 57968 - DNA, 13 bp, Unknown
  misc_feature (1)..( 13): Matrix.003 file - promoters60/4766578
tttttgaataatg

SEQ ID NO: 57969 - DNA, 7 bp, Unknown
  misc_feature (1)..( 7): Matrix.003 file - promoters60/4766578
ataatta

SEQ ID NO: 57970 - DNA, 11 bp, Unknown
  misc_feature (1)..( 11): Matrix.003 file - promoters60/4766578
acattttatag

SEQ ID NO: 57971 - DNA, 10 bp, Unknown
  misc_feature (1)..( 10): Matrix.003 file - promoters60/4766578
taaaataaaa

SEQ ID NO: 57972 - DNA, 6 bp, Unknown
  misc_feature (1)..( 6): Matrix.003 file - promoters60/4766578
gaaaaa

SEQ ID NO: 57973 - DNA, 7 bp, Unknown
  misc_feature (1)..( 7): Matrix.003 file - promoters60/4766602
ccctaac

SEQ ID NO: 57974 - DNA, 8 bp, Unknown
  misc_feature (1)..( 8): Matrix.003 file - promoters60/4766602
actatata

SEQ ID NO: 57975 - DNA, 9 bp, Unknown
  misc_feature (1)..( 9): Matrix.003 file - promoters60/4766602
aggaaaaaa

SEQ ID NO: 57976 - DNA, 8 bp, Unknown
  misc_feature (1)..( 8): Matrix.003 file - promoters60/4766602
tgtaaaac

SEQ ID NO: 57977 - DNA, 6 bp, Unknown
  misc_feature (1)..( 6): Matrix.003 file - promoters60/4766602
attgat

SEQ ID NO: 57978 - DNA, 6 bp, Unknown
  misc_feature (1)..( 6): Matrix.003 file - promoters60/4766602
attcat

SEQ ID NO: 57979 - DNA, 6 bp, Unknown
  misc_feature (1)..( 6): Matrix.003 file - promoters60/4766602
atataa

SEQ ID NO: 57980 - DNA, 8 bp, Unknown
  misc_feature (1)..( 8): Matrix.003 file - promoters60/4766602
tggaaata

SEQ ID NO: 57981 - DNA, 7 bp, Unknown
  misc_feature (1)..( 7): Matrix.003 file - promoters60/4766602
taatttg

SEQ ID NO: 57982 - DNA, 6 bp, Unknown
  misc_feature (1)..( 6): Matrix.003 file - promoters60/4766602
aatcaa

SEQ ID NO: 57983 - DNA, 8 bp, Unknown
  misc_feature (1)..( 8): Matrix.003 file - promoters60/4766602
catttttt

SEQ ID NO: 57984 - DNA, 8 bp, Unknown
  misc_feature (1)..( 8): Matrix.003 file - promoters60/4766602
attttaaa

SEQ ID NO: 57985 - DNA, 8 bp, Unknown
  misc_feature (1)..( 8): Matrix.003 file - promoters60/4766602
gtagttaa

SEQ ID NO: 57986 - DNA, 6 bp, Unknown
  misc_feature (1)..( 6): Matrix.003 file - promoters60/4766602
ttttta

SEQ ID NO: 57987 - DNA, 6 bp, Unknown
  misc_feature (1)..( 6): Matrix.003 file - promoters60/4766602
aacgta

SEQ ID NO: 57988 - DNA, 6 bp, Unknown
  misc_feature (1)..( 6): Matrix.003 file - promoters60/4766602
atttag

SEQ ID NO: 57989 - DNA, 7 bp, Unknown
  misc_feature (1)..( 7): Matrix.003 file - promoters60/4766602
atccaaa

SEQ ID NO: 57990 - DNA, 11 bp, Unknown
  misc_feature (1)..( 11): Matrix.003 file - promoters60/4766620
tttgaatcaaa

SEQ ID NO: 57991 - DNA, 6 bp, Unknown
  misc_feature (1)..( 6): Matrix.003 file - promoters60/4766620
attttg

SEQ ID NO: 57992 - DNA, 7 bp, Unknown
  misc_feature (1)..( 7): Matrix.003 file - promoters60/4766620
taaaaat

SEQ ID NO: 57993 - DNA, 8 bp, Unknown
  misc_feature (1)..( 8): Matrix.003 file - promoters60/4766620
atttcggc

SEQ ID NO: 57994 - DNA, 7 bp, Unknown
  misc_feature (1)..( 7): Matrix.003 file - promoters60/4766620
aactgaa

SEQ ID NO: 57995 - DNA, 7 bp, Unknown
  misc_feature (1)..( 7): Matrix.003 file - promoters60/4766620
tttggtg

SEQ ID NO: 57996 - DNA, 7 bp, Unknown
  misc_feature (1)..( 7): Matrix.003 file - promoters60/4766620
gtttatc

SEQ ID NO: 57997 - DNA, 7 bp, Unknown
  misc_feature (1)..( 7): Matrix.003 file - promoters60/4766620
atcgtac

SEQ ID NO: 57998 - DNA, 6 bp, Unknown
  misc_feature (1)..( 6): Matrix.003 file - promoters60/4766620
ataaat

SEQ ID NO: 57999 - DNA, 7 bp, Unknown
  misc_feature (1)..( 7): Matrix.003 file - promoters60/4766620
ggtacaa

SEQ ID NO: 58000 - DNA, 8 bp, Unknown
  misc_feature (1)..( 8): Matrix.003 file - promoters60/4766620
cagtggat

SEQ ID NO: 58001 - DNA, 6 bp, Unknown
  misc_feature (1)..( 6): Matrix.003 file - promoters60/4766620
aaattc

SEQ ID NO: 58002 - DNA, 7 bp, Unknown
  misc_feature (1)..( 7): Matrix.003 file - promoters60/4766620
aaaggac

SEQ ID NO: 58003 - DNA, 6 bp, Unknown
  misc_feature (1)..( 6): Matrix.003 file - promoters60/4766620
taattt

SEQ ID NO: 58004 - DNA, 10 bp, Unknown
  misc_feature (1)..( 10): Matrix.003 file - promoters60/4766624
ggagatagag

SEQ ID NO: 58005 - DNA, 10 bp, Unknown
  misc_feature (1)..( 10): Matrix.003 file - promoters60/4766624
acctgagata

SEQ ID NO: 58006 - DNA, 10 bp, Unknown
  misc_feature (1)..( 10): Matrix.003 file - promoters60/4766624
tcaactctat

SEQ ID NO: 58007 - DNA, 8 bp, Unknown
  misc_feature (1)..( 8): Matrix.003 file - promoters60/4766624
gaacattt

SEQ ID NO: 58008 - DNA, 7 bp, Unknown
  misc_feature (1)..( 7): Matrix.003 file - promoters60/4766628
ctcatca

SEQ ID NO: 58009 - DNA, 7 bp, Unknown
  misc_feature (1)..( 7): Matrix.003 file - promoters60/4766628
tatcgaa

SEQ ID NO: 58010 - DNA, 6 bp, Unknown
  misc_feature (1)..( 6): Matrix.003 file - promoters60/4766628
agttga

SEQ ID NO: 58011 - DNA, 8 bp, Unknown
  misc_feature (1)..( 8): Matrix.003 file - promoters60/4766628
caaaaaaa

SEQ ID NO: 58012 - DNA, 8 bp, Unknown
  misc_feature (1)..( 8): Matrix.003 file - promoters60/4766628
gtttcgtt

SEQ ID NO: 58013 - DNA, 6 bp, Unknown
  misc_feature (1)..( 6): Matrix.003 file - promoters60/4766628
ccgact

SEQ ID NO: 58014 - DNA, 7 bp, Unknown
  misc_feature (1)..( 7): Matrix.003 file - promoters60/4766628
tatcttg

SEQ ID NO: 58015 - DNA, 7 bp, Unknown
  misc_feature (1)..( 7): Matrix.003 file - promoters60/4766628
aaccaac

SEQ ID NO: 58016 - DNA, 7 bp, Unknown
  misc_feature (1)..( 7): Matrix.003 file - promoters60/4766628
ttttcaa

SEQ ID NO: 58017 - DNA, 7 bp, Unknown
  misc_feature (1)..( 7): Matrix.003 file - promoters60/4766628
tttatta

SEQ ID NO: 58018 - DNA, 7 bp, Unknown
  misc_feature (1)..( 7): Matrix.003 file - promoters60/4766628
tccccaa

SEQ ID NO: 58019 - DNA, 6 bp, Unknown
  misc_feature (1)..( 6): Matrix.003 file - promoters60/4766628
cggaag

SEQ ID NO: 58020 - DNA, 9 bp, Unknown
  misc_feature (1)..( 9): Matrix.003 file - promoters60/4766628
tcatatttt

SEQ ID NO: 58021 - DNA, 6 bp, Unknown
  misc_feature (1)..( 6): Matrix.003 file - promoters60/4766654
tcttat

SEQ ID NO: 58022 - DNA, 7 bp, Unknown
  misc_feature (1)..( 7): Matrix.003 file - promoters60/4766654
gataaaa

SEQ ID NO: 58023 - DNA, 7 bp, Unknown
  misc_feature (1)..( 7): Matrix.003 file - promoters60/4766654
ttacttt

SEQ ID NO: 58024 - DNA, 7 bp, Unknown
  misc_feature (1)..( 7): Matrix.003 file - promoters60/4766654
tttatat

SEQ ID NO: 58025 - DNA, 7 bp, Unknown
  misc_feature (1)..( 7): Matrix.003 file - promoters60/4766654
ataatta

SEQ ID NO: 58026 - DNA, 8 bp, Unknown
  misc_feature (1)..( 8): Matrix.003 file - promoters60/4766654
gtttataa

SEQ ID NO: 58027 - DNA, 8 bp, Unknown
  misc_feature (1)..( 8): Matrix.003 file - promoters60/4766654
aacacttt

SEQ ID NO: 58028 - DNA, 6 bp, Unknown
  misc_feature (1)..( 6): Matrix.003 file - promoters60/4766654
aatcta

SEQ ID NO: 58029 - DNA, 6 bp, Unknown
  misc_feature (1)..( 6): Matrix.003 file - promoters60/4766654
tatata

SEQ ID NO: 58030 - DNA, 6 bp, Unknown
  misc_feature (1)..( 6): Matrix.003 file - promoters60/4766654
ataaat

SEQ ID NO: 58031 - DNA, 6 bp, Unknown
  misc_feature (1)..( 6): Matrix.003 file - promoters60/4766654
ttgaat

SEQ ID NO: 58032 - DNA, 6 bp, Unknown
  misc_feature (1)..( 6): Matrix.003 file - promoters60/4766654
aatcac

SEQ ID NO: 58033 - DNA, 7 bp, Unknown
  misc_feature (1)..( 7): Matrix.003 file - promoters60/4766654
tatactc

SEQ ID NO: 58034 - DNA, 8 bp, Unknown
  misc_feature (1)..( 8): Matrix.003 file - promoters60/4766654
agcattgc

SEQ ID NO: 58035 - DNA, 6 bp, Unknown
  misc_feature (1)..( 6): Matrix.003 file - promoters60/4766654
acttgt

SEQ ID NO: 58036 - DNA, 9 bp, Unknown
  misc_feature (1)..( 9): Matrix.003 file - promoters60/4766654
aataaacac

SEQ ID NO: 58037 - DNA, 6 bp, Unknown
  misc_feature (1)..( 6): Matrix.003 file - promoters60/4766654
attcga

SEQ ID NO: 58038 - DNA, 7 bp, Unknown
  misc_feature (1)..( 7): Matrix.003 file - promoters60/4766654
atacaat

SEQ ID NO: 58039 - DNA, 7 bp, Unknown
  misc_feature (1)..( 7): Matrix.003 file - promoters60/4766654
acaaaaa

SEQ ID NO: 58040 - DNA, 8 bp, Unknown
  misc_feature (1)..( 8): Matrix.003 file - promoters60/4766712
ttttcttc

SEQ ID NO: 58041 - DNA, 6 bp, Unknown
  misc_feature (1)..( 6): Matrix.003 file - promoters60/4766727
taacca

SEQ ID NO: 58042 - DNA, 11 bp, Unknown
  misc_feature (1)..( 11): Matrix.003 file - promoters60/4766727
atattacaata

SEQ ID NO: 58043 - DNA, 9 bp, Unknown
  misc_feature (1)..( 9): Matrix.003 file - promoters60/4766727
aataatgat

SEQ ID NO: 58044 - DNA, 7 bp, Unknown
  misc_feature (1)..( 7): Matrix.003 file - promoters60/4766727
ggtttaa

SEQ ID NO: 58045 - DNA, 7 bp, Unknown
  misc_feature (1)..( 7): Matrix.003 file - promoters60/4766727
tttcttt

SEQ ID NO: 58046 - DNA, 7 bp, Unknown
  misc_feature (1)..( 7): Matrix.003 file - promoters60/4766727
ccatttt

SEQ ID NO: 58047 - DNA, 6 bp, Unknown
  misc_feature (1)..( 6): Matrix.003 file - promoters60/4766727
acataa

SEQ ID NO: 58048 - DNA, 10 bp, Unknown
  misc_feature (1)..( 10): Matrix.003 file - promoters60/4766727
atataaatta

SEQ ID NO: 58049 - DNA, 7 bp, Unknown
  misc_feature (1)..( 7): Matrix.003 file - promoters60/4766727
atattat

SEQ ID NO: 58050 - DNA, 11 bp, Unknown
  misc_feature (1)..( 11): Matrix.003 file - promoters60/4766727
tagattttttt

SEQ ID NO: 58051 - DNA, 6 bp, Unknown
  misc_feature (1)..( 6): Matrix.003 file - promoters60/4766727
taaaaa

SEQ ID NO: 58052 - DNA, 6 bp, Unknown
  misc_feature (1)..( 6): Matrix.003 file - promoters60/4766727
aaaaca

SEQ ID NO: 58053 - DNA, 11 bp, Unknown
  misc_feature (1)..( 11): Matrix.003 file - promoters60/4766727
aaaaggcccaa

SEQ ID NO: 58054 - DNA, 6 bp, Unknown
  misc_feature (1)..( 6): Matrix.003 file - promoters60/4766727
atcaaa

SEQ ID NO: 58055 - DNA, 6 bp, Unknown
  misc_feature (1)..( 6): Matrix.003 file - promoters60/4766727
tacaac

SEQ ID NO: 58056 - DNA, 7 bp, Unknown
  misc_feature (1)..( 7): Matrix.003 file - promoters60/4766727
taacatc

SEQ ID NO: 58057 - DNA, 8 bp, Unknown
  misc_feature (1)..( 8): Matrix.003 file - promoters60/4766727
atagcaca

SEQ ID NO: 58058 - DNA, 8 bp, Unknown
  misc_feature (1)..( 8): Matrix.003 file - promoters60/4766727
atcaaata

SEQ ID NO: 58059 - DNA, 6 bp, Unknown
  misc_feature (1)..( 6): Matrix.003 file - promoters60/4766727
taaaaa

SEQ ID NO: 58060 - DNA, 7 bp, Unknown
  misc_feature (1)..( 7): Matrix.003 file - promoters60/4766727
aaaatat

SEQ ID NO: 58061 - DNA, 7 bp, Unknown
  misc_feature (1)..( 7): Matrix.003 file - promoters60/4766727
aaaaaag

SEQ ID NO: 58062 - DNA, 8 bp, Unknown
  misc_feature (1)..( 8): Matrix.003 file - promoters60/4766727
aaacatag

SEQ ID NO: 58063 - DNA, 10 bp, Unknown
  misc_feature (1)..( 10): Matrix.003 file - promoters60/4766738
aatactaaaa

SEQ ID NO: 58064 - DNA, 6 bp, Unknown
  misc_feature (1)..( 6): Matrix.003 file - promoters60/4766738
aagaat

SEQ ID NO: 58065 - DNA, 6 bp, Unknown
  misc_feature (1)..( 6): Matrix.003 file - promoters60/4766738
cttttt

SEQ ID NO: 58066 - DNA, 6 bp, Unknown
  misc_feature (1)..( 6): Matrix.003 file - promoters60/4766738
ttagta

SEQ ID NO: 58067 - DNA, 6 bp, Unknown
  misc_feature (1)..( 6): Matrix.003 file - promoters60/4766738
ggttga

SEQ ID NO: 58068 - DNA, 7 bp, Unknown
  misc_feature (1)..( 7): Matrix.003 file - promoters60/4766738
aaaagaa

SEQ ID NO: 58069 - DNA, 10 bp, Unknown
  misc_feature (1)..( 10): Matrix.003 file - promoters60/4766738
agaaaaaaag

SEQ ID NO: 58070 - DNA, 8 bp, Unknown
  misc_feature (1)..( 8): Matrix.003 file - promoters60/4766738
ttaatgtc

SEQ ID NO: 58071 - DNA, 6 bp, Unknown
  misc_feature (1)..( 6): Matrix.003 file - promoters60/4766738
gtttcc

SEQ ID NO: 58072 - DNA, 7 bp, Unknown
  misc_feature (1)..( 7): Matrix.003 file - promoters60/4766738
catcact

SEQ ID NO: 58073 - DNA, 6 bp, Unknown
  misc_feature (1)..( 6): Matrix.003 file - promoters60/4766738
tattct

SEQ ID NO: 58074 - DNA, 7 bp, Unknown
  misc_feature (1)..( 7): Matrix.003 file - promoters60/4766738
cttatct

SEQ ID NO: 58075 - DNA, 6 bp, Unknown
  misc_feature (1)..( 6): Matrix.003 file - promoters60/4766738
tctgaa

SEQ ID NO: 58076 - DNA, 7 bp, Unknown
  misc_feature (1)..( 7): Matrix.003 file - promoters60/4766738
tatcatt

SEQ ID NO: 58077 - DNA, 7 bp, Unknown
  misc_feature (1)..( 7): Matrix.003 file - promoters60/4766738
gaatttg

SEQ ID NO: 58078 - DNA, 7 bp, Unknown
  misc_feature (1)..( 7): Matrix.003 file - promoters60/4766738
tttgatt

SEQ ID NO: 58079 - DNA, 7 bp, Unknown
  misc_feature (1)..( 7): Matrix.003 file - promoters60/4766738
ttagatc

SEQ ID NO: 58080 - DNA, 6 bp, Unknown
  misc_feature (1)..( 6): Matrix.003 file - promoters60/4766738
catttg

SEQ ID NO: 58081 - DNA, 8 bp, Unknown
  misc_feature (1)..( 8): Matrix.003 file - promoters60/4766754
attacatg

SEQ ID NO: 58082 - DNA, 6 bp, Unknown
  misc_feature (1)..( 6): Matrix.003 file - promoters60/4766754
gacatt

SEQ ID NO: 58083 - DNA, 7 bp, Unknown
  misc_feature (1)..( 7): Matrix.003 file - promoters60/4766754
atatttt

SEQ ID NO: 58084 - DNA, 6 bp, Unknown
  misc_feature (1)..( 6): Matrix.003 file - promoters60/4766754
ataaat

SEQ ID NO: 58085 - DNA, 16 bp, Unknown
  misc_feature (1)..( 16): Matrix.003 file - promoters60/4766754
tgttaatttatttttg

SEQ ID NO: 58086 - DNA, 6 bp, Unknown
  misc_feature (1)..( 6): Matrix.003 file - promoters60/4766754
ccaaaa

SEQ ID NO: 58087 - DNA, 8 bp, Unknown
  misc_feature (1)..( 8): Matrix.003 file - promoters60/4766754
agtatata

SEQ ID NO: 58088 - DNA, 6 bp, Unknown
  misc_feature (1)..( 6): Matrix.003 file - promoters60/4766754
tataaa

SEQ ID NO: 58089 - DNA, 7 bp, Unknown
  misc_feature (1)..( 7): Matrix.003 file - promoters60/4766754
tggataa

SEQ ID NO: 58090 - DNA, 7 bp, Unknown
  misc_feature (1)..( 7): Matrix.003 file - promoters60/4766754
ggtgttg

SEQ ID NO: 58091 - DNA, 7 bp, Unknown
  misc_feature (1)..( 7): Matrix.003 file - promoters60/4766754
aattaat

SEQ ID NO: 58092 - DNA, 8 bp, Unknown
  misc_feature (1)..( 8): Matrix.003 file - promoters60/4766754
tttgttgg

SEQ ID NO: 58093 - DNA, 7 bp, Unknown
  misc_feature (1)..( 7): Matrix.003 file - promoters60/4766754
tcgaatt

SEQ ID NO: 58094 - DNA, 6 bp, Unknown
  misc_feature (1)..( 6): Matrix.003 file - promoters60/4766754
agtaaa

SEQ ID NO: 58095 - DNA, 7 bp, Unknown
  misc_feature (1)..( 7): Matrix.003 file - promoters60/4766754
aatcggg

SEQ ID NO: 58096 - DNA, 8 bp, Unknown
  misc_feature (1)..( 8): Matrix.003 file - promoters60/4766754
gaaacaaa

SEQ ID NO: 58097 - DNA, 10 bp, Unknown
  misc_feature (1)..( 10): Matrix.003 file - promoters60/4766754
ggaaaagaaa

SEQ ID NO: 58098 - DNA, 7 bp, Unknown
  misc_feature (1)..( 7): Matrix.003 file - promoters60/4766754
cccacta

SEQ ID NO: 58099 - DNA, 9 bp, Unknown
  misc_feature (1)..( 9): Matrix.003 file - promoters60/4766754
aaagaaaag

SEQ ID NO: 58100 - DNA, 9 bp, Unknown
  misc_feature (1)..( 9): Matrix.003 file - promoters60/4766776
aaaaaagaa

SEQ ID NO: 58101 - DNA, 6 bp, Unknown
  misc_feature (1)..( 6): Matrix.003 file - promoters60/4766776
gtgtaa

SEQ ID NO: 58102 - DNA, 7 bp, Unknown
  misc_feature (1)..( 7): Matrix.003 file - promoters60/4766776
gaagaaa

SEQ ID NO: 58103 - DNA, 8 bp, Unknown
  misc_feature (1)..( 8): Matrix.003 file - promoters60/4766776
ttttatca

SEQ ID NO: 58104 - DNA, 9 bp, Unknown
  misc_feature (1)..( 9): Matrix.003 file - promoters60/4766776
atatatatc

SEQ ID NO: 58105 - DNA, 6 bp, Unknown
  misc_feature (1)..( 6): Matrix.003 file - promoters60/4766776
aaatat

SEQ ID NO: 58106 - DNA, 8 bp, Unknown
  misc_feature (1)..( 8): Matrix.003 file - promoters60/4766776
atatatac

SEQ ID NO: 58107 - DNA, 8 bp, Unknown
  misc_feature (1)..( 8): Matrix.003 file - promoters60/4766776
aaatcaat

SEQ ID NO: 58108 - DNA, 7 bp, Unknown
  misc_feature (1)..( 7): Matrix.003 file - promoters60/4766776
aatcaaa

SEQ ID NO: 58109 - DNA, 7 bp, Unknown
  misc_feature (1)..( 7): Matrix.003 file - promoters60/4766776
attaaat

SEQ ID NO: 58110 - DNA, 7 bp, Unknown
  misc_feature (1)..( 7): Matrix.003 file - promoters60/4766776
acacgta

SEQ ID NO: 58111 - DNA, 7 bp, Unknown
  misc_feature (1)..( 7): Matrix.003 file - promoters60/4766776
tttatat

SEQ ID NO: 58112 - DNA, 12 bp, Unknown
  misc_feature (1)..( 12): Matrix.003 file - promoters60/4766776
atcttaaaatat

SEQ ID NO: 58113 - DNA, 7 bp, Unknown
  misc_feature (1)..( 7): Matrix.003 file - promoters60/4766776
ataataa

SEQ ID NO: 58114 - DNA, 7 bp, Unknown
  misc_feature (1)..( 7): Matrix.003 file - promoters60/4766776
aaaaata

SEQ ID NO: 58115 - DNA, 6 bp, Unknown
  misc_feature (1)..( 6): Matrix.003 file - promoters60/4766776
agacac

SEQ ID NO: 58116 - DNA, 7 bp, Unknown
  misc_feature (1)..( 7): Matrix.003 file - promoters60/4766776
tccatct

SEQ ID NO: 58117 - DNA, 7 bp, Unknown
  misc_feature (1)..( 7): Matrix.003 file - promoters60/4766776
tctaacc

SEQ ID NO: 58118 - DNA, 6 bp, Unknown
  misc_feature (1)..( 6): Matrix.003 file - promoters60/4766776
aaataa

SEQ ID NO: 58119 - DNA, 6 bp, Unknown
  misc_feature (1)..( 6): Matrix.003 file - promoters60/4766776
aattca

SEQ ID NO: 58120 - DNA, 10 bp, Unknown
  misc_feature (1)..( 10): Matrix.003 file - promoters60/4766776
aaaatcttta

SEQ ID NO: 58121 - DNA, 10 bp, Unknown
  misc_feature (1)..( 10): Matrix.003 file - promoters60/4766784
acaagatttg

SEQ ID NO: 58122 - DNA, 6 bp, Unknown
  misc_feature (1)..( 6): Matrix.003 file - promoters60/4766784
tccata

SEQ ID NO: 58123 - DNA, 7 bp, Unknown
  misc_feature (1)..( 7): Matrix.003 file - promoters60/4766784
atcaaga

SEQ ID NO: 58124 - DNA, 6 bp, Unknown
  misc_feature (1)..( 6): Matrix.003 file - promoters60/4766784
ctgaaa

SEQ ID NO: 58125 - DNA, 7 bp, Unknown
  misc_feature (1)..( 7): Matrix.003 file - promoters60/4766784
ccacatt

SEQ ID NO: 58126 - DNA, 6 bp, Unknown
  misc_feature (1)..( 6): Matrix.003 file - promoters60/4766784
attaat

SEQ ID NO: 58127 - DNA, 6 bp, Unknown
  misc_feature (1)..( 6): Matrix.003 file - promoters60/4766784
ttaatt

SEQ ID NO: 58128 - DNA, 6 bp, Unknown
  misc_feature (1)..( 6): Matrix.003 file - promoters60/4766784
tttgac

SEQ ID NO: 58129 - DNA, 6 bp, Unknown
  misc_feature (1)..( 6): Matrix.003 file - promoters60/4766784
caaaaa

SEQ ID NO: 58130 - DNA, 6 bp, Unknown
  misc_feature (1)..( 6): Matrix.003 file - promoters60/4766784
ttttta

SEQ ID NO: 58131 - DNA, 10 bp, Unknown
  misc_feature (1)..( 10): Matrix.003 file - promoters60/4766784
tatattatta

SEQ ID NO: 58132 - DNA, 7 bp, Unknown
  misc_feature (1)..( 7): Matrix.003 file - promoters60/4766784
aaaataa

SEQ ID NO: 58133 - DNA, 7 bp, Unknown
  misc_feature (1)..( 7): Matrix.003 file - promoters60/4766784
tgttaaa

SEQ ID NO: 58134 - DNA, 7 bp, Unknown
  misc_feature (1)..( 7): Matrix.003 file - promoters60/4766784
aatataa

SEQ ID NO: 58135 - DNA, 6 bp, Unknown
  misc_feature (1)..( 6): Matrix.003 file - promoters60/4766784
ataaaa

SEQ ID NO: 58136 - DNA, 6 bp, Unknown
  misc_feature (1)..( 6): Matrix.003 file - promoters60/4766816
gattta

SEQ ID NO: 58137 - DNA, 7 bp, Unknown
  misc_feature (1)..( 7): Matrix.003 file - promoters60/4766816
aaaatat

SEQ ID NO: 58138 - DNA, 7 bp, Unknown
  misc_feature (1)..( 7): Matrix.003 file - promoters60/4766816
tatacaa

SEQ ID NO: 58139 - DNA, 7 bp, Unknown
  misc_feature (1)..( 7): Matrix.003 file - promoters60/4766816
tatattt

SEQ ID NO: 58140 - DNA, 6 bp, Unknown
  misc_feature (1)..( 6): Matrix.003 file - promoters60/4766816
tatact

SEQ ID NO: 58141 - DNA, 7 bp, Unknown
  misc_feature (1)..( 7): Matrix.003 file - promoters60/4766816
tttttaa

SEQ ID NO: 58142 - DNA, 7 bp, Unknown
  misc_feature (1)..( 7): Matrix.003 file - promoters60/4766816
taatttt

SEQ ID NO: 58143 - DNA, 9 bp, Unknown
  misc_feature (1)..( 9): Matrix.003 file - promoters60/4766816
ttttaataa

SEQ ID NO: 58144 - DNA, 6 bp, Unknown
  misc_feature (1)..( 6): Matrix.003 file - promoters60/4766816
aaaact

SEQ ID NO: 58145 - DNA, 6 bp, Unknown
  misc_feature (1)..( 6): Matrix.003 file - promoters60/4766816
aataaa

SEQ ID NO: 58146 - DNA, 6 bp, Unknown
  misc_feature (1)..( 6): Matrix.003 file - promoters60/4766816
tctctc

SEQ ID NO: 58147 - DNA, 9 bp, Unknown
  misc_feature (1)..( 9): Matrix.003 file - promoters60/4766816
caaatatgg

SEQ ID NO: 58148 - DNA, 7 bp, Unknown
  misc_feature (1)..( 7): Matrix.003 file - promoters60/4766816
tatattt

SEQ ID NO: 58149 - DNA, 7 bp, Unknown
  misc_feature (1)..( 7): Matrix.003 file - promoters60/4766816
agtactt

SEQ ID NO: 58150 - DNA, 11 bp, Unknown
  misc_feature (1)..( 11): Matrix.003 file - promoters60/4766826
aaacaaatttt

SEQ ID NO: 58151 - DNA, 8 bp, Unknown
  misc_feature (1)..( 8): Matrix.003 file - promoters60/4766835
aagttcaa

SEQ ID NO: 58152 - DNA, 7 bp, Unknown
  misc_feature (1)..( 7): Matrix.003 file - promoters60/4766835
atcaaaa

SEQ ID NO: 58153 - DNA, 8 bp, Unknown
  misc_feature (1)..( 8): Matrix.003 file - promoters60/4766835
aaacaaaa

SEQ ID NO: 58154 - DNA, 8 bp, Unknown
  misc_feature (1)..( 8): Matrix.003 file - promoters60/4766835
ataaaata

SEQ ID NO: 58155 - DNA, 8 bp, Unknown
  misc_feature (1)..( 8): Matrix.003 file - promoters60/4766835
aaaaagta

SEQ ID NO: 58156 - DNA, 10 bp, Unknown
  misc_feature (1)..( 10): Matrix.003 file - promoters60/4766835
aaataattga

SEQ ID NO: 58157 - DNA, 7 bp, Unknown
  misc_feature (1)..( 7): Matrix.003 file - promoters60/4766835
ttaattt

SEQ ID NO: 58158 - DNA, 8 bp, Unknown
  misc_feature (1)..( 8): Matrix.003 file - promoters60/4766835
cataaaaa

SEQ ID NO: 58159 - DNA, 8 bp, Unknown
  misc_feature (1)..( 8): Matrix.003 file - promoters60/4766835
acacataa

SEQ ID NO: 58160 - DNA, 7 bp, Unknown
  misc_feature (1)..( 7): Matrix.003 file - promoters60/4766835
ttttcag

SEQ ID NO: 58161 - DNA, 9 bp, Unknown
  misc_feature (1)..( 9): Matrix.003 file - promoters60/4766862
tttgggtga

SEQ ID NO: 58162 - DNA, 8 bp, Unknown
  misc_feature (1)..( 8): Matrix.003 file - promoters60/4766866
aacatttg

SEQ ID NO: 58163 - DNA, 11 bp, Unknown
  misc_feature (1)..( 11): Matrix.003 file - promoters60/4766866
ttaaaattaaa

SEQ ID NO: 58164 - DNA, 13 bp, Unknown
  misc_feature (1)..( 13): Matrix.003 file - promoters60/4766866
aaagaaattaaaa

SEQ ID NO: 58165 - DNA, 12 bp, Unknown
  misc_feature (1)..( 12): Matrix.003 file - promoters60/4766866
ttttgagacaaa

SEQ ID NO: 58166 - DNA, 6 bp, Unknown
  misc_feature (1)..( 6): Matrix.003 file - promoters60/4766870
atgaag

SEQ ID NO: 58167 - DNA, 7 bp, Unknown
  misc_feature (1)..( 7): Matrix.003 file - promoters60/4766870
tgaagtt

SEQ ID NO: 58168 - DNA, 6 bp, Unknown
  misc_feature (1)..( 6): Matrix.003 file - promoters60/4766870
gatgaa

SEQ ID NO: 58169 - DNA, 7 bp, Unknown
  misc_feature (1)..( 7): Matrix.003 file - promoters60/4766870
gattttg

SEQ ID NO: 58170 - DNA, 6 bp, Unknown
  misc_feature (1)..( 6): Matrix.003 file - promoters60/4766870
tctttg

SEQ ID NO: 58171 - DNA, 7 bp, Unknown
  misc_feature (1)..( 7): Matrix.003 file - promoters60/4766870
gtttgag

SEQ ID NO: 58172 - DNA, 7 bp, Unknown
  misc_feature (1)..( 7): Matrix.003 file - promoters60/4766870
atgatga

SEQ ID NO: 58173 - DNA, 8 bp, Unknown
  misc_feature (1)..( 8): Matrix.003 file - promoters60/4766870
attgtttt

SEQ ID NO: 58174 - DNA, 8 bp, Unknown
  misc_feature (1)..( 8): Matrix.003 file - promoters60/4766870
tgagtatt

SEQ ID NO: 58175 - DNA, 8 bp, Unknown
  misc_feature (1)..( 8): Matrix.003 file - promoters60/4766870
aagaggat

SEQ ID NO: 58176 - DNA, 10 bp, Unknown
  misc_feature (1)..( 10): Matrix.003 file - promoters60/4766870
tttatttata

SEQ ID NO: 58177 - DNA, 7 bp, Unknown
  misc_feature (1)..( 7): Matrix.003 file - promoters60/4766870
tctaaaa

SEQ ID NO: 58178 - DNA, 6 bp, Unknown
  misc_feature (1)..( 6): Matrix.003 file - promoters60/4766924
gttggt

SEQ ID NO: 58179 - DNA, 6 bp, Unknown
  misc_feature (1)..( 6): Matrix.003 file - promoters60/4766924
tagatc

SEQ ID NO: 58180 - DNA, 6 bp, Unknown
  misc_feature (1)..( 6): Matrix.003 file - promoters60/4766924
ttttat

SEQ ID NO: 58181 - DNA, 6 bp, Unknown
  misc_feature (1)..( 6): Matrix.003 file - promoters60/4766924
tatata

SEQ ID NO: 58182 - DNA, 8 bp, Unknown
  misc_feature (1)..( 8): Matrix.003 file - promoters60/4766924
accaacca

SEQ ID NO: 58183 - DNA, 7 bp, Unknown
  misc_feature (1)..( 7): Matrix.003 file - promoters60/4766924
tgggatc

SEQ ID NO: 58184 - DNA, 7 bp, Unknown
  misc_feature (1)..( 7): Matrix.003 file - promoters60/4766924
gtcaaaa

SEQ ID NO: 58185 - DNA, 10 bp, Unknown
  misc_feature (1)..( 10): Matrix.003 file - promoters60/4766977
caacaataat

SEQ ID NO: 58186 - DNA, 10 bp, Unknown
  misc_feature (1)..( 10): Matrix.003 file - promoters60/4766977
aatagaaaat

SEQ ID NO: 58187 - DNA, 10 bp, Unknown
  misc_feature (1)..( 10): Matrix.003 file - promoters60/4766977
actaatttta

SEQ ID NO: 58188 - DNA, 9 bp, Unknown
  misc_feature (1)..( 9): Matrix.003 file - promoters60/4766977
aactaaaat

SEQ ID NO: 58189 - DNA, 10 bp, Unknown
  misc_feature (1)..( 10): Matrix.003 file - promoters60/4766977
aaaatatatg

SEQ ID NO: 58190 - DNA, 10 bp, Unknown
  misc_feature (1)..( 10): Matrix.003 file - promoters60/4766977
attcttttta

SEQ ID NO: 58191 - DNA, 12 bp, Unknown
  misc_feature (1)..( 12): Matrix.003 file - promoters60/4766977
aatataaataaa

SEQ ID NO: 58192 - DNA, 9 bp, Unknown
  misc_feature (1)..( 9): Matrix.003 file - promoters60/4766977
ataaactta

SEQ ID NO: 58193 - DNA, 9 bp, Unknown
  misc_feature (1)..( 9): Matrix.003 file - promoters60/4766977
ataaaatta

SEQ ID NO: 58194 - DNA, 11 bp, Unknown
  misc_feature (1)..( 11): Matrix.003 file - promoters60/4767038
ctttttttttt

SEQ ID NO: 58195 - DNA, 9 bp, Unknown
  misc_feature (1)..( 9): Matrix.003 file - promoters60/4767038
atctatttt

SEQ ID NO: 58196 - DNA, 8 bp, Unknown
  misc_feature (1)..( 8): Matrix.003 file - promoters60/4767050
ttagaatt

SEQ ID NO: 58197 - DNA, 8 bp, Unknown
  misc_feature (1)..( 8): Matrix.003 file - promoters60/4767050
atataaat

SEQ ID NO: 58198 - DNA, 6 bp, Unknown
  misc_feature (1)..( 6): Matrix.003 file - promoters60/4767050
aagaag

SEQ ID NO: 58199 - DNA, 7 bp, Unknown
  misc_feature (1)..( 7): Matrix.003 file - promoters60/4767050
tctgcaa

SEQ ID NO: 58200 - DNA, 9 bp, Unknown
  misc_feature (1)..( 9): Matrix.003 file - promoters60/4767050
agatggttc

SEQ ID NO: 58201 - DNA, 8 bp, Unknown
  misc_feature (1)..( 8): Matrix.003 file - promoters60/4767050
gatcagag

SEQ ID NO: 58202 - DNA, 6 bp, Unknown
  misc_feature (1)..( 6): Matrix.003 file - promoters60/4767050
agagaa

SEQ ID NO: 58203 - DNA, 6 bp, Unknown
  misc_feature (1)..( 6): Matrix.003 file - promoters60/4767050
gatgaa

SEQ ID NO: 58204 - DNA, 6 bp, Unknown
  misc_feature (1)..( 6): Matrix.003 file - promoters60/4767050
atttag

SEQ ID NO: 58205 - DNA, 8 bp, Unknown
  misc_feature (1)..( 8): Matrix.003 file - promoters60/4767050
aaactaaa

SEQ ID NO: 58206 - DNA, 6 bp, Unknown
  misc_feature (1)..( 6): Matrix.003 file - promoters60/4767050
gaatca

SEQ ID NO: 58207 - DNA, 7 bp, Unknown
  misc_feature (1)..( 7): Matrix.003 file - promoters60/4767050
tccagtt

SEQ ID NO: 58208 - DNA, 6 bp, Unknown
  misc_feature (1)..( 6): Matrix.003 file - promoters60/4767050
tttccg

SEQ ID NO: 58209 - DNA, 6 bp, Unknown
  misc_feature (1)..( 6): Matrix.003 file - promoters60/4767050
aaccct

SEQ ID NO: 58210 - DNA, 6 bp, Unknown
  misc_feature (1)..( 6): Matrix.003 file - promoters60/4767059
tagatc

SEQ ID NO: 58211 - DNA, 6 bp, Unknown
  misc_feature (1)..( 6): Matrix.003 file - promoters60/4767059
acttct

SEQ ID NO: 58212 - DNA, 7 bp, Unknown
  misc_feature (1)..( 7): Matrix.003 file - promoters60/4767059
taaattt

SEQ ID NO: 58213 - DNA, 6 bp, Unknown
  misc_feature (1)..( 6): Matrix.003 file - promoters60/4767059
aaagac

SEQ ID NO: 58214 - DNA, 8 bp, Unknown
  misc_feature (1)..( 8): Matrix.003 file - promoters60/4767059
ttggaaga

SEQ ID NO: 58215 - DNA, 8 bp, Unknown
  misc_feature (1)..( 8): Matrix.003 file - promoters60/4767059
gaactttg

SEQ ID NO: 58216 - DNA, 8 bp, Unknown
  misc_feature (1)..( 8): Matrix.003 file - promoters60/4767059
ttaaatgc

SEQ ID NO: 58217 - DNA, 8 bp, Unknown
  misc_feature (1)..( 8): Matrix.003 file - promoters60/4767059
taacaaat

SEQ ID NO: 58218 - DNA, 6 bp, Unknown
  misc_feature (1)..( 6): Matrix.003 file - promoters60/4767059
gatatg

SEQ ID NO: 58219 - DNA, 6 bp, Unknown
  misc_feature (1)..( 6): Matrix.003 file - promoters60/4767059
taattt

SEQ ID NO: 58220 - DNA, 7 bp, Unknown
  misc_feature (1)..( 7): Matrix.003 file - promoters60/4767059
tataatt

SEQ ID NO: 58221 - DNA, 8 bp, Unknown
  misc_feature (1)..( 8): Matrix.003 file - promoters60/4767059
ataaaatt

SEQ ID NO: 58222 - DNA, 8 bp, Unknown
  misc_feature (1)..( 8): Matrix.003 file - promoters60/4767059
aaaatcaa

SEQ ID NO: 58223 - DNA, 8 bp, Unknown
  misc_feature (1)..( 8): Matrix.003 file - promoters60/4767059
attcagtt

SEQ ID NO: 58224 - DNA, 10 bp, Unknown
  misc_feature (1)..( 10): Matrix.003 file - promoters60/4767059
gtcgttttca

SEQ ID NO: 58225 - DNA, 6 bp, Unknown
  misc_feature (1)..( 6): Matrix.003 file - promoters60/4767059
aaaaaa

SEQ ID NO: 58226 - DNA, 7 bp, Unknown
  misc_feature (1)..( 7): Matrix.003 file - promoters60/4767059
gatcaaa

SEQ ID NO: 58227 - DNA, 6 bp, Unknown
  misc_feature (1)..( 6): Matrix.003 file - promoters60/4767059
attaat

SEQ ID NO: 58228 - DNA, 6 bp, Unknown
  misc_feature (1)..( 6): Matrix.003 file - promoters60/4767059
atttca

SEQ ID NO: 58229 - DNA, 10 bp, Unknown
  misc_feature (1)..( 10): Matrix.003 file - promoters60/4767059
cataaattta

SEQ ID NO: 58230 - DNA, 7 bp, Unknown
  misc_feature (1)..( 7): Matrix.003 file - promoters60/4767059
aggccca

SEQ ID NO: 58231 - DNA, 7 bp, Unknown
  misc_feature (1)..( 7): Matrix.003 file - promoters60/4767063
aaaatga

SEQ ID NO: 58232 - DNA, 7 bp, Unknown
  misc_feature (1)..( 7): Matrix.003 file - promoters60/4767063
tttcttt

SEQ ID NO: 58233 - DNA, 6 bp, Unknown
  misc_feature (1)..( 6): Matrix.003 file - promoters60/4767063
cgcttt

SEQ ID NO: 58234 - DNA, 7 bp, Unknown
  misc_feature (1)..( 7): Matrix.003 file - promoters60/4767063
tttagta

SEQ ID NO: 58235 - DNA, 10 bp, Unknown
  misc_feature (1)..( 10): Matrix.003 file - promoters60/4767063
ttgctgtttt

SEQ ID NO: 58236 - DNA, 8 bp, Unknown
  misc_feature (1)..( 8): Matrix.003 file - promoters60/4767063
ttttgtct

SEQ ID NO: 58237 - DNA, 11 bp, Unknown
  misc_feature (1)..( 11): Matrix.003 file - promoters60/4767063
tttagtaattt

SEQ ID NO: 58238 - DNA, 7 bp, Unknown
  misc_feature (1)..( 7): Matrix.003 file - promoters60/4767063
tttataa

SEQ ID NO: 58239 - DNA, 8 bp, Unknown
  misc_feature (1)..( 8): Matrix.003 file - promoters60/4767063
atttaatg

SEQ ID NO: 58240 - DNA, 11 bp, Unknown
  misc_feature (1)..( 11): Matrix.003 file - promoters60/4767063
attaattataa

SEQ ID NO: 58241 - DNA, 8 bp, Unknown
  misc_feature (1)..( 8): Matrix.003 file - promoters60/4767063
attgtaaa

SEQ ID NO: 58242 - DNA, 7 bp, Unknown
  misc_feature (1)..( 7): Matrix.003 file - promoters60/4767063
tctccaa

SEQ ID NO: 58243 - DNA, 6 bp, Unknown
  misc_feature (1)..( 6): Matrix.003 file - promoters60/4767063
tagagg

SEQ ID NO: 58244 - DNA, 6 bp, Unknown
  misc_feature (1)..( 6): Matrix.003 file - promoters60/4767063
atgaga

SEQ ID NO: 58245 - DNA, 6 bp, Unknown
  misc_feature (1)..( 6): Matrix.003 file - promoters60/4767063
tgtgaa

SEQ ID NO: 58246 - DNA, 6 bp, Unknown
  misc_feature (1)..( 6): Matrix.003 file - promoters60/4767063
ttttgt

SEQ ID NO: 58247 - DNA, 6 bp, Unknown
  misc_feature (1)..( 6): Matrix.003 file - promoters60/4767063
aataag

SEQ ID NO: 58248 - DNA, 7 bp, Unknown
  misc_feature (1)..( 7): Matrix.003 file - promoters60/4767063
aaaaaaa

SEQ ID NO: 58249 - DNA, 11 bp, Unknown
  misc_feature (1)..( 11): Matrix.003 file - promoters60/4767063
attaattaatt

SEQ ID NO: 58250 - DNA, 6 bp, Unknown
  misc_feature (1)..( 6): Matrix.003 file - promoters60/4767063
agtagt

SEQ ID NO: 58251 - DNA, 6 bp, Unknown
  misc_feature (1)..( 6): Matrix.003 file - promoters60/4767063
accaaa

SEQ ID NO: 58252 - DNA, 7 bp, Unknown
  misc_feature (1)..( 7): Matrix.003 file - promoters60/4767063
gttaacc

SEQ ID NO: 58253 - DNA, 8 bp, Unknown
  misc_feature (1)..( 8): Matrix.003 file - promoters60/4767063
aaatgata

SEQ ID NO: 58254 - DNA, 10 bp, Unknown
  misc_feature (1)..( 10): Matrix.003 file - promoters60/4767063
caaattagac

SEQ ID NO: 58255 - DNA, 9 bp, Unknown
  misc_feature (1)..( 9): Matrix.003 file - promoters60/4767063
ttcatcttt

SEQ ID NO: 58256 - DNA, 8 bp, Unknown
  misc_feature (1)..( 8): Matrix.003 file - promoters60/4767066
cttagtca

SEQ ID NO: 58257 - DNA, 9 bp, Unknown
  misc_feature (1)..( 9): Matrix.003 file - promoters60/4767066
tattattca

SEQ ID NO: 58258 - DNA, 8 bp, Unknown
  misc_feature (1)..( 8): Matrix.003 file - promoters60/4767066
cattgatg

SEQ ID NO: 58259 - DNA, 8 bp, Unknown
  misc_feature (1)..( 8): Matrix.003 file - promoters60/4767066
aattcttt

SEQ ID NO: 58260 - DNA, 6 bp, Unknown
  misc_feature (1)..( 6): Matrix.003 file - promoters60/4767066
ttcttt

SEQ ID NO: 58261 - DNA, 14 bp, Unknown
  misc_feature (1)..( 14): Matrix.003 file - promoters60/4767066
gtttccaaattctc

SEQ ID NO: 58262 - DNA, 7 bp, Unknown
  misc_feature (1)..( 7): Matrix.003 file - promoters60/4767066
caaaaac

SEQ ID NO: 58263 - DNA, 9 bp, Unknown
  misc_feature (1)..( 9): Matrix.003 file - promoters60/4767066
aaaaacaaa

SEQ ID NO: 58264 - DNA, 6 bp, Unknown
  misc_feature (1)..( 6): Matrix.003 file - promoters60/4767066
aagaaa

SEQ ID NO: 58265 - DNA, 11 bp, Unknown
  misc_feature (1)..( 11): Matrix.003 file - promoters60/4767144
aaaaaattaaa

SEQ ID NO: 58266 - DNA, 13 bp, Unknown
  misc_feature (1)..( 13): Matrix.003 file - promoters60/4767144
aaaaattaaacaa

SEQ ID NO: 58267 - DNA, 12 bp, Unknown
  misc_feature (1)..( 12): Matrix.003 file - promoters60/4767144
atttttgagata

SEQ ID NO: 58268 - DNA, 9 bp, Unknown
  misc_feature (1)..( 9): Matrix.003 file - promoters60/4767144
atattgctt

SEQ ID NO: 58269 - DNA, 6 bp, Unknown
  misc_feature (1)..( 6): Matrix.003 file - promoters60/4767148
acaatt

SEQ ID NO: 58270 - DNA, 6 bp, Unknown
  misc_feature (1)..( 6): Matrix.003 file - promoters60/4767148
atctgt

SEQ ID NO: 58271 - DNA, 8 bp, Unknown
  misc_feature (1)..( 8): Matrix.003 file - promoters60/4767148
attcatat

SEQ ID NO: 58272 - DNA, 6 bp, Unknown
  misc_feature (1)..( 6): Matrix.003 file - promoters60/4767148
acaaat

SEQ ID NO: 58273 - DNA, 7 bp, Unknown
  misc_feature (1)..( 7): Matrix.003 file - promoters60/4767148
atttctt

SEQ ID NO: 58274 - DNA, 7 bp, Unknown
  misc_feature (1)..( 7): Matrix.003 file - promoters60/4767148
tacaaaa

SEQ ID NO: 58275 - DNA, 6 bp, Unknown
  misc_feature (1)..( 6): Matrix.003 file - promoters60/4767148
ttctaa

SEQ ID NO: 58276 - DNA, 8 bp, Unknown
  misc_feature (1)..( 8): Matrix.003 file - promoters60/4767148
tattgatt

SEQ ID NO: 58277 - DNA, 12 bp, Unknown
  misc_feature (1)..( 12): Matrix.003 file - promoters60/4767148
agtaaatttgac

SEQ ID NO: 58278 - DNA, 6 bp, Unknown
  misc_feature (1)..( 6): Matrix.003 file - promoters60/4767148
tatgct

SEQ ID NO: 58279 - DNA, 6 bp, Unknown
  misc_feature (1)..( 6): Matrix.003 file - promoters60/4767148
tatgaa

SEQ ID NO: 58280 - DNA, 6 bp, Unknown
  misc_feature (1)..( 6): Matrix.003 file - promoters60/4767148
taaata

SEQ ID NO: 58281 - DNA, 6 bp, Unknown
  misc_feature (1)..( 6): Matrix.003 file - promoters60/4767148
ttatta

SEQ ID NO: 58282 - DNA, 6 bp, Unknown
  misc_feature (1)..( 6): Matrix.003 file - promoters60/4767148
attata

SEQ ID NO: 58283 - DNA, 7 bp, Unknown
  misc_feature (1)..( 7): Matrix.003 file - promoters60/4767148
ataactt

SEQ ID NO: 58284 - DNA, 6 bp, Unknown
  misc_feature (1)..( 6): Matrix.003 file - promoters60/4767148
aaattt

SEQ ID NO: 58285 - DNA, 7 bp, Unknown
  misc_feature (1)..( 7): Matrix.003 file - promoters60/4767148
aaaaagt

SEQ ID NO: 58286 - DNA, 8 bp, Unknown
  misc_feature (1)..( 8): Matrix.003 file - promoters60/4767148
gttttaaa

SEQ ID NO: 58287 - DNA, 7 bp, Unknown
  misc_feature (1)..( 7): Matrix.003 file - promoters60/4767195
aaaataa

SEQ ID NO: 58288 - DNA, 7 bp, Unknown
  misc_feature (1)..( 7): Matrix.003 file - promoters60/4767195
atactaa

SEQ ID NO: 58289 - DNA, 10 bp, Unknown
  misc_feature (1)..( 10): Matrix.003 file - promoters60/4767195
ttctaaaatt

SEQ ID NO: 58290 - DNA, 7 bp, Unknown
  misc_feature (1)..( 7): Matrix.003 file - promoters60/4767195
ttaattt

SEQ ID NO: 58291 - DNA, 8 bp, Unknown
  misc_feature (1)..( 8): Matrix.003 file - promoters60/4767195
tctataag

SEQ ID NO: 58292 - DNA, 7 bp, Unknown
  misc_feature (1)..( 7): Matrix.003 file - promoters60/4767195
tgaagat

SEQ ID NO: 58293 - DNA, 6 bp, Unknown
  misc_feature (1)..( 6): Matrix.003 file - promoters60/4767195
aatttt

SEQ ID NO: 58294 - DNA, 8 bp, Unknown
  misc_feature (1)..( 8): Matrix.003 file - promoters60/4767195
tgggccta

SEQ ID NO: 58295 - DNA, 6 bp, Unknown
  misc_feature (1)..( 6): Matrix.003 file - promoters60/4767195
gcattt

SEQ ID NO: 58296 - DNA, 6 bp, Unknown
  misc_feature (1)..( 6): Matrix.003 file - promoters60/4767195
gaattt

SEQ ID NO: 58297 - DNA, 7 bp, Unknown
  misc_feature (1)..( 7): Matrix.003 file - promoters60/4767195
tttctaa

SEQ ID NO: 58298 - DNA, 7 bp, Unknown
  misc_feature (1)..( 7): Matrix.003 file - promoters60/4767195
tttattt

SEQ ID NO: 58299 - DNA, 6 bp, Unknown
  misc_feature (1)..( 6): Matrix.003 file - promoters60/4767195
acattt

SEQ ID NO: 58300 - DNA, 6 bp, Unknown
  misc_feature (1)..( 6): Matrix.003 file - promoters60/4767195
cacatg

SEQ ID NO: 58301 - DNA, 6 bp, Unknown
  misc_feature (1)..( 6): Matrix.003 file - promoters60/4767195
gagatt

SEQ ID NO: 58302 - DNA, 6 bp, Unknown
  misc_feature (1)..( 6): Matrix.003 file - promoters60/4767195
ttgggt

SEQ ID NO: 58303 - DNA, 6 bp, Unknown
  misc_feature (1)..( 6): Matrix.003 file - promoters60/4767195
agatga

SEQ ID NO: 58304 - DNA, 9 bp, Unknown
  misc_feature (1)..( 9): Matrix.003 file - promoters60/4767195
ggttaatgg

SEQ ID NO: 58305 - DNA, 10 bp, Unknown
  misc_feature (1)..( 10): Matrix.003 file - promoters60/4767298
tatatcaata

SEQ ID NO: 58306 - DNA, 11 bp, Unknown
  misc_feature (1)..( 11): Matrix.003 file - promoters60/4767298
ttctaaaatat

SEQ ID NO: 58307 - DNA, 12 bp, Unknown
  misc_feature (1)..( 12): Matrix.003 file - promoters60/4767298
tacattttaaaa

SEQ ID NO: 58308 - DNA, 7 bp, Unknown
  misc_feature (1)..( 7): Matrix.003 file - promoters60/4767318
aaaatat

SEQ ID NO: 58309 - DNA, 7 bp, Unknown
  misc_feature (1)..( 7): Matrix.003 file - promoters60/4767318
agagtaa

SEQ ID NO: 58310 - DNA, 7 bp, Unknown
  misc_feature (1)..( 7): Matrix.003 file - promoters60/4767318
aaagact

SEQ ID NO: 58311 - DNA, 13 bp, Unknown
  misc_feature (1)..( 13): Matrix.003 file - promoters60/4767318
tttagttttcctt

SEQ ID NO: 58312 - DNA, 10 bp, Unknown
  misc_feature (1)..( 10): Matrix.003 file - promoters60/4767318
aaaaacacaa

SEQ ID NO: 58313 - DNA, 8 bp, Unknown
  misc_feature (1)..( 8): Matrix.003 file - promoters60/4767318
tgtaattt

SEQ ID NO: 58314 - DNA, 7 bp, Unknown
  misc_feature (1)..( 7): Matrix.003 file - promoters60/4767318
cttaaac

SEQ ID NO: 58315 - DNA, 6 bp, Unknown
  misc_feature (1)..( 6): Matrix.003 file - promoters60/4767318
cattaa

SEQ ID NO: 58316 - DNA, 6 bp, Unknown
  misc_feature (1)..( 6): Matrix.003 file - promoters60/4767318
ctaaaa

SEQ ID NO: 58317 - DNA, 6 bp, Unknown
  misc_feature (1)..( 6): Matrix.003 file - promoters60/4767318
gtattt

SEQ ID NO: 58318 - DNA, 7 bp, Unknown
  misc_feature (1)..( 7): Matrix.003 file - promoters60/4767318
ttataaa

SEQ ID NO: 58319 - DNA, 8 bp, Unknown
  misc_feature (1)..( 8): Matrix.003 file - promoters60/4767318
cttctctt

SEQ ID NO: 58320 - DNA, 9 bp, Unknown
  misc_feature (1)..( 9): Matrix.003 file - promoters60/4767318
tttacttaa

SEQ ID NO: 58321 - DNA, 6 bp, Unknown
  misc_feature (1)..( 6): Matrix.003 file - promoters60/4767318
cttgtt

SEQ ID NO: 58322 - DNA, 8 bp, Unknown
  misc_feature (1)..( 8): Matrix.003 file - promoters60/4767318
acaagatt

SEQ ID NO: 58323 - DNA, 7 bp, Unknown
  misc_feature (1)..( 7): Matrix.003 file - promoters60/4767318
tacgttt

SEQ ID NO: 58324 - DNA, 7 bp, Unknown
  misc_feature (1)..( 7): Matrix.003 file - promoters60/4767318
taaatta

SEQ ID NO: 58325 - DNA, 8 bp, Unknown
  misc_feature (1)..( 8): Matrix.003 file - promoters60/4767318
gaaactaa

SEQ ID NO: 58326 - DNA, 8 bp, Unknown
  misc_feature (1)..( 8): Matrix.003 file - promoters60/4767318
gtcttcat

SEQ ID NO: 58327 - DNA, 6 bp, Unknown
  misc_feature (1)..( 6): Matrix.003 file - promoters60/4767318
ttatta

SEQ ID NO: 58328 - DNA, 7 bp, Unknown
  misc_feature (1)..( 7): Matrix.003 file - promoters60/4767318
ttaatat

SEQ ID NO: 58329 - DNA, 7 bp, Unknown
  misc_feature (1)..( 7): Matrix.003 file - promoters60/4767318
acaaaat

SEQ ID NO: 58330 - DNA, 11 bp, Unknown
  misc_feature (1)..( 11): Matrix.003 file - promoters60/4767330
aacatttcttt

SEQ ID NO: 58331 - DNA, 6 bp, Unknown
  misc_feature (1)..( 6): Matrix.003 file - promoters60/4767330
tttgtt

SEQ ID NO: 58332 - DNA, 11 bp, Unknown
  misc_feature (1)..( 11): Matrix.003 file - promoters60/4767330
atttctgtttg

SEQ ID NO: 58333 - DNA, 7 bp, Unknown
  misc_feature (1)..( 7): Matrix.003 file - promoters60/4767330
aaagaac

SEQ ID NO: 58334 - DNA, 6 bp, Unknown
  misc_feature (1)..( 6): Matrix.003 file - promoters60/4767330
ttaatt

SEQ ID NO: 58335 - DNA, 6 bp, Unknown
  misc_feature (1)..( 6): Matrix.003 file - promoters60/4767330
acaaat

SEQ ID NO: 58336 - DNA, 7 bp, Unknown
  misc_feature (1)..( 7): Matrix.003 file - promoters60/4767330
agtatat

SEQ ID NO: 58337 - DNA, 7 bp, Unknown
  misc_feature (1)..( 7): Matrix.003 file - promoters60/4767330
tatattt

SEQ ID NO: 58338 - DNA, 6 bp, Unknown
  misc_feature (1)..( 6): Matrix.003 file - promoters60/4767330
ttttct

SEQ ID NO: 58339 - DNA, 8 bp, Unknown
  misc_feature (1)..( 8): Matrix.003 file - promoters60/4767330
caattatt

SEQ ID NO: 58340 - DNA, 8 bp, Unknown
  misc_feature (1)..( 8): Matrix.003 file - promoters60/4767330
caatattt

SEQ ID NO: 58341 - DNA, 6 bp, Unknown
  misc_feature (1)..( 6): Matrix.003 file - promoters60/4767330
taatta

SEQ ID NO: 58342 - DNA, 8 bp, Unknown
  misc_feature (1)..( 8): Matrix.003 file - promoters60/4767330
tttagatt

SEQ ID NO: 58343 - DNA, 6 bp, Unknown
  misc_feature (1)..( 6): Matrix.003 file - promoters60/4767330
ataata

SEQ ID NO: 58344 - DNA, 6 bp, Unknown
  misc_feature (1)..( 6): Matrix.003 file - promoters60/4767330
attttt

SEQ ID NO: 58345 - DNA, 6 bp, Unknown
  misc_feature (1)..( 6): Matrix.003 file - promoters60/4767330
aataaa

SEQ ID NO: 58346 - DNA, 6 bp, Unknown
  misc_feature (1)..( 6): Matrix.003 file - promoters60/4767330
aaattt

SEQ ID NO: 58347 - DNA, 10 bp, Unknown
  misc_feature (1)..( 10): Matrix.003 file - promoters60/4767330
ccccaaaacc

SEQ ID NO: 58348 - DNA, 7 bp, Unknown
  misc_feature (1)..( 7): Matrix.003 file - promoters60/4767330
aaacgta

SEQ ID NO: 58349 - DNA, 9 bp, Unknown
  misc_feature (1)..( 9): Matrix.003 file - promoters60/4767330
aatatattt

SEQ ID NO: 58350 - DNA, 8 bp, Unknown
  misc_feature (1)..( 8): Matrix.003 file - promoters60/4767330
taaaataa

SEQ ID NO: 58351 - DNA, 7 bp, Unknown
  misc_feature (1)..( 7): Matrix.003 file - promoters60/4767330
aaaaaat

SEQ ID NO: 58352 - DNA, 8 bp, Unknown
  misc_feature (1)..( 8): Matrix.003 file - promoters60/4767330
tttcaata

SEQ ID NO: 58353 - DNA, 6 bp, Unknown
  misc_feature (1)..( 6): Matrix.003 file - promoters60/4767333
gacaaa

SEQ ID NO: 58354 - DNA, 7 bp, Unknown
  misc_feature (1)..( 7): Matrix.003 file - promoters60/4767333
tttcttt

SEQ ID NO: 58355 - DNA, 10 bp, Unknown
  misc_feature (1)..( 10): Matrix.003 file - promoters60/4767333
atcgaaaaaa

SEQ ID NO: 58356 - DNA, 8 bp, Unknown
  misc_feature (1)..( 8): Matrix.003 file - promoters60/4767333
aaacataa

SEQ ID NO: 58357 - DNA, 6 bp, Unknown
  misc_feature (1)..( 6): Matrix.003 file - promoters60/4767333
gaaaat

SEQ ID NO: 58358 - DNA, 6 bp, Unknown
  misc_feature (1)..( 6): Matrix.003 file - promoters60/4767333
aggtct

SEQ ID NO: 58359 - DNA, 7 bp, Unknown
  misc_feature (1)..( 7): Matrix.003 file - promoters60/4767333
ggtttct

SEQ ID NO: 58360 - DNA, 6 bp, Unknown
  misc_feature (1)..( 6): Matrix.003 file - promoters60/4767333
agtttt

SEQ ID NO: 58361 - DNA, 7 bp, Unknown
  misc_feature (1)..( 7): Matrix.003 file - promoters60/4767333
taaaatc

SEQ ID NO: 58362 - DNA, 7 bp, Unknown
  misc_feature (1)..( 7): Matrix.003 file - promoters60/4767333
aaaacct

SEQ ID NO: 58363 - DNA, 6 bp, Unknown
  misc_feature (1)..( 6): Matrix.003 file - promoters60/4767333
accatt

SEQ ID NO: 58364 - DNA, 9 bp, Unknown
  misc_feature (1)..( 9): Matrix.003 file - promoters60/4767379
aaaaatata

SEQ ID NO: 58365 - DNA, 9 bp, Unknown
  misc_feature (1)..( 9): Matrix.003 file - promoters60/4767379
aataaaatt

SEQ ID NO: 58366 - DNA, 11 bp, Unknown
  misc_feature (1)..( 11): Matrix.003 file - promoters60/4767379
tgtaaaaaaaa

SEQ ID NO: 58367 - DNA, 10 bp, Unknown
  misc_feature (1)..( 10): Matrix.003 file - promoters60/4767379
atttgtttaa

SEQ ID NO: 58368 - DNA, 10 bp, Unknown
  misc_feature (1)..( 10): Matrix.003 file - promoters60/4767379
ccttataaat

SEQ ID NO: 58369 - DNA, 11 bp, Unknown
  misc_feature (1)..( 11): Matrix.003 file - promoters60/4767379
ttgacaaaaaa

SEQ ID NO: 58370 - DNA, 10 bp, Unknown
  misc_feature (1)..( 10): Matrix.003 file - promoters60/4767379
atattattaa

SEQ ID NO: 58371 - DNA, 10 bp, Unknown
  misc_feature (1)..( 10): Matrix.003 file - promoters60/4767379
aataaaaaat

SEQ ID NO: 58372 - DNA, 13 bp, Unknown
  misc_feature (1)..( 13): Matrix.003 file - promoters60/4767379
ttgagtccaaaat

SEQ ID NO: 58373 - DNA, 8 bp, Unknown
  misc_feature (1)..( 8): Matrix.003 file - promoters60/4767379
aaaaaaaa

SEQ ID NO: 58374 - DNA, 10 bp, Unknown
  misc_feature (1)..( 10): Matrix.003 file - promoters60/4767379
ttaatttttg

SEQ ID NO: 58375 - DNA, 13 bp, Unknown
  misc_feature (1)..( 13): Matrix.003 file - promoters60/4767379
cattaaaagctaa

SEQ ID NO: 58376 - DNA, 11 bp, Unknown
  misc_feature (1)..( 11): Matrix.003 file - promoters60/4767379
atttaaaaaga

SEQ ID NO: 58377 - DNA, 8 bp, Unknown
  misc_feature (1)..( 8): Matrix.003 file - promoters60/4767402
acataata

SEQ ID NO: 58378 - DNA, 9 bp, Unknown
  misc_feature (1)..( 9): Matrix.003 file - promoters60/4767402
tattttatt

SEQ ID NO: 58379 - DNA, 9 bp, Unknown
  misc_feature (1)..( 9): Matrix.003 file - promoters60/4767402
ctttttttt

SEQ ID NO: 58380 - DNA, 8 bp, Unknown
  misc_feature (1)..( 8): Matrix.003 file - promoters60/4767402
tctttcaa

SEQ ID NO: 58381 - DNA, 9 bp, Unknown
  misc_feature (1)..( 9): Matrix.003 file - promoters60/4767402
attttgtta

SEQ ID NO: 58382 - DNA, 6 bp, Unknown
  misc_feature (1)..( 6): Matrix.003 file - promoters60/4767410
ttttta

SEQ ID NO: 58383 - DNA, 8 bp, Unknown
  misc_feature (1)..( 8): Matrix.003 file - promoters60/4767410
taaattga

SEQ ID NO: 58384 - DNA, 7 bp, Unknown
  misc_feature (1)..( 7): Matrix.003 file - promoters60/4767410
tatgaaa

SEQ ID NO: 58385 - DNA, 8 bp, Unknown
  misc_feature (1)..( 8): Matrix.003 file - promoters60/4767410
agttaaag

SEQ ID NO: 58386 - DNA, 9 bp, Unknown
  misc_feature (1)..( 9): Matrix.003 file - promoters60/4767410
tcttaatct

SEQ ID NO: 58387 - DNA, 9 bp, Unknown
  misc_feature (1)..( 9): Matrix.003 file - promoters60/4767410
ggatttgtt

SEQ ID NO: 58388 - DNA, 7 bp, Unknown
  misc_feature (1)..( 7): Matrix.003 file - promoters60/4767410
tccattt

SEQ ID NO: 58389 - DNA, 6 bp, Unknown
  misc_feature (1)..( 6): Matrix.003 file - promoters60/4767410
tttctt

SEQ ID NO: 58390 - DNA, 7 bp, Unknown
  misc_feature (1)..( 7): Matrix.003 file - promoters60/4767410
aaaatat

SEQ ID NO: 58391 - DNA, 7 bp, Unknown
  misc_feature (1)..( 7): Matrix.003 file - promoters60/4767410
actgcat

SEQ ID NO: 58392 - DNA, 7 bp, Unknown
  misc_feature (1)..( 7): Matrix.003 file - promoters60/4767410
ccagcca

SEQ ID NO: 58393 - DNA, 6 bp, Unknown
  misc_feature (1)..( 6): Matrix.003 file - promoters60/4767410
atacaa

SEQ ID NO: 58394 - DNA, 6 bp, Unknown
  misc_feature (1)..( 6): Matrix.003 file - promoters60/4767410
atgtct

SEQ ID NO: 58395 - DNA, 7 bp, Unknown
  misc_feature (1)..( 7): Matrix.003 file - promoters60/4767410
ttggaga

SEQ ID NO: 58396 - DNA, 6 bp, Unknown
  misc_feature (1)..( 6): Matrix.003 file - promoters60/4767410
gaagat

SEQ ID NO: 58397 - DNA, 6 bp, Unknown
  misc_feature (1)..( 6): Matrix.003 file - promoters60/4767410
gatcga

SEQ ID NO: 58398 - DNA, 6 bp, Unknown
  misc_feature (1)..( 6): Matrix.003 file - promoters60/4767410
aaatgc

SEQ ID NO: 58399 - DNA, 9 bp, Unknown
  misc_feature (1)..( 9): Matrix.003 file - promoters60/4767442
tttgtttta

SEQ ID NO: 58400 - DNA, 12 bp, Unknown
  misc_feature (1)..( 12): Matrix.003 file - promoters60/4767452
caaaaagatatg

SEQ ID NO: 58401 - DNA, 8 bp, Unknown
  misc_feature (1)..( 8): Matrix.003 file - promoters60/4767452
aatattta

SEQ ID NO: 58402 - DNA, 10 bp, Unknown
  misc_feature (1)..( 10): Matrix.003 file - promoters60/4767452
ttatataagc

SEQ ID NO: 58403 - DNA, 11 bp, Unknown
  misc_feature (1)..( 11): Matrix.003 file - promoters60/4767452
tctcaaaatca

SEQ ID NO: 58404 - DNA, 11 bp, Unknown
  misc_feature (1)..( 11): Matrix.003 file - promoters60/4767452
aaaaacagaaa

SEQ ID NO: 58405 - DNA, 11 bp, Unknown
  misc_feature (1)..( 11): Matrix.003 file - promoters60/4767487
tttaattaaaa

SEQ ID NO: 58406 - DNA, 12 bp, Unknown
  misc_feature (1)..( 12): Matrix.003 file - promoters60/4767487
gtaaaattttta

SEQ ID NO: 58407 - DNA, 11 bp, Unknown
  misc_feature (1)..( 11): Matrix.003 file - promoters60/4767490
tcatatttatt

SEQ ID NO: 58408 - DNA, 13 bp, Unknown
  misc_feature (1)..( 13): Matrix.003 file - promoters60/4767490
tttataaattttt

SEQ ID NO: 58409 - DNA, 10 bp, Unknown
  misc_feature (1)..( 10): Matrix.003 file - promoters60/4767490
atgtccatat

SEQ ID NO: 58410 - DNA, 13 bp, Unknown
  misc_feature (1)..( 13): Matrix.003 file - promoters60/4767490
aaaaattacttta

SEQ ID NO: 58411 - DNA, 12 bp, Unknown
  misc_feature (1)..( 12): Matrix.003 file - promoters60/4767490
aattaaccctca

SEQ ID NO: 58412 - DNA, 9 bp, Unknown
  misc_feature (1)..( 9): Matrix.003 file - promoters60/4767490
taaatgatc

SEQ ID NO: 58413 - DNA, 6 bp, Unknown
  misc_feature (1)..( 6): Matrix.003 file - promoters60/4767505
cgagtc

SEQ ID NO: 58414 - DNA, 6 bp, Unknown
  misc_feature (1)..( 6): Matrix.003 file - promoters60/4767505
gaaatt

SEQ ID NO: 58415 - DNA, 7 bp, Unknown
  misc_feature (1)..( 7): Matrix.003 file - promoters60/4767505
gacagaa

SEQ ID NO: 58416 - DNA, 8 bp, Unknown
  misc_feature (1)..( 8): Matrix.003 file - promoters60/4767505
aaagatca

SEQ ID NO: 58417 - DNA, 6 bp, Unknown
  misc_feature (1)..( 6): Matrix.003 file - promoters60/4767505
tagtag

SEQ ID NO: 58418 - DNA, 6 bp, Unknown
  misc_feature (1)..( 6): Matrix.003 file - promoters60/4767505
cctttt

SEQ ID NO: 58419 - DNA, 6 bp, Unknown
  misc_feature (1)..( 6): Matrix.003 file - promoters60/4767505
tttgat

SEQ ID NO: 58420 - DNA, 8 bp, Unknown
  misc_feature (1)..( 8): Matrix.003 file - promoters60/4767505
tttaacta

SEQ ID NO: 58421 - DNA, 8 bp, Unknown
  misc_feature (1)..( 8): Matrix.003 file - promoters60/4767505
ctatcttt

SEQ ID NO: 58422 - DNA, 8 bp, Unknown
  misc_feature (1)..( 8): Matrix.003 file - promoters60/4767505
cactaacc

SEQ ID NO: 58423 - DNA, 7 bp, Unknown
  misc_feature (1)..( 7): Matrix.003 file - promoters60/4767505
aatcggt

SEQ ID NO: 58424 - DNA, 6 bp, Unknown
  misc_feature (1)..( 6): Matrix.003 file - promoters60/4767505
gacctc

SEQ ID NO: 58425 - DNA, 8 bp, Unknown
  misc_feature (1)..( 8): Matrix.003 file - promoters60/4767505
ttttaata

SEQ ID NO: 58426 - DNA, 9 bp, Unknown
  misc_feature (1)..( 9): Matrix.003 file - promoters60/4767505
tcttgttta

SEQ ID NO: 58427 - DNA, 7 bp, Unknown
  misc_feature (1)..( 7): Matrix.003 file - promoters60/4767505
aaacata

SEQ ID NO: 58428 - DNA, 7 bp, Unknown
  misc_feature (1)..( 7): Matrix.003 file - promoters60/4767505
caacata

SEQ ID NO: 58429 - DNA, 7 bp, Unknown
  misc_feature (1)..( 7): Matrix.003 file - promoters60/4767505
ttaaaaa

SEQ ID NO: 58430 - DNA, 8 bp, Unknown
  misc_feature (1)..( 8): Matrix.003 file - promoters60/4767505
gtgaaaaa

SEQ ID NO: 58431 - DNA, 8 bp, Unknown
  misc_feature (1)..( 8): Matrix.003 file - promoters60/4767505
tataaata

SEQ ID NO: 58432 - DNA, 8 bp, Unknown
  misc_feature (1)..( 8): Matrix.003 file - promoters60/4767515
aaagaaaa

SEQ ID NO: 58433 - DNA, 12 bp, Unknown
  misc_feature (1)..( 12): Matrix.003 file - promoters60/4767515
tacgaaaacaat

SEQ ID NO: 58434 - DNA, 9 bp, Unknown
  misc_feature (1)..( 9): Matrix.003 file - promoters60/4767515
taattaact

SEQ ID NO: 58435 - DNA, 6 bp, Unknown
  misc_feature (1)..( 6): Matrix.003 file - promoters60/4767515
caagaa

SEQ ID NO: 58436 - DNA, 8 bp, Unknown
  misc_feature (1)..( 8): Matrix.003 file - promoters60/4767519
attgattt

SEQ ID NO: 58437 - DNA, 8 bp, Unknown
  misc_feature (1)..( 8): Matrix.003 file - promoters60/4767519
aaaacata

SEQ ID NO: 58438 - DNA, 7 bp, Unknown
  misc_feature (1)..( 7): Matrix.003 file - promoters60/4767519
tttataa

SEQ ID NO: 58439 - DNA, 7 bp, Unknown
  misc_feature (1)..( 7): Matrix.003 file - promoters60/4767519
aaataaa

SEQ ID NO: 58440 - DNA, 7 bp, Unknown
  misc_feature (1)..( 7): Matrix.003 file - promoters60/4767519
ttatata

SEQ ID NO: 58441 - DNA, 7 bp, Unknown
  misc_feature (1)..( 7): Matrix.003 file - promoters60/4767519
gatttat

SEQ ID NO: 58442 - DNA, 10 bp, Unknown
  misc_feature (1)..( 10): Matrix.003 file - promoters60/4767519
aacactatat

SEQ ID NO: 58443 - DNA, 6 bp, Unknown
  misc_feature (1)..( 6): Matrix.003 file - promoters60/4767519
tcttta

SEQ ID NO: 58444 - DNA, 6 bp, Unknown
  misc_feature (1)..( 6): Matrix.003 file - promoters60/4767519
atcttt

SEQ ID NO: 58445 - DNA, 8 bp, Unknown
  misc_feature (1)..( 8): Matrix.003 file - promoters60/4767519
atttaaat

SEQ ID NO: 58446 - DNA, 7 bp, Unknown
  misc_feature (1)..( 7): Matrix.003 file - promoters60/4767519
atttaag

SEQ ID NO: 58447 - DNA, 11 bp, Unknown
  misc_feature (1)..( 11): Matrix.003 file - promoters60/4767519
ataattatatg

SEQ ID NO: 58448 - DNA, 7 bp, Unknown
  misc_feature (1)..( 7): Matrix.003 file - promoters60/4767519
taaatac

SEQ ID NO: 58449 - DNA, 8 bp, Unknown
  misc_feature (1)..( 8): Matrix.003 file - promoters60/4767519
tgaaaaaa

SEQ ID NO: 58450 - DNA, 7 bp, Unknown
  misc_feature (1)..( 7): Matrix.003 file - promoters60/4767519
taacatt

SEQ ID NO: 58451 - DNA, 6 bp, Unknown
  misc_feature (1)..( 6): Matrix.003 file - promoters60/4767519
tgataa

SEQ ID NO: 58452 - DNA, 9 bp, Unknown
  misc_feature (1)..( 9): Matrix.003 file - promoters60/4767519
aataaaaat

SEQ ID NO: 58453 - DNA, 7 bp, Unknown
  misc_feature (1)..( 7): Matrix.003 file - promoters60/4767519
tagaaac

SEQ ID NO: 58454 - DNA, 6 bp, Unknown
  misc_feature (1)..( 6): Matrix.003 file - promoters60/4767519
aacgta

SEQ ID NO: 58455 - DNA, 10 bp, Unknown
  misc_feature (1)..( 10): Matrix.003 file - promoters60/4767519
gtatcaaaat

SEQ ID NO: 58456 - DNA, 10 bp, Unknown
  misc_feature (1)..( 10): Matrix.003 file - promoters60/4767539
atctctgcag

SEQ ID NO: 58457 - DNA, 7 bp, Unknown
  misc_feature (1)..( 7): Matrix.003 file - promoters60/4767539
tttatct

SEQ ID NO: 58458 - DNA, 7 bp, Unknown
  misc_feature (1)..( 7): Matrix.003 file - promoters60/4767539
agatatt

SEQ ID NO: 58459 - DNA, 7 bp, Unknown
  misc_feature (1)..( 7): Matrix.003 file - promoters60/4767539
tttacaa

SEQ ID NO: 58460 - DNA, 7 bp, Unknown
  misc_feature (1)..( 7): Matrix.003 file - promoters60/4767539
agtttat

SEQ ID NO: 58461 - DNA, 6 bp, Unknown
  misc_feature (1)..( 6): Matrix.003 file - promoters60/4767539
ttatcc

SEQ ID NO: 58462 - DNA, 8 bp, Unknown
  misc_feature (1)..( 8): Matrix.003 file - promoters60/4767539
gttgtatg

SEQ ID NO: 58463 - DNA, 6 bp, Unknown
  misc_feature (1)..( 6): Matrix.003 file - promoters60/4767539
tatttt

SEQ ID NO: 58464 - DNA, 6 bp, Unknown
  misc_feature (1)..( 6): Matrix.003 file - promoters60/4767539
acattc

SEQ ID NO: 58465 - DNA, 6 bp, Unknown
  misc_feature (1)..( 6): Matrix.003 file - promoters60/4767539
ttttga

SEQ ID NO: 58466 - DNA, 7 bp, Unknown
  misc_feature (1)..( 7): Matrix.003 file - promoters60/4767539
taaaact

SEQ ID NO: 58467 - DNA, 7 bp, Unknown
  misc_feature (1)..( 7): Matrix.003 file - promoters60/4767539
aaactgt

SEQ ID NO: 58468 - DNA, 7 bp, Unknown
  misc_feature (1)..( 7): Matrix.003 file - promoters60/4767539
aaaaata

SEQ ID NO: 58469 - DNA, 7 bp, Unknown
  misc_feature (1)..( 7): Matrix.003 file - promoters60/4767539
gaagaaa

SEQ ID NO: 58470 - DNA, 9 bp, Unknown
  misc_feature (1)..( 9): Matrix.003 file - promoters60/4767539
cacaatcta

SEQ ID NO: 58471 - DNA, 6 bp, Unknown
  misc_feature (1)..( 6): Matrix.003 file - promoters60/4767545
tccatt

SEQ ID NO: 58472 - DNA, 7 bp, Unknown
  misc_feature (1)..( 7): Matrix.003 file - promoters60/4767545
ttttatg

SEQ ID NO: 58473 - DNA, 7 bp, Unknown
  misc_feature (1)..( 7): Matrix.003 file - promoters60/4767545
tttcaaa

SEQ ID NO: 58474 - DNA, 7 bp, Unknown
  misc_feature (1)..( 7): Matrix.003 file - promoters60/4767545
aaaatgt

SEQ ID NO: 58475 - DNA, 8 bp, Unknown
  misc_feature (1)..( 8): Matrix.003 file - promoters60/4767545
atgaaaag

SEQ ID NO: 58476 - DNA, 7 bp, Unknown
  misc_feature (1)..( 7): Matrix.003 file - promoters60/4767545
ataagtt

SEQ ID NO: 58477 - DNA, 7 bp, Unknown
  misc_feature (1)..( 7): Matrix.003 file - promoters60/4767545
ctttctt

SEQ ID NO: 58478 - DNA, 7 bp, Unknown
  misc_feature (1)..( 7): Matrix.003 file - promoters60/4767545
ctcatct

SEQ ID NO: 58479 - DNA, 8 bp, Unknown
  misc_feature (1)..( 8): Matrix.003 file - promoters60/4767545
attaaaaa

SEQ ID NO: 58480 - DNA, 6 bp, Unknown
  misc_feature (1)..( 6): Matrix.003 file - promoters60/4767545
tgatta

SEQ ID NO: 58481 - DNA, 7 bp, Unknown
  misc_feature (1)..( 7): Matrix.003 file - promoters60/4767545
atgcgga

SEQ ID NO: 58482 - DNA, 8 bp, Unknown
  misc_feature (1)..( 8): Matrix.003 file - promoters60/4767545
aaaataaa

SEQ ID NO: 58483 - DNA, 8 bp, Unknown
  misc_feature (1)..( 8): Matrix.003 file - promoters60/4767545
atgaaaag

SEQ ID NO: 58484 - DNA, 7 bp, Unknown
  misc_feature (1)..( 7): Matrix.003 file - promoters60/4767545
aaacaaa

SEQ ID NO: 58485 - DNA, 7 bp, Unknown
  misc_feature (1)..( 7): Matrix.003 file - promoters60/4767545
aatccaa

SEQ ID NO: 58486 - DNA, 6 bp, Unknown
  misc_feature (1)..( 6): Matrix.003 file - promoters60/4767545
aaataa

SEQ ID NO: 58487 - DNA, 7 bp, Unknown
  misc_feature (1)..( 7): Matrix.003 file - promoters60/4767545
aaaaaat

SEQ ID NO: 58488 - DNA, 7 bp, Unknown
  misc_feature (1)..( 7): Matrix.003 file - promoters60/4767545
caaaatc

SEQ ID NO: 58489 - DNA, 6 bp, Unknown
  misc_feature (1)..( 6): Matrix.003 file - promoters60/4767545
cttctc

SEQ ID NO: 58490 - DNA, 6 bp, Unknown
  misc_feature (1)..( 6): Matrix.003 file - promoters60/4767545
gagttt

SEQ ID NO: 58491 - DNA, 6 bp, Unknown
  misc_feature (1)..( 6): Matrix.003 file - promoters60/4767545
tttcga

SEQ ID NO: 58492 - DNA, 8 bp, Unknown
  misc_feature (1)..( 8): Matrix.003 file - promoters60/4767552
aacaaaaa

SEQ ID NO: 58493 - DNA, 7 bp, Unknown
  misc_feature (1)..( 7): Matrix.003 file - promoters60/4767552
taacaaa

SEQ ID NO: 58494 - DNA, 7 bp, Unknown
  misc_feature (1)..( 7): Matrix.003 file - promoters60/4767552
aaaagtg

SEQ ID NO: 58495 - DNA, 13 bp, Unknown
  misc_feature (1)..( 13): Matrix.003 file - promoters60/4767552
ataatactaaaat

SEQ ID NO: 58496 - DNA, 7 bp, Unknown
  misc_feature (1)..( 7): Matrix.003 file - promoters60/4767552
caaacta

SEQ ID NO: 58497 - DNA, 10 bp, Unknown
  misc_feature (1)..( 10): Matrix.003 file - promoters60/4767552
atatcataaa

SEQ ID NO: 58498 - DNA, 6 bp, Unknown
  misc_feature (1)..( 6): Matrix.003 file - promoters60/4767552
tcagag

SEQ ID NO: 58499 - DNA, 6 bp, Unknown
  misc_feature (1)..( 6): Matrix.003 file - promoters60/4767552
tcattt

SEQ ID NO: 58500 - DNA, 9 bp, Unknown
  misc_feature (1)..( 9): Matrix.003 file - promoters60/4767552
ttgtaagtg

SEQ ID NO: 58501 - DNA, 6 bp, Unknown
  misc_feature (1)..( 6): Matrix.003 file - promoters60/4767552
cataga

SEQ ID NO: 58502 - DNA, 6 bp, Unknown
  misc_feature (1)..( 6): Matrix.003 file - promoters60/4767552
ataaaa

SEQ ID NO: 58503 - DNA, 6 bp, Unknown
  misc_feature (1)..( 6): Matrix.003 file - promoters60/4767552
taggtt

SEQ ID NO: 58504 - DNA, 7 bp, Unknown
  misc_feature (1)..( 7): Matrix.003 file - promoters60/4767552
agaaata

SEQ ID NO: 58505 - DNA, 7 bp, Unknown
  misc_feature (1)..( 7): Matrix.003 file - promoters60/4767552
tcaaaat

SEQ ID NO: 58506 - DNA, 6 bp, Unknown
  misc_feature (1)..( 6): Matrix.003 file - promoters60/4767552
atttct

SEQ ID NO: 58507 - DNA, 8 bp, Unknown
  misc_feature (1)..( 8): Matrix.003 file - promoters60/4767552
tgtcaact

SEQ ID NO: 58508 - DNA, 7 bp, Unknown
  misc_feature (1)..( 7): Matrix.003 file - promoters60/4767552
tcaagag

SEQ ID NO: 58509 - DNA, 10 bp, Unknown
  misc_feature (1)..( 10): Matrix.003 file - promoters60/4767578
taatttatct

SEQ ID NO: 58510 - DNA, 11 bp, Unknown
  misc_feature (1)..( 11): Matrix.003 file - promoters60/4767578
aacaaaatgta

SEQ ID NO: 58511 - DNA, 9 bp, Unknown
  misc_feature (1)..( 9): Matrix.003 file - promoters60/4767578
tgtattcat

SEQ ID NO: 58512 - DNA, 6 bp, Unknown
  misc_feature (1)..( 6): Matrix.003 file - promoters60/4767578
aaattt

SEQ ID NO: 58513 - DNA, 6 bp, Unknown
  misc_feature (1)..( 6): Matrix.003 file - promoters60/4767578
aaatca

SEQ ID NO: 58514 - DNA, 7 bp, Unknown
  misc_feature (1)..( 7): Matrix.003 file - promoters60/4767578
aatgtat

SEQ ID NO: 58515 - DNA, 7 bp, Unknown
  misc_feature (1)..( 7): Matrix.003 file - promoters60/4767578
aatgaca

SEQ ID NO: 58516 - DNA, 8 bp, Unknown
  misc_feature (1)..( 8): Matrix.003 file - promoters60/4767578
tactatat

SEQ ID NO: 58517 - DNA, 6 bp, Unknown
  misc_feature (1)..( 6): Matrix.003 file - promoters60/4767578
ttatat

SEQ ID NO: 58518 - DNA, 7 bp, Unknown
  misc_feature (1)..( 7): Matrix.003 file - promoters60/4767578
aaaaaaa

SEQ ID NO: 58519 - DNA, 8 bp, Unknown
  misc_feature (1)..( 8): Matrix.003 file - promoters60/4767578
aagaaaaa

SEQ ID NO: 58520 - DNA, 6 bp, Unknown
  misc_feature (1)..( 6): Matrix.003 file - promoters60/4767578
tcttct

SEQ ID NO: 58521 - DNA, 6 bp, Unknown
  misc_feature (1)..( 6): Matrix.003 file - promoters60/4767578
ttctct

SEQ ID NO: 58522 - DNA, 7 bp, Unknown
  misc_feature (1)..( 7): Matrix.003 file - promoters60/4767578
aattttg

SEQ ID NO: 58523 - DNA, 7 bp, Unknown
  misc_feature (1)..( 7): Matrix.003 file - promoters60/4767578
atatcat

SEQ ID NO: 58524 - DNA, 8 bp, Unknown
  misc_feature (1)..( 8): Matrix.003 file - promoters60/4767578
gtcactta

SEQ ID NO: 58525 - DNA, 7 bp, Unknown
  misc_feature (1)..( 7): Matrix.003 file - promoters60/4767578
tcgaaat

SEQ ID NO: 58526 - DNA, 6 bp, Unknown
  misc_feature (1)..( 6): Matrix.003 file - promoters60/4767610
aatatt

SEQ ID NO: 58527 - DNA, 7 bp, Unknown
  misc_feature (1)..( 7): Matrix.003 file - promoters60/4767610
atggagt

SEQ ID NO: 58528 - DNA, 7 bp, Unknown
  misc_feature (1)..( 7): Matrix.003 file - promoters60/4767610
acgtgta

SEQ ID NO: 58529 - DNA, 10 bp, Unknown
  misc_feature (1)..( 10): Matrix.003 file - promoters60/4767610
aactatacaa

SEQ ID NO: 58530 - DNA, 7 bp, Unknown
  misc_feature (1)..( 7): Matrix.003 file - promoters60/4767610
tgtatac

SEQ ID NO: 58531 - DNA, 8 bp, Unknown
  misc_feature (1)..( 8): Matrix.003 file - promoters60/4767610
tattttaa

SEQ ID NO: 58532 - DNA, 6 bp, Unknown
  misc_feature (1)..( 6): Matrix.003 file - promoters60/4767610
aagaca

SEQ ID NO: 58533 - DNA, 9 bp, Unknown
  misc_feature (1)..( 9): Matrix.003 file - promoters60/4767610
cttaattat

SEQ ID NO: 58534 - DNA, 13 bp, Unknown
  misc_feature (1)..( 13): Matrix.003 file - promoters60/4767610
tatacagtataca

SEQ ID NO: 58535 - DNA, 6 bp, Unknown
  misc_feature (1)..( 6): Matrix.003 file - promoters60/4767610
taataa

SEQ ID NO: 58536 - DNA, 6 bp, Unknown
  misc_feature (1)..( 6): Matrix.003 file - promoters60/4767610
ttttat

SEQ ID NO: 58537 - DNA, 6 bp, Unknown
  misc_feature (1)..( 6): Matrix.003 file - promoters60/4767610
tatata

SEQ ID NO: 58538 - DNA, 8 bp, Unknown
  misc_feature (1)..( 8): Matrix.003 file - promoters60/4767610
accaacca

SEQ ID NO: 58539 - DNA, 7 bp, Unknown
  misc_feature (1)..( 7): Matrix.003 file - promoters60/4767610
atataat

SEQ ID NO: 58540 - DNA, 6 bp, Unknown
  misc_feature (1)..( 6): Matrix.003 file - promoters60/4767610
aatcca

SEQ ID NO: 58541 - DNA, 8 bp, Unknown
  misc_feature (1)..( 8): Matrix.003 file - promoters60/4767610
aaaaaatg

SEQ ID NO: 58542 - DNA, 10 bp, Unknown
  misc_feature (1)..( 10): Matrix.003 file - promoters60/4767638
ttataattaa

SEQ ID NO: 58543 - DNA, 9 bp, Unknown
  misc_feature (1)..( 9): Matrix.003 file - promoters60/4767638
acaataaaa

SEQ ID NO: 58544 - DNA, 6 bp, Unknown
  misc_feature (1)..( 6): Matrix.003 file - promoters60/4767659
gaaaaa

SEQ ID NO: 58545 - DNA, 6 bp, Unknown
  misc_feature (1)..( 6): Matrix.003 file - promoters60/4767659
aaaata

SEQ ID NO: 58546 - DNA, 7 bp, Unknown
  misc_feature (1)..( 7): Matrix.003 file - promoters60/4767659
tcaaata

SEQ ID NO: 58547 - DNA, 7 bp, Unknown
  misc_feature (1)..( 7): Matrix.003 file - promoters60/4767659
ttgtaag

SEQ ID NO: 58548 - DNA, 7 bp, Unknown
  misc_feature (1)..( 7): Matrix.003 file - promoters60/4767659
attttag

SEQ ID NO: 58549 - DNA, 8 bp, Unknown
  misc_feature (1)..( 8): Matrix.003 file - promoters60/4767659
aaaaggaa

SEQ ID NO: 58550 - DNA, 7 bp, Unknown
  misc_feature (1)..( 7): Matrix.003 file - promoters60/4767659
ttagttg

SEQ ID NO: 58551 - DNA, 8 bp, Unknown
  misc_feature (1)..( 8): Matrix.003 file - promoters60/4767659
aaagcctt

SEQ ID NO: 58552 - DNA, 6 bp, Unknown
  misc_feature (1)..( 6): Matrix.003 file - promoters60/4767659
aaaatt

SEQ ID NO: 58553 - DNA, 7 bp, Unknown
  misc_feature (1)..( 7): Matrix.003 file - promoters60/4767659
cttatca

SEQ ID NO: 58554 - DNA, 6 bp, Unknown
  misc_feature (1)..( 6): Matrix.003 file - promoters60/4767659
gagaag

SEQ ID NO: 58555 - DNA, 7 bp, Unknown
  misc_feature (1)..( 7): Matrix.003 file - promoters60/4767659
acatgaa

SEQ ID NO: 58556 - DNA, 6 bp, Unknown
  misc_feature (1)..( 6): Matrix.003 file - promoters60/4767659
cctaat

SEQ ID NO: 58557 - DNA, 6 bp, Unknown
  misc_feature (1)..( 6): Matrix.003 file - promoters60/4767659
acaagt

SEQ ID NO: 58558 - DNA, 6 bp, Unknown
  misc_feature (1)..( 6): Matrix.003 file - promoters60/4767659
ttctgt

SEQ ID NO: 58559 - DNA, 9 bp, Unknown
  misc_feature (1)..( 9): Matrix.003 file - promoters60/4767659
ggcaagaaa

SEQ ID NO: 58560 - DNA, 8 bp, Unknown
  misc_feature (1)..( 8): Matrix.003 file - promoters60/4767659
agtgacta

SEQ ID NO: 58561 - DNA, 7 bp, Unknown
  misc_feature (1)..( 7): Matrix.003 file - promoters60/4767659
ttcatat

SEQ ID NO: 58562 - DNA, 8 bp, Unknown
  misc_feature (1)..( 8): Matrix.003 file - promoters60/4767663
aatgaaaa

SEQ ID NO: 58563 - DNA, 9 bp, Unknown
  misc_feature (1)..( 9): Matrix.003 file - promoters60/4767663
atatatata

SEQ ID NO: 58564 - DNA, 11 bp, Unknown
  misc_feature (1)..( 11): Matrix.003 file - promoters60/4767663
tatacaaaaac

SEQ ID NO: 58565 - DNA, 12 bp, Unknown
  misc_feature (1)..( 12): Matrix.003 file - promoters60/4767663
aaaaattttgag

SEQ ID NO: 58566 - DNA, 14 bp, Unknown
  misc_feature (1)..( 14): Matrix.003 file - promoters60/4767663
taagataagtttaa

SEQ ID NO: 58567 - DNA, 6 bp, Unknown
  misc_feature (1)..( 6): Matrix.003 file - promoters60/4767679
agacaa

SEQ ID NO: 58568 - DNA, 7 bp, Unknown
  misc_feature (1)..( 7): Matrix.003 file - promoters60/4767679
taaaagt

SEQ ID NO: 58569 - DNA, 8 bp, Unknown
  misc_feature (1)..( 8): Matrix.003 file - promoters60/4767679
ggactatt

SEQ ID NO: 58570 - DNA, 8 bp, Unknown
  misc_feature (1)..( 8): Matrix.003 file - promoters60/4767679
aacaatca

SEQ ID NO: 58571 - DNA, 8 bp, Unknown
  misc_feature (1)..( 8): Matrix.003 file - promoters60/4767679
tataaata

SEQ ID NO: 58572 - DNA, 6 bp, Unknown
  misc_feature (1)..( 6): Matrix.003 file - promoters60/4767679
atatca

SEQ ID NO: 58573 - DNA, 6 bp, Unknown
  misc_feature (1)..( 6): Matrix.003 file - promoters60/4767679
ttttct

SEQ ID NO: 58574 - DNA, 6 bp, Unknown
  misc_feature (1)..( 6): Matrix.003 file - promoters60/4767679
aaaaaa

SEQ ID NO: 58575 - DNA, 10 bp, Unknown
  misc_feature (1)..( 10): Matrix.003 file - promoters60/4767679
caaaaaatta

SEQ ID NO: 58576 - DNA, 14 bp, Unknown
  misc_feature (1)..( 14): Matrix.003 file - promoters60/4767679
aaaaagaaaaaaaa

SEQ ID NO: 58577 - DNA, 9 bp, Unknown
  misc_feature (1)..( 9): Matrix.003 file - promoters60/4767679
ggttaaaat

SEQ ID NO: 58578 - DNA, 7 bp, Unknown
  misc_feature (1)..( 7): Matrix.003 file - promoters60/4767679
caataat

SEQ ID NO: 58579 - DNA, 6 bp, Unknown
  misc_feature (1)..( 6): Matrix.003 file - promoters60/4767679
agaaat

SEQ ID NO: 58580 - DNA, 6 bp, Unknown
  misc_feature (1)..( 6): Matrix.003 file - promoters60/4767679
aataga

SEQ ID NO: 58581 - DNA, 7 bp, Unknown
  misc_feature (1)..( 7): Matrix.003 file - promoters60/4767679
tatgtca

SEQ ID NO: 58582 - DNA, 7 bp, Unknown
  misc_feature (1)..( 7): Matrix.003 file - promoters60/4767679
acaagga

SEQ ID NO: 58583 - DNA, 6 bp, Unknown
  misc_feature (1)..( 6): Matrix.003 file - promoters60/4767679
taattt

SEQ ID NO: 58584 - DNA, 7 bp, Unknown
  misc_feature (1)..( 7): Matrix.003 file - promoters60/4767679
tttatga

SEQ ID NO: 58585 - DNA, 6 bp, Unknown
  misc_feature (1)..( 6): Matrix.003 file - promoters60/4767679
atgaaa

SEQ ID NO: 58586 - DNA, 8 bp, Unknown
  misc_feature (1)..( 8): Matrix.003 file - promoters60/4767679
aaaaacaa

SEQ ID NO: 58587 - DNA, 6 bp, Unknown
  misc_feature (1)..( 6): Matrix.003 file - promoters60/4767679
ttaatg

SEQ ID NO: 58588 - DNA, 12 bp, Unknown
  misc_feature (1)..( 12): Matrix.003 file - promoters60/4767683
tatataaaaaga

SEQ ID NO: 58589 - DNA, 11 bp, Unknown
  misc_feature (1)..( 11): Matrix.003 file - promoters60/4767683
aaaaagaaatg

SEQ ID NO: 58590 - DNA, 9 bp, Unknown
  misc_feature (1)..( 9): Matrix.003 file - promoters60/4767683
aaagaagag

SEQ ID NO: 58591 - DNA, 16 bp, Unknown
  misc_feature (1)..( 16): Matrix.003 file - promoters60/4767683
tgagtagtgtaaaata

SEQ ID NO: 58592 - DNA, 8 bp, Unknown
  misc_feature (1)..( 8): Matrix.003 file - promoters60/4767683
attagact

SEQ ID NO: 58593 - DNA, 9 bp, Unknown
  misc_feature (1)..( 9): Matrix.003 file - promoters60/4767701
aattgttac

SEQ ID NO: 58594 - DNA, 9 bp, Unknown
  misc_feature (1)..( 9): Matrix.003 file - promoters60/4767705
ataataatt

SEQ ID NO: 58595 - DNA, 13 bp, Unknown
  misc_feature (1)..( 13): Matrix.003 file - promoters60/4767705
ttatatttttaaa

SEQ ID NO: 58596 - DNA, 7 bp, Unknown
  misc_feature (1)..( 7): Matrix.003 file - promoters60/4767705
ttaaaaa

SEQ ID NO: 58597 - DNA, 9 bp, Unknown
  misc_feature (1)..( 9): Matrix.003 file - promoters60/4767705
aaaaattga

SEQ ID NO: 58598 - DNA, 10 bp, Unknown
  misc_feature (1)..( 10): Matrix.003 file - promoters60/4767705
aaatgaaaaa

SEQ ID NO: 58599 - DNA, 10 bp, Unknown
  misc_feature (1)..( 10): Matrix.003 file - promoters60/4767705
aatttatctg

SEQ ID NO: 58600 - DNA, 7 bp, Unknown
  misc_feature (1)..( 7): Matrix.003 file - promoters60/4767705
attggat

SEQ ID NO: 58601 - DNA, 8 bp, Unknown
  misc_feature (1)..( 8): Matrix.003 file - promoters60/4767705
gataaaaa

SEQ ID NO: 58602 - DNA, 7 bp, Unknown
  misc_feature (1)..( 7): Matrix.003 file - promoters60/4767705
attattt

SEQ ID NO: 58603 - DNA, 8 bp, Unknown
  misc_feature (1)..( 8): Matrix.003 file - promoters60/4767705
taaaaaat

SEQ ID NO: 58604 - DNA, 6 bp, Unknown
  misc_feature (1)..( 6): Matrix.003 file - promoters60/4767705
aagaaa

SEQ ID NO: 58605 - DNA, 8 bp, Unknown
  misc_feature (1)..( 8): Matrix.003 file - promoters60/4767705
aaatgtaa

SEQ ID NO: 58606 - DNA, 9 bp, Unknown
  misc_feature (1)..( 9): Matrix.003 file - promoters60/4767715
tttggtaaa

SEQ ID NO: 58607 - DNA, 8 bp, Unknown
  misc_feature (1)..( 8): Matrix.003 file - promoters60/4767715
aaagttaa

SEQ ID NO: 58608 - DNA, 7 bp, Unknown
  misc_feature (1)..( 7): Matrix.003 file - promoters60/4767715
tttttaa

SEQ ID NO: 58609 - DNA, 11 bp, Unknown
  misc_feature (1)..( 11): Matrix.003 file - promoters60/4767715
aaaaaaaacaa

SEQ ID NO: 58610 - DNA, 9 bp, Unknown
  misc_feature (1)..( 9): Matrix.003 file - promoters60/4767715
aaacaaaaa

SEQ ID NO: 58611 - DNA, 6 bp, Unknown
  misc_feature (1)..( 6): Matrix.003 file - promoters60/4767715
actttt

SEQ ID NO: 58612 - DNA, 6 bp, Unknown
  misc_feature (1)..( 6): Matrix.003 file - promoters60/4767715
gaaaat

SEQ ID NO: 58613 - DNA, 6 bp, Unknown
  misc_feature (1)..( 6): Matrix.003 file - promoters60/4767715
gtttga

SEQ ID NO: 58614 - DNA, 9 bp, Unknown
  misc_feature (1)..( 9): Matrix.003 file - promoters60/4767715
attttgttg

SEQ ID NO: 58615 - DNA, 6 bp, Unknown
  misc_feature (1)..( 6): Matrix.003 file - promoters60/4767715
gttgtg

SEQ ID NO: 58616 - DNA, 7 bp, Unknown
  misc_feature (1)..( 7): Matrix.003 file - promoters60/4767715
aaaagtt

SEQ ID NO: 58617 - DNA, 7 bp, Unknown
  misc_feature (1)..( 7): Matrix.003 file - promoters60/4767715
gtattat

SEQ ID NO: 58618 - DNA, 10 bp, Unknown
  misc_feature (1)..( 10): Matrix.003 file - promoters60/4767715
acctgctcat

SEQ ID NO: 58619 - DNA, 7 bp, Unknown
  misc_feature (1)..( 7): Matrix.003 file - promoters60/4767715
ttcttct

SEQ ID NO: 58620 - DNA, 8 bp, Unknown
  misc_feature (1)..( 8): Matrix.003 file - promoters60/4767748
caaaacaa

SEQ ID NO: 58621 - DNA, 7 bp, Unknown
  misc_feature (1)..( 7): Matrix.003 file - promoters60/4767764
gcaaaag

SEQ ID NO: 58622 - DNA, 7 bp, Unknown
  misc_feature (1)..( 7): Matrix.003 file - promoters60/4767764
tttaaaa

SEQ ID NO: 58623 - DNA, 7 bp, Unknown
  misc_feature (1)..( 7): Matrix.003 file - promoters60/4767764
aaacatt

SEQ ID NO: 58624 - DNA, 7 bp, Unknown
  misc_feature (1)..( 7): Matrix.003 file - promoters60/4767764
tcaaatt

SEQ ID NO: 58625 - DNA, 6 bp, Unknown
  misc_feature (1)..( 6): Matrix.003 file - promoters60/4767764
aaaata

SEQ ID NO: 58626 - DNA, 7 bp, Unknown
  misc_feature (1)..( 7): Matrix.003 file - promoters60/4767764
tgagacg

SEQ ID NO: 58627 - DNA, 8 bp, Unknown
  misc_feature (1)..( 8): Matrix.003 file - promoters60/4767764
gaaaaagg

SEQ ID NO: 58628 - DNA, 6 bp, Unknown
  misc_feature (1)..( 6): Matrix.003 file - promoters60/4767764
aagcaa

SEQ ID NO: 58629 - DNA, 15 bp, Unknown
  misc_feature (1)..( 15): Matrix.003 file - promoters60/4767764
aaattggatacatat

SEQ ID NO: 58630 - DNA, 9 bp, Unknown
  misc_feature (1)..( 9): Matrix.003 file - promoters60/4767764
ttaatattt

SEQ ID NO: 58631 - DNA, 6 bp, Unknown
  misc_feature (1)..( 6): Matrix.003 file - promoters60/4767764
acaaaa

SEQ ID NO: 58632 - DNA, 8 bp, Unknown
  misc_feature (1)..( 8): Matrix.003 file - promoters60/4767764
aagtcaaa

SEQ ID NO: 58633 - DNA, 9 bp, Unknown
  misc_feature (1)..( 9): Matrix.003 file - promoters60/4767764
taatgctac

SEQ ID NO: 58634 - DNA, 8 bp, Unknown
  misc_feature (1)..( 8): Matrix.003 file - promoters60/4767764
tatattac

SEQ ID NO: 58635 - DNA, 6 bp, Unknown
  misc_feature (1)..( 6): Matrix.003 file - promoters60/4767764
tatttt

SEQ ID NO: 58636 - DNA, 6 bp, Unknown
  misc_feature (1)..( 6): Matrix.003 file - promoters60/4767764
gaacat

SEQ ID NO: 58637 - DNA, 6 bp, Unknown
  misc_feature (1)..( 6): Matrix.003 file - promoters60/4767764
tttata

SEQ ID NO: 58638 - DNA, 8 bp, Unknown
  misc_feature (1)..( 8): Matrix.003 file - promoters60/4767764
aatcttta

SEQ ID NO: 58639 - DNA, 6 bp, Unknown
  misc_feature (1)..( 6): Matrix.003 file - promoters60/4767764
aacaac

SEQ ID NO: 58640 - DNA, 8 bp, Unknown
  misc_feature (1)..( 8): Matrix.003 file - promoters60/4767764
gtaataat

SEQ ID NO: 58641 - DNA, 8 bp, Unknown
  misc_feature (1)..( 8): Matrix.003 file - promoters60/4767767
aacattat

SEQ ID NO: 58642 - DNA, 9 bp, Unknown
  misc_feature (1)..( 9): Matrix.003 file - promoters60/4767767
actaaaata

SEQ ID NO: 58643 - DNA, 8 bp, Unknown
  misc_feature (1)..( 8): Matrix.003 file - promoters60/4767767
aatctata

SEQ ID NO: 58644 - DNA, 7 bp, Unknown
  misc_feature (1)..( 7): Matrix.003 file - promoters60/4767767
aatgcaa

SEQ ID NO: 58645 - DNA, 6 bp, Unknown
  misc_feature (1)..( 6): Matrix.003 file - promoters60/4767767
atcaca

SEQ ID NO: 58646 - DNA, 7 bp, Unknown
  misc_feature (1)..( 7): Matrix.003 file - promoters60/4767767
ttgaaaa

SEQ ID NO: 58647 - DNA, 7 bp, Unknown
  misc_feature (1)..( 7): Matrix.003 file - promoters60/4767767
aacctta

SEQ ID NO: 58648 - DNA, 9 bp, Unknown
  misc_feature (1)..( 9): Matrix.003 file - promoters60/4767767
catgaatat

SEQ ID NO: 58649 - DNA, 7 bp, Unknown
  misc_feature (1)..( 7): Matrix.003 file - promoters60/4767767
ttagaat

SEQ ID NO: 58650 - DNA, 8 bp, Unknown
  misc_feature (1)..( 8): Matrix.003 file - promoters60/4767767
tttgaagt

SEQ ID NO: 58651 - DNA, 7 bp, Unknown
  misc_feature (1)..( 7): Matrix.003 file - promoters60/4767767
acaaaaa

SEQ ID NO: 58652 - DNA, 6 bp, Unknown
  misc_feature (1)..( 6): Matrix.003 file - promoters60/4767767
aagcat

SEQ ID NO: 58653 - DNA, 7 bp, Unknown
  misc_feature (1)..( 7): Matrix.003 file - promoters60/4767767
ctaaatt

SEQ ID NO: 58654 - DNA, 6 bp, Unknown
  misc_feature (1)..( 6): Matrix.003 file - promoters60/4767767
aataaa

SEQ ID NO: 58655 - DNA, 10 bp, Unknown
  misc_feature (1)..( 10): Matrix.003 file - promoters60/4767767
aaacaaaaaa

SEQ ID NO: 58656 - DNA, 6 bp, Unknown
  misc_feature (1)..( 6): Matrix.003 file - promoters60/4767767
tttcaa

SEQ ID NO: 58657 - DNA, 6 bp, Unknown
  misc_feature (1)..( 6): Matrix.003 file - promoters60/4767767
aaaatg

SEQ ID NO: 58658 - DNA, 6 bp, Unknown
  misc_feature (1)..( 6): Matrix.003 file - promoters60/4767767
gaaatt

SEQ ID NO: 58659 - DNA, 8 bp, Unknown
  misc_feature (1)..( 8): Matrix.003 file - promoters60/4767767
aattaagc

SEQ ID NO: 58660 - DNA, 7 bp, Unknown
  misc_feature (1)..( 7): Matrix.003 file - promoters60/4767767
aatattt

SEQ ID NO: 58661 - DNA, 8 bp, Unknown
  misc_feature (1)..( 8): Matrix.003 file - promoters60/4767767
aaccctag

SEQ ID NO: 58662 - DNA, 9 bp, Unknown
  misc_feature (1)..( 9): Matrix.003 file - promoters60/4767767
ttatggata

SEQ ID NO: 58663 - DNA, 11 bp, Unknown
  misc_feature (1)..( 11): Matrix.003 file - promoters60/4767795
aaaatcataat

SEQ ID NO: 58664 - DNA, 10 bp, Unknown
  misc_feature (1)..( 10): Matrix.003 file - promoters60/4767795
tgattagtta

SEQ ID NO: 58665 - DNA, 8 bp, Unknown
  misc_feature (1)..( 8): Matrix.003 file - promoters60/4767795
ttagaaat

SEQ ID NO: 58666 - DNA, 6 bp, Unknown
  misc_feature (1)..( 6): Matrix.003 file - promoters60/4767795
atattt

SEQ ID NO: 58667 - DNA, 6 bp, Unknown
  misc_feature (1)..( 6): Matrix.003 file - promoters60/4767795
ttccaa

SEQ ID NO: 58668 - DNA, 6 bp, Unknown
  misc_feature (1)..( 6): Matrix.003 file - promoters60/4767795
catttt

SEQ ID NO: 58669 - DNA, 8 bp, Unknown
  misc_feature (1)..( 8): Matrix.003 file - promoters60/4767795
tttcttaa

SEQ ID NO: 58670 - DNA, 7 bp, Unknown
  misc_feature (1)..( 7): Matrix.003 file - promoters60/4767795
aagaaac

SEQ ID NO: 58671 - DNA, 7 bp, Unknown
  misc_feature (1)..( 7): Matrix.003 file - promoters60/4767795
ctctata

SEQ ID NO: 58672 - DNA, 8 bp, Unknown
  misc_feature (1)..( 8): Matrix.003 file - promoters60/4767795
gttaaatt

SEQ ID NO: 58673 - DNA, 10 bp, Unknown
  misc_feature (1)..( 10): Matrix.003 file - promoters60/4767795
tttccaattt

SEQ ID NO: 58674 - DNA, 7 bp, Unknown
  misc_feature (1)..( 7): Matrix.003 file - promoters60/4767795
ttgattc

SEQ ID NO: 58675 - DNA, 7 bp, Unknown
  misc_feature (1)..( 7): Matrix.003 file - promoters60/4767795
aaaaaaa

SEQ ID NO: 58676 - DNA, 6 bp, Unknown
  misc_feature (1)..( 6): Matrix.003 file - promoters60/4767795
aaaata

SEQ ID NO: 58677 - DNA, 8 bp, Unknown
  misc_feature (1)..( 8): Matrix.003 file - promoters60/4767795
ttacagtt

SEQ ID NO: 58678 - DNA, 12 bp, Unknown
  misc_feature (1)..( 12): Matrix.003 file - promoters60/4767837
acaaaaaacaat

SEQ ID NO: 58679 - DNA, 9 bp, Unknown
  misc_feature (1)..( 9): Matrix.003 file - promoters60/4767837
ttcttcaat

SEQ ID NO: 58680 - DNA, 13 bp, Unknown
  misc_feature (1)..( 13): Matrix.003 file - promoters60/4767884
aagtctaaaatat

SEQ ID NO: 58681 - DNA, 10 bp, Unknown
  misc_feature (1)..( 10): Matrix.003 file - promoters60/4767884
ataaaaaaat

SEQ ID NO: 58682 - DNA, 12 bp, Unknown
  misc_feature (1)..( 12): Matrix.003 file - promoters60/4767884
aatatttgatac

SEQ ID NO: 58683 - DNA, 13 bp, Unknown
  misc_feature (1)..( 13): Matrix.003 file - promoters60/4767892
ttaaacgtgttta

SEQ ID NO: 58684 - DNA, 14 bp, Unknown
  misc_feature (1)..( 14): Matrix.003 file - promoters60/4767892
acattattacaaaa

SEQ ID NO: 58685 - DNA, 8 bp, Unknown
  misc_feature (1)..( 8): Matrix.003 file - promoters60/4767892
acaaacaa

SEQ ID NO: 58686 - DNA, 8 bp, Unknown
  misc_feature (1)..( 8): Matrix.003 file - promoters60/4767892
agaaaaaa

SEQ ID NO: 58687 - DNA, 8 bp, Unknown
  misc_feature (1)..( 8): Matrix.003 file - promoters60/4767892
tgtaaact

SEQ ID NO: 58688 - DNA, 14 bp, Unknown
  misc_feature (1)..( 14): Matrix.003 file - promoters60/4767892
attattacaaaaac

SEQ ID NO: 58689 - DNA, 6 bp, Unknown
  misc_feature (1)..( 6): Matrix.003 file - promoters60/4767933
aaccct

SEQ ID NO: 58690 - DNA, 6 bp, Unknown
  misc_feature (1)..( 6): Matrix.003 file - promoters60/4767933
gcccaa

SEQ ID NO: 58691 - DNA, 7 bp, Unknown
  misc_feature (1)..( 7): Matrix.003 file - promoters60/4767933
caaaaaa

SEQ ID NO: 58692 - DNA, 6 bp, Unknown
  misc_feature (1)..( 6): Matrix.003 file - promoters60/4767933
ttttca

SEQ ID NO: 58693 - DNA, 8 bp, Unknown
  misc_feature (1)..( 8): Matrix.003 file - promoters60/4767933
atccaaaa

SEQ ID NO: 58694 - DNA, 6 bp, Unknown
  misc_feature (1)..( 6): Matrix.003 file - promoters60/4767933
aatttc

SEQ ID NO: 58695 - DNA, 7 bp, Unknown
  misc_feature (1)..( 7): Matrix.003 file - promoters60/4767933
tatggac

SEQ ID NO: 58696 - DNA, 10 bp, Unknown
  misc_feature (1)..( 10): Matrix.003 file - promoters60/4767933
aaatggaaac

SEQ ID NO: 58697 - DNA, 7 bp, Unknown
  misc_feature (1)..( 7): Matrix.003 file - promoters60/4767933
agtgaaa

SEQ ID NO: 58698 - DNA, 8 bp, Unknown
  misc_feature (1)..( 8): Matrix.003 file - promoters60/4767933
agtcggta

SEQ ID NO: 58699 - DNA, 11 bp, Unknown
  misc_feature (1)..( 11): Matrix.003 file - promoters60/4767933
caatatggaaa

SEQ ID NO: 58700 - DNA, 8 bp, Unknown
  misc_feature (1)..( 8): Matrix.003 file - promoters60/4767933
attttgtc

SEQ ID NO: 58701 - DNA, 6 bp, Unknown
  misc_feature (1)..( 6): Matrix.003 file - promoters60/4767933
tttttg

SEQ ID NO: 58702 - DNA, 8 bp, Unknown
  misc_feature (1)..( 8): Matrix.003 file - promoters60/4767933
aagaaaat

SEQ ID NO: 58703 - DNA, 10 bp, Unknown
  misc_feature (1)..( 10): Matrix.003 file - promoters60/4767933
aaataaaaat

SEQ ID NO: 58704 - DNA, 6 bp, Unknown
  misc_feature (1)..( 6): Matrix.003 file - promoters60/4767933
aacaat

SEQ ID NO: 58705 - DNA, 9 bp, Unknown
  misc_feature (1)..( 9): Matrix.003 file - promoters60/4767944
agatacgaa

SEQ ID NO: 58706 - DNA, 9 bp, Unknown
  misc_feature (1)..( 9): Matrix.003 file - promoters60/4767944
tttgatttg

SEQ ID NO: 58707 - DNA, 6 bp, Unknown
  misc_feature (1)..( 6): Matrix.003 file - promoters60/4767944
ttacga

SEQ ID NO: 58708 - DNA, 7 bp, Unknown
  misc_feature (1)..( 7): Matrix.003 file - promoters60/4767944
ccaaaac

SEQ ID NO: 58709 - DNA, 8 bp, Unknown
  misc_feature (1)..( 8): Matrix.003 file - promoters60/4767944
caaaacct

SEQ ID NO: 58710 - DNA, 7 bp, Unknown
  misc_feature (1)..( 7): Matrix.003 file - promoters60/4767944
actgtag

SEQ ID NO: 58711 - DNA, 8 bp, Unknown
  misc_feature (1)..( 8): Matrix.003 file - promoters60/4767944
gatagatg

SEQ ID NO: 58712 - DNA, 8 bp, Unknown
  misc_feature (1)..( 8): Matrix.003 file - promoters60/4767944
aaaacatg

SEQ ID NO: 58713 - DNA, 7 bp, Unknown
  misc_feature (1)..( 7): Matrix.003 file - promoters60/4767944
aataaat

SEQ ID NO: 58714 - DNA, 7 bp, Unknown
  misc_feature (1)..( 7): Matrix.003 file - promoters60/4767944
tccaata

SEQ ID NO: 58715 - DNA, 9 bp, Unknown
  misc_feature (1)..( 9): Matrix.003 file - promoters60/4767944
tataaatca

SEQ ID NO: 58716 - DNA, 6 bp, Unknown
  misc_feature (1)..( 6): Matrix.003 file - promoters60/4767944
gaaaaa

SEQ ID NO: 58717 - DNA, 7 bp, Unknown
  misc_feature (1)..( 7): Matrix.003 file - promoters60/4767944
aatatat

SEQ ID NO: 58718 - DNA, 7 bp, Unknown
  misc_feature (1)..( 7): Matrix.003 file - promoters60/4767944
ccaaaac

SEQ ID NO: 58719 - DNA, 7 bp, Unknown
  misc_feature (1)..( 7): Matrix.003 file - promoters60/4767944
accaaat

SEQ ID NO: 58720 - DNA, 5 bp, Unknown
  misc_feature (1)..( 5): Matrix.003 file - promoters60/4767952
agaaa

SEQ ID NO: 58721 - DNA, 8 bp, Unknown
  misc_feature (1)..( 8): Matrix.003 file - promoters60/4767952
aaatgttg

SEQ ID NO: 58722 - DNA, 10 bp, Unknown
  misc_feature (1)..( 10): Matrix.003 file - promoters60/4767952
ataaataaaa

SEQ ID NO: 58723 - DNA, 9 bp, Unknown
  misc_feature (1)..( 9): Matrix.003 file - promoters60/4767952
tattaaatg

SEQ ID NO: 58724 - DNA, 9 bp, Unknown
  misc_feature (1)..( 9): Matrix.003 file - promoters60/4767952
ataaataaa

SEQ ID NO: 58725 - DNA, 11 bp, Unknown
  misc_feature (1)..( 11): Matrix.003 file - promoters60/4767952
aaaaaagaaag

SEQ ID NO: 58726 - DNA, 8 bp, Unknown
  misc_feature (1)..( 8): Matrix.003 file - promoters60/4767952
agaccaaa

SEQ ID NO: 58727 - DNA, 11 bp, Unknown
  misc_feature (1)..( 11): Matrix.003 file - promoters60/4767952
aaaatgttaac

SEQ ID NO: 58728 - DNA, 9 bp, Unknown
  misc_feature (1)..( 9): Matrix.003 file - promoters60/4767952
agatcaaat

SEQ ID NO: 58729 - DNA, 8 bp, Unknown
  misc_feature (1)..( 8): Matrix.003 file - promoters60/4767956
caaacata

SEQ ID NO: 58730 - DNA, 10 bp, Unknown
  misc_feature (1)..( 10): Matrix.003 file - promoters60/4767972
gaaaatgaaa

SEQ ID NO: 58731 - DNA, 11 bp, Unknown
  misc_feature (1)..( 11): Matrix.003 file - promoters60/4767972
gaaaatataca

SEQ ID NO: 58732 - DNA, 7 bp, Unknown
  misc_feature (1)..( 7): Matrix.003 file - promoters60/4767972
attaacc

SEQ ID NO: 58733 - DNA, 9 bp, Unknown
  misc_feature (1)..( 9): Matrix.003 file - promoters60/4767972
actttcata

SEQ ID NO: 58734 - DNA, 6 bp, Unknown
  misc_feature (1)..( 6): Matrix.003 file - promoters60/4767976
aacatt

SEQ ID NO: 58735 - DNA, 8 bp, Unknown
  misc_feature (1)..( 8): Matrix.003 file - promoters60/4767976
tgtattaa

SEQ ID NO: 58736 - DNA, 7 bp, Unknown
  misc_feature (1)..( 7): Matrix.003 file - promoters60/4767976
tttgtaa

SEQ ID NO: 58737 - DNA, 7 bp, Unknown
  misc_feature (1)..( 7): Matrix.003 file - promoters60/4767976
gaaaatt

SEQ ID NO: 58738 - DNA, 9 bp, Unknown
  misc_feature (1)..( 9): Matrix.003 file - promoters60/4767976
ttatcttcc

SEQ ID NO: 58739 - DNA, 8 bp, Unknown
  misc_feature (1)..( 8): Matrix.003 file - promoters60/4767976
attattgc

SEQ ID NO: 58740 - DNA, 7 bp, Unknown
  misc_feature (1)..( 7): Matrix.003 file - promoters60/4767976
aataagc

SEQ ID NO: 58741 - DNA, 6 bp, Unknown
  misc_feature (1)..( 6): Matrix.003 file - promoters60/4767976
taaagg

SEQ ID NO: 58742 - DNA, 7 bp, Unknown
  misc_feature (1)..( 7): Matrix.003 file - promoters60/4767976
aaagata

SEQ ID NO: 58743 - DNA, 7 bp, Unknown
  misc_feature (1)..( 7): Matrix.003 file - promoters60/4767976
tttcaat

SEQ ID NO: 58744 - DNA, 8 bp, Unknown
  misc_feature (1)..( 8): Matrix.003 file - promoters60/4767976
gttgggtc

SEQ ID NO: 58745 - DNA, 6 bp, Unknown
  misc_feature (1)..( 6): Matrix.003 file - promoters60/4767976
aacatt

SEQ ID NO: 58746 - DNA, 7 bp, Unknown
  misc_feature (1)..( 7): Matrix.003 file - promoters60/4767976
cactaaa

SEQ ID NO: 58747 - DNA, 6 bp, Unknown
  misc_feature (1)..( 6): Matrix.003 file - promoters60/4767976
ccatta

SEQ ID NO: 58748 - DNA, 7 bp, Unknown
  misc_feature (1)..( 7): Matrix.003 file - promoters60/4767976
gtatata

SEQ ID NO: 58749 - DNA, 6 bp, Unknown
  misc_feature (1)..( 6): Matrix.003 file - promoters60/4767976
agtaaa

SEQ ID NO: 58750 - DNA, 7 bp, Unknown
  misc_feature (1)..( 7): Matrix.003 file - promoters60/4767976
aatcggg

SEQ ID NO: 58751 - DNA, 8 bp, Unknown
  misc_feature (1)..( 8): Matrix.003 file - promoters60/4767976
gaaacaaa

SEQ ID NO: 58752 - DNA, 10 bp, Unknown
  misc_feature (1)..( 10): Matrix.003 file - promoters60/4767976
ggaaaagaaa

SEQ ID NO: 58753 - DNA, 7 bp, Unknown
  misc_feature (1)..( 7): Matrix.003 file - promoters60/4767976
cccacta

SEQ ID NO: 58754 - DNA, 9 bp, Unknown
  misc_feature (1)..( 9): Matrix.003 file - promoters60/4767976
aaagaaaag

SEQ ID NO: 58755 - DNA, 7 bp, Unknown
  misc_feature (1)..( 7): Matrix.003 file - promoters60/4767982
taaaaat

SEQ ID NO: 58756 - DNA, 9 bp, Unknown
  misc_feature (1)..( 9): Matrix.003 file - promoters60/4767982
atgtgttag

SEQ ID NO: 58757 - DNA, 6 bp, Unknown
  misc_feature (1)..( 6): Matrix.003 file - promoters60/4767986
aataat

SEQ ID NO: 58758 - DNA, 6 bp, Unknown
  misc_feature (1)..( 6): Matrix.003 file - promoters60/4767986
aataat

SEQ ID NO: 58759 - DNA, 6 bp, Unknown
  misc_feature (1)..( 6): Matrix.003 file - promoters60/4767986
aataat

SEQ ID NO: 58760 - DNA, 8 bp, Unknown
  misc_feature (1)..( 8): Matrix.003 file - promoters60/4767986
taaacaaa

SEQ ID NO: 58761 - DNA, 6 bp, Unknown
  misc_feature (1)..( 6): Matrix.003 file - promoters60/4767986
aatcaa

SEQ ID NO: 58762 - DNA, 6 bp, Unknown
  misc_feature (1)..( 6): Matrix.003 file - promoters60/4767986
tcttta

SEQ ID NO: 58763 - DNA, 6 bp, Unknown
  misc_feature (1)..( 6): Matrix.003 file - promoters60/4767986
tgtttc

SEQ ID NO: 58764 - DNA, 9 bp, Unknown
  misc_feature (1)..( 9): Matrix.003 file - promoters60/4767994
attttttca

SEQ ID NO: 58765 - DNA, 7 bp, Unknown
  misc_feature (1)..( 7): Matrix.003 file - promoters60/4767994
cttttta

SEQ ID NO: 58766 - DNA, 9 bp, Unknown
  misc_feature (1)..( 9): Matrix.003 file - promoters60/4767994
aaaaaaaaa

SEQ ID NO: 58767 - DNA, 11 bp, Unknown
  misc_feature (1)..( 11): Matrix.003 file - promoters60/4767994
aaagaaacaaa

SEQ ID NO: 58768 - DNA, 9 bp, Unknown
  misc_feature (1)..( 9): Matrix.003 file - promoters60/4768007
aaagataaa

SEQ ID NO: 58769 - DNA, 11 bp, Unknown
  misc_feature (1)..( 11): Matrix.003 file - promoters60/4768007
gaaataaaaaa

SEQ ID NO: 58770 - DNA, 10 bp, Unknown
  misc_feature (1)..( 10): Matrix.003 file - promoters60/4768007
tgtaaaacaa

SEQ ID NO: 58771 - DNA, 12 bp, Unknown
  misc_feature (1)..( 12): Matrix.003 file - promoters60/4768007
aaaatttcttta

SEQ ID NO: 58772 - DNA, 11 bp, Unknown
  misc_feature (1)..( 11): Matrix.003 file - promoters60/4768007
tcctttatata

SEQ ID NO: 58773 - DNA, 13 bp, Unknown
  misc_feature (1)..( 13): Matrix.003 file - promoters60/4768007
aaaaattaaaatt

SEQ ID NO: 58774 - DNA, 10 bp, Unknown
  misc_feature (1)..( 10): Matrix.003 file - promoters60/4768007
ttcataaaat

SEQ ID NO: 58775 - DNA, 7 bp, Unknown
  misc_feature (1)..( 7): Matrix.003 file - promoters60/4768007
aaacaaa

SEQ ID NO: 58776 - DNA, 9 bp, Unknown
  misc_feature (1)..( 9): Matrix.003 file - promoters60/4768007
aatatttaa

SEQ ID NO: 58777 - DNA, 11 bp, Unknown
  misc_feature (1)..( 11): Matrix.003 file - promoters60/4768007
gaaacaaaaaa

SEQ ID NO: 58778 - DNA, 9 bp, Unknown
  misc_feature (1)..( 9): Matrix.003 file - promoters60/4768039
atttctaaa

SEQ ID NO: 58779 - DNA, 10 bp, Unknown
  misc_feature (1)..( 10): Matrix.003 file - promoters60/4768039
tataatagat

SEQ ID NO: 58780 - DNA, 11 bp, Unknown
  misc_feature (1)..( 11): Matrix.003 file - promoters60/4768039
caaaaaaaaag

SEQ ID NO: 58781 - DNA, 10 bp, Unknown
  misc_feature (1)..( 10): Matrix.003 file - promoters60/4768039
tgcaactttg

SEQ ID NO: 58782 - DNA, 11 bp, Unknown
  misc_feature (1)..( 11): Matrix.003 file - promoters60/4768039
ttattatagat

SEQ ID NO: 58783 - DNA, 6 bp, Unknown
  misc_feature (1)..( 6): Matrix.003 file - promoters60/4768066
gataaa

SEQ ID NO: 58784 - DNA, 6 bp, Unknown
  misc_feature (1)..( 6): Matrix.003 file - promoters60/4768066
tttatt

SEQ ID NO: 58785 - DNA, 7 bp, Unknown
  misc_feature (1)..( 7): Matrix.003 file - promoters60/4768066
gttgtaa

SEQ ID NO: 58786 - DNA, 6 bp, Unknown
  misc_feature (1)..( 6): Matrix.003 file - promoters60/4768066
taacgt

SEQ ID NO: 58787 - DNA, 7 bp, Unknown
  misc_feature (1)..( 7): Matrix.003 file - promoters60/4768066
aaaataa

SEQ ID NO: 58788 - DNA, 10 bp, Unknown
  misc_feature (1)..( 10): Matrix.003 file - promoters60/4768066
taaaaaaaaa

SEQ ID NO: 58789 - DNA, 6 bp, Unknown
  misc_feature (1)..( 6): Matrix.003 file - promoters60/4768066
gtatat

SEQ ID NO: 58790 - DNA, 6 bp, Unknown
  misc_feature (1)..( 6): Matrix.003 file - promoters60/4768066
taaaca

SEQ ID NO: 58791 - DNA, 8 bp, Unknown
  misc_feature (1)..( 8): Matrix.003 file - promoters60/4768066
ggattagg

SEQ ID NO: 58792 - DNA, 6 bp, Unknown
  misc_feature (1)..( 6): Matrix.003 file - promoters60/4768066
ttttgt

SEQ ID NO: 58793 - DNA, 7 bp, Unknown
  misc_feature (1)..( 7): Matrix.003 file - promoters60/4768066
taattaa

SEQ ID NO: 58794 - DNA, 11 bp, Unknown
  misc_feature (1)..( 11): Matrix.003 file - promoters60/4768066
ttaactaaacc

SEQ ID NO: 58795 - DNA, 7 bp, Unknown
  misc_feature (1)..( 7): Matrix.003 file - promoters60/4768066
actaaac

SEQ ID NO: 58796 - DNA, 8 bp, Unknown
  misc_feature (1)..( 8): Matrix.003 file - promoters60/4768066
tctaaatt

SEQ ID NO: 58797 - DNA, 7 bp, Unknown
  misc_feature (1)..( 7): Matrix.003 file - promoters60/4768066
tagataa

SEQ ID NO: 58798 - DNA, 6 bp, Unknown
  misc_feature (1)..( 6): Matrix.003 file - promoters60/4768066
attaat

SEQ ID NO: 58799 - DNA, 6 bp, Unknown
  misc_feature (1)..( 6): Matrix.003 file - promoters60/4768066
agtaaa

SEQ ID NO: 58800 - DNA, 7 bp, Unknown
  misc_feature (1)..( 7): Matrix.003 file - promoters60/4768066
aatcggg

SEQ ID NO: 58801 - DNA, 8 bp, Unknown
  misc_feature (1)..( 8): Matrix.003 file - promoters60/4768066
gaaacaaa

SEQ ID NO: 58802 - DNA, 10 bp, Unknown
  misc_feature (1)..( 10): Matrix.003 file - promoters60/4768066
ggaaaagaaa

SEQ ID NO: 58803 - DNA, 7 bp, Unknown
  misc_feature (1)..( 7): Matrix.003 file - promoters60/4768066
cccacta

SEQ ID NO: 58804 - DNA, 9 bp, Unknown
  misc_feature (1)..( 9): Matrix.003 file - promoters60/4768066
aaagaaaag

SEQ ID NO: 58805 - DNA, 7 bp, Unknown
  misc_feature (1)..( 7): Matrix.003 file - promoters60/4768147
tcttttt

SEQ ID NO: 58806 - DNA, 13 bp, Unknown
  misc_feature (1)..( 13): Matrix.003 file - promoters60/4768147
caataatttttcc

SEQ ID NO: 58807 - DNA, 6 bp, Unknown
  misc_feature (1)..( 6): Matrix.003 file - promoters60/4768147
acattg

SEQ ID NO: 58808 - DNA, 7 bp, Unknown
  misc_feature (1)..( 7): Matrix.003 file - promoters60/4768147
tattata

SEQ ID NO: 58809 - DNA, 10 bp, Unknown
  misc_feature (1)..( 10): Matrix.003 file - promoters60/4768147
aaaacaataa

SEQ ID NO: 58810 - DNA, 6 bp, Unknown
  misc_feature (1)..( 6): Matrix.003 file - promoters60/4768147
acttga

SEQ ID NO: 58811 - DNA, 7 bp, Unknown
  misc_feature (1)..( 7): Matrix.003 file - promoters60/4768147
taggttg

SEQ ID NO: 58812 - DNA, 6 bp, Unknown
  misc_feature (1)..( 6): Matrix.003 file - promoters60/4768147
attttt

SEQ ID NO: 58813 - DNA, 7 bp, Unknown
  misc_feature (1)..( 7): Matrix.003 file - promoters60/4768147
caaaaaa

SEQ ID NO: 58814 - DNA, 8 bp, Unknown
  misc_feature (1)..( 8): Matrix.003 file - promoters60/4768147
tctaaaaa

SEQ ID NO: 58815 - DNA, 7 bp, Unknown
  misc_feature (1)..( 7): Matrix.003 file - promoters60/4768147
atagata

SEQ ID NO: 58816 - DNA, 7 bp, Unknown
  misc_feature (1)..( 7): Matrix.003 file - promoters60/4768147
atggaat

SEQ ID NO: 58817 - DNA, 7 bp, Unknown
  misc_feature (1)..( 7): Matrix.003 file - promoters60/4768147
accaaat

SEQ ID NO: 58818 - DNA, 6 bp, Unknown
  misc_feature (1)..( 6): Matrix.003 file - promoters60/4768147
aaaaaa

SEQ ID NO: 58819 - DNA, 6 bp, Unknown
  misc_feature (1)..( 6): Matrix.003 file - promoters60/4768147
gtcaaa

SEQ ID NO: 58820 - DNA, 6 bp, Unknown
  misc_feature (1)..( 6): Matrix.003 file - promoters60/4768147
ggcgag

SEQ ID NO: 58821 - DNA, 8 bp, Unknown
  misc_feature (1)..( 8): Matrix.003 file - promoters60/4768169
gtttgaaa

SEQ ID NO: 58822 - DNA, 6 bp, Unknown
  misc_feature (1)..( 6): Matrix.003 file - promoters60/4768169
aattca

SEQ ID NO: 58823 - DNA, 7 bp, Unknown
  misc_feature (1)..( 7): Matrix.003 file - promoters60/4768169
tttctaa

SEQ ID NO: 58824 - DNA, 9 bp, Unknown
  misc_feature (1)..( 9): Matrix.003 file - promoters60/4768169
ttaactttg

SEQ ID NO: 58825 - DNA, 8 bp, Unknown
  misc_feature (1)..( 8): Matrix.003 file - promoters60/4768169
tcaaataa

SEQ ID NO: 58826 - DNA, 6 bp, Unknown
  misc_feature (1)..( 6): Matrix.003 file - promoters60/4768169
ttcttt

SEQ ID NO: 58827 - DNA, 7 bp, Unknown
  misc_feature (1)..( 7): Matrix.003 file - promoters60/4768169
aacaaag

SEQ ID NO: 58828 - DNA, 7 bp, Unknown
  misc_feature (1)..( 7): Matrix.003 file - promoters60/4768169
tatatat

SEQ ID NO: 58829 - DNA, 7 bp, Unknown
  misc_feature (1)..( 7): Matrix.003 file - promoters60/4768169
aaaccag

SEQ ID NO: 58830 - DNA, 7 bp, Unknown
  misc_feature (1)..( 7): Matrix.003 file - promoters60/4768169
gaaaaaa

SEQ ID NO: 58831 - DNA, 7 bp, Unknown
  misc_feature (1)..( 7): Matrix.003 file - promoters60/4768169
accacat

SEQ ID NO: 58832 - DNA, 7 bp, Unknown
  misc_feature (1)..( 7): Matrix.003 file - promoters60/4768169
aaaagat

SEQ ID NO: 58833 - DNA, 6 bp, Unknown
  misc_feature (1)..( 6): Matrix.003 file - promoters60/4768169
tgtgga

SEQ ID NO: 58834 - DNA, 7 bp, Unknown
  misc_feature (1)..( 7): Matrix.003 file - promoters60/4768169
gaaattg

SEQ ID NO: 58835 - DNA, 9 bp, Unknown
  misc_feature (1)..( 9): Matrix.003 file - promoters60/4768169
aaactatat

SEQ ID NO: 58836 - DNA, 8 bp, Unknown
  misc_feature (1)..( 8): Matrix.003 file - promoters60/4768169
ttgacaaa

SEQ ID NO: 58837 - DNA, 6 bp, Unknown
  misc_feature (1)..( 6): Matrix.003 file - promoters60/4768169
aaagtt

SEQ ID NO: 58838 - DNA, 7 bp, Unknown
  misc_feature (1)..( 7): Matrix.003 file - promoters60/4768169
tatggac

SEQ ID NO: 58839 - DNA, 8 bp, Unknown
  misc_feature (1)..( 8): Matrix.003 file - promoters60/4768169
aaatatct

SEQ ID NO: 58840 - DNA, 6 bp, Unknown
  misc_feature (1)..( 6): Matrix.003 file - promoters60/4768169
tttaaa

SEQ ID NO: 58841 - DNA, 9 bp, Unknown
  misc_feature (1)..( 9): Matrix.003 file - promoters60/4768169
attttctga

SEQ ID NO: 58842 - DNA, 7 bp, Unknown
  misc_feature (1)..( 7): Matrix.003 file - promoters60/4768169
gttttca

SEQ ID NO: 58843 - DNA, 8 bp, Unknown
  misc_feature (1)..( 8): Matrix.003 file - promoters60/4768198
ttttagct

SEQ ID NO: 58844 - DNA, 10 bp, Unknown
  misc_feature (1)..( 10): Matrix.003 file - promoters60/4768198
ttaaaattta

SEQ ID NO: 58845 - DNA, 7 bp, Unknown
  misc_feature (1)..( 7): Matrix.003 file - promoters60/4768198
tagtgat

SEQ ID NO: 58846 - DNA, 6 bp, Unknown
  misc_feature (1)..( 6): Matrix.003 file - promoters60/4768198
caaaaa

SEQ ID NO: 58847 - DNA, 7 bp, Unknown
  misc_feature (1)..( 7): Matrix.003 file - promoters60/4768198
gaaaact

SEQ ID NO: 58848 - DNA, 6 bp, Unknown
  misc_feature (1)..( 6): Matrix.003 file - promoters60/4768198
atgaaa

SEQ ID NO: 58849 - DNA, 11 bp, Unknown
  misc_feature (1)..( 11): Matrix.003 file - promoters60/4768198
aatcaatggtt

SEQ ID NO: 58850 - DNA, 9 bp, Unknown
  misc_feature (1)..( 9): Matrix.003 file - promoters60/4768198
tgtcaaatt

SEQ ID NO: 58851 - DNA, 9 bp, Unknown
  misc_feature (1)..( 9): Matrix.003 file - promoters60/4768198
tttatagtt

SEQ ID NO: 58852 - DNA, 8 bp, Unknown
  misc_feature (1)..( 8): Matrix.003 file - promoters60/4768198
actcaaat

SEQ ID NO: 58853 - DNA, 6 bp, Unknown
  misc_feature (1)..( 6): Matrix.003 file - promoters60/4768198
attaaa

SEQ ID NO: 58854 - DNA, 6 bp, Unknown
  misc_feature (1)..( 6): Matrix.003 file - promoters60/4768198
aaatta

SEQ ID NO: 58855 - DNA, 7 bp, Unknown
  misc_feature (1)..( 7): Matrix.003 file - promoters60/4768198
aaagaag

SEQ ID NO: 58856 - DNA, 9 bp, Unknown
  misc_feature (1)..( 9): Matrix.003 file - promoters60/4768198
tcttctatt

SEQ ID NO: 58857 - DNA, 7 bp, Unknown
  misc_feature (1)..( 7): Matrix.003 file - promoters60/4768198
cttgaga

SEQ ID NO: 58858 - DNA, 6 bp, Unknown
  misc_feature (1)..( 6): Matrix.003 file - promoters60/4768198
ggtttt

SEQ ID NO: 58859 - DNA, 7 bp, Unknown
  misc_feature (1)..( 7): Matrix.003 file - promoters60/4768198
attgttt

SEQ ID NO: 58860 - DNA, 7 bp, Unknown
  misc_feature (1)..( 7): Matrix.003 file - promoters60/4768198
aatatta

SEQ ID NO: 58861 - DNA, 7 bp, Unknown
  misc_feature (1)..( 7): Matrix.003 file - promoters60/4768198
gcaatgt

SEQ ID NO: 58862 - DNA, 11 bp, Unknown
  misc_feature (1)..( 11): Matrix.003 file - promoters60/4768209
gatttagttta

SEQ ID NO: 58863 - DNA, 11 bp, Unknown
  misc_feature (1)..( 11): Matrix.003 file - promoters60/4768217
taaccattgaa

SEQ ID NO: 58864 - DNA, 11 bp, Unknown
  misc_feature (1)..( 11): Matrix.003 file - promoters60/4768236
accaaaaaaga

SEQ ID NO: 58865 - DNA, 9 bp, Unknown
  misc_feature (1)..( 9): Matrix.003 file - promoters60/4768236
aaaaaaatc

SEQ ID NO: 58866 - DNA, 7 bp, Unknown
  misc_feature (1)..( 7): Matrix.003 file - promoters60/4768236
taaattc

SEQ ID NO: 58867 - DNA, 12 bp, Unknown
  misc_feature (1)..( 12): Matrix.003 file - promoters60/4768236
aataaatatcaa

SEQ ID NO: 58868 - DNA, 9 bp, Unknown
  misc_feature (1)..( 9): Matrix.003 file - promoters60/4768236
caaaaaata

SEQ ID NO: 58869 - DNA, 9 bp, Unknown
  misc_feature (1)..( 9): Matrix.003 file - promoters60/4768236
aagacaaaa

SEQ ID NO: 58870 - DNA, 10 bp, Unknown
  misc_feature (1)..( 10): Matrix.003 file - promoters60/4768236
cataaaaata

SEQ ID NO: 58871 - DNA, 10 bp, Unknown
  misc_feature (1)..( 10): Matrix.003 file - promoters60/4768236
caattttata

SEQ ID NO: 58872 - DNA, 6 bp, Unknown
  misc_feature (1)..( 6): Matrix.003 file - promoters60/4768239
ctttta

SEQ ID NO: 58873 - DNA, 10 bp, Unknown
  misc_feature (1)..( 10): Matrix.003 file - promoters60/4768239
aaatattata

SEQ ID NO: 58874 - DNA, 7 bp, Unknown
  misc_feature (1)..( 7): Matrix.003 file - promoters60/4768239
acaaata

SEQ ID NO: 58875 - DNA, 8 bp, Unknown
  misc_feature (1)..( 8): Matrix.003 file - promoters60/4768239
atcctttg

SEQ ID NO: 58876 - DNA, 6 bp, Unknown
  misc_feature (1)..( 6): Matrix.003 file - promoters60/4768239
atttga

SEQ ID NO: 58877 - DNA, 9 bp, Unknown
  misc_feature (1)..( 9): Matrix.003 file - promoters60/4768239
gattctttg

SEQ ID NO: 58878 - DNA, 7 bp, Unknown
  misc_feature (1)..( 7): Matrix.003 file - promoters60/4768239
tatgata

SEQ ID NO: 58879 - DNA, 10 bp, Unknown
  misc_feature (1)..( 10): Matrix.003 file - promoters60/4768239
agattagcta

SEQ ID NO: 58880 - DNA, 6 bp, Unknown
  misc_feature (1)..( 6): Matrix.003 file - promoters60/4768239
tgtttt

SEQ ID NO: 58881 - DNA, 6 bp, Unknown
  misc_feature (1)..( 6): Matrix.003 file - promoters60/4768239
ttttat

SEQ ID NO: 58882 - DNA, 7 bp, Unknown
  misc_feature (1)..( 7): Matrix.003 file - promoters60/4768239
taacaat

SEQ ID NO: 58883 - DNA, 8 bp, Unknown
  misc_feature (1)..( 8): Matrix.003 file - promoters60/4768239
gtccgatt

SEQ ID NO: 58884 - DNA, 7 bp, Unknown
  misc_feature (1)..( 7): Matrix.003 file - promoters60/4768239
tatatat

SEQ ID NO: 58885 - DNA, 9 bp, Unknown
  misc_feature (1)..( 9): Matrix.003 file - promoters60/4768250
tatttaatt

SEQ ID NO: 58886 - DNA, 10 bp, Unknown
  misc_feature (1)..( 10): Matrix.003 file - promoters60/4768250
ataaaaaaat

SEQ ID NO: 58887 - DNA, 12 bp, Unknown
  misc_feature (1)..( 12): Matrix.003 file - promoters60/4768250
caaaacaatata

SEQ ID NO: 58888 - DNA, 9 bp, Unknown
  misc_feature (1)..( 9): Matrix.003 file - promoters60/4768250
caaaattta

SEQ ID NO: 58889 - DNA, 11 bp, Unknown
  misc_feature (1)..( 11): Matrix.003 file - promoters60/4768250
gataaaaaaaa

SEQ ID NO: 58890 - DNA, 11 bp, Unknown
  misc_feature (1)..( 11): Matrix.003 file - promoters60/4768250
taaaataatac

SEQ ID NO: 58891 - DNA, 6 bp, Unknown
  misc_feature (1)..( 6): Matrix.003 file - promoters60/4768253
agattc

SEQ ID NO: 58892 - DNA, 8 bp, Unknown
  misc_feature (1)..( 8): Matrix.003 file - promoters60/4768253
tcccatga

SEQ ID NO: 58893 - DNA, 6 bp, Unknown
  misc_feature (1)..( 6): Matrix.003 file - promoters60/4768253
tcttct

SEQ ID NO: 58894 - DNA, 6 bp, Unknown
  misc_feature (1)..( 6): Matrix.003 file - promoters60/4768253
gaaaaa

SEQ ID NO: 58895 - DNA, 6 bp, Unknown
  misc_feature (1)..( 6): Matrix.003 file - promoters60/4768253
ataaat

SEQ ID NO: 58896 - DNA, 7 bp, Unknown
  misc_feature (1)..( 7): Matrix.003 file - promoters60/4768253
taaaaat

SEQ ID NO: 58897 - DNA, 8 bp, Unknown
  misc_feature (1)..( 8): Matrix.003 file - promoters60/4768253
aagaaaaa

SEQ ID NO: 58898 - DNA, 7 bp, Unknown
  misc_feature (1)..( 7): Matrix.003 file - promoters60/4768253
gaactca

SEQ ID NO: 58899 - DNA, 7 bp, Unknown
  misc_feature (1)..( 7): Matrix.003 file - promoters60/4768253
attgtct

SEQ ID NO: 58900 - DNA, 6 bp, Unknown
  misc_feature (1)..( 6): Matrix.003 file - promoters60/4768253
aagaaa

SEQ ID NO: 58901 - DNA, 8 bp, Unknown
  misc_feature (1)..( 8): Matrix.003 file - promoters60/4768253
ggcccatt

SEQ ID NO: 58902 - DNA, 7 bp, Unknown
  misc_feature (1)..( 7): Matrix.003 file - promoters60/4768253
agtctcc

SEQ ID NO: 58903 - DNA, 10 bp, Unknown
  misc_feature (1)..( 10): Matrix.003 file - promoters60/4768265
atgaatttgt

SEQ ID NO: 58904 - DNA, 11 bp, Unknown
  misc_feature (1)..( 11): Matrix.003 file - promoters60/4768265
atcaagtttga

SEQ ID NO: 58905 - DNA, 6 bp, Unknown
  misc_feature (1)..( 6): Matrix.003 file - promoters60/4768269
attcac

SEQ ID NO: 58906 - DNA, 7 bp, Unknown
  misc_feature (1)..( 7): Matrix.003 file - promoters60/4768269
acaaata

SEQ ID NO: 58907 - DNA, 8 bp, Unknown
  misc_feature (1)..( 8): Matrix.003 file - promoters60/4768269
ataacaat

SEQ ID NO: 58908 - DNA, 6 bp, Unknown
  misc_feature (1)..( 6): Matrix.003 file - promoters60/4768269
ctttca

SEQ ID NO: 58909 - DNA, 6 bp, Unknown
  misc_feature (1)..( 6): Matrix.003 file - promoters60/4768269
aataac

SEQ ID NO: 58910 - DNA, 7 bp, Unknown
  misc_feature (1)..( 7): Matrix.003 file - promoters60/4768269
aaacaat

SEQ ID NO: 58911 - DNA, 11 bp, Unknown
  misc_feature (1)..( 11): Matrix.003 file - promoters60/4768269
agttattttgc

SEQ ID NO: 58912 - DNA, 7 bp, Unknown
  misc_feature (1)..( 7): Matrix.003 file - promoters60/4768269
tctgtga

SEQ ID NO: 58913 - DNA, 7 bp, Unknown
  misc_feature (1)..( 7): Matrix.003 file - promoters60/4768269
tttggta

SEQ ID NO: 58914 - DNA, 7 bp, Unknown
  misc_feature (1)..( 7): Matrix.003 file - promoters60/4768269
tggaatt

SEQ ID NO: 58915 - DNA, 6 bp, Unknown
  misc_feature (1)..( 6): Matrix.003 file - promoters60/4768269
ttcggt

SEQ ID NO: 58916 - DNA, 8 bp, Unknown
  misc_feature (1)..( 8): Matrix.003 file - promoters60/4768269
catcagaa

SEQ ID NO: 58917 - DNA, 7 bp, Unknown
  misc_feature (1)..( 7): Matrix.003 file - promoters60/4768269
tgcaagg

SEQ ID NO: 58918 - DNA, 10 bp, Unknown
  misc_feature (1)..( 10): Matrix.003 file - promoters60/4768285
taaattaaaa

SEQ ID NO: 58919 - DNA, 12 bp, Unknown
  misc_feature (1)..( 12): Matrix.003 file - promoters60/4768285
ttttttccaata

SEQ ID NO: 58920 - DNA, 10 bp, Unknown
  misc_feature (1)..( 10): Matrix.003 file - promoters60/4768285
ttttatcaat

SEQ ID NO: 58921 - DNA, 12 bp, Unknown
  misc_feature (1)..( 12): Matrix.003 file - promoters60/4768285
caatttttatat

SEQ ID NO: 58922 - DNA, 6 bp, Unknown
  misc_feature (1)..( 6): Matrix.003 file - promoters60/4768289
taacaa

SEQ ID NO: 58923 - DNA, 9 bp, Unknown
  misc_feature (1)..( 9): Matrix.003 file - promoters60/4768289
gtttattaa

SEQ ID NO: 58924 - DNA, 6 bp, Unknown
  misc_feature (1)..( 6): Matrix.003 file - promoters60/4768289
gaacat

SEQ ID NO: 58925 - DNA, 8 bp, Unknown
  misc_feature (1)..( 8): Matrix.003 file - promoters60/4768289
ttaaaaga

SEQ ID NO: 58926 - DNA, 8 bp, Unknown
  misc_feature (1)..( 8): Matrix.003 file - promoters60/4768289
tgaactta

SEQ ID NO: 58927 - DNA, 6 bp, Unknown
  misc_feature (1)..( 6): Matrix.003 file - promoters60/4768289
gagatt

SEQ ID NO: 58928 - DNA, 7 bp, Unknown
  misc_feature (1)..( 7): Matrix.003 file - promoters60/4768289
atgctta

SEQ ID NO: 58929 - DNA, 8 bp, Unknown
  misc_feature (1)..( 8): Matrix.003 file - promoters60/4768289
tcaagttg

SEQ ID NO: 58930 - DNA, 13 bp, Unknown
  misc_feature (1)..( 13): Matrix.003 file - promoters60/4768289
ttgaatcaaaatt

SEQ ID NO: 58931 - DNA, 7 bp, Unknown
  misc_feature (1)..( 7): Matrix.003 file - promoters60/4768289
tggattt

SEQ ID NO: 58932 - DNA, 6 bp, Unknown
  misc_feature (1)..( 6): Matrix.003 file - promoters60/4768289
aagatt

SEQ ID NO: 58933 - DNA, 6 bp, Unknown
  misc_feature (1)..( 6): Matrix.003 file - promoters60/4768289
ttggtt

SEQ ID NO: 58934 - DNA, 6 bp, Unknown
  misc_feature (1)..( 6): Matrix.003 file - promoters60/4768289
ttaacc

SEQ ID NO: 58935 - DNA, 7 bp, Unknown
  misc_feature (1)..( 7): Matrix.003 file - promoters60/4768289
ctcactc

SEQ ID NO: 58936 - DNA, 6 bp, Unknown
  misc_feature (1)..( 6): Matrix.003 file - promoters60/4768289
atttct

SEQ ID NO: 58937 - DNA, 7 bp, Unknown
  misc_feature (1)..( 7): Matrix.003 file - promoters60/4768293
tcttctg

SEQ ID NO: 58938 - DNA, 8 bp, Unknown
  misc_feature (1)..( 8): Matrix.003 file - promoters60/4768293
cattttca

SEQ ID NO: 58939 - DNA, 10 bp, Unknown
  misc_feature (1)..( 10): Matrix.003 file - promoters60/4768293
attttcacac

SEQ ID NO: 58940 - DNA, 7 bp, Unknown
  misc_feature (1)..( 7): Matrix.003 file - promoters60/4768293
cagggaa

SEQ ID NO: 58941 - DNA, 10 bp, Unknown
  misc_feature (1)..( 10): Matrix.003 file - promoters60/4768293
tgatatgctt

SEQ ID NO: 58942 - DNA, 7 bp, Unknown
  misc_feature (1)..( 7): Matrix.003 file - promoters60/4768293
gatcata

SEQ ID NO: 58943 - DNA, 7 bp, Unknown
  misc_feature (1)..( 7): Matrix.003 file - promoters60/4768293
aaactac

SEQ ID NO: 58944 - DNA, 6 bp, Unknown
  misc_feature (1)..( 6): Matrix.003 file - promoters60/4768293
aaactt

SEQ ID NO: 58945 - DNA, 8 bp, Unknown
  misc_feature (1)..( 8): Matrix.003 file - promoters60/4768293
tgcaggta

SEQ ID NO: 58946 - DNA, 8 bp, Unknown
  misc_feature (1)..( 8): Matrix.003 file - promoters60/4768293
tggaatcc

SEQ ID NO: 58947 - DNA, 7 bp, Unknown
  misc_feature (1)..( 7): Matrix.003 file - promoters60/4768293
atcatgc

SEQ ID NO: 58948 - DNA, 13 bp, Unknown
  misc_feature (1)..( 13): Matrix.003 file - promoters60/4768319
aatcttcgtttgt

SEQ ID NO: 58949 - DNA, 11 bp, Unknown
  misc_feature (1)..( 11): Matrix.003 file - promoters60/4768319
tagataattgt

SEQ ID NO: 58950 - DNA, 7 bp, Unknown
  misc_feature (1)..( 7): Matrix.003 file - promoters60/4768319
actcttc

SEQ ID NO: 58951 - DNA, 6 bp, Unknown
  misc_feature (1)..( 6): Matrix.003 file - promoters60/4768319
aaaaaa

SEQ ID NO: 58952 - DNA, 8 bp, Unknown
  misc_feature (1)..( 8): Matrix.003 file - promoters60/4768319
taaacaaa

SEQ ID NO: 58953 - DNA, 9 bp, Unknown
  misc_feature (1)..( 9): Matrix.003 file - promoters60/4768319
ctcattttt

SEQ ID NO: 58954 - DNA, 7 bp, Unknown
  misc_feature (1)..( 7): Matrix.003 file - promoters60/4768323
ttggtca

SEQ ID NO: 58955 - DNA, 7 bp, Unknown
  misc_feature (1)..( 7): Matrix.003 file - promoters60/4768323
tttactg

SEQ ID NO: 58956 - DNA, 7 bp, Unknown
  misc_feature (1)..( 7): Matrix.003 file - promoters60/4768323
atgaaat

SEQ ID NO: 58957 - DNA, 9 bp, Unknown
  misc_feature (1)..( 9): Matrix.003 file - promoters60/4768323
gaaaagtat

SEQ ID NO: 58958 - DNA, 7 bp, Unknown
  misc_feature (1)..( 7): Matrix.003 file - promoters60/4768323
tcaaatc

SEQ ID NO: 58959 - DNA, 7 bp, Unknown
  misc_feature (1)..( 7): Matrix.003 file - promoters60/4768323
ctttttc

SEQ ID NO: 58960 - DNA, 6 bp, Unknown
  misc_feature (1)..( 6): Matrix.003 file - promoters60/4768323
tgattt

SEQ ID NO: 58961 - DNA, 8 bp, Unknown
  misc_feature (1)..( 8): Matrix.003 file - promoters60/4768323
tttcttat

SEQ ID NO: 58962 - DNA, 7 bp, Unknown
  misc_feature (1)..( 7): Matrix.003 file - promoters60/4768323
ggaacca

SEQ ID NO: 58963 - DNA, 6 bp, Unknown
  misc_feature (1)..( 6): Matrix.003 file - promoters60/4768323
tagggt

SEQ ID NO: 58964 - DNA, 6 bp, Unknown
  misc_feature (1)..( 6): Matrix.003 file - promoters60/4768323
aaaaaa

SEQ ID NO: 58965 - DNA, 7 bp, Unknown
  misc_feature (1)..( 7): Matrix.003 file - promoters60/4768323
tcttttt

SEQ ID NO: 58966 - DNA, 6 bp, Unknown
  misc_feature (1)..( 6): Matrix.003 file - promoters60/4768323
atattt

SEQ ID NO: 58967 - DNA, 6 bp, Unknown
  misc_feature (1)..( 6): Matrix.003 file - promoters60/4768323
aaaaga

SEQ ID NO: 58968 - DNA, 7 bp, Unknown
  misc_feature (1)..( 7): Matrix.003 file - promoters60/4768346
atatgat

SEQ ID NO: 58969 - DNA, 7 bp, Unknown
  misc_feature (1)..( 7): Matrix.003 file - promoters60/4768346
taaaata

SEQ ID NO: 58970 - DNA, 10 bp, Unknown
  misc_feature (1)..( 10): Matrix.003 file - promoters60/4768346
atatatgaaa

SEQ ID NO: 58971 - DNA, 9 bp, Unknown
  misc_feature (1)..( 9): Matrix.003 file - promoters60/4768346
aaataaaat

SEQ ID NO: 58972 - DNA, 7 bp, Unknown
  misc_feature (1)..( 7): Matrix.003 file - promoters60/4768346
accaaaa

SEQ ID NO: 58973 - DNA, 8 bp, Unknown
  misc_feature (1)..( 8): Matrix.003 file - promoters60/4768346
aaaaaatc

SEQ ID NO: 58974 - DNA, 9 bp, Unknown
  misc_feature (1)..( 9): Matrix.003 file - promoters60/4768346
aatcatatt

SEQ ID NO: 58975 - DNA, 7 bp, Unknown
  misc_feature (1)..( 7): Matrix.003 file - promoters60/4768346
tcaaaat

SEQ ID NO: 58976 - DNA, 7 bp, Unknown
  misc_feature (1)..( 7): Matrix.003 file - promoters60/4768346
aatacaa

SEQ ID NO: 58977 - DNA, 7 bp, Unknown
  misc_feature (1)..( 7): Matrix.003 file - promoters60/4768346
accaaaa

SEQ ID NO: 58978 - DNA, 9 bp, Unknown
  misc_feature (1)..( 9): Matrix.003 file - promoters60/4768346
actcgaaaa

SEQ ID NO: 58979 - DNA, 9 bp, Unknown
  misc_feature (1)..( 9): Matrix.003 file - promoters60/4768346
accaaaatc

SEQ ID NO: 58980 - DNA, 7 bp, Unknown
  misc_feature (1)..( 7): Matrix.003 file - promoters60/4768346
tcaaaac

SEQ ID NO: 58981 - DNA, 7 bp, Unknown
  misc_feature (1)..( 7): Matrix.003 file - promoters60/4768346
aattgaa

SEQ ID NO: 58982 - DNA, 8 bp, Unknown
  misc_feature (1)..( 8): Matrix.003 file - promoters60/4768346
catatatg

SEQ ID NO: 58983 - DNA, 6 bp, Unknown
  misc_feature (1)..( 6): Matrix.003 file - promoters60/4768346
tttacg

SEQ ID NO: 58984 - DNA, 7 bp, Unknown
  misc_feature (1)..( 7): Matrix.003 file - promoters60/4768346
aatcatt

SEQ ID NO: 58985 - DNA, 7 bp, Unknown
  misc_feature (1)..( 7): Matrix.003 file - promoters60/4768346
ttacaat

SEQ ID NO: 58986 - DNA, 7 bp, Unknown
  misc_feature (1)..( 7): Matrix.003 file - promoters60/4768346
aatctgt

SEQ ID NO: 58987 - DNA, 11 bp, Unknown
  misc_feature (1)..( 11): Matrix.003 file - promoters60/4768354
taaaatttttt

SEQ ID NO: 58988 - DNA, 9 bp, Unknown
  misc_feature (1)..( 9): Matrix.003 file - promoters60/4768354
tttattcag

SEQ ID NO: 58989 - DNA, 6 bp, Unknown
  misc_feature (1)..( 6): Matrix.003 file - promoters60/4768354
tgcaat

SEQ ID NO: 58990 - DNA, 8 bp, Unknown
  misc_feature (1)..( 8): Matrix.003 file - promoters60/4768354
ttcattta

SEQ ID NO: 58991 - DNA, 6 bp, Unknown
  misc_feature (1)..( 6): Matrix.003 file - promoters60/4768354
tatttt

SEQ ID NO: 58992 - DNA, 6 bp, Unknown
  misc_feature (1)..( 6): Matrix.003 file - promoters60/4768354
taattt

SEQ ID NO: 58993 - DNA, 6 bp, Unknown
  misc_feature (1)..( 6): Matrix.003 file - promoters60/4768354
tttcac

SEQ ID NO: 58994 - DNA, 7 bp, Unknown
  misc_feature (1)..( 7): Matrix.003 file - promoters60/4768354
attctca

SEQ ID NO: 58995 - DNA, 7 bp, Unknown
  misc_feature (1)..( 7): Matrix.003 file - promoters60/4768354
atggtat

SEQ ID NO: 58996 - DNA, 6 bp, Unknown
  misc_feature (1)..( 6): Matrix.003 file - promoters60/4768354
aatatt

SEQ ID NO: 58997 - DNA, 6 bp, Unknown
  misc_feature (1)..( 6): Matrix.003 file - promoters60/4768354
gaaaat

SEQ ID NO: 58998 - DNA, 7 bp, Unknown
  misc_feature (1)..( 7): Matrix.003 file - promoters60/4768354
taaatct

SEQ ID NO: 58999 - DNA, 12 bp, Unknown
  misc_feature (1)..( 12): Matrix.003 file - promoters60/4768354
aaaaaatctctg

SEQ ID NO: 59000 - DNA, 7 bp, Unknown
  misc_feature (1)..( 7): Matrix.003 file - promoters60/4768354
aattttt

SEQ ID NO: 59001 - DNA, 7 bp, Unknown
  misc_feature (1)..( 7): Matrix.003 file - promoters60/4768354
ttaatgt

SEQ ID NO: 59002 - DNA, 6 bp, Unknown
  misc_feature (1)..( 6): Matrix.003 file - promoters60/4768354
aatttt

SEQ ID NO: 59003 - DNA, 6 bp, Unknown
  misc_feature (1)..( 6): Matrix.003 file - promoters60/4768354
tattcg

SEQ ID NO: 59004 - DNA, 6 bp, Unknown
  misc_feature (1)..( 6): Matrix.003 file - promoters60/4768354
acctat

SEQ ID NO: 59005 - DNA, 8 bp, Unknown
  misc_feature (1)..( 8): Matrix.003 file - promoters60/4768354
caaaactt

SEQ ID NO: 59006 - DNA, 7 bp, Unknown
  misc_feature (1)..( 7): Matrix.003 file - promoters60/4768354
gaaaaaa

SEQ ID NO: 59007 - DNA, 6 bp, Unknown
  misc_feature (1)..( 6): Matrix.003 file - promoters60/4768354
atttaa

SEQ ID NO: 59008 - DNA, 6 bp, Unknown
  misc_feature (1)..( 6): Matrix.003 file - promoters60/4768354
taaaat

SEQ ID NO: 59009 - DNA, 7 bp, Unknown
  misc_feature (1)..( 7): Matrix.003 file - promoters60/4768354
aaaatca

SEQ ID NO: 59010 - DNA, 6 bp, Unknown
  misc_feature (1)..( 6): Matrix.003 file - promoters60/4768354
tcacat

SEQ ID NO: 59011 - DNA, 6 bp, Unknown
  misc_feature (1)..( 6): Matrix.003 file - promoters60/4768354
aatcat

SEQ ID NO: 59012 - DNA, 6 bp, Unknown
  misc_feature (1)..( 6): Matrix.003 file - promoters60/4768354
tttgta

SEQ ID NO: 59013 - DNA, 6 bp, Unknown
  misc_feature (1)..( 6): Matrix.003 file - promoters60/4768358
gttttt

SEQ ID NO: 59014 - DNA, 7 bp, Unknown
  misc_feature (1)..( 7): Matrix.003 file - promoters60/4768358
aatttta

SEQ ID NO: 59015 - DNA, 7 bp, Unknown
  misc_feature (1)..( 7): Matrix.003 file - promoters60/4768358
ataacaa

SEQ ID NO: 59016 - DNA, 8 bp, Unknown
  misc_feature (1)..( 8): Matrix.003 file - promoters60/4768358
atactttt

SEQ ID NO: 59017 - DNA, 6 bp, Unknown
  misc_feature (1)..( 6): Matrix.003 file - promoters60/4768358
ttttag

SEQ ID NO: 59018 - DNA, 6 bp, Unknown
  misc_feature (1)..( 6): Matrix.003 file - promoters60/4768358
aacgaa

SEQ ID NO: 59019 - DNA, 6 bp, Unknown
  misc_feature (1)..( 6): Matrix.003 file - promoters60/4768358
aactaa

SEQ ID NO: 59020 - DNA, 9 bp, Unknown
  misc_feature (1)..( 9): Matrix.003 file - promoters60/4768358
caatatgtt

SEQ ID NO: 59021 - DNA, 8 bp, Unknown
  misc_feature (1)..( 8): Matrix.003 file - promoters60/4768358
atatgttt

SEQ ID NO: 59022 - DNA, 7 bp, Unknown
  misc_feature (1)..( 7): Matrix.003 file - promoters60/4768358
tttcatt

SEQ ID NO: 59023 - DNA, 8 bp, Unknown
  misc_feature (1)..( 8): Matrix.003 file - promoters60/4768358
tgtgttta

SEQ ID NO: 59024 - DNA, 7 bp, Unknown
  misc_feature (1)..( 7): Matrix.003 file - promoters60/4768358
aaaaatc

SEQ ID NO: 59025 - DNA, 6 bp, Unknown
  misc_feature (1)..( 6): Matrix.003 file - promoters60/4768358
gttata

SEQ ID NO: 59026 - DNA, 6 bp, Unknown
  misc_feature (1)..( 6): Matrix.003 file - promoters60/4768358
ttttaa

SEQ ID NO: 59027 - DNA, 7 bp, Unknown
  misc_feature (1)..( 7): Matrix.003 file - promoters60/4768358
ttaaatt

SEQ ID NO: 59028 - DNA, 6 bp, Unknown
  misc_feature (1)..( 6): Matrix.003 file - promoters60/4768358
acttaa

SEQ ID NO: 59029 - DNA, 6 bp, Unknown
  misc_feature (1)..( 6): Matrix.003 file - promoters60/4768358
tattta

SEQ ID NO: 59030 - DNA, 6 bp, Unknown
  misc_feature (1)..( 6): Matrix.003 file - promoters60/4768358
aaataa

SEQ ID NO: 59031 - DNA, 6 bp, Unknown
  misc_feature (1)..( 6): Matrix.003 file - promoters60/4768444
ctattg

SEQ ID NO: 59032 - DNA, 6 bp, Unknown
  misc_feature (1)..( 6): Matrix.003 file - promoters60/4768444
cttcaa

SEQ ID NO: 59033 - DNA, 7 bp, Unknown
  misc_feature (1)..( 7): Matrix.003 file - promoters60/4768444
gagagta

SEQ ID NO: 59034 - DNA, 6 bp, Unknown
  misc_feature (1)..( 6): Matrix.003 file - promoters60/4768444
atttaa

SEQ ID NO: 59035 - DNA, 6 bp, Unknown
  misc_feature (1)..( 6): Matrix.003 file - promoters60/4768444
caaaaa

SEQ ID NO: 59036 - DNA, 7 bp, Unknown
  misc_feature (1)..( 7): Matrix.003 file - promoters60/4768444
tatctta

SEQ ID NO: 59037 - DNA, 8 bp, Unknown
  misc_feature (1)..( 8): Matrix.003 file - promoters60/4768444
aagactct

SEQ ID NO: 59038 - DNA, 7 bp, Unknown
  misc_feature (1)..( 7): Matrix.003 file - promoters60/4768444
caagagt

SEQ ID NO: 59039 - DNA, 9 bp, Unknown
  misc_feature (1)..( 9): Matrix.003 file - promoters60/4768528
aaaatttct

SEQ ID NO: 59040 - DNA, 8 bp, Unknown
  misc_feature (1)..( 8): Matrix.003 file - promoters60/4768528
tgtgaaac

SEQ ID NO: 59041 - DNA, 9 bp, Unknown
  misc_feature (1)..( 9): Matrix.003 file - promoters60/4768528
aaaatttct

SEQ ID NO: 59042 - DNA, 9 bp, Unknown
  misc_feature (1)..( 9): Matrix.003 file - promoters60/4768528
tttcaaaat

SEQ ID NO: 59043 - DNA, 6 bp, Unknown
  misc_feature (1)..( 6): Matrix.003 file - promoters60/4768528
taacat

SEQ ID NO: 59044 - DNA, 7 bp, Unknown
  misc_feature (1)..( 7): Matrix.003 file - promoters60/4768528
aaaatat

SEQ ID NO: 59045 - DNA, 8 bp, Unknown
  misc_feature (1)..( 8): Matrix.003 file - promoters60/4768528
taactaaa

SEQ ID NO: 59046 - DNA, 6 bp, Unknown
  misc_feature (1)..( 6): Matrix.003 file - promoters60/4768528
aatcaa

SEQ ID NO: 59047 - DNA, 14 bp, Unknown
  misc_feature (1)..( 14): Matrix.003 file - promoters60/4768528
tcaataaatacaca

SEQ ID NO: 59048 - DNA, 7 bp, Unknown
  misc_feature (1)..( 7): Matrix.003 file - promoters60/4768528
aaaaaaa

SEQ ID NO: 59049 - DNA, 9 bp, Unknown
  misc_feature (1)..( 9): Matrix.003 file - promoters60/4768528
ctgctttca

SEQ ID NO: 59050 - DNA, 7 bp, Unknown
  misc_feature (1)..( 7): Matrix.003 file - promoters60/4768528
attttgg

SEQ ID NO: 59051 - DNA, 8 bp, Unknown
  misc_feature (1)..( 8): Matrix.003 file - promoters60/4768528
tcaaattt

SEQ ID NO: 59052 - DNA, 7 bp, Unknown
  misc_feature (1)..( 7): Matrix.003 file - promoters60/4768528
gtaatgg

SEQ ID NO: 59053 - DNA, 6 bp, Unknown
  misc_feature (1)..( 6): Matrix.003 file - promoters60/4768528
aaaatg

SEQ ID NO: 59054 - DNA, 6 bp, Unknown
  misc_feature (1)..( 6): Matrix.003 file - promoters60/4768528
aagatt

SEQ ID NO: 59055 - DNA, 8 bp, Unknown
  misc_feature (1)..( 8): Matrix.003 file - promoters60/4768528
atgtaaac

SEQ ID NO: 59056 - DNA, 7 bp, Unknown
  misc_feature (1)..( 7): Matrix.003 file - promoters60/4768528
gaaaaat

SEQ ID NO: 59057 - DNA, 7 bp, Unknown
  misc_feature (1)..( 7): Matrix.003 file - promoters60/4768528
caaaatt

SEQ ID NO: 59058 - DNA, 7 bp, Unknown
  misc_feature (1)..( 7): Matrix.003 file - promoters60/4768528
acaactt

SEQ ID NO: 59059 - DNA, 7 bp, Unknown
  misc_feature (1)..( 7): Matrix.003 file - promoters60/4768528
tttattt

SEQ ID NO: 59060 - DNA, 6 bp, Unknown
  misc_feature (1)..( 6): Matrix.003 file - promoters60/4768528
ttggtt

SEQ ID NO: 59061 - DNA, 6 bp, Unknown
  misc_feature (1)..( 6): Matrix.003 file - promoters60/4768528
aaaagt

SEQ ID NO: 59062 - DNA, 8 bp, Unknown
  misc_feature (1)..( 8): Matrix.003 file - promoters60/4768547
tcaaaatt

SEQ ID NO: 59063 - DNA, 14 bp, Unknown
  misc_feature (1)..( 14): Matrix.003 file - promoters60/4768547
ccaaacttaaataa

SEQ ID NO: 59064 - DNA, 9 bp, Unknown
  misc_feature (1)..( 9): Matrix.003 file - promoters60/4768547
tgatcttga

SEQ ID NO: 59065 - DNA, 10 bp, Unknown
  misc_feature (1)..( 10): Matrix.003 file - promoters60/4768547
ttacaagaag

SEQ ID NO: 59066 - DNA, 12 bp, Unknown
  misc_feature (1)..( 12): Matrix.003 file - promoters60/4768568
ttttacacaaat

SEQ ID NO: 59067 - DNA, 12 bp, Unknown
  misc_feature (1)..( 12): Matrix.003 file - promoters60/4768568
aattttataaac

SEQ ID NO: 59068 - DNA, 15 bp, Unknown
  misc_feature (1)..( 15): Matrix.003 file - promoters60/4768568
acataaactaatata

SEQ ID NO: 59069 - DNA, 12 bp, Unknown
  misc_feature (1)..( 12): Matrix.003 file - promoters60/4768568
aatacaactaat

SEQ ID NO: 59070 - DNA, 17 bp, Unknown
  misc_feature (1)..( 17): Matrix.003 file - promoters60/4768568
ttaaaaaatagaaatag

SEQ ID NO: 59071 - DNA, 8 bp, Unknown
  misc_feature (1)..( 8): Matrix.003 file - promoters60/4768568
tatatata

SEQ ID NO: 59072 - DNA, 8 bp, Unknown
  misc_feature (1)..( 8): Matrix.003 file - promoters60/4768568
atatttat

SEQ ID NO: 59073 - DNA, 12 bp, Unknown
  misc_feature (1)..( 12): Matrix.003 file - promoters60/4768568
aacataattttg

SEQ ID NO: 59074 - DNA, 10 bp, Unknown
  misc_feature (1)..( 10): Matrix.003 file - promoters60/4768568
tttttagttt

SEQ ID NO: 59075 - DNA, 10 bp, Unknown
  misc_feature (1)..( 10): Matrix.003 file - promoters60/4768568
tattttaatt

SEQ ID NO: 59076 - DNA, 12 bp, Unknown
  misc_feature (1)..( 12): Matrix.003 file - promoters60/4768599
gttatatatatt

SEQ ID NO: 59077 - DNA, 6 bp, Unknown
  misc_feature (1)..( 6): Matrix.003 file - promoters60/4768599
ttaata

SEQ ID NO: 59078 - DNA, 10 bp, Unknown
  misc_feature (1)..( 10): Matrix.003 file - promoters60/4768599
atttggtttt

SEQ ID NO: 59079 - DNA, 8 bp, Unknown
  misc_feature (1)..( 8): Matrix.003 file - promoters60/4768599
tttgccgt

SEQ ID NO: 59080 - DNA, 9 bp, Unknown
  misc_feature (1)..( 9): Matrix.003 file - promoters60/4768599
tatttagga

SEQ ID NO: 59081 - DNA, 9 bp, Unknown
  misc_feature (1)..( 9): Matrix.003 file - promoters60/4768599
tgagtttct

SEQ ID NO: 59082 - DNA, 6 bp, Unknown
  misc_feature (1)..( 6): Matrix.003 file - promoters60/4768599
tttttc

SEQ ID NO: 59083 - DNA, 6 bp, Unknown
  misc_feature (1)..( 6): Matrix.003 file - promoters60/4768599
gggaaa

SEQ ID NO: 59084 - DNA, 6 bp, Unknown
  misc_feature (1)..( 6): Matrix.003 file - promoters60/4768599
tccatg

SEQ ID NO: 59085 - DNA, 8 bp, Unknown
  misc_feature (1)..( 8): Matrix.003 file - promoters60/4768599
tttcttct

SEQ ID NO: 59086 - DNA, 12 bp, Unknown
  misc_feature (1)..( 12): Matrix.003 file - promoters60/4768599
atgctattaaat

SEQ ID NO: 59087 - DNA, 6 bp, Unknown
  misc_feature (1)..( 6): Matrix.003 file - promoters60/4768599
aatatt

SEQ ID NO: 59088 - DNA, 6 bp, Unknown
  misc_feature (1)..( 6): Matrix.003 file - promoters60/4768599
atagta

SEQ ID NO: 59089 - DNA, 6 bp, Unknown
  misc_feature (1)..( 6): Matrix.003 file - promoters60/4768599
atacca

SEQ ID NO: 59090 - DNA, 7 bp, Unknown
  misc_feature (1)..( 7): Matrix.003 file - promoters60/4768599
tcttata

SEQ ID NO: 59091 - DNA, 6 bp, Unknown
  misc_feature (1)..( 6): Matrix.003 file - promoters60/4768599
tgttca

SEQ ID NO: 59092 - DNA, 7 bp, Unknown
  misc_feature (1)..( 7): Matrix.003 file - promoters60/4768599
attaaat

SEQ ID NO: 59093 - DNA, 6 bp, Unknown
  misc_feature (1)..( 6): Matrix.003 file - promoters60/4768599
aaattt

SEQ ID NO: 59094 - DNA, 7 bp, Unknown
  misc_feature (1)..( 7): Matrix.003 file - promoters60/4768599
aacatga

SEQ ID NO: 59095 - DNA, 7 bp, Unknown
  misc_feature (1)..( 7): Matrix.003 file - promoters60/4768599
tatcttt

SEQ ID NO: 59096 - DNA, 7 bp, Unknown
  misc_feature (1)..( 7): Matrix.003 file - promoters60/4768599
gagagtt

SEQ ID NO: 59097 - DNA, 7 bp, Unknown
  misc_feature (1)..( 7): Matrix.003 file - promoters60/4768599
tgtcttc

SEQ ID NO: 59098 - DNA, 7 bp, Unknown
  misc_feature (1)..( 7): Matrix.003 file - promoters60/4768615
aaaatat

SEQ ID NO: 59099 - DNA, 10 bp, Unknown
  misc_feature (1)..( 10): Matrix.003 file - promoters60/4768615
ataattaaac

SEQ ID NO: 59100 - DNA, 6 bp, Unknown
  misc_feature (1)..( 6): Matrix.003 file - promoters60/4768615
aaaaaa

SEQ ID NO: 59101 - DNA, 11 bp, Unknown
  misc_feature (1)..( 11): Matrix.003 file - promoters60/4768615
ataagtttagt

SEQ ID NO: 59102 - DNA, 10 bp, Unknown
  misc_feature (1)..( 10): Matrix.003 file - promoters60/4768615
taaaaataaa

SEQ ID NO: 59103 - DNA, 12 bp, Unknown
  misc_feature (1)..( 12): Matrix.003 file - promoters60/4768615
aaacaataaaaa

SEQ ID NO: 59104 - DNA, 10 bp, Unknown
  misc_feature (1)..( 10): Matrix.003 file - promoters60/4768615
atattattaa

SEQ ID NO: 59105 - DNA, 13 bp, Unknown
  misc_feature (1)..( 13): Matrix.003 file - promoters60/4768615
aattacaaaaata

SEQ ID NO: 59106 - DNA, 9 bp, Unknown
  misc_feature (1)..( 9): Matrix.003 file - promoters60/4768615
aatgaatta

SEQ ID NO: 59107 - DNA, 8 bp, Unknown
  misc_feature (1)..( 8): Matrix.003 file - promoters60/4768615
tatatata

SEQ ID NO: 59108 - DNA, 12 bp, Unknown
  misc_feature (1)..( 12): Matrix.003 file - promoters60/4768615
ataaaaattaaa

SEQ ID NO: 59109 - DNA, 9 bp, Unknown
  misc_feature (1)..( 9): Matrix.003 file - promoters60/4768631
aaaatctca

SEQ ID NO: 59110 - DNA, 8 bp, Unknown
  misc_feature (1)..( 8): Matrix.003 file - promoters60/4768631
ggcccaaa

SEQ ID NO: 59111 - DNA, 7 bp, Unknown
  misc_feature (1)..( 7): Matrix.003 file - promoters60/4768690
tgtccaa

SEQ ID NO: 59112 - DNA, 9 bp, Unknown
  misc_feature (1)..( 9): Matrix.003 file - promoters60/4768690
taagaatct

SEQ ID NO: 59113 - DNA, 7 bp, Unknown
  misc_feature (1)..( 7): Matrix.003 file - promoters60/4768690
ttgattt

SEQ ID NO: 59114 - DNA, 8 bp, Unknown
  misc_feature (1)..( 8): Matrix.003 file - promoters60/4768690
gatagtag

SEQ ID NO: 59115 - DNA, 9 bp, Unknown
  misc_feature (1)..( 9): Matrix.003 file - promoters60/4768690
aacggttct

SEQ ID NO: 59116 - DNA, 6 bp, Unknown
  misc_feature (1)..( 6): Matrix.003 file - promoters60/4768690
ataaac

SEQ ID NO: 59117 - DNA, 8 bp, Unknown
  misc_feature (1)..( 8): Matrix.003 file - promoters60/4768690
ctaaatat

SEQ ID NO: 59118 - DNA, 8 bp, Unknown
  misc_feature (1)..( 8): Matrix.003 file - promoters60/4768690
tatataaa

SEQ ID NO: 59119 - DNA, 8 bp, Unknown
  misc_feature (1)..( 8): Matrix.003 file - promoters60/4768690
gtttcaaa

SEQ ID NO: 59120 - DNA, 6 bp, Unknown
  misc_feature (1)..( 6): Matrix.003 file - promoters60/4768690
caaaat

SEQ ID NO: 59121 - DNA, 6 bp, Unknown
  misc_feature (1)..( 6): Matrix.003 file - promoters60/4768690
agaatc

SEQ ID NO: 59122 - DNA, 8 bp, Unknown
  misc_feature (1)..( 8): Matrix.003 file - promoters60/4768690
aatccaat

SEQ ID NO: 59123 - DNA, 7 bp, Unknown
  misc_feature (1)..( 7): Matrix.003 file - promoters60/4768690
ataacca

SEQ ID NO: 59124 - DNA, 6 bp, Unknown
  misc_feature (1)..( 6): Matrix.003 file - promoters60/4768690
aaagaa

SEQ ID NO: 59125 - DNA, 6 bp, Unknown
  misc_feature (1)..( 6): Matrix.003 file - promoters60/4768690
agaaaa

SEQ ID NO: 59126 - DNA, 8 bp, Unknown
  misc_feature (1)..( 8): Matrix.003 file - promoters60/4768690
ctcaatac

SEQ ID NO: 59127 - DNA, 8 bp, Unknown
  misc_feature (1)..( 8): Matrix.003 file - promoters60/4768698
attagtta

SEQ ID NO: 59128 - DNA, 14 bp, Unknown
  misc_feature (1)..( 14): Matrix.003 file - promoters60/4768698
gatttgaatttttc

SEQ ID NO: 59129 - DNA, 14 bp, Unknown
  misc_feature (1)..( 14): Matrix.003 file - promoters60/4768698
attagaatttttca

SEQ ID NO: 59130 - DNA, 9 bp, Unknown
  misc_feature (1)..( 9): Matrix.003 file - promoters60/4768698
ttttgatga

SEQ ID NO: 59131 - DNA, 20 bp, Unknown
  misc_feature (1)..( 20): Matrix.003 file - promoters60/4768698
ttataaattttaaaataatt

SEQ ID NO: 59132 - DNA, 10 bp, Unknown
  misc_feature (1)..( 10): Matrix.003 file - promoters60/4768698
tatataaata

SEQ ID NO: 59133 - DNA, 12 bp, Unknown
  misc_feature (1)..( 12): Matrix.003 file - promoters60/4768698
tatataaataac

SEQ ID NO: 59134 - DNA, 10 bp, Unknown
  misc_feature (1)..( 10): Matrix.003 file - promoters60/4768698
tagaaaattt

SEQ ID NO: 59135 - DNA, 12 bp, Unknown
  misc_feature (1)..( 12): Matrix.003 file - promoters60/4768698
atatttataagt

SEQ ID NO: 59136 - DNA, 6 bp, Unknown
  misc_feature (1)..( 6): Matrix.003 file - promoters60/4768698
tgaatg

SEQ ID NO: 59137 - DNA, 10 bp, Unknown
  misc_feature (1)..( 10): Matrix.003 file - promoters60/4768698
ttatgtaaat

SEQ ID NO: 59138 - DNA, 13 bp, Unknown
  misc_feature (1)..( 13): Matrix.003 file - promoters60/4768698
atatctttatacg

SEQ ID NO: 59139 - DNA, 7 bp, Unknown
  misc_feature (1)..( 7): Matrix.003 file - promoters60/4768748
gtaaagt

SEQ ID NO: 59140 - DNA, 6 bp, Unknown
  misc_feature (1)..( 6): Matrix.003 file - promoters60/4768748
ttttga

SEQ ID NO: 59141 - DNA, 8 bp, Unknown
  misc_feature (1)..( 8): Matrix.003 file - promoters60/4768748
atttgtag

SEQ ID NO: 59142 - DNA, 7 bp, Unknown
  misc_feature (1)..( 7): Matrix.003 file - promoters60/4768748
ttaattt

SEQ ID NO: 59143 - DNA, 7 bp, Unknown
  misc_feature (1)..( 7): Matrix.003 file - promoters60/4768748
gacctct

SEQ ID NO: 59144 - DNA, 6 bp, Unknown
  misc_feature (1)..( 6): Matrix.003 file - promoters60/4768748
tgagct

SEQ ID NO: 59145 - DNA, 8 bp, Unknown
  misc_feature (1)..( 8): Matrix.003 file - promoters60/4768748
gcttactc

SEQ ID NO: 59146 - DNA, 8 bp, Unknown
  misc_feature (1)..( 8): Matrix.003 file - promoters60/4768748
ttagctca

SEQ ID NO: 59147 - DNA, 7 bp, Unknown
  misc_feature (1)..( 7): Matrix.003 file - promoters60/4768748
actcgta

SEQ ID NO: 59148 - DNA, 9 bp, Unknown
  misc_feature (1)..( 9): Matrix.003 file - promoters60/4768748
tgaaaaact

SEQ ID NO: 59149 - DNA, 8 bp, Unknown
  misc_feature (1)..( 8): Matrix.003 file - promoters60/4768748
aatcaagt

SEQ ID NO: 59150 - DNA, 7 bp, Unknown
  misc_feature (1)..( 7): Matrix.003 file - promoters60/4768748
caaaaaa

SEQ ID NO: 59151 - DNA, 8 bp, Unknown
  misc_feature (1)..( 8): Matrix.003 file - promoters60/4768778
gtttttgt

SEQ ID NO: 59152 - DNA, 10 bp, Unknown
  misc_feature (1)..( 10): Matrix.003 file - promoters60/4768778
ttgtattttt

SEQ ID NO: 59153 - DNA, 7 bp, Unknown
  misc_feature (1)..( 7): Matrix.003 file - promoters60/4768782
attgtgt

SEQ ID NO: 59154 - DNA, 11 bp, Unknown
  misc_feature (1)..( 11): Matrix.003 file - promoters60/4768782
ttggaaaatgt

SEQ ID NO: 59155 - DNA, 8 bp, Unknown
  misc_feature (1)..( 8): Matrix.003 file - promoters60/4768782
attattct

SEQ ID NO: 59156 - DNA, 10 bp, Unknown
  misc_feature (1)..( 10): Matrix.003 file - promoters60/4768782
aagtaaatga

SEQ ID NO: 59157 - DNA, 11 bp, Unknown
  misc_feature (1)..( 11): Matrix.003 file - promoters60/4768782
ttcttattgtt

SEQ ID NO: 59158 - DNA, 7 bp, Unknown
  misc_feature (1)..( 7): Matrix.003 file - promoters60/4768804
aattttg

SEQ ID NO: 59159 - DNA, 6 bp, Unknown
  misc_feature (1)..( 6): Matrix.003 file - promoters60/4768804
ctaaca

SEQ ID NO: 59160 - DNA, 8 bp, Unknown
  misc_feature (1)..( 8): Matrix.003 file - promoters60/4768804
ataagata

SEQ ID NO: 59161 - DNA, 7 bp, Unknown
  misc_feature (1)..( 7): Matrix.003 file - promoters60/4768804
aataaaa

SEQ ID NO: 59162 - DNA, 10 bp, Unknown
  misc_feature (1)..( 10): Matrix.003 file - promoters60/4768804
aatagataaa

SEQ ID NO: 59163 - DNA, 8 bp, Unknown
  misc_feature (1)..( 8): Matrix.003 file - promoters60/4768804
ttgagaaa

SEQ ID NO: 59164 - DNA, 6 bp, Unknown
  misc_feature (1)..( 6): Matrix.003 file - promoters60/4768804
gttaag

SEQ ID NO: 59165 - DNA, 7 bp, Unknown
  misc_feature (1)..( 7): Matrix.003 file - promoters60/4768804
agagaca

SEQ ID NO: 59166 - DNA, 6 bp, Unknown
  misc_feature (1)..( 6): Matrix.003 file - promoters60/4768804
tgctaa

SEQ ID NO: 59167 - DNA, 6 bp, Unknown
  misc_feature (1)..( 6): Matrix.003 file - promoters60/4768804
attata

SEQ ID NO: 59168 - DNA, 7 bp, Unknown
  misc_feature (1)..( 7): Matrix.003 file - promoters60/4768804
tttaaag

SEQ ID NO: 59169 - DNA, 6 bp, Unknown
  misc_feature (1)..( 6): Matrix.003 file - promoters60/4768811
aaagta

SEQ ID NO: 59170 - DNA, 7 bp, Unknown
  misc_feature (1)..( 7): Matrix.003 file - promoters60/4768811
tcccact

SEQ ID NO: 59171 - DNA, 6 bp, Unknown
  misc_feature (1)..( 6): Matrix.003 file - promoters60/4768811
tacgcg

SEQ ID NO: 59172 - DNA, 7 bp, Unknown
  misc_feature (1)..( 7): Matrix.003 file - promoters60/4768811
ctaattt

SEQ ID NO: 59173 - DNA, 6 bp, Unknown
  misc_feature (1)..( 6): Matrix.003 file - promoters60/4768811
tttgga

SEQ ID NO: 59174 - DNA, 6 bp, Unknown
  misc_feature (1)..( 6): Matrix.003 file - promoters60/4768811
gatttg

SEQ ID NO: 59175 - DNA, 8 bp, Unknown
  misc_feature (1)..( 8): Matrix.003 file - promoters60/4768811
aaaacttt

SEQ ID NO: 59176 - DNA, 8 bp, Unknown
  misc_feature (1)..( 8): Matrix.003 file - promoters60/4768811
gaggtgct

SEQ ID NO: 59177 - DNA, 7 bp, Unknown
  misc_feature (1)..( 7): Matrix.003 file - promoters60/4768811
gagcttc

SEQ ID NO: 59178 - DNA, 6 bp, Unknown
  misc_feature (1)..( 6): Matrix.003 file - promoters60/4768811
ttagat

SEQ ID NO: 59179 - DNA, 7 bp, Unknown
  misc_feature (1)..( 7): Matrix.003 file - promoters60/4768811
tgtaaaa

SEQ ID NO: 59180 - DNA, 7 bp, Unknown
  misc_feature (1)..( 7): Matrix.003 file - promoters60/4768811
aagtttg

SEQ ID NO: 59181 - DNA, 7 bp, Unknown
  misc_feature (1)..( 7): Matrix.003 file - promoters60/4768811
taaataa

SEQ ID NO: 59182 - DNA, 9 bp, Unknown
  misc_feature (1)..( 9): Matrix.003 file - promoters60/4768829
ctaaaaatt

SEQ ID NO: 59183 - DNA, 11 bp, Unknown
  misc_feature (1)..( 11): Matrix.003 file - promoters60/4768829
caaacaaatgt

SEQ ID NO: 59184 - DNA, 6 bp, Unknown
  misc_feature (1)..( 6): Matrix.003 file - promoters60/4768829
taatta

SEQ ID NO: 59185 - DNA, 12 bp, Unknown
  misc_feature (1)..( 12): Matrix.003 file - promoters60/4768829
aaaaattctaaa

SEQ ID NO: 59186 - DNA, 8 bp, Unknown
  misc_feature (1)..( 8): Matrix.003 file - promoters60/4768848
tggaaaat

SEQ ID NO: 59187 - DNA, 8 bp, Unknown
  misc_feature (1)..( 8): Matrix.003 file - promoters60/4768848
ttctgact

SEQ ID NO: 59188 - DNA, 6 bp, Unknown
  misc_feature (1)..( 6): Matrix.003 file - promoters60/4768848
aatgat

SEQ ID NO: 59189 - DNA, 9 bp, Unknown
  misc_feature (1)..( 9): Matrix.003 file - promoters60/4768848
tactccatt

SEQ ID NO: 59190 - DNA, 10 bp, Unknown
  misc_feature (1)..( 10): Matrix.003 file - promoters60/4768848
ttttaaggtt

SEQ ID NO: 59191 - DNA, 7 bp, Unknown
  misc_feature (1)..( 7): Matrix.003 file - promoters60/4768848
gttatat

SEQ ID NO: 59192 - DNA, 6 bp, Unknown
  misc_feature (1)..( 6): Matrix.003 file - promoters60/4768848
attttt

SEQ ID NO: 59193 - DNA, 6 bp, Unknown
  misc_feature (1)..( 6): Matrix.003 file - promoters60/4768848
tccaaa

SEQ ID NO: 59194 - DNA, 8 bp, Unknown
  misc_feature (1)..( 8): Matrix.003 file - promoters60/4768848
attaaaat

SEQ ID NO: 59195 - DNA, 7 bp, Unknown
  misc_feature (1)..( 7): Matrix.003 file - promoters60/4768848
tttctca

SEQ ID NO: 59196 - DNA, 8 bp, Unknown
  misc_feature (1)..( 8): Matrix.003 file - promoters60/4768848
cattctct

SEQ ID NO: 59197 - DNA, 6 bp, Unknown
  misc_feature (1)..( 6): Matrix.003 file - promoters60/4768848
aagaaa

SEQ ID NO: 59198 - DNA, 7 bp, Unknown
  misc_feature (1)..( 7): Matrix.003 file - promoters60/4768848
agaaagt

SEQ ID NO: 59199 - DNA, 6 bp, Unknown
  misc_feature (1)..( 6): Matrix.003 file - promoters60/4768848
aaatgc

SEQ ID NO: 59200 - DNA, 15 bp, Unknown
  misc_feature (1)..( 15): Matrix.003 file - promoters60/4768856
gtaacaattctattt

SEQ ID NO: 59201 - DNA, 11 bp, Unknown
  misc_feature (1)..( 11): Matrix.003 file - promoters60/4768856
atttgattata

SEQ ID NO: 59202 - DNA, 11 bp, Unknown
  misc_feature (1)..( 11): Matrix.003 file - promoters60/4768856
tgattaaataa

SEQ ID NO: 59203 - DNA, 10 bp, Unknown
  misc_feature (1)..( 10): Matrix.003 file - promoters60/4768856
gattaaataa

SEQ ID NO: 59204 - DNA, 10 bp, Unknown
  misc_feature (1)..( 10): Matrix.003 file - promoters60/4768856
tttattgttt

SEQ ID NO: 59205 - DNA, 10 bp, Unknown
  misc_feature (1)..( 10): Matrix.003 file - promoters60/4768856
atactttatt

SEQ ID NO: 59206 - DNA, 9 bp, Unknown
  misc_feature (1)..( 9): Matrix.003 file - promoters60/4768856
agtaataaa

SEQ ID NO: 59207 - DNA, 6 bp, Unknown
  misc_feature (1)..( 6): Matrix.003 file - promoters60/4768928
gtttca

SEQ ID NO: 59208 - DNA, 8 bp, Unknown
  misc_feature (1)..( 8): Matrix.003 file - promoters60/4768928
ttcagatc

SEQ ID NO: 59209 - DNA, 10 bp, Unknown
  misc_feature (1)..( 10): Matrix.003 file - promoters60/4768928
tagatgtgtt

SEQ ID NO: 59210 - DNA, 6 bp, Unknown
  misc_feature (1)..( 6): Matrix.003 file - promoters60/4768928
gcaata

SEQ ID NO: 59211 - DNA, 8 bp, Unknown
  misc_feature (1)..( 8): Matrix.003 file - promoters60/4768928
aaagaaaa

SEQ ID NO: 59212 - DNA, 10 bp, Unknown
  misc_feature (1)..( 10): Matrix.003 file - promoters60/4768928
aaagaaaaga

SEQ ID NO: 59213 - DNA, 8 bp, Unknown
  misc_feature (1)..( 8): Matrix.003 file - promoters60/4768928
agaattta

SEQ ID NO: 59214 - DNA, 9 bp, Unknown
  misc_feature (1)..( 9): Matrix.003 file - promoters60/4768928
agaaatttg

SEQ ID NO: 59215 - DNA, 8 bp, Unknown
  misc_feature (1)..( 8): Matrix.003 file - promoters60/4768928
tgttggaa

SEQ ID NO: 59216 - DNA, 11 bp, Unknown
  misc_feature (1)..( 11): Matrix.003 file - promoters60/4768928
agtgaaagata

SEQ ID NO: 59217 - DNA, 7 bp, Unknown
  misc_feature (1)..( 7): Matrix.003 file - promoters60/4768928
aaactta

SEQ ID NO: 59218 - DNA, 6 bp, Unknown
  misc_feature (1)..( 6): Matrix.003 file - promoters60/4768928
taataa

SEQ ID NO: 59219 - DNA, 6 bp, Unknown
  misc_feature (1)..( 6): Matrix.003 file - promoters60/4768928
agtaaa

SEQ ID NO: 59220 - DNA, 7 bp, Unknown
  misc_feature (1)..( 7): Matrix.003 file - promoters60/4768928
aatcggg

SEQ ID NO: 59221 - DNA, 10 bp, Unknown
  misc_feature (1)..( 10): Matrix.003 file - promoters60/4768928
aaataaaata

SEQ ID NO: 59222 - DNA, 7 bp, Unknown
  misc_feature (1)..( 7): Matrix.003 file - promoters60/4768928
cccacta

SEQ ID NO: 59223 - DNA, 9 bp, Unknown
  misc_feature (1)..( 9): Matrix.003 file - promoters60/4768928
aaagaaaag

SEQ ID NO: 59224 - DNA, 7 bp, Unknown
  misc_feature (1)..( 7): Matrix.003 file - promoters60/4768928
gtatata

SEQ ID NO: 59225 - DNA, 8 bp, Unknown
  misc_feature (1)..( 8): Matrix.003 file - promoters60/4769048
aaatttgg

SEQ ID NO: 59226 - DNA, 6 bp, Unknown
  misc_feature (1)..( 6): Matrix.003 file - promoters60/4769052
ttgtaa

SEQ ID NO: 59227 - DNA, 6 bp, Unknown
  misc_feature (1)..( 6): Matrix.003 file - promoters60/4769052
cctttt

SEQ ID NO: 59228 - DNA, 8 bp, Unknown
  misc_feature (1)..( 8): Matrix.003 file - promoters60/4769052
aatagatc

SEQ ID NO: 59229 - DNA, 8 bp, Unknown
  misc_feature (1)..( 8): Matrix.003 file - promoters60/4769052
aaaaatta

SEQ ID NO: 59230 - DNA, 9 bp, Unknown
  misc_feature (1)..( 9): Matrix.003 file - promoters60/4769052
ggataaaat

SEQ ID NO: 59231 - DNA, 6 bp, Unknown
  misc_feature (1)..( 6): Matrix.003 file - promoters60/4769052
taggtt

SEQ ID NO: 59232 - DNA, 6 bp, Unknown
  misc_feature (1)..( 6): Matrix.003 file - promoters60/4769052
aaaaaa

SEQ ID NO: 59233 - DNA, 7 bp, Unknown
  misc_feature (1)..( 7): Matrix.003 file - promoters60/4769052
attaaca

SEQ ID NO: 59234 - DNA, 6 bp, Unknown
  misc_feature (1)..( 6): Matrix.003 file - promoters60/4769052
gaaatt

SEQ ID NO: 59235 - DNA, 7 bp, Unknown
  misc_feature (1)..( 7): Matrix.003 file - promoters60/4769052
atctcag

SEQ ID NO: 59236 - DNA, 7 bp, Unknown
  misc_feature (1)..( 7): Matrix.003 file - promoters60/4769052
caaaaca

SEQ ID NO: 59237 - DNA, 7 bp, Unknown
  misc_feature (1)..( 7): Matrix.003 file - promoters60/4769052
aacactc

SEQ ID NO: 59238 - DNA, 7 bp, Unknown
  misc_feature (1)..( 7): Matrix.003 file - promoters60/4769052
tatctcg

SEQ ID NO: 59239 - DNA, 6 bp, Unknown
  misc_feature (1)..( 6): Matrix.003 file - promoters60/4769052
catcca

SEQ ID NO: 59240 - DNA, 6 bp, Unknown
  misc_feature (1)..( 6): Matrix.003 file - promoters60/4769052
aatcca

SEQ ID NO: 59241 - DNA, 7 bp, Unknown
  misc_feature (1)..( 7): Matrix.003 file - promoters60/4769052
tattatc

SEQ ID NO: 59242 - DNA, 7 bp, Unknown
  misc_feature (1)..( 7): Matrix.003 file - promoters60/4769055
aatagga

SEQ ID NO: 59243 - DNA, 9 bp, Unknown
  misc_feature (1)..( 9): Matrix.003 file - promoters60/4769055
tagaaatac

SEQ ID NO: 59244 - DNA, 9 bp, Unknown
  misc_feature (1)..( 9): Matrix.003 file - promoters60/4769055
gaaagttaa

SEQ ID NO: 59245 - DNA, 6 bp, Unknown
  misc_feature (1)..( 6): Matrix.003 file - promoters60/4769055
aatttt

SEQ ID NO: 59246 - DNA, 8 bp, Unknown
  misc_feature (1)..( 8): Matrix.003 file - promoters60/4769055
tttaaatt

SEQ ID NO: 59247 - DNA, 6 bp, Unknown
  misc_feature (1)..( 6): Matrix.003 file - promoters60/4769055
cctaaa

SEQ ID NO: 59248 - DNA, 11 bp, Unknown
  misc_feature (1)..( 11): Matrix.003 file - promoters60/4769055
taaaatattga

SEQ ID NO: 59249 - DNA, 12 bp, Unknown
  misc_feature (1)..( 12): Matrix.003 file - promoters60/4769055
gaaaagcaaaac

SEQ ID NO: 59250 - DNA, 9 bp, Unknown
  misc_feature (1)..( 9): Matrix.003 file - promoters60/4769055
ttaaatttt

SEQ ID NO: 59251 - DNA, 7 bp, Unknown
  misc_feature (1)..( 7): Matrix.003 file - promoters60/4769055
caagtgt

SEQ ID NO: 59252 - DNA, 7 bp, Unknown
  misc_feature (1)..( 7): Matrix.003 file - promoters60/4769055
ctgattt

SEQ ID NO: 59253 - DNA, 6 bp, Unknown
  misc_feature (1)..( 6): Matrix.003 file - promoters60/4769055
tcttcc

SEQ ID NO: 59254 - DNA, 8 bp, Unknown
  misc_feature (1)..( 8): Matrix.003 file - promoters60/4769055
ctctctcg

SEQ ID NO: 59255 - DNA, 6 bp, Unknown
  misc_feature (1)..( 6): Matrix.003 file - promoters60/4769059
aaagaa

SEQ ID NO: 59256 - DNA, 7 bp, Unknown
  misc_feature (1)..( 7): Matrix.003 file - promoters60/4769059
tccacca

SEQ ID NO: 59257 - DNA, 7 bp, Unknown
  misc_feature (1)..( 7): Matrix.003 file - promoters60/4769059
taccgca

SEQ ID NO: 59258 - DNA, 6 bp, Unknown
  misc_feature (1)..( 6): Matrix.003 file - promoters60/4769059
tgacgg

SEQ ID NO: 59259 - DNA, 8 bp, Unknown
  misc_feature (1)..( 8): Matrix.003 file - promoters60/4769059
aagcgaat

SEQ ID NO: 59260 - DNA, 12 bp, Unknown
  misc_feature (1)..( 12): Matrix.003 file - promoters60/4769059
ttatatctttat

SEQ ID NO: 59261 - DNA, 9 bp, Unknown
  misc_feature (1)..( 9): Matrix.003 file - promoters60/4769059
gtgttcatt

SEQ ID NO: 59262 - DNA, 8 bp, Unknown
  misc_feature (1)..( 8): Matrix.003 file - promoters60/4769059
tggtcagt

SEQ ID NO: 59263 - DNA, 6 bp, Unknown
  misc_feature (1)..( 6): Matrix.003 file - promoters60/4769059
gttctc

SEQ ID NO: 59264 - DNA, 6 bp, Unknown
  misc_feature (1)..( 6): Matrix.003 file - promoters60/4769059
cctttt

SEQ ID NO: 59265 - DNA, 6 bp, Unknown
  misc_feature (1)..( 6): Matrix.003 file - promoters60/4769059
tcttta

SEQ ID NO: 59266 - DNA, 7 bp, Unknown
  misc_feature (1)..( 7): Matrix.003 file - promoters60/4769059
tggagtc

SEQ ID NO: 59267 - DNA, 7 bp, Unknown
  misc_feature (1)..( 7): Matrix.003 file - promoters60/4769059
tatcatt

SEQ ID NO: 59268 - DNA, 7 bp, Unknown
  misc_feature (1)..( 7): Matrix.003 file - promoters60/4769059
gaatttg

SEQ ID NO: 59269 - DNA, 7 bp, Unknown
  misc_feature (1)..( 7): Matrix.003 file - promoters60/4769059
tttgatt

SEQ ID NO: 59270 - DNA, 6 bp, Unknown
  misc_feature (1)..( 6): Matrix.003 file - promoters60/4769059
catttg

SEQ ID NO: 59271 - DNA, 6 bp, Unknown
  misc_feature (1)..( 6): Matrix.003 file - promoters60/4769075
ataaat

SEQ ID NO: 59272 - DNA, 6 bp, Unknown
  misc_feature (1)..( 6): Matrix.003 file - promoters60/4769075
aaacca

SEQ ID NO: 59273 - DNA, 11 bp, Unknown
  misc_feature (1)..( 11): Matrix.003 file - promoters60/4769075
acactatactg

SEQ ID NO: 59274 - DNA, 6 bp, Unknown
  misc_feature (1)..( 6): Matrix.003 file - promoters60/4769075
tttgat

SEQ ID NO: 59275 - DNA, 7 bp, Unknown
  misc_feature (1)..( 7): Matrix.003 file - promoters60/4769075
atgcgct

SEQ ID NO: 59276 - DNA, 6 bp, Unknown
  misc_feature (1)..( 6): Matrix.003 file - promoters60/4769075
caatta

SEQ ID NO: 59277 - DNA, 6 bp, Unknown
  misc_feature (1)..( 6): Matrix.003 file - promoters60/4769075
caattt

SEQ ID NO: 59278 - DNA, 7 bp, Unknown
  misc_feature (1)..( 7): Matrix.003 file - promoters60/4769075
tttcact

SEQ ID NO: 59279 - DNA, 6 bp, Unknown
  misc_feature (1)..( 6): Matrix.003 file - promoters60/4769075
tctaaa

SEQ ID NO: 59280 - DNA, 8 bp, Unknown
  misc_feature (1)..( 8): Matrix.003 file - promoters60/4769075
attttcta

SEQ ID NO: 59281 - DNA, 9 bp, Unknown
  misc_feature (1)..( 9): Matrix.003 file - promoters60/4769075
taaaagccg

SEQ ID NO: 59282 - DNA, 9 bp, Unknown
  misc_feature (1)..( 9): Matrix.003 file - promoters60/4769075
gaaggattt

SEQ ID NO: 59283 - DNA, 6 bp, Unknown
  misc_feature (1)..( 6): Matrix.003 file - promoters60/4769075
aaacca

SEQ ID NO: 59284 - DNA, 7 bp, Unknown
  misc_feature (1)..( 7): Matrix.003 file - promoters60/4769075
aaagaaa

SEQ ID NO: 59285 - DNA, 6 bp, Unknown
  misc_feature (1)..( 6): Matrix.003 file - promoters60/4769075
tgattt

SEQ ID NO: 59286 - DNA, 7 bp, Unknown
  misc_feature (1)..( 7): Matrix.003 file - promoters60/4769075
tgaccaa

SEQ ID NO: 59287 - DNA, 7 bp, Unknown
  misc_feature (1)..( 7): Matrix.003 file - promoters60/4769083
gagccac

SEQ ID NO: 59288 - DNA, 9 bp, Unknown
  misc_feature (1)..( 9): Matrix.003 file - promoters60/4769083
ttaatttat

SEQ ID NO: 59289 - DNA, 7 bp, Unknown
  misc_feature (1)..( 7): Matrix.003 file - promoters60/4769083
aatttat

SEQ ID NO: 59290 - DNA, 6 bp, Unknown
  misc_feature (1)..( 6): Matrix.003 file - promoters60/4769083
aagctc

SEQ ID NO: 59291 - DNA, 7 bp, Unknown
  misc_feature (1)..( 7): Matrix.003 file - promoters60/4769083
ctcacat

SEQ ID NO: 59292 - DNA, 7 bp, Unknown
  misc_feature (1)..( 7): Matrix.003 file - promoters60/4769083
taaaata

SEQ ID NO: 59293 - DNA, 12 bp, Unknown
  misc_feature (1)..( 12): Matrix.003 file - promoters60/4769083
gttaggttgata

SEQ ID NO: 59294 - DNA, 9 bp, Unknown
  misc_feature (1)..( 9): Matrix.003 file - promoters60/4769083
taaagaaaa

SEQ ID NO: 59295 - DNA, 8 bp, Unknown
  misc_feature (1)..( 8): Matrix.003 file - promoters60/4769083
aaaataaa

SEQ ID NO: 59296 - DNA, 6 bp, Unknown
  misc_feature (1)..( 6): Matrix.003 file - promoters60/4769083
aaaata

SEQ ID NO: 59297 - DNA, 9 bp, Unknown
  misc_feature (1)..( 9): Matrix.003 file - promoters60/4769083
ttctcaacc

SEQ ID NO: 59298 - DNA, 8 bp, Unknown
  misc_feature (1)..( 8): Matrix.003 file - promoters60/4769083
tatatata

SEQ ID NO: 59299 - DNA, 7 bp, Unknown
  misc_feature (1)..( 7): Matrix.003 file - promoters60/4769083
ccaaaaa

SEQ ID NO: 59300 - DNA, 11 bp, Unknown
  misc_feature (1)..( 11): Matrix.003 file - promoters60/4769083
attaaaagcaa

SEQ ID NO: 59301 - DNA, 8 bp, Unknown
  misc_feature (1)..( 8): Matrix.003 file - promoters60/4769083
ctaaaaat

SEQ ID NO: 59302 - DNA, 6 bp, Unknown
  misc_feature (1)..( 6): Matrix.003 file - promoters60/4769083
aaatgt

SEQ ID NO: 59303 - DNA, 9 bp, Unknown
  misc_feature (1)..( 9): Matrix.003 file - promoters60/4769083
aaaaacaaa

SEQ ID NO: 59304 - DNA, 7 bp, Unknown
  misc_feature (1)..( 7): Matrix.003 file - promoters60/4769083
atcacaa

SEQ ID NO: 59305 - DNA, 8 bp, Unknown
  misc_feature (1)..( 8): Matrix.003 file - promoters60/4769083
aagaatcc

SEQ ID NO: 59306 - DNA, 8 bp, Unknown
  misc_feature (1)..( 8): Matrix.003 file - promoters60/4769083
tataaaac

SEQ ID NO: 59307 - DNA, 6 bp, Unknown
  misc_feature (1)..( 6): Matrix.003 file - promoters60/4769083
atgttt

SEQ ID NO: 59308 - DNA, 7 bp, Unknown
  misc_feature (1)..( 7): Matrix.003 file - promoters60/4769083
taaaaat

SEQ ID NO: 59309 - DNA, 7 bp, Unknown
  misc_feature (1)..( 7): Matrix.003 file - promoters60/4769083
atcatca

SEQ ID NO: 59310 - DNA, 6 bp, Unknown
  misc_feature (1)..( 6): Matrix.003 file - promoters60/4769107
ttgttt

SEQ ID NO: 59311 - DNA, 6 bp, Unknown
  misc_feature (1)..( 6): Matrix.003 file - promoters60/4769107
atatat

SEQ ID NO: 59312 - DNA, 6 bp, Unknown
  misc_feature (1)..( 6): Matrix.003 file - promoters60/4769107
attttt

SEQ ID NO: 59313 - DNA, 8 bp, Unknown
  misc_feature (1)..( 8): Matrix.003 file - promoters60/4769107
aaacaaaa

SEQ ID NO: 59314 - DNA, 7 bp, Unknown
  misc_feature (1)..( 7): Matrix.003 file - promoters60/4769107
aataaac

SEQ ID NO: 59315 - DNA, 6 bp, Unknown
  misc_feature (1)..( 6): Matrix.003 file - promoters60/4769107
tttatt

SEQ ID NO: 59316 - DNA, 6 bp, Unknown
  misc_feature (1)..( 6): Matrix.003 file - promoters60/4769107
attaaa

SEQ ID NO: 59317 - DNA, 6 bp, Unknown
  misc_feature (1)..( 6): Matrix.003 file - promoters60/4769107
attaca

SEQ ID NO: 59318 - DNA, 6 bp, Unknown
  misc_feature (1)..( 6): Matrix.003 file - promoters60/4769107
tatatt

SEQ ID NO: 59319 - DNA, 12 bp, Unknown
  misc_feature (1)..( 12): Matrix.003 file - promoters60/4769107
tatatataatgc

SEQ ID NO: 59320 - DNA, 9 bp, Unknown
  misc_feature (1)..( 9): Matrix.003 file - promoters60/4769107
tttttatat

SEQ ID NO: 59321 - DNA, 7 bp, Unknown
  misc_feature (1)..( 7): Matrix.003 file - promoters60/4769107
aacatta

SEQ ID NO: 59322 - DNA, 10 bp, Unknown
  misc_feature (1)..( 10): Matrix.003 file - promoters60/4769107
aaaaacaaat

SEQ ID NO: 59323 - DNA, 8 bp, Unknown
  misc_feature (1)..( 8): Matrix.003 file - promoters60/4769107
aaaaaaac

SEQ ID NO: 59324 - DNA, 7 bp, Unknown
  misc_feature (1)..( 7): Matrix.003 file - promoters60/4769107
accacag

SEQ ID NO: 59325 - DNA, 8 bp, Unknown
  misc_feature (1)..( 8): Matrix.003 file - promoters60/4769107
aaaaaaaa

SEQ ID NO: 59326 - DNA, 6 bp, Unknown
  misc_feature (1)..( 6): Matrix.003 file - promoters60/4769107
aaaaaa

SEQ ID NO: 59327 - DNA, 7 bp, Unknown
  misc_feature (1)..( 7): Matrix.003 file - promoters60/4769107
aaaaaag

SEQ ID NO: 59328 - DNA, 7 bp, Unknown
  misc_feature (1)..( 7): Matrix.003 file - promoters60/4769107
ttctttt

SEQ ID NO: 59329 - DNA, 6 bp, Unknown
  misc_feature (1)..( 6): Matrix.003 file - promoters60/4769107
ataaag

SEQ ID NO: 59330 - DNA, 8 bp, Unknown
  misc_feature (1)..( 8): Matrix.003 file - promoters60/4769107
cttcgcaa

SEQ ID NO: 59331 - DNA, 8 bp, Unknown
  misc_feature (1)..( 8): Matrix.003 file - promoters60/4769107
tttaaaaa

SEQ ID NO: 59332 - DNA, 6 bp, Unknown
  misc_feature (1)..( 6): Matrix.003 file - promoters60/4769107
tcattt

SEQ ID NO: 59333 - DNA, 8 bp, Unknown
  misc_feature (1)..( 8): Matrix.003 file - promoters60/4769107
ttgtttca

SEQ ID NO: 59334 - DNA, 8 bp, Unknown
  misc_feature (1)..( 8): Matrix.003 file - promoters60/4769107
tctatata

SEQ ID NO: 59335 - DNA, 6 bp, Unknown
  misc_feature (1)..( 6): Matrix.003 file - promoters60/4769107
aagata

SEQ ID NO: 59336 - DNA, 11 bp, Unknown
  misc_feature (1)..( 11): Matrix.003 file - promoters60/4769107
atccaccaccg

SEQ ID NO: 59337 - DNA, 13 bp, Unknown
  misc_feature (1)..( 13): Matrix.003 file - promoters60/4769137
aacgtcgtctaat

SEQ ID NO: 59338 - DNA, 8 bp, Unknown
  misc_feature (1)..( 8): Matrix.003 file - promoters60/4769137
catataaa

SEQ ID NO: 59339 - DNA, 8 bp, Unknown
  misc_feature (1)..( 8): Matrix.003 file - promoters60/4769141
atttaaat

SEQ ID NO: 59340 - DNA, 9 bp, Unknown
  misc_feature (1)..( 9): Matrix.003 file - promoters60/4769141
aaaaactaa

SEQ ID NO: 59341 - DNA, 11 bp, Unknown
  misc_feature (1)..( 11): Matrix.003 file - promoters60/4769141
aaaataattat

SEQ ID NO: 59342 - DNA, 8 bp, Unknown
  misc_feature (1)..( 8): Matrix.003 file - promoters60/4769141
atttctaa

SEQ ID NO: 59343 - DNA, 11 bp, Unknown
  misc_feature (1)..( 11): Matrix.003 file - promoters60/4769141
aagaaaaaagt

SEQ ID NO: 59344 - DNA, 11 bp, Unknown
  misc_feature (1)..( 11): Matrix.003 file - promoters60/4769141
tatataaaagc

SEQ ID NO: 59345 - DNA, 10 bp, Unknown
  misc_feature (1)..( 10): Matrix.003 file - promoters60/4769141
ttaataaaac

SEQ ID NO: 59346 - DNA, 8 bp, Unknown
  misc_feature (1)..( 8): Matrix.003 file - promoters60/4769153
aaaaataa

SEQ ID NO: 59347 - DNA, 11 bp, Unknown
  misc_feature (1)..( 11): Matrix.003 file - promoters60/4769153
aacaaaaacaa

SEQ ID NO: 59348 - DNA, 7 bp, Unknown
  misc_feature (1)..( 7): Matrix.003 file - promoters60/4769153
aaacata

SEQ ID NO: 59349 - DNA, 12 bp, Unknown
  misc_feature (1)..( 12): Matrix.003 file - promoters60/4769153
atattaaaaaaa

SEQ ID NO: 59350 - DNA, 11 bp, Unknown
  misc_feature (1)..( 11): Matrix.003 file - promoters60/4769153
atattaaaaaa

SEQ ID NO: 59351 - DNA, 7 bp, Unknown
  misc_feature (1)..( 7): Matrix.003 file - promoters60/4769169
tccaaaa

SEQ ID NO: 59352 - DNA, 9 bp, Unknown
  misc_feature (1)..( 9): Matrix.003 file - promoters60/4769169
aaaaacaaa

SEQ ID NO: 59353 - DNA, 7 bp, Unknown
  misc_feature (1)..( 7): Matrix.003 file - promoters60/4769169
cccacga

SEQ ID NO: 59354 - DNA, 8 bp, Unknown
  misc_feature (1)..( 8): Matrix.003 file - promoters60/4769169
aaattata

SEQ ID NO: 59355 - DNA, 8 bp, Unknown
  misc_feature (1)..( 8): Matrix.003 file - promoters60/4769169
aaaaataa

SEQ ID NO: 59356 - DNA, 10 bp, Unknown
  misc_feature (1)..( 10): Matrix.003 file - promoters60/4769169
aaatatttaa

SEQ ID NO: 59357 - DNA, 9 bp, Unknown
  misc_feature (1)..( 9): Matrix.003 file - promoters60/4769169
ttaaacata

SEQ ID NO: 59358 - DNA, 9 bp, Unknown
  misc_feature (1)..( 9): Matrix.003 file - promoters60/4769169
attttgtaa

SEQ ID NO: 59359 - DNA, 7 bp, Unknown
  misc_feature (1)..( 7): Matrix.003 file - promoters60/4769169
aaaatta

SEQ ID NO: 59360 - DNA, 7 bp, Unknown
  misc_feature (1)..( 7): Matrix.003 file - promoters60/4769169
gtaaaat

SEQ ID NO: 59361 - DNA, 9 bp, Unknown
  misc_feature (1)..( 9): Matrix.003 file - promoters60/4769169
ataatattt

SEQ ID NO: 59362 - DNA, 6 bp, Unknown
  misc_feature (1)..( 6): Matrix.003 file - promoters60/4769169
ttcaaa

SEQ ID NO: 59363 - DNA, 9 bp, Unknown
  misc_feature (1)..( 9): Matrix.003 file - promoters60/4769169
tttttttta

SEQ ID NO: 59364 - DNA, 10 bp, Unknown
  misc_feature (1)..( 10): Matrix.003 file - promoters60/4769169
attaatgttc

SEQ ID NO: 59365 - DNA, 9 bp, Unknown
  misc_feature (1)..( 9): Matrix.003 file - promoters60/4769169
ttaaaaata

SEQ ID NO: 59366 - DNA, 9 bp, Unknown
  misc_feature (1)..( 9): Matrix.003 file - promoters60/4769169
ttaaaaata

SEQ ID NO: 59367 - DNA, 9 bp, Unknown
  misc_feature (1)..( 9): Matrix.003 file - promoters60/4769180
acattaata

SEQ ID NO: 59368 - DNA, 8 bp, Unknown
  misc_feature (1)..( 8): Matrix.003 file - promoters60/4769180
aaaacatt

SEQ ID NO: 59369 - DNA, 9 bp, Unknown
  misc_feature (1)..( 9): Matrix.003 file - promoters60/4769180
agatttatc

SEQ ID NO: 59370 - DNA, 9 bp, Unknown
  misc_feature (1)..( 9): Matrix.003 file - promoters60/4769180
atttatctt

SEQ ID NO: 59371 - DNA, 11 bp, Unknown
  misc_feature (1)..( 11): Matrix.003 file - promoters60/4769180
aaataaacaaa

SEQ ID NO: 59372 - DNA, 10 bp, Unknown
  misc_feature (1)..( 10): Matrix.003 file - promoters60/4769180
aaataaacaa

SEQ ID NO: 59373 - DNA, 8 bp, Unknown
  misc_feature (1)..( 8): Matrix.003 file - promoters60/4769180
tcataaaa

SEQ ID NO: 59374 - DNA, 9 bp, Unknown
  misc_feature (1)..( 9): Matrix.003 file - promoters60/4769180
ataacaaat

SEQ ID NO: 59375 - DNA, 8 bp, Unknown
  misc_feature (1)..( 8): Matrix.003 file - promoters60/4769180
aaaaaaaa

SEQ ID NO: 59376 - DNA, 11 bp, Unknown
  misc_feature (1)..( 11): Matrix.003 file - promoters60/4769180
gaataacaaaa

SEQ ID NO: 59377 - DNA, 12 bp, Unknown
  misc_feature (1)..( 12): Matrix.003 file - promoters60/4769180
gaataaccaaaa

SEQ ID NO: 59378 - DNA, 9 bp, Unknown
  misc_feature (1)..( 9): Matrix.003 file - promoters60/4769180
aaattaatc

SEQ ID NO: 59379 - DNA, 16 bp, Unknown
  misc_feature (1)..( 16): Matrix.003 file - promoters60/4769184
tgctaaaagtacaagt

SEQ ID NO: 59380 - DNA, 9 bp, Unknown
  misc_feature (1)..( 9): Matrix.003 file - promoters60/4769184
tctaaaatt

SEQ ID NO: 59381 - DNA, 15 bp, Unknown
  misc_feature (1)..( 15): Matrix.003 file - promoters60/4769184
taaaagtacaattta

SEQ ID NO: 59382 - DNA, 9 bp, Unknown
  misc_feature (1)..( 9): Matrix.003 file - promoters60/4769184
aaaaattct

SEQ ID NO: 59383 - DNA, 9 bp, Unknown
  misc_feature (1)..( 9): Matrix.003 file - promoters60/4769184
atttaatta

SEQ ID NO: 59384 - DNA, 8 bp, Unknown
  misc_feature (1)..( 8): Matrix.003 file - promoters60/4769184
aattatat

SEQ ID NO: 59385 - DNA, 11 bp, Unknown
  misc_feature (1)..( 11): Matrix.003 file - promoters60/4769184
ttcctagatac

SEQ ID NO: 59386 - DNA, 10 bp, Unknown
  misc_feature (1)..( 10): Matrix.003 file - promoters60/4769186
cgaaaagaaa

SEQ ID NO: 59387 - DNA, 7 bp, Unknown
  misc_feature (1)..( 7): Matrix.003 file - promoters60/4769186
aaaatat

SEQ ID NO: 59388 - DNA, 6 bp, Unknown
  misc_feature (1)..( 6): Matrix.003 file - promoters60/4769186
aatatt

SEQ ID NO: 59389 - DNA, 8 bp, Unknown
  misc_feature (1)..( 8): Matrix.003 file - promoters60/4769186
atgaagaa

SEQ ID NO: 59390 - DNA, 7 bp, Unknown
  misc_feature (1)..( 7): Matrix.003 file - promoters60/4769186
tataaac

SEQ ID NO: 59391 - DNA, 8 bp, Unknown
  misc_feature (1)..( 8): Matrix.003 file - promoters60/4769186
ggttgtgt

SEQ ID NO: 59392 - DNA, 10 bp, Unknown
  misc_feature (1)..( 10): Matrix.003 file - promoters60/4769186
gaacccacta

SEQ ID NO: 59393 - DNA, 6 bp, Unknown
  misc_feature (1)..( 6): Matrix.003 file - promoters60/4769186
tttatt

SEQ ID NO: 59394 - DNA, 6 bp, Unknown
  misc_feature (1)..( 6): Matrix.003 file - promoters60/4769186
agtaaa

SEQ ID NO: 59395 - DNA, 7 bp, Unknown
  misc_feature (1)..( 7): Matrix.003 file - promoters60/4769186
aatcggg

SEQ ID NO: 59396 - DNA, 8 bp, Unknown
  misc_feature (1)..( 8): Matrix.003 file - promoters60/4769186
gaaacaaa

SEQ ID NO: 59397 - DNA, 7 bp, Unknown
  misc_feature (1)..( 7): Matrix.003 file - promoters60/4769186
cccacta

SEQ ID NO: 59398 - DNA, 9 bp, Unknown
  misc_feature (1)..( 9): Matrix.003 file - promoters60/4769186
aaagaaaag

SEQ ID NO: 59399 - DNA, 7 bp, Unknown
  misc_feature (1)..( 7): Matrix.003 file - promoters60/4769186
gtatata

SEQ ID NO: 59400 - DNA, 7 bp, Unknown
  misc_feature (1)..( 7): Matrix.003 file - promoters60/4769229
tacgaaa

SEQ ID NO: 59401 - DNA, 9 bp, Unknown
  misc_feature (1)..( 9): Matrix.003 file - promoters60/4769229
gttgaaaaa

SEQ ID NO: 59402 - DNA, 6 bp, Unknown
  misc_feature (1)..( 6): Matrix.003 file - promoters60/4769229
ctatta

SEQ ID NO: 59403 - DNA, 7 bp, Unknown
  misc_feature (1)..( 7): Matrix.003 file - promoters60/4769229
tttttga

SEQ ID NO: 59404 - DNA, 9 bp, Unknown
  misc_feature (1)..( 9): Matrix.003 file - promoters60/4769229
aagaagaaa

SEQ ID NO: 59405 - DNA, 6 bp, Unknown
  misc_feature (1)..( 6): Matrix.003 file - promoters60/4769229
aattta

SEQ ID NO: 59406 - DNA, 9 bp, Unknown
  misc_feature (1)..( 9): Matrix.003 file - promoters60/4769229
ttataataa

SEQ ID NO: 59407 - DNA, 7 bp, Unknown
  misc_feature (1)..( 7): Matrix.003 file - promoters60/4769229
agagttt

SEQ ID NO: 59408 - DNA, 9 bp, Unknown
  misc_feature (1)..( 9): Matrix.003 file - promoters60/4769229
gactctctt

SEQ ID NO: 59409 - DNA, 7 bp, Unknown
  misc_feature (1)..( 7): Matrix.003 file - promoters60/4769229
aatacat

SEQ ID NO: 59410 - DNA, 7 bp, Unknown
  misc_feature (1)..( 7): Matrix.003 file - promoters60/4769229
aaggatt

SEQ ID NO: 59411 - DNA, 10 bp, Unknown
  misc_feature (1)..( 10): Matrix.003 file - promoters60/4769229
tatcttaccg

SEQ ID NO: 59412 - DNA, 8 bp, Unknown
  misc_feature (1)..( 8): Matrix.003 file - promoters60/4769229
aaaatccc

SEQ ID NO: 59413 - DNA, 8 bp, Unknown
  misc_feature (1)..( 8): Matrix.003 file - promoters60/4769257
aatacaaa

SEQ ID NO: 59414 - DNA, 10 bp, Unknown
  misc_feature (1)..( 10): Matrix.003 file - promoters60/4769257
taaaatctat

SEQ ID NO: 59415 - DNA, 9 bp, Unknown
  misc_feature (1)..( 9): Matrix.003 file - promoters60/4769257
ataaaaaaa

SEQ ID NO: 59416 - DNA, 12 bp, Unknown
  misc_feature (1)..( 12): Matrix.003 file - promoters60/4769257
taaaaaaaacga

SEQ ID NO: 59417 - DNA, 6 bp, Unknown
  misc_feature (1)..( 6): Matrix.003 file - promoters60/4769260
gattca

SEQ ID NO: 59418 - DNA, 7 bp, Unknown
  misc_feature (1)..( 7): Matrix.003 file - promoters60/4769260
tatgttc

SEQ ID NO: 59419 - DNA, 9 bp, Unknown
  misc_feature (1)..( 9): Matrix.003 file - promoters60/4769260
caaaaacaa

SEQ ID NO: 59420 - DNA, 7 bp, Unknown
  misc_feature (1)..( 7): Matrix.003 file - promoters60/4769260
taaaaag

SEQ ID NO: 59421 - DNA, 6 bp, Unknown
  misc_feature (1)..( 6): Matrix.003 file - promoters60/4769260
ttgatt

SEQ ID NO: 59422 - DNA, 7 bp, Unknown
  misc_feature (1)..( 7): Matrix.003 file - promoters60/4769260
caaaatt

SEQ ID NO: 59423 - DNA, 7 bp, Unknown
  misc_feature (1)..( 7): Matrix.003 file - promoters60/4769260
ataaaaa

SEQ ID NO: 59424 - DNA, 6 bp, Unknown
  misc_feature (1)..( 6): Matrix.003 file - promoters60/4769260
aaaaaa

SEQ ID NO: 59425 - DNA, 11 bp, Unknown
  misc_feature (1)..( 11): Matrix.003 file - promoters60/4769260
atgatttatgt

SEQ ID NO: 59426 - DNA, 6 bp, Unknown
  misc_feature (1)..( 6): Matrix.003 file - promoters60/4769260
atatgt

SEQ ID NO: 59427 - DNA, 7 bp, Unknown
  misc_feature (1)..( 7): Matrix.003 file - promoters60/4769260
ctagact

SEQ ID NO: 59428 - DNA, 10 bp, Unknown
  misc_feature (1)..( 10): Matrix.003 file - promoters60/4769260
tgatttgttt

SEQ ID NO: 59429 - DNA, 7 bp, Unknown
  misc_feature (1)..( 7): Matrix.003 file - promoters60/4769260
ttggatc

SEQ ID NO: 59430 - DNA, 7 bp, Unknown
  misc_feature (1)..( 7): Matrix.003 file - promoters60/4769260
tacttga

SEQ ID NO: 59431 - DNA, 12 bp, Unknown
  misc_feature (1)..( 12): Matrix.003 file - promoters60/4769260
aatgggcctaag

SEQ ID NO: 59432 - DNA, 6 bp, Unknown
  misc_feature (1)..( 6): Matrix.003 file - promoters60/4769260
ctaaaa

SEQ ID NO: 59433 - DNA, 6 bp, Unknown
  misc_feature (1)..( 6): Matrix.003 file - promoters60/4769276
gaacat

SEQ ID NO: 59434 - DNA, 6 bp, Unknown
  misc_feature (1)..( 6): Matrix.003 file - promoters60/4769298
cactgt

SEQ ID NO: 59435 - DNA, 8 bp, Unknown
  misc_feature (1)..( 8): Matrix.003 file - promoters60/4769298
ataagtcg

SEQ ID NO: 59436 - DNA, 7 bp, Unknown
  misc_feature (1)..( 7): Matrix.003 file - promoters60/4769298
ctcacta

SEQ ID NO: 59437 - DNA, 11 bp, Unknown
  misc_feature (1)..( 11): Matrix.003 file - promoters60/4769298
caataataata

SEQ ID NO: 59438 - DNA, 8 bp, Unknown
  misc_feature (1)..( 8): Matrix.003 file - promoters60/4769298
cgtcaggg

SEQ ID NO: 59439 - DNA, 8 bp, Unknown
  misc_feature (1)..( 8): Matrix.003 file - promoters60/4769298
cattcact

SEQ ID NO: 59440 - DNA, 7 bp, Unknown
  misc_feature (1)..( 7): Matrix.003 file - promoters60/4769298
ttaagct

SEQ ID NO: 59441 - DNA, 6 bp, Unknown
  misc_feature (1)..( 6): Matrix.003 file - promoters60/4769298
catttc

SEQ ID NO: 59442 - DNA, 6 bp, Unknown
  misc_feature (1)..( 6): Matrix.003 file - promoters60/4769298
taaaca

SEQ ID NO: 59443 - DNA, 7 bp, Unknown
  misc_feature (1)..( 7): Matrix.003 file - promoters60/4769298
cattttt

SEQ ID NO: 59444 - DNA, 6 bp, Unknown
  misc_feature (1)..( 6): Matrix.003 file - promoters60/4769298
tcttat

SEQ ID NO: 59445 - DNA, 7 bp, Unknown
  misc_feature (1)..( 7): Matrix.003 file - promoters60/4769298
gatatta

SEQ ID NO: 59446 - DNA, 7 bp, Unknown
  misc_feature (1)..( 7): Matrix.003 file - promoters60/4769298
aaacaca

SEQ ID NO: 59447 - DNA, 7 bp, Unknown
  misc_feature (1)..( 7): Matrix.003 file - promoters60/4769298
aataaaa

SEQ ID NO: 59448 - DNA, 7 bp, Unknown
  misc_feature (1)..( 7): Matrix.003 file - promoters60/4769301
cttattt

SEQ ID NO: 59449 - DNA, 9 bp, Unknown
  misc_feature (1)..( 9): Matrix.003 file - promoters60/4769301
tttggtctt

SEQ ID NO: 59450 - DNA, 6 bp, Unknown
  misc_feature (1)..( 6): Matrix.003 file - promoters60/4769301
tttttt

SEQ ID NO: 59451 - DNA, 7 bp, Unknown
  misc_feature (1)..( 7): Matrix.003 file - promoters60/4769301
tgtgctc

SEQ ID NO: 59452 - DNA, 7 bp, Unknown
  misc_feature (1)..( 7): Matrix.003 file - promoters60/4769301
ataatca

SEQ ID NO: 59453 - DNA, 7 bp, Unknown
  misc_feature (1)..( 7): Matrix.003 file - promoters60/4769301
tgtacat

SEQ ID NO: 59454 - DNA, 8 bp, Unknown
  misc_feature (1)..( 8): Matrix.003 file - promoters60/4769301
ttataata

SEQ ID NO: 59455 - DNA, 6 bp, Unknown
  misc_feature (1)..( 6): Matrix.003 file - promoters60/4769301
attttt

SEQ ID NO: 59456 - DNA, 6 bp, Unknown
  misc_feature (1)..( 6): Matrix.003 file - promoters60/4769301
aaaaaa

SEQ ID NO: 59457 - DNA, 14 bp, Unknown
  misc_feature (1)..( 14): Matrix.003 file - promoters60/4769301
agaaatacaatttt

SEQ ID NO: 59458 - DNA, 6 bp, Unknown
  misc_feature (1)..( 6): Matrix.003 file - promoters60/4769301
caaaaa

SEQ ID NO: 59459 - DNA, 8 bp, Unknown
  misc_feature (1)..( 8): Matrix.003 file - promoters60/4769301
ctaaaaaa

SEQ ID NO: 59460 - DNA, 7 bp, Unknown
  misc_feature (1)..( 7): Matrix.003 file - promoters60/4769301
tttttgg

SEQ ID NO: 59461 - DNA, 8 bp, Unknown
  misc_feature (1)..( 8): Matrix.003 file - promoters60/4769301
tttgcttt

SEQ ID NO: 59462 - DNA, 11 bp, Unknown
  misc_feature (1)..( 11): Matrix.003 file - promoters60/4769301
aaaagaagaaa

SEQ ID NO: 59463 - DNA, 10 bp, Unknown
  misc_feature (1)..( 10): Matrix.003 file - promoters60/4769301
tttcaaaaaa

SEQ ID NO: 59464 - DNA, 7 bp, Unknown
  misc_feature (1)..( 7): Matrix.003 file - promoters60/4769301
aaagaaa

SEQ ID NO: 59465 - DNA, 7 bp, Unknown
  misc_feature (1)..( 7): Matrix.003 file - promoters60/4769301
aaacaaa

SEQ ID NO: 59466 - DNA, 10 bp, Unknown
  misc_feature (1)..( 10): Matrix.003 file - promoters60/4769301
tatacatcaa

SEQ ID NO: 59467 - DNA, 6 bp, Unknown
  misc_feature (1)..( 6): Matrix.003 file - promoters60/4769301
ataaat

SEQ ID NO: 59468 - DNA, 7 bp, Unknown
  misc_feature (1)..( 7): Matrix.003 file - promoters60/4769301
tttatta

SEQ ID NO: 59469 - DNA, 6 bp, Unknown
  misc_feature (1)..( 6): Matrix.003 file - promoters60/4769301
ttacaa

SEQ ID NO: 59470 - DNA, 6 bp, Unknown
  misc_feature (1)..( 6): Matrix.003 file - promoters60/4769301
aactaa

SEQ ID NO: 59471 - DNA, 7 bp, Unknown
  misc_feature (1)..( 7): Matrix.003 file - promoters60/4769301
ttgtaca

SEQ ID NO: 59472 - DNA, 6 bp, Unknown
  misc_feature (1)..( 6): Matrix.003 file - promoters60/4769301
ataaat

SEQ ID NO: 59473 - DNA, 11 bp, Unknown
  misc_feature (1)..( 11): Matrix.003 file - promoters60/4769312
aaataaaattg

SEQ ID NO: 59474 - DNA, 11 bp, Unknown
  misc_feature (1)..( 11): Matrix.003 file - promoters60/4769312
aaaaaaagaat

SEQ ID NO: 59475 - DNA, 11 bp, Unknown
  misc_feature (1)..( 11): Matrix.003 file - promoters60/4769312
aaacaaagaaa

SEQ ID NO: 59476 - DNA, 7 bp, Unknown
  misc_feature (1)..( 7): Matrix.003 file - promoters60/4769312
aaattaa

SEQ ID NO: 59477 - DNA, 8 bp, Unknown
  misc_feature (1)..( 8): Matrix.003 file - promoters60/4769312
tgaacaaa

SEQ ID NO: 59478 - DNA, 11 bp, Unknown
  misc_feature (1)..( 11): Matrix.003 file - promoters60/4769312
caatcactctc

SEQ ID NO: 59479 - DNA, 10 bp, Unknown
  misc_feature (1)..( 10): Matrix.003 file - promoters60/4769312
tatataaaac

SEQ ID NO: 59480 - DNA, 9 bp, Unknown
  misc_feature (1)..( 9): Matrix.003 file - promoters60/4769312
ttgaccaaa

SEQ ID NO: 59481 - DNA, 6 bp, Unknown
  misc_feature (1)..( 6): Matrix.003 file - promoters60/4769320
aaatac

SEQ ID NO: 59482 - DNA, 6 bp, Unknown
  misc_feature (1)..( 6): Matrix.003 file - promoters60/4769320
cattaa

SEQ ID NO: 59483 - DNA, 6 bp, Unknown
  misc_feature (1)..( 6): Matrix.003 file - promoters60/4769320
caaaca

SEQ ID NO: 59484 - DNA, 6 bp, Unknown
  misc_feature (1)..( 6): Matrix.003 file - promoters60/4769320
aacaaa

SEQ ID NO: 59485 - DNA, 6 bp, Unknown
  misc_feature (1)..( 6): Matrix.003 file - promoters60/4769320
aaaata

SEQ ID NO: 59486 - DNA, 8 bp, Unknown
  misc_feature (1)..( 8): Matrix.003 file - promoters60/4769320
attacaca

SEQ ID NO: 59487 - DNA, 14 bp, Unknown
  misc_feature (1)..( 14): Matrix.003 file - promoters60/4769320
atttaatagtcatt

SEQ ID NO: 59488 - DNA, 7 bp, Unknown
  misc_feature (1)..( 7): Matrix.003 file - promoters60/4769320
aatatca

SEQ ID NO: 59489 - DNA, 8 bp, Unknown
  misc_feature (1)..( 8): Matrix.003 file - promoters60/4769320
tattgttt

SEQ ID NO: 59490 - DNA, 9 bp, Unknown
  misc_feature (1)..( 9): Matrix.003 file - promoters60/4769320
tatttgatt

SEQ ID NO: 59491 - DNA, 6 bp, Unknown
  misc_feature (1)..( 6): Matrix.003 file - promoters60/4769320
tgtaat

SEQ ID NO: 59492 - DNA, 7 bp, Unknown
  misc_feature (1)..( 7): Matrix.003 file - promoters60/4769320
aaaaata

SEQ ID NO: 59493 - DNA, 6 bp, Unknown
  misc_feature (1)..( 6): Matrix.003 file - promoters60/4769320
aaaata

SEQ ID NO: 59494 - DNA, 7 bp, Unknown
  misc_feature (1)..( 7): Matrix.003 file - promoters60/4769320
aatattg

SEQ ID NO: 59495 - DNA, 6 bp, Unknown
  misc_feature (1)..( 6): Matrix.003 file - promoters60/4769320
acactt

SEQ ID NO: 59496 - DNA, 6 bp, Unknown
  misc_feature (1)..( 6): Matrix.003 file - promoters60/4769320
ttgtat

SEQ ID NO: 59497 - DNA, 6 bp, Unknown
  misc_feature (1)..( 6): Matrix.003 file - promoters60/4769320
taactt

SEQ ID NO: 59498 - DNA, 6 bp, Unknown
  misc_feature (1)..( 6): Matrix.003 file - promoters60/4769320
attcat

SEQ ID NO: 59499 - DNA, 6 bp, Unknown
  misc_feature (1)..( 6): Matrix.003 file - promoters60/4769320
gtcatt

SEQ ID NO: 59500 - DNA, 12 bp, Unknown
  misc_feature (1)..( 12): Matrix.003 file - promoters60/4769328
atagttttcttc

SEQ ID NO: 59501 - DNA, 11 bp, Unknown
  misc_feature (1)..( 11): Matrix.003 file - promoters60/4769328
atcatatacat

SEQ ID NO: 59502 - DNA, 6 bp, Unknown
  misc_feature (1)..( 6): Matrix.003 file - promoters60/4769344
cttcgt

SEQ ID NO: 59503 - DNA, 7 bp, Unknown
  misc_feature (1)..( 7): Matrix.003 file - promoters60/4769344
tggattt

SEQ ID NO: 59504 - DNA, 6 bp, Unknown
  misc_feature (1)..( 6): Matrix.003 file - promoters60/4769344
ttgctt

SEQ ID NO: 59505 - DNA, 6 bp, Unknown
  misc_feature (1)..( 6): Matrix.003 file - promoters60/4769344
atgtgt

SEQ ID NO: 59506 - DNA, 6 bp, Unknown
  misc_feature (1)..( 6): Matrix.003 file - promoters60/4769344
gtactg

SEQ ID NO: 59507 - DNA, 7 bp, Unknown
  misc_feature (1)..( 7): Matrix.003 file - promoters60/4769344
catcgtt

SEQ ID NO: 59508 - DNA, 7 bp, Unknown
  misc_feature (1)..( 7): Matrix.003 file - promoters60/4769344
tcttaaa

SEQ ID NO: 59509 - DNA, 7 bp, Unknown
  misc_feature (1)..( 7): Matrix.003 file - promoters60/4769344
attattg

SEQ ID NO: 59510 - DNA, 7 bp, Unknown
  misc_feature (1)..( 7): Matrix.003 file - promoters60/4769344
gctgagt

SEQ ID NO: 59511 - DNA, 6 bp, Unknown
  misc_feature (1)..( 6): Matrix.003 file - promoters60/4769344
taaaac

SEQ ID NO: 59512 - DNA, 8 bp, Unknown
  misc_feature (1)..( 8): Matrix.003 file - promoters60/4769344
ttgaagaa

SEQ ID NO: 59513 - DNA, 7 bp, Unknown
  misc_feature (1)..( 7): Matrix.003 file - promoters60/4769344
aaacttt

SEQ ID NO: 59514 - DNA, 6 bp, Unknown
  misc_feature (1)..( 6): Matrix.003 file - promoters60/4769344
gtttga

SEQ ID NO: 59515 - DNA, 7 bp, Unknown
  misc_feature (1)..( 7): Matrix.003 file - promoters60/4769344
tatattt

SEQ ID NO: 59516 - DNA, 9 bp, Unknown
  misc_feature (1)..( 9): Matrix.003 file - promoters60/4769366
acaactaag

SEQ ID NO: 59517 - DNA, 6 bp, Unknown
  misc_feature (1)..( 6): Matrix.003 file - promoters60/4769366
ccaaac

SEQ ID NO: 59518 - DNA, 8 bp, Unknown
  misc_feature (1)..( 8): Matrix.003 file - promoters60/4769366
caccaacc

SEQ ID NO: 59519 - DNA, 6 bp, Unknown
  misc_feature (1)..( 6): Matrix.003 file - promoters60/4769366
ttctca

SEQ ID NO: 59520 - DNA, 16 bp, Unknown
  misc_feature (1)..( 16): Matrix.003 file - promoters60/4769366
cacaaatttaaccaaa

SEQ ID NO: 59521 - DNA, 13 bp, Unknown
  misc_feature (1)..( 13): Matrix.003 file - promoters60/4769366
ttcttattaaaac

SEQ ID NO: 59522 - DNA, 9 bp, Unknown
  misc_feature (1)..( 9): Matrix.003 file - promoters60/4769366
ataataaat

SEQ ID NO: 59523 - DNA, 12 bp, Unknown
  misc_feature (1)..( 12): Matrix.003 file - promoters60/4769366
actaaaaatttt

SEQ ID NO: 59524 - DNA, 7 bp, Unknown
  misc_feature (1)..( 7): Matrix.003 file - promoters60/4769366
aaaagtc

SEQ ID NO: 59525 - DNA, 6 bp, Unknown
  misc_feature (1)..( 6): Matrix.003 file - promoters60/4769366
atattt

SEQ ID NO: 59526 - DNA, 7 bp, Unknown
  misc_feature (1)..( 7): Matrix.003 file - promoters60/4769366
aaaatca

SEQ ID NO: 59527 - DNA, 6 bp, Unknown
  misc_feature (1)..( 6): Matrix.003 file - promoters60/4769366
ccttct

SEQ ID NO: 59528 - DNA, 10 bp, Unknown
  misc_feature (1)..( 10): Matrix.003 file - promoters60/4769366
tttagcaaaa

SEQ ID NO: 59529 - DNA, 6 bp, Unknown
  misc_feature (1)..( 6): Matrix.003 file - promoters60/4769366
acacaa

SEQ ID NO: 59530 - DNA, 7 bp, Unknown
  misc_feature (1)..( 7): Matrix.003 file - promoters60/4769366
gatattg

SEQ ID NO: 59531 - DNA, 7 bp, Unknown
  misc_feature (1)..( 7): Matrix.003 file - promoters60/4769366
aatccaa

SEQ ID NO: 59532 - DNA, 6 bp, Unknown
  misc_feature (1)..( 6): Matrix.003 file - promoters60/4769366
ccacta

SEQ ID NO: 59533 - DNA, 8 bp, Unknown
  misc_feature (1)..( 8): Matrix.003 file - promoters60/4769384
atttgatt

SEQ ID NO: 59534 - DNA, 7 bp, Unknown
  misc_feature (1)..( 7): Matrix.003 file - promoters60/4769384
ttctccc

SEQ ID NO: 59535 - DNA, 7 bp, Unknown
  misc_feature (1)..( 7): Matrix.003 file - promoters60/4769384
acaatct

SEQ ID NO: 59536 - DNA, 7 bp, Unknown
  misc_feature (1)..( 7): Matrix.003 file - promoters60/4769384
tctatat

SEQ ID NO: 59537 - DNA, 8 bp, Unknown
  misc_feature (1)..( 8): Matrix.003 file - promoters60/4769384
tatcgttg

SEQ ID NO: 59538 - DNA, 6 bp, Unknown
  misc_feature (1)..( 6): Matrix.003 file - promoters60/4769384
ctccaa

SEQ ID NO: 59539 - DNA, 6 bp, Unknown
  misc_feature (1)..( 6): Matrix.003 file - promoters60/4769384
ttaaca

SEQ ID NO: 59540 - DNA, 6 bp, Unknown
  misc_feature (1)..( 6): Matrix.003 file - promoters60/4769384
gtggac

SEQ ID NO: 59541 - DNA, 6 bp, Unknown
  misc_feature (1)..( 6): Matrix.003 file - promoters60/4769384
attata

SEQ ID NO: 59542 - DNA, 6 bp, Unknown
  misc_feature (1)..( 6): Matrix.003 file - promoters60/4769384
tatttt

SEQ ID NO: 59543 - DNA, 11 bp, Unknown
  misc_feature (1)..( 11): Matrix.003 file - promoters60/4769384
ccaaatattaa

SEQ ID NO: 59544 - DNA, 6 bp, Unknown
  misc_feature (1)..( 6): Matrix.003 file - promoters60/4769384
ataaaa

SEQ ID NO: 59545 - DNA, 8 bp, Unknown
  misc_feature (1)..( 8): Matrix.003 file - promoters60/4769384
aaaagaag

SEQ ID NO: 59546 - DNA, 7 bp, Unknown
  misc_feature (1)..( 7): Matrix.003 file - promoters60/4769384
aaaaaga

SEQ ID NO: 59547 - DNA, 7 bp, Unknown
  misc_feature (1)..( 7): Matrix.003 file - promoters60/4769384
aaaacaa

SEQ ID NO: 59548 - DNA, 6 bp, Unknown
  misc_feature (1)..( 6): Matrix.003 file - promoters60/4769384
ggtctc

SEQ ID NO: 59549 - DNA, 7 bp, Unknown
  misc_feature (1)..( 7): Matrix.003 file - promoters60/4769384
ctaattt

SEQ ID NO: 59550 - DNA, 6 bp, Unknown
  misc_feature (1)..( 6): Matrix.003 file - promoters60/4769384
tttgga

SEQ ID NO: 59551 - DNA, 6 bp, Unknown
  misc_feature (1)..( 6): Matrix.003 file - promoters60/4769384
gatttg

SEQ ID NO: 59552 - DNA, 8 bp, Unknown
  misc_feature (1)..( 8): Matrix.003 file - promoters60/4769384
aaaacttt

SEQ ID NO: 59553 - DNA, 6 bp, Unknown
  misc_feature (1)..( 6): Matrix.003 file - promoters60/4769388
ccatat

SEQ ID NO: 59554 - DNA, 6 bp, Unknown
  misc_feature (1)..( 6): Matrix.003 file - promoters60/4769388
tataaa

SEQ ID NO: 59555 - DNA, 6 bp, Unknown
  misc_feature (1)..( 6): Matrix.003 file - promoters60/4769388
gttttg

SEQ ID NO: 59556 - DNA, 8 bp, Unknown
  misc_feature (1)..( 8): Matrix.003 file - promoters60/4769388
ctttaaaa

SEQ ID NO: 59557 - DNA, 6 bp, Unknown
  misc_feature (1)..( 6): Matrix.003 file - promoters60/4769388
agaaat

SEQ ID NO: 59558 - DNA, 7 bp, Unknown
  misc_feature (1)..( 7): Matrix.003 file - promoters60/4769388
tcgtaag

SEQ ID NO: 59559 - DNA, 6 bp, Unknown
  misc_feature (1)..( 6): Matrix.003 file - promoters60/4769388
aagaaa

SEQ ID NO: 59560 - DNA, 6 bp, Unknown
  misc_feature (1)..( 6): Matrix.003 file - promoters60/4769388
gtcatc

SEQ ID NO: 59561 - DNA, 7 bp, Unknown
  misc_feature (1)..( 7): Matrix.003 file - promoters60/4769388
aaacaca

SEQ ID NO: 59562 - DNA, 7 bp, Unknown
  misc_feature (1)..( 7): Matrix.003 file - promoters60/4769388
ccattgt

SEQ ID NO: 59563 - DNA, 10 bp, Unknown
  misc_feature (1)..( 10): Matrix.003 file - promoters60/4769392
tgtaaaattg

SEQ ID NO: 59564 - DNA, 10 bp, Unknown
  misc_feature (1)..( 10): Matrix.003 file - promoters60/4769392
taagttttat

SEQ ID NO: 59565 - DNA, 10 bp, Unknown
  misc_feature (1)..( 10): Matrix.003 file - promoters60/4769392
cctttaatta

SEQ ID NO: 59566 - DNA, 10 bp, Unknown
  misc_feature (1)..( 10): Matrix.003 file - promoters60/4769392
taaatcttta

SEQ ID NO: 59567 - DNA, 10 bp, Unknown
  misc_feature (1)..( 10): Matrix.003 file - promoters60/4769392
ccaaaaaaat

SEQ ID NO: 59568 - DNA, 8 bp, Unknown
  misc_feature (1)..( 8): Matrix.003 file - promoters60/4769392
tttatgtc

SEQ ID NO: 59569 - DNA, 12 bp, Unknown
  misc_feature (1)..( 12): Matrix.003 file - promoters60/4769392
aatcaaaaaaaa

SEQ ID NO: 59570 - DNA, 9 bp, Unknown
  misc_feature (1)..( 9): Matrix.003 file - promoters60/4769392
ttatttgta

SEQ ID NO: 59571 - DNA, 9 bp, Unknown
  misc_feature (1)..( 9): Matrix.003 file - promoters60/4769392
taataattt

SEQ ID NO: 59572 - DNA, 10 bp, Unknown
  misc_feature (1)..( 10): Matrix.003 file - promoters60/4769392
agaaaaatcg

SEQ ID NO: 59573 - DNA, 17 bp, Unknown
  misc_feature (1)..( 17): Matrix.003 file - promoters60/4769411
taaggtttaattttaca

SEQ ID NO: 59574 - DNA, 11 bp, Unknown
  misc_feature (1)..( 11): Matrix.003 file - promoters60/4769411
agacaatcatt

SEQ ID NO: 59575 - DNA, 11 bp, Unknown
  misc_feature (1)..( 11): Matrix.003 file - promoters60/4769411
attgtaaaaaa

SEQ ID NO: 59576 - DNA, 8 bp, Unknown
  misc_feature (1)..( 8): Matrix.003 file - promoters60/4769411
ggataagc

SEQ ID NO: 59577 - DNA, 9 bp, Unknown
  misc_feature (1)..( 9): Matrix.003 file - promoters60/4769411
gaaataatt

SEQ ID NO: 59578 - DNA, 9 bp, Unknown
  misc_feature (1)..( 9): Matrix.003 file - promoters60/4769411
aaattaaat

SEQ ID NO: 59579 - DNA, 10 bp, Unknown
  misc_feature (1)..( 10): Matrix.003 file - promoters60/4769411
gaagataagg

SEQ ID NO: 59580 - DNA, 7 bp, Unknown
  misc_feature (1)..( 7): Matrix.003 file - promoters60/4769420
taatttc

SEQ ID NO: 59581 - DNA, 12 bp, Unknown
  misc_feature (1)..( 12): Matrix.003 file - promoters60/4769420
aaaaagtatttt

SEQ ID NO: 59582 - DNA, 6 bp, Unknown
  misc_feature (1)..( 6): Matrix.003 file - promoters60/4769420
agctaa

SEQ ID NO: 59583 - DNA, 7 bp, Unknown
  misc_feature (1)..( 7): Matrix.003 file - promoters60/4769420
aaattat

SEQ ID NO: 59584 - DNA, 7 bp, Unknown
  misc_feature (1)..( 7): Matrix.003 file - promoters60/4769420
aactaag

SEQ ID NO: 59585 - DNA, 10 bp, Unknown
  misc_feature (1)..( 10): Matrix.003 file - promoters60/4769420
actaaaaatt

SEQ ID NO: 59586 - DNA, 10 bp, Unknown
  misc_feature (1)..( 10): Matrix.003 file - promoters60/4769420
tttagcaaaa

SEQ ID NO: 59587 - DNA, 6 bp, Unknown
  misc_feature (1)..( 6): Matrix.003 file - promoters60/4769420
acacaa

SEQ ID NO: 59588 - DNA, 7 bp, Unknown
  misc_feature (1)..( 7): Matrix.003 file - promoters60/4769420
gatattg

SEQ ID NO: 59589 - DNA, 7 bp, Unknown
  misc_feature (1)..( 7): Matrix.003 file - promoters60/4769420
aatccaa

SEQ ID NO: 59590 - DNA, 6 bp, Unknown
  misc_feature (1)..( 6): Matrix.003 file - promoters60/4769420
ccacta

SEQ ID NO: 59591 - DNA, 7 bp, Unknown
  misc_feature (1)..( 7): Matrix.003 file - promoters60/4769420
taaaacc

SEQ ID NO: 59592 - DNA, 6 bp, Unknown
  misc_feature (1)..( 6): Matrix.003 file - promoters60/4769420
gttttg

SEQ ID NO: 59593 - DNA, 6 bp, Unknown
  misc_feature (1)..( 6): Matrix.003 file - promoters60/4769420
aattgt

SEQ ID NO: 59594 - DNA, 8 bp, Unknown
  misc_feature (1)..( 8): Matrix.003 file - promoters60/4769420
ccaagtaa

SEQ ID NO: 59595 - DNA, 9 bp, Unknown
  misc_feature (1)..( 9): Matrix.003 file - promoters60/4769420
tcagagata

SEQ ID NO: 59596 - DNA, 6 bp, Unknown
  misc_feature (1)..( 6): Matrix.003 file - promoters60/4769420
ttatat

SEQ ID NO: 59597 - DNA, 7 bp, Unknown
  misc_feature (1)..( 7): Matrix.003 file - promoters60/4769420
atcatca

SEQ ID NO: 59598 - DNA, 7 bp, Unknown
  misc_feature (1)..( 7): Matrix.003 file - promoters60/4769420
caaagaa

SEQ ID NO: 59599 - DNA, 11 bp, Unknown
  misc_feature (1)..( 11): Matrix.003 file - promoters60/4770260
ccatttatata

SEQ ID NO: 59600 - DNA, 9 bp, Unknown
  misc_feature (1)..( 9): Matrix.003 file - promoters60/4770260
tatttgaaa

SEQ ID NO: 59601 - DNA, 13 bp, Unknown
  misc_feature (1)..( 13): Matrix.003 file - promoters60/4770264
tttattaaaaaaa

SEQ ID NO: 59602 - DNA, 8 bp, Unknown
  misc_feature (1)..( 8): Matrix.003 file - promoters60/4770264
taaaagaa

SEQ ID NO: 59603 - DNA, 8 bp, Unknown
  misc_feature (1)..( 8): Matrix.003 file - promoters60/4770264
aaaattga

SEQ ID NO: 59604 - DNA, 6 bp, Unknown
  misc_feature (1)..( 6): Matrix.003 file - promoters60/4770264
aaaata

SEQ ID NO: 59605 - DNA, 8 bp, Unknown
  misc_feature (1)..( 8): Matrix.003 file - promoters60/4770264
caaaagat

SEQ ID NO: 59606 - DNA, 6 bp, Unknown
  misc_feature (1)..( 6): Matrix.003 file - promoters60/4770264
gtgaga

SEQ ID NO: 59607 - DNA, 10 bp, Unknown
  misc_feature (1)..( 10): Matrix.003 file - promoters60/4770264
cattaattct

SEQ ID NO: 59608 - DNA, 10 bp, Unknown
  misc_feature (1)..( 10): Matrix.003 file - promoters60/4770264
ttaaatattt

SEQ ID NO: 59609 - DNA, 9 bp, Unknown
  misc_feature (1)..( 9): Matrix.003 file - promoters60/4770264
gaatatatt

SEQ ID NO: 59610 - DNA, 7 bp, Unknown
  misc_feature (1)..( 7): Matrix.003 file - promoters60/4770264
aaagtta

SEQ ID NO: 59611 - DNA, 6 bp, Unknown
  misc_feature (1)..( 6): Matrix.003 file - promoters60/4770264
tttgaa

SEQ ID NO: 59612 - DNA, 7 bp, Unknown
  misc_feature (1)..( 7): Matrix.003 file - promoters60/4770264
gaagaaa

SEQ ID NO: 59613 - DNA, 7 bp, Unknown
  misc_feature (1)..( 7): Matrix.003 file - promoters60/4770264
gatcttc

SEQ ID NO: 59614 - DNA, 8 bp, Unknown
  misc_feature (1)..( 8): Matrix.003 file - promoters60/4770264
tttagctt

SEQ ID NO: 59615 - DNA, 6 bp, Unknown
  misc_feature (1)..( 6): Matrix.003 file - promoters60/4770264
gaatta

SEQ ID NO: 59616 - DNA, 6 bp, Unknown
  misc_feature (1)..( 6): Matrix.003 file - promoters60/4770264
gcggaa

SEQ ID NO: 59617 - DNA, 6 bp, Unknown
  misc_feature (1)..( 6): Matrix.003 file - promoters60/4770264
aaagaa

SEQ ID NO: 59618 - DNA, 7 bp, Unknown
  misc_feature (1)..( 7): Matrix.003 file - promoters60/4770264
tatcttc

SEQ ID NO: 59619 - DNA, 6 bp, Unknown
  misc_feature (1)..( 6): Matrix.003 file - promoters60/4770264
tccttg

SEQ ID NO: 59620 - DNA, 7 bp, Unknown
  misc_feature (1)..( 7): Matrix.003 file - promoters60/4770264
gatatat

SEQ ID NO: 59621 - DNA, 10 bp, Unknown
  misc_feature (1)..( 10): Matrix.003 file - promoters60/4770268
gattttgaaa

SEQ ID NO: 59622 - DNA, 10 bp, Unknown
  misc_feature (1)..( 10): Matrix.003 file - promoters60/4770268
tctatgaata

SEQ ID NO: 59623 - DNA, 8 bp, Unknown
  misc_feature (1)..( 8): Matrix.003 file - promoters60/4770268
ttttgtat

SEQ ID NO: 59624 - DNA, 8 bp, Unknown
  misc_feature (1)..( 8): Matrix.003 file - promoters60/4770268
ttgttgac

SEQ ID NO: 59625 - DNA, 7 bp, Unknown
  misc_feature (1)..( 7): Matrix.003 file - promoters60/4770268
gaaattg

SEQ ID NO: 59626 - DNA, 8 bp, Unknown
  misc_feature (1)..( 8): Matrix.003 file - promoters60/4770274
gaaaaaac

SEQ ID NO: 59627 - DNA, 8 bp, Unknown
  misc_feature (1)..( 8): Matrix.003 file - promoters60/4770274
ctagatat

SEQ ID NO: 59628 - DNA, 7 bp, Unknown
  misc_feature (1)..( 7): Matrix.003 file - promoters60/4770274
aataaaa

SEQ ID NO: 59629 - DNA, 8 bp, Unknown
  misc_feature (1)..( 8): Matrix.003 file - promoters60/4770274
ttttcttt

SEQ ID NO: 59630 - DNA, 10 bp, Unknown
  misc_feature (1)..( 10): Matrix.003 file - promoters60/4770274
tttaatataa

SEQ ID NO: 59631 - DNA, 8 bp, Unknown
  misc_feature (1)..( 8): Matrix.003 file - promoters60/4770274
aataatat

SEQ ID NO: 59632 - DNA, 7 bp, Unknown
  misc_feature (1)..( 7): Matrix.003 file - promoters60/4770274
tacttgt

SEQ ID NO: 59633 - DNA, 10 bp, Unknown
  misc_feature (1)..( 10): Matrix.003 file - promoters60/4770274
cctaaacctt

SEQ ID NO: 59634 - DNA, 8 bp, Unknown
  misc_feature (1)..( 8): Matrix.003 file - promoters60/4770274
ataattac

SEQ ID NO: 59635 - DNA, 11 bp, Unknown
  misc_feature (1)..( 11): Matrix.003 file - promoters60/4770274
attcactacat

SEQ ID NO: 59636 - DNA, 9 bp, Unknown
  misc_feature (1)..( 9): Matrix.003 file - promoters60/4770274
tccattaat

SEQ ID NO: 59637 - DNA, 8 bp, Unknown
  misc_feature (1)..( 8): Matrix.003 file - promoters60/4770274
tcctttac

SEQ ID NO: 59638 - DNA, 9 bp, Unknown
  misc_feature (1)..( 9): Matrix.003 file - promoters60/4770278
taaaaaaat

SEQ ID NO: 59639 - DNA, 10 bp, Unknown
  misc_feature (1)..( 10): Matrix.003 file - promoters60/4770278
ctcaaacaaa

SEQ ID NO: 59640 - DNA, 16 bp, Unknown
  misc_feature (1)..( 16): Matrix.003 file - promoters60/4770278
aaaatgaaaataattt

SEQ ID NO: 59641 - DNA, 7 bp, Unknown
  misc_feature (1)..( 7): Matrix.003 file - promoters60/4770280
taaaatt

SEQ ID NO: 59642 - DNA, 7 bp, Unknown
  misc_feature (1)..( 7): Matrix.003 file - promoters60/4770280
catatac

SEQ ID NO: 59643 - DNA, 7 bp, Unknown
  misc_feature (1)..( 7): Matrix.003 file - promoters60/4770280
ctgaatc

SEQ ID NO: 59644 - DNA, 6 bp, Unknown
  misc_feature (1)..( 6): Matrix.003 file - promoters60/4770280
ttgatt

SEQ ID NO: 59645 - DNA, 6 bp, Unknown
  misc_feature (1)..( 6): Matrix.003 file - promoters60/4770280
caaagg

SEQ ID NO: 59646 - DNA, 7 bp, Unknown
  misc_feature (1)..( 7): Matrix.003 file - promoters60/4770280
tatcatt

SEQ ID NO: 59647 - DNA, 7 bp, Unknown
  misc_feature (1)..( 7): Matrix.003 file - promoters60/4770280
gaatttg

SEQ ID NO: 59648 - DNA, 7 bp, Unknown
  misc_feature (1)..( 7): Matrix.003 file - promoters60/4770280
tttgatt

SEQ ID NO: 59649 - DNA, 7 bp, Unknown
  misc_feature (1)..( 7): Matrix.003 file - promoters60/4770280
ttagatc

SEQ ID NO: 59650 - DNA, 6 bp, Unknown
  misc_feature (1)..( 6): Matrix.003 file - promoters60/4770280
catttg

SEQ ID NO: 59651 - DNA, 6 bp, Unknown
  misc_feature (1)..( 6): Matrix.003 file - promoters60/4770288
aaaaaa

SEQ ID NO: 59652 - DNA, 16 bp, Unknown
  misc_feature (1)..( 16): Matrix.003 file - promoters60/4770288
taaaagcaaataaata

SEQ ID NO: 59653 - DNA, 8 bp, Unknown
  misc_feature (1)..( 8): Matrix.003 file - promoters60/4770288
ttttcatt

SEQ ID NO: 59654 - DNA, 9 bp, Unknown
  misc_feature (1)..( 9): Matrix.003 file - promoters60/4770288
tgttatctc

SEQ ID NO: 59655 - DNA, 7 bp, Unknown
  misc_feature (1)..( 7): Matrix.003 file - promoters60/4770288
ttatctc

SEQ ID NO: 59656 - DNA, 13 bp, Unknown
  misc_feature (1)..( 13): Matrix.003 file - promoters60/4770288
agttcttagattc

SEQ ID NO: 59657 - DNA, 10 bp, Unknown
  misc_feature (1)..( 10): Matrix.003 file - promoters60/4770305
ttttgaatac

SEQ ID NO: 59658 - DNA, 11 bp, Unknown
  misc_feature (1)..( 11): Matrix.003 file - promoters60/4770305
aaaatcttaaa

SEQ ID NO: 59659 - DNA, 9 bp, Unknown
  misc_feature (1)..( 9): Matrix.003 file - promoters60/4770305
agcccaaag

SEQ ID NO: 59660 - DNA, 11 bp, Unknown
  misc_feature (1)..( 11): Matrix.003 file - promoters60/4770305
tttcttaaatt

SEQ ID NO: 59661 - DNA, 8 bp, Unknown
  misc_feature (1)..( 8): Matrix.003 file - promoters60/4770305
caaatttt

SEQ ID NO: 59662 - DNA, 10 bp, Unknown
  misc_feature (1)..( 10): Matrix.003 file - promoters60/4770305
tcttaaattt

SEQ ID NO: 59663 - DNA, 7 bp, Unknown
  misc_feature (1)..( 7): Matrix.003 file - promoters60/4770305
agaacta

SEQ ID NO: 59664 - DNA, 7 bp, Unknown
  misc_feature (1)..( 7): Matrix.003 file - promoters60/4770317
gaacaaa

SEQ ID NO: 59665 - DNA, 6 bp, Unknown
  misc_feature (1)..( 6): Matrix.003 file - promoters60/4770317
aagaag

SEQ ID NO: 59666 - DNA, 6 bp, Unknown
  misc_feature (1)..( 6): Matrix.003 file - promoters60/4770317
gggaat

SEQ ID NO: 59667 - DNA, 8 bp, Unknown
  misc_feature (1)..( 8): Matrix.003 file - promoters60/4770317
agctccga

SEQ ID NO: 59668 - DNA, 6 bp, Unknown
  misc_feature (1)..( 6): Matrix.003 file - promoters60/4770317
tttcca

SEQ ID NO: 59669 - DNA, 6 bp, Unknown
  misc_feature (1)..( 6): Matrix.003 file - promoters60/4770317
cgaatg

SEQ ID NO: 59670 - DNA, 6 bp, Unknown
  misc_feature (1)..( 6): Matrix.003 file - promoters60/4770317
gaagaa

SEQ ID NO: 59671 - DNA, 6 bp, Unknown
  misc_feature (1)..( 6): Matrix.003 file - promoters60/4770317
ttccga

SEQ ID NO: 59672 - DNA, 6 bp, Unknown
  misc_feature (1)..( 6): Matrix.003 file - promoters60/4770317
accttt

SEQ ID NO: 59673 - DNA, 8 bp, Unknown
  misc_feature (1)..( 8): Matrix.003 file - promoters60/4770317
tttctctc

SEQ ID NO: 59674 - DNA, 6 bp, Unknown
  misc_feature (1)..( 6): Matrix.003 file - promoters60/4770317
tcaaaa

SEQ ID NO: 59675 - DNA, 7 bp, Unknown
  misc_feature (1)..( 7): Matrix.003 file - promoters60/4770317
aaaagaa

SEQ ID NO: 59676 - DNA, 8 bp, Unknown
  misc_feature (1)..( 8): Matrix.003 file - promoters60/4770317
caaaaaaa

SEQ ID NO: 59677 - DNA, 7 bp, Unknown
  misc_feature (1)..( 7): Matrix.003 file - promoters60/4770330
gatacac

SEQ ID NO: 59678 - DNA, 6 bp, Unknown
  misc_feature (1)..( 6): Matrix.003 file - promoters60/4770330
aagaag

SEQ ID NO: 59679 - DNA, 6 bp, Unknown
  misc_feature (1)..( 6): Matrix.003 file - promoters60/4770330
tagtgt

SEQ ID NO: 59680 - DNA, 8 bp, Unknown
  misc_feature (1)..( 8): Matrix.003 file - promoters60/4770330
aacaactt

SEQ ID NO: 59681 - DNA, 7 bp, Unknown
  misc_feature (1)..( 7): Matrix.003 file - promoters60/4770330
tttaact

SEQ ID NO: 59682 - DNA, 6 bp, Unknown
  misc_feature (1)..( 6): Matrix.003 file - promoters60/4770330
gattaa

SEQ ID NO: 59683 - DNA, 6 bp, Unknown
  misc_feature (1)..( 6): Matrix.003 file - promoters60/4770330
tttgat

SEQ ID NO: 59684 - DNA, 8 bp, Unknown
  misc_feature (1)..( 8): Matrix.003 file - promoters60/4770330
cttcatat

SEQ ID NO: 59685 - DNA, 8 bp, Unknown
  misc_feature (1)..( 8): Matrix.003 file - promoters60/4770330
attgttca

SEQ ID NO: 59686 - DNA, 8 bp, Unknown
  misc_feature (1)..( 8): Matrix.003 file - promoters60/4770330
tttaacaa

SEQ ID NO: 59687 - DNA, 8 bp, Unknown
  misc_feature (1)..( 8): Matrix.003 file - promoters60/4770330
tgttatta

SEQ ID NO: 59688 - DNA, 6 bp, Unknown
  misc_feature (1)..( 6): Matrix.003 file - promoters60/4770330
attttt

SEQ ID NO: 59689 - DNA, 7 bp, Unknown
  misc_feature (1)..( 7): Matrix.003 file - promoters60/4770365
tatatag

SEQ ID NO: 59690 - DNA, 7 bp, Unknown
  misc_feature (1)..( 7): Matrix.003 file - promoters60/4770365
aagttaa

SEQ ID NO: 59691 - DNA, 8 bp, Unknown
  misc_feature (1)..( 8): Matrix.003 file - promoters60/4770365
ttaaaaaa

SEQ ID NO: 59692 - DNA, 8 bp, Unknown
  misc_feature (1)..( 8): Matrix.003 file - promoters60/4770365
aaaaaatg

SEQ ID NO: 59693 - DNA, 6 bp, Unknown
  misc_feature (1)..( 6): Matrix.003 file - promoters60/4770365
gattat

SEQ ID NO: 59694 - DNA, 7 bp, Unknown
  misc_feature (1)..( 7): Matrix.003 file - promoters60/4770365
tattatt

SEQ ID NO: 59695 - DNA, 8 bp, Unknown
  misc_feature (1)..( 8): Matrix.003 file - promoters60/4770365
caagatta

SEQ ID NO: 59696 - DNA, 8 bp, Unknown
  misc_feature (1)..( 8): Matrix.003 file - promoters60/4770365
ttttattt

SEQ ID NO: 59697 - DNA, 7 bp, Unknown
  misc_feature (1)..( 7): Matrix.003 file - promoters60/4770365
aaaaaat

SEQ ID NO: 59698 - DNA, 11 bp, Unknown
  misc_feature (1)..( 11): Matrix.003 file - promoters60/4770379
cattcttattt

SEQ ID NO: 59699 - DNA, 11 bp, Unknown
  misc_feature (1)..( 11): Matrix.003 file - promoters60/4770379
atacttacaaa

SEQ ID NO: 59700 - DNA, 11 bp, Unknown
  misc_feature (1)..( 11): Matrix.003 file - promoters60/4770379
tcatatatata

SEQ ID NO: 59701 - DNA, 12 bp, Unknown
  misc_feature (1)..( 12): Matrix.003 file - promoters60/4770379
aattttttttca

SEQ ID NO: 59702 - DNA, 14 bp, Unknown
  misc_feature (1)..( 14): Matrix.003 file - promoters60/4770379
ttagctataaatta

SEQ ID NO: 59703 - DNA, 7 bp, Unknown
  misc_feature (1)..( 7): Matrix.003 file - promoters60/4770379
aactaaa

SEQ ID NO: 59704 - DNA, 14 bp, Unknown
  misc_feature (1)..( 14): Matrix.003 file - promoters60/4770379
ttttatatagataa

SEQ ID NO: 59705 - DNA, 9 bp, Unknown
  misc_feature (1)..( 9): Matrix.003 file - promoters60/4770379
aactaaaca

SEQ ID NO: 59706 - DNA, 11 bp, Unknown
  misc_feature (1)..( 11): Matrix.003 file - promoters60/4770390
gttataaatct

SEQ ID NO: 59707 - DNA, 16 bp, Unknown
  misc_feature (1)..( 16): Matrix.003 file - promoters60/4770390
ttttgaaataaaactt

SEQ ID NO: 59708 - DNA, 7 bp, Unknown
  misc_feature (1)..( 7): Matrix.003 file - promoters60/4770390
ataaaaa

SEQ ID NO: 59709 - DNA, 9 bp, Unknown
  misc_feature (1)..( 9): Matrix.003 file - promoters60/4770406
taataaaca

SEQ ID NO: 59710 - DNA, 8 bp, Unknown
  misc_feature (1)..( 8): Matrix.003 file - promoters60/4770406
aacataaa

SEQ ID NO: 59711 - DNA, 6 bp, Unknown
  misc_feature (1)..( 6): Matrix.003 file - promoters60/4770406
tgtttt

SEQ ID NO: 59712 - DNA, 6 bp, Unknown
  misc_feature (1)..( 6): Matrix.003 file - promoters60/4770414
gtttaa

SEQ ID NO: 59713 - DNA, 8 bp, Unknown
  misc_feature (1)..( 8): Matrix.003 file - promoters60/4770414
atagttga

SEQ ID NO: 59714 - DNA, 7 bp, Unknown
  misc_feature (1)..( 7): Matrix.003 file - promoters60/4770414
attcttg

SEQ ID NO: 59715 - DNA, 8 bp, Unknown
  misc_feature (1)..( 8): Matrix.003 file - promoters60/4770414
aaaattta

SEQ ID NO: 59716 - DNA, 12 bp, Unknown
  misc_feature (1)..( 12): Matrix.003 file - promoters60/4770414
aatttataacca

SEQ ID NO: 59717 - DNA, 7 bp, Unknown
  misc_feature (1)..( 7): Matrix.003 file - promoters60/4770414
ttagtaa

SEQ ID NO: 59718 - DNA, 6 bp, Unknown
  misc_feature (1)..( 6): Matrix.003 file - promoters60/4770414
attttt

SEQ ID NO: 59719 - DNA, 8 bp, Unknown
  misc_feature (1)..( 8): Matrix.003 file - promoters60/4770414
ctataaaa

SEQ ID NO: 59720 - DNA, 11 bp, Unknown
  misc_feature (1)..( 11): Matrix.003 file - promoters60/4770414
tcaacacaaaa

SEQ ID NO: 59721 - DNA, 6 bp, Unknown
  misc_feature (1)..( 6): Matrix.003 file - promoters60/4770414
tagttt

SEQ ID NO: 59722 - DNA, 6 bp, Unknown
  misc_feature (1)..( 6): Matrix.003 file - promoters60/4770414
tgacta

SEQ ID NO: 59723 - DNA, 8 bp, Unknown
  misc_feature (1)..( 8): Matrix.003 file - promoters60/4770414
cttgttac

SEQ ID NO: 59724 - DNA, 7 bp, Unknown
  misc_feature (1)..( 7): Matrix.003 file - promoters60/4770414
aaagtaa

SEQ ID NO: 59725 - DNA, 9 bp, Unknown
  misc_feature (1)..( 9): Matrix.003 file - promoters60/4770414
gtaacataa

SEQ ID NO: 59726 - DNA, 8 bp, Unknown
  misc_feature (1)..( 8): Matrix.003 file - promoters60/4770428
ttttgtgt

SEQ ID NO: 59727 - DNA, 9 bp, Unknown
  misc_feature (1)..( 9): Matrix.003 file - promoters60/4770428
aatgggcca

SEQ ID NO: 59728 - DNA, 12 bp, Unknown
  misc_feature (1)..( 12): Matrix.003 file - promoters60/4770463
tattttgtattt

SEQ ID NO: 59729 - DNA, 17 bp, Unknown
  misc_feature (1)..( 17): Matrix.003 file - promoters60/4770463
ttcatttataaaaacaa

SEQ ID NO: 59730 - DNA, 7 bp, Unknown
  misc_feature (1)..( 7): Matrix.003 file - promoters60/4770463
aaacaaa

SEQ ID NO: 59731 - DNA, 9 bp, Unknown
  misc_feature (1)..( 9): Matrix.003 file - promoters60/4770463
aaaattatt

SEQ ID NO: 59732 - DNA, 11 bp, Unknown
  misc_feature (1)..( 11): Matrix.003 file - promoters60/4770463
ttgaaatcaca

SEQ ID NO: 59733 - DNA, 8 bp, Unknown
  misc_feature (1)..( 8): Matrix.003 file - promoters60/4770463
taaacaaa

SEQ ID NO: 59734 - DNA, 6 bp, Unknown
  misc_feature (1)..( 6): Matrix.003 file - promoters60/4770466
tttttc

SEQ ID NO: 59735 - DNA, 6 bp, Unknown
  misc_feature (1)..( 6): Matrix.003 file - promoters60/4770466
ataaac

SEQ ID NO: 59736 - DNA, 6 bp, Unknown
  misc_feature (1)..( 6): Matrix.003 file - promoters60/4770466
atatat

SEQ ID NO: 59737 - DNA, 14 bp, Unknown
  misc_feature (1)..( 14): Matrix.003 file - promoters60/4770466
attttatgttctgc

SEQ ID NO: 59738 - DNA, 9 bp, Unknown
  misc_feature (1)..( 9): Matrix.003 file - promoters60/4770466
aaatcaaaa

SEQ ID NO: 59739 - DNA, 6 bp, Unknown
  misc_feature (1)..( 6): Matrix.003 file - promoters60/4770466
tttctt

SEQ ID NO: 59740 - DNA, 8 bp, Unknown
  misc_feature (1)..( 8): Matrix.003 file - promoters60/4770466
tatctcga

SEQ ID NO: 59741 - DNA, 11 bp, Unknown
  misc_feature (1)..( 11): Matrix.003 file - promoters60/4770477
tatagttcagt

SEQ ID NO: 59742 - DNA, 7 bp, Unknown
  misc_feature (1)..( 7): Matrix.003 file - promoters60/4770499
ttcagat

SEQ ID NO: 59743 - DNA, 9 bp, Unknown
  misc_feature (1)..( 9): Matrix.003 file - promoters60/4770499
ctttttaat

SEQ ID NO: 59744 - DNA, 6 bp, Unknown
  misc_feature (1)..( 6): Matrix.003 file - promoters60/4770499
gagaaa

SEQ ID NO: 59745 - DNA, 7 bp, Unknown
  misc_feature (1)..( 7): Matrix.003 file - promoters60/4770499
tttcgaa

SEQ ID NO: 59746 - DNA, 10 bp, Unknown
  misc_feature (1)..( 10): Matrix.003 file - promoters60/4770499
aaataaaata

SEQ ID NO: 59747 - DNA, 7 bp, Unknown
  misc_feature (1)..( 7): Matrix.003 file - promoters60/4770499
aacttga

SEQ ID NO: 59748 - DNA, 6 bp, Unknown
  misc_feature (1)..( 6): Matrix.003 file - promoters60/4770499
agaact

SEQ ID NO: 59749 - DNA, 6 bp, Unknown
  misc_feature (1)..( 6): Matrix.003 file - promoters60/4770499
aacgat

SEQ ID NO: 59750 - DNA, 8 bp, Unknown
  misc_feature (1)..( 8): Matrix.003 file - promoters60/4770499
gttcggtt

SEQ ID NO: 59751 - DNA, 7 bp, Unknown
  misc_feature (1)..( 7): Matrix.003 file - promoters60/4770499
tcagtgt

SEQ ID NO: 59752 - DNA, 6 bp, Unknown
  misc_feature (1)..( 6): Matrix.003 file - promoters60/4770499
agtaaa

SEQ ID NO: 59753 - DNA, 7 bp, Unknown
  misc_feature (1)..( 7): Matrix.003 file - promoters60/4770499
aatcggg

SEQ ID NO: 59754 - DNA, 8 bp, Unknown
  misc_feature (1)..( 8): Matrix.003 file - promoters60/4770499
gaaacaaa

SEQ ID NO: 59755 - DNA, 10 bp, Unknown
  misc_feature (1)..( 10): Matrix.003 file - promoters60/4770499
ggaaaagaaa

SEQ ID NO: 59756 - DNA, 7 bp, Unknown
  misc_feature (1)..( 7): Matrix.003 file - promoters60/4770499
cccacta

SEQ ID NO: 59757 - DNA, 9 bp, Unknown
  misc_feature (1)..( 9): Matrix.003 file - promoters60/4770499
aaagaaaag

SEQ ID NO: 59758 - DNA, 7 bp, Unknown
  misc_feature (1)..( 7): Matrix.003 file - promoters60/4770499
gtatata

SEQ ID NO: 59759 - DNA, 14 bp, Unknown
  misc_feature (1)..( 14): Matrix.003 file - promoters60/4770594
aaaacattacaata

SEQ ID NO: 59760 - DNA, 9 bp, Unknown
  misc_feature (1)..( 9): Matrix.003 file - promoters60/4770604
tatattcta

SEQ ID NO: 59761 - DNA, 8 bp, Unknown
  misc_feature (1)..( 8): Matrix.003 file - promoters60/4770604
caaaaaag

SEQ ID NO: 59762 - DNA, 8 bp, Unknown
  misc_feature (1)..( 8): Matrix.003 file - promoters60/4770604
aatcaata

SEQ ID NO: 59763 - DNA, 9 bp, Unknown
  misc_feature (1)..( 9): Matrix.003 file - promoters60/4770604
aaatattct

SEQ ID NO: 59764 - DNA, 7 bp, Unknown
  misc_feature (1)..( 7): Matrix.003 file - promoters60/4770604
tatatat

SEQ ID NO: 59765 - DNA, 8 bp, Unknown
  misc_feature (1)..( 8): Matrix.003 file - promoters60/4770620
aaaagatc

SEQ ID NO: 59766 - DNA, 12 bp, Unknown
  misc_feature (1)..( 12): Matrix.003 file - promoters60/4770620
tatcaaaattaa

SEQ ID NO: 59767 - DNA, 7 bp, Unknown
  misc_feature (1)..( 7): Matrix.003 file - promoters60/4770624
aaactaa

SEQ ID NO: 59768 - DNA, 6 bp, Unknown
  misc_feature (1)..( 6): Matrix.003 file - promoters60/4770624
ttatta

SEQ ID NO: 59769 - DNA, 8 bp, Unknown
  misc_feature (1)..( 8): Matrix.003 file - promoters60/4770624
aatgtata

SEQ ID NO: 59770 - DNA, 6 bp, Unknown
  misc_feature (1)..( 6): Matrix.003 file - promoters60/4770624
ctaaac

SEQ ID NO: 59771 - DNA, 6 bp, Unknown
  misc_feature (1)..( 6): Matrix.003 file - promoters60/4770624
ttaaac

SEQ ID NO: 59772 - DNA, 8 bp, Unknown
  misc_feature (1)..( 8): Matrix.003 file - promoters60/4770624
aaaaatag

SEQ ID NO: 59773 - DNA, 6 bp, Unknown
  misc_feature (1)..( 6): Matrix.003 file - promoters60/4770624
agaaaa

SEQ ID NO: 59774 - DNA, 6 bp, Unknown
  misc_feature (1)..( 6): Matrix.003 file - promoters60/4770624
aaacac

SEQ ID NO: 59775 - DNA, 10 bp, Unknown
  misc_feature (1)..( 10): Matrix.003 file - promoters60/4770624
ttgtacataa

SEQ ID NO: 59776 - DNA, 6 bp, Unknown
  misc_feature (1)..( 6): Matrix.003 file - promoters60/4770624
aattaa

SEQ ID NO: 59777 - DNA, 6 bp, Unknown
  misc_feature (1)..( 6): Matrix.003 file - promoters60/4770624
ttgaca

SEQ ID NO: 59778 - DNA, 6 bp, Unknown
  misc_feature (1)..( 6): Matrix.003 file - promoters60/4770624
atcatg

SEQ ID NO: 59779 - DNA, 6 bp, Unknown
  misc_feature (1)..( 6): Matrix.003 file - promoters60/4770624
aaacct

SEQ ID NO: 59780 - DNA, 7 bp, Unknown
  misc_feature (1)..( 7): Matrix.003 file - promoters60/4770624
aattcaa

SEQ ID NO: 59781 - DNA, 6 bp, Unknown
  misc_feature (1)..( 6): Matrix.003 file - promoters60/4770624
aaaatt

SEQ ID NO: 59782 - DNA, 6 bp, Unknown
  misc_feature (1)..( 6): Matrix.003 file - promoters60/4770624
caatca

SEQ ID NO: 59783 - DNA, 7 bp, Unknown
  misc_feature (1)..( 7): Matrix.003 file - promoters60/4770624
aatcttt

SEQ ID NO: 59784 - DNA, 8 bp, Unknown
  misc_feature (1)..( 8): Matrix.003 file - promoters60/4770624
aaaaaaca

SEQ ID NO: 59785 - DNA, 6 bp, Unknown
  misc_feature (1)..( 6): Matrix.003 file - promoters60/4770624
tcaaaa

SEQ ID NO: 59786 - DNA, 7 bp, Unknown
  misc_feature (1)..( 7): Matrix.003 file - promoters60/4770624
agtataa

SEQ ID NO: 59787 - DNA, 7 bp, Unknown
  misc_feature (1)..( 7): Matrix.003 file - promoters60/4770659
aactctg

SEQ ID NO: 59788 - DNA, 7 bp, Unknown
  misc_feature (1)..( 7): Matrix.003 file - promoters60/4770659
agtatat

SEQ ID NO: 59789 - DNA, 6 bp, Unknown
  misc_feature (1)..( 6): Matrix.003 file - promoters60/4770659
aaactt

SEQ ID NO: 59790 - DNA, 10 bp, Unknown
  misc_feature (1)..( 10): Matrix.003 file - promoters60/4770659
aaaataaata

SEQ ID NO: 59791 - DNA, 8 bp, Unknown
  misc_feature (1)..( 8): Matrix.003 file - promoters60/4770659
atattttt

SEQ ID NO: 59792 - DNA, 6 bp, Unknown
  misc_feature (1)..( 6): Matrix.003 file - promoters60/4770659
ataata

SEQ ID NO: 59793 - DNA, 6 bp, Unknown
  misc_feature (1)..( 6): Matrix.003 file - promoters60/4770659
tgattt

SEQ ID NO: 59794 - DNA, 7 bp, Unknown
  misc_feature (1)..( 7): Matrix.003 file - promoters60/4770659
attagtt

SEQ ID NO: 59795 - DNA, 6 bp, Unknown
  misc_feature (1)..( 6): Matrix.003 file - promoters60/4770659
attcaa

SEQ ID NO: 59796 - DNA, 8 bp, Unknown
  misc_feature (1)..( 8): Matrix.003 file - promoters60/4770659
tattcatg

SEQ ID NO: 59797 - DNA, 6 bp, Unknown
  misc_feature (1)..( 6): Matrix.003 file - promoters60/4770659
aacaaa

SEQ ID NO: 59798 - DNA, 8 bp, Unknown
  misc_feature (1)..( 8): Matrix.003 file - promoters60/4770659
aatagata

SEQ ID NO: 59799 - DNA, 6 bp, Unknown
  misc_feature (1)..( 6): Matrix.003 file - promoters60/4770659
ttttta

SEQ ID NO: 59800 - DNA, 6 bp, Unknown
  misc_feature (1)..( 6): Matrix.003 file - promoters60/4770659
ttaatt

SEQ ID NO: 59801 - DNA, 6 bp, Unknown
  misc_feature (1)..( 6): Matrix.003 file - promoters60/4770659
ttctaa

SEQ ID NO: 59802 - DNA, 7 bp, Unknown
  misc_feature (1)..( 7): Matrix.003 file - promoters60/4770666
ttggatt

SEQ ID NO: 59803 - DNA, 7 bp, Unknown
  misc_feature (1)..( 7): Matrix.003 file - promoters60/4770666
aattata

SEQ ID NO: 59804 - DNA, 7 bp, Unknown
  misc_feature (1)..( 7): Matrix.003 file - promoters60/4770666
aaaacct

SEQ ID NO: 59805 - DNA, 7 bp, Unknown
  misc_feature (1)..( 7): Matrix.003 file - promoters60/4770666
tctcacg

SEQ ID NO: 59806 - DNA, 6 bp, Unknown
  misc_feature (1)..( 6): Matrix.003 file - promoters60/4770666
tttcaa

SEQ ID NO: 59807 - DNA, 7 bp, Unknown
  misc_feature (1)..( 7): Matrix.003 file - promoters60/4770666
ataattg

SEQ ID NO: 59808 - DNA, 6 bp, Unknown
  misc_feature (1)..( 6): Matrix.003 file - promoters60/4770666
agatat

SEQ ID NO: 59809 - DNA, 7 bp, Unknown
  misc_feature (1)..( 7): Matrix.003 file - promoters60/4770666
gaaaaaa

SEQ ID NO: 59810 - DNA, 7 bp, Unknown
  misc_feature (1)..( 7): Matrix.003 file - promoters60/4770666
caccata

SEQ ID NO: 59811 - DNA, 8 bp, Unknown
  misc_feature (1)..( 8): Matrix.003 file - promoters60/4770666
ttaattca

SEQ ID NO: 59812 - DNA, 6 bp, Unknown
  misc_feature (1)..( 6): Matrix.003 file - promoters60/4770666
atatgt

SEQ ID NO: 59813 - DNA, 6 bp, Unknown
  misc_feature (1)..( 6): Matrix.003 file - promoters60/4770666
aaccta

SEQ ID NO: 59814 - DNA, 6 bp, Unknown
  misc_feature (1)..( 6): Matrix.003 file - promoters60/4770666
tatcat

SEQ ID NO: 59815 - DNA, 6 bp, Unknown
  misc_feature (1)..( 6): Matrix.003 file - promoters60/4770666
ttaaaa

SEQ ID NO: 59816 - DNA, 7 bp, Unknown
  misc_feature (1)..( 7): Matrix.003 file - promoters60/4770666
tcaaata

SEQ ID NO: 59817 - DNA, 8 bp, Unknown
  misc_feature (1)..( 8): Matrix.003 file - promoters60/4770666
tttaatct

SEQ ID NO: 59818 - DNA, 8 bp, Unknown
  misc_feature (1)..( 8): Matrix.003 file - promoters60/4770666
aatggtaa

SEQ ID NO: 59819 - DNA, 8 bp, Unknown
  misc_feature (1)..( 8): Matrix.003 file - promoters60/4770666
aagcagag

SEQ ID NO: 59820 - DNA, 6 bp, Unknown
  misc_feature (1)..( 6): Matrix.003 file - promoters60/4770666
aataat

SEQ ID NO: 59821 - DNA, 10 bp, Unknown
  misc_feature (1)..( 10): Matrix.003 file - promoters60/4770666
aactaatcat

SEQ ID NO: 59822 - DNA, 10 bp, Unknown
  misc_feature (1)..( 10): Matrix.003 file - promoters60/4770666
attagtttaa

SEQ ID NO: 59823 - DNA, 14 bp, Unknown
  misc_feature (1)..( 14): Matrix.003 file - promoters60/4770666
ctacaaatagaggc

SEQ ID NO: 59824 - DNA, 8 bp, Unknown
  misc_feature (1)..( 8): Matrix.003 file - promoters60/4770865
acatattg

SEQ ID NO: 59825 - DNA, 9 bp, Unknown
  misc_feature (1)..( 9): Matrix.003 file - promoters60/4770865
ttataaaaa

SEQ ID NO: 59826 - DNA, 5 bp, Unknown
  misc_feature (1)..( 5): Matrix.003 file - promoters60/4771271
gaaag

SEQ ID NO: 59827 - DNA, 7 bp, Unknown
  misc_feature (1)..( 7): Matrix.003 file - promoters60/4771286
aacatat

SEQ ID NO: 59828 - DNA, 12 bp, Unknown
  misc_feature (1)..( 12): Matrix.003 file - promoters60/4771286
tttgtattttag

SEQ ID NO: 59829 - DNA, 7 bp, Unknown
  misc_feature (1)..( 7): Matrix.003 file - promoters60/4771286
attcaaa

SEQ ID NO: 59830 - DNA, 7 bp, Unknown
  misc_feature (1)..( 7): Matrix.003 file - promoters60/4771286
aatatgt

SEQ ID NO: 59831 - DNA, 9 bp, Unknown
  misc_feature (1)..( 9): Matrix.003 file - promoters60/4771286
gttattttt

SEQ ID NO: 59832 - DNA, 9 bp, Unknown
  misc_feature (1)..( 9): Matrix.003 file - promoters60/4771286
ataataatg

SEQ ID NO: 59833 - DNA, 11 bp, Unknown
  misc_feature (1)..( 11): Matrix.003 file - promoters60/4771286
gataggaaaaa

SEQ ID NO: 59834 - DNA, 6 bp, Unknown
  misc_feature (1)..( 6): Matrix.003 file - promoters60/4771286
tatcca

SEQ ID NO: 59835 - DNA, 6 bp, Unknown
  misc_feature (1)..( 6): Matrix.003 file - promoters60/4771286
cattaa

SEQ ID NO: 59836 - DNA, 11 bp, Unknown
  misc_feature (1)..( 11): Matrix.003 file - promoters60/4771286
ataaacccttc

SEQ ID NO: 59837 - DNA, 10 bp, Unknown
  misc_feature (1)..( 10): Matrix.003 file - promoters60/4771286
tataaaaaaa

SEQ ID NO: 59838 - DNA, 6 bp, Unknown
  misc_feature (1)..( 6): Matrix.003 file - promoters60/4771286
aaattc

SEQ ID NO: 59839 - DNA, 7 bp, Unknown
  misc_feature (1)..( 7): Matrix.003 file - promoters60/4771286
tttgaaa

SEQ ID NO: 59840 - DNA, 10 bp, Unknown
  misc_feature (1)..( 10): Matrix.003 file - promoters60/4771286
aaaatgttag

SEQ ID NO: 59841 - DNA, 7 bp, Unknown
  misc_feature (1)..( 7): Matrix.003 file - promoters60/4771286
actctgt

SEQ ID NO: 59842 - DNA, 6 bp, Unknown
  misc_feature (1)..( 6): Matrix.003 file - promoters60/4771286
atctcc

SEQ ID NO: 59843 - DNA, 8 bp, Unknown
  misc_feature (1)..( 8): Matrix.003 file - promoters60/4771286
atccgcgt

SEQ ID NO: 59844 - DNA, 14 bp, Unknown
  misc_feature (1)..( 14): Matrix.003 file - promoters60/4771286
taaccaatcagatc

SEQ ID NO: 59845 - DNA, 6 bp, Unknown
  misc_feature (1)..( 6): Matrix.003 file - promoters60/4771286
tattct

SEQ ID NO: 59846 - DNA, 8 bp, Unknown
  misc_feature (1)..( 8): Matrix.003 file - promoters60/4771286
atacaaca

SEQ ID NO: 59847 - DNA, 9 bp, Unknown
  misc_feature (1)..( 9): Matrix.003 file - promoters60/4771286
tcaacttgt

SEQ ID NO: 59848 - DNA, 7 bp, Unknown
  misc_feature (1)..( 7): Matrix.003 file - promoters60/4771286
tttcgat

SEQ ID NO: 59849 - DNA, 7 bp, Unknown
  misc_feature (1)..( 7): Matrix.003 file - promoters60/4771286
aacataa

SEQ ID NO: 59850 - DNA, 10 bp, Unknown
  misc_feature (1)..( 10): Matrix.003 file - promoters60/4771286
ataaaccaat

SEQ ID NO: 59851 - DNA, 7 bp, Unknown
  misc_feature (1)..( 7): Matrix.003 file - promoters60/4771286
tcccatc

SEQ ID NO: 59852 - DNA, 8 bp, Unknown
  misc_feature (1)..( 8): Matrix.003 file - promoters60/4771321
tttataaa

SEQ ID NO: 59853 - DNA, 7 bp, Unknown
  misc_feature (1)..( 7): Matrix.003 file - promoters60/4771348
atgaaga

SEQ ID NO: 59854 - DNA, 8 bp, Unknown
  misc_feature (1)..( 8): Matrix.003 file - promoters60/4771348
tgtcttta

SEQ ID NO: 59855 - DNA, 6 bp, Unknown
  misc_feature (1)..( 6): Matrix.003 file - promoters60/4771348
ttgttt

SEQ ID NO: 59856 - DNA, 8 bp, Unknown
  misc_feature (1)..( 8): Matrix.003 file - promoters60/4771348
cattagta

SEQ ID NO: 59857 - DNA, 7 bp, Unknown
  misc_feature (1)..( 7): Matrix.003 file - promoters60/4771348
caacatt

SEQ ID NO: 59858 - DNA, 6 bp, Unknown
  misc_feature (1)..( 6): Matrix.003 file - promoters60/4771348
tgacag

SEQ ID NO: 59859 - DNA, 8 bp, Unknown
  misc_feature (1)..( 8): Matrix.003 file - promoters60/4771348
ctctccac

SEQ ID NO: 59860 - DNA, 7 bp, Unknown
  misc_feature (1)..( 7): Matrix.003 file - promoters60/4771348
tttagtt

SEQ ID NO: 59861 - DNA, 7 bp, Unknown
  misc_feature (1)..( 7): Matrix.003 file - promoters60/4771348
atagaaa

SEQ ID NO: 59862 - DNA, 7 bp, Unknown
  misc_feature (1)..( 7): Matrix.003 file - promoters60/4771348
ttaattt

SEQ ID NO: 59863 - DNA, 7 bp, Unknown
  misc_feature (1)..( 7): Matrix.003 file - promoters60/4771348
acactgt

SEQ ID NO: 59864 - DNA, 6 bp, Unknown
  misc_feature (1)..( 6): Matrix.003 file - promoters60/4771348
catttt

SEQ ID NO: 59865 - DNA, 6 bp, Unknown
  misc_feature (1)..( 6): Matrix.003 file - promoters60/4771348
agatta

SEQ ID NO: 59866 - DNA, 9 bp, Unknown
  misc_feature (1)..( 9): Matrix.003 file - promoters60/4771348
aagacaaag

SEQ ID NO: 59867 - DNA, 7 bp, Unknown
  misc_feature (1)..( 7): Matrix.003 file - promoters60/4771348
tagaaaa

SEQ ID NO: 59868 - DNA, 7 bp, Unknown
  misc_feature (1)..( 7): Matrix.003 file - promoters60/4771348
gagagaa

SEQ ID NO: 59869 - DNA, 7 bp, Unknown
  misc_feature (1)..( 7): Matrix.003 file - promoters60/4771348
ttatgtc

SEQ ID NO: 59870 - DNA, 10 bp, Unknown
  misc_feature (1)..( 10): Matrix.003 file - promoters60/4771348
ttttaataac

SEQ ID NO: 59871 - DNA, 6 bp, Unknown
  misc_feature (1)..( 6): Matrix.003 file - promoters60/4771348
aaaatc

SEQ ID NO: 59872 - DNA, 7 bp, Unknown
  misc_feature (1)..( 7): Matrix.003 file - promoters60/4771348
gattcag

SEQ ID NO: 59873 - DNA, 7 bp, Unknown
  misc_feature (1)..( 7): Matrix.003 file - promoters60/4771348
gatcgat

SEQ ID NO: 59874 - DNA, 10 bp, Unknown
  misc_feature (1)..( 10): Matrix.003 file - promoters60/4771360
acaaacaaaa

SEQ ID NO: 59875 - DNA, 7 bp, Unknown
  misc_feature (1)..( 7): Matrix.003 file - promoters60/4771360
tttattt

SEQ ID NO: 59876 - DNA, 13 bp, Unknown
  misc_feature (1)..( 13): Matrix.003 file - promoters60/4771360
acaatataagtta

SEQ ID NO: 59877 - DNA, 7 bp, Unknown
  misc_feature (1)..( 7): Matrix.003 file - promoters60/4771360
tttaatt

SEQ ID NO: 59878 - DNA, 12 bp, Unknown
  misc_feature (1)..( 12): Matrix.003 file - promoters60/4771360
caataaaagtta

SEQ ID NO: 59879 - DNA, 7 bp, Unknown
  misc_feature (1)..( 7): Matrix.003 file - promoters60/4771385
tgggaaa

SEQ ID NO: 59880 - DNA, 7 bp, Unknown
  misc_feature (1)..( 7): Matrix.003 file - promoters60/4771385
ttcattt

SEQ ID NO: 59881 - DNA, 9 bp, Unknown
  misc_feature (1)..( 9): Matrix.003 file - promoters60/4771385
atgtttctc

SEQ ID NO: 59882 - DNA, 9 bp, Unknown
  misc_feature (1)..( 9): Matrix.003 file - promoters60/4771385
tttctgttt

SEQ ID NO: 59883 - DNA, 7 bp, Unknown
  misc_feature (1)..( 7): Matrix.003 file - promoters60/4771385
gttcctt

SEQ ID NO: 59884 - DNA, 9 bp, Unknown
  misc_feature (1)..( 9): Matrix.003 file - promoters60/4771385
aacaagaaa

SEQ ID NO: 59885 - DNA, 11 bp, Unknown
  misc_feature (1)..( 11): Matrix.003 file - promoters60/4771385
tttttaagaac

SEQ ID NO: 59886 - DNA, 8 bp, Unknown
  misc_feature (1)..( 8): Matrix.003 file - promoters60/4771385
gtcaccga

SEQ ID NO: 59887 - DNA, 7 bp, Unknown
  misc_feature (1)..( 7): Matrix.003 file - promoters60/4771385
tccagtg

SEQ ID NO: 59888 - DNA, 7 bp, Unknown
  misc_feature (1)..( 7): Matrix.003 file - promoters60/4771385
ataccct

SEQ ID NO: 59889 - DNA, 8 bp, Unknown
  misc_feature (1)..( 8): Matrix.003 file - promoters60/4771385
cttcaaag

SEQ ID NO: 59890 - DNA, 6 bp, Unknown
  misc_feature (1)..( 6): Matrix.003 file - promoters60/4771385
caccaa

SEQ ID NO: 59891 - DNA, 12 bp, Unknown
  misc_feature (1)..( 12): Matrix.003 file - promoters60/4771385
atagagaaacaa

SEQ ID NO: 59892 - DNA, 8 bp, Unknown
  misc_feature (1)..( 8): Matrix.003 file - promoters60/4771385
gatcgatg

SEQ ID NO: 59893 - DNA, 7 bp, Unknown
  misc_feature (1)..( 7): Matrix.003 file - promoters60/4771385
tggagtt

SEQ ID NO: 59894 - DNA, 10 bp, Unknown
  misc_feature (1)..( 10): Matrix.003 file - promoters60/4771385
atatagtata

SEQ ID NO: 59895 - DNA, 7 bp, Unknown
  misc_feature (1)..( 7): Matrix.003 file - promoters60/4771385
gatcaaa

SEQ ID NO: 59896 - DNA, 8 bp, Unknown
  misc_feature (1)..( 8): Matrix.003 file - promoters60/4771385
agtcagaa

SEQ ID NO: 59897 - DNA, 7 bp, Unknown
  misc_feature (1)..( 7): Matrix.003 file - promoters60/4771385
tttcggt

SEQ ID NO: 59898 - DNA, 8 bp, Unknown
  misc_feature (1)..( 8): Matrix.003 file - promoters60/4771407
cagattat

SEQ ID NO: 59899 - DNA, 12 bp, Unknown
  misc_feature (1)..( 12): Matrix.003 file - promoters60/4771407
aaatgtcatttt

SEQ ID NO: 59900 - DNA, 7 bp, Unknown
  misc_feature (1)..( 7): Matrix.003 file - promoters60/4771407
attttgt

SEQ ID NO: 59901 - DNA, 9 bp, Unknown
  misc_feature (1)..( 9): Matrix.003 file - promoters60/4771407
aatggaaga

SEQ ID NO: 59902 - DNA, 11 bp, Unknown
  misc_feature (1)..( 11): Matrix.003 file - promoters60/4771407
gatttttgtta

SEQ ID NO: 59903 - DNA, 8 bp, Unknown
  misc_feature (1)..( 8): Matrix.003 file - promoters60/4771410
ttatctat

SEQ ID NO: 59904 - DNA, 6 bp, Unknown
  misc_feature (1)..( 6): Matrix.003 file - promoters60/4771426
atattg

SEQ ID NO: 59905 - DNA, 10 bp, Unknown
  misc_feature (1)..( 10): Matrix.003 file - promoters60/4771426
attacaatat

SEQ ID NO: 59906 - DNA, 20 bp, Unknown
  misc_feature (1)..( 20): Matrix.003 file - promoters60/4771426
aaagttgctacaaattatag

SEQ ID NO: 59907 - DNA, 22 bp, Unknown
  misc_feature (1)..( 22): Matrix.003 file - promoters60/4771426
tcttttctgattttgtttctca

SEQ ID NO: 59908 - DNA, 7 bp, Unknown
  misc_feature (1)..( 7): Matrix.003 file - promoters60/4771426
taccaaa

SEQ ID NO: 59909 - DNA, 8 bp, Unknown
  misc_feature (1)..( 8): Matrix.003 file - promoters60/4771426
caatatga

SEQ ID NO: 59910 - DNA, 7 bp, Unknown
  misc_feature (1)..( 7): Matrix.003 file - promoters60/4771426
ctcaaat

SEQ ID NO: 59911 - DNA, 7 bp, Unknown
  misc_feature (1)..( 7): Matrix.003 file - promoters60/4771426
aaatata

SEQ ID NO: 59912 - DNA, 7 bp, Unknown
  misc_feature (1)..( 7): Matrix.003 file - promoters60/4771426
ttcaatg

SEQ ID NO: 59913 - DNA, 7 bp, Unknown
  misc_feature (1)..( 7): Matrix.003 file - promoters60/4771426
caaatct

SEQ ID NO: 59914 - DNA, 7 bp, Unknown
  misc_feature (1)..( 7): Matrix.003 file - promoters60/4771426
aattctt

SEQ ID NO: 59915 - DNA, 8 bp, Unknown
  misc_feature (1)..( 8): Matrix.003 file - promoters60/4771426
tcttttct

SEQ ID NO: 59916 - DNA, 8 bp, Unknown
  misc_feature (1)..( 8): Matrix.003 file - promoters60/4771426
gataaaat

SEQ ID NO: 59917 - DNA, 6 bp, Unknown
  misc_feature (1)..( 6): Matrix.003 file - promoters60/4771426
atagga

SEQ ID NO: 59918 - DNA, 6 bp, Unknown
  misc_feature (1)..( 6): Matrix.003 file - promoters60/4771426
atagga

SEQ ID NO: 59919 - DNA, 8 bp, Unknown
  misc_feature (1)..( 8): Matrix.003 file - promoters60/4771426
ataaaatt

SEQ ID NO: 59920 - DNA, 6 bp, Unknown
  misc_feature (1)..( 6): Matrix.003 file - promoters60/4771426
aaaaaa

SEQ ID NO: 59921 - DNA, 12 bp, Unknown
  misc_feature (1)..( 12): Matrix.003 file - promoters60/4771426
aaaaaataaaaa

SEQ ID NO: 59922 - DNA, 7 bp, Unknown
  misc_feature (1)..( 7): Matrix.003 file - promoters60/4771426
gcacaaa

SEQ ID NO: 59923 - DNA, 6 bp, Unknown
  misc_feature (1)..( 6): Matrix.003 file - promoters60/4771426
ttgata

SEQ ID NO: 59924 - DNA, 7 bp, Unknown
  misc_feature (1)..( 7): Matrix.003 file - promoters60/4771426
tttccta

SEQ ID NO: 59925 - DNA, 9 bp, Unknown
  misc_feature (1)..( 9): Matrix.003 file - promoters60/4771426
aaaaataaa

SEQ ID NO: 59926 - DNA, 9 bp, Unknown
  misc_feature (1)..( 9): Matrix.003 file - promoters60/4771426
aaacaaaaa

SEQ ID NO: 59927 - DNA, 8 bp, Unknown
  misc_feature (1)..( 8): Matrix.003 file - promoters60/4771426
ctaaatat

SEQ ID NO: 59928 - DNA, 6 bp, Unknown
  misc_feature (1)..( 6): Matrix.003 file - promoters60/4771426
aaatta

SEQ ID NO: 59929 - DNA, 8 bp, Unknown
  misc_feature (1)..( 8): Matrix.003 file - promoters60/4771441
gttttttt

SEQ ID NO: 59930 - DNA, 9 bp, Unknown
  misc_feature (1)..( 9): Matrix.003 file - promoters60/4771441
gtttttcat

SEQ ID NO: 59931 - DNA, 10 bp, Unknown
  misc_feature (1)..( 10): Matrix.003 file - promoters60/4771441
tctattcttt

SEQ ID NO: 59932 - DNA, 7 bp, Unknown
  misc_feature (1)..( 7): Matrix.003 file - promoters60/4771441
tttaata

SEQ ID NO: 59933 - DNA, 8 bp, Unknown
  misc_feature (1)..( 8): Matrix.003 file - promoters60/4771441
catatact

SEQ ID NO: 59934 - DNA, 15 bp, Unknown
  misc_feature (1)..( 15): Matrix.003 file - promoters60/4771441
ctatataatagtagc

SEQ ID NO: 59935 - DNA, 6 bp, Unknown
  misc_feature (1)..( 6): Matrix.003 file - promoters60/4771441
catttt

SEQ ID NO: 59936 - DNA, 7 bp, Unknown
  misc_feature (1)..( 7): Matrix.003 file - promoters60/4771441
ataacca

SEQ ID NO: 59937 - DNA, 6 bp, Unknown
  misc_feature (1)..( 6): Matrix.003 file - promoters60/4771441
ttatat

SEQ ID NO: 59938 - DNA, 7 bp, Unknown
  misc_feature (1)..( 7): Matrix.003 file - promoters60/4771441
tcaatat

SEQ ID NO: 59939 - DNA, 6 bp, Unknown
  misc_feature (1)..( 6): Matrix.003 file - promoters60/4771441
ttgctt

SEQ ID NO: 59940 - DNA, 8 bp, Unknown
  misc_feature (1)..( 8): Matrix.003 file - promoters60/4771441
tataatgt

SEQ ID NO: 59941 - DNA, 7 bp, Unknown
  misc_feature (1)..( 7): Matrix.003 file - promoters60/4771441
ctatttt

SEQ ID NO: 59942 - DNA, 6 bp, Unknown
  misc_feature (1)..( 6): Matrix.003 file - promoters60/4771441
cagaaa

SEQ ID NO: 59943 - DNA, 6 bp, Unknown
  misc_feature (1)..( 6): Matrix.003 file - promoters60/4771441
aaagag

SEQ ID NO: 59944 - DNA, 6 bp, Unknown
  misc_feature (1)..( 6): Matrix.003 file - promoters60/4771441
ctgaaa

SEQ ID NO: 59945 - DNA, 12 bp, Unknown
  misc_feature (1)..( 12): Matrix.003 file - promoters60/4771457
ataaaacctaaa

SEQ ID NO: 59946 - DNA, 7 bp, Unknown
  misc_feature (1)..( 7): Matrix.003 file - promoters60/4771457
attcctt

SEQ ID NO: 59947 - DNA, 10 bp, Unknown
  misc_feature (1)..( 10): Matrix.003 file - promoters60/4771457
ggtttatttt

SEQ ID NO: 59948 - DNA, 10 bp, Unknown
  misc_feature (1)..( 10): Matrix.003 file - promoters60/4771464
attttgttat

SEQ ID NO: 59949 - DNA, 8 bp, Unknown
  misc_feature (1)..( 8): Matrix.003 file - promoters60/4771467
aaaaatgt

SEQ ID NO: 59950 - DNA, 7 bp, Unknown
  misc_feature (1)..( 7): Matrix.003 file - promoters60/4771467
ttcaatt

SEQ ID NO: 59951 - DNA, 9 bp, Unknown
  misc_feature (1)..( 9): Matrix.003 file - promoters60/4771467
tataatttg

SEQ ID NO: 59952 - DNA, 7 bp, Unknown
  misc_feature (1)..( 7): Matrix.003 file - promoters60/4771467
tataaaa

SEQ ID NO: 59953 - DNA, 7 bp, Unknown
  misc_feature (1)..( 7): Matrix.003 file - promoters60/4771467
tgaatat

SEQ ID NO: 59954 - DNA, 7 bp, Unknown
  misc_feature (1)..( 7): Matrix.003 file - promoters60/4771467
aaaacaa

SEQ ID NO: 59955 - DNA, 7 bp, Unknown
  misc_feature (1)..( 7): Matrix.003 file - promoters60/4771467
ataccaa

SEQ ID NO: 59956 - DNA, 6 bp, Unknown
  misc_feature (1)..( 6): Matrix.003 file - promoters60/4771467
aaaaat

SEQ ID NO: 59957 - DNA, 7 bp, Unknown
  misc_feature (1)..( 7): Matrix.003 file - promoters60/4771467
aagaaag

SEQ ID NO: 59958 - DNA, 7 bp, Unknown
  misc_feature (1)..( 7): Matrix.003 file - promoters60/4771467
tcataat

SEQ ID NO: 59959 - DNA, 6 bp, Unknown
  misc_feature (1)..( 6): Matrix.003 file - promoters60/4771467
attgtt

SEQ ID NO: 59960 - DNA, 8 bp, Unknown
  misc_feature (1)..( 8): Matrix.003 file - promoters60/4771472
caaatgtg

SEQ ID NO: 59961 - DNA, 9 bp, Unknown
  misc_feature (1)..( 9): Matrix.003 file - promoters60/4771472
tcttcttta

SEQ ID NO: 59962 - DNA, 8 bp, Unknown
  misc_feature (1)..( 8): Matrix.003 file - promoters60/4771472
ataaatct

SEQ ID NO: 59963 - DNA, 10 bp, Unknown
  misc_feature (1)..( 10): Matrix.003 file - promoters60/4771472
tgtatcgtaa

SEQ ID NO: 59964 - DNA, 8 bp, Unknown
  misc_feature (1)..( 8): Matrix.003 file - promoters60/4771472
aaggtttt

SEQ ID NO: 59965 - DNA, 21 bp, Unknown
  misc_feature (1)..( 21): Matrix.003 file - promoters60/4771472
aacggctaatttctcttcttc

SEQ ID NO: 59966 - DNA, 10 bp, Unknown
  misc_feature (1)..( 10): Matrix.003 file - promoters60/4771472
tttctcttct

SEQ ID NO: 59967 - DNA, 6 bp, Unknown
  misc_feature (1)..( 6): Matrix.003 file - promoters60/4771472
aaattt

SEQ ID NO: 59968 - DNA, 12 bp, Unknown
  misc_feature (1)..( 12): Matrix.003 file - promoters60/4771472
tttattttctgt

SEQ ID NO: 59969 - DNA, 9 bp, Unknown
  misc_feature (1)..( 9): Matrix.003 file - promoters60/4771478
ttttttgtt

SEQ ID NO: 59970 - DNA, 13 bp, Unknown
  misc_feature (1)..( 13): Matrix.003 file - promoters60/4771478
tatataaatcctt

SEQ ID NO: 59971 - DNA, 9 bp, Unknown
  misc_feature (1)..( 9): Matrix.003 file - promoters60/4771478
tctttttaa

SEQ ID NO: 59972 - DNA, 9 bp, Unknown
  misc_feature (1)..( 9): Matrix.003 file - promoters60/4771478
catttttct

SEQ ID NO: 59973 - DNA, 9 bp, Unknown
  misc_feature (1)..( 9): Matrix.003 file - promoters60/4771495
ttcataaat

SEQ ID NO: 59974 - DNA, 11 bp, Unknown
  misc_feature (1)..( 11): Matrix.003 file - promoters60/4771495
tttaaagatat

SEQ ID NO: 59975 - DNA, 14 bp, Unknown
  misc_feature (1)..( 14): Matrix.003 file - promoters60/4771495
gatattttttataa

SEQ ID NO: 59976 - DNA, 7 bp, Unknown
  misc_feature (1)..( 7): Matrix.003 file - promoters60/4771502
attattt

SEQ ID NO: 59977 - DNA, 7 bp, Unknown
  misc_feature (1)..( 7): Matrix.003 file - promoters60/4771502
caatttt

SEQ ID NO: 59978 - DNA, 13 bp, Unknown
  misc_feature (1)..( 13): Matrix.003 file - promoters60/4771502
atatatttcattt

SEQ ID NO: 59979 - DNA, 8 bp, Unknown
  misc_feature (1)..( 8): Matrix.003 file - promoters60/4771502
taatcgat

SEQ ID NO: 59980 - DNA, 6 bp, Unknown
  misc_feature (1)..( 6): Matrix.003 file - promoters60/4771502
gtaatt

SEQ ID NO: 59981 - DNA, 7 bp, Unknown
  misc_feature (1)..( 7): Matrix.003 file - promoters60/4771502
tttaata

SEQ ID NO: 59982 - DNA, 8 bp, Unknown
  misc_feature (1)..( 8): Matrix.003 file - promoters60/4771502
tttggttt

SEQ ID NO: 59983 - DNA, 6 bp, Unknown
  misc_feature (1)..( 6): Matrix.003 file - promoters60/4771502
attgga

SEQ ID NO: 59984 - DNA, 7 bp, Unknown
  misc_feature (1)..( 7): Matrix.003 file - promoters60/4771502
aggccca

SEQ ID NO: 59985 - DNA, 6 bp, Unknown
  misc_feature (1)..( 6): Matrix.003 file - promoters60/4771502
cccaat

SEQ ID NO: 59986 - DNA, 6 bp, Unknown
  misc_feature (1)..( 6): Matrix.003 file - promoters60/4771502
caatta

SEQ ID NO: 59987 - DNA, 7 bp, Unknown
  misc_feature (1)..( 7): Matrix.003 file - promoters60/4771502
tttcact

SEQ ID NO: 59988 - DNA, 13 bp, Unknown
  misc_feature (1)..( 13): Matrix.003 file - promoters60/4771502
caacactatactg

SEQ ID NO: 59989 - DNA, 6 bp, Unknown
  misc_feature (1)..( 6): Matrix.003 file - promoters60/4771502
tctaaa

SEQ ID NO: 59990 - DNA, 8 bp, Unknown
  misc_feature (1)..( 8): Matrix.003 file - promoters60/4771502
attttcta

SEQ ID NO: 59991 - DNA, 9 bp, Unknown
  misc_feature (1)..( 9): Matrix.003 file - promoters60/4771502
taaaagccg

SEQ ID NO: 59992 - DNA, 6 bp, Unknown
  misc_feature (1)..( 6): Matrix.003 file - promoters60/4771502
gataaa

SEQ ID NO: 59993 - DNA, 6 bp, Unknown
  misc_feature (1)..( 6): Matrix.003 file - promoters60/4771502
tcacag

SEQ ID NO: 59994 - DNA, 7 bp, Unknown
  misc_feature (1)..( 7): Matrix.003 file - promoters60/4771502
tcaaagg

SEQ ID NO: 59995 - DNA, 6 bp, Unknown
  misc_feature (1)..( 6): Matrix.003 file - promoters60/4771502
ccactt

SEQ ID NO: 59996 - DNA, 13 bp, Unknown
  misc_feature (1)..( 13): Matrix.003 file - promoters60/4771519
aaatctctcacaa

SEQ ID NO: 59997 - DNA, 7 bp, Unknown
  misc_feature (1)..( 7): Matrix.003 file - promoters60/4771523
aagaaag

SEQ ID NO: 59998 - DNA, 10 bp, Unknown
  misc_feature (1)..( 10): Matrix.003 file - promoters60/4771586
actatttaaa

SEQ ID NO: 59999 - DNA, 8 bp, Unknown
  misc_feature (1)..( 8): Matrix.003 file - promoters60/4771638
aaaaaaaa

SEQ ID NO: 60000 - DNA, 7 bp, Unknown
  misc_feature (1)..( 7): Matrix.003 file - promoters60/4771638
tatcaaa

SEQ ID NO: 60001 - DNA, 6 bp, Unknown
  misc_feature (1)..( 6): Matrix.003 file - promoters60/4771638
tataat

SEQ ID NO: 60002 - DNA, 6 bp, Unknown
  misc_feature (1)..( 6): Matrix.003 file - promoters60/4771638
ttttgt

SEQ ID NO: 60003 - DNA, 11 bp, Unknown
  misc_feature (1)..( 11): Matrix.003 file - promoters60/4771638
agtgattaatc

SEQ ID NO: 60004 - DNA, 10 bp, Unknown
  misc_feature (1)..( 10): Matrix.003 file - promoters60/4771638
tttattaaag

SEQ ID NO: 60005 - DNA, 6 bp, Unknown
  misc_feature (1)..( 6): Matrix.003 file - promoters60/4771638
agctct

SEQ ID NO: 60006 - DNA, 9 bp, Unknown
  misc_feature (1)..( 9): Matrix.003 file - promoters60/4771638
aacaacttt

SEQ ID NO: 60007 - DNA, 9 bp, Unknown
  misc_feature (1)..( 9): Matrix.003 file - promoters60/4771638
ttttataca

SEQ ID NO: 60008 - DNA, 6 bp, Unknown
  misc_feature (1)..( 6): Matrix.003 file - promoters60/4771638
cactat

SEQ ID NO: 60009 - DNA, 8 bp, Unknown
  misc_feature (1)..( 8): Matrix.003 file - promoters60/4771638
acagctaa

SEQ ID NO: 60010 - DNA, 9 bp, Unknown
  misc_feature (1)..( 9): Matrix.003 file - promoters60/4771638
acataaaaa

SEQ ID NO: 60011 - DNA, 7 bp, Unknown
  misc_feature (1)..( 7): Matrix.003 file - promoters60/4771638
ttgaaac

SEQ ID NO: 60012 - DNA, 7 bp, Unknown
  misc_feature (1)..( 7): Matrix.003 file - promoters60/4771638
atgtttt

SEQ ID NO: 60013 - DNA, 7 bp, Unknown
  misc_feature (1)..( 7): Matrix.003 file - promoters60/4771638
ctacctc

SEQ ID NO: 60014 - DNA, 7 bp, Unknown
  misc_feature (1)..( 7): Matrix.003 file - promoters60/4771638
ctctgga

SEQ ID NO: 60015 - DNA, 7 bp, Unknown
  misc_feature (1)..( 7): Matrix.003 file - promoters60/4771638
agacaaa

SEQ ID NO: 60016 - DNA, 6 bp, Unknown
  misc_feature (1)..( 6): Matrix.003 file - promoters60/4771638
taactc

SEQ ID NO: 60017 - DNA, 6 bp, Unknown
  misc_feature (1)..( 6): Matrix.003 file - promoters60/4771638
acaaaa

SEQ ID NO: 60018 - DNA, 7 bp, Unknown
  misc_feature (1)..( 7): Matrix.003 file - promoters60/4771638
aaaagtt

SEQ ID NO: 60019 - DNA, 7 bp, Unknown
  misc_feature (1)..( 7): Matrix.003 file - promoters60/4771638
tttctta

SEQ ID NO: 60020 - DNA, 11 bp, Unknown
  misc_feature (1)..( 11): Matrix.003 file - promoters60/4771646
tttttctctgc

SEQ ID NO: 60021 - DNA, 14 bp, Unknown
  misc_feature (1)..( 14): Matrix.003 file - promoters60/4771677
gtttaattatattg

SEQ ID NO: 60022 - DNA, 13 bp, Unknown
  misc_feature (1)..( 13): Matrix.003 file - promoters60/4771677
aaaaatgttaatt

SEQ ID NO: 60023 - DNA, 11 bp, Unknown
  misc_feature (1)..( 11): Matrix.003 file - promoters60/4771677
agttgactttt

SEQ ID NO: 60024 - DNA, 10 bp, Unknown
  misc_feature (1)..( 10): Matrix.003 file - promoters60/4771677
aaaatgttta

SEQ ID NO: 60025 - DNA, 10 bp, Unknown
  misc_feature (1)..( 10): Matrix.003 file - promoters60/4771677
aaattatttc

SEQ ID NO: 60026 - DNA, 10 bp, Unknown
  misc_feature (1)..( 10): Matrix.003 file - promoters60/4771677
gtaaaatttt

SEQ ID NO: 60027 - DNA, 11 bp, Unknown
  misc_feature (1)..( 11): Matrix.003 file - promoters60/4771713
aaacaattatt

SEQ ID NO: 60028 - DNA, 7 bp, Unknown
  misc_feature (1)..( 7): Matrix.003 file - promoters60/4771713
attaatt

SEQ ID NO: 60029 - DNA, 6 bp, Unknown
  misc_feature (1)..( 6): Matrix.003 file - promoters60/4771713
ttattt

SEQ ID NO: 60030 - DNA, 7 bp, Unknown
  misc_feature (1)..( 7): Matrix.003 file - promoters60/4771713
aaaattg

SEQ ID NO: 60031 - DNA, 7 bp, Unknown
  misc_feature (1)..( 7): Matrix.003 file - promoters60/4771713
ccaaata

SEQ ID NO: 60032 - DNA, 7 bp, Unknown
  misc_feature (1)..( 7): Matrix.003 file - promoters60/4771713
ctcagca

SEQ ID NO: 60033 - DNA, 7 bp, Unknown
  misc_feature (1)..( 7): Matrix.003 file - promoters60/4771713
atctgag

SEQ ID NO: 60034 - DNA, 6 bp, Unknown
  misc_feature (1)..( 6): Matrix.003 file - promoters60/4771713
aaattg

SEQ ID NO: 60035 - DNA, 8 bp, Unknown
  misc_feature (1)..( 8): Matrix.003 file - promoters60/4771713
ttattaag

SEQ ID NO: 60036 - DNA, 8 bp, Unknown
  misc_feature (1)..( 8): Matrix.003 file - promoters60/4771713
aacaaatt

SEQ ID NO: 60037 - DNA, 8 bp, Unknown
  misc_feature (1)..( 8): Matrix.003 file - promoters60/4771713
cgaaccca

SEQ ID NO: 60038 - DNA, 7 bp, Unknown
  misc_feature (1)..( 7): Matrix.003 file - promoters60/4771713
aaagaaa

SEQ ID NO: 60039 - DNA, 7 bp, Unknown
  misc_feature (1)..( 7): Matrix.003 file - promoters60/4771713
aataaaa

SEQ ID NO: 60040 - DNA, 7 bp, Unknown
  misc_feature (1)..( 7): Matrix.003 file - promoters60/4771713
aaacttt

SEQ ID NO: 60041 - DNA, 7 bp, Unknown
  misc_feature (1)..( 7): Matrix.003 file - promoters60/4771713
ctaaaat

SEQ ID NO: 60042 - DNA, 7 bp, Unknown
  misc_feature (1)..( 7): Matrix.003 file - promoters60/4771713
ttttgtt

SEQ ID NO: 60043 - DNA, 7 bp, Unknown
  misc_feature (1)..( 7): Matrix.003 file - promoters60/4771713
tctgttc

SEQ ID NO: 60044 - DNA, 6 bp, Unknown
  misc_feature (1)..( 6): Matrix.003 file - promoters60/4771713
aataat

SEQ ID NO: 60045 - DNA, 6 bp, Unknown
  misc_feature (1)..( 6): Matrix.003 file - promoters60/4771725
atcaat

SEQ ID NO: 60046 - DNA, 6 bp, Unknown
  misc_feature (1)..( 6): Matrix.003 file - promoters60/4771725
acactt

SEQ ID NO: 60047 - DNA, 11 bp, Unknown
  misc_feature (1)..( 11): Matrix.003 file - promoters60/4771725
taacagaataa

SEQ ID NO: 60048 - DNA, 6 bp, Unknown
  misc_feature (1)..( 6): Matrix.003 file - promoters60/4771725
gtgatc

SEQ ID NO: 60049 - DNA, 6 bp, Unknown
  misc_feature (1)..( 6): Matrix.003 file - promoters60/4771725
gatcgt

SEQ ID NO: 60050 - DNA, 5 bp, Unknown
  misc_feature (1)..( 5): Matrix.003 file - promoters60/4771725
aaata

SEQ ID NO: 60051 - DNA, 6 bp, Unknown
  misc_feature (1)..( 6): Matrix.003 file - promoters60/4771725
agaatc

SEQ ID NO: 60052 - DNA, 8 bp, Unknown
  misc_feature (1)..( 8): Matrix.003 file - promoters60/4771725
agagaaga

SEQ ID NO: 60053 - DNA, 8 bp, Unknown
  misc_feature (1)..( 8): Matrix.003 file - promoters60/4771725
aataaaat

SEQ ID NO: 60054 - DNA, 7 bp, Unknown
  misc_feature (1)..( 7): Matrix.003 file - promoters60/4771725
aaaagaa

SEQ ID NO: 60055 - DNA, 9 bp, Unknown
  misc_feature (1)..( 9): Matrix.003 file - promoters60/4771725
cttaaatat

SEQ ID NO: 60056 - DNA, 8 bp, Unknown
  misc_feature (1)..( 8): Matrix.003 file - promoters60/4771725
cttcaaaa

SEQ ID NO: 60057 - DNA, 6 bp, Unknown
  misc_feature (1)..( 6): Matrix.003 file - promoters60/4771725
atcaaa

SEQ ID NO: 60058 - DNA, 7 bp, Unknown
  misc_feature (1)..( 7): Matrix.003 file - promoters60/4771725
aatagtt

SEQ ID NO: 60059 - DNA, 7 bp, Unknown
  misc_feature (1)..( 7): Matrix.003 file - promoters60/4771733
aaattaa

SEQ ID NO: 60060 - DNA, 6 bp, Unknown
  misc_feature (1)..( 6): Matrix.003 file - promoters60/4771733
atacaa

SEQ ID NO: 60061 - DNA, 7 bp, Unknown
  misc_feature (1)..( 7): Matrix.003 file - promoters60/4771733
aaaagtt

SEQ ID NO: 60062 - DNA, 9 bp, Unknown
  misc_feature (1)..( 9): Matrix.003 file - promoters60/4771733
caaaaaaaa

SEQ ID NO: 60063 - DNA, 7 bp, Unknown
  misc_feature (1)..( 7): Matrix.003 file - promoters60/4771733
aaaaaaa

SEQ ID NO: 60064 - DNA, 8 bp, Unknown
  misc_feature (1)..( 8): Matrix.003 file - promoters60/4771733
ccttatta

SEQ ID NO: 60065 - DNA, 10 bp, Unknown
  misc_feature (1)..( 10): Matrix.003 file - promoters60/4771733
gtgacataac

SEQ ID NO: 60066 - DNA, 7 bp, Unknown
  misc_feature (1)..( 7): Matrix.003 file - promoters60/4771733
taccatt

SEQ ID NO: 60067 - DNA, 6 bp, Unknown
  misc_feature (1)..( 6): Matrix.003 file - promoters60/4771733
caagag

SEQ ID NO: 60068 - DNA, 7 bp, Unknown
  misc_feature (1)..( 7): Matrix.003 file - promoters60/4771733
agagtga

SEQ ID NO: 60069 - DNA, 8 bp, Unknown
  misc_feature (1)..( 8): Matrix.003 file - promoters60/4771733
gccgacaa

SEQ ID NO: 60070 - DNA, 9 bp, Unknown
  misc_feature (1)..( 9): Matrix.003 file - promoters60/4771733
gtcattgaa

SEQ ID NO: 60071 - DNA, 7 bp, Unknown
  misc_feature (1)..( 7): Matrix.003 file - promoters60/4771733
aaacaaa

SEQ ID NO: 60072 - DNA, 7 bp, Unknown
  misc_feature (1)..( 7): Matrix.003 file - promoters60/4771733
acgagcc

SEQ ID NO: 60073 - DNA, 8 bp, Unknown
  misc_feature (1)..( 8): Matrix.003 file - promoters60/4771733
taaagtaa

SEQ ID NO: 60074 - DNA, 7 bp, Unknown
  misc_feature (1)..( 7): Matrix.003 file - promoters60/4771733
ttccaaa

SEQ ID NO: 60075 - DNA, 6 bp, Unknown
  misc_feature (1)..( 6): Matrix.003 file - promoters60/4771733
ccaaac

SEQ ID NO: 60076 - DNA, 6 bp, Unknown
  misc_feature (1)..( 6): Matrix.003 file - promoters60/4771733
ggtttt

SEQ ID NO: 60077 - DNA, 6 bp, Unknown
  misc_feature (1)..( 6): Matrix.003 file - promoters60/4771733
ttaatt

SEQ ID NO: 60078 - DNA, 8 bp, Unknown
  misc_feature (1)..( 8): Matrix.003 file - promoters60/4771733
gttagtat

SEQ ID NO: 60079 - DNA, 6 bp, Unknown
  misc_feature (1)..( 6): Matrix.003 file - promoters60/4771733
ttggcg

SEQ ID NO: 60080 - DNA, 7 bp, Unknown
  misc_feature (1)..( 7): Matrix.003 file - promoters60/4771733
atattta

SEQ ID NO: 60081 - DNA, 11 bp, Unknown
  misc_feature (1)..( 11): Matrix.003 file - promoters60/4771745
ttaaattttaa

SEQ ID NO: 60082 - DNA, 7 bp, Unknown
  misc_feature (1)..( 7): Matrix.003 file - promoters60/4771745
attttgt

SEQ ID NO: 60083 - DNA, 6 bp, Unknown
  misc_feature (1)..( 6): Matrix.003 file - promoters60/4771745
ttaaaa

SEQ ID NO: 60084 - DNA, 10 bp, Unknown
  misc_feature (1)..( 10): Matrix.003 file - promoters60/4771745
gatcagaaat

SEQ ID NO: 60085 - DNA, 6 bp, Unknown
  misc_feature (1)..( 6): Matrix.003 file - promoters60/4771745
gataat

SEQ ID NO: 60086 - DNA, 8 bp, Unknown
  misc_feature (1)..( 8): Matrix.003 file - promoters60/4771745
tgaaaaaa

SEQ ID NO: 60087 - DNA, 7 bp, Unknown
  misc_feature (1)..( 7): Matrix.003 file - promoters60/4771745
aaaatga

SEQ ID NO: 60088 - DNA, 7 bp, Unknown
  misc_feature (1)..( 7): Matrix.003 file - promoters60/4771745
agactgt

SEQ ID NO: 60089 - DNA, 9 bp, Unknown
  misc_feature (1)..( 9): Matrix.003 file - promoters60/4771745
ataatatat

SEQ ID NO: 60090 - DNA, 7 bp, Unknown
  misc_feature (1)..( 7): Matrix.003 file - promoters60/4771745
ttgggct

SEQ ID NO: 60091 - DNA, 7 bp, Unknown
  misc_feature (1)..( 7): Matrix.003 file - promoters60/4771745
tactcaa

SEQ ID NO: 60092 - DNA, 7 bp, Unknown
  misc_feature (1)..( 7): Matrix.003 file - promoters60/4771745
attgttt

SEQ ID NO: 60093 - DNA, 7 bp, Unknown
  misc_feature (1)..( 7): Matrix.003 file - promoters60/4771745
tagaaaa

SEQ ID NO: 60094 - DNA, 8 bp, Unknown
  misc_feature (1)..( 8): Matrix.003 file - promoters60/4771745
aaattaga

SEQ ID NO: 60095 - DNA, 8 bp, Unknown
  misc_feature (1)..( 8): Matrix.003 file - promoters60/4771745
caaagtaa

SEQ ID NO: 60096 - DNA, 7 bp, Unknown
  misc_feature (1)..( 7): Matrix.003 file - promoters60/4771793
aagaata

SEQ ID NO: 60097 - DNA, 9 bp, Unknown
  misc_feature (1)..( 9): Matrix.003 file - promoters60/4771793
atacttttt

SEQ ID NO: 60098 - DNA, 9 bp, Unknown
  misc_feature (1)..( 9): Matrix.003 file - promoters60/4771793
ttttttctt

SEQ ID NO: 60099 - DNA, 9 bp, Unknown
  misc_feature (1)..( 9): Matrix.003 file - promoters60/4771793
tatatattt

SEQ ID NO: 60100 - DNA, 8 bp, Unknown
  misc_feature (1)..( 8): Matrix.003 file - promoters60/4771793
aagaaatt

SEQ ID NO: 60101 - DNA, 8 bp, Unknown
  misc_feature (1)..( 8): Matrix.003 file - promoters60/4771808
tagggttt

SEQ ID NO: 60102 - DNA, 7 bp, Unknown
  misc_feature (1)..( 7): Matrix.003 file - promoters60/4771808
tttggat

SEQ ID NO: 60103 - DNA, 10 bp, Unknown
  misc_feature (1)..( 10): Matrix.003 file - promoters60/4771808
ttgtgaatgt

SEQ ID NO: 60104 - DNA, 7 bp, Unknown
  misc_feature (1)..( 7): Matrix.003 file - promoters60/4771808
caaaaaa

SEQ ID NO: 60105 - DNA, 7 bp, Unknown
  misc_feature (1)..( 7): Matrix.003 file - promoters60/4771808
caaaaag

SEQ ID NO: 60106 - DNA, 8 bp, Unknown
  misc_feature (1)..( 8): Matrix.003 file - promoters60/4771808
ctgattct

SEQ ID NO: 60107 - DNA, 8 bp, Unknown
  misc_feature (1)..( 8): Matrix.003 file - promoters60/4771808
tttcctgt

SEQ ID NO: 60108 - DNA, 7 bp, Unknown
  misc_feature (1)..( 7): Matrix.003 file - promoters60/4771808
tctgtat

SEQ ID NO: 60109 - DNA, 7 bp, Unknown
  misc_feature (1)..( 7): Matrix.003 file - promoters60/4771808
aatatta

SEQ ID NO: 60110 - DNA, 7 bp, Unknown
  misc_feature (1)..( 7): Matrix.003 file - promoters60/4771808
gccatta

SEQ ID NO: 60111 - DNA, 6 bp, Unknown
  misc_feature (1)..( 6): Matrix.003 file - promoters60/4771808
gtacaa

SEQ ID NO: 60112 - DNA, 9 bp, Unknown
  misc_feature (1)..( 9): Matrix.003 file - promoters60/4771808
tttccaatt

SEQ ID NO: 60113 - DNA, 7 bp, Unknown
  misc_feature (1)..( 7): Matrix.003 file - promoters60/4771808
ttcaaag

SEQ ID NO: 60114 - DNA, 7 bp, Unknown
  misc_feature (1)..( 7): Matrix.003 file - promoters60/4771808
aacattt

SEQ ID NO: 60115 - DNA, 6 bp, Unknown
  misc_feature (1)..( 6): Matrix.003 file - promoters60/4771808
ataatt

SEQ ID NO: 60116 - DNA, 8 bp, Unknown
  misc_feature (1)..( 8): Matrix.003 file - promoters60/4771808
attagtgt

SEQ ID NO: 60117 - DNA, 9 bp, Unknown
  misc_feature (1)..( 9): Matrix.003 file - promoters60/4771808
ataaaccaa

SEQ ID NO: 60118 - DNA, 6 bp, Unknown
  misc_feature (1)..( 6): Matrix.003 file - promoters60/4771808
acctct

SEQ ID NO: 60119 - DNA, 7 bp, Unknown
  misc_feature (1)..( 7): Matrix.003 file - promoters60/4771808
tttattt

SEQ ID NO: 60120 - DNA, 9 bp, Unknown
  misc_feature (1)..( 9): Matrix.003 file - promoters60/4771853
gtttccttt

SEQ ID NO: 60121 - DNA, 8 bp, Unknown
  misc_feature (1)..( 8): Matrix.003 file - promoters60/4771853
aaccaata

SEQ ID NO: 60122 - DNA, 9 bp, Unknown
  misc_feature (1)..( 9): Matrix.003 file - promoters60/4771853
tttccttat

SEQ ID NO: 60123 - DNA, 4 bp, Unknown
  misc_feature (1)..( 4): Matrix.003 file - promoters60/4771872
caat

SEQ ID NO: 60124 - DNA, 10 bp, Unknown
  misc_feature (1)..( 10): Matrix.003 file - promoters60/4771872
aatgaaaatt

SEQ ID NO: 60125 - DNA, 10 bp, Unknown
  misc_feature (1)..( 10): Matrix.003 file - promoters60/4771872
gaagataagg

SEQ ID NO: 60126 - DNA, 13 bp, Unknown
  misc_feature (1)..( 13): Matrix.003 file - promoters60/4771879
tcgtcgtatctaa

SEQ ID NO: 60127 - DNA, 8 bp, Unknown
  misc_feature (1)..( 8): Matrix.003 file - promoters60/4771879
tatctaat

SEQ ID NO: 60128 - DNA, 7 bp, Unknown
  misc_feature (1)..( 7): Matrix.003 file - promoters60/4771879
aatagta

SEQ ID NO: 60129 - DNA, 6 bp, Unknown
  misc_feature (1)..( 6): Matrix.003 file - promoters60/4771879
aagaaa

SEQ ID NO: 60130 - DNA, 7 bp, Unknown
  misc_feature (1)..( 7): Matrix.003 file - promoters60/4771879
tatatgt

SEQ ID NO: 60131 - DNA, 8 bp, Unknown
  misc_feature (1)..( 8): Matrix.003 file - promoters60/4771879
gtaatttg

SEQ ID NO: 60132 - DNA, 6 bp, Unknown
  misc_feature (1)..( 6): Matrix.003 file - promoters60/4771879
caaata

SEQ ID NO: 60133 - DNA, 6 bp, Unknown
  misc_feature (1)..( 6): Matrix.003 file - promoters60/4771879
aataaa

SEQ ID NO: 60134 - DNA, 6 bp, Unknown
  misc_feature (1)..( 6): Matrix.003 file - promoters60/4771879
taatat

SEQ ID NO: 60135 - DNA, 8 bp, Unknown
  misc_feature (1)..( 8): Matrix.003 file - promoters60/4771879
cctgaatt

SEQ ID NO: 60136 - DNA, 8 bp, Unknown
  misc_feature (1)..( 8): Matrix.003 file - promoters60/4771879
taaaatat

SEQ ID NO: 60137 - DNA, 8 bp, Unknown
  misc_feature (1)..( 8): Matrix.003 file - promoters60/4771879
ttctaatt

SEQ ID NO: 60138 - DNA, 7 bp, Unknown
  misc_feature (1)..( 7): Matrix.003 file - promoters60/4771879
aaaaaat

SEQ ID NO: 60139 - DNA, 7 bp, Unknown
  misc_feature (1)..( 7): Matrix.003 file - promoters60/4771879
accctat

SEQ ID NO: 60140 - DNA, 6 bp, Unknown
  misc_feature (1)..( 6): Matrix.003 file - promoters60/4771879
aaattc

SEQ ID NO: 60141 - DNA, 8 bp, Unknown
  misc_feature (1)..( 8): Matrix.003 file - promoters60/4771879
catacaga

SEQ ID NO: 60142 - DNA, 11 bp, Unknown
  misc_feature (1)..( 11): Matrix.003 file - promoters60/4771895
ttcattaatta

SEQ ID NO: 60143 - DNA, 8 bp, Unknown
  misc_feature (1)..( 8): Matrix.003 file - promoters60/4771895
ttcatatc

SEQ ID NO: 60144 - DNA, 7 bp, Unknown
  misc_feature (1)..( 7): Matrix.003 file - promoters60/4771895
tttacaa

SEQ ID NO: 60145 - DNA, 8 bp, Unknown
  misc_feature (1)..( 8): Matrix.003 file - promoters60/4771895
gaaaattc

SEQ ID NO: 60146 - DNA, 11 bp, Unknown
  misc_feature (1)..( 11): Matrix.003 file - promoters60/4771895
ttcagaatcat

SEQ ID NO: 60147 - DNA, 7 bp, Unknown
  misc_feature (1)..( 7): Matrix.003 file - promoters60/4771895
aataaaa

SEQ ID NO: 60148 - DNA, 8 bp, Unknown
  misc_feature (1)..( 8): Matrix.003 file - promoters60/4771895
aaaattta

SEQ ID NO: 60149 - DNA, 6 bp, Unknown
  misc_feature (1)..( 6): Matrix.003 file - promoters60/4771895
tttaaa

SEQ ID NO: 60150 - DNA, 9 bp, Unknown
  misc_feature (1)..( 9): Matrix.003 file - promoters60/4771895
atcttcttc

SEQ ID NO: 60151 - DNA, 6 bp, Unknown
  misc_feature (1)..( 6): Matrix.003 file - promoters60/4771895
tagaat

SEQ ID NO: 60152 - DNA, 9 bp, Unknown
  misc_feature (1)..( 9): Matrix.003 file - promoters60/4771895
attagtttg

SEQ ID NO: 60153 - DNA, 6 bp, Unknown
  misc_feature (1)..( 6): Matrix.003 file - promoters60/4771895
aaacta

SEQ ID NO: 60154 - DNA, 6 bp, Unknown
  misc_feature (1)..( 6): Matrix.003 file - promoters60/4771895
tatttt

SEQ ID NO: 60155 - DNA, 6 bp, Unknown
  misc_feature (1)..( 6): Matrix.003 file - promoters60/4771895
cgtgat

SEQ ID NO: 60156 - DNA, 10 bp, Unknown
  misc_feature (1)..( 10): Matrix.003 file - promoters60/4771895
aaattaaata

SEQ ID NO: 60157 - DNA, 7 bp, Unknown
  misc_feature (1)..( 7): Matrix.003 file - promoters60/4771895
tttgtta

SEQ ID NO: 60158 - DNA, 6 bp, Unknown
  misc_feature (1)..( 6): Matrix.003 file - promoters60/4771895
aaaaca

SEQ ID NO: 60159 - DNA, 7 bp, Unknown
  misc_feature (1)..( 7): Matrix.003 file - promoters60/4771895
aaagaaa

SEQ ID NO: 60160 - DNA, 6 bp, Unknown
  misc_feature (1)..( 6): Matrix.003 file - promoters60/4771895
gagaaa

SEQ ID NO: 60161 - DNA, 8 bp, Unknown
  misc_feature (1)..( 8): Matrix.003 file - promoters60/4771911
ttatttat

SEQ ID NO: 60162 - DNA, 11 bp, Unknown
  misc_feature (1)..( 11): Matrix.003 file - promoters60/4771911
aaaaaaagaaa

SEQ ID NO: 60163 - DNA, 13 bp, Unknown
  misc_feature (1)..( 13): Matrix.003 file - promoters60/4771911
tttggaaaagaaa

SEQ ID NO: 60164 - DNA, 9 bp, Unknown
  misc_feature (1)..( 9): Matrix.003 file - promoters60/4771911
aaaataaaa

SEQ ID NO: 60165 - DNA, 8 bp, Unknown
  misc_feature (1)..( 8): Matrix.003 file - promoters60/4771911
aaaatatc

SEQ ID NO: 60166 - DNA, 8 bp, Unknown
  misc_feature (1)..( 8): Matrix.003 file - promoters60/4771911
aacaaaat

SEQ ID NO: 60167 - DNA, 13 bp, Unknown
  misc_feature (1)..( 13): Matrix.003 file - promoters60/4771911
gaaacaaaaacat

SEQ ID NO: 60168 - DNA, 8 bp, Unknown
  misc_feature (1)..( 8): Matrix.003 file - promoters60/4771913
tttttaaa

SEQ ID NO: 60169 - DNA, 10 bp, Unknown
  misc_feature (1)..( 10): Matrix.003 file - promoters60/4771913
acaaaaaaaa

SEQ ID NO: 60170 - DNA, 8 bp, Unknown
  misc_feature (1)..( 8): Matrix.003 file - promoters60/4771913
caaagaaa

SEQ ID NO: 60171 - DNA, 9 bp, Unknown
  misc_feature (1)..( 9): Matrix.003 file - promoters60/4771913
aaaatatat

SEQ ID NO: 60172 - DNA, 12 bp, Unknown
  misc_feature (1)..( 12): Matrix.003 file - promoters60/4771913
taaattttattt

SEQ ID NO: 60173 - DNA, 7 bp, Unknown
  misc_feature (1)..( 7): Matrix.003 file - promoters60/4771913
aaaaaaa

SEQ ID NO: 60174 - DNA, 10 bp, Unknown
  misc_feature (1)..( 10): Matrix.003 file - promoters60/4771913
tcaaaattaa

SEQ ID NO: 60175 - DNA, 9 bp, Unknown
  misc_feature (1)..( 9): Matrix.003 file - promoters60/4771928
atttatata

SEQ ID NO: 60176 - DNA, 14 bp, Unknown
  misc_feature (1)..( 14): Matrix.003 file - promoters60/4771928
agaaatacaatttt

SEQ ID NO: 60177 - DNA, 8 bp, Unknown
  misc_feature (1)..( 8): Matrix.003 file - promoters60/4771928
ctaaaaaa

SEQ ID NO: 60178 - DNA, 8 bp, Unknown
  misc_feature (1)..( 8): Matrix.003 file - promoters60/4771928
atttttgg

SEQ ID NO: 60179 - DNA, 10 bp, Unknown
  misc_feature (1)..( 10): Matrix.003 file - promoters60/4771928
tttcaaaaaa

SEQ ID NO: 60180 - DNA, 16 bp, Unknown
  misc_feature (1)..( 16): Matrix.003 file - promoters60/4771928
agaaataaactattcg

SEQ ID NO: 60181 - DNA, 6 bp, Unknown
  misc_feature (1)..( 6): Matrix.003 file - promoters60/4771952
attctc

SEQ ID NO: 60182 - DNA, 8 bp, Unknown
  misc_feature (1)..( 8): Matrix.003 file - promoters60/4771952
ctcaaatt

SEQ ID NO: 60183 - DNA, 7 bp, Unknown
  misc_feature (1)..( 7): Matrix.003 file - promoters60/4771952
tacaaaa

SEQ ID NO: 60184 - DNA, 7 bp, Unknown
  misc_feature (1)..( 7): Matrix.003 file - promoters60/4771952
aaaaagg

SEQ ID NO: 60185 - DNA, 6 bp, Unknown
  misc_feature (1)..( 6): Matrix.003 file - promoters60/4771952
tattta

SEQ ID NO: 60186 - DNA, 6 bp, Unknown
  misc_feature (1)..( 6): Matrix.003 file - promoters60/4771952
cttcaa

SEQ ID NO: 60187 - DNA, 6 bp, Unknown
  misc_feature (1)..( 6): Matrix.003 file - promoters60/4771952
tcttac

SEQ ID NO: 60188 - DNA, 6 bp, Unknown
  misc_feature (1)..( 6): Matrix.003 file - promoters60/4771952
tgataa

SEQ ID NO: 60189 - DNA, 7 bp, Unknown
  misc_feature (1)..( 7): Matrix.003 file - promoters60/4771952
ttaagtt

SEQ ID NO: 60190 - DNA, 8 bp, Unknown
  misc_feature (1)..( 8): Matrix.003 file - promoters60/4771952
tatagttg

SEQ ID NO: 60191 - DNA, 6 bp, Unknown
  misc_feature (1)..( 6): Matrix.003 file - promoters60/4771952
gaaaaa

SEQ ID NO: 60192 - DNA, 8 bp, Unknown
  misc_feature (1)..( 8): Matrix.003 file - promoters60/4771952
tgtataga

SEQ ID NO: 60193 - DNA, 7 bp, Unknown
  misc_feature (1)..( 7): Matrix.003 file - promoters60/4771952
aaaaata

SEQ ID NO: 60194 - DNA, 7 bp, Unknown
  misc_feature (1)..( 7): Matrix.003 file - promoters60/4771952
ataatat

SEQ ID NO: 60195 - DNA, 7 bp, Unknown
  misc_feature (1)..( 7): Matrix.003 file - promoters60/4771952
aaacgct

SEQ ID NO: 60196 - DNA, 9 bp, Unknown
  misc_feature (1)..( 9): Matrix.003 file - promoters60/4771952
aaaagaaaa

SEQ ID NO: 60197 - DNA, 7 bp, Unknown
  misc_feature (1)..( 7): Matrix.003 file - promoters60/4771952
ctggaat

SEQ ID NO: 60198 - DNA, 7 bp, Unknown
  misc_feature (1)..( 7): Matrix.003 file - promoters60/4771952
aaaactt

SEQ ID NO: 60199 - DNA, 8 bp, Unknown
  misc_feature (1)..( 8): Matrix.003 file - promoters60/4771952
cttaatta

SEQ ID NO: 60200 - DNA, 7 bp, Unknown
  misc_feature (1)..( 7): Matrix.003 file - promoters60/4771952
cacatat

SEQ ID NO: 60201 - DNA, 6 bp, Unknown
  misc_feature (1)..( 6): Matrix.003 file - promoters60/4771956
acactg

SEQ ID NO: 60202 - DNA, 6 bp, Unknown
  misc_feature (1)..( 6): Matrix.003 file - promoters60/4771956
ccgttg

SEQ ID NO: 60203 - DNA, 7 bp, Unknown
  misc_feature (1)..( 7): Matrix.003 file - promoters60/4771956
gtttatt

SEQ ID NO: 60204 - DNA, 6 bp, Unknown
  misc_feature (1)..( 6): Matrix.003 file - promoters60/4771956
cataat

SEQ ID NO: 60205 - DNA, 6 bp, Unknown
  misc_feature (1)..( 6): Matrix.003 file - promoters60/4771956
ataagt

SEQ ID NO: 60206 - DNA, 6 bp, Unknown
  misc_feature (1)..( 6): Matrix.003 file - promoters60/4771956
aacaaa

SEQ ID NO: 60207 - DNA, 7 bp, Unknown
  misc_feature (1)..( 7): Matrix.003 file - promoters60/4771956
tctcaac

SEQ ID NO: 60208 - DNA, 6 bp, Unknown
  misc_feature (1)..( 6): Matrix.003 file - promoters60/4771956
tagaaa

SEQ ID NO: 60209 - DNA, 7 bp, Unknown
  misc_feature (1)..( 7): Matrix.003 file - promoters60/4771956
aaaatag

SEQ ID NO: 60210 - DNA, 6 bp, Unknown
  misc_feature (1)..( 6): Matrix.003 file - promoters60/4771956
aaaaaa

SEQ ID NO: 60211 - DNA, 8 bp, Unknown
  misc_feature (1)..( 8): Matrix.003 file - promoters60/4771956
atttgtca

SEQ ID NO: 60212 - DNA, 7 bp, Unknown
  misc_feature (1)..( 7): Matrix.003 file - promoters60/4771956
ttaatta

SEQ ID NO: 60213 - DNA, 8 bp, Unknown
  misc_feature (1)..( 8): Matrix.003 file - promoters60/4771956
ccagcaac

SEQ ID NO: 60214 - DNA, 6 bp, Unknown
  misc_feature (1)..( 6): Matrix.003 file - promoters60/4771956
ataatt

SEQ ID NO: 60215 - DNA, 7 bp, Unknown
  misc_feature (1)..( 7): Matrix.003 file - promoters60/4771956
ctagttt

SEQ ID NO: 60216 - DNA, 7 bp, Unknown
  misc_feature (1)..( 7): Matrix.003 file - promoters60/4771956
cacacaa

SEQ ID NO: 60217 - DNA, 6 bp, Unknown
  misc_feature (1)..( 6): Matrix.003 file - promoters60/4771956
cctttt

SEQ ID NO: 60218 - DNA, 6 bp, Unknown
  misc_feature (1)..( 6): Matrix.003 file - promoters60/4771956
cataaa

SEQ ID NO: 60219 - DNA, 7 bp, Unknown
  misc_feature (1)..( 7): Matrix.003 file - promoters60/4771956
aaaactc

SEQ ID NO: 60220 - DNA, 8 bp, Unknown
  misc_feature (1)..( 8): Matrix.003 file - promoters60/4771960
ttagttgc

SEQ ID NO: 60221 - DNA, 8 bp, Unknown
  misc_feature (1)..( 8): Matrix.003 file - promoters60/4771960
attaaatc

SEQ ID NO: 60222 - DNA, 9 bp, Unknown
  misc_feature (1)..( 9): Matrix.003 file - promoters60/4771960
gaaaattat

SEQ ID NO: 60223 - DNA, 8 bp, Unknown
  misc_feature (1)..( 8): Matrix.003 file - promoters60/4771960
tagaattc

SEQ ID NO: 60224 - DNA, 8 bp, Unknown
  misc_feature (1)..( 8): Matrix.003 file - promoters60/4771960
ctttgaaa

SEQ ID NO: 60225 - DNA, 9 bp, Unknown
  misc_feature (1)..( 9): Matrix.003 file - promoters60/4771960
ctataaata

SEQ ID NO: 60226 - DNA, 6 bp, Unknown
  misc_feature (1)..( 6): Matrix.003 file - promoters60/4771960
aagatt

SEQ ID NO: 60227 - DNA, 8 bp, Unknown
  misc_feature (1)..( 8): Matrix.003 file - promoters60/4771960
gttgcttt

SEQ ID NO: 60228 - DNA, 6 bp, Unknown
  misc_feature (1)..( 6): Matrix.003 file - promoters60/4771960
agaaga

SEQ ID NO: 60229 - DNA, 11 bp, Unknown
  misc_feature (1)..( 11): Matrix.003 file - promoters60/4771960
aaagtgacata

SEQ ID NO: 60230 - DNA, 8 bp, Unknown
  misc_feature (1)..( 8): Matrix.003 file - promoters60/4771960
caaaaaga

SEQ ID NO: 60231 - DNA, 8 bp, Unknown
  misc_feature (1)..( 8): Matrix.003 file - promoters60/4771960
ccgaaaat

SEQ ID NO: 60232 - DNA, 6 bp, Unknown
  misc_feature (1)..( 6): Matrix.003 file - promoters60/4771960
tgaaca

SEQ ID NO: 60233 - DNA, 7 bp, Unknown
  misc_feature (1)..( 7): Matrix.003 file - promoters60/4771960
aaaaaca

SEQ ID NO: 60234 - DNA, 8 bp, Unknown
  misc_feature (1)..( 8): Matrix.003 file - promoters60/4771960
aatacttg

SEQ ID NO: 60235 - DNA, 8 bp, Unknown
  misc_feature (1)..( 8): Matrix.003 file - promoters60/4771960
aaaattac

SEQ ID NO: 60236 - DNA, 6 bp, Unknown
  misc_feature (1)..( 6): Matrix.003 file - promoters60/4771960
atcaat

SEQ ID NO: 60237 - DNA, 11 bp, Unknown
  misc_feature (1)..( 11): Matrix.003 file - promoters60/4771960
caaaaacaaaa

SEQ ID NO: 60238 - DNA, 10 bp, Unknown
  misc_feature (1)..( 10): Matrix.003 file - promoters60/4771968
gaaaaaaatg

SEQ ID NO: 60239 - DNA, 8 bp, Unknown
  misc_feature (1)..( 8): Matrix.003 file - promoters60/4771968
aaaaatgt

SEQ ID NO: 60240 - DNA, 10 bp, Unknown
  misc_feature (1)..( 10): Matrix.003 file - promoters60/4771968
taaaaaaagg

SEQ ID NO: 60241 - DNA, 9 bp, Unknown
  misc_feature (1)..( 9): Matrix.003 file - promoters60/4771972
ttttctttg

SEQ ID NO: 60242 - DNA, 7 bp, Unknown
  misc_feature (1)..( 7): Matrix.003 file - promoters60/4771972
taaaaat

SEQ ID NO: 60243 - DNA, 8 bp, Unknown
  misc_feature (1)..( 8): Matrix.003 file - promoters60/4771972
aagatatg

SEQ ID NO: 60244 - DNA, 8 bp, Unknown
  misc_feature (1)..( 8): Matrix.003 file - promoters60/4771972
ttttattt

SEQ ID NO: 60245 - DNA, 7 bp, Unknown
  misc_feature (1)..( 7): Matrix.003 file - promoters60/4771972
tttaatt

SEQ ID NO: 60246 - DNA, 9 bp, Unknown
  misc_feature (1)..( 9): Matrix.003 file - promoters60/4771972
gaaacaaaa

SEQ ID NO: 60247 - DNA, 6 bp, Unknown
  misc_feature (1)..( 6): Matrix.003 file - promoters60/4771972
tttgtt

SEQ ID NO: 60248 - DNA, 6 bp, Unknown
  misc_feature (1)..( 6): Matrix.003 file - promoters60/4771972
aaaact

SEQ ID NO: 60249 - DNA, 7 bp, Unknown
  misc_feature (1)..( 7): Matrix.003 file - promoters60/4771972
ataaaaa

SEQ ID NO: 60250 - DNA, 10 bp, Unknown
  misc_feature (1)..( 10): Matrix.003 file - promoters60/4771972
taaaataaaa

SEQ ID NO: 60251 - DNA, 6 bp, Unknown
  misc_feature (1)..( 6): Matrix.003 file - promoters60/4771972
aaagct

SEQ ID NO: 60252 - DNA, 6 bp, Unknown
  misc_feature (1)..( 6): Matrix.003 file - promoters60/4771972
agtaaa

SEQ ID NO: 60253 - DNA, 7 bp, Unknown
  misc_feature (1)..( 7): Matrix.003 file - promoters60/4771972
aatcggg

SEQ ID NO: 60254 - DNA, 10 bp, Unknown
  misc_feature (1)..( 10): Matrix.003 file - promoters60/4771972
ggaaaagaaa

SEQ ID NO: 60255 - DNA, 7 bp, Unknown
  misc_feature (1)..( 7): Matrix.003 file - promoters60/4771972
cccacta

SEQ ID NO: 60256 - DNA, 7 bp, Unknown
  misc_feature (1)..( 7): Matrix.003 file - promoters60/4771972
gtatata

SEQ ID NO: 60257 - DNA, 7 bp, Unknown
  misc_feature (1)..( 7): Matrix.003 file - promoters60/4771983
aattttt

SEQ ID NO: 60258 - DNA, 8 bp, Unknown
  misc_feature (1)..( 8): Matrix.003 file - promoters60/4771983
tttttgtt

SEQ ID NO: 60259 - DNA, 7 bp, Unknown
  misc_feature (1)..( 7): Matrix.003 file - promoters60/4771983
ataaaat

SEQ ID NO: 60260 - DNA, 11 bp, Unknown
  misc_feature (1)..( 11): Matrix.003 file - promoters60/4771983
ttaatttaata

SEQ ID NO: 60261 - DNA, 7 bp, Unknown
  misc_feature (1)..( 7): Matrix.003 file - promoters60/4771983
tagtttt

SEQ ID NO: 60262 - DNA, 7 bp, Unknown
  misc_feature (1)..( 7): Matrix.003 file - promoters60/4771983
ttctctt

SEQ ID NO: 60263 - DNA, 8 bp, Unknown
  misc_feature (1)..( 8): Matrix.003 file - promoters60/4771983
gttttttt

SEQ ID NO: 60264 - DNA, 8 bp, Unknown
  misc_feature (1)..( 8): Matrix.003 file - promoters60/4771983
aatattcg

SEQ ID NO: 60265 - DNA, 7 bp, Unknown
  misc_feature (1)..( 7): Matrix.003 file - promoters60/4771983
tttattt

SEQ ID NO: 60266 - DNA, 7 bp, Unknown
  misc_feature (1)..( 7): Matrix.003 file - promoters60/4771983
taaacaa

SEQ ID NO: 60267 - DNA, 6 bp, Unknown
  misc_feature (1)..( 6): Matrix.003 file - promoters60/4771983
taagaa

SEQ ID NO: 60268 - DNA, 6 bp, Unknown
  misc_feature (1)..( 6): Matrix.003 file - promoters60/4771983
tttggt

SEQ ID NO: 60269 - DNA, 7 bp, Unknown
  misc_feature (1)..( 7): Matrix.003 file - promoters60/4771983
ttaaatt

SEQ ID NO: 60270 - DNA, 6 bp, Unknown
  misc_feature (1)..( 6): Matrix.003 file - promoters60/4771983
atggaa

SEQ ID NO: 60271 - DNA, 8 bp, Unknown
  misc_feature (1)..( 8): Matrix.003 file - promoters60/4771983
aacatttt

SEQ ID NO: 60272 - DNA, 7 bp, Unknown
  misc_feature (1)..( 7): Matrix.003 file - promoters60/4771983
tataact

SEQ ID NO: 60273 - DNA, 6 bp, Unknown
  misc_feature (1)..( 6): Matrix.003 file - promoters60/4771983
ttttta

SEQ ID NO: 60274 - DNA, 6 bp, Unknown
  misc_feature (1)..( 6): Matrix.003 file - promoters60/4771990
tttatt

SEQ ID NO: 60275 - DNA, 8 bp, Unknown
  misc_feature (1)..( 8): Matrix.003 file - promoters60/4771990
aataaaat

SEQ ID NO: 60276 - DNA, 7 bp, Unknown
  misc_feature (1)..( 7): Matrix.003 file - promoters60/4771990
aaaaaaa

SEQ ID NO: 60277 - DNA, 6 bp, Unknown
  misc_feature (1)..( 6): Matrix.003 file - promoters60/4771990
aaataa

SEQ ID NO: 60278 - DNA, 6 bp, Unknown
  misc_feature (1)..( 6): Matrix.003 file - promoters60/4771990
aacatt

SEQ ID NO: 60279 - DNA, 7 bp, Unknown
  misc_feature (1)..( 7): Matrix.003 file - promoters60/4771990
aaaacaa

SEQ ID NO: 60280 - DNA, 10 bp, Unknown
  misc_feature (1)..( 10): Matrix.003 file - promoters60/4771990
taaacaaaaa

SEQ ID NO: 60281 - DNA, 8 bp, Unknown
  misc_feature (1)..( 8): Matrix.003 file - promoters60/4771990
aaaagaaa

SEQ ID NO: 60282 - DNA, 6 bp, Unknown
  misc_feature (1)..( 6): Matrix.003 file - promoters60/4771990
ttattt

SEQ ID NO: 60283 - DNA, 6 bp, Unknown
  misc_feature (1)..( 6): Matrix.003 file - promoters60/4771990
agtaaa

SEQ ID NO: 60284 - DNA, 7 bp, Unknown
  misc_feature (1)..( 7): Matrix.003 file - promoters60/4771990
aatcggg

SEQ ID NO: 60285 - DNA, 8 bp, Unknown
  misc_feature (1)..( 8): Matrix.003 file - promoters60/4771990
gaaacaaa

SEQ ID NO: 60286 - DNA, 7 bp, Unknown
  misc_feature (1)..( 7): Matrix.003 file - promoters60/4771990
cccacta

SEQ ID NO: 60287 - DNA, 9 bp, Unknown
  misc_feature (1)..( 9): Matrix.003 file - promoters60/4771990
aaagaaaag

SEQ ID NO: 60288 - DNA, 7 bp, Unknown
  misc_feature (1)..( 7): Matrix.003 file - promoters60/4771990
gtatata

SEQ ID NO: 60289 - DNA, 9 bp, Unknown
  misc_feature (1)..( 9): Matrix.003 file - promoters60/4772062
tataattaa

SEQ ID NO: 60290 - DNA, 8 bp, Unknown
  misc_feature (1)..( 8): Matrix.003 file - promoters60/4772062
attattta

SEQ ID NO: 60291 - DNA, 9 bp, Unknown
  misc_feature (1)..( 9): Matrix.003 file - promoters60/4772062
agaacaaaa

SEQ ID NO: 60292 - DNA, 8 bp, Unknown
  misc_feature (1)..( 8): Matrix.003 file - promoters60/4772062
ctatataa

SEQ ID NO: 60293 - DNA, 13 bp, Unknown
  misc_feature (1)..( 13): Matrix.003 file - promoters60/4772062
aaaactaaaaaaa

SEQ ID NO: 60294 - DNA, 9 bp, Unknown
  misc_feature (1)..( 9): Matrix.003 file - promoters60/4772062
aaatgataa

SEQ ID NO: 60295 - DNA, 8 bp, Unknown
  misc_feature (1)..( 8): Matrix.003 file - promoters60/4772062
gaaaaatt

SEQ ID NO: 60296 - DNA, 11 bp, Unknown
  misc_feature (1)..( 11): Matrix.003 file - promoters60/4772062
aacttttgtca

SEQ ID NO: 60297 - DNA, 10 bp, Unknown
  misc_feature (1)..( 10): Matrix.003 file - promoters60/4772062
tgttaaatat

SEQ ID NO: 60298 - DNA, 9 bp, Unknown
  misc_feature (1)..( 9): Matrix.003 file - promoters60/4772062
aaaagaaaa

SEQ ID NO: 60299 - DNA, 9 bp, Unknown
  misc_feature (1)..( 9): Matrix.003 file - promoters60/4772062
agaaaaaga

SEQ ID NO: 60300 - DNA, 7 bp, Unknown
  misc_feature (1)..( 7): Matrix.003 file - promoters60/4772062
agaaaaa

SEQ ID NO: 60301 - DNA, 12 bp, Unknown
  misc_feature (1)..( 12): Matrix.003 file - promoters60/4772070
ttcatcatttat

SEQ ID NO: 60302 - DNA, 10 bp, Unknown
  misc_feature (1)..( 10): Matrix.003 file - promoters60/4772070
aataacttta

SEQ ID NO: 60303 - DNA, 9 bp, Unknown
  misc_feature (1)..( 9): Matrix.003 file - promoters60/4772070
tgatgatac

SEQ ID NO: 60304 - DNA, 5 bp, Unknown
  misc_feature (1)..( 5): Matrix.003 file - promoters60/4772070
caaac

SEQ ID NO: 60305 - DNA, 7 bp, Unknown
  misc_feature (1)..( 7): Matrix.003 file - promoters60/4772070
tttgtta

SEQ ID NO: 60306 - DNA, 7 bp, Unknown
  misc_feature (1)..( 7): Matrix.003 file - promoters60/4772084
aaaatct

SEQ ID NO: 60307 - DNA, 7 bp, Unknown
  misc_feature (1)..( 7): Matrix.003 file - promoters60/4772084
ggtactt

SEQ ID NO: 60308 - DNA, 9 bp, Unknown
  misc_feature (1)..( 9): Matrix.003 file - promoters60/4772084
tcactaact

SEQ ID NO: 60309 - DNA, 6 bp, Unknown
  misc_feature (1)..( 6): Matrix.003 file - promoters60/4772084
aactta

SEQ ID NO: 60310 - DNA, 6 bp, Unknown
  misc_feature (1)..( 6): Matrix.003 file - promoters60/4772084
tttctt

SEQ ID NO: 60311 - DNA, 8 bp, Unknown
  misc_feature (1)..( 8): Matrix.003 file - promoters60/4772084
attcaatt

SEQ ID NO: 60312 - DNA, 6 bp, Unknown
  misc_feature (1)..( 6): Matrix.003 file - promoters60/4772084
aaatct

SEQ ID NO: 60313 - DNA, 8 bp, Unknown
  misc_feature (1)..( 8): Matrix.003 file - promoters60/4772084
actccaaa

SEQ ID NO: 60314 - DNA, 6 bp, Unknown
  misc_feature (1)..( 6): Matrix.003 file - promoters60/4772084
gaagat

SEQ ID NO: 60315 - DNA, 17 bp, Unknown
  misc_feature (1)..( 17): Matrix.003 file - promoters60/4772103
aaaaacaaaaaagttaa

SEQ ID NO: 60316 - DNA, 8 bp, Unknown
  misc_feature (1)..( 8): Matrix.003 file - promoters60/4772103
gaaaagtc

SEQ ID NO: 60317 - DNA, 9 bp, Unknown
  misc_feature (1)..( 9): Matrix.003 file - promoters60/4772103
cgcaaattt

SEQ ID NO: 60318 - DNA, 7 bp, Unknown
  misc_feature (1)..( 7): Matrix.003 file - promoters60/4772103
tgataca

SEQ ID NO: 60319 - DNA, 15 bp, Unknown
  misc_feature (1)..( 15): Matrix.003 file - promoters60/4772103
accaatcagaattgt

SEQ ID NO: 60320 - DNA, 7 bp, Unknown
  misc_feature (1)..( 7): Matrix.003 file - promoters60/4772103
tctagtg

SEQ ID NO: 60321 - DNA, 6 bp, Unknown
  misc_feature (1)..( 6): Matrix.003 file - promoters60/4772103
ttaaag

SEQ ID NO: 60322 - DNA, 6 bp, Unknown
  misc_feature (1)..( 6): Matrix.003 file - promoters60/4772103
gtggta

SEQ ID NO: 60323 - DNA, 6 bp, Unknown
  misc_feature (1)..( 6): Matrix.003 file - promoters60/4772103
tttctt

SEQ ID NO: 60324 - DNA, 9 bp, Unknown
  misc_feature (1)..( 9): Matrix.003 file - promoters60/4772103
ttatcatat

SEQ ID NO: 60325 - DNA, 7 bp, Unknown
  misc_feature (1)..( 7): Matrix.003 file - promoters60/4772103
gacaaaa

SEQ ID NO: 60326 - DNA, 8 bp, Unknown
  misc_feature (1)..( 8): Matrix.003 file - promoters60/4772122
ggataaaa

SEQ ID NO: 60327 - DNA, 7 bp, Unknown
  misc_feature (1)..( 7): Matrix.003 file - promoters60/4772122
ttactac

SEQ ID NO: 60328 - DNA, 7 bp, Unknown
  misc_feature (1)..( 7): Matrix.003 file - promoters60/4772122
aacaaat

SEQ ID NO: 60329 - DNA, 10 bp, Unknown
  misc_feature (1)..( 10): Matrix.003 file - promoters60/4772130
caattgcaca

SEQ ID NO: 60330 - DNA, 9 bp, Unknown
  misc_feature (1)..( 9): Matrix.003 file - promoters60/4772137
ctgatttta

SEQ ID NO: 60331 - DNA, 7 bp, Unknown
  misc_feature (1)..( 7): Matrix.003 file - promoters60/4772137
agacttg

SEQ ID NO: 60332 - DNA, 8 bp, Unknown
  misc_feature (1)..( 8): Matrix.003 file - promoters60/4772137
aaaagtaa

SEQ ID NO: 60333 - DNA, 9 bp, Unknown
  misc_feature (1)..( 9): Matrix.003 file - promoters60/4772137
tatttaaaa

SEQ ID NO: 60334 - DNA, 7 bp, Unknown
  misc_feature (1)..( 7): Matrix.003 file - promoters60/4772137
tttttat

SEQ ID NO: 60335 - DNA, 8 bp, Unknown
  misc_feature (1)..( 8): Matrix.003 file - promoters60/4772137
agacttga

SEQ ID NO: 60336 - DNA, 8 bp, Unknown
  misc_feature (1)..( 8): Matrix.003 file - promoters60/4772155
aatttttt

SEQ ID NO: 60337 - DNA, 10 bp, Unknown
  misc_feature (1)..( 10): Matrix.003 file - promoters60/4772155
aaaatcttgt

SEQ ID NO: 60338 - DNA, 7 bp, Unknown
  misc_feature (1)..( 7): Matrix.003 file - promoters60/4772155
taccatt

SEQ ID NO: 60339 - DNA, 6 bp, Unknown
  misc_feature (1)..( 6): Matrix.003 file - promoters60/4772155
tcaaat

SEQ ID NO: 60340 - DNA, 10 bp, Unknown
  misc_feature (1)..( 10): Matrix.003 file - promoters60/4772155
gatcataaca

SEQ ID NO: 60341 - DNA, 7 bp, Unknown
  misc_feature (1)..( 7): Matrix.003 file - promoters60/4772155
ttccact

SEQ ID NO: 60342 - DNA, 7 bp, Unknown
  misc_feature (1)..( 7): Matrix.003 file - promoters60/4772155
atggtca

SEQ ID NO: 60343 - DNA, 8 bp, Unknown
  misc_feature (1)..( 8): Matrix.003 file - promoters60/4772155
caaaaaaa

SEQ ID NO: 60344 - DNA, 6 bp, Unknown
  misc_feature (1)..( 6): Matrix.003 file - promoters60/4772155
tttttt

SEQ ID NO: 60345 - DNA, 7 bp, Unknown
  misc_feature (1)..( 7): Matrix.003 file - promoters60/4772155
atttttc

SEQ ID NO: 60346 - DNA, 8 bp, Unknown
  misc_feature (1)..( 8): Matrix.003 file - promoters60/4772155
ttttttct

SEQ ID NO: 60347 - DNA, 7 bp, Unknown
  misc_feature (1)..( 7): Matrix.003 file - promoters60/4772155
aggaaaa

SEQ ID NO: 60348 - DNA, 11 bp, Unknown
  misc_feature (1)..( 11): Matrix.003 file - promoters60/4772155
aaaaacaaaaa

SEQ ID NO: 60349 - DNA, 7 bp, Unknown
  misc_feature (1)..( 7): Matrix.003 file - promoters60/4772155
tttgcat

SEQ ID NO: 60350 - DNA, 8 bp, Unknown
  misc_feature (1)..( 8): Matrix.003 file - promoters60/4772155
tctataga

SEQ ID NO: 60351 - DNA, 6 bp, Unknown
  misc_feature (1)..( 6): Matrix.003 file - promoters60/4772155
taacat

SEQ ID NO: 60352 - DNA, 7 bp, Unknown
  misc_feature (1)..( 7): Matrix.003 file - promoters60/4772155
aacaaaa

SEQ ID NO: 60353 - DNA, 6 bp, Unknown
  misc_feature (1)..( 6): Matrix.003 file - promoters60/4772155
ttctta

SEQ ID NO: 60354 - DNA, 8 bp, Unknown
  misc_feature (1)..( 8): Matrix.003 file - promoters60/4772155
tttgttta

SEQ ID NO: 60355 - DNA, 10 bp, Unknown
  misc_feature (1)..( 10): Matrix.003 file - promoters60/4772195
gaacatgaca

SEQ ID NO: 60356 - DNA, 8 bp, Unknown
  misc_feature (1)..( 8): Matrix.003 file - promoters60/4772195
cgaaatta

SEQ ID NO: 60357 - DNA, 8 bp, Unknown
  misc_feature (1)..( 8): Matrix.003 file - promoters60/4772195
ctgtttaa

SEQ ID NO: 60358 - DNA, 12 bp, Unknown
  misc_feature (1)..( 12): Matrix.003 file - promoters60/4772195
ttcattttattt

SEQ ID NO: 60359 - DNA, 13 bp, Unknown
  misc_feature (1)..( 13): Matrix.003 file - promoters60/4772195
ttcattttcttta

SEQ ID NO: 60360 - DNA, 7 bp, Unknown
  misc_feature (1)..( 7): Matrix.003 file - promoters60/4772195
aggattt

SEQ ID NO: 60361 - DNA, 8 bp, Unknown
  misc_feature (1)..( 8): Matrix.003 file - promoters60/4772208
ataaatga

SEQ ID NO: 60362 - DNA, 10 bp, Unknown
  misc_feature (1)..( 10): Matrix.003 file - promoters60/4772208
actttcaaaa

SEQ ID NO: 60363 - DNA, 8 bp, Unknown
  misc_feature (1)..( 8): Matrix.003 file - promoters60/4772208
taaatgtt

SEQ ID NO: 60364 - DNA, 9 bp, Unknown
  misc_feature (1)..( 9): Matrix.003 file - promoters60/4772223
acttatata

SEQ ID NO: 60365 - DNA, 8 bp, Unknown
  misc_feature (1)..( 8): Matrix.003 file - promoters60/4772223
atttcaaa

SEQ ID NO: 60366 - DNA, 10 bp, Unknown
  misc_feature (1)..( 10): Matrix.003 file - promoters60/4772223
tcaaaaaaaa

SEQ ID NO: 60367 - DNA, 9 bp, Unknown
  misc_feature (1)..( 9): Matrix.003 file - promoters60/4772223
caaacacta

SEQ ID NO: 60368 - DNA, 8 bp, Unknown
  misc_feature (1)..( 8): Matrix.003 file - promoters60/4772223
ataatttt

SEQ ID NO: 60369 - DNA, 9 bp, Unknown
  misc_feature (1)..( 9): Matrix.003 file - promoters60/4772223
acaagaaaa

SEQ ID NO: 60370 - DNA, 10 bp, Unknown
  misc_feature (1)..( 10): Matrix.003 file - promoters60/4772223
ttttgacaat

SEQ ID NO: 60371 - DNA, 12 bp, Unknown
  misc_feature (1)..( 12): Matrix.003 file - promoters60/4772223
ttatcaaattga

SEQ ID NO: 60372 - DNA, 8 bp, Unknown
  misc_feature (1)..( 8): Matrix.003 file - promoters60/4772223
acatgaaa

SEQ ID NO: 60373 - DNA, 7 bp, Unknown
  misc_feature (1)..( 7): Matrix.003 file - promoters60/4772230
atttatt

SEQ ID NO: 60374 - DNA, 6 bp, Unknown
  misc_feature (1)..( 6): Matrix.003 file - promoters60/4772230
ttaaaa

SEQ ID NO: 60375 - DNA, 7 bp, Unknown
  misc_feature (1)..( 7): Matrix.003 file - promoters60/4772230
actaatt

SEQ ID NO: 60376 - DNA, 6 bp, Unknown
  misc_feature (1)..( 6): Matrix.003 file - promoters60/4772230
tttttc

SEQ ID NO: 60377 - DNA, 9 bp, Unknown
  misc_feature (1)..( 9): Matrix.003 file - promoters60/4772230
aatagattt

SEQ ID NO: 60378 - DNA, 7 bp, Unknown
  misc_feature (1)..( 7): Matrix.003 file - promoters60/4772230
taaattt

SEQ ID NO: 60379 - DNA, 6 bp, Unknown
  misc_feature (1)..( 6): Matrix.003 file - promoters60/4772230
tcaaga

SEQ ID NO: 60380 - DNA, 10 bp, Unknown
  misc_feature (1)..( 10): Matrix.003 file - promoters60/4772230
aaatattcac

SEQ ID NO: 60381 - DNA, 6 bp, Unknown
  misc_feature (1)..( 6): Matrix.003 file - promoters60/4772230
caaaca

SEQ ID NO: 60382 - DNA, 8 bp, Unknown
  misc_feature (1)..( 8): Matrix.003 file - promoters60/4772230
tatcttca

SEQ ID NO: 60383 - DNA, 7 bp, Unknown
  misc_feature (1)..( 7): Matrix.003 file - promoters60/4772230
atagatt

SEQ ID NO: 60384 - DNA, 8 bp, Unknown
  misc_feature (1)..( 8): Matrix.003 file - promoters60/4772230
tttcaatt

SEQ ID NO: 60385 - DNA, 6 bp, Unknown
  misc_feature (1)..( 6): Matrix.003 file - promoters60/4772230
ttttct

SEQ ID NO: 60386 - DNA, 7 bp, Unknown
  misc_feature (1)..( 7): Matrix.003 file - promoters60/4772230
ataaaat

SEQ ID NO: 60387 - DNA, 7 bp, Unknown
  misc_feature (1)..( 7): Matrix.003 file - promoters60/4772230
aacccaa

SEQ ID NO: 60388 - DNA, 8 bp, Unknown
  misc_feature (1)..( 8): Matrix.003 file - promoters60/4772230
cacatgtc

SEQ ID NO: 60389 - DNA, 8 bp, Unknown
  misc_feature (1)..( 8): Matrix.003 file - promoters60/4772230
tttattaa

SEQ ID NO: 60390 - DNA, 8 bp, Unknown
  misc_feature (1)..( 8): Matrix.003 file - promoters60/4772230
aatttatc

SEQ ID NO: 60391 - DNA, 8 bp, Unknown
  misc_feature (1)..( 8): Matrix.003 file - promoters60/4772230
atagatat

SEQ ID NO: 60392 - DNA, 7 bp, Unknown
  misc_feature (1)..( 7): Matrix.003 file - promoters60/4772230
tcataca

SEQ ID NO: 60393 - DNA, 7 bp, Unknown
  misc_feature (1)..( 7): Matrix.003 file - promoters60/4772230
catctat

SEQ ID NO: 60394 - DNA, 7 bp, Unknown
  misc_feature (1)..( 7): Matrix.003 file - promoters60/4772230
tatatac

SEQ ID NO: 60395 - DNA, 8 bp, Unknown
  misc_feature (1)..( 8): Matrix.003 file - promoters60/4772230
aaacaaaa

SEQ ID NO: 60396 - DNA, 7 bp, Unknown
  misc_feature (1)..( 7): Matrix.003 file - promoters60/4772230
aaaccaa

SEQ ID NO: 60397 - DNA, 8 bp, Unknown
  misc_feature (1)..( 8): Matrix.003 file - promoters60/4772240
tagattct

SEQ ID NO: 60398 - DNA, 7 bp, Unknown
  misc_feature (1)..( 7): Matrix.003 file - promoters60/4772240
taaaaaa

SEQ ID NO: 60399 - DNA, 11 bp, Unknown
  misc_feature (1)..( 11): Matrix.003 file - promoters60/4772240
taagaaaaaga

SEQ ID NO: 60400 - DNA, 7 bp, Unknown
  misc_feature (1)..( 7): Matrix.003 file - promoters60/4772240
gagaaaa

SEQ ID NO: 60401 - DNA, 9 bp, Unknown
  misc_feature (1)..( 9): Matrix.003 file - promoters60/4772248
caaaactta

SEQ ID NO: 60402 - DNA, 12 bp, Unknown
  misc_feature (1)..( 12): Matrix.003 file - promoters60/4772248
atatttttcata

SEQ ID NO: 60403 - DNA, 13 bp, Unknown
  misc_feature (1)..( 13): Matrix.003 file - promoters60/4772248
atttttaaagcat

SEQ ID NO: 60404 - DNA, 11 bp, Unknown
  misc_feature (1)..( 11): Matrix.003 file - promoters60/4772248
aaattaaaaaa

SEQ ID NO: 60405 - DNA, 10 bp, Unknown
  misc_feature (1)..( 10): Matrix.003 file - promoters60/4772248
atttattttt

SEQ ID NO: 60406 - DNA, 12 bp, Unknown
  misc_feature (1)..( 12): Matrix.003 file - promoters60/4772248
tatcaaacatat

SEQ ID NO: 60407 - DNA, 8 bp, Unknown
  misc_feature (1)..( 8): Matrix.003 file - promoters60/4772258
ttttgtta

SEQ ID NO: 60408 - DNA, 8 bp, Unknown
  misc_feature (1)..( 8): Matrix.003 file - promoters60/4772258
tcttcttt

SEQ ID NO: 60409 - DNA, 9 bp, Unknown
  misc_feature (1)..( 9): Matrix.003 file - promoters60/4772258
attttttat

SEQ ID NO: 60410 - DNA, 8 bp, Unknown
  misc_feature (1)..( 8): Matrix.003 file - promoters60/4772258
ttaatata

SEQ ID NO: 60411 - DNA, 7 bp, Unknown
  misc_feature (1)..( 7): Matrix.003 file - promoters60/4772258
attttgg

SEQ ID NO: 60412 - DNA, 9 bp, Unknown
  misc_feature (1)..( 9): Matrix.003 file - promoters60/4772258
agattcata

SEQ ID NO: 60413 - DNA, 8 bp, Unknown
  misc_feature (1)..( 8): Matrix.003 file - promoters60/4772258
tttcattg

SEQ ID NO: 60414 - DNA, 8 bp, Unknown
  misc_feature (1)..( 8): Matrix.003 file - promoters60/4772258
tgttgttt

SEQ ID NO: 60415 - DNA, 9 bp, Unknown
  misc_feature (1)..( 9): Matrix.003 file - promoters60/4772258
tttgaccaa

SEQ ID NO: 60416 - DNA, 6 bp, Unknown
  misc_feature (1)..( 6): Matrix.003 file - promoters60/4772270
agagca

SEQ ID NO: 60417 - DNA, 6 bp, Unknown
  misc_feature (1)..( 6): Matrix.003 file - promoters60/4772270
atagag

SEQ ID NO: 60418 - DNA, 7 bp, Unknown
  misc_feature (1)..( 7): Matrix.003 file - promoters60/4772270
tatattg

SEQ ID NO: 60419 - DNA, 6 bp, Unknown
  misc_feature (1)..( 6): Matrix.003 file - promoters60/4772270
aaagac

SEQ ID NO: 60420 - DNA, 7 bp, Unknown
  misc_feature (1)..( 7): Matrix.003 file - promoters60/4772270
taaaaaa

SEQ ID NO: 60421 - DNA, 6 bp, Unknown
  misc_feature (1)..( 6): Matrix.003 file - promoters60/4772270
taaaaa

SEQ ID NO: 60422 - DNA, 6 bp, Unknown
  misc_feature (1)..( 6): Matrix.003 file - promoters60/4772270
cttcta

SEQ ID NO: 60423 - DNA, 7 bp, Unknown
  misc_feature (1)..( 7): Matrix.003 file - promoters60/4772270
tttctat

SEQ ID NO: 60424 - DNA, 7 bp, Unknown
  misc_feature (1)..( 7): Matrix.003 file - promoters60/4772270
tatattg

SEQ ID NO: 60425 - DNA, 8 bp, Unknown
  misc_feature (1)..( 8): Matrix.003 file - promoters60/4772270
tgttaaaa

SEQ ID NO: 60426 - DNA, 8 bp, Unknown
  misc_feature (1)..( 8): Matrix.003 file - promoters60/4772270
cattaaac

SEQ ID NO: 60427 - DNA, 6 bp, Unknown
  misc_feature (1)..( 6): Matrix.003 file - promoters60/4772270
tctcca

SEQ ID NO: 60428 - DNA, 7 bp, Unknown
  misc_feature (1)..( 7): Matrix.003 file - promoters60/4772270
ccatttt

SEQ ID NO: 60429 - DNA, 6 bp, Unknown
  misc_feature (1)..( 6): Matrix.003 file - promoters60/4772270
ttttca

SEQ ID NO: 60430 - DNA, 6 bp, Unknown
  misc_feature (1)..( 6): Matrix.003 file - promoters60/4772270
tgtctt

SEQ ID NO: 60431 - DNA, 6 bp, Unknown
  misc_feature (1)..( 6): Matrix.003 file - promoters60/4772270
caagct

SEQ ID NO: 60432 - DNA, 7 bp, Unknown
  misc_feature (1)..( 7): Matrix.003 file - promoters60/4772270
ataaata

SEQ ID NO: 60433 - DNA, 6 bp, Unknown
  misc_feature (1)..( 6): Matrix.003 file - promoters60/4772274
ttcaga

SEQ ID NO: 60434 - DNA, 6 bp, Unknown
  misc_feature (1)..( 6): Matrix.003 file - promoters60/4772274
tctgtt

SEQ ID NO: 60435 - DNA, 6 bp, Unknown
  misc_feature (1)..( 6): Matrix.003 file - promoters60/4772274
ttcttt

SEQ ID NO: 60436 - DNA, 12 bp, Unknown
  misc_feature (1)..( 12): Matrix.003 file - promoters60/4772274
aaaggttatcat

SEQ ID NO: 60437 - DNA, 8 bp, Unknown
  misc_feature (1)..( 8): Matrix.003 file - promoters60/4772274
gttaggga

SEQ ID NO: 60438 - DNA, 6 bp, Unknown
  misc_feature (1)..( 6): Matrix.003 file - promoters60/4772274
gggcct

SEQ ID NO: 60439 - DNA, 9 bp, Unknown
  misc_feature (1)..( 9): Matrix.003 file - promoters60/4772274
taaaaccac

SEQ ID NO: 60440 - DNA, 6 bp, Unknown
  misc_feature (1)..( 6): Matrix.003 file - promoters60/4772274
acaaaa

SEQ ID NO: 60441 - DNA, 7 bp, Unknown
  misc_feature (1)..( 7): Matrix.003 file - promoters60/4772274
tatctct

SEQ ID NO: 60442 - DNA, 6 bp, Unknown
  misc_feature (1)..( 6): Matrix.003 file - promoters60/4772274
ttaatc

SEQ ID NO: 60443 - DNA, 10 bp, Unknown
  misc_feature (1)..( 10): Matrix.003 file - promoters60/4772274
atcaaaatgt

SEQ ID NO: 60444 - DNA, 8 bp, Unknown
  misc_feature (1)..( 8): Matrix.003 file - promoters60/4772274
caaaatgt

SEQ ID NO: 60445 - DNA, 6 bp, Unknown
  misc_feature (1)..( 6): Matrix.003 file - promoters60/4772274
ttatta

SEQ ID NO: 60446 - DNA, 8 bp, Unknown
  misc_feature (1)..( 8): Matrix.003 file - promoters60/4772274
attgtaag

SEQ ID NO: 60447 - DNA, 6 bp, Unknown
  misc_feature (1)..( 6): Matrix.003 file - promoters60/4772274
tttcca

SEQ ID NO: 60448 - DNA, 7 bp, Unknown
  misc_feature (1)..( 7): Matrix.003 file - promoters60/4772274
ttgaatt

SEQ ID NO: 60449 - DNA, 7 bp, Unknown
  misc_feature (1)..( 7): Matrix.003 file - promoters60/4772274
tctcaga

SEQ ID NO: 60450 - DNA, 9 bp, Unknown
  misc_feature (1)..( 9): Matrix.003 file - promoters60/4772274
aatagatca

SEQ ID NO: 60451 - DNA, 7 bp, Unknown
  misc_feature (1)..( 7): Matrix.003 file - promoters60/4772274
caaaatt

SEQ ID NO: 60452 - DNA, 7 bp, Unknown
  misc_feature (1)..( 7): Matrix.003 file - promoters60/4772277
gattata

SEQ ID NO: 60453 - DNA, 7 bp, Unknown
  misc_feature (1)..( 7): Matrix.003 file - promoters60/4772277
taaatga

SEQ ID NO: 60454 - DNA, 6 bp, Unknown
  misc_feature (1)..( 6): Matrix.003 file - promoters60/4772277
gtgaca

SEQ ID NO: 60455 - DNA, 10 bp, Unknown
  misc_feature (1)..( 10): Matrix.003 file - promoters60/4772277
aaaacaaaaa

SEQ ID NO: 60456 - DNA, 7 bp, Unknown
  misc_feature (1)..( 7): Matrix.003 file - promoters60/4772277
gcagcat

SEQ ID NO: 60457 - DNA, 6 bp, Unknown
  misc_feature (1)..( 6): Matrix.003 file - promoters60/4772277
ttttat

SEQ ID NO: 60458 - DNA, 7 bp, Unknown
  misc_feature (1)..( 7): Matrix.003 file - promoters60/4772277
tctatgt

SEQ ID NO: 60459 - DNA, 6 bp, Unknown
  misc_feature (1)..( 6): Matrix.003 file - promoters60/4772277
aaatgt

SEQ ID NO: 60460 - DNA, 10 bp, Unknown
  misc_feature (1)..( 10): Matrix.003 file - promoters60/4772277
gaaaaggtga

SEQ ID NO: 60461 - DNA, 7 bp, Unknown
  misc_feature (1)..( 7): Matrix.003 file - promoters60/4772277
caagtta

SEQ ID NO: 60462 - DNA, 6 bp, Unknown
  misc_feature (1)..( 6): Matrix.003 file - promoters60/4772277
aacaaa

SEQ ID NO: 60463 - DNA, 7 bp, Unknown
  misc_feature (1)..( 7): Matrix.003 file - promoters60/4772277
tgaagaa

SEQ ID NO: 60464 - DNA, 8 bp, Unknown
  misc_feature (1)..( 8): Matrix.003 file - promoters60/4772277
tatataat

SEQ ID NO: 60465 - DNA, 7 bp, Unknown
  misc_feature (1)..( 7): Matrix.003 file - promoters60/4772277
taagttg

SEQ ID NO: 60466 - DNA, 6 bp, Unknown
  misc_feature (1)..( 6): Matrix.003 file - promoters60/4772277
gttgac

SEQ ID NO: 60467 - DNA, 6 bp, Unknown
  misc_feature (1)..( 6): Matrix.003 file - promoters60/4772277
aagaaa

SEQ ID NO: 60468 - DNA, 7 bp, Unknown
  misc_feature (1)..( 7): Matrix.003 file - promoters60/4772277
atgctct

SEQ ID NO: 60469 - DNA, 7 bp, Unknown
  misc_feature (1)..( 7): Matrix.003 file - promoters60/4772289
caacgat

SEQ ID NO: 60470 - DNA, 6 bp, Unknown
  misc_feature (1)..( 6): Matrix.003 file - promoters60/4772289
agatgt

SEQ ID NO: 60471 - DNA, 8 bp, Unknown
  misc_feature (1)..( 8): Matrix.003 file - promoters60/4772289
atgcgttg

SEQ ID NO: 60472 - DNA, 7 bp, Unknown
  misc_feature (1)..( 7): Matrix.003 file - promoters60/4772289
tcaagtt

SEQ ID NO: 60473 - DNA, 6 bp, Unknown
  misc_feature (1)..( 6): Matrix.003 file - promoters60/4772289
aataaa

SEQ ID NO: 60474 - DNA, 6 bp, Unknown
  misc_feature (1)..( 6): Matrix.003 file - promoters60/4772289
agagct

SEQ ID NO: 60475 - DNA, 8 bp, Unknown
  misc_feature (1)..( 8): Matrix.003 file - promoters60/4772289
gaaacaaa

SEQ ID NO: 60476 - DNA, 6 bp, Unknown
  misc_feature (1)..( 6): Matrix.003 file - promoters60/4772289
ttgtta

SEQ ID NO: 60477 - DNA, 6 bp, Unknown
  misc_feature (1)..( 6): Matrix.003 file - promoters60/4772289
agtaaa

SEQ ID NO: 60478 - DNA, 7 bp, Unknown
  misc_feature (1)..( 7): Matrix.003 file - promoters60/4772289
aatcggg

SEQ ID NO: 60479 - DNA, 10 bp, Unknown
  misc_feature (1)..( 10): Matrix.003 file - promoters60/4772289
ggaaaagaaa

SEQ ID NO: 60480 - DNA, 7 bp, Unknown
  misc_feature (1)..( 7): Matrix.003 file - promoters60/4772289
cccacta

SEQ ID NO: 60481 - DNA, 9 bp, Unknown
  misc_feature (1)..( 9): Matrix.003 file - promoters60/4772289
aaagaaaag

SEQ ID NO: 60482 - DNA, 7 bp, Unknown
  misc_feature (1)..( 7): Matrix.003 file - promoters60/4772289
gtatata

SEQ ID NO: 60483 - DNA, 7 bp, Unknown
  misc_feature (1)..( 7): Matrix.003 file - promoters60/4772311
cctaaaa

SEQ ID NO: 60484 - DNA, 8 bp, Unknown
  misc_feature (1)..( 8): Matrix.003 file - promoters60/4772311
aaaatcaa

SEQ ID NO: 60485 - DNA, 9 bp, Unknown
  misc_feature (1)..( 9): Matrix.003 file - promoters60/4772311
gtaaaattc

SEQ ID NO: 60486 - DNA, 6 bp, Unknown
  misc_feature (1)..( 6): Matrix.003 file - promoters60/4772311
tttcta

SEQ ID NO: 60487 - DNA, 6 bp, Unknown
  misc_feature (1)..( 6): Matrix.003 file - promoters60/4772311
ggtttg

SEQ ID NO: 60488 - DNA, 8 bp, Unknown
  misc_feature (1)..( 8): Matrix.003 file - promoters60/4772311
catccaat

SEQ ID NO: 60489 - DNA, 8 bp, Unknown
  misc_feature (1)..( 8): Matrix.003 file - promoters60/4772311
tatcaaaa

SEQ ID NO: 60490 - DNA, 6 bp, Unknown
  misc_feature (1)..( 6): Matrix.003 file - promoters60/4772311
aaacga

SEQ ID NO: 60491 - DNA, 6 bp, Unknown
  misc_feature (1)..( 6): Matrix.003 file - promoters60/4772311
aagatg

SEQ ID NO: 60492 - DNA, 10 bp, Unknown
  misc_feature (1)..( 10): Matrix.003 file - promoters60/4772311
atgtttctct

SEQ ID NO: 60493 - DNA, 7 bp, Unknown
  misc_feature (1)..( 7): Matrix.003 file - promoters60/4772311
gaaacaa

SEQ ID NO: 60494 - DNA, 6 bp, Unknown
  misc_feature (1)..( 6): Matrix.003 file - promoters60/4772311
tccata

SEQ ID NO: 60495 - DNA, 8 bp, Unknown
  misc_feature (1)..( 8): Matrix.003 file - promoters60/4772329
atagataa

SEQ ID NO: 60496 - DNA, 7 bp, Unknown
  misc_feature (1)..( 7): Matrix.003 file - promoters60/4772329
ttatata

SEQ ID NO: 60497 - DNA, 6 bp, Unknown
  misc_feature (1)..( 6): Matrix.003 file - promoters60/4772329
tatact

SEQ ID NO: 60498 - DNA, 7 bp, Unknown
  misc_feature (1)..( 7): Matrix.003 file - promoters60/4772329
cgtatga

SEQ ID NO: 60499 - DNA, 6 bp, Unknown
  misc_feature (1)..( 6): Matrix.003 file - promoters60/4772329
ttttct

SEQ ID NO: 60500 - DNA, 7 bp, Unknown
  misc_feature (1)..( 7): Matrix.003 file - promoters60/4772329
ttgtcta

SEQ ID NO: 60501 - DNA, 12 bp, Unknown
  misc_feature (1)..( 12): Matrix.003 file - promoters60/4772329
tatataaaaccc

SEQ ID NO: 60502 - DNA, 6 bp, Unknown
  misc_feature (1)..( 6): Matrix.003 file - promoters60/4772329
aaaaca

SEQ ID NO: 60503 - DNA, 7 bp, Unknown
  misc_feature (1)..( 7): Matrix.003 file - promoters60/4772329
ttgttta

SEQ ID NO: 60504 - DNA, 9 bp, Unknown
  misc_feature (1)..( 9): Matrix.003 file - promoters60/4772329
taacttaat

SEQ ID NO: 60505 - DNA, 7 bp, Unknown
  misc_feature (1)..( 7): Matrix.003 file - promoters60/4772329
ataatgc

SEQ ID NO: 60506 - DNA, 9 bp, Unknown
  misc_feature (1)..( 9): Matrix.003 file - promoters60/4772329
atattcatt

SEQ ID NO: 60507 - DNA, 7 bp, Unknown
  misc_feature (1)..( 7): Matrix.003 file - promoters60/4772329
aatataa

SEQ ID NO: 60508 - DNA, 6 bp, Unknown
  misc_feature (1)..( 6): Matrix.003 file - promoters60/4772329
aaataa

SEQ ID NO: 60509 - DNA, 8 bp, Unknown
  misc_feature (1)..( 8): Matrix.003 file - promoters60/4772329
caacctga

SEQ ID NO: 60510 - DNA, 6 bp, Unknown
  misc_feature (1)..( 6): Matrix.003 file - promoters60/4772329
attatt

SEQ ID NO: 60511 - DNA, 7 bp, Unknown
  misc_feature (1)..( 7): Matrix.003 file - promoters60/4772329
tcagatt

SEQ ID NO: 60512 - DNA, 9 bp, Unknown
  misc_feature (1)..( 9): Matrix.003 file - promoters60/4772329
gtacttctc

SEQ ID NO: 60513 - DNA, 9 bp, Unknown
  misc_feature (1)..( 9): Matrix.003 file - promoters60/4772329
aaaaggaac

SEQ ID NO: 60514 - DNA, 10 bp, Unknown
  misc_feature (1)..( 10): Matrix.003 file - promoters60/4772329
atagtataca

SEQ ID NO: 60515 - DNA, 7 bp, Unknown
  misc_feature (1)..( 7): Matrix.003 file - promoters60/4772329
tgaaaaa

SEQ ID NO: 60516 - DNA, 6 bp, Unknown
  misc_feature (1)..( 6): Matrix.003 file - promoters60/4772329
tattta

SEQ ID NO: 60517 - DNA, 8 bp, Unknown
  misc_feature (1)..( 8): Matrix.003 file - promoters60/4772329
aaacatta

SEQ ID NO: 60518 - DNA, 6 bp, Unknown
  misc_feature (1)..( 6): Matrix.003 file - promoters60/4772329
tattat

SEQ ID NO: 60519 - DNA, 8 bp, Unknown
  misc_feature (1)..( 8): Matrix.003 file - promoters60/4772329
caatatga

SEQ ID NO: 60520 - DNA, 7 bp, Unknown
  misc_feature (1)..( 7): Matrix.003 file - promoters60/4772332
aatctgt

SEQ ID NO: 60521 - DNA, 7 bp, Unknown
  misc_feature (1)..( 7): Matrix.003 file - promoters60/4772332
cctacaa

SEQ ID NO: 60522 - DNA, 6 bp, Unknown
  misc_feature (1)..( 6): Matrix.003 file - promoters60/4772332
aagaga

SEQ ID NO: 60523 - DNA, 8 bp, Unknown
  misc_feature (1)..( 8): Matrix.003 file - promoters60/4772332
ttattttt

SEQ ID NO: 60524 - DNA, 6 bp, Unknown
  misc_feature (1)..( 6): Matrix.003 file - promoters60/4772332
aaaaaa

SEQ ID NO: 60525 - DNA, 9 bp, Unknown
  misc_feature (1)..( 9): Matrix.003 file - promoters60/4772332
ttttggtat

SEQ ID NO: 60526 - DNA, 7 bp, Unknown
  misc_feature (1)..( 7): Matrix.003 file - promoters60/4772332
tttaatg

SEQ ID NO: 60527 - DNA, 9 bp, Unknown
  misc_feature (1)..( 9): Matrix.003 file - promoters60/4772332
gtgtattgg

SEQ ID NO: 60528 - DNA, 7 bp, Unknown
  misc_feature (1)..( 7): Matrix.003 file - promoters60/4772332
tgttgta

SEQ ID NO: 60529 - DNA, 6 bp, Unknown
  misc_feature (1)..( 6): Matrix.003 file - promoters60/4772332
caagag

SEQ ID NO: 60530 - DNA, 7 bp, Unknown
  misc_feature (1)..( 7): Matrix.003 file - promoters60/4772332
gaccata

SEQ ID NO: 60531 - DNA, 12 bp, Unknown
  misc_feature (1)..( 12): Matrix.003 file - promoters60/4772336
atatatataaca

SEQ ID NO: 60532 - DNA, 15 bp, Unknown
  misc_feature (1)..( 15): Matrix.003 file - promoters60/4772336
tttttacattgcgtg

SEQ ID NO: 60533 - DNA, 7 bp, Unknown
  misc_feature (1)..( 7): Matrix.003 file - promoters60/4772336
ataagaa

SEQ ID NO: 60534 - DNA, 8 bp, Unknown
  misc_feature (1)..( 8): Matrix.003 file - promoters60/4772346
agatacag

SEQ ID NO: 60535 - DNA, 8 bp, Unknown
  misc_feature (1)..( 8): Matrix.003 file - promoters60/4772370
attaaaaa

SEQ ID NO: 60536 - DNA, 12 bp, Unknown
  misc_feature (1)..( 12): Matrix.003 file - promoters60/4772370
atgtaataacac

SEQ ID NO: 60537 - DNA, 8 bp, Unknown
  misc_feature (1)..( 8): Matrix.003 file - promoters60/4772370
tataaaaa

SEQ ID NO: 60538 - DNA, 12 bp, Unknown
  misc_feature (1)..( 12): Matrix.003 file - promoters60/4772370
aaaagaaaaaaa

SEQ ID NO: 60539 - DNA, 8 bp, Unknown
  misc_feature (1)..( 8): Matrix.003 file - promoters60/4772378
tgtttaga

SEQ ID NO: 60540 - DNA, 8 bp, Unknown
  misc_feature (1)..( 8): Matrix.003 file - promoters60/4772382
atgcagga

SEQ ID NO: 60541 - DNA, 8 bp, Unknown
  misc_feature (1)..( 8): Matrix.003 file - promoters60/4772382
aagtattt

SEQ ID NO: 60542 - DNA, 6 bp, Unknown
  misc_feature (1)..( 6): Matrix.003 file - promoters60/4772382
gtaaag

SEQ ID NO: 60543 - DNA, 8 bp, Unknown
  misc_feature (1)..( 8): Matrix.003 file - promoters60/4772382
gttacaac

SEQ ID NO: 60544 - DNA, 9 bp, Unknown
  misc_feature (1)..( 9): Matrix.003 file - promoters60/4772382
ccttataaa

SEQ ID NO: 60545 - DNA, 10 bp, Unknown
  misc_feature (1)..( 10): Matrix.003 file - promoters60/4772382
acataagatt

SEQ ID NO: 60546 - DNA, 8 bp, Unknown
  misc_feature (1)..( 8): Matrix.003 file - promoters60/4772382
attcacat

SEQ ID NO: 60547 - DNA, 6 bp, Unknown
  misc_feature (1)..( 6): Matrix.003 file - promoters60/4772382
tttcaa

SEQ ID NO: 60548 - DNA, 7 bp, Unknown
  misc_feature (1)..( 7): Matrix.003 file - promoters60/4772382
attttag

SEQ ID NO: 60549 - DNA, 7 bp, Unknown
  misc_feature (1)..( 7): Matrix.003 file - promoters60/4772382
tttaagt

SEQ ID NO: 60550 - DNA, 8 bp, Unknown
  misc_feature (1)..( 8): Matrix.003 file - promoters60/4772382
tttattta

SEQ ID NO: 60551 - DNA, 6 bp, Unknown
  misc_feature (1)..( 6): Matrix.003 file - promoters60/4772382
taaacg

SEQ ID NO: 60552 - DNA, 9 bp, Unknown
  misc_feature (1)..( 9): Matrix.003 file - promoters60/4772382
atattacca

SEQ ID NO: 60553 - DNA, 11 bp, Unknown
  misc_feature (1)..( 11): Matrix.003 file - promoters60/4772382
caaaatgtcaa

SEQ ID NO: 60554 - DNA, 6 bp, Unknown
  misc_feature (1)..( 6): Matrix.003 file - promoters60/4772382
aaacat

SEQ ID NO: 60555 - DNA, 10 bp, Unknown
  misc_feature (1)..( 10): Matrix.003 file - promoters60/4772382
aaaaaaaaaa

SEQ ID NO: 60556 - DNA, 9 bp, Unknown
  misc_feature (1)..( 9): Matrix.003 file - promoters60/4772382
caaaaccta

SEQ ID NO: 60557 - DNA, 6 bp, Unknown
  misc_feature (1)..( 6): Matrix.003 file - promoters60/4772382
gaaaaa

SEQ ID NO: 60558 - DNA, 6 bp, Unknown
  misc_feature (1)..( 6): Matrix.003 file - promoters60/4772382
aattca

SEQ ID NO: 60559 - DNA, 7 bp, Unknown
  misc_feature (1)..( 7): Matrix.003 file - promoters60/4772382
attaaaa

SEQ ID NO: 60560 - DNA, 17 bp, Unknown
  misc_feature (1)..( 17): Matrix.003 file - promoters60/4772389
agaggtaaaaaaaaaca

SEQ ID NO: 60561 - DNA, 10 bp, Unknown
  misc_feature (1)..( 10): Matrix.003 file - promoters60/4772389
ataaaaaata

SEQ ID NO: 60562 - DNA, 10 bp, Unknown
  misc_feature (1)..( 10): Matrix.003 file - promoters60/4772389
atttatttcg

SEQ ID NO: 60563 - DNA, 16 bp, Unknown
  misc_feature (1)..( 16): Matrix.003 file - promoters60/4772389
aaacaaacgaactaaa

SEQ ID NO: 60564 - DNA, 11 bp, Unknown
  misc_feature (1)..( 11): Matrix.003 file - promoters60/4772389
gaaaaaaaata

SEQ ID NO: 60565 - DNA, 10 bp, Unknown
  misc_feature (1)..( 10): Matrix.003 file - promoters60/4772389
tacaaataaa

SEQ ID NO: 60566 - DNA, 8 bp, Unknown
  misc_feature (1)..( 8): Matrix.003 file - promoters60/4772389
atataatt

SEQ ID NO: 60567 - DNA, 10 bp, Unknown
  misc_feature (1)..( 10): Matrix.003 file - promoters60/4772393
caaatttaaa

SEQ ID NO: 60568 - DNA, 8 bp, Unknown
  misc_feature (1)..( 8): Matrix.003 file - promoters60/4772393
atttctaa

SEQ ID NO: 60569 - DNA, 13 bp, Unknown
  misc_feature (1)..( 13): Matrix.003 file - promoters60/4772398
aatgggcttatta

SEQ ID NO: 60570 - DNA, 8 bp, Unknown
  misc_feature (1)..( 8): Matrix.003 file - promoters60/4772700
tatatatt

SEQ ID NO: 60571 - DNA, 6 bp, Unknown
  misc_feature (1)..( 6): Matrix.003 file - promoters60/4772706
tgatgt

SEQ ID NO: 60572 - DNA, 7 bp, Unknown
  misc_feature (1)..( 7): Matrix.003 file - promoters60/4772706
catgaga

SEQ ID NO: 60573 - DNA, 6 bp, Unknown
  misc_feature (1)..( 6): Matrix.003 file - promoters60/4772706
taatag

SEQ ID NO: 60574 - DNA, 7 bp, Unknown
  misc_feature (1)..( 7): Matrix.003 file - promoters60/4772706
tcaaaat

SEQ ID NO: 60575 - DNA, 6 bp, Unknown
  misc_feature (1)..( 6): Matrix.003 file - promoters60/4772706
tgtctt

SEQ ID NO: 60576 - DNA, 8 bp, Unknown
  misc_feature (1)..( 8): Matrix.003 file - promoters60/4772706
aacaaaag

SEQ ID NO: 60577 - DNA, 7 bp, Unknown
  misc_feature (1)..( 7): Matrix.003 file - promoters60/4772706
gtttgtt

SEQ ID NO: 60578 - DNA, 6 bp, Unknown
  misc_feature (1)..( 6): Matrix.003 file - promoters60/4772706
attttt

SEQ ID NO: 60579 - DNA, 6 bp, Unknown
  misc_feature (1)..( 6): Matrix.003 file - promoters60/4772706
ttttgt

SEQ ID NO: 60580 - DNA, 6 bp, Unknown
  misc_feature (1)..( 6): Matrix.003 file - promoters60/4772706
tgggtc

SEQ ID NO: 60581 - DNA, 6 bp, Unknown
  misc_feature (1)..( 6): Matrix.003 file - promoters60/4772706
cttctt

SEQ ID NO: 60582 - DNA, 6 bp, Unknown
  misc_feature (1)..( 6): Matrix.003 file - promoters60/4772706
tgataa

SEQ ID NO: 60583 - DNA, 6 bp, Unknown
  misc_feature (1)..( 6): Matrix.003 file - promoters60/4772710
tttctt

SEQ ID NO: 60584 - DNA, 8 bp, Unknown
  misc_feature (1)..( 8): Matrix.003 file - promoters60/4772710
gaatcaaa

SEQ ID NO: 60585 - DNA, 10 bp, Unknown
  misc_feature (1)..( 10): Matrix.003 file - promoters60/4772710
tttcttttgt

SEQ ID NO: 60586 - DNA, 7 bp, Unknown
  misc_feature (1)..( 7): Matrix.003 file - promoters60/4772710
tttgctt

SEQ ID NO: 60587 - DNA, 7 bp, Unknown
  misc_feature (1)..( 7): Matrix.003 file - promoters60/4772710
ctttaat

SEQ ID NO: 60588 - DNA, 7 bp, Unknown
  misc_feature (1)..( 7): Matrix.003 file - promoters60/4772710
aaaattg

SEQ ID NO: 60589 - DNA, 10 bp, Unknown
  misc_feature (1)..( 10): Matrix.003 file - promoters60/4772710
attgaaattt

SEQ ID NO: 60590 - DNA, 9 bp, Unknown
  misc_feature (1)..( 9): Matrix.003 file - promoters60/4772710
aattcagaa

SEQ ID NO: 60591 - DNA, 8 bp, Unknown
  misc_feature (1)..( 8): Matrix.003 file - promoters60/4772710
ttattttg

SEQ ID NO: 60592 - DNA, 7 bp, Unknown
  misc_feature (1)..( 7): Matrix.003 file - promoters60/4772724
ttaccct

SEQ ID NO: 60593 - DNA, 6 bp, Unknown
  misc_feature (1)..( 6): Matrix.003 file - promoters60/4772724
taaccg

SEQ ID NO: 60594 - DNA, 6 bp, Unknown
  misc_feature (1)..( 6): Matrix.003 file - promoters60/4772724
gttaaa

SEQ ID NO: 60595 - DNA, 7 bp, Unknown
  misc_feature (1)..( 7): Matrix.003 file - promoters60/4772724
caaagtc

SEQ ID NO: 60596 - DNA, 8 bp, Unknown
  misc_feature (1)..( 8): Matrix.003 file - promoters60/4772724
atatcttc

SEQ ID NO: 60597 - DNA, 6 bp, Unknown
  misc_feature (1)..( 6): Matrix.003 file - promoters60/4772724
gagata

SEQ ID NO: 60598 - DNA, 7 bp, Unknown
  misc_feature (1)..( 7): Matrix.003 file - promoters60/4772724
atgtgga

SEQ ID NO: 60599 - DNA, 7 bp, Unknown
  misc_feature (1)..( 7): Matrix.003 file - promoters60/4772724
agcaaat

SEQ ID NO: 60600 - DNA, 6 bp, Unknown
  misc_feature (1)..( 6): Matrix.003 file - promoters60/4772724
aatgct

SEQ ID NO: 60601 - DNA, 7 bp, Unknown
  misc_feature (1)..( 7): Matrix.003 file - promoters60/4772724
caatcta

SEQ ID NO: 60602 - DNA, 8 bp, Unknown
  misc_feature (1)..( 8): Matrix.003 file - promoters60/4772724
atttcaaa

SEQ ID NO: 60603 - DNA, 8 bp, Unknown
  misc_feature (1)..( 8): Matrix.003 file - promoters60/4772724
tttgcgaa

SEQ ID NO: 60604 - DNA, 10 bp, Unknown
  misc_feature (1)..( 10): Matrix.003 file - promoters60/4772724
ttcaagaaga

SEQ ID NO: 60605 - DNA, 6 bp, Unknown
  misc_feature (1)..( 6): Matrix.003 file - promoters60/4772724
cgttga

SEQ ID NO: 60606 - DNA, 9 bp, Unknown
  misc_feature (1)..( 9): Matrix.003 file - promoters60/4772724
aataaagat

SEQ ID NO: 60607 - DNA, 6 bp, Unknown
  misc_feature (1)..( 6): Matrix.003 file - promoters60/4772743
attttt

SEQ ID NO: 60608 - DNA, 6 bp, Unknown
  misc_feature (1)..( 6): Matrix.003 file - promoters60/4772743
tttact

SEQ ID NO: 60609 - DNA, 8 bp, Unknown
  misc_feature (1)..( 8): Matrix.003 file - promoters60/4772743
tactagct

SEQ ID NO: 60610 - DNA, 6 bp, Unknown
  misc_feature (1)..( 6): Matrix.003 file - promoters60/4772743
agaatg

SEQ ID NO: 60611 - DNA, 13 bp, Unknown
  misc_feature (1)..( 13): Matrix.003 file - promoters60/4772772
ttaaaaatattaa

SEQ ID NO: 60612 - DNA, 8 bp, Unknown
  misc_feature (1)..( 8): Matrix.003 file - promoters60/4772772
aaaacaaa

SEQ ID NO: 60613 - DNA, 5 bp, Unknown
  misc_feature (1)..( 5): Matrix.003 file - promoters60/4772772
tcaat

SEQ ID NO: 60614 - DNA, 12 bp, Unknown
  misc_feature (1)..( 12): Matrix.003 file - promoters60/4772772
cctctatatata

SEQ ID NO: 60615 - DNA, 9 bp, Unknown
  misc_feature (1)..( 9): Matrix.003 file - promoters60/4772772
tatttaaat

SEQ ID NO: 60616 - DNA, 11 bp, Unknown
  misc_feature (1)..( 11): Matrix.003 file - promoters60/4772772
gtttaaaaaga

SEQ ID NO: 60617 - DNA, 6 bp, Unknown
  misc_feature (1)..( 6): Matrix.003 file - promoters60/4772772
aaaata

SEQ ID NO: 60618 - DNA, 12 bp, Unknown
  misc_feature (1)..( 12): Matrix.003 file - promoters60/4772772
taaagtttcaaa

SEQ ID NO: 60619 - DNA, 12 bp, Unknown
  misc_feature (1)..( 12): Matrix.003 file - promoters60/4772772
ataagtttaaaa

SEQ ID NO: 60620 - DNA, 9 bp, Unknown
  misc_feature (1)..( 9): Matrix.003 file - promoters60/4772772
aaaaatata

SEQ ID NO: 60621 - DNA, 10 bp, Unknown
  misc_feature (1)..( 10): Matrix.003 file - promoters60/4772772
atattattaa

SEQ ID NO: 60622 - DNA, 9 bp, Unknown
  misc_feature (1)..( 9): Matrix.003 file - promoters60/4772772
ttttatttc

SEQ ID NO: 60623 - DNA, 10 bp, Unknown
  misc_feature (1)..( 10): Matrix.003 file - promoters60/4772776
aaattagtga

SEQ ID NO: 60624 - DNA, 14 bp, Unknown
  misc_feature (1)..( 14): Matrix.003 file - promoters60/4772776
ttcttaaaataaaa

SEQ ID NO: 60625 - DNA, 9 bp, Unknown
  misc_feature (1)..( 9): Matrix.003 file - promoters60/4772813
taaattttc

SEQ ID NO: 60626 - DNA, 8 bp, Unknown
  misc_feature (1)..( 8): Matrix.003 file - promoters60/4772813
attcgata

SEQ ID NO: 60627 - DNA, 15 bp, Unknown
  misc_feature (1)..( 15): Matrix.003 file - promoters60/4772813
aaagttttctgtttc

SEQ ID NO: 60628 - DNA, 7 bp, Unknown
  misc_feature (1)..( 7): Matrix.003 file - promoters60/4772813
cttcttt

SEQ ID NO: 60629 - DNA, 12 bp, Unknown
  misc_feature (1)..( 12): Matrix.003 file - promoters60/4772820
ttgatttaagac

SEQ ID NO: 60630 - DNA, 8 bp, Unknown
  misc_feature (1)..( 8): Matrix.003 file - promoters60/4772820
aataaaaa

SEQ ID NO: 60631 - DNA, 8 bp, Unknown
  misc_feature (1)..( 8): Matrix.003 file - promoters60/4772846
aatattct

SEQ ID NO: 60632 - DNA, 10 bp, Unknown
  misc_feature (1)..( 10): Matrix.003 file - promoters60/4772846
ggaaggagag

SEQ ID NO: 60633 - DNA, 9 bp, Unknown
  misc_feature (1)..( 9): Matrix.003 file - promoters60/4772855
caatatgtt

SEQ ID NO: 60634 - DNA, 7 bp, Unknown
  misc_feature (1)..( 7): Matrix.003 file - promoters60/4772855
aaattta

SEQ ID NO: 60635 - DNA, 7 bp, Unknown
  misc_feature (1)..( 7): Matrix.003 file - promoters60/4772855
aaataaa

SEQ ID NO: 60636 - DNA, 6 bp, Unknown
  misc_feature (1)..( 6): Matrix.003 file - promoters60/4772855
atatgt

SEQ ID NO: 60637 - DNA, 6 bp, Unknown
  misc_feature (1)..( 6): Matrix.003 file - promoters60/4772855
ttatta

SEQ ID NO: 60638 - DNA, 6 bp, Unknown
  misc_feature (1)..( 6): Matrix.003 file - promoters60/4772855
actaaa

SEQ ID NO: 60639 - DNA, 8 bp, Unknown
  misc_feature (1)..( 8): Matrix.003 file - promoters60/4772855
aaaataag

SEQ ID NO: 60640 - DNA, 8 bp, Unknown
  misc_feature (1)..( 8): Matrix.003 file - promoters60/4772855
taaattgt

SEQ ID NO: 60641 - DNA, 6 bp, Unknown
  misc_feature (1)..( 6): Matrix.003 file - promoters60/4772855
atagat

SEQ ID NO: 60642 - DNA, 7 bp, Unknown
  misc_feature (1)..( 7): Matrix.003 file - promoters60/4772855
agagata

SEQ ID NO: 60643 - DNA, 6 bp, Unknown
  misc_feature (1)..( 6): Matrix.003 file - promoters60/4772855
ttttgg

SEQ ID NO: 60644 - DNA, 6 bp, Unknown
  misc_feature (1)..( 6): Matrix.003 file - promoters60/4772855
taagat

SEQ ID NO: 60645 - DNA, 6 bp, Unknown
  misc_feature (1)..( 6): Matrix.003 file - promoters60/4772855
aaagaa

SEQ ID NO: 60646 - DNA, 12 bp, Unknown
  misc_feature (1)..( 12): Matrix.003 file - promoters60/4772855
aaaaacaaaaca

SEQ ID NO: 60647 - DNA, 6 bp, Unknown
  misc_feature (1)..( 6): Matrix.003 file - promoters60/4772855
aaaaat

SEQ ID NO: 60648 - DNA, 6 bp, Unknown
  misc_feature (1)..( 6): Matrix.003 file - promoters60/4772855
taaccc

SEQ ID NO: 60649 - DNA, 10 bp, Unknown
  misc_feature (1)..( 10): Matrix.003 file - promoters60/4772879
taaaaaggat

SEQ ID NO: 60650 - DNA, 14 bp, Unknown
  misc_feature (1)..( 14): Matrix.003 file - promoters60/4772879
acttataatataat

SEQ ID NO: 60651 - DNA, 9 bp, Unknown
  misc_feature (1)..( 9): Matrix.003 file - promoters60/4772879
atatataat

SEQ ID NO: 60652 - DNA, 9 bp, Unknown
  misc_feature (1)..( 9): Matrix.003 file - promoters60/4772879
aaaatatat

SEQ ID NO: 60653 - DNA, 11 bp, Unknown
  misc_feature (1)..( 11): Matrix.003 file - promoters60/4772879
agaaaatcaat

SEQ ID NO: 60654 - DNA, 11 bp, Unknown
  misc_feature (1)..( 11): Matrix.003 file - promoters60/4772879
tcctattatat

SEQ ID NO: 60655 - DNA, 8 bp, Unknown
  misc_feature (1)..( 8): Matrix.003 file - promoters60/4772879
ttgtatca

SEQ ID NO: 60656 - DNA, 11 bp, Unknown
  misc_feature (1)..( 11): Matrix.003 file - promoters60/4772879
tcaattcaaac

SEQ ID NO: 60657 - DNA, 8 bp, Unknown
  misc_feature (1)..( 8): Matrix.003 file - promoters60/4772879
atttgttt

SEQ ID NO: 60658 - DNA, 12 bp, Unknown
  misc_feature (1)..( 12): Matrix.003 file - promoters60/4772883
gaaaaaaaaaaa

SEQ ID NO: 60659 - DNA, 11 bp, Unknown
  misc_feature (1)..( 11): Matrix.003 file - promoters60/4772883
atttattaaga

SEQ ID NO: 60660 - DNA, 7 bp, Unknown
  misc_feature (1)..( 7): Matrix.003 file - promoters60/4772883
agaataa

SEQ ID NO: 60661 - DNA, 13 bp, Unknown
  misc_feature (1)..( 13): Matrix.003 file - promoters60/4772883
ctcataaaataaa

SEQ ID NO: 60662 - DNA, 8 bp, Unknown
  misc_feature (1)..( 8): Matrix.003 file - promoters60/4772883
ataaataa

SEQ ID NO: 60663 - DNA, 8 bp, Unknown
  misc_feature (1)..( 8): Matrix.003 file - promoters60/4772883
aaacaaat

SEQ ID NO: 60664 - DNA, 9 bp, Unknown
  misc_feature (1)..( 9): Matrix.003 file - promoters60/4772883
taaatacaa

SEQ ID NO: 60665 - DNA, 9 bp, Unknown
  misc_feature (1)..( 9): Matrix.003 file - promoters60/4772883
aaaaattta

SEQ ID NO: 60666 - DNA, 7 bp, Unknown
  misc_feature (1)..( 7): Matrix.003 file - promoters60/4772883
aaaactt

SEQ ID NO: 60667 - DNA, 8 bp, Unknown
  misc_feature (1)..( 8): Matrix.003 file - promoters60/4772883
caatttta

SEQ ID NO: 60668 - DNA, 8 bp, Unknown
  misc_feature (1)..( 8): Matrix.003 file - promoters60/4772883
aaaaacaa

SEQ ID NO: 60669 - DNA, 10 bp, Unknown
  misc_feature (1)..( 10): Matrix.003 file - promoters60/4772883
aatattaaaa

SEQ ID NO: 60670 - DNA, 8 bp, Unknown
  misc_feature (1)..( 8): Matrix.003 file - promoters60/4772883
tcttataa

SEQ ID NO: 60671 - DNA, 7 bp, Unknown
  misc_feature (1)..( 7): Matrix.003 file - promoters60/4772991
gttggat

SEQ ID NO: 60672 - DNA, 6 bp, Unknown
  misc_feature (1)..( 6): Matrix.003 file - promoters60/4772991
tcattt

SEQ ID NO: 60673 - DNA, 7 bp, Unknown
  misc_feature (1)..( 7): Matrix.003 file - promoters60/4772991
ataaatg

SEQ ID NO: 60674 - DNA, 7 bp, Unknown
  misc_feature (1)..( 7): Matrix.003 file - promoters60/4772991
caaattt

SEQ ID NO: 60675 - DNA, 8 bp, Unknown
  misc_feature (1)..( 8): Matrix.003 file - promoters60/4772991
aagtcaaa

SEQ ID NO: 60676 - DNA, 6 bp, Unknown
  misc_feature (1)..( 6): Matrix.003 file - promoters60/4772991
tctata

SEQ ID NO: 60677 - DNA, 8 bp, Unknown
  misc_feature (1)..( 8): Matrix.003 file - promoters60/4772991
aaactgtt

SEQ ID NO: 60678 - DNA, 6 bp, Unknown
  misc_feature (1)..( 6): Matrix.003 file - promoters60/4772991
tcaaca

SEQ ID NO: 60679 - DNA, 6 bp, Unknown
  misc_feature (1)..( 6): Matrix.003 file - promoters60/4772991
gtttgt

SEQ ID NO: 60680 - DNA, 6 bp, Unknown
  misc_feature (1)..( 6): Matrix.003 file - promoters60/4772991
cttcac

SEQ ID NO: 60681 - DNA, 9 bp, Unknown
  misc_feature (1)..( 9): Matrix.003 file - promoters60/4772991
aaaacatac

SEQ ID NO: 60682 - DNA, 6 bp, Unknown
  misc_feature (1)..( 6): Matrix.003 file - promoters60/4772991
tagaaa

SEQ ID NO: 60683 - DNA, 8 bp, Unknown
  misc_feature (1)..( 8): Matrix.003 file - promoters60/4772991
aaactaac

SEQ ID NO: 60684 - DNA, 7 bp, Unknown
  misc_feature (1)..( 7): Matrix.003 file - promoters60/4772991
taaccat

SEQ ID NO: 60685 - DNA, 6 bp, Unknown
  misc_feature (1)..( 6): Matrix.003 file - promoters60/4772991
ttcaca

SEQ ID NO: 60686 - DNA, 8 bp, Unknown
  misc_feature (1)..( 8): Matrix.003 file - promoters60/4772991
tgtcgatt

SEQ ID NO: 60687 - DNA, 8 bp, Unknown
  misc_feature (1)..( 8): Matrix.003 file - promoters60/4772991
aacaaaat

SEQ ID NO: 60688 - DNA, 8 bp, Unknown
  misc_feature (1)..( 8): Matrix.003 file - promoters60/4772991
tttaaagt

SEQ ID NO: 60689 - DNA, 7 bp, Unknown
  misc_feature (1)..( 7): Matrix.003 file - promoters60/4772991
tgaaaaa

SEQ ID NO: 60690 - DNA, 7 bp, Unknown
  misc_feature (1)..( 7): Matrix.003 file - promoters60/4772991
ttcaaag

SEQ ID NO: 60691 - DNA, 8 bp, Unknown
  misc_feature (1)..( 8): Matrix.003 file - promoters60/4772991
aaaaccat

SEQ ID NO: 60692 - DNA, 10 bp, Unknown
  misc_feature (1)..( 10): Matrix.003 file - promoters60/4773011
atttgttgat

SEQ ID NO: 60693 - DNA, 11 bp, Unknown
  misc_feature (1)..( 11): Matrix.003 file - promoters60/4773011
tgattcttttg

SEQ ID NO: 60694 - DNA, 9 bp, Unknown
  misc_feature (1)..( 9): Matrix.003 file - promoters60/4773011
ctttttatt

SEQ ID NO: 60695 - DNA, 6 bp, Unknown
  misc_feature (1)..( 6): Matrix.003 file - promoters60/4773015
ttttct

SEQ ID NO: 60696 - DNA, 9 bp, Unknown
  misc_feature (1)..( 9): Matrix.003 file - promoters60/4773015
tttcgtttc

SEQ ID NO: 60697 - DNA, 10 bp, Unknown
  misc_feature (1)..( 10): Matrix.003 file - promoters60/4773015
accaaaaaaa

SEQ ID NO: 60698 - DNA, 9 bp, Unknown
  misc_feature (1)..( 9): Matrix.003 file - promoters60/4773015
gtattatct

SEQ ID NO: 60699 - DNA, 7 bp, Unknown
  misc_feature (1)..( 7): Matrix.003 file - promoters60/4773015
tttagaa

SEQ ID NO: 60700 - DNA, 7 bp, Unknown
  misc_feature (1)..( 7): Matrix.003 file - promoters60/4773015
ttttttc

SEQ ID NO: 60701 - DNA, 7 bp, Unknown
  misc_feature (1)..( 7): Matrix.003 file - promoters60/4773015
ttgattc

SEQ ID NO: 60702 - DNA, 6 bp, Unknown
  misc_feature (1)..( 6): Matrix.003 file - promoters60/4773015
aaagaa

SEQ ID NO: 60703 - DNA, 7 bp, Unknown
  misc_feature (1)..( 7): Matrix.003 file - promoters60/4773015
ttcattt

SEQ ID NO: 60704 - DNA, 9 bp, Unknown
  misc_feature (1)..( 9): Matrix.003 file - promoters60/4773015
ctttctttt

SEQ ID NO: 60705 - DNA, 7 bp, Unknown
  misc_feature (1)..( 7): Matrix.003 file - promoters60/4773015
attacag

SEQ ID NO: 60706 - DNA, 7 bp, Unknown
  misc_feature (1)..( 7): Matrix.003 file - promoters60/4773027
tatattt

SEQ ID NO: 60707 - DNA, 8 bp, Unknown
  misc_feature (1)..( 8): Matrix.003 file - promoters60/4773027
tatgttct

SEQ ID NO: 60708 - DNA, 6 bp, Unknown
  misc_feature (1)..( 6): Matrix.003 file - promoters60/4773027
atattt

SEQ ID NO: 60709 - DNA, 6 bp, Unknown
  misc_feature (1)..( 6): Matrix.003 file - promoters60/4773027
atttat

SEQ ID NO: 60710 - DNA, 6 bp, Unknown
  misc_feature (1)..( 6): Matrix.003 file - promoters60/4773027
cctttt

SEQ ID NO: 60711 - DNA, 6 bp, Unknown
  misc_feature (1)..( 6): Matrix.003 file - promoters60/4773027
cttata

SEQ ID NO: 60712 - DNA, 6 bp, Unknown
  misc_feature (1)..( 6): Matrix.003 file - promoters60/4773027
gttgga

SEQ ID NO: 60713 - DNA, 6 bp, Unknown
  misc_feature (1)..( 6): Matrix.003 file - promoters60/4773027
ttcgag

SEQ ID NO: 60714 - DNA, 7 bp, Unknown
  misc_feature (1)..( 7): Matrix.003 file - promoters60/4773027
gacaata

SEQ ID NO: 60715 - DNA, 6 bp, Unknown
  misc_feature (1)..( 6): Matrix.003 file - promoters60/4773027
tatctg

SEQ ID NO: 60716 - DNA, 7 bp, Unknown
  misc_feature (1)..( 7): Matrix.003 file - promoters60/4773027
gaaatca

SEQ ID NO: 60717 - DNA, 7 bp, Unknown
  misc_feature (1)..( 7): Matrix.003 file - promoters60/4773027
ggtcctt

SEQ ID NO: 60718 - DNA, 6 bp, Unknown
  misc_feature (1)..( 6): Matrix.003 file - promoters60/4773027
atatct

SEQ ID NO: 60719 - DNA, 6 bp, Unknown
  misc_feature (1)..( 6): Matrix.003 file - promoters60/4773027
aactaa

SEQ ID NO: 60720 - DNA, 7 bp, Unknown
  misc_feature (1)..( 7): Matrix.003 file - promoters60/4773027
ctaatgt

SEQ ID NO: 60721 - DNA, 6 bp, Unknown
  misc_feature (1)..( 6): Matrix.003 file - promoters60/4773027
tgtgct

SEQ ID NO: 60722 - DNA, 8 bp, Unknown
  misc_feature (1)..( 8): Matrix.003 file - promoters60/4773027
aaacaatt

SEQ ID NO: 60723 - DNA, 7 bp, Unknown
  misc_feature (1)..( 7): Matrix.003 file - promoters60/4773027
ctaaaat

SEQ ID NO: 60724 - DNA, 7 bp, Unknown
  misc_feature (1)..( 7): Matrix.003 file - promoters60/4773027
ttttgtt

SEQ ID NO: 60725 - DNA, 7 bp, Unknown
  misc_feature (1)..( 7): Matrix.003 file - promoters60/4773027
ttagtaa

SEQ ID NO: 60726 - DNA, 7 bp, Unknown
  misc_feature (1)..( 7): Matrix.003 file - promoters60/4773027
tctgttc

SEQ ID NO: 60727 - DNA, 6 bp, Unknown
  misc_feature (1)..( 6): Matrix.003 file - promoters60/4773027
aataat

SEQ ID NO: 60728 - DNA, 8 bp, Unknown
  misc_feature (1)..( 8): Matrix.003 file - promoters60/4773035
aaataaat

SEQ ID NO: 60729 - DNA, 9 bp, Unknown
  misc_feature (1)..( 9): Matrix.003 file - promoters60/4773035
taccaatta

SEQ ID NO: 60730 - DNA, 9 bp, Unknown
  misc_feature (1)..( 9): Matrix.003 file - promoters60/4773035
ctatataaa

SEQ ID NO: 60731 - DNA, 8 bp, Unknown
  misc_feature (1)..( 8): Matrix.003 file - promoters60/4773068
caaaaaaa

SEQ ID NO: 60732 - DNA, 6 bp, Unknown
  misc_feature (1)..( 6): Matrix.003 file - promoters60/4773068
aaaaca

SEQ ID NO: 60733 - DNA, 8 bp, Unknown
  misc_feature (1)..( 8): Matrix.003 file - promoters60/4773068
gaaataaa

SEQ ID NO: 60734 - DNA, 7 bp, Unknown
  misc_feature (1)..( 7): Matrix.003 file - promoters60/4773068
caaattt

SEQ ID NO: 60735 - DNA, 6 bp, Unknown
  misc_feature (1)..( 6): Matrix.003 file - promoters60/4773068
ttaaaa

SEQ ID NO: 60736 - DNA, 6 bp, Unknown
  misc_feature (1)..( 6): Matrix.003 file - promoters60/4773068
gtaacg

SEQ ID NO: 60737 - DNA, 7 bp, Unknown
  misc_feature (1)..( 7): Matrix.003 file - promoters60/4773068
gtggtta

SEQ ID NO: 60738 - DNA, 10 bp, Unknown
  misc_feature (1)..( 10): Matrix.003 file - promoters60/4773068
tacgtgtcaa

SEQ ID NO: 60739 - DNA, 20 bp, Unknown
  misc_feature (1)..( 20): Matrix.003 file - promoters60/4773068
ttggctattgcttcaccgcc

SEQ ID NO: 60740 - DNA, 16 bp, Unknown
  misc_feature (1)..( 16): Matrix.003 file - promoters60/4773068
gaccgagtcgtcctcg

SEQ ID NO: 60741 - DNA, 19 bp, Unknown
  misc_feature (1)..( 19): Matrix.003 file - promoters60/4773068
ttcttcttctataaatcaa

SEQ ID NO: 60742 - DNA, 6 bp, Unknown
  misc_feature (1)..( 6): Matrix.003 file - promoters60/4773068
gcttct

SEQ ID NO: 60743 - DNA, 8 bp, Unknown
  misc_feature (1)..( 8): Matrix.003 file - promoters60/4773068
ttctggcc

SEQ ID NO: 60744 - DNA, 7 bp, Unknown
  misc_feature (1)..( 7): Matrix.003 file - promoters60/4773068
tacatat

SEQ ID NO: 60745 - DNA, 15 bp, Unknown
  misc_feature (1)..( 15): Matrix.003 file - promoters60/4773068
cgccttagctttctc

SEQ ID NO: 60746 - DNA, 6 bp, Unknown
  misc_feature (1)..( 6): Matrix.003 file - promoters60/4773068
tttttt

SEQ ID NO: 60747 - DNA, 9 bp, Unknown
  misc_feature (1)..( 9): Matrix.003 file - promoters60/4773068
acaaaaagg

SEQ ID NO: 60748 - DNA, 7 bp, Unknown
  misc_feature (1)..( 7): Matrix.003 file - promoters60/4773068
acgaaga

SEQ ID NO: 60749 - DNA, 6 bp, Unknown
  misc_feature (1)..( 6): Matrix.003 file - promoters60/4773068
gttcaa

SEQ ID NO: 60750 - DNA, 6 bp, Unknown
  misc_feature (1)..( 6): Matrix.003 file - promoters60/4773068
gtatat

SEQ ID NO: 60751 - DNA, 9 bp, Unknown
  misc_feature (1)..( 9): Matrix.003 file - promoters60/4773068
atctaatga

SEQ ID NO: 60752 - DNA, 6 bp, Unknown
  misc_feature (1)..( 6): Matrix.003 file - promoters60/4773068
tcagta

SEQ ID NO: 60753 - DNA, 6 bp, Unknown
  misc_feature (1)..( 6): Matrix.003 file - promoters60/4773068
aacaac

SEQ ID NO: 60754 - DNA, 15 bp, Unknown
  misc_feature (1)..( 15): Matrix.003 file - promoters60/4773068
aatacccaaagagct

SEQ ID NO: 60755 - DNA, 10 bp, Unknown
  misc_feature (1)..( 10): Matrix.003 file - promoters60/4773074
aaagcttttt

SEQ ID NO: 60756 - DNA, 6 bp, Unknown
  misc_feature (1)..( 6): Matrix.003 file - promoters60/4773077
atccaa

SEQ ID NO: 60757 - DNA, 6 bp, Unknown
  misc_feature (1)..( 6): Matrix.003 file - promoters60/4773077
ctcctc

SEQ ID NO: 60758 - DNA, 7 bp, Unknown
  misc_feature (1)..( 7): Matrix.003 file - promoters60/4773077
accactc

SEQ ID NO: 60759 - DNA, 8 bp, Unknown
  misc_feature (1)..( 8): Matrix.003 file - promoters60/4773077
ctctctca

SEQ ID NO: 60760 - DNA, 6 bp, Unknown
  misc_feature (1)..( 6): Matrix.003 file - promoters60/4773077
tctttc

SEQ ID NO: 60761 - DNA, 8 bp, Unknown
  misc_feature (1)..( 8): Matrix.003 file - promoters60/4773077
tatcttct

SEQ ID NO: 60762 - DNA, 9 bp, Unknown
  misc_feature (1)..( 9): Matrix.003 file - promoters60/4773077
tctcgctaa

SEQ ID NO: 60763 - DNA, 8 bp, Unknown
  misc_feature (1)..( 8): Matrix.003 file - promoters60/4773077
tttagctt

SEQ ID NO: 60764 - DNA, 6 bp, Unknown
  misc_feature (1)..( 6): Matrix.003 file - promoters60/4773077
gaatta

SEQ ID NO: 60765 - DNA, 6 bp, Unknown
  misc_feature (1)..( 6): Matrix.003 file - promoters60/4773077
gcggaa

SEQ ID NO: 60766 - DNA, 6 bp, Unknown
  misc_feature (1)..( 6): Matrix.003 file - promoters60/4773077
aaagaa

SEQ ID NO: 60767 - DNA, 6 bp, Unknown
  misc_feature (1)..( 6): Matrix.003 file - promoters60/4773077
tccttg

SEQ ID NO: 60768 - DNA, 7 bp, Unknown
  misc_feature (1)..( 7): Matrix.003 file - promoters60/4773077
gatatat

SEQ ID NO: 60769 - DNA, 9 bp, Unknown
  misc_feature (1)..( 9): Matrix.003 file - promoters60/4773089
caaaaaaat

SEQ ID NO: 60770 - DNA, 9 bp, Unknown
  misc_feature (1)..( 9): Matrix.003 file - promoters60/4773089
ataaaattt

SEQ ID NO: 60771 - DNA, 12 bp, Unknown
  misc_feature (1)..( 12): Matrix.003 file - promoters60/4773089
aaaaaatacaac

SEQ ID NO: 60772 - DNA, 10 bp, Unknown
  misc_feature (1)..( 10): Matrix.003 file - promoters60/4773089
aaaatttatt

SEQ ID NO: 60773 - DNA, 12 bp, Unknown
  misc_feature (1)..( 12): Matrix.003 file - promoters60/4773089
aaaataaactta

SEQ ID NO: 60774 - DNA, 7 bp, Unknown
  misc_feature (1)..( 7): Matrix.003 file - promoters60/4773093
tttccca

SEQ ID NO: 60775 - DNA, 7 bp, Unknown
  misc_feature (1)..( 7): Matrix.003 file - promoters60/4773093
gcaaatt

SEQ ID NO: 60776 - DNA, 6 bp, Unknown
  misc_feature (1)..( 6): Matrix.003 file - promoters60/4773093
tttgat

SEQ ID NO: 60777 - DNA, 7 bp, Unknown
  misc_feature (1)..( 7): Matrix.003 file - promoters60/4773093
tttttat

SEQ ID NO: 60778 - DNA, 8 bp, Unknown
  misc_feature (1)..( 8): Matrix.003 file - promoters60/4773093
attttttt

SEQ ID NO: 60779 - DNA, 6 bp, Unknown
  misc_feature (1)..( 6): Matrix.003 file - promoters60/4773093
tgttat

SEQ ID NO: 60780 - DNA, 8 bp, Unknown
  misc_feature (1)..( 8): Matrix.003 file - promoters60/4773093
tgtatgtt

SEQ ID NO: 60781 - DNA, 6 bp, Unknown
  misc_feature (1)..( 6): Matrix.003 file - promoters60/4773093
ctctta

SEQ ID NO: 60782 - DNA, 6 bp, Unknown
  misc_feature (1)..( 6): Matrix.003 file - promoters60/4773093
atttaa

SEQ ID NO: 60783 - DNA, 6 bp, Unknown
  misc_feature (1)..( 6): Matrix.003 file - promoters60/4773093
aaattt

SEQ ID NO: 60784 - DNA, 10 bp, Unknown
  misc_feature (1)..( 10): Matrix.003 file - promoters60/4773093
aatattgggc

SEQ ID NO: 60785 - DNA, 7 bp, Unknown
  misc_feature (1)..( 7): Matrix.003 file - promoters60/4773093
attgggc

SEQ ID NO: 60786 - DNA, 7 bp, Unknown
  misc_feature (1)..( 7): Matrix.003 file - promoters60/4773093
tatatga

SEQ ID NO: 60787 - DNA, 7 bp, Unknown
  misc_feature (1)..( 7): Matrix.003 file - promoters60/4773093
ctagaaa

SEQ ID NO: 60788 - DNA, 7 bp, Unknown
  misc_feature (1)..( 7): Matrix.003 file - promoters60/4773093
tttctct

SEQ ID NO: 60789 - DNA, 7 bp, Unknown
  misc_feature (1)..( 7): Matrix.003 file - promoters60/4773093
gttatct

SEQ ID NO: 60790 - DNA, 8 bp, Unknown
  misc_feature (1)..( 8): Matrix.003 file - promoters60/4773093
caatagtc

SEQ ID NO: 60791 - DNA, 7 bp, Unknown
  misc_feature (1)..( 7): Matrix.003 file - promoters60/4773093
aaagcag

SEQ ID NO: 60792 - DNA, 10 bp, Unknown
  misc_feature (1)..( 10): Matrix.003 file - promoters60/4773093
aacttgaaat

SEQ ID NO: 60793 - DNA, 8 bp, Unknown
  misc_feature (1)..( 8): Matrix.003 file - promoters60/4773093
aaccctaa

SEQ ID NO: 60794 - DNA, 8 bp, Unknown
  misc_feature (1)..( 8): Matrix.003 file - promoters60/4773093
ttaccaat

SEQ ID NO: 60795 - DNA, 6 bp, Unknown
  misc_feature (1)..( 6): Matrix.003 file - promoters60/4773093
tgttcc

SEQ ID NO: 60796 - DNA, 6 bp, Unknown
  misc_feature (1)..( 6): Matrix.003 file - promoters60/4773093
tgtttt

SEQ ID NO: 60797 - DNA, 6 bp, Unknown
  misc_feature (1)..( 6): Matrix.003 file - promoters60/4773093
tgattt

SEQ ID NO: 60798 - DNA, 7 bp, Unknown
  misc_feature (1)..( 7): Matrix.003 file - promoters60/4773093
tatcgtc

SEQ ID NO: 60799 - DNA, 8 bp, Unknown
  misc_feature (1)..( 8): Matrix.003 file - promoters60/4773093
ccttcttg

SEQ ID NO: 60800 - DNA, 6 bp, Unknown
  misc_feature (1)..( 6): Matrix.003 file - promoters60/4773093
aaccaa

SEQ ID NO: 60801 - DNA, 7 bp, Unknown
  misc_feature (1)..( 7): Matrix.003 file - promoters60/4773093
tatcaaa

SEQ ID NO: 60802 - DNA, 8 bp, Unknown
  misc_feature (1)..( 8): Matrix.003 file - promoters60/4773093
aaacaaga

SEQ ID NO: 60803 - DNA, 7 bp, Unknown
  misc_feature (1)..( 7): Matrix.003 file - promoters60/4773112
tgtattt

SEQ ID NO: 60804 - DNA, 8 bp, Unknown
  misc_feature (1)..( 8): Matrix.003 file - promoters60/4773112
cattcgga

SEQ ID NO: 60805 - DNA, 9 bp, Unknown
  misc_feature (1)..( 9): Matrix.003 file - promoters60/4773112
tgttaattt

SEQ ID NO: 60806 - DNA, 7 bp, Unknown
  misc_feature (1)..( 7): Matrix.003 file - promoters60/4773112
acaaatg

SEQ ID NO: 60807 - DNA, 6 bp, Unknown
  misc_feature (1)..( 6): Matrix.003 file - promoters60/4773112
ttcata

SEQ ID NO: 60808 - DNA, 7 bp, Unknown
  misc_feature (1)..( 7): Matrix.003 file - promoters60/4773112
tatatta

SEQ ID NO: 60809 - DNA, 6 bp, Unknown
  misc_feature (1)..( 6): Matrix.003 file - promoters60/4773112
tagtat

SEQ ID NO: 60810 - DNA, 11 bp, Unknown
  misc_feature (1)..( 11): Matrix.003 file - promoters60/4773112
aaactttattt

SEQ ID NO: 60811 - DNA, 8 bp, Unknown
  misc_feature (1)..( 8): Matrix.003 file - promoters60/4773112
ttaaattt

SEQ ID NO: 60812 - DNA, 7 bp, Unknown
  misc_feature (1)..( 7): Matrix.003 file - promoters60/4773112
tttagat

SEQ ID NO: 60813 - DNA, 6 bp, Unknown
  misc_feature (1)..( 6): Matrix.003 file - promoters60/4773112
tttttt

SEQ ID NO: 60814 - DNA, 7 bp, Unknown
  misc_feature (1)..( 7): Matrix.003 file - promoters60/4773112
atattat

SEQ ID NO: 60815 - DNA, 7 bp, Unknown
  misc_feature (1)..( 7): Matrix.003 file - promoters60/4773112
ttaattt

SEQ ID NO: 60816 - DNA, 6 bp, Unknown
  misc_feature (1)..( 6): Matrix.003 file - promoters60/4773112
tttaaa

SEQ ID NO: 60817 - DNA, 9 bp, Unknown
  misc_feature (1)..( 9): Matrix.003 file - promoters60/4773112
aatattttt

SEQ ID NO: 60818 - DNA, 6 bp, Unknown
  misc_feature (1)..( 6): Matrix.003 file - promoters60/4773112
atatcc

SEQ ID NO: 60819 - DNA, 7 bp, Unknown
  misc_feature (1)..( 7): Matrix.003 file - promoters60/4773112
cggatat

SEQ ID NO: 60820 - DNA, 6 bp, Unknown
  misc_feature (1)..( 6): Matrix.003 file - promoters60/4773112
gtttca

SEQ ID NO: 60821 - DNA, 6 bp, Unknown
  misc_feature (1)..( 6): Matrix.003 file - promoters60/4773112
cattcg

SEQ ID NO: 60822 - DNA, 6 bp, Unknown
  misc_feature (1)..( 6): Matrix.003 file - promoters60/4773112
ttttat

SEQ ID NO: 60823 - DNA, 6 bp, Unknown
  misc_feature (1)..( 6): Matrix.003 file - promoters60/4773112
tatata

SEQ ID NO: 60824 - DNA, 7 bp, Unknown
  misc_feature (1)..( 7): Matrix.003 file - promoters60/4773112
tatccat

SEQ ID NO: 60825 - DNA, 6 bp, Unknown
  misc_feature (1)..( 6): Matrix.003 file - promoters60/4773112
tggtta

SEQ ID NO: 60826 - DNA, 6 bp, Unknown
  misc_feature (1)..( 6): Matrix.003 file - promoters60/4773112
ttcggt

SEQ ID NO: 60827 - DNA, 7 bp, Unknown
  misc_feature (1)..( 7): Matrix.003 file - promoters60/4773112
ggtttag

SEQ ID NO: 60828 - DNA, 7 bp, Unknown
  misc_feature (1)..( 7): Matrix.003 file - promoters60/4773124
atatatt

SEQ ID NO: 60829 - DNA, 6 bp, Unknown
  misc_feature (1)..( 6): Matrix.003 file - promoters60/4773124
acaaat

SEQ ID NO: 60830 - DNA, 6 bp, Unknown
  misc_feature (1)..( 6): Matrix.003 file - promoters60/4773124
ttctaa

SEQ ID NO: 60831 - DNA, 9 bp, Unknown
  misc_feature (1)..( 9): Matrix.003 file - promoters60/4773124
taactaaaa

SEQ ID NO: 60832 - DNA, 7 bp, Unknown
  misc_feature (1)..( 7): Matrix.003 file - promoters60/4773124
taaaaac

SEQ ID NO: 60833 - DNA, 6 bp, Unknown
  misc_feature (1)..( 6): Matrix.003 file - promoters60/4773124
aagaaa

SEQ ID NO: 60834 - DNA, 7 bp, Unknown
  misc_feature (1)..( 7): Matrix.003 file - promoters60/4773124
taattag

SEQ ID NO: 60835 - DNA, 8 bp, Unknown
  misc_feature (1)..( 8): Matrix.003 file - promoters60/4773124
tgttgttg

SEQ ID NO: 60836 - DNA, 6 bp, Unknown
  misc_feature (1)..( 6): Matrix.003 file - promoters60/4773124
ttttct

SEQ ID NO: 60837 - DNA, 8 bp, Unknown
  misc_feature (1)..( 8): Matrix.003 file - promoters60/4773124
tttgattc

SEQ ID NO: 60838 - DNA, 7 bp, Unknown
  misc_feature (1)..( 7): Matrix.003 file - promoters60/4773124
gaattct

SEQ ID NO: 60839 - DNA, 6 bp, Unknown
  misc_feature (1)..( 6): Matrix.003 file - promoters60/4773124
tctctt

SEQ ID NO: 60840 - DNA, 8 bp, Unknown
  misc_feature (1)..( 8): Matrix.003 file - promoters60/4773124
tgatcttt

SEQ ID NO: 60841 - DNA, 6 bp, Unknown
  misc_feature (1)..( 6): Matrix.003 file - promoters60/4773124
aatctc

SEQ ID NO: 60842 - DNA, 7 bp, Unknown
  misc_feature (1)..( 7): Matrix.003 file - promoters60/4773124
ttaactc

SEQ ID NO: 60843 - DNA, 6 bp, Unknown
  misc_feature (1)..( 6): Matrix.003 file - promoters60/4773124
ttcata

SEQ ID NO: 60844 - DNA, 8 bp, Unknown
  misc_feature (1)..( 8): Matrix.003 file - promoters60/4773127
caatgtgt

SEQ ID NO: 60845 - DNA, 10 bp, Unknown
  misc_feature (1)..( 10): Matrix.003 file - promoters60/4773127
atataatttt

SEQ ID NO: 60846 - DNA, 8 bp, Unknown
  misc_feature (1)..( 8): Matrix.003 file - promoters60/4773127
aaaccaaa

SEQ ID NO: 60847 - DNA, 7 bp, Unknown
  misc_feature (1)..( 7): Matrix.003 file - promoters60/4773127
tcgtcaa

SEQ ID NO: 60848 - DNA, 7 bp, Unknown
  misc_feature (1)..( 7): Matrix.003 file - promoters60/4773127
aaacaaa

SEQ ID NO: 60849 - DNA, 8 bp, Unknown
  misc_feature (1)..( 8): Matrix.003 file - promoters60/4773127
taaatata

SEQ ID NO: 60850 - DNA, 8 bp, Unknown
  misc_feature (1)..( 8): Matrix.003 file - promoters60/4773127
taatatta

SEQ ID NO: 60851 - DNA, 6 bp, Unknown
  misc_feature (1)..( 6): Matrix.003 file - promoters60/4773127
tttaaa

SEQ ID NO: 60852 - DNA, 10 bp, Unknown
  misc_feature (1)..( 10): Matrix.003 file - promoters60/4773127
ttaaaaattc

SEQ ID NO: 60853 - DNA, 7 bp, Unknown
  misc_feature (1)..( 7): Matrix.003 file - promoters60/4773127
gttggtt

SEQ ID NO: 60854 - DNA, 7 bp, Unknown
  misc_feature (1)..( 7): Matrix.003 file - promoters60/4773127
aaccgaa

SEQ ID NO: 60855 - DNA, 11 bp, Unknown
  misc_feature (1)..( 11): Matrix.003 file - promoters60/4773127
aatccaaacac

SEQ ID NO: 60856 - DNA, 9 bp, Unknown
  misc_feature (1)..( 9): Matrix.003 file - promoters60/4773127
tgtcgcata

SEQ ID NO: 60857 - DNA, 7 bp, Unknown
  misc_feature (1)..( 7): Matrix.003 file - promoters60/4773127
tttattg

SEQ ID NO: 60858 - DNA, 5 bp, Unknown
  misc_feature (1)..( 5): Matrix.003 file - promoters60/4773134
tattt

SEQ ID NO: 60859 - DNA, 8 bp, Unknown
  misc_feature (1)..( 8): Matrix.003 file - promoters60/4773134
aattttgg

SEQ ID NO: 60860 - DNA, 8 bp, Unknown
  misc_feature (1)..( 8): Matrix.003 file - promoters60/4773134
attacaca

SEQ ID NO: 60861 - DNA, 14 bp, Unknown
  misc_feature (1)..( 14): Matrix.003 file - promoters60/4773134
atttaatagtcatt

SEQ ID NO: 60862 - DNA, 9 bp, Unknown
  misc_feature (1)..( 9): Matrix.003 file - promoters60/4773134
tatttgatt

SEQ ID NO: 60863 - DNA, 10 bp, Unknown
  misc_feature (1)..( 10): Matrix.003 file - promoters60/4773182
aacttcatta

SEQ ID NO: 60864 - DNA, 10 bp, Unknown
  misc_feature (1)..( 10): Matrix.003 file - promoters60/4773185
aaataataaa

SEQ ID NO: 60865 - DNA, 12 bp, Unknown
  misc_feature (1)..( 12): Matrix.003 file - promoters60/4773185
aaatagaataaa

SEQ ID NO: 60866 - DNA, 11 bp, Unknown
  misc_feature (1)..( 11): Matrix.003 file - promoters60/4773185
atataaaatag

SEQ ID NO: 60867 - DNA, 8 bp, Unknown
  misc_feature (1)..( 8): Matrix.003 file - promoters60/4773185
aaaacaat

SEQ ID NO: 60868 - DNA, 9 bp, Unknown
  misc_feature (1)..( 9): Matrix.003 file - promoters60/4773185
aaatattac

SEQ ID NO: 60869 - DNA, 6 bp, Unknown
  misc_feature (1)..( 6): Matrix.003 file - promoters60/4773187
ttttta

SEQ ID NO: 60870 - DNA, 8 bp, Unknown
  misc_feature (1)..( 8): Matrix.003 file - promoters60/4773187
cttatgtt

SEQ ID NO: 60871 - DNA, 13 bp, Unknown
  misc_feature (1)..( 13): Matrix.003 file - promoters60/4773187
atatattttattt

SEQ ID NO: 60872 - DNA, 8 bp, Unknown
  misc_feature (1)..( 8): Matrix.003 file - promoters60/4773187
gtatataa

SEQ ID NO: 60873 - DNA, 6 bp, Unknown
  misc_feature (1)..( 6): Matrix.003 file - promoters60/4773187
aattta

SEQ ID NO: 60874 - DNA, 7 bp, Unknown
  misc_feature (1)..( 7): Matrix.003 file - promoters60/4773187
taaaata

SEQ ID NO: 60875 - DNA, 6 bp, Unknown
  misc_feature (1)..( 6): Matrix.003 file - promoters60/4773187
aaaaaa

SEQ ID NO: 60876 - DNA, 7 bp, Unknown
  misc_feature (1)..( 7): Matrix.003 file - promoters60/4773187
atacaaa

SEQ ID NO: 60877 - DNA, 6 bp, Unknown
  misc_feature (1)..( 6): Matrix.003 file - promoters60/4773187
atgtct

SEQ ID NO: 60878 - DNA, 7 bp, Unknown
  misc_feature (1)..( 7): Matrix.003 file - promoters60/4773187
ttggaga

SEQ ID NO: 60879 - DNA, 6 bp, Unknown
  misc_feature (1)..( 6): Matrix.003 file - promoters60/4773187
gaagat

SEQ ID NO: 60880 - DNA, 6 bp, Unknown
  misc_feature (1)..( 6): Matrix.003 file - promoters60/4773187
gatcga

SEQ ID NO: 60881 - DNA, 6 bp, Unknown
  misc_feature (1)..( 6): Matrix.003 file - promoters60/4773187
aaatgc

SEQ ID NO: 60882 - DNA, 8 bp, Unknown
  misc_feature (1)..( 8): Matrix.003 file - promoters60/4773187
ggacttgt

SEQ ID NO: 60883 - DNA, 7 bp, Unknown
  misc_feature (1)..( 7): Matrix.003 file - promoters60/4773205
tcataaa

SEQ ID NO: 60884 - DNA, 7 bp, Unknown
  misc_feature (1)..( 7): Matrix.003 file - promoters60/4773205
ataatta

SEQ ID NO: 60885 - DNA, 7 bp, Unknown
  misc_feature (1)..( 7): Matrix.003 file - promoters60/4773205
tttaaaa

SEQ ID NO: 60886 - DNA, 6 bp, Unknown
  misc_feature (1)..( 6): Matrix.003 file - promoters60/4773205
atttac

SEQ ID NO: 60887 - DNA, 6 bp, Unknown
  misc_feature (1)..( 6): Matrix.003 file - promoters60/4773205
ataaaa

SEQ ID NO: 60888 - DNA, 10 bp, Unknown
  misc_feature (1)..( 10): Matrix.003 file - promoters60/4773205
aaaacaattt

SEQ ID NO: 60889 - DNA, 7 bp, Unknown
  misc_feature (1)..( 7): Matrix.003 file - promoters60/4773205
aaaagaa

SEQ ID NO: 60890 - DNA, 8 bp, Unknown
  misc_feature (1)..( 8): Matrix.003 file - promoters60/4773205
tgaaacag

SEQ ID NO: 60891 - DNA, 7 bp, Unknown
  misc_feature (1)..( 7): Matrix.003 file - promoters60/4773205
gatcact

SEQ ID NO: 60892 - DNA, 6 bp, Unknown
  misc_feature (1)..( 6): Matrix.003 file - promoters60/4773205
ttttat

SEQ ID NO: 60893 - DNA, 7 bp, Unknown
  misc_feature (1)..( 7): Matrix.003 file - promoters60/4773205
tatgata

SEQ ID NO: 60894 - DNA, 6 bp, Unknown
  misc_feature (1)..( 6): Matrix.003 file - promoters60/4773205
atggtt

SEQ ID NO: 60895 - DNA, 6 bp, Unknown
  misc_feature (1)..( 6): Matrix.003 file - promoters60/4773205
gagttc

SEQ ID NO: 60896 - DNA, 6 bp, Unknown
  misc_feature (1)..( 6): Matrix.003 file - promoters60/4773205
taaaaa

SEQ ID NO: 60897 - DNA, 6 bp, Unknown
  misc_feature (1)..( 6): Matrix.003 file - promoters60/4773205
cccaaa

SEQ ID NO: 60898 - DNA, 6 bp, Unknown
  misc_feature (1)..( 6): Matrix.003 file - promoters60/4773205
tttatt

SEQ ID NO: 60899 - DNA, 12 bp, Unknown
  misc_feature (1)..( 12): Matrix.003 file - promoters60/4773205
aataatgatgat

SEQ ID NO: 60900 - DNA, 6 bp, Unknown
  misc_feature (1)..( 6): Matrix.003 file - promoters60/4773205
ttgttg

SEQ ID NO: 60901 - DNA, 6 bp, Unknown
  misc_feature (1)..( 6): Matrix.003 file - promoters60/4773223
tgcaag

SEQ ID NO: 60902 - DNA, 8 bp, Unknown
  misc_feature (1)..( 8): Matrix.003 file - promoters60/4773223
ttggcact

SEQ ID NO: 60903 - DNA, 9 bp, Unknown
  misc_feature (1)..( 9): Matrix.003 file - promoters60/4773223
tttgatttt

SEQ ID NO: 60904 - DNA, 9 bp, Unknown
  misc_feature (1)..( 9): Matrix.003 file - promoters60/4773223
atttaattt

SEQ ID NO: 60905 - DNA, 7 bp, Unknown
  misc_feature (1)..( 7): Matrix.003 file - promoters60/4773223
tcagttt

SEQ ID NO: 60906 - DNA, 8 bp, Unknown
  misc_feature (1)..( 8): Matrix.003 file - promoters60/4773223
taaagtga

SEQ ID NO: 60907 - DNA, 7 bp, Unknown
  misc_feature (1)..( 7): Matrix.003 file - promoters60/4773223
ataattg

SEQ ID NO: 60908 - DNA, 6 bp, Unknown
  misc_feature (1)..( 6): Matrix.003 file - promoters60/4773223
tatagg

SEQ ID NO: 60909 - DNA, 8 bp, Unknown
  misc_feature (1)..( 8): Matrix.003 file - promoters60/4773223
gccatgaa

SEQ ID NO: 60910 - DNA, 8 bp, Unknown
  misc_feature (1)..( 8): Matrix.003 file - promoters60/4773223
ctgcgatt

SEQ ID NO: 60911 - DNA, 7 bp, Unknown
  misc_feature (1)..( 7): Matrix.003 file - promoters60/4773223
gatacag

SEQ ID NO: 60912 - DNA, 6 bp, Unknown
  misc_feature (1)..( 6): Matrix.003 file - promoters60/4773223
attcca

SEQ ID NO: 60913 - DNA, 7 bp, Unknown
  misc_feature (1)..( 7): Matrix.003 file - promoters60/4773223
aaacctg

SEQ ID NO: 60914 - DNA, 6 bp, Unknown
  misc_feature (1)..( 6): Matrix.003 file - promoters60/4773223
tttgac

SEQ ID NO: 60915 - DNA, 6 bp, Unknown
  misc_feature (1)..( 6): Matrix.003 file - promoters60/4773223
acggta

SEQ ID NO: 60916 - DNA, 7 bp, Unknown
  misc_feature (1)..( 7): Matrix.003 file - promoters60/4773223
tcaagtt

SEQ ID NO: 60917 - DNA, 9 bp, Unknown
  misc_feature (1)..( 9): Matrix.003 file - promoters60/4773225
atttagctt

SEQ ID NO: 60918 - DNA, 6 bp, Unknown
  misc_feature (1)..( 6): Matrix.003 file - promoters60/4773225
ttaaaa

SEQ ID NO: 60919 - DNA, 7 bp, Unknown
  misc_feature (1)..( 7): Matrix.003 file - promoters60/4773225
taaaata

SEQ ID NO: 60920 - DNA, 7 bp, Unknown
  misc_feature (1)..( 7): Matrix.003 file - promoters60/4773225
ctgaaaa

SEQ ID NO: 60921 - DNA, 6 bp, Unknown
  misc_feature (1)..( 6): Matrix.003 file - promoters60/4773225
tccaaa

SEQ ID NO: 60922 - DNA, 9 bp, Unknown
  misc_feature (1)..( 9): Matrix.003 file - promoters60/4773225
aaaaaataa

SEQ ID NO: 60923 - DNA, 7 bp, Unknown
  misc_feature (1)..( 7): Matrix.003 file - promoters60/4773225
cgaaaaa

SEQ ID NO: 60924 - DNA, 8 bp, Unknown
  misc_feature (1)..( 8): Matrix.003 file - promoters60/4773225
cgaggtca

SEQ ID NO: 60925 - DNA, 7 bp, Unknown
  misc_feature (1)..( 7): Matrix.003 file - promoters60/4773225
attagca

SEQ ID NO: 60926 - DNA, 8 bp, Unknown
  misc_feature (1)..( 8): Matrix.003 file - promoters60/4773225
ataattat

SEQ ID NO: 60927 - DNA, 6 bp, Unknown
  misc_feature (1)..( 6): Matrix.003 file - promoters60/4773225
gaatta

SEQ ID NO: 60928 - DNA, 6 bp, Unknown
  misc_feature (1)..( 6): Matrix.003 file - promoters60/4773225
gcggaa

SEQ ID NO: 60929 - DNA, 7 bp, Unknown
  misc_feature (1)..( 7): Matrix.003 file - promoters60/4773225
tatcttc

SEQ ID NO: 60930 - DNA, 6 bp, Unknown
  misc_feature (1)..( 6): Matrix.003 file - promoters60/4773225
tccttg

SEQ ID NO: 60931 - DNA, 7 bp, Unknown
  misc_feature (1)..( 7): Matrix.003 file - promoters60/4773225
gatatat

SEQ ID NO: 60932 - DNA, 6 bp, Unknown
  misc_feature (1)..( 6): Matrix.003 file - promoters60/4773229
caagac

SEQ ID NO: 60933 - DNA, 8 bp, Unknown
  misc_feature (1)..( 8): Matrix.003 file - promoters60/4773229
tggaaaga

SEQ ID NO: 60934 - DNA, 6 bp, Unknown
  misc_feature (1)..( 6): Matrix.003 file - promoters60/4773229
tattga

SEQ ID NO: 60935 - DNA, 8 bp, Unknown
  misc_feature (1)..( 8): Matrix.003 file - promoters60/4773229
aggaaaag

SEQ ID NO: 60936 - DNA, 6 bp, Unknown
  misc_feature (1)..( 6): Matrix.003 file - promoters60/4773229
aagcag

SEQ ID NO: 60937 - DNA, 6 bp, Unknown
  misc_feature (1)..( 6): Matrix.003 file - promoters60/4773229
gagtcg

SEQ ID NO: 60938 - DNA, 8 bp, Unknown
  misc_feature (1)..( 8): Matrix.003 file - promoters60/4773229
ttgtcaag

SEQ ID NO: 60939 - DNA, 7 bp, Unknown
  misc_feature (1)..( 7): Matrix.003 file - promoters60/4773229
tgacact

SEQ ID NO: 60940 - DNA, 6 bp, Unknown
  misc_feature (1)..( 6): Matrix.003 file - promoters60/4773229
gatcca

SEQ ID NO: 60941 - DNA, 9 bp, Unknown
  misc_feature (1)..( 9): Matrix.003 file - promoters60/4773229
cttatcttt

SEQ ID NO: 60942 - DNA, 6 bp, Unknown
  misc_feature (1)..( 6): Matrix.003 file - promoters60/4773229
aagaag

SEQ ID NO: 60943 - DNA, 9 bp, Unknown
  misc_feature (1)..( 9): Matrix.003 file - promoters60/4773229
agaaaaatc

SEQ ID NO: 60944 - DNA, 9 bp, Unknown
  misc_feature (1)..( 9): Matrix.003 file - promoters60/4773229
atatgatga

SEQ ID NO: 60945 - DNA, 7 bp, Unknown
  misc_feature (1)..( 7): Matrix.003 file - promoters60/4773229
atcattt

SEQ ID NO: 60946 - DNA, 7 bp, Unknown
  misc_feature (1)..( 7): Matrix.003 file - promoters60/4773229
tttactt

SEQ ID NO: 60947 - DNA, 7 bp, Unknown
  misc_feature (1)..( 7): Matrix.003 file - promoters60/4773229
aataatt

SEQ ID NO: 60948 - DNA, 8 bp, Unknown
  misc_feature (1)..( 8): Matrix.003 file - promoters60/4773229
aatagaaa

SEQ ID NO: 60949 - DNA, 7 bp, Unknown
  misc_feature (1)..( 7): Matrix.003 file - promoters60/4773229
aaaatgt

SEQ ID NO: 60950 - DNA, 6 bp, Unknown
  misc_feature (1)..( 6): Matrix.003 file - promoters60/4773229
tctttt

SEQ ID NO: 60951 - DNA, 6 bp, Unknown
  misc_feature (1)..( 6): Matrix.003 file - promoters60/4773229
ggaaaa

SEQ ID NO: 60952 - DNA, 7 bp, Unknown
  misc_feature (1)..( 7): Matrix.003 file - promoters60/4773245
attccat

SEQ ID NO: 60953 - DNA, 7 bp, Unknown
  misc_feature (1)..( 7): Matrix.003 file - promoters60/4773245
cacacaa

SEQ ID NO: 60954 - DNA, 5 bp, Unknown
  misc_feature (1)..( 5): Matrix.003 file - promoters60/4773245
ctctt

SEQ ID NO: 60955 - DNA, 6 bp, Unknown
  misc_feature (1)..( 6): Matrix.003 file - promoters60/4773245
ccaatg

SEQ ID NO: 60956 - DNA, 7 bp, Unknown
  misc_feature (1)..( 7): Matrix.003 file - promoters60/4773245
aaaactc

SEQ ID NO: 60957 - DNA, 6 bp, Unknown
  misc_feature (1)..( 6): Matrix.003 file - promoters60/4773245
attgtt

SEQ ID NO: 60958 - DNA, 6 bp, Unknown
  misc_feature (1)..( 6): Matrix.003 file - promoters60/4773245
actgaa

SEQ ID NO: 60959 - DNA, 7 bp, Unknown
  misc_feature (1)..( 7): Matrix.003 file - promoters60/4773245
gaaggtg

SEQ ID NO: 60960 - DNA, 7 bp, Unknown
  misc_feature (1)..( 7): Matrix.003 file - promoters60/4773245
acaagta

SEQ ID NO: 60961 - DNA, 6 bp, Unknown
  misc_feature (1)..( 6): Matrix.003 file - promoters60/4773245
ccaaaa

SEQ ID NO: 60962 - DNA, 7 bp, Unknown
  misc_feature (1)..( 7): Matrix.003 file - promoters60/4773245
ttgcaga

SEQ ID NO: 60963 - DNA, 6 bp, Unknown
  misc_feature (1)..( 6): Matrix.003 file - promoters60/4773245
ggagat

SEQ ID NO: 60964 - DNA, 8 bp, Unknown
  misc_feature (1)..( 8): Matrix.003 file - promoters60/4773245
tgcaaaga

SEQ ID NO: 60965 - DNA, 7 bp, Unknown
  misc_feature (1)..( 7): Matrix.003 file - promoters60/4773245
aacacca

SEQ ID NO: 60966 - DNA, 7 bp, Unknown
  misc_feature (1)..( 7): Matrix.003 file - promoters60/4773245
ttcaatt

SEQ ID NO: 60967 - DNA, 8 bp, Unknown
  misc_feature (1)..( 8): Matrix.003 file - promoters60/4773264
attggaga

SEQ ID NO: 60968 - DNA, 8 bp, Unknown
  misc_feature (1)..( 8): Matrix.003 file - promoters60/4773264
tagtaatt

SEQ ID NO: 60969 - DNA, 8 bp, Unknown
  misc_feature (1)..( 8): Matrix.003 file - promoters60/4773264
tttgcgtg

SEQ ID NO: 60970 - DNA, 6 bp, Unknown
  misc_feature (1)..( 6): Matrix.003 file - promoters60/4773264
gagatc

SEQ ID NO: 60971 - DNA, 7 bp, Unknown
  misc_feature (1)..( 7): Matrix.003 file - promoters60/4773264
taacgaa

SEQ ID NO: 60972 - DNA, 7 bp, Unknown
  misc_feature (1)..( 7): Matrix.003 file - promoters60/4773264
agtatta

SEQ ID NO: 60973 - DNA, 6 bp, Unknown
  misc_feature (1)..( 6): Matrix.003 file - promoters60/4773264
tttgag

SEQ ID NO: 60974 - DNA, 8 bp, Unknown
  misc_feature (1)..( 8): Matrix.003 file - promoters60/4773264
tatgtctc

SEQ ID NO: 60975 - DNA, 8 bp, Unknown
  misc_feature (1)..( 8): Matrix.003 file - promoters60/4773264
ttgttttt

SEQ ID NO: 60976 - DNA, 8 bp, Unknown
  misc_feature (1)..( 8): Matrix.003 file - promoters60/4773264
ttttaact

SEQ ID NO: 60977 - DNA, 8 bp, Unknown
  misc_feature (1)..( 8): Matrix.003 file - promoters60/4773264
aaagcaaa

SEQ ID NO: 60978 - DNA, 6 bp, Unknown
  misc_feature (1)..( 6): Matrix.003 file - promoters60/4773264
atacaa

SEQ ID NO: 60979 - DNA, 7 bp, Unknown
  misc_feature (1)..( 7): Matrix.003 file - promoters60/4773264
agaaaat

SEQ ID NO: 60980 - DNA, 7 bp, Unknown
  misc_feature (1)..( 7): Matrix.003 file - promoters60/4773264
tctctga

SEQ ID NO: 60981 - DNA, 6 bp, Unknown
  misc_feature (1)..( 6): Matrix.003 file - promoters60/4773264
ttaaaa

SEQ ID NO: 60982 - DNA, 9 bp, Unknown
  misc_feature (1)..( 9): Matrix.003 file - promoters60/4773355
ttaatgttt

SEQ ID NO: 60983 - DNA, 7 bp, Unknown
  misc_feature (1)..( 7): Matrix.003 file - promoters60/4773355
gattaaa

SEQ ID NO: 60984 - DNA, 8 bp, Unknown
  misc_feature (1)..( 8): Matrix.003 file - promoters60/4773355
taatgtct

SEQ ID NO: 60985 - DNA, 9 bp, Unknown
  misc_feature (1)..( 9): Matrix.003 file - promoters60/4773355
aacattata

SEQ ID NO: 60986 - DNA, 11 bp, Unknown
  misc_feature (1)..( 11): Matrix.003 file - promoters60/4773355
ttacttttaac

SEQ ID NO: 60987 - DNA, 9 bp, Unknown
  misc_feature (1)..( 9): Matrix.003 file - promoters60/4773355
ttaacaaaa

SEQ ID NO: 60988 - DNA, 8 bp, Unknown
  misc_feature (1)..( 8): Matrix.003 file - promoters60/4773355
aaacaatt

SEQ ID NO: 60989 - DNA, 7 bp, Unknown
  misc_feature (1)..( 7): Matrix.003 file - promoters60/4773355
taaatta

SEQ ID NO: 60990 - DNA, 6 bp, Unknown
  misc_feature (1)..( 6): Matrix.003 file - promoters60/4773355
ttttct

SEQ ID NO: 60991 - DNA, 12 bp, Unknown
  misc_feature (1)..( 12): Matrix.003 file - promoters60/4773392
ataatatccaat

SEQ ID NO: 60992 - DNA, 6 bp, Unknown
  misc_feature (1)..( 6): Matrix.003 file - promoters60/4773392
aaaaac

SEQ ID NO: 60993 - DNA, 6 bp, Unknown
  misc_feature (1)..( 6): Matrix.003 file - promoters60/4773392
aagttt

SEQ ID NO: 60994 - DNA, 7 bp, Unknown
  misc_feature (1)..( 7): Matrix.003 file - promoters60/4773392
aaatcat

SEQ ID NO: 60995 - DNA, 8 bp, Unknown
  misc_feature (1)..( 8): Matrix.003 file - promoters60/4773392
atatttaa

SEQ ID NO: 60996 - DNA, 6 bp, Unknown
  misc_feature (1)..( 6): Matrix.003 file - promoters60/4773392
agaaag

SEQ ID NO: 60997 - DNA, 7 bp, Unknown
  misc_feature (1)..( 7): Matrix.003 file - promoters60/4773392
aatatgc

SEQ ID NO: 60998 - DNA, 9 bp, Unknown
  misc_feature (1)..( 9): Matrix.003 file - promoters60/4773392
tcagagaaa

SEQ ID NO: 60999 - DNA, 6 bp, Unknown
  misc_feature (1)..( 6): Matrix.003 file - promoters60/4773392
aaagat

SEQ ID NO: 61000 - DNA, 7 bp, Unknown
  misc_feature (1)..( 7): Matrix.003 file - promoters60/4773392
gcacggc

SEQ ID NO: 61001 - DNA, 9 bp, Unknown
  misc_feature (1)..( 9): Matrix.003 file - promoters60/4773392
aaaacaaaa

SEQ ID NO: 61002 - DNA, 6 bp, Unknown
  misc_feature (1)..( 6): Matrix.003 file - promoters60/4773392
tcaaaa

SEQ ID NO: 61003 - DNA, 7 bp, Unknown
  misc_feature (1)..( 7): Matrix.003 file - promoters60/4773392
aaaatta

SEQ ID NO: 61004 - DNA, 7 bp, Unknown
  misc_feature (1)..( 7): Matrix.003 file - promoters60/4773392
atagtat

SEQ ID NO: 61005 - DNA, 6 bp, Unknown
  misc_feature (1)..( 6): Matrix.003 file - promoters60/4773392
tttttt

SEQ ID NO: 61006 - DNA, 7 bp, Unknown
  misc_feature (1)..( 7): Matrix.003 file - promoters60/4773392
tttcttt

SEQ ID NO: 61007 - DNA, 6 bp, Unknown
  misc_feature (1)..( 6): Matrix.003 file - promoters60/4773392
cgttta

SEQ ID NO: 61008 - DNA, 6 bp, Unknown
  misc_feature (1)..( 6): Matrix.003 file - promoters60/4773795
gctttc

SEQ ID NO: 61009 - DNA, 6 bp, Unknown
  misc_feature (1)..( 6): Matrix.003 file - promoters60/4773795
tctctc

SEQ ID NO: 61010 - DNA, 7 bp, Unknown
  misc_feature (1)..( 7): Matrix.003 file - promoters60/4773795
tctcctc

SEQ ID NO: 61011 - DNA, 9 bp, Unknown
  misc_feature (1)..( 9): Matrix.003 file - promoters60/4773795
taaatacaa

SEQ ID NO: 61012 - DNA, 7 bp, Unknown
  misc_feature (1)..( 7): Matrix.003 file - promoters60/4773795
agtggga

SEQ ID NO: 61013 - DNA, 9 bp, Unknown
  misc_feature (1)..( 9): Matrix.003 file - promoters60/4773795
tttaatttt

SEQ ID NO: 61014 - DNA, 6 bp, Unknown
  misc_feature (1)..( 6): Matrix.003 file - promoters60/4773795
ctctgt

SEQ ID NO: 61015 - DNA, 6 bp, Unknown
  misc_feature (1)..( 6): Matrix.003 file - promoters60/4773795
tctatc

SEQ ID NO: 61016 - DNA, 12 bp, Unknown
  misc_feature (1)..( 12): Matrix.003 file - promoters60/4773795
tcaatgatattt

SEQ ID NO: 61017 - DNA, 7 bp, Unknown
  misc_feature (1)..( 7): Matrix.003 file - promoters60/4773795
attaaag

SEQ ID NO: 61018 - DNA, 7 bp, Unknown
  misc_feature (1)..( 7): Matrix.003 file - promoters60/4773795
tgtatat

SEQ ID NO: 61019 - DNA, 8 bp, Unknown
  misc_feature (1)..( 8): Matrix.003 file - promoters60/4773795
tctggttt

SEQ ID NO: 61020 - DNA, 7 bp, Unknown
  misc_feature (1)..( 7): Matrix.003 file - promoters60/4773795
tttactt

SEQ ID NO: 61021 - DNA, 8 bp, Unknown
  misc_feature (1)..( 8): Matrix.003 file - promoters60/4773795
cttgtctc

SEQ ID NO: 61022 - DNA, 7 bp, Unknown
  misc_feature (1)..( 7): Matrix.003 file - promoters60/4773795
ttgaagc

SEQ ID NO: 61023 - DNA, 6 bp, Unknown
  misc_feature (1)..( 6): Matrix.003 file - promoters60/4773795
cctttt

SEQ ID NO: 61024 - DNA, 7 bp, Unknown
  misc_feature (1)..( 7): Matrix.003 file - promoters60/4773795
ttttttt

SEQ ID NO: 61025 - DNA, 7 bp, Unknown
  misc_feature (1)..( 7): Matrix.003 file - promoters60/4773795
ggcctat

SEQ ID NO: 61026 - DNA, 10 bp, Unknown
  misc_feature (1)..( 10): Matrix.003 file - promoters60/4773819
gtataaaaag

SEQ ID NO: 61027 - DNA, 12 bp, Unknown
  misc_feature (1)..( 12): Matrix.003 file - promoters60/4773819
gattcttttcaa

SEQ ID NO: 61028 - DNA, 8 bp, Unknown
  misc_feature (1)..( 8): Matrix.003 file - promoters60/4773819
atttcaaa

SEQ ID NO: 61029 - DNA, 8 bp, Unknown
  misc_feature (1)..( 8): Matrix.003 file - promoters60/4773823
actttctt

SEQ ID NO: 61030 - DNA, 11 bp, Unknown
  misc_feature (1)..( 11): Matrix.003 file - promoters60/4773823
atgttattcta

SEQ ID NO: 61031 - DNA, 13 bp, Unknown
  misc_feature (1)..( 13): Matrix.003 file - promoters60/4773823
aatttgttatttt

SEQ ID NO: 61032 - DNA, 9 bp, Unknown
  misc_feature (1)..( 9): Matrix.003 file - promoters60/4773836
atttatcat

SEQ ID NO: 61033 - DNA, 9 bp, Unknown
  misc_feature (1)..( 9): Matrix.003 file - promoters60/4773836
gtcaaaaaa

SEQ ID NO: 61034 - DNA, 10 bp, Unknown
  misc_feature (1)..( 10): Matrix.003 file - promoters60/4773846
tattaaaaaa

SEQ ID NO: 61035 - DNA, 6 bp, Unknown
  misc_feature (1)..( 6): Matrix.003 file - promoters60/4773846
aataca

SEQ ID NO: 61036 - DNA, 8 bp, Unknown
  misc_feature (1)..( 8): Matrix.003 file - promoters60/4773846
aatttata

SEQ ID NO: 61037 - DNA, 7 bp, Unknown
  misc_feature (1)..( 7): Matrix.003 file - promoters60/4773846
tatggta

SEQ ID NO: 61038 - DNA, 8 bp, Unknown
  misc_feature (1)..( 8): Matrix.003 file - promoters60/4773846
tatccaca

SEQ ID NO: 61039 - DNA, 6 bp, Unknown
  misc_feature (1)..( 6): Matrix.003 file - promoters60/4773846
aataat

SEQ ID NO: 61040 - DNA, 6 bp, Unknown
  misc_feature (1)..( 6): Matrix.003 file - promoters60/4773846
tacttg

SEQ ID NO: 61041 - DNA, 6 bp, Unknown
  misc_feature (1)..( 6): Matrix.003 file - promoters60/4773846
agacaa

SEQ ID NO: 61042 - DNA, 8 bp, Unknown
  misc_feature (1)..( 8): Matrix.003 file - promoters60/4773846
aatacaac

SEQ ID NO: 61043 - DNA, 7 bp, Unknown
  misc_feature (1)..( 7): Matrix.003 file - promoters60/4773846
aaaaata

SEQ ID NO: 61044 - DNA, 9 bp, Unknown
  misc_feature (1)..( 9): Matrix.003 file - promoters60/4773846
attttatct

SEQ ID NO: 61045 - DNA, 9 bp, Unknown
  misc_feature (1)..( 9): Matrix.003 file - promoters60/4773846
ttttcttat

SEQ ID NO: 61046 - DNA, 7 bp, Unknown
  misc_feature (1)..( 7): Matrix.003 file - promoters60/4773846
gataaaa

SEQ ID NO: 61047 - DNA, 6 bp, Unknown
  misc_feature (1)..( 6): Matrix.003 file - promoters60/4773846
catata

SEQ ID NO: 61048 - DNA, 10 bp, Unknown
  misc_feature (1)..( 10): Matrix.003 file - promoters60/4773846
aattcaaata

SEQ ID NO: 61049 - DNA, 8 bp, Unknown
  misc_feature (1)..( 8): Matrix.003 file - promoters60/4773846
attcaaat

SEQ ID NO: 61050 - DNA, 7 bp, Unknown
  misc_feature (1)..( 7): Matrix.003 file - promoters60/4773846
aagaaaa

SEQ ID NO: 61051 - DNA, 6 bp, Unknown
  misc_feature (1)..( 6): Matrix.003 file - promoters60/4773846
cagcaa

SEQ ID NO: 61052 - DNA, 6 bp, Unknown
  misc_feature (1)..( 6): Matrix.003 file - promoters60/4773846
acgtac

SEQ ID NO: 61053 - DNA, 7 bp, Unknown
  misc_feature (1)..( 7): Matrix.003 file - promoters60/4773846
aatcaaa

SEQ ID NO: 61054 - DNA, 12 bp, Unknown
  misc_feature (1)..( 12): Matrix.003 file - promoters60/4773846
attagataattt

SEQ ID NO: 61055 - DNA, 9 bp, Unknown
  misc_feature (1)..( 9): Matrix.003 file - promoters60/4802537
aaattaaat

SEQ ID NO: 61056 - DNA, 14 bp, Unknown
  misc_feature (1)..( 14): Matrix.003 file - promoters60/4802537
aaataaacaaaagt

SEQ ID NO: 61057 - DNA, 10 bp, Unknown
  misc_feature (1)..( 10): Matrix.003 file - promoters60/4802537
tatataaaat

SEQ ID NO: 61058 - DNA, 12 bp, Unknown
  misc_feature (1)..( 12): Matrix.003 file - promoters60/4802537
atatgaaaaaga

SEQ ID NO: 61059 - DNA, 8 bp, Unknown
  misc_feature (1)..( 8): Matrix.003 file - promoters60/4803329
atttttac

SEQ ID NO: 61060 - DNA, 8 bp, Unknown
  misc_feature (1)..( 8): Matrix.003 file - promoters60/4803329
tttatttt

SEQ ID NO: 61061 - DNA, 9 bp, Unknown
  misc_feature (1)..( 9): Matrix.003 file - promoters60/4803329
gaagacaaa

SEQ ID NO: 61062 - DNA, 13 bp, Unknown
  misc_feature (1)..( 13): Matrix.003 file - promoters60/4803329
aaaattgaatttg

SEQ ID NO: 61063 - DNA, 7 bp, Unknown
  misc_feature (1)..( 7): Matrix.003 file - promoters60/4806023
cagcttt

SEQ ID NO: 61064 - DNA, 8 bp, Unknown
  misc_feature (1)..( 8): Matrix.003 file - promoters60/4806023
aaacttat

SEQ ID NO: 61065 - DNA, 6 bp, Unknown
  misc_feature (1)..( 6): Matrix.003 file - promoters60/4806023
caactt

SEQ ID NO: 61066 - DNA, 6 bp, Unknown
  misc_feature (1)..( 6): Matrix.003 file - promoters60/4806023
ggccca

SEQ ID NO: 61067 - DNA, 6 bp, Unknown
  misc_feature (1)..( 6): Matrix.003 file - promoters60/4806023
aacaaa

SEQ ID NO: 61068 - DNA, 6 bp, Unknown
  misc_feature (1)..( 6): Matrix.003 file - promoters60/4806023
caaaaa

SEQ ID NO: 61069 - DNA, 6 bp, Unknown
  misc_feature (1)..( 6): Matrix.003 file - promoters60/4806023
tcactt

SEQ ID NO: 61070 - DNA, 7 bp, Unknown
  misc_feature (1)..( 7): Matrix.003 file - promoters60/4806023
gaccgtt

SEQ ID NO: 61071 - DNA, 10 bp, Unknown
  misc_feature (1)..( 10): Matrix.003 file - promoters60/4806023
atcttgattt

SEQ ID NO: 61072 - DNA, 7 bp, Unknown
  misc_feature (1)..( 7): Matrix.003 file - promoters60/4806023
ggtctca

SEQ ID NO: 61073 - DNA, 6 bp, Unknown
  misc_feature (1)..( 6): Matrix.003 file - promoters60/4806023
tcaaga

SEQ ID NO: 61074 - DNA, 6 bp, Unknown
  misc_feature (1)..( 6): Matrix.003 file - promoters60/4806023
ctgttt

SEQ ID NO: 61075 - DNA, 9 bp, Unknown
  misc_feature (1)..( 9): Matrix.003 file - promoters60/4806023
tcacaattc

SEQ ID NO: 61076 - DNA, 7 bp, Unknown
  misc_feature (1)..( 7): Matrix.003 file - promoters60/4806023
tcaaata

SEQ ID NO: 61077 - DNA, 6 bp, Unknown
  misc_feature (1)..( 6): Matrix.003 file - promoters60/4806023
ccattg

SEQ ID NO: 61078 - DNA, 7 bp, Unknown
  misc_feature (1)..( 7): Matrix.003 file - promoters60/4806023
ttccgga

SEQ ID NO: 61079 - DNA, 8 bp, Unknown
  misc_feature (1)..( 8): Matrix.003 file - promoters60/4806023
gtttaaat

SEQ ID NO: 61080 - DNA, 11 bp, Unknown
  misc_feature (1)..( 11): Matrix.003 file - promoters60/4807018
actttttactg

SEQ ID NO: 61081 - DNA, 10 bp, Unknown
  misc_feature (1)..( 10): Matrix.003 file - promoters60/4807018
aaaaaccaaa

SEQ ID NO: 61082 - DNA, 14 bp, Unknown
  misc_feature (1)..( 14): Matrix.003 file - promoters60/4807018
ttctattagttccg

SEQ ID NO: 61083 - DNA, 16 bp, Unknown
  misc_feature (1)..( 16): Matrix.003 file - promoters60/4807026
aacaaaaaagaataaa

SEQ ID NO: 61084 - DNA, 8 bp, Unknown
  misc_feature (1)..( 8): Matrix.003 file - promoters60/4807026
cttatata

SEQ ID NO: 61085 - DNA, 9 bp, Unknown
  misc_feature (1)..( 9): Matrix.003 file - promoters60/4807026
atataaata

SEQ ID NO: 61086 - DNA, 11 bp, Unknown
  misc_feature (1)..( 11): Matrix.003 file - promoters60/4807026
atttgaataaa

SEQ ID NO: 61087 - DNA, 13 bp, Unknown
  misc_feature (1)..( 13): Matrix.003 file - promoters60/4807236
ttttaacaaaaag

SEQ ID NO: 61088 - DNA, 9 bp, Unknown
  misc_feature (1)..( 9): Matrix.003 file - promoters60/4807258
cttgttttt

SEQ ID NO: 61089 - DNA, 7 bp, Unknown
  misc_feature (1)..( 7): Matrix.003 file - promoters60/4808052
aaaccat

SEQ ID NO: 61090 - DNA, 10 bp, Unknown
  misc_feature (1)..( 10): Matrix.003 file - promoters60/4808052
ggacaaaaac

SEQ ID NO: 61091 - DNA, 7 bp, Unknown
  misc_feature (1)..( 7): Matrix.003 file - promoters60/4808052
ttaaaaa

SEQ ID NO: 61092 - DNA, 7 bp, Unknown
  misc_feature (1)..( 7): Matrix.003 file - promoters60/4808052
aaaatta

SEQ ID NO: 61093 - DNA, 7 bp, Unknown
  misc_feature (1)..( 7): Matrix.003 file - promoters60/4808052
agatcaa

SEQ ID NO: 61094 - DNA, 6 bp, Unknown
  misc_feature (1)..( 6): Matrix.003 file - promoters60/4809801
ttttgc

SEQ ID NO: 61095 - DNA, 9 bp, Unknown
  misc_feature (1)..( 9): Matrix.003 file - promoters60/4809801
atttccatg

SEQ ID NO: 61096 - DNA, 7 bp, Unknown
  misc_feature (1)..( 7): Matrix.003 file - promoters60/4809801
atgcatg

SEQ ID NO: 61097 - DNA, 7 bp, Unknown
  misc_feature (1)..( 7): Matrix.003 file - promoters60/4809801
ctaagga

SEQ ID NO: 61098 - DNA, 7 bp, Unknown
  misc_feature (1)..( 7): Matrix.003 file - promoters60/4809801
ttgtgtt

SEQ ID NO: 61099 - DNA, 7 bp, Unknown
  misc_feature (1)..( 7): Matrix.003 file - promoters60/4809801
cagaaga

SEQ ID NO: 61100 - DNA, 6 bp, Unknown
  misc_feature (1)..( 6): Matrix.003 file - promoters60/4809801
agatct

SEQ ID NO: 61101 - DNA, 6 bp, Unknown
  misc_feature (1)..( 6): Matrix.003 file - promoters60/4809801
gaagaa

SEQ ID NO: 61102 - DNA, 6 bp, Unknown
  misc_feature (1)..( 6): Matrix.003 file - promoters60/4809801
tttctt

SEQ ID NO: 61103 - DNA, 6 bp, Unknown
  misc_feature (1)..( 6): Matrix.003 file - promoters60/4809801
tttcaa

SEQ ID NO: 61104 - DNA, 6 bp, Unknown
  misc_feature (1)..( 6): Matrix.003 file - promoters60/4809801
ctcatt

SEQ ID NO: 61105 - DNA, 7 bp, Unknown
  misc_feature (1)..( 7): Matrix.003 file - promoters60/4809801
ctcctcc

SEQ ID NO: 61106 - DNA, 6 bp, Unknown
  misc_feature (1)..( 6): Matrix.003 file - promoters60/4811854
atctct

SEQ ID NO: 61107 - DNA, 6 bp, Unknown
  misc_feature (1)..( 6): Matrix.003 file - promoters60/4811854
atatgt

SEQ ID NO: 61108 - DNA, 8 bp, Unknown
  misc_feature (1)..( 8): Matrix.003 file - promoters60/4811854
tttaattt

SEQ ID NO: 61109 - DNA, 6 bp, Unknown
  misc_feature (1)..( 6): Matrix.003 file - promoters60/4811854
tttcat

SEQ ID NO: 61110 - DNA, 8 bp, Unknown
  misc_feature (1)..( 8): Matrix.003 file - promoters60/4811854
aagtataa

SEQ ID NO: 61111 - DNA, 10 bp, Unknown
  misc_feature (1)..( 10): Matrix.003 file - promoters60/4811854
aaattatttt

SEQ ID NO: 61112 - DNA, 7 bp, Unknown
  misc_feature (1)..( 7): Matrix.003 file - promoters60/4811854
aaaaatg

SEQ ID NO: 61113 - DNA, 12 bp, Unknown
  misc_feature (1)..( 12): Matrix.003 file - promoters60/4811854
tcctcacgatta

SEQ ID NO: 61114 - DNA, 6 bp, Unknown
  misc_feature (1)..( 6): Matrix.003 file - promoters60/4811854
gctctt

SEQ ID NO: 61115 - DNA, 6 bp, Unknown
  misc_feature (1)..( 6): Matrix.003 file - promoters60/4811854
cctcaa

SEQ ID NO: 61116 - DNA, 8 bp, Unknown
  misc_feature (1)..( 8): Matrix.003 file - promoters60/4811854
tctatatt

SEQ ID NO: 61117 - DNA, 6 bp, Unknown
  misc_feature (1)..( 6): Matrix.003 file - promoters60/4811854
gatttt

SEQ ID NO: 61118 - DNA, 6 bp, Unknown
  misc_feature (1)..( 6): Matrix.003 file - promoters60/4811854
tacata

SEQ ID NO: 61119 - DNA, 10 bp, Unknown
  misc_feature (1)..( 10): Matrix.003 file - promoters60/4811854
attaattttt

SEQ ID NO: 61120 - DNA, 7 bp, Unknown
  misc_feature (1)..( 7): Matrix.003 file - promoters60/4811854
catcaca

SEQ ID NO: 61121 - DNA, 8 bp, Unknown
  misc_feature (1)..( 8): Matrix.003 file - promoters60/4811854
aaaaaaca

SEQ ID NO: 61122 - DNA, 6 bp, Unknown
  misc_feature (1)..( 6): Matrix.003 file - promoters60/4811854
tttaaa

SEQ ID NO: 61123 - DNA, 9 bp, Unknown
  misc_feature (1)..( 9): Matrix.003 file - promoters60/4811854
atctaattt

SEQ ID NO: 61124 - DNA, 7 bp, Unknown
  misc_feature (1)..( 7): Matrix.003 file - promoters60/4811854
ttaaaat

SEQ ID NO: 61125 - DNA, 6 bp, Unknown
  misc_feature (1)..( 6): Matrix.003 file - promoters60/4811854
aaatta

SEQ ID NO: 61126 - DNA, 9 bp, Unknown
  misc_feature (1)..( 9): Matrix.003 file - promoters60/4811854
gtatatttc

SEQ ID NO: 61127 - DNA, 7 bp, Unknown
  misc_feature (1)..( 7): Matrix.003 file - promoters60/4811854
ggacgct

SEQ ID NO: 61128 - DNA, 6 bp, Unknown
  misc_feature (1)..( 6): Matrix.003 file - promoters60/4811854
aaataa

SEQ ID NO: 61129 - DNA, 6 bp, Unknown
  misc_feature (1)..( 6): Matrix.003 file - promoters60/4811854
taaata

SEQ ID NO: 61130 - DNA, 6 bp, Unknown
  misc_feature (1)..( 6): Matrix.003 file - promoters60/4811854
attaaa

SEQ ID NO: 61131 - DNA, 8 bp, Unknown
  misc_feature (1)..( 8): Matrix.003 file - promoters60/4811854
aaaagtta

SEQ ID NO: 61132 - DNA, 7 bp, Unknown
  misc_feature (1)..( 7): Matrix.003 file - promoters60/4811854
catctat

SEQ ID NO: 61133 - DNA, 8 bp, Unknown
  misc_feature (1)..( 8): Matrix.003 file - promoters60/4811975
atactact

SEQ ID NO: 61134 - DNA, 7 bp, Unknown
  misc_feature (1)..( 7): Matrix.003 file - promoters60/4811975
caaatac

SEQ ID NO: 61135 - DNA, 11 bp, Unknown
  misc_feature (1)..( 11): Matrix.003 file - promoters60/4811975
tatattttttt

SEQ ID NO: 61136 - DNA, 6 bp, Unknown
  misc_feature (1)..( 6): Matrix.003 file - promoters60/4811975
tatatg

SEQ ID NO: 61137 - DNA, 6 bp, Unknown
  misc_feature (1)..( 6): Matrix.003 file - promoters60/4811975
ttcaaa

SEQ ID NO: 61138 - DNA, 9 bp, Unknown
  misc_feature (1)..( 9): Matrix.003 file - promoters60/4811975
atactctca

SEQ ID NO: 61139 - DNA, 6 bp, Unknown
  misc_feature (1)..( 6): Matrix.003 file - promoters60/4811975
tcaaac

SEQ ID NO: 61140 - DNA, 6 bp, Unknown
  misc_feature (1)..( 6): Matrix.003 file - promoters60/4811975
ttttct

SEQ ID NO: 61141 - DNA, 7 bp, Unknown
  misc_feature (1)..( 7): Matrix.003 file - promoters60/4811975
gaaatca

SEQ ID NO: 61142 - DNA, 6 bp, Unknown
  misc_feature (1)..( 6): Matrix.003 file - promoters60/4811975
atcttg

SEQ ID NO: 61143 - DNA, 6 bp, Unknown
  misc_feature (1)..( 6): Matrix.003 file - promoters60/4811975
acacaa

SEQ ID NO: 61144 - DNA, 10 bp, Unknown
  misc_feature (1)..( 10): Matrix.003 file - promoters60/4811975
atttttttaa

SEQ ID NO: 61145 - DNA, 7 bp, Unknown
  misc_feature (1)..( 7): Matrix.003 file - promoters60/4811975
actattc

SEQ ID NO: 61146 - DNA, 11 bp, Unknown
  misc_feature (1)..( 11): Matrix.003 file - promoters60/4811975
accggatatta

SEQ ID NO: 61147 - DNA, 6 bp, Unknown
  misc_feature (1)..( 6): Matrix.003 file - promoters60/4811975
tactgt

SEQ ID NO: 61148 - DNA, 9 bp, Unknown
  misc_feature (1)..( 9): Matrix.003 file - promoters60/4811975
tcaaaattt

SEQ ID NO: 61149 - DNA, 6 bp, Unknown
  misc_feature (1)..( 6): Matrix.003 file - promoters60/4811975
ttgaaa

SEQ ID NO: 61150 - DNA, 7 bp, Unknown
  misc_feature (1)..( 7): Matrix.003 file - promoters60/4811975
cttctcc

SEQ ID NO: 61151 - DNA, 7 bp, Unknown
  misc_feature (1)..( 7): Matrix.003 file - promoters60/4811975
ttcatgt

SEQ ID NO: 61152 - DNA, 7 bp, Unknown
  misc_feature (1)..( 7): Matrix.003 file - promoters60/4811975
aagattt

SEQ ID NO: 61153 - DNA, 7 bp, Unknown
  misc_feature (1)..( 7): Matrix.003 file - promoters60/4811975
tacctca

SEQ ID NO: 61154 - DNA, 7 bp, Unknown
  misc_feature (1)..( 7): Matrix.003 file - promoters60/4811975
tttgata

SEQ ID NO: 61155 - DNA, 9 bp, Unknown
  misc_feature (1)..( 9): Matrix.003 file - promoters60/4811975
catcattat

SEQ ID NO: 61156 - DNA, 7 bp, Unknown
  misc_feature (1)..( 7): Matrix.003 file - promoters60/4854186
cacagaa

SEQ ID NO: 61157 - DNA, 8 bp, Unknown
  misc_feature (1)..( 8): Matrix.003 file - promoters60/4854186
aatcgata

SEQ ID NO: 61158 - DNA, 7 bp, Unknown
  misc_feature (1)..( 7): Matrix.003 file - promoters60/4854186
agaacgg

SEQ ID NO: 61159 - DNA, 6 bp, Unknown
  misc_feature (1)..( 6): Matrix.003 file - promoters60/4854186
tgggct

SEQ ID NO: 61160 - DNA, 8 bp, Unknown
  misc_feature (1)..( 8): Matrix.003 file - promoters60/4854186
tttgatta

SEQ ID NO: 61161 - DNA, 8 bp, Unknown
  misc_feature (1)..( 8): Matrix.003 file - promoters60/4854186
tatgcata

SEQ ID NO: 61162 - DNA, 6 bp, Unknown
  misc_feature (1)..( 6): Matrix.003 file - promoters60/4854186
ttagtg

SEQ ID NO: 61163 - DNA, 7 bp, Unknown
  misc_feature (1)..( 7): Matrix.003 file - promoters60/4854186
cccaaat

SEQ ID NO: 61164 - DNA, 7 bp, Unknown
  misc_feature (1)..( 7): Matrix.003 file - promoters60/4854186
aacaaat

SEQ ID NO: 61165 - DNA, 6 bp, Unknown
  misc_feature (1)..( 6): Matrix.003 file - promoters60/4854186
aaaatt

SEQ ID NO: 61166 - DNA, 7 bp, Unknown
  misc_feature (1)..( 7): Matrix.003 file - promoters60/4854186
ataaaaa

SEQ ID NO: 61167 - DNA, 6 bp, Unknown
  misc_feature (1)..( 6): Matrix.003 file - promoters60/4854186
ggccca

SEQ ID NO: 61168 - DNA, 8 bp, Unknown
  misc_feature (1)..( 8): Matrix.003 file - promoters60/4899822
aaagaaaa

SEQ ID NO: 61169 - DNA, 11 bp, Unknown
  misc_feature (1)..( 11): Matrix.003 file - promoters60/4899822
agtaaagaaaa

SEQ ID NO: 61170 - DNA, 9 bp, Unknown
  misc_feature (1)..( 9): Matrix.003 file - promoters60/4899822
aaaagaaaa

SEQ ID NO: 61171 - DNA, 8 bp, Unknown
  misc_feature (1)..( 8): Matrix.003 file - promoters60/4899880
atttttag

SEQ ID NO: 61172 - DNA, 8 bp, Unknown
  misc_feature (1)..( 8): Matrix.003 file - promoters60/4899880
tcaccatg

SEQ ID NO: 61173 - DNA, 6 bp, Unknown
  misc_feature (1)..( 6): Matrix.003 file - promoters60/4899880
catgag

SEQ ID NO: 61174 - DNA, 6 bp, Unknown
  misc_feature (1)..( 6): Matrix.003 file - promoters60/4899880
tatcat

SEQ ID NO: 61175 - DNA, 7 bp, Unknown
  misc_feature (1)..( 7): Matrix.003 file - promoters60/4899880
gacaagt

SEQ ID NO: 61176 - DNA, 8 bp, Unknown
  misc_feature (1)..( 8): Matrix.003 file - promoters60/4899880
ccaacaaa

SEQ ID NO: 61177 - DNA, 7 bp, Unknown
  misc_feature (1)..( 7): Matrix.003 file - promoters60/4899880
gaaaagt

SEQ ID NO: 61178 - DNA, 6 bp, Unknown
  misc_feature (1)..( 6): Matrix.003 file - promoters60/4899880
ttaaat

SEQ ID NO: 61179 - DNA, 6 bp, Unknown
  misc_feature (1)..( 6): Matrix.003 file - promoters60/4899880
tttgta

SEQ ID NO: 61180 - DNA, 8 bp, Unknown
  misc_feature (1)..( 8): Matrix.003 file - promoters60/4899880
taaacaag

SEQ ID NO: 61181 - DNA, 6 bp, Unknown
  misc_feature (1)..( 6): Matrix.003 file - promoters60/4899880
gaaaaa

SEQ ID NO: 61182 - DNA, 10 bp, Unknown
  misc_feature (1)..( 10): Matrix.003 file - promoters60/4899880
aaaacaattc

SEQ ID NO: 61183 - DNA, 9 bp, Unknown
  misc_feature (1)..( 9): Matrix.003 file - promoters60/4899880
ctataattt

SEQ ID NO: 61184 - DNA, 11 bp, Unknown
  misc_feature (1)..( 11): Matrix.003 file - promoters60/4899880
aaaataaaaat

SEQ ID NO: 61185 - DNA, 10 bp, Unknown
  misc_feature (1)..( 10): Matrix.003 file - promoters60/4899880
taaaatcagt

SEQ ID NO: 61186 - DNA, 6 bp, Unknown
  misc_feature (1)..( 6): Matrix.003 file - promoters60/4899880
caaaga

SEQ ID NO: 61187 - DNA, 7 bp, Unknown
  misc_feature (1)..( 7): Matrix.003 file - promoters60/4899880
gtacgag

SEQ ID NO: 61188 - DNA, 8 bp, Unknown
  misc_feature (1)..( 8): Matrix.003 file - promoters60/4899880
ctttggaa

SEQ ID NO: 61189 - DNA, 6 bp, Unknown
  misc_feature (1)..( 6): Matrix.003 file - promoters60/4899880
gtggtt

SEQ ID NO: 61190 - DNA, 6 bp, Unknown
  misc_feature (1)..( 6): Matrix.003 file - promoters60/4899880
aggaaa

SEQ ID NO: 61191 - DNA, 6 bp, Unknown
  misc_feature (1)..( 6): Matrix.003 file - promoters60/4899880
atctac

SEQ ID NO: 61192 - DNA, 6 bp, Unknown
  misc_feature (1)..( 6): Matrix.003 file - promoters60/4899880
tctttt

SEQ ID NO: 61193 - DNA, 7 bp, Unknown
  misc_feature (1)..( 7): Matrix.003 file - promoters60/4899880
ttttgta

SEQ ID NO: 61194 - DNA, 8 bp, Unknown
  misc_feature (1)..( 8): Matrix.003 file - promoters60/4899880
tttaagtg

SEQ ID NO: 61195 - DNA, 8 bp, Unknown
  misc_feature (1)..( 8): Matrix.003 file - promoters60/4899880
ttgagata

SEQ ID NO: 61196 - DNA, 11 bp, Unknown
  misc_feature (1)..( 11): Matrix.003 file - promoters60/4900035
aaataattaat

SEQ ID NO: 61197 - DNA, 10 bp, Unknown
  misc_feature (1)..( 10): Matrix.003 file - promoters60/4900035
aaaacatatt

SEQ ID NO: 61198 - DNA, 9 bp, Unknown
  misc_feature (1)..( 9): Matrix.003 file - promoters60/4900035
gattaaaac

SEQ ID NO: 61199 - DNA, 11 bp, Unknown
  misc_feature (1)..( 11): Matrix.003 file - promoters60/4900035
tttatctatca

SEQ ID NO: 61200 - DNA, 11 bp, Unknown
  misc_feature (1)..( 11): Matrix.003 file - promoters60/4900353
ctataaaaaat

SEQ ID NO: 61201 - DNA, 7 bp, Unknown
  misc_feature (1)..( 7): Matrix.003 file - promoters60/4900589
gtagatc

SEQ ID NO: 61202 - DNA, 11 bp, Unknown
  misc_feature (1)..( 11): Matrix.003 file - promoters60/4900589
gtataaattga

SEQ ID NO: 61203 - DNA, 8 bp, Unknown
  misc_feature (1)..( 8): Matrix.003 file - promoters60/4900589
tttgtttt

SEQ ID NO: 61204 - DNA, 11 bp, Unknown
  misc_feature (1)..( 11): Matrix.003 file - promoters60/4900589
atctaaatttt

SEQ ID NO: 61205 - DNA, 8 bp, Unknown
  misc_feature (1)..( 8): Matrix.003 file - promoters60/4900589
ctataatt

SEQ ID NO: 61206 - DNA, 7 bp, Unknown
  misc_feature (1)..( 7): Matrix.003 file - promoters60/4900589
tctaaat

SEQ ID NO: 61207 - DNA, 7 bp, Unknown
  misc_feature (1)..( 7): Matrix.003 file - promoters60/4900589
tggattt

SEQ ID NO: 61208 - DNA, 8 bp, Unknown
  misc_feature (1)..( 8): Matrix.003 file - promoters60/4900589
ttttaatt

SEQ ID NO: 61209 - DNA, 6 bp, Unknown
  misc_feature (1)..( 6): Matrix.003 file - promoters60/4900589
aatttt

SEQ ID NO: 61210 - DNA, 11 bp, Unknown
  misc_feature (1)..( 11): Matrix.003 file - promoters60/4900589
tgaaacaaaaa

SEQ ID NO: 61211 - DNA, 7 bp, Unknown
  misc_feature (1)..( 7): Matrix.003 file - promoters60/4900589
tctactg

SEQ ID NO: 61212 - DNA, 6 bp, Unknown
  misc_feature (1)..( 6): Matrix.003 file - promoters60/4900589
taaaga

SEQ ID NO: 61213 - DNA, 9 bp, Unknown
  misc_feature (1)..( 9): Matrix.003 file - promoters60/4900589
caaaaagag

SEQ ID NO: 61214 - DNA, 6 bp, Unknown
  misc_feature (1)..( 6): Matrix.003 file - promoters60/4900589
aaattg

SEQ ID NO: 61215 - DNA, 7 bp, Unknown
  misc_feature (1)..( 7): Matrix.003 file - promoters60/4900589
tattgtg

SEQ ID NO: 61216 - DNA, 9 bp, Unknown
  misc_feature (1)..( 9): Matrix.003 file - promoters60/4900589
tatttattt

SEQ ID NO: 61217 - DNA, 11 bp, Unknown
  misc_feature (1)..( 11): Matrix.003 file - promoters60/4900643
atacaaaatca

SEQ ID NO: 61218 - DNA, 9 bp, Unknown
  misc_feature (1)..( 9): Matrix.003 file - promoters60/4900643
aaaaaccaa

SEQ ID NO: 61219 - DNA, 9 bp, Unknown
  misc_feature (1)..( 9): Matrix.003 file - promoters60/4900643
aagatctcc

SEQ ID NO: 61220 - DNA, 8 bp, Unknown
  misc_feature (1)..( 8): Matrix.003 file - promoters60/4900643
tgtgggtt

SEQ ID NO: 61221 - DNA, 6 bp, Unknown
  misc_feature (1)..( 6): Matrix.003 file - promoters60/4900643
ctttga

SEQ ID NO: 61222 - DNA, 7 bp, Unknown
  misc_feature (1)..( 7): Matrix.003 file - promoters60/4900643
tgtaata

SEQ ID NO: 61223 - DNA, 16 bp, Unknown
  misc_feature (1)..( 16): Matrix.003 file - promoters60/4900643
ggaaaacgtgagaact

SEQ ID NO: 61224 - DNA, 6 bp, Unknown
  misc_feature (1)..( 6): Matrix.003 file - promoters60/4900643
tgtttt

SEQ ID NO: 61225 - DNA, 8 bp, Unknown
  misc_feature (1)..( 8): Matrix.003 file - promoters60/4900643
tgtcatta

SEQ ID NO: 61226 - DNA, 7 bp, Unknown
  misc_feature (1)..( 7): Matrix.003 file - promoters60/4900643
ctctact

SEQ ID NO: 61227 - DNA, 8 bp, Unknown
  misc_feature (1)..( 8): Matrix.003 file - promoters60/4900643
tgtgctct

SEQ ID NO: 61228 - DNA, 9 bp, Unknown
  misc_feature (1)..( 9): Matrix.003 file - promoters60/4900643
agaaaaaaa

SEQ ID NO: 61229 - DNA, 7 bp, Unknown
  misc_feature (1)..( 7): Matrix.003 file - promoters60/4900643
aaaactt

SEQ ID NO: 61230 - DNA, 9 bp, Unknown
  misc_feature (1)..( 9): Matrix.003 file - promoters60/4900643
tttatttac

SEQ ID NO: 61231 - DNA, 7 bp, Unknown
  misc_feature (1)..( 7): Matrix.003 file - promoters60/4900643
ttccaaa

SEQ ID NO: 61232 - DNA, 6 bp, Unknown
  misc_feature (1)..( 6): Matrix.003 file - promoters60/4900643
ccaaac

SEQ ID NO: 61233 - DNA, 6 bp, Unknown
  misc_feature (1)..( 6): Matrix.003 file - promoters60/4900643
ggtttt

SEQ ID NO: 61234 - DNA, 6 bp, Unknown
  misc_feature (1)..( 6): Matrix.003 file - promoters60/4900643
ttaatt

SEQ ID NO: 61235 - DNA, 8 bp, Unknown
  misc_feature (1)..( 8): Matrix.003 file - promoters60/4900643
gttagtat

SEQ ID NO: 61236 - DNA, 6 bp, Unknown
  misc_feature (1)..( 6): Matrix.003 file - promoters60/4900643
ttggcg

SEQ ID NO: 61237 - DNA, 7 bp, Unknown
  misc_feature (1)..( 7): Matrix.003 file - promoters60/4900643
atattta

SEQ ID NO: 61238 - DNA, 7 bp, Unknown
  misc_feature (1)..( 7): Matrix.003 file - promoters60/4900722
ctacatt

SEQ ID NO: 61239 - DNA, 8 bp, Unknown
  misc_feature (1)..( 8): Matrix.003 file - promoters60/4900722
ttataaat

SEQ ID NO: 61240 - DNA, 6 bp, Unknown
  misc_feature (1)..( 6): Matrix.003 file - promoters60/4900722
agattt

SEQ ID NO: 61241 - DNA, 7 bp, Unknown
  misc_feature (1)..( 7): Matrix.003 file - promoters60/4900722
atttacc

SEQ ID NO: 61242 - DNA, 8 bp, Unknown
  misc_feature (1)..( 8): Matrix.003 file - promoters60/4900722
atatatga

SEQ ID NO: 61243 - DNA, 7 bp, Unknown
  misc_feature (1)..( 7): Matrix.003 file - promoters60/4900722
tttaata

SEQ ID NO: 61244 - DNA, 6 bp, Unknown
  misc_feature (1)..( 6): Matrix.003 file - promoters60/4900722
gtgtgt

SEQ ID NO: 61245 - DNA, 6 bp, Unknown
  misc_feature (1)..( 6): Matrix.003 file - promoters60/4900722
acagct

SEQ ID NO: 61246 - DNA, 6 bp, Unknown
  misc_feature (1)..( 6): Matrix.003 file - promoters60/4900722
ccatat

SEQ ID NO: 61247 - DNA, 8 bp, Unknown
  misc_feature (1)..( 8): Matrix.003 file - promoters60/4900722
tgcctcag

SEQ ID NO: 61248 - DNA, 7 bp, Unknown
  misc_feature (1)..( 7): Matrix.003 file - promoters60/4900722
ttcggtt

SEQ ID NO: 61249 - DNA, 8 bp, Unknown
  misc_feature (1)..( 8): Matrix.003 file - promoters60/4900722
gtgggtat

SEQ ID NO: 61250 - DNA, 12 bp, Unknown
  misc_feature (1)..( 12): Matrix.003 file - promoters60/4900939
aaaataaaaagt

SEQ ID NO: 61251 - DNA, 7 bp, Unknown
  misc_feature (1)..( 7): Matrix.003 file - promoters60/4900939
aaaattc

SEQ ID NO: 61252 - DNA, 9 bp, Unknown
  misc_feature (1)..( 9): Matrix.003 file - promoters60/4900939
ttaaacgaa

SEQ ID NO: 61253 - DNA, 7 bp, Unknown
  misc_feature (1)..( 7): Matrix.003 file - promoters60/4900939
ttttgtt

SEQ ID NO: 61254 - DNA, 11 bp, Unknown
  misc_feature (1)..( 11): Matrix.003 file - promoters60/4901133
aaatgggccca

SEQ ID NO: 61255 - DNA, 9 bp, Unknown
  misc_feature (1)..( 9): Matrix.003 file - promoters60/4901133
tatataaat

SEQ ID NO: 61256 - DNA, 11 bp, Unknown
  misc_feature (1)..( 11): Matrix.003 file - promoters60/4901133
aaaaaattata

SEQ ID NO: 61257 - DNA, 6 bp, Unknown
  misc_feature (1)..( 6): Matrix.003 file - promoters60/4901225
tgattg

SEQ ID NO: 61258 - DNA, 13 bp, Unknown
  misc_feature (1)..( 13): Matrix.003 file - promoters60/4901225
acacaaaaaaaaa

SEQ ID NO: 61259 - DNA, 7 bp, Unknown
  misc_feature (1)..( 7): Matrix.003 file - promoters60/4901225
aaaactg

SEQ ID NO: 61260 - DNA, 7 bp, Unknown
  misc_feature (1)..( 7): Matrix.003 file - promoters60/4901225
aagaaga

SEQ ID NO: 61261 - DNA, 11 bp, Unknown
  misc_feature (1)..( 11): Matrix.003 file - promoters60/4901225
agaagaaaaag

SEQ ID NO: 61262 - DNA, 8 bp, Unknown
  misc_feature (1)..( 8): Matrix.003 file - promoters60/4901225
acaaaaca

SEQ ID NO: 61263 - DNA, 10 bp, Unknown
  misc_feature (1)..( 10): Matrix.003 file - promoters60/4901225
acatttatcc

SEQ ID NO: 61264 - DNA, 6 bp, Unknown
  misc_feature (1)..( 6): Matrix.003 file - promoters60/4901225
aatttt

SEQ ID NO: 61265 - DNA, 7 bp, Unknown
  misc_feature (1)..( 7): Matrix.003 file - promoters60/4901225
aaaaagg

SEQ ID NO: 61266 - DNA, 7 bp, Unknown
  misc_feature (1)..( 7): Matrix.003 file - promoters60/4901225
tttcgac

SEQ ID NO: 61267 - DNA, 8 bp, Unknown
  misc_feature (1)..( 8): Matrix.003 file - promoters60/4901225
ttaacaat

SEQ ID NO: 61268 - DNA, 8 bp, Unknown
  misc_feature (1)..( 8): Matrix.003 file - promoters60/4901225
atcacatc

SEQ ID NO: 61269 - DNA, 7 bp, Unknown
  misc_feature (1)..( 7): Matrix.003 file - promoters60/4901225
tggatcg

SEQ ID NO: 61270 - DNA, 9 bp, Unknown
  misc_feature (1)..( 9): Matrix.003 file - promoters60/4901241
ttaaaatat

SEQ ID NO: 61271 - DNA, 15 bp, Unknown
  misc_feature (1)..( 15): Matrix.003 file - promoters60/4901241
ttaaaatatatttaa

SEQ ID NO: 61272 - DNA, 10 bp, Unknown
  misc_feature (1)..( 10): Matrix.003 file - promoters60/4901241
ataaagaatt

SEQ ID NO: 61273 - DNA, 12 bp, Unknown
  misc_feature (1)..( 12): Matrix.003 file - promoters60/4901241
catgcaactaat

SEQ ID NO: 61274 - DNA, 11 bp, Unknown
  misc_feature (1)..( 11): Matrix.003 file - promoters60/4901241
agactaaataa

SEQ ID NO: 61275 - DNA, 9 bp, Unknown
  misc_feature (1)..( 9): Matrix.003 file - promoters60/4901241
tataaaaac

SEQ ID NO: 61276 - DNA, 11 bp, Unknown
  misc_feature (1)..( 11): Matrix.003 file - promoters60/4901241
attaaaatata

SEQ ID NO: 61277 - DNA, 13 bp, Unknown
  misc_feature (1)..( 13): Matrix.003 file - promoters60/4901241
ttaaacatcgtat

SEQ ID NO: 61278 - DNA, 8 bp, Unknown
  misc_feature (1)..( 8): Matrix.003 file - promoters60/4901241
cctaattt

SEQ ID NO: 61279 - DNA, 9 bp, Unknown
  misc_feature (1)..( 9): Matrix.003 file - promoters60/4901241
taaccttac

SEQ ID NO: 61280 - DNA, 10 bp, Unknown
  misc_feature (1)..( 10): Matrix.003 file - promoters60/4901241
actatataaa

SEQ ID NO: 61281 - DNA, 6 bp, Unknown
  misc_feature (1)..( 6): Matrix.003 file - promoters60/4901333
ttcatc

SEQ ID NO: 61282 - DNA, 7 bp, Unknown
  misc_feature (1)..( 7): Matrix.003 file - promoters60/4901333
atttgtt

SEQ ID NO: 61283 - DNA, 6 bp, Unknown
  misc_feature (1)..( 6): Matrix.003 file - promoters60/4901333
tctcgc

SEQ ID NO: 61284 - DNA, 11 bp, Unknown
  misc_feature (1)..( 11): Matrix.003 file - promoters60/4901333
ctttattcgat

SEQ ID NO: 61285 - DNA, 6 bp, Unknown
  misc_feature (1)..( 6): Matrix.003 file - promoters60/4901333
gaacat

SEQ ID NO: 61286 - DNA, 6 bp, Unknown
  misc_feature (1)..( 6): Matrix.003 file - promoters60/4901333
aagaaa

SEQ ID NO: 61287 - DNA, 6 bp, Unknown
  misc_feature (1)..( 6): Matrix.003 file - promoters60/4901333
ttttaa

SEQ ID NO: 61288 - DNA, 6 bp, Unknown
  misc_feature (1)..( 6): Matrix.003 file - promoters60/4901333
aacttc

SEQ ID NO: 61289 - DNA, 7 bp, Unknown
  misc_feature (1)..( 7): Matrix.003 file - promoters60/4901333
attcatc

SEQ ID NO: 61290 - DNA, 7 bp, Unknown
  misc_feature (1)..( 7): Matrix.003 file - promoters60/4901333
atttttg

SEQ ID NO: 61291 - DNA, 7 bp, Unknown
  misc_feature (1)..( 7): Matrix.003 file - promoters60/4901333
agtcttt

SEQ ID NO: 61292 - DNA, 8 bp, Unknown
  misc_feature (1)..( 8): Matrix.003 file - promoters60/4901333
cgacttct

SEQ ID NO: 61293 - DNA, 6 bp, Unknown
  misc_feature (1)..( 6): Matrix.003 file - promoters60/4901333
tttaat

SEQ ID NO: 61294 - DNA, 7 bp, Unknown
  misc_feature (1)..( 7): Matrix.003 file - promoters60/4901333
tagataa

SEQ ID NO: 61295 - DNA, 7 bp, Unknown
  misc_feature (1)..( 7): Matrix.003 file - promoters60/4901333
aaaaaca

SEQ ID NO: 61296 - DNA, 9 bp, Unknown
  misc_feature (1)..( 9): Matrix.003 file - promoters60/4901333
acgttatag

SEQ ID NO: 61297 - DNA, 7 bp, Unknown
  misc_feature (1)..( 7): Matrix.003 file - promoters60/4901333
ttataat

SEQ ID NO: 61298 - DNA, 10 bp, Unknown
  misc_feature (1)..( 10): Matrix.003 file - promoters60/4901333
taatgggttc

SEQ ID NO: 61299 - DNA, 6 bp, Unknown
  misc_feature (1)..( 6): Matrix.003 file - promoters60/4901516
gttttg

SEQ ID NO: 61300 - DNA, 6 bp, Unknown
  misc_feature (1)..( 6): Matrix.003 file - promoters60/4901516
acattc

SEQ ID NO: 61301 - DNA, 8 bp, Unknown
  misc_feature (1)..( 8): Matrix.003 file - promoters60/4901516
aatgattt

SEQ ID NO: 61302 - DNA, 9 bp, Unknown
  misc_feature (1)..( 9): Matrix.003 file - promoters60/4901516
taaagtcaa

SEQ ID NO: 61303 - DNA, 10 bp, Unknown
  misc_feature (1)..( 10): Matrix.003 file - promoters60/4901516
aaataaaata

SEQ ID NO: 61304 - DNA, 8 bp, Unknown
  misc_feature (1)..( 8): Matrix.003 file - promoters60/4901516
tatatatt

SEQ ID NO: 61305 - DNA, 6 bp, Unknown
  misc_feature (1)..( 6): Matrix.003 file - promoters60/4901516
tcgaaa

SEQ ID NO: 61306 - DNA, 7 bp, Unknown
  misc_feature (1)..( 7): Matrix.003 file - promoters60/4901516
aagatat

SEQ ID NO: 61307 - DNA, 6 bp, Unknown
  misc_feature (1)..( 6): Matrix.003 file - promoters60/4901516
ttttgt

SEQ ID NO: 61308 - DNA, 14 bp, Unknown
  misc_feature (1)..( 14): Matrix.003 file - promoters60/4901516
gaaacaaaaacatt

SEQ ID NO: 61309 - DNA, 6 bp, Unknown
  misc_feature (1)..( 6): Matrix.003 file - promoters60/4901516
actgtt

SEQ ID NO: 61310 - DNA, 9 bp, Unknown
  misc_feature (1)..( 9): Matrix.003 file - promoters60/4901516
cccactaaa

SEQ ID NO: 61311 - DNA, 7 bp, Unknown
  misc_feature (1)..( 7): Matrix.003 file - promoters60/4901516
aaacaaa

SEQ ID NO: 61312 - DNA, 6 bp, Unknown
  misc_feature (1)..( 6): Matrix.003 file - promoters60/4901516
ctcctt

SEQ ID NO: 61313 - DNA, 6 bp, Unknown
  misc_feature (1)..( 6): Matrix.003 file - promoters60/4901516
agtaaa

SEQ ID NO: 61314 - DNA, 7 bp, Unknown
  misc_feature (1)..( 7): Matrix.003 file - promoters60/4901516
aatcggg

SEQ ID NO: 61315 - DNA, 10 bp, Unknown
  misc_feature (1)..( 10): Matrix.003 file - promoters60/4901516
ggaaaagaaa

SEQ ID NO: 61316 - DNA, 9 bp, Unknown
  misc_feature (1)..( 9): Matrix.003 file - promoters60/4901516
aaagaaaag

SEQ ID NO: 61317 - DNA, 7 bp, Unknown
  misc_feature (1)..( 7): Matrix.003 file - promoters60/4901528
tcagagc

SEQ ID NO: 61318 - DNA, 8 bp, Unknown
  misc_feature (1)..( 8): Matrix.003 file - promoters60/4901528
agtatatt

SEQ ID NO: 61319 - DNA, 7 bp, Unknown
  misc_feature (1)..( 7): Matrix.003 file - promoters60/4901528
ttaaaaa

SEQ ID NO: 61320 - DNA, 8 bp, Unknown
  misc_feature (1)..( 8): Matrix.003 file - promoters60/4901528
taacaaaa

SEQ ID NO: 61321 - DNA, 6 bp, Unknown
  misc_feature (1)..( 6): Matrix.003 file - promoters60/4901528
ttatca

SEQ ID NO: 61322 - DNA, 7 bp, Unknown
  misc_feature (1)..( 7): Matrix.003 file - promoters60/4901528
tttatta

SEQ ID NO: 61323 - DNA, 7 bp, Unknown
  misc_feature (1)..( 7): Matrix.003 file - promoters60/4901528
gtagatt

SEQ ID NO: 61324 - DNA, 7 bp, Unknown
  misc_feature (1)..( 7): Matrix.003 file - promoters60/4901528
ttccaaa

SEQ ID NO: 61325 - DNA, 7 bp, Unknown
  misc_feature (1)..( 7): Matrix.003 file - promoters60/4901528
tttgatt

SEQ ID NO: 61326 - DNA, 6 bp, Unknown
  misc_feature (1)..( 6): Matrix.003 file - promoters60/4901528
gtctcc

SEQ ID NO: 61327 - DNA, 11 bp, Unknown
  misc_feature (1)..( 11): Matrix.003 file - promoters60/4901528
accctagattt

SEQ ID NO: 61328 - DNA, 10 bp, Unknown
  misc_feature (1)..( 10): Matrix.003 file - promoters60/4901564
gtttctaaaa

SEQ ID NO: 61329 - DNA, 12 bp, Unknown
  misc_feature (1)..( 12): Matrix.003 file - promoters60/4901564
ggtatgggctgt

SEQ ID NO: 61330 - DNA, 9 bp, Unknown
  misc_feature (1)..( 9): Matrix.003 file - promoters60/4901673
tatttaagc

SEQ ID NO: 61331 - DNA, 7 bp, Unknown
  misc_feature (1)..( 7): Matrix.003 file - promoters60/4901673
aattcaa

SEQ ID NO: 61332 - DNA, 8 bp, Unknown
  misc_feature (1)..( 8): Matrix.003 file - promoters60/4901673
attccata

SEQ ID NO: 61333 - DNA, 11 bp, Unknown
  misc_feature (1)..( 11): Matrix.003 file - promoters60/4901673
ttcctagatac

SEQ ID NO: 61334 - DNA, 9 bp, Unknown
  misc_feature (1)..( 9): Matrix.003 file - promoters60/4901783
aaaaaattt

SEQ ID NO: 61335 - DNA, 8 bp, Unknown
  misc_feature (1)..( 8): Matrix.003 file - promoters60/4901783
caaacaaa

SEQ ID NO: 61336 - DNA, 9 bp, Unknown
  misc_feature (1)..( 9): Matrix.003 file - promoters60/4901783
taaatatca

SEQ ID NO: 61337 - DNA, 9 bp, Unknown
  misc_feature (1)..( 9): Matrix.003 file - promoters60/4901783
taaaaaaca

SEQ ID NO: 61338 - DNA, 8 bp, Unknown
  misc_feature (1)..( 8): Matrix.003 file - promoters60/4901783
caaaaatc

SEQ ID NO: 61339 - DNA, 7 bp, Unknown
  misc_feature (1)..( 7): Matrix.003 file - promoters60/4901822
catgtga

SEQ ID NO: 61340 - DNA, 11 bp, Unknown
  misc_feature (1)..( 11): Matrix.003 file - promoters60/4901822
aacatcaagag

SEQ ID NO: 61341 - DNA, 7 bp, Unknown
  misc_feature (1)..( 7): Matrix.003 file - promoters60/4901822
tctgcag

SEQ ID NO: 61342 - DNA, 7 bp, Unknown
  misc_feature (1)..( 7): Matrix.003 file - promoters60/4901822
aagcagt

SEQ ID NO: 61343 - DNA, 8 bp, Unknown
  misc_feature (1)..( 8): Matrix.003 file - promoters60/4901822
ggtactaa

SEQ ID NO: 61344 - DNA, 9 bp, Unknown
  misc_feature (1)..( 9): Matrix.003 file - promoters60/4901822
tttctacaa

SEQ ID NO: 61345 - DNA, 6 bp, Unknown
  misc_feature (1)..( 6): Matrix.003 file - promoters60/4901822
aaaaca

SEQ ID NO: 61346 - DNA, 6 bp, Unknown
  misc_feature (1)..( 6): Matrix.003 file - promoters60/4901822
taatta

SEQ ID NO: 61347 - DNA, 10 bp, Unknown
  misc_feature (1)..( 10): Matrix.003 file - promoters60/4901822
agaattccgg

SEQ ID NO: 61348 - DNA, 8 bp, Unknown
  misc_feature (1)..( 8): Matrix.003 file - promoters60/4901822
aacctaca

SEQ ID NO: 61349 - DNA, 7 bp, Unknown
  misc_feature (1)..( 7): Matrix.003 file - promoters60/4901822
tggaaat

SEQ ID NO: 61350 - DNA, 7 bp, Unknown
  misc_feature (1)..( 7): Matrix.003 file - promoters60/4901822
tttgtct

SEQ ID NO: 61351 - DNA, 10 bp, Unknown
  misc_feature (1)..( 10): Matrix.003 file - promoters60/4901822
tgaatcaata

SEQ ID NO: 61352 - DNA, 8 bp, Unknown
  misc_feature (1)..( 8): Matrix.003 file - promoters60/4901822
ggtgtttg

SEQ ID NO: 61353 - DNA, 6 bp, Unknown
  misc_feature (1)..( 6): Matrix.003 file - promoters60/4901822
acaaac

SEQ ID NO: 61354 - DNA, 7 bp, Unknown
  misc_feature (1)..( 7): Matrix.003 file - promoters60/4901884
aaacaaa

SEQ ID NO: 61355 - DNA, 6 bp, Unknown
  misc_feature (1)..( 6): Matrix.003 file - promoters60/4901884
acaaaa

SEQ ID NO: 61356 - DNA, 6 bp, Unknown
  misc_feature (1)..( 6): Matrix.003 file - promoters60/4901884
acaata

SEQ ID NO: 61357 - DNA, 8 bp, Unknown
  misc_feature (1)..( 8): Matrix.003 file - promoters60/4901884
ggccatga

SEQ ID NO: 61358 - DNA, 7 bp, Unknown
  misc_feature (1)..( 7): Matrix.003 file - promoters60/4901884
ataaaac

SEQ ID NO: 61359 - DNA, 6 bp, Unknown
  misc_feature (1)..( 6): Matrix.003 file - promoters60/4901884
gcaaac

SEQ ID NO: 61360 - DNA, 10 bp, Unknown
  misc_feature (1)..( 10): Matrix.003 file - promoters60/4901884
aaaaaactta

SEQ ID NO: 61361 - DNA, 9 bp, Unknown
  misc_feature (1)..( 9): Matrix.003 file - promoters60/4901884
tgagacact

SEQ ID NO: 61362 - DNA, 6 bp, Unknown
  misc_feature (1)..( 6): Matrix.003 file - promoters60/4901884
tcattt

SEQ ID NO: 61363 - DNA, 6 bp, Unknown
  misc_feature (1)..( 6): Matrix.003 file - promoters60/4901884
tataca

SEQ ID NO: 61364 - DNA, 6 bp, Unknown
  misc_feature (1)..( 6): Matrix.003 file - promoters60/4901884
aattta

SEQ ID NO: 61365 - DNA, 6 bp, Unknown
  misc_feature (1)..( 6): Matrix.003 file - promoters60/4901884
ataatt

SEQ ID NO: 61366 - DNA, 6 bp, Unknown
  misc_feature (1)..( 6): Matrix.003 file - promoters60/4901884
ttttaa

SEQ ID NO: 61367 - DNA, 6 bp, Unknown
  misc_feature (1)..( 6): Matrix.003 file - promoters60/4901884
aataat

SEQ ID NO: 61368 - DNA, 6 bp, Unknown
  misc_feature (1)..( 6): Matrix.003 file - promoters60/4902082
ctttta

SEQ ID NO: 61369 - DNA, 7 bp, Unknown
  misc_feature (1)..( 7): Matrix.003 file - promoters60/4902082
tttatta

SEQ ID NO: 61370 - DNA, 6 bp, Unknown
  misc_feature (1)..( 6): Matrix.003 file - promoters60/4902082
ataatt

SEQ ID NO: 61371 - DNA, 6 bp, Unknown
  misc_feature (1)..( 6): Matrix.003 file - promoters60/4902082
attgaa

SEQ ID NO: 61372 - DNA, 8 bp, Unknown
  misc_feature (1)..( 8): Matrix.003 file - promoters60/4902082
ttccatca

SEQ ID NO: 61373 - DNA, 8 bp, Unknown
  misc_feature (1)..( 8): Matrix.003 file - promoters60/4902082
ttaaatcc

SEQ ID NO: 61374 - DNA, 9 bp, Unknown
  misc_feature (1)..( 9): Matrix.003 file - promoters60/4902082
acaatgatg

SEQ ID NO: 61375 - DNA, 6 bp, Unknown
  misc_feature (1)..( 6): Matrix.003 file - promoters60/4902082
caaatg

SEQ ID NO: 61376 - DNA, 6 bp, Unknown
  misc_feature (1)..( 6): Matrix.003 file - promoters60/4902082
agtata

SEQ ID NO: 61377 - DNA, 8 bp, Unknown
  misc_feature (1)..( 8): Matrix.003 file - promoters60/4902082
caaatggt

SEQ ID NO: 61378 - DNA, 7 bp, Unknown
  misc_feature (1)..( 7): Matrix.003 file - promoters60/4902082
attattt

SEQ ID NO: 61379 - DNA, 7 bp, Unknown
  misc_feature (1)..( 7): Matrix.003 file - promoters60/4902082
atagata

SEQ ID NO: 61380 - DNA, 7 bp, Unknown
  misc_feature (1)..( 7): Matrix.003 file - promoters60/4902082
atggaat

SEQ ID NO: 61381 - DNA, 7 bp, Unknown
  misc_feature (1)..( 7): Matrix.003 file - promoters60/4902082
accaaat

SEQ ID NO: 61382 - DNA, 6 bp, Unknown
  misc_feature (1)..( 6): Matrix.003 file - promoters60/4902082
tattat

SEQ ID NO: 61383 - DNA, 6 bp, Unknown
  misc_feature (1)..( 6): Matrix.003 file - promoters60/4902082
aaaaaa

SEQ ID NO: 61384 - DNA, 6 bp, Unknown
  misc_feature (1)..( 6): Matrix.003 file - promoters60/4902082
gtcaaa

SEQ ID NO: 61385 - DNA, 6 bp, Unknown
  misc_feature (1)..( 6): Matrix.003 file - promoters60/4902082
ggcgag

SEQ ID NO: 61386 - DNA, 7 bp, Unknown
  misc_feature (1)..( 7): Matrix.003 file - promoters60/4902143
accagaa

SEQ ID NO: 61387 - DNA, 7 bp, Unknown
  misc_feature (1)..( 7): Matrix.003 file - promoters60/4902143
aaacacc

SEQ ID NO: 61388 - DNA, 7 bp, Unknown
  misc_feature (1)..( 7): Matrix.003 file - promoters60/4902143
aaaatca

SEQ ID NO: 61389 - DNA, 7 bp, Unknown
  misc_feature (1)..( 7): Matrix.003 file - promoters60/4902143
atggttt

SEQ ID NO: 61390 - DNA, 8 bp, Unknown
  misc_feature (1)..( 8): Matrix.003 file - promoters60/4902143
taaaatat

SEQ ID NO: 61391 - DNA, 12 bp, Unknown
  misc_feature (1)..( 12): Matrix.003 file - promoters60/4902143
taaacaataaat

SEQ ID NO: 61392 - DNA, 9 bp, Unknown
  misc_feature (1)..( 9): Matrix.003 file - promoters60/4902288
aaaatctac

SEQ ID NO: 61393 - DNA, 10 bp, Unknown
  misc_feature (1)..( 10): Matrix.003 file - promoters60/4902288
gaaatagatt

SEQ ID NO: 61394 - DNA, 13 bp, Unknown
  misc_feature (1)..( 13): Matrix.003 file - promoters60/4902387
taaatatcatatt

SEQ ID NO: 61395 - DNA, 7 bp, Unknown
  misc_feature (1)..( 7): Matrix.003 file - promoters60/4902387
ttagaaa

SEQ ID NO: 61396 - DNA, 6 bp, Unknown
  misc_feature (1)..( 6): Matrix.003 file - promoters60/4902387
acatgt

SEQ ID NO: 61397 - DNA, 11 bp, Unknown
  misc_feature (1)..( 11): Matrix.003 file - promoters60/4902387
aaaaatgttta

SEQ ID NO: 61398 - DNA, 9 bp, Unknown
  misc_feature (1)..( 9): Matrix.003 file - promoters60/4902387
acatgttta

SEQ ID NO: 61399 - DNA, 10 bp, Unknown
  misc_feature (1)..( 10): Matrix.003 file - promoters60/4902387
atctaaataa

SEQ ID NO: 61400 - DNA, 10 bp, Unknown
  misc_feature (1)..( 10): Matrix.003 file - promoters60/4902387
aaataaataa

SEQ ID NO: 61401 - DNA, 7 bp, Unknown
  misc_feature (1)..( 7): Matrix.003 file - promoters60/4902791
caaacca

SEQ ID NO: 61402 - DNA, 10 bp, Unknown
  misc_feature (1)..( 10): Matrix.003 file - promoters60/4902791
aaataataaa

SEQ ID NO: 61403 - DNA, 9 bp, Unknown
  misc_feature (1)..( 9): Matrix.003 file - promoters60/4903407
taaataaaa

SEQ ID NO: 61404 - DNA, 8 bp, Unknown
  misc_feature (1)..( 8): Matrix.003 file - promoters60/4903407
aaaaacta

SEQ ID NO: 61405 - DNA, 10 bp, Unknown
  misc_feature (1)..( 10): Matrix.003 file - promoters60/4903407
acaaaaaaaa

SEQ ID NO: 61406 - DNA, 10 bp, Unknown
  misc_feature (1)..( 10): Matrix.003 file - promoters60/4903407
gtttttcttt

SEQ ID NO: 61407 - DNA, 11 bp, Unknown
  misc_feature (1)..( 11): Matrix.003 file - promoters60/4903407
aaaaatatatt

SEQ ID NO: 61408 - DNA, 6 bp, Unknown
  misc_feature (1)..( 6): Matrix.003 file - promoters60/4903614
gattga

SEQ ID NO: 61409 - DNA, 8 bp, Unknown
  misc_feature (1)..( 8): Matrix.003 file - promoters60/4903614
tcgatttt

SEQ ID NO: 61410 - DNA, 6 bp, Unknown
  misc_feature (1)..( 6): Matrix.003 file - promoters60/4903614
atttta

SEQ ID NO: 61411 - DNA, 10 bp, Unknown
  misc_feature (1)..( 10): Matrix.003 file - promoters60/4903614
ttaatataaa

SEQ ID NO: 61412 - DNA, 6 bp, Unknown
  misc_feature (1)..( 6): Matrix.003 file - promoters60/4903614
aaccgt

SEQ ID NO: 61413 - DNA, 7 bp, Unknown
  misc_feature (1)..( 7): Matrix.003 file - promoters60/4903614
taaacta

SEQ ID NO: 61414 - DNA, 6 bp, Unknown
  misc_feature (1)..( 6): Matrix.003 file - promoters60/4903614
aatatt

SEQ ID NO: 61415 - DNA, 7 bp, Unknown
  misc_feature (1)..( 7): Matrix.003 file - promoters60/4903614
attataa

SEQ ID NO: 61416 - DNA, 8 bp, Unknown
  misc_feature (1)..( 8): Matrix.003 file - promoters60/4903614
tattataa

SEQ ID NO: 61417 - DNA, 8 bp, Unknown
  misc_feature (1)..( 8): Matrix.003 file - promoters60/4903614
tttatggt

SEQ ID NO: 61418 - DNA, 7 bp, Unknown
  misc_feature (1)..( 7): Matrix.003 file - promoters60/4903614
aataaaa

SEQ ID NO: 61419 - DNA, 7 bp, Unknown
  misc_feature (1)..( 7): Matrix.003 file - promoters60/4903614
acaaatt

SEQ ID NO: 61420 - DNA, 6 bp, Unknown
  misc_feature (1)..( 6): Matrix.003 file - promoters60/4903614
agaaaa

SEQ ID NO: 61421 - DNA, 6 bp, Unknown
  misc_feature (1)..( 6): Matrix.003 file - promoters60/4903614
taataa

SEQ ID NO: 61422 - DNA, 7 bp, Unknown
  misc_feature (1)..( 7): Matrix.003 file - promoters60/4903614
tgtgtga

SEQ ID NO: 61423 - DNA, 6 bp, Unknown
  misc_feature (1)..( 6): Matrix.003 file - promoters60/4903614
taaaca

SEQ ID NO: 61424 - DNA, 7 bp, Unknown
  misc_feature (1)..( 7): Matrix.003 file - promoters60/4903614
acaaaat

SEQ ID NO: 61425 - DNA, 8 bp, Unknown
  misc_feature (1)..( 8): Matrix.003 file - promoters60/4903614
gttaaata

SEQ ID NO: 61426 - DNA, 6 bp, Unknown
  misc_feature (1)..( 6): Matrix.003 file - promoters60/4903614
aaacct

SEQ ID NO: 61427 - DNA, 8 bp, Unknown
  misc_feature (1)..( 8): Matrix.003 file - promoters60/4903653
aaaaatag

SEQ ID NO: 61428 - DNA, 9 bp, Unknown
  misc_feature (1)..( 9): Matrix.003 file - promoters60/4903653
ataaaaaca

SEQ ID NO: 61429 - DNA, 7 bp, Unknown
  misc_feature (1)..( 7): Matrix.003 file - promoters60/4903653
aaagtag

SEQ ID NO: 61430 - DNA, 11 bp, Unknown
  misc_feature (1)..( 11): Matrix.003 file - promoters60/4904511
tatatcttttt

SEQ ID NO: 61431 - DNA, 13 bp, Unknown
  misc_feature (1)..( 13): Matrix.003 file - promoters60/4904511
taacaattactac

SEQ ID NO: 61432 - DNA, 9 bp, Unknown
  misc_feature (1)..( 9): Matrix.003 file - promoters60/4904511
ttataaata

SEQ ID NO: 61433 - DNA, 10 bp, Unknown
  misc_feature (1)..( 10): Matrix.003 file - promoters60/4904511
tcgactctta

SEQ ID NO: 61434 - DNA, 7 bp, Unknown
  misc_feature (1)..( 7): Matrix.003 file - promoters60/4906198
atctaaa

SEQ ID NO: 61435 - DNA, 9 bp, Unknown
  misc_feature (1)..( 9): Matrix.003 file - promoters60/4906198
caacaattt

SEQ ID NO: 61436 - DNA, 8 bp, Unknown
  misc_feature (1)..( 8): Matrix.003 file - promoters60/4906198
tttacaat

SEQ ID NO: 61437 - DNA, 8 bp, Unknown
  misc_feature (1)..( 8): Matrix.003 file - promoters60/4906198
atattcac

SEQ ID NO: 61438 - DNA, 8 bp, Unknown
  misc_feature (1)..( 8): Matrix.003 file - promoters60/4906198
aataaaaa

SEQ ID NO: 61439 - DNA, 9 bp, Unknown
  misc_feature (1)..( 9): Matrix.003 file - promoters60/4909449
tatataaag

SEQ ID NO: 61440 - DNA, 10 bp, Unknown
  misc_feature (1)..( 10): Matrix.003 file - promoters60/4909449
aaaattagat

SEQ ID NO: 61441 - DNA, 7 bp, Unknown
  misc_feature (1)..( 7): Matrix.003 file - promoters60/4910362
acaaatg

SEQ ID NO: 61442 - DNA, 8 bp, Unknown
  misc_feature (1)..( 8): Matrix.003 file - promoters60/4910362
atttgtct

SEQ ID NO: 61443 - DNA, 7 bp, Unknown
  misc_feature (1)..( 7): Matrix.003 file - promoters60/4910362
ttctttg

SEQ ID NO: 61444 - DNA, 7 bp, Unknown
  misc_feature (1)..( 7): Matrix.003 file - promoters60/4910362
aacaaaa

SEQ ID NO: 61445 - DNA, 7 bp, Unknown
  misc_feature (1)..( 7): Matrix.003 file - promoters60/4910362
taaattc

SEQ ID NO: 61446 - DNA, 9 bp, Unknown
  misc_feature (1)..( 9): Matrix.003 file - promoters60/4910362
aatttactt

SEQ ID NO: 61447 - DNA, 7 bp, Unknown
  misc_feature (1)..( 7): Matrix.003 file - promoters60/4910362
ttatttt

SEQ ID NO: 61448 - DNA, 8 bp, Unknown
  misc_feature (1)..( 8): Matrix.003 file - promoters60/4910362
tatatatt

SEQ ID NO: 61449 - DNA, 9 bp, Unknown
  misc_feature (1)..( 9): Matrix.003 file - promoters60/4910362
tttttattt

SEQ ID NO: 61450 - DNA, 10 bp, Unknown
  misc_feature (1)..( 10): Matrix.003 file - promoters60/4910362
ttgaccttat

SEQ ID NO: 61451 - DNA, 8 bp, Unknown
  misc_feature (1)..( 8): Matrix.003 file - promoters60/4910362
atttaaca

SEQ ID NO: 61452 - DNA, 7 bp, Unknown
  misc_feature (1)..( 7): Matrix.003 file - promoters60/4910362
ttactaa

SEQ ID NO: 61453 - DNA, 8 bp, Unknown
  misc_feature (1)..( 8): Matrix.003 file - promoters60/4910362
attctaat

SEQ ID NO: 61454 - DNA, 9 bp, Unknown
  misc_feature (1)..( 9): Matrix.003 file - promoters60/4910362
taatctatt

SEQ ID NO: 61455 - DNA, 6 bp, Unknown
  misc_feature (1)..( 6): Matrix.003 file - promoters60/4910362
actgta

SEQ ID NO: 61456 - DNA, 6 bp, Unknown
  misc_feature (1)..( 6): Matrix.003 file - promoters60/4910362
tttgta

SEQ ID NO: 61457 - DNA, 7 bp, Unknown
  misc_feature (1)..( 7): Matrix.003 file - promoters60/4910362
tttcctt

SEQ ID NO: 61458 - DNA, 6 bp, Unknown
  misc_feature (1)..( 6): Matrix.003 file - promoters60/4910362
tatttt

SEQ ID NO: 61459 - DNA, 7 bp, Unknown
  misc_feature (1)..( 7): Matrix.003 file - promoters60/4910362
gaaaaaa

SEQ ID NO: 61460 - DNA, 7 bp, Unknown
  misc_feature (1)..( 7): Matrix.003 file - promoters60/4910362
aaaatct

SEQ ID NO: 61461 - DNA, 7 bp, Unknown
  misc_feature (1)..( 7): Matrix.003 file - promoters60/4910362
aaccaaa

SEQ ID NO: 61462 - DNA, 9 bp, Unknown
  misc_feature (1)..( 9): Matrix.003 file - promoters60/4910426
cttaattat

SEQ ID NO: 61463 - DNA, 8 bp, Unknown
  misc_feature (1)..( 8): Matrix.003 file - promoters60/4910426
ataattat

SEQ ID NO: 61464 - DNA, 11 bp, Unknown
  misc_feature (1)..( 11): Matrix.003 file - promoters60/4910426
ctatatatata

SEQ ID NO: 61465 - DNA, 11 bp, Unknown
  misc_feature (1)..( 11): Matrix.003 file - promoters60/4910426
atataaatata

SEQ ID NO: 61466 - DNA, 6 bp, Unknown
  misc_feature (1)..( 6): Matrix.003 file - promoters60/4911303
tttaag

SEQ ID NO: 61467 - DNA, 7 bp, Unknown
  misc_feature (1)..( 7): Matrix.003 file - promoters60/4911303
taattta

SEQ ID NO: 61468 - DNA, 5 bp, Unknown
  misc_feature (1)..( 5): Matrix.003 file - promoters60/4911303
agaga

SEQ ID NO: 61469 - DNA, 9 bp, Unknown
  misc_feature (1)..( 9): Matrix.003 file - promoters60/4911303
tctatttaa

SEQ ID NO: 61470 - DNA, 9 bp, Unknown
  misc_feature (1)..( 9): Matrix.003 file - promoters60/4911303
ttttcttta

SEQ ID NO: 61471 - DNA, 6 bp, Unknown
  misc_feature (1)..( 6): Matrix.003 file - promoters60/4911303
atcatt

SEQ ID NO: 61472 - DNA, 8 bp, Unknown
  misc_feature (1)..( 8): Matrix.003 file - promoters60/4911303
aagtatta

SEQ ID NO: 61473 - DNA, 7 bp, Unknown
  misc_feature (1)..( 7): Matrix.003 file - promoters60/4911303
taagtta

SEQ ID NO: 61474 - DNA, 8 bp, Unknown
  misc_feature (1)..( 8): Matrix.003 file - promoters60/4911303
aaaagaaa

SEQ ID NO: 61475 - DNA, 11 bp, Unknown
  misc_feature (1)..( 11): Matrix.003 file - promoters60/4911303
aaaagaaacta

SEQ ID NO: 61476 - DNA, 8 bp, Unknown
  misc_feature (1)..( 8): Matrix.003 file - promoters60/4911303
atttcttt

SEQ ID NO: 61477 - DNA, 6 bp, Unknown
  misc_feature (1)..( 6): Matrix.003 file - promoters60/4911303
ttattt

SEQ ID NO: 61478 - DNA, 7 bp, Unknown
  misc_feature (1)..( 7): Matrix.003 file - promoters60/4911303
gacatga

SEQ ID NO: 61479 - DNA, 7 bp, Unknown
  misc_feature (1)..( 7): Matrix.003 file - promoters60/4911303
ccgcgta

SEQ ID NO: 61480 - DNA, 8 bp, Unknown
  misc_feature (1)..( 8): Matrix.003 file - promoters60/4911303
cgcgggaa

SEQ ID NO: 61481 - DNA, 6 bp, Unknown
  misc_feature (1)..( 6): Matrix.003 file - promoters60/4911303
tttata

SEQ ID NO: 61482 - DNA, 10 bp, Unknown
  misc_feature (1)..( 10): Matrix.003 file - promoters60/4911303
taacagagat

SEQ ID NO: 61483 - DNA, 6 bp, Unknown
  misc_feature (1)..( 6): Matrix.003 file - promoters60/4911303
tttata

SEQ ID NO: 61484 - DNA, 6 bp, Unknown
  misc_feature (1)..( 6): Matrix.003 file - promoters60/4911303
aaacag

SEQ ID NO: 61485 - DNA, 7 bp, Unknown
  misc_feature (1)..( 7): Matrix.003 file - promoters60/4911303
tttaatt

SEQ ID NO: 61486 - DNA, 6 bp, Unknown
  misc_feature (1)..( 6): Matrix.003 file - promoters60/4911303
tccact

SEQ ID NO: 61487 - DNA, 8 bp, Unknown
  misc_feature (1)..( 8): Matrix.003 file - promoters60/4911303
attaatga

SEQ ID NO: 61488 - DNA, 6 bp, Unknown
  misc_feature (1)..( 6): Matrix.003 file - promoters60/4911303
cgggtc

SEQ ID NO: 61489 - DNA, 11 bp, Unknown
  misc_feature (1)..( 11): Matrix.003 file - promoters60/4911309
caaaatttctt

SEQ ID NO: 61490 - DNA, 6 bp, Unknown
  misc_feature (1)..( 6): Matrix.003 file - promoters60/4911309
ttttct

SEQ ID NO: 61491 - DNA, 9 bp, Unknown
  misc_feature (1)..( 9): Matrix.003 file - promoters60/4911309
tatgcttat

SEQ ID NO: 61492 - DNA, 9 bp, Unknown
  misc_feature (1)..( 9): Matrix.003 file - promoters60/4911309
tcttattat

SEQ ID NO: 61493 - DNA, 10 bp, Unknown
  misc_feature (1)..( 10): Matrix.003 file - promoters60/4911309
ttcttttgaa

SEQ ID NO: 61494 - DNA, 12 bp, Unknown
  misc_feature (1)..( 12): Matrix.003 file - promoters60/4911312
aattttaaaatc

SEQ ID NO: 61495 - DNA, 7 bp, Unknown
  misc_feature (1)..( 7): Matrix.003 file - promoters60/4911314
gagttgt

SEQ ID NO: 61496 - DNA, 9 bp, Unknown
  misc_feature (1)..( 9): Matrix.003 file - promoters60/4911314
ctgatgaaa

SEQ ID NO: 61497 - DNA, 6 bp, Unknown
  misc_feature (1)..( 6): Matrix.003 file - promoters60/4911314
aatctt

SEQ ID NO: 61498 - DNA, 8 bp, Unknown
  misc_feature (1)..( 8): Matrix.003 file - promoters60/4911314
aacttaaa

SEQ ID NO: 61499 - DNA, 6 bp, Unknown
  misc_feature (1)..( 6): Matrix.003 file - promoters60/4911314
tagtct

SEQ ID NO: 61500 - DNA, 6 bp, Unknown
  misc_feature (1)..( 6): Matrix.003 file - promoters60/4911314
ctaaac

SEQ ID NO: 61501 - DNA, 6 bp, Unknown
  misc_feature (1)..( 6): Matrix.003 file - promoters60/4911314
agttgt

SEQ ID NO: 61502 - DNA, 8 bp, Unknown
  misc_feature (1)..( 8): Matrix.003 file - promoters60/4911314
atgtagct

SEQ ID NO: 61503 - DNA, 8 bp, Unknown
  misc_feature (1)..( 8): Matrix.003 file - promoters60/4911314
ttgacagt

SEQ ID NO: 61504 - DNA, 9 bp, Unknown
  misc_feature (1)..( 9): Matrix.003 file - promoters60/4911314
tttgtctaa

SEQ ID NO: 61505 - DNA, 7 bp, Unknown
  misc_feature (1)..( 7): Matrix.003 file - promoters60/4911314
tcttctc

SEQ ID NO: 61506 - DNA, 7 bp, Unknown
  misc_feature (1)..( 7): Matrix.003 file - promoters60/4911314
ttcactt

SEQ ID NO: 61507 - DNA, 6 bp, Unknown
  misc_feature (1)..( 6): Matrix.003 file - promoters60/4911314
atttaa

SEQ ID NO: 61508 - DNA, 7 bp, Unknown
  misc_feature (1)..( 7): Matrix.003 file - promoters60/4911314
aaagtaa

SEQ ID NO: 61509 - DNA, 9 bp, Unknown
  misc_feature (1)..( 9): Matrix.003 file - promoters60/4911314
cacgtgtga

SEQ ID NO: 61510 - DNA, 7 bp, Unknown
  misc_feature (1)..( 7): Matrix.003 file - promoters60/4911314
aagtcaa

SEQ ID NO: 61511 - DNA, 6 bp, Unknown
  misc_feature (1)..( 6): Matrix.003 file - promoters60/4911314
tcaagt

SEQ ID NO: 61512 - DNA, 7 bp, Unknown
  misc_feature (1)..( 7): Matrix.003 file - promoters60/4911314
acaaaca

SEQ ID NO: 61513 - DNA, 10 bp, Unknown
  misc_feature (1)..( 10): Matrix.003 file - promoters60/4911457
gttgaatttg

SEQ ID NO: 61514 - DNA, 8 bp, Unknown
  misc_feature (1)..( 8): Matrix.003 file - promoters60/4911457
tttagata

SEQ ID NO: 61515 - DNA, 7 bp, Unknown
  misc_feature (1)..( 7): Matrix.003 file - promoters60/4911457
catcaat

SEQ ID NO: 61516 - DNA, 9 bp, Unknown
  misc_feature (1)..( 9): Matrix.003 file - promoters60/4911457
tgtaacatt

SEQ ID NO: 61517 - DNA, 8 bp, Unknown
  misc_feature (1)..( 8): Matrix.003 file - promoters60/4911457
ttgatttc

SEQ ID NO: 61518 - DNA, 8 bp, Unknown
  misc_feature (1)..( 8): Matrix.003 file - promoters60/4911457
ttgatttc

SEQ ID NO: 61519 - DNA, 13 bp, Unknown
  misc_feature (1)..( 13): Matrix.003 file - promoters60/4911457
cttgagtccttta

SEQ ID NO: 61520 - DNA, 11 bp, Unknown
  misc_feature (1)..( 11): Matrix.003 file - promoters60/4911457
gaatttgagat

SEQ ID NO: 61521 - DNA, 8 bp, Unknown
  misc_feature (1)..( 8): Matrix.003 file - promoters60/4911457
ggtctttt

SEQ ID NO: 61522 - DNA, 9 bp, Unknown
  misc_feature (1)..( 9): Matrix.003 file - promoters60/4911457
tgttggaga

SEQ ID NO: 61523 - DNA, 10 bp, Unknown
  misc_feature (1)..( 10): Matrix.003 file - promoters60/4911457
aattttagat

SEQ ID NO: 61524 - DNA, 12 bp, Unknown
  misc_feature (1)..( 12): Matrix.003 file - promoters60/4911457
ataagtattgtt

SEQ ID NO: 61525 - DNA, 11 bp, Unknown
  misc_feature (1)..( 11): Matrix.003 file - promoters60/4911485
ttatattttat

SEQ ID NO: 61526 - DNA, 8 bp, Unknown
  misc_feature (1)..( 8): Matrix.003 file - promoters60/4911485
aatgggcc

SEQ ID NO: 61527 - DNA, 14 bp, Unknown
  misc_feature (1)..( 14): Matrix.003 file - promoters60/4911485
gaaatataaagccc

SEQ ID NO: 61528 - DNA, 7 bp, Unknown
  misc_feature (1)..( 7): Matrix.003 file - promoters60/4911492
atttatt

SEQ ID NO: 61529 - DNA, 10 bp, Unknown
  misc_feature (1)..( 10): Matrix.003 file - promoters60/4911492
ttaataatta

SEQ ID NO: 61530 - DNA, 10 bp, Unknown
  misc_feature (1)..( 10): Matrix.003 file - promoters60/4911492
gattaaaatt

SEQ ID NO: 61531 - DNA, 9 bp, Unknown
  misc_feature (1)..( 9): Matrix.003 file - promoters60/4911492
gtaaaataa

SEQ ID NO: 61532 - DNA, 8 bp, Unknown
  misc_feature (1)..( 8): Matrix.003 file - promoters60/4912240
caaaacac

SEQ ID NO: 61533 - DNA, 16 bp, Unknown
  misc_feature (1)..( 16): Matrix.003 file - promoters60/4912240
taattgattcaaaatt

SEQ ID NO: 61534 - DNA, 7 bp, Unknown
  misc_feature (1)..( 7): Matrix.003 file - promoters60/4912240
ttttaac

SEQ ID NO: 61535 - DNA, 11 bp, Unknown
  misc_feature (1)..( 11): Matrix.003 file - promoters60/4912541
ggctcctgtga

SEQ ID NO: 61536 - DNA, 8 bp, Unknown
  misc_feature (1)..( 8): Matrix.003 file - promoters60/4912541
gtttaaat

SEQ ID NO: 61537 - DNA, 13 bp, Unknown
  misc_feature (1)..( 13): Matrix.003 file - promoters60/4912541
aaattctcagtct

SEQ ID NO: 61538 - DNA, 9 bp, Unknown
  misc_feature (1)..( 9): Matrix.003 file - promoters60/4912541
gattctaat

SEQ ID NO: 61539 - DNA, 7 bp, Unknown
  misc_feature (1)..( 7): Matrix.003 file - promoters60/4912541
tgtgtaa

SEQ ID NO: 61540 - DNA, 7 bp, Unknown
  misc_feature (1)..( 7): Matrix.003 file - promoters60/4912541
gaaaccc

SEQ ID NO: 61541 - DNA, 7 bp, Unknown
  misc_feature (1)..( 7): Matrix.003 file - promoters60/4912541
aagggct

SEQ ID NO: 61542 - DNA, 6 bp, Unknown
  misc_feature (1)..( 6): Matrix.003 file - promoters60/4912541
gctaaa

SEQ ID NO: 61543 - DNA, 8 bp, Unknown
  misc_feature (1)..( 8): Matrix.003 file - promoters60/4912541
ccggtcaa

SEQ ID NO: 61544 - DNA, 6 bp, Unknown
  misc_feature (1)..( 6): Matrix.003 file - promoters60/4912541
aaagtt

SEQ ID NO: 61545 - DNA, 7 bp, Unknown
  misc_feature (1)..( 7): Matrix.003 file - promoters60/4912541
ccgtttt

SEQ ID NO: 61546 - DNA, 7 bp, Unknown
  misc_feature (1)..( 7): Matrix.003 file - promoters60/4912541
tttgttt

SEQ ID NO: 61547 - DNA, 6 bp, Unknown
  misc_feature (1)..( 6): Matrix.003 file - promoters60/4912541
gatttg

SEQ ID NO: 61548 - DNA, 8 bp, Unknown
  misc_feature (1)..( 8): Matrix.003 file - promoters60/4912541
aaggagaa

SEQ ID NO: 61549 - DNA, 13 bp, Unknown
  misc_feature (1)..( 13): Matrix.003 file - promoters60/4913068
gttgtaaaaatta

SEQ ID NO: 61550 - DNA, 8 bp, Unknown
  misc_feature (1)..( 8): Matrix.003 file - promoters60/4913068
aaaaatta

SEQ ID NO: 61551 - DNA, 15 bp, Unknown
  misc_feature (1)..( 15): Matrix.003 file - promoters60/4913068
aaaatgtaattctat

SEQ ID NO: 61552 - DNA, 8 bp, Unknown
  misc_feature (1)..( 8): Matrix.003 file - promoters60/4913068
ctttggaa

SEQ ID NO: 61553 - DNA, 7 bp, Unknown
  misc_feature (1)..( 7): Matrix.003 file - promoters60/4913068
ttgtatt

SEQ ID NO: 61554 - DNA, 11 bp, Unknown
  misc_feature (1)..( 11): Matrix.003 file - promoters60/4913068
ataatttttta

SEQ ID NO: 61555 - DNA, 10 bp, Unknown
  misc_feature (1)..( 10): Matrix.003 file - promoters60/4913068
taggaagaaa

SEQ ID NO: 61556 - DNA, 11 bp, Unknown
  misc_feature (1)..( 11): Matrix.003 file - promoters60/4913068
tgtaaaaaata

SEQ ID NO: 61557 - DNA, 15 bp, Unknown
  misc_feature (1)..( 15): Matrix.003 file - promoters60/4913068
ttgtataaaaaaatt

SEQ ID NO: 61558 - DNA, 11 bp, Unknown
  misc_feature (1)..( 11): Matrix.003 file - promoters60/4913068
ataaaaaaaaa

SEQ ID NO: 61559 - DNA, 8 bp, Unknown
  misc_feature (1)..( 8): Matrix.003 file - promoters60/4913068
ctttggaa

SEQ ID NO: 61560 - DNA, 11 bp, Unknown
  misc_feature (1)..( 11): Matrix.003 file - promoters60/4913068
gattattttgg

SEQ ID NO: 61561 - DNA, 8 bp, Unknown
  misc_feature (1)..( 8): Matrix.003 file - promoters60/4913068
aaatcttt

SEQ ID NO: 61562 - DNA, 13 bp, Unknown
  misc_feature (1)..( 13): Matrix.003 file - promoters60/4913068
acaaattaaattt

SEQ ID NO: 61563 - DNA, 10 bp, Unknown
  misc_feature (1)..( 10): Matrix.003 file - promoters60/4913068
ttaatgtttg

SEQ ID NO: 61564 - DNA, 8 bp, Unknown
  misc_feature (1)..( 8): Matrix.003 file - promoters60/4913083
ttactaaa

SEQ ID NO: 61565 - DNA, 9 bp, Unknown
  misc_feature (1)..( 9): Matrix.003 file - promoters60/4913083
agtgatgtt

SEQ ID NO: 61566 - DNA, 13 bp, Unknown
  misc_feature (1)..( 13): Matrix.003 file - promoters60/4913724
aacattttggttt

SEQ ID NO: 61567 - DNA, 8 bp, Unknown
  misc_feature (1)..( 8): Matrix.003 file - promoters60/4913724
gttgatgt

SEQ ID NO: 61568 - DNA, 13 bp, Unknown
  misc_feature (1)..( 13): Matrix.003 file - promoters60/4913724
gagataagtattg

SEQ ID NO: 61569 - DNA, 7 bp, Unknown
  misc_feature (1)..( 7): Matrix.003 file - promoters60/4914111
tttgccg

SEQ ID NO: 61570 - DNA, 8 bp, Unknown
  misc_feature (1)..( 8): Matrix.003 file - promoters60/4914111
ctgtttat

SEQ ID NO: 61571 - DNA, 9 bp, Unknown
  misc_feature (1)..( 9): Matrix.003 file - promoters60/4914111
ctgtgtctc

SEQ ID NO: 61572 - DNA, 7 bp, Unknown
  misc_feature (1)..( 7): Matrix.003 file - promoters60/4914111
tctggtt

SEQ ID NO: 61573 - DNA, 7 bp, Unknown
  misc_feature (1)..( 7): Matrix.003 file - promoters60/4914111
gatgcag

SEQ ID NO: 61574 - DNA, 7 bp, Unknown
  misc_feature (1)..( 7): Matrix.003 file - promoters60/4914111
acaagtg

SEQ ID NO: 61575 - DNA, 7 bp, Unknown
  misc_feature (1)..( 7): Matrix.003 file - promoters60/4914111
aatagtt

SEQ ID NO: 61576 - DNA, 9 bp, Unknown
  misc_feature (1)..( 9): Matrix.003 file - promoters60/4914111
attggactt

SEQ ID NO: 61577 - DNA, 6 bp, Unknown
  misc_feature (1)..( 6): Matrix.003 file - promoters60/4914111
aatttc

SEQ ID NO: 61578 - DNA, 7 bp, Unknown
  misc_feature (1)..( 7): Matrix.003 file - promoters60/4914111
tctgtct

SEQ ID NO: 61579 - DNA, 8 bp, Unknown
  misc_feature (1)..( 8): Matrix.003 file - promoters60/4914111
aatgattt

SEQ ID NO: 61580 - DNA, 6 bp, Unknown
  misc_feature (1)..( 6): Matrix.003 file - promoters60/4914111
aacagt

SEQ ID NO: 61581 - DNA, 6 bp, Unknown
  misc_feature (1)..( 6): Matrix.003 file - promoters60/4914111
attgga

SEQ ID NO: 61582 - DNA, 6 bp, Unknown
  misc_feature (1)..( 6): Matrix.003 file - promoters60/4914111
taattt

SEQ ID NO: 61583 - DNA, 7 bp, Unknown
  misc_feature (1)..( 7): Matrix.003 file - promoters60/4914111
tttattg

SEQ ID NO: 61584 - DNA, 6 bp, Unknown
  misc_feature (1)..( 6): Matrix.003 file - promoters60/4914111
tctaga

SEQ ID NO: 61585 - DNA, 10 bp, Unknown
  misc_feature (1)..( 10): Matrix.003 file - promoters60/4915127
tatataaata

SEQ ID NO: 61586 - DNA, 8 bp, Unknown
  misc_feature (1)..( 8): Matrix.003 file - promoters60/4915163
caaaatat

SEQ ID NO: 61587 - DNA, 11 bp, Unknown
  misc_feature (1)..( 11): Matrix.003 file - promoters60/4915163
taatataagta

SEQ ID NO: 61588 - DNA, 9 bp, Unknown
  misc_feature (1)..( 9): Matrix.003 file - promoters60/4915163
attattcat

SEQ ID NO: 61589 - DNA, 7 bp, Unknown
  misc_feature (1)..( 7): Matrix.003 file - promoters60/4915163
attttaa

SEQ ID NO: 61590 - DNA, 9 bp, Unknown
  misc_feature (1)..( 9): Matrix.003 file - promoters60/4915163
tttataagt

SEQ ID NO: 61591 - DNA, 9 bp, Unknown
  misc_feature (1)..( 9): Matrix.003 file - promoters60/4915163
aaaatatat

SEQ ID NO: 61592 - DNA, 17 bp, Unknown
  misc_feature (1)..( 17): Matrix.003 file - promoters60/4915163
taaattttaaaattatt

SEQ ID NO: 61593 - DNA, 10 bp, Unknown
  misc_feature (1)..( 10): Matrix.003 file - promoters60/4915163
atttaaatta

SEQ ID NO: 61594 - DNA, 10 bp, Unknown
  misc_feature (1)..( 10): Matrix.003 file - promoters60/4915163
tattttaatt

SEQ ID NO: 61595 - DNA, 6 bp, Unknown
  misc_feature (1)..( 6): Matrix.003 file - promoters60/4915163
tttaag

SEQ ID NO: 61596 - DNA, 13 bp, Unknown
  misc_feature (1)..( 13): Matrix.003 file - promoters60/4915163
attctaaaattat

SEQ ID NO: 61597 - DNA, 13 bp, Unknown
  misc_feature (1)..( 13): Matrix.003 file - promoters60/4915163
ctataaaaaccaa

SEQ ID NO: 61598 - DNA, 9 bp, Unknown
  misc_feature (1)..( 9): Matrix.003 file - promoters60/4915163
cataattat

SEQ ID NO: 61599 - DNA, 11 bp, Unknown
  misc_feature (1)..( 11): Matrix.003 file - promoters60/4915163
ctataaatatc

SEQ ID NO: 61600 - DNA, 7 bp, Unknown
  misc_feature (1)..( 7): Matrix.003 file - promoters60/4915199
tgtgttg

SEQ ID NO: 61601 - DNA, 7 bp, Unknown
  misc_feature (1)..( 7): Matrix.003 file - promoters60/4915199
ttgcttc

SEQ ID NO: 61602 - DNA, 8 bp, Unknown
  misc_feature (1)..( 8): Matrix.003 file - promoters60/4915199
accaaaaa

SEQ ID NO: 61603 - DNA, 7 bp, Unknown
  misc_feature (1)..( 7): Matrix.003 file - promoters60/4915199
ttttact

SEQ ID NO: 61604 - DNA, 6 bp, Unknown
  misc_feature (1)..( 6): Matrix.003 file - promoters60/4915199
aaagct

SEQ ID NO: 61605 - DNA, 6 bp, Unknown
  misc_feature (1)..( 6): Matrix.003 file - promoters60/4915199
gtttgt

SEQ ID NO: 61606 - DNA, 9 bp, Unknown
  misc_feature (1)..( 9): Matrix.003 file - promoters60/4915199
tgtctgtgt

SEQ ID NO: 61607 - DNA, 6 bp, Unknown
  misc_feature (1)..( 6): Matrix.003 file - promoters60/4915199
aaaaat

SEQ ID NO: 61608 - DNA, 10 bp, Unknown
  misc_feature (1)..( 10): Matrix.003 file - promoters60/4915199
gtttctctga

SEQ ID NO: 61609 - DNA, 8 bp, Unknown
  misc_feature (1)..( 8): Matrix.003 file - promoters60/4915199
atttagat

SEQ ID NO: 61610 - DNA, 8 bp, Unknown
  misc_feature (1)..( 8): Matrix.003 file - promoters60/4915199
aaaaatat

SEQ ID NO: 61611 - DNA, 8 bp, Unknown
  misc_feature (1)..( 8): Matrix.003 file - promoters60/4915199
acacaaat

SEQ ID NO: 61612 - DNA, 6 bp, Unknown
  misc_feature (1)..( 6): Matrix.003 file - promoters60/4915199
gataaa

SEQ ID NO: 61613 - DNA, 6 bp, Unknown
  misc_feature (1)..( 6): Matrix.003 file - promoters60/4915199
gttgtt

SEQ ID NO: 61614 - DNA, 7 bp, Unknown
  misc_feature (1)..( 7): Matrix.003 file - promoters60/4915199
aatcgta

SEQ ID NO: 61615 - DNA, 7 bp, Unknown
  misc_feature (1)..( 7): Matrix.003 file - promoters60/4915199
aaaataa

SEQ ID NO: 61616 - DNA, 7 bp, Unknown
  misc_feature (1)..( 7): Matrix.003 file - promoters60/4915199
attctca

SEQ ID NO: 61617 - DNA, 7 bp, Unknown
  misc_feature (1)..( 7): Matrix.003 file - promoters60/4915199
atcacaa

SEQ ID NO: 61618 - DNA, 6 bp, Unknown
  misc_feature (1)..( 6): Matrix.003 file - promoters60/4915199
aatcaa

SEQ ID NO: 61619 - DNA, 6 bp, Unknown
  misc_feature (1)..( 6): Matrix.003 file - promoters60/4915199
tttctt

SEQ ID NO: 61620 - DNA, 9 bp, Unknown
  misc_feature (1)..( 9): Matrix.003 file - promoters60/4915199
tcactgttt

SEQ ID NO: 61621 - DNA, 8 bp, Unknown
  misc_feature (1)..( 8): Matrix.003 file - promoters60/4915199
acaccaat

SEQ ID NO: 61622 - DNA, 7 bp, Unknown
  misc_feature (1)..( 7): Matrix.003 file - promoters60/4915199
ctggtga

SEQ ID NO: 61623 - DNA, 11 bp, Unknown
  misc_feature (1)..( 11): Matrix.003 file - promoters60/4915244
tttgattctat

SEQ ID NO: 61624 - DNA, 9 bp, Unknown
  misc_feature (1)..( 9): Matrix.003 file - promoters60/4915244
ttatattgt

SEQ ID NO: 61625 - DNA, 9 bp, Unknown
  misc_feature (1)..( 9): Matrix.003 file - promoters60/4915244
aaatataaa

SEQ ID NO: 61626 - DNA, 17 bp, Unknown
  misc_feature (1)..( 17): Matrix.003 file - promoters60/4915244
aaatataaaaatataaa

SEQ ID NO: 61627 - DNA, 9 bp, Unknown
  misc_feature (1)..( 9): Matrix.003 file - promoters60/4915244
ccaatattt

SEQ ID NO: 61628 - DNA, 9 bp, Unknown
  misc_feature (1)..( 9): Matrix.003 file - promoters60/4915244
tttttcaaa

SEQ ID NO: 61629 - DNA, 8 bp, Unknown
  misc_feature (1)..( 8): Matrix.003 file - promoters60/4915347
ttttttac

SEQ ID NO: 61630 - DNA, 7 bp, Unknown
  misc_feature (1)..( 7): Matrix.003 file - promoters60/4915347
catatat

SEQ ID NO: 61631 - DNA, 6 bp, Unknown
  misc_feature (1)..( 6): Matrix.003 file - promoters60/4915347
ttatat

SEQ ID NO: 61632 - DNA, 7 bp, Unknown
  misc_feature (1)..( 7): Matrix.003 file - promoters60/4915347
acaatca

SEQ ID NO: 61633 - DNA, 7 bp, Unknown
  misc_feature (1)..( 7): Matrix.003 file - promoters60/4915347
tgaaaac

SEQ ID NO: 61634 - DNA, 6 bp, Unknown
  misc_feature (1)..( 6): Matrix.003 file - promoters60/4915347
tttttt

SEQ ID NO: 61635 - DNA, 7 bp, Unknown
  misc_feature (1)..( 7): Matrix.003 file - promoters60/4915347
gttttaa

SEQ ID NO: 61636 - DNA, 7 bp, Unknown
  misc_feature (1)..( 7): Matrix.003 file - promoters60/4915347
ctctctc

SEQ ID NO: 61637 - DNA, 7 bp, Unknown
  misc_feature (1)..( 7): Matrix.003 file - promoters60/4915347
attggta

SEQ ID NO: 61638 - DNA, 8 bp, Unknown
  misc_feature (1)..( 8): Matrix.003 file - promoters60/4915347
aatcatat

SEQ ID NO: 61639 - DNA, 7 bp, Unknown
  misc_feature (1)..( 7): Matrix.003 file - promoters60/4915347
tcctttt

SEQ ID NO: 61640 - DNA, 7 bp, Unknown
  misc_feature (1)..( 7): Matrix.003 file - promoters60/4915347
aaacaca

SEQ ID NO: 61641 - DNA, 6 bp, Unknown
  misc_feature (1)..( 6): Matrix.003 file - promoters60/4915347
taataa

SEQ ID NO: 61642 - DNA, 9 bp, Unknown
  misc_feature (1)..( 9): Matrix.003 file - promoters60/4915347
attttttta

SEQ ID NO: 61643 - DNA, 7 bp, Unknown
  misc_feature (1)..( 7): Matrix.003 file - promoters60/4915347
gtgggaa

SEQ ID NO: 61644 - DNA, 6 bp, Unknown
  misc_feature (1)..( 6): Matrix.003 file - promoters60/4915347
tactgt

SEQ ID NO: 61645 - DNA, 9 bp, Unknown
  misc_feature (1)..( 9): Matrix.003 file - promoters60/4915347
tcaaaattt

SEQ ID NO: 61646 - DNA, 6 bp, Unknown
  misc_feature (1)..( 6): Matrix.003 file - promoters60/4915347
ttgaaa

SEQ ID NO: 61647 - DNA, 7 bp, Unknown
  misc_feature (1)..( 7): Matrix.003 file - promoters60/4915347
cttctcc

SEQ ID NO: 61648 - DNA, 7 bp, Unknown
  misc_feature (1)..( 7): Matrix.003 file - promoters60/4915347
ttcatgt

SEQ ID NO: 61649 - DNA, 7 bp, Unknown
  misc_feature (1)..( 7): Matrix.003 file - promoters60/4915347
aagattt

SEQ ID NO: 61650 - DNA, 7 bp, Unknown
  misc_feature (1)..( 7): Matrix.003 file - promoters60/4915347
tacctca

SEQ ID NO: 61651 - DNA, 7 bp, Unknown
  misc_feature (1)..( 7): Matrix.003 file - promoters60/4915347
tttgata

SEQ ID NO: 61652 - DNA, 9 bp, Unknown
  misc_feature (1)..( 9): Matrix.003 file - promoters60/4915347
catcattat

SEQ ID NO: 61653 - DNA, 10 bp, Unknown
  misc_feature (1)..( 10): Matrix.003 file - promoters60/4915384
tttcaataac

SEQ ID NO: 61654 - DNA, 7 bp, Unknown
  misc_feature (1)..( 7): Matrix.003 file - promoters60/4915384
ttttaat

SEQ ID NO: 61655 - DNA, 10 bp, Unknown
  misc_feature (1)..( 10): Matrix.003 file - promoters60/4915384
ggtttatttt

SEQ ID NO: 61656 - DNA, 8 bp, Unknown
  misc_feature (1)..( 8): Matrix.003 file - promoters60/4915384
gaaaagta

SEQ ID NO: 61657 - DNA, 8 bp, Unknown
  misc_feature (1)..( 8): Matrix.003 file - promoters60/4915384
tcaaattg

SEQ ID NO: 61658 - DNA, 8 bp, Unknown
  misc_feature (1)..( 8): Matrix.003 file - promoters60/4915384
aaatttgt

SEQ ID NO: 61659 - DNA, 8 bp, Unknown
  misc_feature (1)..( 8): Matrix.003 file - promoters60/4915384
ttaagaga

SEQ ID NO: 61660 - DNA, 10 bp, Unknown
  misc_feature (1)..( 10): Matrix.003 file - promoters60/4915384
attttatttt

SEQ ID NO: 61661 - DNA, 11 bp, Unknown
  misc_feature (1)..( 11): Matrix.003 file - promoters60/4915409
atagttcaaac

SEQ ID NO: 61662 - DNA, 7 bp, Unknown
  misc_feature (1)..( 7): Matrix.003 file - promoters60/4915409
ttataga

SEQ ID NO: 61663 - DNA, 12 bp, Unknown
  misc_feature (1)..( 12): Matrix.003 file - promoters60/4915420
ataaaaatacta

SEQ ID NO: 61664 - DNA, 6 bp, Unknown
  misc_feature (1)..( 6): Matrix.003 file - promoters60/4915420
tattat

SEQ ID NO: 61665 - DNA, 13 bp, Unknown
  misc_feature (1)..( 13): Matrix.003 file - promoters60/4915420
aaacaatttacaa

SEQ ID NO: 61666 - DNA, 8 bp, Unknown
  misc_feature (1)..( 8): Matrix.003 file - promoters60/4915420
tttagatc

SEQ ID NO: 61667 - DNA, 12 bp, Unknown
  misc_feature (1)..( 12): Matrix.003 file - promoters60/4915420
gagattttatat

SEQ ID NO: 61668 - DNA, 10 bp, Unknown
  misc_feature (1)..( 10): Matrix.003 file - promoters60/4915420
tatttataaa

SEQ ID NO: 61669 - DNA, 9 bp, Unknown
  misc_feature (1)..( 9): Matrix.003 file - promoters60/4915606
taatggtta

SEQ ID NO: 61670 - DNA, 11 bp, Unknown
  misc_feature (1)..( 11): Matrix.003 file - promoters60/4915606
tcagataaaaa

SEQ ID NO: 61671 - DNA, 7 bp, Unknown
  misc_feature (1)..( 7): Matrix.003 file - promoters60/4915606
attttat

SEQ ID NO: 61672 - DNA, 9 bp, Unknown
  misc_feature (1)..( 9): Matrix.003 file - promoters60/4915623
tcatatctg

SEQ ID NO: 61673 - DNA, 8 bp, Unknown
  misc_feature (1)..( 8): Matrix.003 file - promoters60/4915623
tttaaatt

SEQ ID NO: 61674 - DNA, 9 bp, Unknown
  misc_feature (1)..( 9): Matrix.003 file - promoters60/4915623
aatttattt

SEQ ID NO: 61675 - DNA, 9 bp, Unknown
  misc_feature (1)..( 9): Matrix.003 file - promoters60/4915623
ttacattag

SEQ ID NO: 61676 - DNA, 8 bp, Unknown
  misc_feature (1)..( 8): Matrix.003 file - promoters60/4915623
ttatgatc

SEQ ID NO: 61677 - DNA, 7 bp, Unknown
  misc_feature (1)..( 7): Matrix.003 file - promoters60/4915623
aaacact

SEQ ID NO: 61678 - DNA, 6 bp, Unknown
  misc_feature (1)..( 6): Matrix.003 file - promoters60/4915623
caaata

SEQ ID NO: 61679 - DNA, 6 bp, Unknown
  misc_feature (1)..( 6): Matrix.003 file - promoters60/4915694
ctactt

SEQ ID NO: 61680 - DNA, 6 bp, Unknown
  misc_feature (1)..( 6): Matrix.003 file - promoters60/4915694
tttcaa

SEQ ID NO: 61681 - DNA, 7 bp, Unknown
  misc_feature (1)..( 7): Matrix.003 file - promoters60/4915694
attattt

SEQ ID NO: 61682 - DNA, 7 bp, Unknown
  misc_feature (1)..( 7): Matrix.003 file - promoters60/4915694
atttaaa

SEQ ID NO: 61683 - DNA, 6 bp, Unknown
  misc_feature (1)..( 6): Matrix.003 file - promoters60/4915694
ccaaag

SEQ ID NO: 61684 - DNA, 8 bp, Unknown
  misc_feature (1)..( 8): Matrix.003 file - promoters60/4915694
aaatcttg

SEQ ID NO: 61685 - DNA, 8 bp, Unknown
  misc_feature (1)..( 8): Matrix.003 file - promoters60/4915694
tttaacgt

SEQ ID NO: 61686 - DNA, 6 bp, Unknown
  misc_feature (1)..( 6): Matrix.003 file - promoters60/4915694
tattta

SEQ ID NO: 61687 - DNA, 6 bp, Unknown
  misc_feature (1)..( 6): Matrix.003 file - promoters60/4915694
tcaata

SEQ ID NO: 61688 - DNA, 6 bp, Unknown
  misc_feature (1)..( 6): Matrix.003 file - promoters60/4915694
aacaaa

SEQ ID NO: 61689 - DNA, 8 bp, Unknown
  misc_feature (1)..( 8): Matrix.003 file - promoters60/4915694
aaaaacaa

SEQ ID NO: 61690 - DNA, 8 bp, Unknown
  misc_feature (1)..( 8): Matrix.003 file - promoters60/4915694
ctacaaaa

SEQ ID NO: 61691 - DNA, 8 bp, Unknown
  misc_feature (1)..( 8): Matrix.003 file - promoters60/4915694
ctaaattc

SEQ ID NO: 61692 - DNA, 8 bp, Unknown
  misc_feature (1)..( 8): Matrix.003 file - promoters60/4915694
gattcaaa

SEQ ID NO: 61693 - DNA, 7 bp, Unknown
  misc_feature (1)..( 7): Matrix.003 file - promoters60/4915694
tttacaa

SEQ ID NO: 61694 - DNA, 6 bp, Unknown
  misc_feature (1)..( 6): Matrix.003 file - promoters60/4915694
gttttg

SEQ ID NO: 61695 - DNA, 7 bp, Unknown
  misc_feature (1)..( 7): Matrix.003 file - promoters60/4915694
aaagaaa

SEQ ID NO: 61696 - DNA, 7 bp, Unknown
  misc_feature (1)..( 7): Matrix.003 file - promoters60/4915694
cacattt

SEQ ID NO: 61697 - DNA, 8 bp, Unknown
  misc_feature (1)..( 8): Matrix.003 file - promoters60/4915694
taacaatt

SEQ ID NO: 61698 - DNA, 6 bp, Unknown
  misc_feature (1)..( 6): Matrix.003 file - promoters60/4915694
acaaaa

SEQ ID NO: 61699 - DNA, 8 bp, Unknown
  misc_feature (1)..( 8): Matrix.003 file - promoters60/4915816
atttcttt

SEQ ID NO: 61700 - DNA, 8 bp, Unknown
  misc_feature (1)..( 8): Matrix.003 file - promoters60/4915816
atgaattg

SEQ ID NO: 61701 - DNA, 6 bp, Unknown
  misc_feature (1)..( 6): Matrix.003 file - promoters60/4915816
acatga

SEQ ID NO: 61702 - DNA, 9 bp, Unknown
  misc_feature (1)..( 9): Matrix.003 file - promoters60/4915816
ggcaaggaa

SEQ ID NO: 61703 - DNA, 9 bp, Unknown
  misc_feature (1)..( 9): Matrix.003 file - promoters60/4915816
agaaacata

SEQ ID NO: 61704 - DNA, 6 bp, Unknown
  misc_feature (1)..( 6): Matrix.003 file - promoters60/4915816
aggaag

SEQ ID NO: 61705 - DNA, 7 bp, Unknown
  misc_feature (1)..( 7): Matrix.003 file - promoters60/4915816
ataaacc

SEQ ID NO: 61706 - DNA, 8 bp, Unknown
  misc_feature (1)..( 8): Matrix.003 file - promoters60/4915816
taaagatt

SEQ ID NO: 61707 - DNA, 6 bp, Unknown
  misc_feature (1)..( 6): Matrix.003 file - promoters60/4915816
attggg

SEQ ID NO: 61708 - DNA, 6 bp, Unknown
  misc_feature (1)..( 6): Matrix.003 file - promoters60/4915816
ccattt

SEQ ID NO: 61709 - DNA, 7 bp, Unknown
  misc_feature (1)..( 7): Matrix.003 file - promoters60/4915816
aatggcg

SEQ ID NO: 61710 - DNA, 7 bp, Unknown
  misc_feature (1)..( 7): Matrix.003 file - promoters60/4915816
agattgg

SEQ ID NO: 61711 - DNA, 7 bp, Unknown
  misc_feature (1)..( 7): Matrix.003 file - promoters60/4915816
ttttctt

SEQ ID NO: 61712 - DNA, 6 bp, Unknown
  misc_feature (1)..( 6): Matrix.003 file - promoters60/4915816
aatgga

SEQ ID NO: 61713 - DNA, 6 bp, Unknown
  misc_feature (1)..( 6): Matrix.003 file - promoters60/4915816
aatatt

SEQ ID NO: 61714 - DNA, 8 bp, Unknown
  misc_feature (1)..( 8): Matrix.003 file - promoters60/4915816
gaaattag

SEQ ID NO: 61715 - DNA, 6 bp, Unknown
  misc_feature (1)..( 6): Matrix.003 file - promoters60/4915816
aaaaat

SEQ ID NO: 61716 - DNA, 6 bp, Unknown
  misc_feature (1)..( 6): Matrix.003 file - promoters60/4915816
aaatag

SEQ ID NO: 61717 - DNA, 6 bp, Unknown
  misc_feature (1)..( 6): Matrix.003 file - promoters60/4915816
atttta

SEQ ID NO: 61718 - DNA, 12 bp, Unknown
  misc_feature (1)..( 12): Matrix.003 file - promoters60/4915819
aaataaaacatt

SEQ ID NO: 61719 - DNA, 9 bp, Unknown
  misc_feature (1)..( 9): Matrix.003 file - promoters60/4915819
aaaccaaac

SEQ ID NO: 61720 - DNA, 8 bp, Unknown
  misc_feature (1)..( 8): Matrix.003 file - promoters60/4915819
aataaaag

SEQ ID NO: 61721 - DNA, 10 bp, Unknown
  misc_feature (1)..( 10): Matrix.003 file - promoters60/4921122
aaatacaata

SEQ ID NO: 61722 - DNA, 8 bp, Unknown
  misc_feature (1)..( 8): Matrix.003 file - promoters60/4921122
cacaaggc

SEQ ID NO: 61723 - DNA, 6 bp, Unknown
  misc_feature (1)..( 6): Matrix.003 file - promoters60/4921291
acattt

SEQ ID NO: 61724 - DNA, 11 bp, Unknown
  misc_feature (1)..( 11): Matrix.003 file - promoters60/4921291
tccgttatgtc

SEQ ID NO: 61725 - DNA, 7 bp, Unknown
  misc_feature (1)..( 7): Matrix.003 file - promoters60/4921291
acaataa

SEQ ID NO: 61726 - DNA, 7 bp, Unknown
  misc_feature (1)..( 7): Matrix.003 file - promoters60/4921291
aatgtag

SEQ ID NO: 61727 - DNA, 6 bp, Unknown
  misc_feature (1)..( 6): Matrix.003 file - promoters60/4921291
tctgaa

SEQ ID NO: 61728 - DNA, 7 bp, Unknown
  misc_feature (1)..( 7): Matrix.003 file - promoters60/4921291
ataatta

SEQ ID NO: 61729 - DNA, 7 bp, Unknown
  misc_feature (1)..( 7): Matrix.003 file - promoters60/4921291
caaaatt

SEQ ID NO: 61730 - DNA, 7 bp, Unknown
  misc_feature (1)..( 7): Matrix.003 file - promoters60/4921291
ttcataa

SEQ ID NO: 61731 - DNA, 8 bp, Unknown
  misc_feature (1)..( 8): Matrix.003 file - promoters60/4921291
ttttactt

SEQ ID NO: 61732 - DNA, 7 bp, Unknown
  misc_feature (1)..( 7): Matrix.003 file - promoters60/4921291
acgaact

SEQ ID NO: 61733 - DNA, 7 bp, Unknown
  misc_feature (1)..( 7): Matrix.003 file - promoters60/4921291
tatctcg

SEQ ID NO: 61734 - DNA, 8 bp, Unknown
  misc_feature (1)..( 8): Matrix.003 file - promoters60/4921291
atttgcac

SEQ ID NO: 61735 - DNA, 7 bp, Unknown
  misc_feature (1)..( 7): Matrix.003 file - promoters60/4921291
ttaatat

SEQ ID NO: 61736 - DNA, 6 bp, Unknown
  misc_feature (1)..( 6): Matrix.003 file - promoters60/4921291
aatata

SEQ ID NO: 61737 - DNA, 7 bp, Unknown
  misc_feature (1)..( 7): Matrix.003 file - promoters60/4921291
tgactaa

SEQ ID NO: 61738 - DNA, 6 bp, Unknown
  misc_feature (1)..( 6): Matrix.003 file - promoters60/4921291
atttat

SEQ ID NO: 61739 - DNA, 7 bp, Unknown
  misc_feature (1)..( 7): Matrix.003 file - promoters60/4921291
tttattt

SEQ ID NO: 61740 - DNA, 8 bp, Unknown
  misc_feature (1)..( 8): Matrix.003 file - promoters60/4921291
taaatata

SEQ ID NO: 61741 - DNA, 7 bp, Unknown
  misc_feature (1)..( 7): Matrix.003 file - promoters60/4921373
atgatta

SEQ ID NO: 61742 - DNA, 6 bp, Unknown
  misc_feature (1)..( 6): Matrix.003 file - promoters60/4921373
attaca

SEQ ID NO: 61743 - DNA, 7 bp, Unknown
  misc_feature (1)..( 7): Matrix.003 file - promoters60/4921373
aattata

SEQ ID NO: 61744 - DNA, 8 bp, Unknown
  misc_feature (1)..( 8): Matrix.003 file - promoters60/4921373
aaagatta

SEQ ID NO: 61745 - DNA, 7 bp, Unknown
  misc_feature (1)..( 7): Matrix.003 file - promoters60/4921373
aaaagtg

SEQ ID NO: 61746 - DNA, 7 bp, Unknown
  misc_feature (1)..( 7): Matrix.003 file - promoters60/4921373
tttcatt

SEQ ID NO: 61747 - DNA, 6 bp, Unknown
  misc_feature (1)..( 6): Matrix.003 file - promoters60/4921373
ttcaaa

SEQ ID NO: 61748 - DNA, 9 bp, Unknown
  misc_feature (1)..( 9): Matrix.003 file - promoters60/4921373
ctataaata

SEQ ID NO: 61749 - DNA, 6 bp, Unknown
  misc_feature (1)..( 6): Matrix.003 file - promoters60/4921373
agtata

SEQ ID NO: 61750 - DNA, 8 bp, Unknown
  misc_feature (1)..( 8): Matrix.003 file - promoters60/4921373
agttaatt

SEQ ID NO: 61751 - DNA, 6 bp, Unknown
  misc_feature (1)..( 6): Matrix.003 file - promoters60/4921373
taaaag

SEQ ID NO: 61752 - DNA, 8 bp, Unknown
  misc_feature (1)..( 8): Matrix.003 file - promoters60/4921373
atgaattt

SEQ ID NO: 61753 - DNA, 7 bp, Unknown
  misc_feature (1)..( 7): Matrix.003 file - promoters60/4921373
tttatgt

SEQ ID NO: 61754 - DNA, 6 bp, Unknown
  misc_feature (1)..( 6): Matrix.003 file - promoters60/4921373
tatatt

SEQ ID NO: 61755 - DNA, 6 bp, Unknown
  misc_feature (1)..( 6): Matrix.003 file - promoters60/4921373
tctaaa

SEQ ID NO: 61756 - DNA, 10 bp, Unknown
  misc_feature (1)..( 10): Matrix.003 file - promoters60/4921381
aaaaattgaa

SEQ ID NO: 61757 - DNA, 8 bp, Unknown
  misc_feature (1)..( 8): Matrix.003 file - promoters60/4921433
cagatttt

SEQ ID NO: 61758 - DNA, 9 bp, Unknown
  misc_feature (1)..( 9): Matrix.003 file - promoters60/4921433
gaatttaaa

SEQ ID NO: 61759 - DNA, 8 bp, Unknown
  misc_feature (1)..( 8): Matrix.003 file - promoters60/4921433
tatgaata

SEQ ID NO: 61760 - DNA, 12 bp, Unknown
  misc_feature (1)..( 12): Matrix.003 file - promoters60/4921433
ggtcaaaaaaaa

SEQ ID NO: 61761 - DNA, 8 bp, Unknown
  misc_feature (1)..( 8): Matrix.003 file - promoters60/4934904
gagctctc

SEQ ID NO: 61762 - DNA, 8 bp, Unknown
  misc_feature (1)..( 8): Matrix.003 file - promoters60/4934904
acatctca

SEQ ID NO: 61763 - DNA, 12 bp, Unknown
  misc_feature (1)..( 12): Matrix.003 file - promoters60/4934904
tctgggaaatcg

SEQ ID NO: 61764 - DNA, 6 bp, Unknown
  misc_feature (1)..( 6): Matrix.003 file - promoters60/4934904
tttcaa

SEQ ID NO: 61765 - DNA, 6 bp, Unknown
  misc_feature (1)..( 6): Matrix.003 file - promoters60/4934904
ggaaat

SEQ ID NO: 61766 - DNA, 9 bp, Unknown
  misc_feature (1)..( 9): Matrix.003 file - promoters60/4938731
aattaaaac

SEQ ID NO: 61767 - DNA, 10 bp, Unknown
  misc_feature (1)..( 10): Matrix.003 file - promoters60/4938731
ttataaaaaa

SEQ ID NO: 61768 - DNA, 11 bp, Unknown
  misc_feature (1)..( 11): Matrix.003 file - promoters60/4938731
acatatttcta

SEQ ID NO: 61769 - DNA, 11 bp, Unknown
  misc_feature (1)..( 11): Matrix.003 file - promoters60/4938731
cgatttatctt

SEQ ID NO: 61770 - DNA, 6 bp, Unknown
  misc_feature (1)..( 6): Matrix.003 file - promoters60/4943425
taaaag

SEQ ID NO: 61771 - DNA, 8 bp, Unknown
  misc_feature (1)..( 8): Matrix.003 file - promoters60/4943425
ctgtaaaa

SEQ ID NO: 61772 - DNA, 6 bp, Unknown
  misc_feature (1)..( 6): Matrix.003 file - promoters60/4943425
ggtggt

SEQ ID NO: 61773 - DNA, 6 bp, Unknown
  misc_feature (1)..( 6): Matrix.003 file - promoters60/4943425
ttgagt

SEQ ID NO: 61774 - DNA, 7 bp, Unknown
  misc_feature (1)..( 7): Matrix.003 file - promoters60/4943425
tttgatt

SEQ ID NO: 61775 - DNA, 6 bp, Unknown
  misc_feature (1)..( 6): Matrix.003 file - promoters60/4943425
tcaaaa

SEQ ID NO: 61776 - DNA, 8 bp, Unknown
  misc_feature (1)..( 8): Matrix.003 file - promoters60/4943425
ctctcgtt

SEQ ID NO: 61777 - DNA, 7 bp, Unknown
  misc_feature (1)..( 7): Matrix.003 file - promoters60/4943425
atgataa

SEQ ID NO: 61778 - DNA, 7 bp, Unknown
  misc_feature (1)..( 7): Matrix.003 file - promoters60/4943425
aacctgt

SEQ ID NO: 61779 - DNA, 8 bp, Unknown
  misc_feature (1)..( 8): Matrix.003 file - promoters60/4943425
ttgcatat

SEQ ID NO: 61780 - DNA, 8 bp, Unknown
  misc_feature (1)..( 8): Matrix.003 file - promoters60/4943425
tgttatgc

SEQ ID NO: 61781 - DNA, 7 bp, Unknown
  misc_feature (1)..( 7): Matrix.003 file - promoters60/4943425
ttgctaa

SEQ ID NO: 61782 - DNA, 6 bp, Unknown
  misc_feature (1)..( 6): Matrix.003 file - promoters60/4943425
ttcctt

SEQ ID NO: 61783 - DNA, 6 bp, Unknown
  misc_feature (1)..( 6): Matrix.003 file - promoters60/4943425
aagaga

SEQ ID NO: 61784 - DNA, 7 bp, Unknown
  misc_feature (1)..( 7): Matrix.003 file - promoters60/4943425
aagaaag

SEQ ID NO: 61785 - DNA, 12 bp, Unknown
  misc_feature (1)..( 12): Matrix.003 file - promoters60/4943637
ttggtttaaaaa

SEQ ID NO: 61786 - DNA, 8 bp, Unknown
  misc_feature (1)..( 8): Matrix.003 file - promoters60/4943637
tgagaaag

SEQ ID NO: 61787 - DNA, 12 bp, Unknown
  misc_feature (1)..( 12): Matrix.003 file - promoters60/4943637
ttagtttggtct

SEQ ID NO: 61788 - DNA, 7 bp, Unknown
  misc_feature (1)..( 7): Matrix.003 file - promoters60/4943637
tattttt

SEQ ID NO: 61789 - DNA, 12 bp, Unknown
  misc_feature (1)..( 12): Matrix.003 file - promoters60/4943637
ttagtttgttct

SEQ ID NO: 61790 - DNA, 10 bp, Unknown
  misc_feature (1)..( 10): Matrix.003 file - promoters60/4943637
taaatttgct

SEQ ID NO: 61791 - DNA, 11 bp, Unknown
  misc_feature (1)..( 11): Matrix.003 file - promoters60/4949707
tttaaaaaatc

SEQ ID NO: 61792 - DNA, 11 bp, Unknown
  misc_feature (1)..( 11): Matrix.003 file - promoters60/4949707
taagaaaattc

SEQ ID NO: 61793 - DNA, 11 bp, Unknown
  misc_feature (1)..( 11): Matrix.003 file - promoters60/4952527
caatgaaacct

SEQ ID NO: 61794 - DNA, 6 bp, Unknown
  misc_feature (1)..( 6): Matrix.003 file - promoters60/4974495
ctaatt

SEQ ID NO: 61795 - DNA, 7 bp, Unknown
  misc_feature (1)..( 7): Matrix.003 file - promoters60/4974495
gaaacag

SEQ ID NO: 61796 - DNA, 6 bp, Unknown
  misc_feature (1)..( 6): Matrix.003 file - promoters60/4974495
aagaga

SEQ ID NO: 61797 - DNA, 6 bp, Unknown
  misc_feature (1)..( 6): Matrix.003 file - promoters60/4974495
atcata

SEQ ID NO: 61798 - DNA, 7 bp, Unknown
  misc_feature (1)..( 7): Matrix.003 file - promoters60/4974495
tgtgttt

SEQ ID NO: 61799 - DNA, 11 bp, Unknown
  misc_feature (1)..( 11): Matrix.003 file - promoters60/4974495
ttaggatgcag

SEQ ID NO: 61800 - DNA, 8 bp, Unknown
  misc_feature (1)..( 8): Matrix.003 file - promoters60/4974495
aatgcatg

SEQ ID NO: 61801 - DNA, 7 bp, Unknown
  misc_feature (1)..( 7): Matrix.003 file - promoters60/4974495
ttggttg

SEQ ID NO: 61802 - DNA, 6 bp, Unknown
  misc_feature (1)..( 6): Matrix.003 file - promoters60/4974495
gagatg

SEQ ID NO: 61803 - DNA, 7 bp, Unknown
  misc_feature (1)..( 7): Matrix.003 file - promoters60/4974495
ttaatta

SEQ ID NO: 61804 - DNA, 6 bp, Unknown
  misc_feature (1)..( 6): Matrix.003 file - promoters60/4974495
agttca

SEQ ID NO: 61805 - DNA, 7 bp, Unknown
  misc_feature (1)..( 7): Matrix.003 file - promoters60/4974495
ggaagaa

SEQ ID NO: 61806 - DNA, 7 bp, Unknown
  misc_feature (1)..( 7): Matrix.003 file - promoters60/4974495
aataaaa

SEQ ID NO: 61807 - DNA, 6 bp, Unknown
  misc_feature (1)..( 6): Matrix.003 file - promoters60/4974495
tgcaca

SEQ ID NO: 61808 - DNA, 10 bp, Unknown
  misc_feature (1)..( 10): Matrix.003 file - promoters60/4974495
tttatccaag

SEQ ID NO: 61809 - DNA, 12 bp, Unknown
  misc_feature (1)..( 12): Matrix.003 file - promoters60/4978201
ataatttaaatg

SEQ ID NO: 61810 - DNA, 10 bp, Unknown
  misc_feature (1)..( 10): Matrix.003 file - promoters60/4992383
ttttgatttg

SEQ ID NO: 61811 - DNA, 9 bp, Unknown
  misc_feature (1)..( 9): Matrix.003 file - promoters60/4992383
aatttattt

SEQ ID NO: 61812 - DNA, 11 bp, Unknown
  misc_feature (1)..( 11): Matrix.003 file - promoters60/4992383
tacgtaacatg

SEQ ID NO: 61813 - DNA, 12 bp, Unknown
  misc_feature (1)..( 12): Matrix.003 file - promoters60/4992383
aacttttaagta

SEQ ID NO: 61814 - DNA, 8 bp, Unknown
  misc_feature (1)..( 8): Matrix.003 file - promoters60/4992383
agtttcta

SEQ ID NO: 61815 - DNA, 8 bp, Unknown
  misc_feature (1)..( 8): Matrix.003 file - promoters60/4992383
tttagttt

SEQ ID NO: 61816 - DNA, 7 bp, Unknown
  misc_feature (1)..( 7): Matrix.003 file - promoters60/4992383
aatgttt

SEQ ID NO: 61817 - DNA, 7 bp, Unknown
  misc_feature (1)..( 7): Matrix.003 file - promoters60/4992383
actttta

SEQ ID NO: 61818 - DNA, 10 bp, Unknown
  misc_feature (1)..( 10): Matrix.003 file - promoters60/4992383
aaattgatat

SEQ ID NO: 61819 - DNA, 10 bp, Unknown
  misc_feature (1)..( 10): Matrix.003 file - promoters60/4992383
tttgtataaa

SEQ ID NO: 61820 - DNA, 8 bp, Unknown
  misc_feature (1)..( 8): Matrix.003 file - promoters60/4992383
cggtttgg

SEQ ID NO: 61821 - DNA, 8 bp, Unknown
  misc_feature (1)..( 8): Matrix.003 file - promoters60/4992383
tagctaaa

SEQ ID NO: 61822 - DNA, 9 bp, Unknown
  misc_feature (1)..( 9): Matrix.003 file - promoters60/4992383
tattaatat

SEQ ID NO: 61823 - DNA, 9 bp, Unknown
  misc_feature (1)..( 9): Matrix.003 file - promoters60/4992383
ttttagaaa

SEQ ID NO: 61824 - DNA, 11 bp, Unknown
  misc_feature (1)..( 11): Matrix.003 file - promoters60/4992383
tgttttgtttt

SEQ ID NO: 61825 - DNA, 12 bp, Unknown
  misc_feature (1)..( 12): Matrix.003 file - promoters60/4992383
ttttaactaaca

SEQ ID NO: 61826 - DNA, 8 bp, Unknown
  misc_feature (1)..( 8): Matrix.003 file - promoters60/5003710
agaggaat

SEQ ID NO: 61827 - DNA, 13 bp, Unknown
  misc_feature (1)..( 13): Matrix.003 file - promoters60/5003710
tattcaaaacata

SEQ ID NO: 61828 - DNA, 13 bp, Unknown
  misc_feature (1)..( 13): Matrix.003 file - promoters60/5003710
tattcaaaacata

SEQ ID NO: 61829 - DNA, 12 bp, Unknown
  misc_feature (1)..( 12): Matrix.003 file - promoters60/5003710
ttttcttattgt

SEQ ID NO: 61830 - DNA, 8 bp, Unknown
  misc_feature (1)..( 8): Matrix.003 file - promoters60/5003710
atacaaaa

SEQ ID NO: 61831 - DNA, 6 bp, Unknown
  misc_feature (1)..( 6): Matrix.003 file - promoters60/5003710
atcaca

SEQ ID NO: 61832 - DNA, 10 bp, Unknown
  misc_feature (1)..( 10): Matrix.003 file - promoters60/5003710
tactatttta

SEQ ID NO: 61833 - DNA, 7 bp, Unknown
  misc_feature (1)..( 7): Matrix.003 file - promoters60/5003710
caaaact

SEQ ID NO: 61834 - DNA, 10 bp, Unknown
  misc_feature (1)..( 10): Matrix.003 file - promoters60/5003710
atatattttc

SEQ ID NO: 61835 - DNA, 7 bp, Unknown
  misc_feature (1)..( 7): Matrix.003 file - promoters60/5003710
aaaatat

SEQ ID NO: 61836 - DNA, 9 bp, Unknown
  misc_feature (1)..( 9): Matrix.003 file - promoters60/5003710
aataataca

SEQ ID NO: 61837 - DNA, 7 bp, Unknown
  misc_feature (1)..( 7): Matrix.003 file - promoters60/5003710
aaaatat

SEQ ID NO: 61838 - DNA, 6 bp, Unknown
  misc_feature (1)..( 6): Matrix.003 file - promoters60/5003710
gtggaa

SEQ ID NO: 61839 - DNA, 7 bp, Unknown
  misc_feature (1)..( 7): Matrix.003 file - promoters60/5003710
tatccgt

SEQ ID NO: 61840 - DNA, 7 bp, Unknown
  misc_feature (1)..( 7): Matrix.003 file - promoters60/5003710
atcaaag

SEQ ID NO: 61841 - DNA, 7 bp, Unknown
  misc_feature (1)..( 7): Matrix.003 file - promoters60/5003710
tttccat

SEQ ID NO: 61842 - DNA, 6 bp, Unknown
  misc_feature (1)..( 6): Matrix.003 file - promoters60/5003710
tatatt

SEQ ID NO: 61843 - DNA, 7 bp, Unknown
  misc_feature (1)..( 7): Matrix.003 file - promoters60/5003710
acaaaac

SEQ ID NO: 61844 - DNA, 6 bp, Unknown
  misc_feature (1)..( 6): Matrix.003 file - promoters60/5003710
gaccta

SEQ ID NO: 61845 - DNA, 9 bp, Unknown
  misc_feature (1)..( 9): Matrix.003 file - promoters60/5003848
tcaagaaag

SEQ ID NO: 61846 - DNA, 6 bp, Unknown
  misc_feature (1)..( 6): Matrix.003 file - promoters60/5003848
attgtt

SEQ ID NO: 61847 - DNA, 8 bp, Unknown
  misc_feature (1)..( 8): Matrix.003 file - promoters60/5003848
ctaaattt

SEQ ID NO: 61848 - DNA, 7 bp, Unknown
  misc_feature (1)..( 7): Matrix.003 file - promoters60/5003848
tttggag

SEQ ID NO: 61849 - DNA, 7 bp, Unknown
  misc_feature (1)..( 7): Matrix.003 file - promoters60/5003848
gagtgta

SEQ ID NO: 61850 - DNA, 6 bp, Unknown
  misc_feature (1)..( 6): Matrix.003 file - promoters60/5003848
gaacca

SEQ ID NO: 61851 - DNA, 7 bp, Unknown
  misc_feature (1)..( 7): Matrix.003 file - promoters60/5003848
tagaaag

SEQ ID NO: 61852 - DNA, 7 bp, Unknown
  misc_feature (1)..( 7): Matrix.003 file - promoters60/5003848
gttctga

SEQ ID NO: 61853 - DNA, 6 bp, Unknown
  misc_feature (1)..( 6): Matrix.003 file - promoters60/5003848
tagtca

SEQ ID NO: 61854 - DNA, 8 bp, Unknown
  misc_feature (1)..( 8): Matrix.003 file - promoters60/5003848
tcaaaacc

SEQ ID NO: 61855 - DNA, 8 bp, Unknown
  misc_feature (1)..( 8): Matrix.003 file - promoters60/5003848
tttgtttt

SEQ ID NO: 61856 - DNA, 6 bp, Unknown
  misc_feature (1)..( 6): Matrix.003 file - promoters60/5003848
ctttga
